United States Patent 9,572,897 (MODIFIED POLYNUCLEOTIDES FOR THE PRODUCTION OF CYTOPLASMIC AND CYTOSKELETAL PROTEINS) - sequence listing, part 12

SEQ ID NO: 21466 - DNA, 978 bp, Artificial Sequence
  Description of Artificial Sequence: Synthetic coding sequence
atgcagcagcctgtgcgggccggggacatcggcgtgtcccgggtgcagacccaccacaatgccagccccttctctgtgcccaagaagcaggatgagagccccatgattggagatggagaggactacttcctgagcctgtttggagacagcaagaagctgacagcccacagcaactacacccagaagaccctgaagtacttctccatgatcctggaggaggtgggccagttcaccagcagcagcctgggagatgtggagattgctgaggtgaatgtgaagggcctgtttgtgaagctgatcaacagcagcctggacaaggagatggccatcggggaccacatcctgcagcagaatgtgaatggccagaccatcagcctgtaccgcttcctgcccaacatcgtgatgcaggccaacagcacagtgacagtgtgggccgccgccagcgaggccaagcaccagccccccagcgacttcctgtggaaggagcaggacaagttccgggccagcccagactgcatcaccatcctgtgcaagcccaacggccaggccatcgcctggtacacccccatccactggaagcaggcctgggagaagctggatgctgatgtggagttcaaccgctgcagcgtggtgagccccaccttcaggaagagggtcttccagtggacagccagcacagccaccatcaccaaggagaagcaggaccagcccaagaaggacatcagcaactaccaggtggagcaggcccaggtgctgctgaagcgggagaaggagatcccccccaccgtcttccccaacagaagcccctggtgccagaacccctacgtgtctgcccacccctactgccccctgattgagccccacaacaccagcacagctgggggccgcctggaccggcagcccaggaccaggagcacccggcccaacagagccagcggcagcaagaagaagaagaccagcgagagccagaagcagtag

SEQ ID NO: 21467 - DNA, 1257 bp, Artificial Sequence
  Description of Artificial Sequence: Synthetic coding sequence
atgagggagatcgtgcacatccaggccggccagtgtggcaaccagatcggcaccaagttctgggaggtgatcagtgatgagcacggcatcgaccctgctgggggctacgtgggggacagcgccctgcagctggagcgcatcaacgtgtactacaatgaaagcagcagccagaagtatgtgcccagggctgccctggtggacctggagcccggcaccatggattctgtgcgcagcggccccttcggccagctgttccggccagacaacttcatcttcggccagacaggagctggcaacaactgcctgcagggcttccagctgacccacagcctgggcggcggcactggaagtggcatgggcaccctgctgatcagcaagatccgggaggagttcccagaccgcatcatgaacaccttctctgtgatgcccagccccaaggtgtctgacacagtggtggagccctacaatgccaccctgtctgtgcaccagctggtggagaacacagatgagacctactgcatcgacaatgaggccctgtatgacatctgcttccgcaccctgaagctgaccacccccacctacggggacctgaaccacctggtgtctgccaccatgtctggagtgaccaccagcctgcgcttccctggccagctgaatgctgacctgaggaagctggccgtgaacatggtgcccttcccccggctgcacttcttcatgcctggctttgcccccctgaccagccggggcagccagcagtaccgggccctgactgtgcctgagctgacccagcagatgtttgatgccaggaacatgatggccgcctgtgaccccaggcatggccgctacctgactgtggccaccgtcttccggggccccatgtccatgaaggaggtggatgagcagatgctggccatccagagcaagaacagcagctactttgtggagtggatccccaacaacgtgaaggtggccgtgtgtgacatccccccccggggcctgaagatggccagcaccttcatcggcaacagcacagccatccaggagctgttcaagaggatcagcgagcagttcagcgccatgttccggaggaaggccttcctgcactggttcaccggggagggcatggatgagatggagttcacagaagctgagagcaacatgaatgacctggtgtctgagtaccagcagtaccaggatgccacagccaatgatggagaggaggcctttgaagatgaggaggaggagattgatggatag

SEQ ID NO: 21468 - DNA, 270 bp, Artificial Sequence
  Description of Artificial Sequence: Synthetic coding sequence
atggatgtgctgagccccctgtccttcatcaaggtgagccacgtgaggatgcagggcatcctgctgctggtgtttgccaagtaccagcacctgccctacatccagatcctgagcaccaagagcacccccaccggcctgtttggctactggggcaacaagggcggcgtgaacatctgcctgaagctgtatggctactacgtgtccatcatcaactgccacctgcccccccacatcagcaacaactaccagaggctggagcactttgattag

SEQ ID NO: 21469 - DNA, 180 bp, Artificial Sequence; identical to SEQ ID NO: 18361
  Description of Artificial Sequence: Synthetic coding sequence

SEQ ID NO: 21470 - DNA, 864 bp, Artificial Sequence
  Description of Artificial Sequence: Synthetic coding sequence
atggatgaaacagagatcggcagctgcttcggccgctatggctctgtgaaggaggtgaagatcatcaccaacagaactggagtgtccaagggctacggctttgtgtcctttgtgaatgatgtggatgtgcagaagatcgtgggcagccagatccacttccacggcaagaagctgaagctgggccctgccatcaggaagcagaagctgtgtgcccggcacgtgcagccccggcccctggtggtgaaccccccacctccaccccagttccagaatgtgtggaggaaccccaacacagagacctacctgcagccccagatcacccccaaccctgtgacccagcacgtgcaggcctacagcgcctacccccacagccctggccaggtgatcaccggctgccagctgctggtgtacaactaccaggagtaccccacctacccagacagcgccttccaggtgaccaccggctaccagctgcctgtgtacaactaccagcccttccctgcctaccccaggagccccttccaggtgacagctggctaccagctgcctgtgtacaactaccaggccttccctgcctaccccaacagccccttccaggtggccaccggctaccagtttcctgtgtacaactaccagcccttccctgcctaccccagcagccccttccaggtgacagctggctaccagctgcctgtgtacaactaccaggccttccctgcctaccccaacagccccttccaggtggccaccggctaccagtttcctgtgtacaactaccaggccttccctgcctaccccaacagccctgtgcaggtgaccaccggctaccagctgcctgtgtacaactaccagaagttcccctag

SEQ ID NO: 21471 - DNA, 1344 bp, Artificial Sequence; identical to SEQ ID NO: 18737
  Description of Artificial Sequence: Synthetic coding sequence

SEQ ID NO: 21472 - DNA, 474 bp, Artificial Sequence
  Description of Artificial Sequence: Synthetic coding sequence
atggccaacattgctgtgcagaggatcaagcgggagttcaaggaggtgctgaagtctgaggagaccagcaagaaccagatcaaggtggacctggtggatgagaacttcacagagctgcggggggagattgctggccccccagacaccccctatgaaggaggccgctaccagctggagatcaagatccctgagacctaccccttcaacccccccaaggtgcgcttcatcaccaagatctggcaccccaacatcagctctgtgactggagccatctgcctggacatcctgaaggaccagtgggccgccgccatgaccctgaggacagtgctgctgagcctgcaggccctgctggccgctgctgagccagatgacccccaggatgctgtggtggccaaccagaatgctgtgattgtggccctgagcagcaagtcctgggatgtggagacagccacagagctgctgctgagcaactag

SEQ ID NO: 21473 - DNA, 582 bp, Artificial Sequence; identical to SEQ ID NO: 18345
  Description of Artificial Sequence: Synthetic coding sequence

SEQ ID NO: 21474 - DNA, 1188 bp, Artificial Sequence; identical to SEQ ID NO: 20054
  Description of Artificial Sequence: Synthetic coding sequence

SEQ ID NO: 21475 - DNA, 624 bp, Artificial Sequence
  Description of Artificial Sequence: Synthetic coding sequence
atgacagaggacagccagaggaacttccgctctgtgtactatgagaaggtgggcttccggggcgtggaggagaagaagagcctggagatcctgctgaaggatgaccggctgggcatcctgcccccccaccacgagagccacgccaaggtgatgatgtacaggaaggagcagtacctggatgtgctgcacgccctgaaggtggtgcgctttgtgtctgatgccaccccccaggccgaggtgtacctgaggatgtaccagctggagagcggcaagctgcccaggagccccagcttccccctggagccagatgatgaggtgttcctggccatcgccaaggccatggaggagatggtggaggacagcgtggactgctactggatcaccaggagatttgtgaaccagctgaacaccaagtacagagacagcctgccccagctgcccaaggcctttgagcagtacctgaacctggaggatggccgcctgctgacccacctgaggatgtgcagcgctgcccccaagctgccctatgacctgtggttcaagcgctgctttgctggctgcctgcctgagagcagcctgcagagggtgtgggacaaggtggtgtctggcagctgcaagatctag

SEQ ID NO: 21476 - DNA, 1404 bp, Artificial Sequence
  Description of Artificial Sequence: Synthetic coding sequence
atggccagcctgctgcagagcgacagagtgctgtacctggtgcagggcgagaagaaggtgcgggcccccctgagccagctgtacttctgccgctactgcagcgagctgcggagcctggagtgtgtgtcccatgaggtggacagccactactgccccagctgcctggagaacatgcccagcgctgaggccaagctgaagaagaacagatgtgccaactgctttgactgccccggctgcatgcacaccctgagcacccgggccaccagcatcagcacccagctgcctgatgatcctgccaagaccaccatgaagaaggcctactacctggcctgtggcttctgccgctggaccagcagagatgtgggcatggctgacaagtctgtggccagcggcggctggcaggagcctgagaacccccacacccagaggatgaacaagctgattgagtactaccagcagctggcccagaaggagaaggtggagcgggacaggaagaagctggccaggagaagaaactacatgcccctggccttcagccagcacaccatccacgtggtggacaagtatggcctgggcacccggctgcagaggccccgggccggggccagcatcagcaccctggccggcctgagcctgaaggagggggaggaccagaaggagatcaagattgaaccagcccaggccgtggatgaggtggagcccctgcctgaggactactacaccaggcctgtgaacctgacagaggtgaccaccctgcagcagaggctgctgcagcctgacttccagcctgtgtgtgccagccagctgtaccccaggcacaagcacctgctgatcaagaggagcctgcgctgcaggaaatgtgagcacaacctgagcaagccagagttcaaccccaccagcatcaagttcaagatccagctggtggccgtgaactacatccctgaggtgcgcatcatgagcatccccaacctgcgctacatgaaggagagccaggtgctgctgaccctgaccaaccctgtggagaacctgacccacgtgaccctgtttgaatgtgaggagggggaccctgatgacatcaacagcacagccaaggtggtggtgccccccaaggagctggtgctggccggcaaggatgctgctgctgaatatgatgagctggccgagccccaggacttccaggatgatcctgacatcatcgccttcaggaaggccaacaaggtgggcatcttcatcaaggtgaccccccagcgggaggagggggaggtgacagtgtgcttcaagatgaagcatgacttcaagaacctggccgcccccatccggcccatcgaggagagtgaccagggcacagaggtgatctggctgacccagcacgtggagctgagcctgggccccctgctgccctag

SEQ ID NO: 21477 - DNA, 435 bp, Artificial Sequence
  Description of Artificial Sequence: Synthetic coding sequence
gtgcgggagctggaggccgagctggatgctgagcagaagaagcacgccgaggccctgaagggcgtgaggaagcatgaaagaagagtgaaggagctggcctaccaggccgaggaggacaggaagaacctggccaggatgcaggacctggtggacaagctgcagagcaaggtgaagagctacaagaggcagtttgaggaggccgtgtctgccctgggccctggccacctggaccgggccccccagctgtgcccccgggtgtgtggccaggagcagcaggccaacaccaacctggccaagtacaggaaggcccagcacgagctggatgatgctgaggagagagctgacatggccgagacccaggccaacaagctgcgggcccggaccagagatgccctgggccccaagctgagcctgagcccccagcacaaggagtag

SEQ ID NO: 21478 - DNA, 747 bp, Artificial Sequence; identical to SEQ ID NO: 20797
  Description of Artificial Sequence: Synthetic coding sequence

SEQ ID NO: 21479 - DNA, 3468 bp, Artificial Sequence
  Description of Artificial Sequence: Synthetic coding sequence
atggccgccagccgggacctgctgaaggagttcccccagcccaagaacctgctgaacagcgtcatcggccgggccctgggcatcagccacgccaaggacaagctggtgtatgtgcacaccaacggccccaagaagaagaaggtgaccctgcacatcaagtggcccaagtctgtggaggtggagggctacggcagcaagaagattgatgctgagcggcaggccgctgctgctgcctgccagctgttcaagggctggggcctgctgggccccagaaatgagctgtttgatgctgccaagtacagagtgctggccgacagatttggcagccctgctgacagctggtggaggcctgagcccaccatgccacccacctcctggaggcagctgaaccctgagagcatccggcctgggggccctgggggcctgagccgcagcctgggccgggaggaggaggaggatgaggaggaggagctggaggagggcaccattgatgtgacagacttcctgtccatgacccagcaggacagccacgcccccctgcgggacagccggggcagcagctttgagatgacagatgatgattctgccatccgggccctgacccagttccccctgcccaagaacctgctggccaaggtgatccagatcgccaccagcagcagcacagccaagaacctgatgcagttccacacagtgggcaccaagaccaagctgagcaccctgaccctgctgtggccctgccccatgacctttgtggccaagggccgcaggaaggccgaggccgagaacaaggccgccgccctggcctgcaagaagctgaagagcctgggcctggtggacagaaataatgagcccctgacccacgccatgtacaacctggccagcctgcgggagctgggggagacccagaggcggccctgcaccatccaggtgcctgagcccatcctgaggaagattgagaccttcctgaaccactaccctgtggagagctcctggatcgcccctgagctgcggctgcagagtgatgacatcctgcccctgggcaaggacagcggccccctgagtgaccccatcaccgggaagccctacgtgcccctgctggaggccgaggaggtgcggctgagccagagcctgctggagctgtggaggcggcggggccctgtgtggcaggaggccccccagctgcctgtggacccccaccgggacaccatcctgaatgccatcgagcagcaccctgtggtggtgatcagcggggacaccggctgtgggaagaccacccgcatcccccagctgctgctggagcgctacgtgacagagggccgcggggcccgctgcaacgtcatcatcacccagccccggcgcatctctgctgtgtctgtggcccagagggtgtcccatgagctgggccccagcctgcggagaaatgtgggcttccaggtgcggctggagagcaagccacccagccggggcggggccctgctcttctgcaccgtgggcatcctgctgaggaagctgcagagcaaccccagcctggagggcgtgagccacgtgattgtggatgaggtgcatgaaagagatgtgaacacagacttcctgctgatcctgctgaagggcctgcagaggctgaacccagccctgcggctggtgctgatgtctgccaccggggacaatgaacgcttcagccgctactttggaggctgccctgtgatcaaggtgcccggcttcatgtaccctgtgaaggagcactacctggaggacatcctggccaagctgggcaagcaccagtacctgcaccgccaccgccaccatgaaagtgaagatgaatgtgccctggacctggacctggtgacagacctggtgctgcacattgatgcccggggggagcccggcggcatcctgtgcttcctgcccggctggcaggagatcaagggcgtgcagcagaggctgcaggaggccctgggcatgcatgagagcaagtacctgatcctgcctgtgcacagcaacatccccatgatggaccagaaggccatcttccagcagccccctgtgggcgtgaggaagatcgtgctggccaccaacattgctgagaccagcatcaccatcaatgacatcgtgcacgtggtggacagcggcctgcacaaggaggagagatatgacctgaagaccaaggtgtcctgcctggagaccgtgtgggtgtcccgggccaacgtcatccagaggcggggccgggccggccgctgccagagcggctttgcctaccacctgttccccaggagccggctggagaagatggtgcccttccaggtgcctgagatcctgcggacccccctggagaacctggtgctgcaggccaagatccacatgcctgagaagacagctgtggagttcctgagcaaggctgtggacagccccaacatcaaggctgtggatgaggccgtcatcctgctgcaggagattggagtgctggaccagcgggagtacctgaccaccctgggccagaggctggcccacatcagcacagacccccggctggccaaggccatcgtgctggccgccatcttccgctgcctgcaccccctgctggtggtggtgtcctgcctgacccgggaccccttcagcagcagcctgcagaacagagctgaggtggacaaggtgaaggccctgctgagccatgattctggcagtgaccacctggcctttgtgcgggctgtggccggctgggaggaggtgctgcgctggcaggacaggagcagccgggagaactacctggaggagaacctgctgtatgcccccagcctgcgcttcatccacggcctcatcaagcagttcagcgagaacatctatgaggccttcctggtgggcaagcccagcgactgcaccctggccagcgcccagtgcaatgagtacagcgaggaggaggagctggtgaagggcgtgctgatggccggcctgtaccccaacctgatccaggtgcggcagggcaaggtgacccggcagggcaagttcaagcccaacagcgtgacctaccgcaccaagagcggcaacatcctgctgcacaagagcaccatcaaccgggaggccacccggctgcggagccgctggctgacctacttcatggctgtgaagagcaatggatctgtgtttgtgcgggacagcagccaggtgcaccccctggccgtgctgctgctgacagatggagatgtgcacatcagagatgatggaagaagagccaccatcagcctgagtgacagcgacctgctgcggctggagggggacagcaggacagtgcggctgctgaaggagctgcggcgggccctgggccgcatggtggagaggagcctgcggtctgagctggccgccctgccccccagcgtgcaggaggagcacggccagctgctggccctgctggccgagctgctgcggggcccctgtggcagctttgatgtgaggaagacagcagatgactag

SEQ ID NO: 21480 - DNA, 762 bp, Artificial Sequence
  Description of Artificial Sequence: Synthetic coding sequence
tgagtgggcgtggaggccgcccgggtcatcgccaaggccctggagaagaagtctgagctgaagcgctgccactggagcgacatgttcaccggccgcctgaggacagagatccccccagccctgatcagcctgggggagggcctcatcacagctggggcccagctggtggagctggacctgagtgacaatgcctttggaccagatggagtgcagggctttgaggccctgctgaagagcagcgcctgcttcaccctgcaggagctgaagctgaacaactgtggcatgggcattggaggcggcaaggtgattggcaccctggaggaggtgcacatgccccagaatggcatcaaccaccctggcatcacagccctggcccaggcctttgctgtgaaccccctgctgcgggtcatcaacctgaatgacaacaccttcacagagaagggagctgtggccatggccgagaccctgaagaccctgcggcaggtggaggtgatcaactttggagactgcctggtgcgcagcaaaggagctgtggccatcgcagatgccatccggggcggcctgcccaagctgaaggagctgaacctgtccttctgtgagatcaagagagatgctgccctggccgtggccgaggccatggctgacaaggccgagctggagaagctggacctgaatggaaacaccctgggggaggagggctgtgagcagctgcaggaggtgctggagggcttcaacatggccaaggtgctggccagcctgtag

SEQ ID NO: 21481 - DNA, 3735 bp, Artificial Sequence
  Description of Artificial Sequence: Synthetic coding sequence
gatgtgggcggggaccggccctgggacagcggcaacacccagctgccccccaggaaccctgtgaaggccaatgccatgtttggagctggagatgaagatgacacagacttcctgagccccagcggcggggcccggctggccagcctgtttggcctggaccaggccgctgctggccatggaaatgagttcttccagtacacagcccccaagcagcccaagaagggccagggcacagctgccactggaaaccaggccacccccaagacagccccagccaccatgagcacccccaccatcctggtggccacagctgtgcacgcctaccgctacaccaacggccagtatgtgaagcagggcaagtttggagctgctgtgctgggcaaccacacagcccgggagtaccgcatcctgctgtacatcagccagcagcagcctgtgacagtggcccgcatccacgtgaactttgagctgatggtgcggcccaacaactacagcaccttctatgatgaccagaggcagaactggagcatcatgtttgaaagtgagaaggctgctgtggagttcaacaagcaggtgtgcatcgccaagtgcaacagcaccagcagcctggatgctgtgctgagccaggacctgattgtggctgatggccctgctgtggaggtgggggacagcctggaggtggcctacacaggctggctgttccagaaccacgtgctgggccaggtgtttgacagcacagccaacaaggacaagctgctgcggctgaagctgggcagcggcaaggtgatcaagggctgggaggatggcatgctgggcatgaagaagggcggcaagaggctgctgattgtgcccccagcctgtgctgtgggcagcgagggcgtgattggctggacccaggccacagacagcatcctggtgtttgaggtggaggtgcggcgggtgaagtttgcccgggacagcggcagtgatggccacagcgtgagcagccgggacagcgctgcccccagccccatccctggagctgacaacctgtctgctgaccctgtggtgagcccccccaccagcatccccttcaagagcggggagcccgccctgcggaccaagagcaacagcctgtctgagcagctggccatcaacaccagcccagatgctgtgaaggccaagctgatcagcaggatggccaagatgggccagcccatgctgcccatcctgcccccccagctggacagcaatgattctgaaattgaagatgtgaacaccctgcagggcggcggccagcctgtggtgacccccagcgtgcagcccagcctgcacccagcccacccagccctgccccagatgaccagccaggccccccagcccagcgtgacaggcctgcaggcccccagcgctgccctgatgcaggtgagcagcctggacagccacagcgctgtgtctggaaatgcccagagcttccagccctatgccggcatgcaggcctatgcctacccccaggccagcgctgtgaccagccagctgcagcctgtgcggcccctgtacccagcccccctgagccagcccccccacttccagggcagcggggacatggccagcttcctgatgacagaggcccggcagcacaacacagagatccgcatggctgtgtccaaggtggccgacaagatggaccacctgatgaccaaggtggaggagctgcagaagcacagcgctggcaacagcatgctgatccccagcatgtctgtgaccatggagacctccatgatcatgagcaacatccagaggatcatccaggagaatgaaaggctgaagcaggagatcctggagaagagcaacagaattgaggagcagaatgacaagatcagcgagctgattgaaagaaaccagcgctacgtggagcagagcaacctgatgatggagaagaggaacaacagcctgcagacagccacagagaacacccaggcccgggtgctgcatgctgagcaggagaaggccaaggtgacagaggagctggccgccgccacagcccaggtgagccacctgcagctgaagatgacagcccaccagaagaaggagacagagctgcagatgcagctgacagagagcctgaaggagacagacctgctgcggggccagctgaccaaggtgcaggccaagctgtctgagctgcaggagaccagcgagcaggcccagagcaagttcaagtctgagaagcagaacaggaagcagctggagctgaaggtgaccagcctggaggaggagctgacagacctgcgggtggagaaggagagcctggagaagaacctgtctgagaggaagaagaagagcgcccaggagaggagccaggccgaggaggagattgatgagatcaggaagagctaccaggaggagctggacaagctgcggcagctgctgaagaagaccagggtgtccacagaccaggccgctgctgagcagctgagcctggtgcaggccgagctgcagacccagtgggaggccaagtgtgagcacctgctggccagcgccaaggatgagcacctgcagcagtaccaggaggtgtgtgcccagagagatgcctaccagcagaagctggtgcagctgcaggagaagtgcctggccctgcaggcccagatcacagccctgaccaagcagaatgagcagcacatcaaggagctggagaagaacaagagccagatgtctggagtggaggccgccgccagtgaccccagcgagaaggtgaagaagatcatgaaccaggtgttccagagcctgcggcgggagtttgagctggaggagagctacaacggccgcaccatcctgggcaccatcatgaacaccatcaagatggtgaccctgcagctgctgaaccagcaggagcaggagaaggaggagagcagcagcgaggaggaggaggagaaggccgaggagcggccccggcggcccagccaggagcagagcgccagcgccagcagcggccagccccaggcccccctgaaccgggagaggcctgagagccccatggtgcccagcgagcaggtggtggaggaggccgtgcccctgcccccccaggccctgaccaccagccaggacggccacaggaggaagggggacagcgaggccgaggccctgtctgagatcaaggatggcagcctgcccccagagctgagctgcatccccagccaccgggtgctgggcccccccaccagcatccccccagagcccctgggccctgtgtccatggattctgaatgtgaggagagcctggccgccagccccatggccgccaagccagacaaccccagcggcaaggtgtgtgtgcgggaggtggccccagatggccccctgcaggagagcagcacccggctgagcctgaccagtgaccctgaggagggggaccccctggccctgggccctgagagccctggagagccccagcccccccagctgaagaaggatgatgtgaccagcagcacaggcccccacaaggagctgagcagcacagaggccggcagcacagtggccggggccgccctgcggcccagccaccacagccagaggagcagcctgtctggagatgaagaagatgagctgttcaagggggccaccctgaaggccctgcggcccaaggcccagcctgaggaggaggatgaagatgaggtgtccatgaagggccggcccccacccacccccctgtttggagatgatgatgatgatgatgacatcgactggctgggctag

SEQ ID NO: 21482 - DNA, 1653 bp, Artificial Sequence
  Description of Artificial Sequence: Synthetic coding sequence
atgaagtgggaggagtatgaggagctgctgcactacgccatcgtgacccccaacatcgagccctgtgccagccagagcagccaccccaagggggagctggtgcctgatgtgcgcatcagcaccatccatgacatcctgcacagccagggcaacaacagcgaggtgcgggagacagccatcgaggtgggcaagggctgtgacttccacatcagcagccacagcaagacagatgagagcagccctgtgctgagccccaggaagcccagccaccctgtgatggacttcttcagcagccacctgctggccgacagcagcagccctgccaccaacagcagccacacagatgcccacgagatcctggtgtctgacttcctggtgtctgatgagaacctgcagaagatggagaatgtgctggacctgtggagcagcggcctgaagaccaacatcatcagcgagctgagcaagtggaggctgaacttcatcgactggcacaggatggagatgaggaaggagaaggagaagcacgccgcccacctgaagcagctgtgcaaccagatcaatgagctgaaggagctgcagaagacctttgagatcagcatcggcaggaaggatgaggtgatcagcagcctgagccacgccatcggcaagcagaaggagaagattgagctgatgaggaccttcttccactggagaattggccacgtgcgggcccggcaggatgtgtatgagggcaagctggccgaccagtactaccagaggaccctgctgaagaaggtgtggaaggtgtggaggtctgtggtgcagaagcagtggaaggatgtggtggagcgggcctgccaggcccgggcagaggaggtgtgcatccagatcagcaatgactatgaggccaaggtggccatgctgagcggggccctggagaatgccaaggccgagatccagaggatgcagcacgagaaggagcactttgaagattccatgaagaaggccttcatgagaggagtgtgtgccctgaacctggaggccatgaccatcttccagaacagaaatgatgctggcatcgacagcaccaacaacaagaaggaggagtatggccctggggtgcagggcaaggagcacagcgcccacctggaccccagcgccccacccatgcccctgcctgtgaccagccccctgctgcccagccccccagctgctgtgggcggggccagcgccacagctgtgcccagcgctgcctccatgaccagcacccgggccgccagcgccagctctgtgcacgtgcctgtgtctgccctgggcgccggcagcgctgccacagctgccagcgaggagatgtatgtgccccgggtggtgaccagcgcccagcagaaggccggccgcaccatcacagcccgcatcaccggccgctgtgactttgccagcaagaaccgcatcagcagcagcctggccatcatgggcgtgagcccccccatgagctctgtggtggtggagaagcaccaccctgtgacagtgcagaccatcccccaggccacagctgccaagtaccccaggaccatccaccctgagagcagcaccagcgccagccgcagcctgggcaccaggtctgcccacacccagagcctgacctctgtgcacagcatcaaggtggtggactag

SEQ ID NO: 21483 - DNA, 402 bp, Artificial Sequence
  Description of Artificial Sequence: Synthetic coding sequence
atgagccccagccagatgatcatgcccaacgtgatggagatgattgctgccctgggccctggccccagcccctaccccctgcccccacctcctgggggcaccaacagcaatgactacagcagccagggcaacaactaccagggccacggcaactttgacttcccccacggcaaccctgggggcacctccatgaatgacttcatgcacggccccccccagctgagccaccccccagacatgcccaacaacatggccgccctggagaagcccctgagccaccccatgcaggagaccctgctgcctgagctgaccaacccagatgagctgctgagctacctggaccccccagacctgcccagcaacagcaatgatgacctgctgagcctgtttgagaacaactag

SEQ ID NO: 21484 - DNA, 1473 bp, Artificial Sequence
  Description of Artificial Sequence: Synthetic coding sequence
atgagcagctgtgtgagcagccagcccagcagcaacagagctgccccccaggatgagctgggcggccggggcagcagcagcagcgagagccagaagccctgtgaggccctgcggggcctgagcagcctgagcatccacctgggcatggagagcttcatcgtggtgacagaatgtgagcccggctgtgctgtggacctgggcctggcccgggaccggcccctggaggctgatggccaggaggtgcccctggacaccagcggcagccaggcccggccccacctgagcggcaggaagctgagcctgcaggagaggagccagggcggcctggccgccggcggcagcctggacatgaatggccgctgcatctgccccagcctgccctacagccctgtgagcagcccccagagcagcccccggctgccccggcggcccaccgtggagagccaccacgtgtccatcaccggcatgcaggactgtgtgcagctgaaccagtacaccctgaaggatgaaattggcaagggcagctatggagtggtgaagctggcctacaatgaaaatgacaacacctactatgccatgaaggtgctgagcaagaagaagctgatccggcaggccggcttcccccggcggcccccaccccggggcaccaggcctgcccctgggggctgcatccagccccggggccccatcgagcaggtgtaccaggagatcgccatcctgaagaagctggaccaccccaacgtggtgaagctggtggaggtgctggatgaccccaatgaagaccacctgtacatggtgtttgagctggtgaaccagggccctgtgatggaggtgcccaccctgaagcccctgtctgaggaccaggcccgcttctacttccaggacctgatcaagggcatcgagtacctgcactaccagaagatcatccaccgggacatcaagcccagcaacctgctggtgggggaggatggccacatcaagattgctgactttggagtgtccaatgagttcaagggcagtgatgccctgctgagcaacacagtgggcaccccagccttcatggcccctgagagcctgtctgagaccaggaagatcttcagcggcaaggccctggatgtgtgggccatgggcgtgaccctgtactgctttgtgtttggccagtgccccttcatggatgagcgcatcatgtgcctgcacagcaagatcaagagccaggccctggagttcccagaccagcctgacattgctgaggacctgaaggacctgatcaccaggatgctggacaagaaccctgagagcagaattgtggtgcctgagatcaagatcctggtgaagaccatgatcaggaagaggagctttggaaacccctttgagggcagcagaagagaggagaggagcctgagcgcccctggcaacctgctgaccaagaagcccaccagagaatgtgagagcctgtctgagctgaagacctag

SEQ ID NO: 21485 - DNA, 1872 bp, Artificial Sequence
  Description of Artificial Sequence: Synthetic coding sequence
atggctgctgccactggagaccccggcctgagcaagctgcagtttgcccccttcagcagcgccctggatgtgggcttctggcatgagctgacccagaagaagctgaatgagtaccgcctggatgaggcccccaaggacatcaagggctactactacaatggagacagcgctggcctgcctgcccggctgaccctggagttcagcgcctttgacatgtctgcccccaccccagcccgctgctgcccagccatcggcaccctgtacaacaccaacaccctggagagcttcaagacagctgacaagaagctgctgctggagcaggccgccaatgagatctgggagagcatcaagagcggcacagccctggagaaccctgtgctgctgaacaagttcctgctgctgacctttgccatcgaggccctggagtgtgcctatgacaacctgtgccagacagaaggagtgacagccctgccctacttcctgatcaagtatgatgagaacatggtgctggtgtccctgctgaagcactacagcgacttcttccagggccagaggaccaagatcaccatcggcgtgtatgacccctgcaacctggcccagtacccaggctggcccctgaggaacttcctggtgctggccgcccaccgctggagcagcagcttccagagcgtggaggtggtgtgcttccgggacaggaccatgcagggcgccagagatgtggcccacagcatcatctttgaggtgaagctgcctgagatggccttctccccagactgccccaaggctgtgggctgggagaagaaccagaagggcggcatgggccccaggatggtgaacctgtctgagtgcatggaccccaagaggctggccgagagctctgtggacctgaacctgaagctgatgtgctggaggctggtgcccaccctggacctggacaaggtggtgtctgtgaagtgcctgctgctgggcgccggcaccctgggctgcaatgtggcccggaccctgatgggctggggcgtgcgccacatcacctttgtggacaatgccaagatctcctacagcaaccctgtgcggcagcccctgtatgaatttgaggactgcctgggcggcggcaagcccaaggccctggccgctgctgaccggctgcagaagatcttccctggggtgaatgcccggggcttcaacatgagcatccccatgcctggccaccctgtgaacttcagctctgtgaccctggagcaggccaggagagatgtggagcagctggagcagctgattgagagccatgatgtggtgttcctgctgatggacacccgggagagccgctggctgcctgctgtgattgctgccagcaagaggaagctggtgatcaatgctgccctgggctttgacacctttgtggtgatgagacatggcctgaagaagcccaagcagcagggcgctggggacctgtgccccaaccaccctgtggccagcgctgacctgctgggcagcagcctgtttgccaacatccctggctacaagctgggctgctacttctgcaatgatgtggtggcccctggggacagcacccgggacaggaccctggaccagcagtgcaccgtgtcccggcccggcctggccgtgattgctggggccctggccgtggagctgatggtgtctgtgctgcagcaccctgagggcggctacgccatcgccagcagcagtgatgacaggatgaatgagccccccaccagcctgggcctggtgccccaccagatccggggcttcctgagcagatttgacaacgtgctgcctgtgtccctggcctttgacaagtgcacagcctgcagcagcaagatctgggacatgtctgatgatgagaccatctag

SEQ ID NO: 21486 - DNA, 966 bp, Artificial Sequence
  Description of Artificial Sequence: Synthetic coding sequence
agaagaaatgtggagctgatcaatgaggaggccgccatgtttgacagcctgctgatggacagctatgtgagcagcaccactggagagagcgtcatcacccgggagatggtggagatgctgttcagtgatgacagcgacctgcagctggccaccacccagaagttcaggaagctgctgagcaaggagcccagcccccccattgatgaggtgatcaacaccccccgggtggtggacagatttgtggagttcctgaagagaaatgaaaactgcaccctgcaggccgtgtgggccctgggcaacattgctggggacagctctgtgtgccgggactatgtgctgaactgcagcatcctgaaccccctgctgaccctgctgaccaagagcacccggctgaccatgaccagaaatgctgtgtgggccctgagcaacctgtgccggggcaagaaccccccacctgagtttgccaaggtgagcccctgcctgcctgtgctgagccggctgctcttcagcagtgacagcgacctgctggctgatgcctgctgggccctgagctacctgagtgatggccccaatgagaagatccaggccgtcatcgacagcggcgtgtgccggcggctggtggagctgctgatgcacaatgactacaaggtggccagccctgccctgcgggctgtgggcaacatcgtgactggagatgacatccagacccaggtgatcctgaactgcagcgccctgccctgcctgctgcacctgctgagcagccccaaggagagcatcaggaaggaggcctgctggaccatcagcaacatcacagctggcaacagagcccagatccaggccgtgattgatgccaacatcttccctgtgctgattgagatcctgcagaaggccgagttccgcaccaggaaggaggccgcctgggccatcaccaatgccaccagcggcggcaccccagagcagatctag

SEQ ID NO: 21487 - DNA, 795 bp, Artificial Sequence
  Description of Artificial Sequence: Synthetic coding sequence
atgggcggggcccagctggagctgcccagcggggcccggcctggggtgtgtgtgagaagaagcttccgggcccacgccggggaccagcccaggaggcctcctggccccatccctgtgcccggcaccatgaagcaggagagcgctgcccccaacaccccacccaccagccagagccccacccccagcgcccagttccccagaaatgatggagacccccaggccctgtggatcttcggctacggcagcctggtgtggaggccagactttgcctacagcgacagccgggtgggctttgtgcggggctacagccgccgcttctggcagggcgacaccttccaccggggcagtgacaagatgcctggccgggtggtgaccctgctggaggaccacgagggctgcacctggggcgtggcctaccaggtgcagggcgagcaggtgtccaaggccctgaagtacctgaatgtgcgggaggccgtgctgggcggctatgacaccaaggaggtgaccttctacccccaggatgccccagaccagcccctgaaggccctggcctacgtggccaccccccagaaccctggctacctgggccctgcccctgaggaggccatcgccacccagatcctggcctgccggggcttcagcggccacaacctggagtacctgctgcggctggccgacttcatgcagctgtgtggcccccaggcccaggatgagcacctggccgccatcgtggatgctgtgggcaccatgctgccctgcttctgccccacagagcaggccctggccctggtgtag

SEQ ID NO: 21488 - DNA, 747 bp, Artificial Sequence; identical to SEQ ID NO: 20797
  Description of Artificial Sequence: Synthetic coding sequence

SEQ ID NO: 21489 - DNA, 768 bp, Artificial Sequence
  Description of Artificial Sequence: Synthetic coding sequence
atgagcagctccatgtggtacatcatgcagagcatccagagcaagtacagcctgtctgagcggctcatccgcaccatcgccgccatccgctccttcccccatgacaacgtggaggacctgatccggggcggcgcagatgtgaactgcacccacggcaccctgaagcccctgcactgtgcctgcatggtgtctgatgctgactgtgtggagctgctgctggagaagggagctgaggtgaatgccctggatggctacaacagaacagccctgcactatgctgctgagaaggatgaggcctgtgtggaggtgctgctggagtatggagccaaccccaatgccctggactacaacaatgacacccccctgtcctgggccgccatgaagggcaacctggagagcgtgtccatcctgctggactatggagctgaggtgcgggtcatcaacctgattggccagacccccatcagccggctggtggccctgctggtgcggggcctgggcacagagaaggaggacagctgctttgagctgctgcacagagctgtgggccactttgagctgaggaagaatggcaccatgccccgggaggtggcccgggacccccagctgtgtgagaagctgactgtgctgtgcagcgcccctggcaccctgaagaccctggcccgctatgctgtgcggcgcagcctgggcctgcagtacctgcctgatgctgtgaagggcctgcccctgcctgccagcctgaaggagtacctgctgctgctggagtag

SEQ ID NO: 21490 - DNA, 585 bp, Artificial Sequence
  Description of Artificial Sequence: Synthetic coding sequence
gagcctgtgcagccccactggttctactgcaaggaggtggagtacaagcagctgtggatgcccttctctgtgtttgacagcctgaacctggaggagatctacaacagcgtgcagcctgaccctgagagcgtggtgctgggcacagatggcggccgctatgatgtgtacctgtatgaccgcatcaggaaggccgcctactgggaggaggagcctgctgaggtgcggcgctgcacctggttctacaagggggacacagacagccgcttcatcccctacacagaggagttcagcgagaagctggaggtgattgtgcagttccagcccagctctgtgcctgatgagtggggcaccacccaggacggccagacccggccccgggtggtgaagaggggcattgatgacaacctggatgagatcccagatggagagatgccccaggtggaccacctggtgtttgtggtgcatggaattggccctgtgtgtgacctgcgcttccgcagcatcattgaatgtgtggatgacttccgggtggtgtccctgaagctgctgcggacccacttcaagaagagcctggatgatggatag

SEQ ID NO: 21491 - DNA, 981 bp, Artificial Sequence; identical to SEQ ID NO: 20766
  Description of Artificial Sequence: Synthetic coding sequence

SEQ ID NO: 21492 - DNA, 990 bp, Artificial Sequence
  Description of Artificial Sequence: Synthetic coding sequence
atggccggggccctggagggggacatcttcatcggccccaaggccgaggagcaccggggcctgctgagcatccgctaccccatggagcacggcatcgtgaaggactggaatgacatggagcgcatctggcagtatgtgtacagcaaggaccagctgcagaccttcagcgaggagcaccctgtgctgctgacagaggcccccctgaaccccaggaagaaccgggagagagctgctgaggtgttctttgagaccttcaacgtgcctgccctcttcatctccatgcaggccgtgctgagcctgtatgccactggaagaaccactggagtggtgctggacagcggagatggagtgacccatgctgtgcccatctatgagggctttgccatgccccacagcatcatgagaattgatattgctggaagagatgtgagccgcttcctgcggctgtacctgaggaaggagggctatgacttccacagcagcagcgagtttgagatcgtgaaggccatcaaggagcgggcctgctacctgagcatcaacccccagaaggatgagaccctggagacagagaaggcccagtactacctgcctgatggcagcaccatcgagatcggccccagccgcttccgggcccctgagctgctcttccggccagacctgattggagaggagagcgagggcatccacgaggtgctggtgtttgccatccagaagagtgacatggacctgcggaggaccctcttcagcaacatcgtgctgagcggcggcagcaccctcttcaagggctttggagaccggctgctgtctgaggtgaagaagctggcccccaaggatgtgaagatccgcatcagcgccccccaggagcggctgtacagcacctggattggaggcagcatcctggccagcctggacaccttcaagaagatgtgggtgtccaagaaggagtatgaggaggatggagcccggagcatccacaggaagaccttctag

SEQ ID NO: 21493 - DNA, 450 bp, Artificial Sequence
  Description of Artificial Sequence: Synthetic coding sequence
atggagaagacagagctgatccagaaggccaagctggccgagcaggccgagagatatgatgacatggccacctgcatgaaggctgtgacagagcagggcgctgagctgagcaatgaggagaggaacctgctgtctgtggcctacaagaatgtggtgggcggcagaagaagtgcctggagggtcatcagcagcattgagcagaagacagacaccagtgacaagaagctgcagctgatcaaggactaccgggagaaggtggagagcgagctgcggagcatctgcaccaccgtgctggagctgctggacaagtacctgattgccaatgccaccaaccctgagagcaaggtgttctacctgaagatgaagggggactacttccgctacctggccgaggtggcctgtggagatgacaggaagcagaccatcgacaacagccagggcgcctactag

SEQ ID NO: 21494 - DNA, 735 bp, Artificial Sequence
  Description of Artificial Sequence: Synthetic coding sequence
atgctgagtgacaggaagcgggagctggagcaccggctgagcgccaccctggaggagaatgacctgctgcagggcaccgtggaggagctgcaggacagagtgctgatcctggagcggcagggccatgacaaggacctgcagctgcaccagagccagctggagctgcaggaggtgcggctgagctgccggcagctgcaggtgaaggtggaggagctgacagaggagaggagcctgcagagcagcgctgccaccagcaccagcctgctgtctgaaattgagcagagcatggaggccgaggagctggagcaggagcgggagcaggtgaccctgctgtctgtggagatgacagccctgaaggaggagcgggaccggctgcgggtgaccagcgaggacaaggagcccaaggagcagctgcagaaggccatccgggacagagatgaggccatcgccaagaagaatgctgtggagctggagctggccaagtgcaggatggacatgatgagcctgaacagccagctgctggatgccatccagcagaagctgaacctgagccagcagctggaggcctggcaggatgacatgcacagggtcatcgaccggcagctgatggacacccacctgaaggagaggagccagcctgctgctgccctgtgccggggccacagcgctggaagaggagatgagcccagcattgctgagggcaagaggctcttctccttcttcaggaagatctag

SEQ ID NO: 21495 - DNA, 603 bp, Artificial Sequence
  Description of Artificial Sequence: Synthetic coding sequence
tgacacatgctgagcaaggtgggcatgtgggactttgacatcttcctgtttgaccggctgaccaacggcaacagcctggtgaccctgctgtgccacctgttcaacacccacggcctcatccaccacttcaagctggacatggtgaccctgcaccgcttcctggtgatggtgcaggaggactaccacagccagaacccctaccacaatgctgtgcatgctgctgatgtgacccaggccatgcactgctacctgaaggagcccaagctggccagcttcctgacccccctggacatcatgctgggcctgctggccgccgccgcccatgatgtggaccaccctggggtgaaccagcccttcctgatcaagaccaaccaccacctggccaacctgtaccaggtgcgggagcccaacctggagcccgccaccgtgtggagcatcgccctgggccctgtgctgaagccagagagctgcccctggaggaagccctgcttccgggtgctggaggtgcagaggaggatgaagcacaacctgtgcccccagaagtttgtgcagacccagatgctgaagatgagcaagatccaggccaacctgatccctgtgtag

SEQ ID NO: 21496 - DNA, 1728 bp, Artificial Sequence; identical to SEQ ID NO: 18827
  Description of Artificial Sequence: Synthetic coding sequence

SEQ ID NO: 21497 - DNA, 3036 bp, Artificial Sequence; identical to SEQ ID NO: 20061
  Description of Artificial Sequence: Synthetic coding sequence

SEQ ID NO: 21498 - DNA, 3786 bp, Artificial Sequence
  Description of Artificial Sequence: Synthetic coding sequence
atggctgctgctgctgccagcggggccggcggcgctgctggagctggcactggaggagctggccctgctggccgcctgctgcccccaccagcccctggcagccctgctgccccagctgctgtgtccccagctgctggccagccccggcccccagccccagccagccggggccccatgcctgccagaattggctactatgaaattgacaggaccatcggcaagggcaactttgctgtggtgaagagggccacccacctggtgaccaaggccaaggtggccatcaagatcatcgacaagacccagctggatgaggagaacctgaagaagatcttccgggaggtgcagatcatgaagatgctgtgccacccccacatcatccggctgtaccaggtgatggagacagagaggatgatctacctggtgacagaatatgccagcggcggggagatctttgaccacctggtggcccacggccgcatggccgagaaggaggcccggaggaagttcaagcagatcgtgacagctgtgtacttctgccactgcaggaacatcgtgcaccgggacctgaaggccgagaacctgctgctggatgccaacctgaacatcaagattgctgactttggcttcagcaacctcttcaccccaggccagctgctgaagacctggtgtggcagccccccctatgctgcccctgagctgtttgagggcaaggagtatgatggccccaaggtggacatctggagcctgggcgtggtgctgtatgtgctggtgtgtggggccctgccctttgatggcagcaccctgcagaacctgcgggcccgggtgctgagcggcaagttccgcatccccttcttcatgagcacagaatgtgagcacctgatccgccacatgctggtgctggaccccaacaagaggctgtccatggagcagatctgcaagcacaagtggatgaagctgggagatgctgaccccaactttgaccggctgattgctgagtgccagcagctgaaggaggagcggcaggtggaccccctgaatgaagatgtgctgctggccatggaggacatgggcctggacaaggagcagaccctgcaggccgagcaggccggcacagccatgaacatctctgtgccccaggtgcagctgatcaaccctgagaaccagatcgtggagccagatggcaccctgaacctggacagtgatgaaggagaggagcccagccctgaggccctggtgcgctacctgtccatgaggaggcacacagtgggcgtggccgaccccaggacagaggtgatggaggacctgcagaagctgctgcccggcttccctggggtgaacccccaggcccccttcctgcaggtggccccaaatgtgaacttcatgcacaacctgctgcccatgcagaacctgcagcccaccggccagctggagtacaaggagcagagcctgctgcagccccccaccctgcagctgctgaatggcatgggccccctgggccggcgggccagtgatggaggagccaacatccagctgcacgcccagcagctgctgaagaggccccggggccccagccccctggtgaccatgaccccagctgtgcctgctgtgacccctgtggatgaggagagcagtgatggagagccagaccaggaggccgtgcagcgctacctggccaacagaagcaagaggcacaccctggccatgaccaaccccacagctgagatccccccagacctgcagaggcagctgggccagcagcccttccgcagccgggtgtggccaccccacctggtgcctgaccagcacaggagcacctacaaggacagcaacaccctgcacctgcccacagagcgcttcagccctgtgcggcgcttcagtgatggagctgccagcatccaggccttcaaggcccacctggagaagatgggcaacaacagcagcatcaagcagctgcagcaggagtgtgagcagctgcagaagatgtatggaggccagattgatgagaggaccctggagaagacccagcagcagcacatgctgtaccagcaggagcagcaccaccagatcctgcagcagcagatccaggacagcatctgccccccccagcccagcccccccctgcaggccgcctgtgagaaccagcctgccctgctgacccaccagctgcagaggctgcgcatccagcccagcagccccccacccaaccaccccaacaaccacctgttccggcagcccagcaacagccccccacccatgagcagcgccatgatccagccccacggggccgccagcagcagccagttccagggcctgcccagccgcagcgccatcttccagcagcagcctgagaactgcagcagcccccccaacgtggccctgacctgcctgggcatgcagcagcctgcccagagccagcaggtgaccatccaggtgcaggagcctgtggacatgctgagcaacatgcctggaacagctgctggcagcagcggccggggcatcagcatcagccccagcgctggccagatgcagatgcagcacaggaccaacctgatggccaccctgtcctatggccaccggcccctgagcaagcagctgtctgctgacagcgctgaggcccacagcgcccaccagcagcccccccactacaccaccagcgccctgcagcaggccctgctgagccccaccccaccagactacaccaggcaccagcaggtgccccacatcctgcagggcctgctgagccccaggcacagcctgaccggccacagcgacatccggctgcccccaacagaatttgcccagctgatcaagaggcagcagcagcagaggcagcagcagcagcagcagcagcagcagcaggagtaccaggagctgttccgccacatgaaccagggagatgctggcagcctggcccccagcctgggcggccagagcatgacagagcggcaggccctgagctaccagaatgctgacagctaccaccaccacaccagcccccagcacctgctgcagatccgggcccaggagtgtgtgtcccaggccagcagccccaccccacctcatggctacgcccaccagcctgccctgatgcacagcgagagcatggaggaggactgcagctgtgagggcgccaaggatggcttccaggacagcaagagcagcagcaccctgaccaagggctgccacgacagccccctgctgctgagcactggaggccctggggaccctgagagcctgctgggcaccgtgtcccatgcccaggagctgggcatccacccctacggccaccagcccacagctgccttcagcaagaacaaggtgcccagccgggagcccgtcatcggcaactgcatggacaggagcagccctggccaggccgtggagctgcctgaccacaacggcctgggctacccagcccggcccagcgtgcatgagcaccaccggccccgggccctgcagaggcaccacaccatccagaacagtgatgatgcctacgtgcagctggacaacctgcccggcatgagcctggtggccggcaaggccctgagcagcgccaggatgtctgatgctgtgctgagccagagcagcctgatgggcagccagcagttccaggatggagaaaatgaggagtgtggggccagcctgggcggccacgagcacccagacctgagtgatggcagccagcacctgaacagcagctgctaccccagcacctgcatcacagacatcctgctgagctacaagcaccctgaggtgtccttctccatggagcaggccggcgtgtag

SEQ ID NO: 21499 - DNA, 519 bp, Artificial Sequence
  Description of Artificial Sequence: Synthetic coding sequence
atgagcagcaatgaatgcttcaagtgtggccgcagcggccactgggcccgggagtgccccactggaggcggccggggccggggcatgaggagccggggccggggcttccagtttgtgagcagcagcctgcctgacatctgctaccgctgtggggagagcggccacctggccaaggactgtgacctgcaggaggatgtggaggcctgctacaactgtggccggggcggccacatcgccaaggactgcaaggagcccaagcgggagcgggagcagtgctgctacaactgtgggaagccaggccacctggcccgggactgtgaccatgctgatgagcagaagtgctacagctgtggggagtttggccacatccagaaggactgcaccaaggtgaagtgctaccgctgtggggagaccggccacgtggccatcaactgcagcaagaccagcgaggtgaactgctaccgctgtggggagagcggccacctggccagagaatgtaccatcgaggccacagcctag

SEQ ID NO: 21500 - DNA, 471 bp, Artificial Sequence
  Description of Artificial Sequence: Synthetic coding sequence
atgctggccgagaagctgcccaacctgacccacctgaacctgagcggcaacaagctgaaggacatcagcaccctggagcccctgaagaagctggagtgcctgaagagcctggacctcttcaactgtgaggtgaccaacctgaatgactaccgggagagcgtcttcaagctgctgccccagctgacctacctggatggctatgaccgggaggaccaggaggccccagacagtgatgctgaggtggatggagtggatgaggaggaggaggatgaggagggggaggatgaagaagatgaagatgatgaagatggagaggaggaggagtttgatgaggaggatgatgaagatgaagatgtggagggagatgaagatgatgatgaggtgtctgaggaggaggaggagtttggcctggatgaggaggatgaagatgaagatgaagatgaggaggaggaggagggcggcaaaggatag

SEQ ID NO: 21501 - DNA, 516 bp, Artificial Sequence; identical to SEQ ID NO: 21041
  Description of Artificial Sequence: Synthetic coding sequence

SEQ ID NO: 21502 - DNA, 111 bp, Artificial Sequence
  Description of Artificial Sequence: Synthetic coding sequence
atgattgagaagatgcagggcagcaggatggatgagcagcgctgcagcttccccccacccctgaagacagaggaggactacatcccctaccccagcgtgcatgaggtgtag

SEQ ID NO: 21503 - DNA, 639 bp, Artificial Sequence
  Description of Artificial Sequence: Synthetic coding sequence
atgagcagcaagggcagcagcacagatggccgcacagacctggccaacggcagcctgagcagcagccctgaggagatgtctggagctgaggagggccgggagaccagcagcggcatcgaggtggaggccagtgacctgagcctgagcctgactggagatgatggcggccccaacagaaccagcacagagagccggggcacagacacagagagcagcggggaggacaaggacagcgacagcatggaggacaccggccactacagcatcaatgatgagaacagagtgcatgacagaagtgaggaggaggaggaggaggaggaggaggaggaggaggagcagccccggcggcgggtgcagaggaagagggccaacagagaccaggacagcagtgatgatgagcgggccctggaggactgggtgagcagcgagaccagcgccctgccccggccccgctggcaggccctgcctgccctgcgggagcgggagctgggcagcagcgccaggtttgtgtatgaggcctgtggggcccgggtgtttgtgcagcgcttccggctgcagcacggcctggagggccacacaggctgtgtgaacaccctgcacttcaaccagaggggcacctggctggccagcggcagctag

SEQ ID NO: 21504 - DNA, 726 bp, Artificial Sequence
  Description of Artificial Sequence: Synthetic coding sequence
atgacctctgtgaccaggtctgagatcattgatgagaagggccctgtgatgagcaagacccatgaccaccagctggagagcagcctgagccctgtggaggtgtttgccaagaccagcgccagcctggagatgaaccagggcgtgtctgaggagcgcatccacctgggcagcagccccaagaagggcggcaactgtgacctgagccaccaggagcggctgcagagcaagagcctgcacctgagcccccaggagcagagcgccagctaccaggaccggcggcagagctggaggcgggcctccatgaaggagaccaacagaaggaagagcctgcaccccatccaccagggcatcacagagctgagccgcagcatctctgtggacctggccgagagcaagaggctgggctgcctgctgctgagcagcttccagttcagcatccagaagctggagcccttcctgcgggacaccaagggcttcagcctggagagcttccgggccaaggccagcagcctgtctgaggagctgaagcactttgctgatggcctggagacagatggcaccctgcagaagtgctttgaggacagcaatggcaaggccagtgacttcagcctggaggcctctgtggccgagatgaaggagtacatcaccaagttcagcctggagcggcagacctgggaccagctgctgctgcactaccagcaggaggccaaggagatcctgtcctag

SEQ ID NO: 21505 - DNA, 1188 bp, Artificial Sequence; identical to SEQ ID NO: 20054
  Description of Artificial Sequence: Synthetic coding sequence

SEQ ID NO: 21506 - DNA, 1887 bp, Artificial Sequence
  Description of Artificial Sequence: Synthetic coding sequence
atgtctgacaagagtgacctgaaggccgagctggagaggaagaagcagaggctggcccagatccgggaggagaagaagaggaaggaggaggagaggaagaagaaggaggccgacatgcagcagaagaaggagcctgtgcaggatgacagcgacctggacaggaagaggcgggagacagaggccctgctgcagagcatcggcatcagccctgagccccccctggtgcccacccccatgagccccagcagcaagtctgtgtccacccccagcgaggccggcagccaggacagcggggacctgggccccctgaccaggaccctgcagtgggacacagaccccagcgtgctgcagctgcagagcgacagcgagctgggccggcggctgcacaagctgggcgtgtccaaggtgacccaggtggacttcctgccccgggaggtggtgtcctacagcaaggagacccagacccccctggccacccaccagagcgaggaggatgaagaagatgaggagatggtggagagcaaggtgggccaggacagcgagctggagaaccaggacaagaagcaggaggtgaaggaggccccaccccgggagctgacagaggaggagaagcagcagatcctgcacagcgaggagttcctgatcttctttgacaggaccatccgggtcatcgagcgggccctggccgaggacagcgacatcttctttgactacagcggccgggagctggaggagaaggatggagatgtgcaggccggggccaacctgtccttcaaccggcagttctatgatgagcactggagcaagcaccgggtggtgacctgcatggactggagcctgcagtacccagagctgatggtggccagctacaacaacaatgaagatgcccctcatgagccagatggagtggccctggtgtggaacatgaagttcaagaagaccaccccagaatatgtgttccactgccagagctctgtgatgtctgtgtgctttgcccgcttccaccccaacctggtggtgggcggcacctacagcggccagatcgtgctgtgggacaacagaagccacaggaggacccctgtgcagaggacccccctgtctgctgctgcccacacccaccctgtgtactgtgtgaatgtggtgggcacccagaatgcccacaacctgatcaccgtgtccacagatggcaagatgtgctcctggagcctggacatgctgagcaccccccaggagagcatggagctggtgtacaacaagagcaagcctgtggccgtgacaggcatggccttccccactggagatgtgaacaactttgtggtgggcagcgaggagggcaccgtgtacacagcctgcagacatggcagcaaggccggcattggagaggtgtttgagggccaccagggccctgtgacaggcatcaactgccacatggctgtgggccccatcgacttcagccacctgtttgtgaccagcagctttgactggacagtgaagctgtggaccaccaagcacaacaagcccctgtacagctttgaggacaatgctgactatgtgtatgatgtgatgtggagccctgtgcacccagccctgtttgcctgtgtggatggcatgggccgcctggacctgtggaacctgaacaatgacacagaggtgcccacagcctctgtggccatcgagggcgccagcgccctgaacagagtgcgctgggcccaggccggcaaggaggtggccgtgggggacagcgagggccgcatctgggtgtatgatgtgggggagctggccgtgccccacaatgatgagtggaccaggtttgcccggaccctggtggagatccgggccaacagagctgacagcgaggaggagggcaccgtggagctgagcgcctag

SEQ ID NO: 21507 - DNA, 1644 bp, Artificial Sequence; identical to SEQ ID NO: 19587
  Description of Artificial Sequence: Synthetic coding sequence

SEQ ID NO: 21508 - DNA, 747 bp, Artificial Sequence
  Description of Artificial Sequence: Synthetic coding sequence
atggccttcagcggccgggcccggccctgcatcatcccagaaaatgaggagatccccagggctgccctgaacacagtgcatgaggccaacggcacagaagatgaaagagctgtgtccaagctgcagaggaggcacagtgatgtgaaggtgtacaaggagttctgtgacttctacgccaagttcaacatggccaatgccctggccagcgccacctgtgagcgctgcaagggcggctttgccccagctgagaccatcgtgaacagcaatggagagctgtaccacgagcagtgctttgtgtgtgcccagtgcttccagcagtttcctgagggcctcttctatgaatttgagggcaggaagtactgtgaacatgacttccagatgctgtttgccccctgctgccaccagtgtggggagttcatcatcggccgggtcatcaaggccatgaacaacagctggcaccctgagtgcttccgctgtgacctgtgccaggaggtgctggccgacattggatttgtgaagaatgccggccgccacctgtgccggccctgccacaaccgggagaaggcccggggcctgggcaagtacatctgccagaagtgccacgccatcattgatgagcagcccctcatcttcaagaatgacccctaccacccagaccacttcaactgtgccaactgtggccaggagggcagtgactgccgctgcaccggggctgagcggggggccatcctgcctgccatgccctag

SEQ ID NO: 21509 - DNA, 621 bp, Artificial Sequence
  Description of Artificial Sequence: Synthetic coding sequence
atggagagcaacttcaaccaggagggcgtgccccggcccagctatgtgttttctgctgaccccatcgcccggcccagcgagatcaactttgatggcatcaagctggacctgagccatgagttcagcctggtggcccccaacacagaggccaacagctttgagagcaaggactacctgcaggtgtgcctgcgcatccggcccttcacccagagcgagaaggagctggagagcgagggctgtgtgcacatcctggacagccagacagtggtgctgaaggagccccagtgcatcctgggccgcctgtctgagaagagcagcggccagatggcccagaagttctccttcagcaaggtgtttggacctgccaccacccagaaggagttcttccagggctgcatcatgcagcctgtgaaggacctgctgaagggccagagccgcctcatcttcacctacggcctgaccaacagcggcaagacctacaccttccagggcacagaagaaaatattggcatcctgcccaggaccctgaatgtgctgtttgacagcctgcaggagcggctgtacaccaagatgaacctgaagccccacaggagccgggagtacctgcggctgagcagctag

SEQ ID NO: 21510 - DNA, 990 bp, Artificial Sequence
  Description of Artificial Sequence: Synthetic coding sequence
atggaggtggccgagcccagcagccccacagaggaggaggaggaggaggaggagcacagcgctgagccccggcccaggaccaggagcaaccctgagggcgcagaagatagagctgtgggcgcccaggcctctgtgggcagccgctctgagggggagggggaggccgccagcgcagatgatggcagcctgaacaccagcggggccggccccaagtcctggcaggtgcccccaccagcccctgaggtgcagatccgcaccccccgggtgaactgcccagagaaggtgatcatctgcctggacctgtctgaggagatgagcctgcccaagctggagagcttcaacggcagcaagaccaatgccctgaatgtgtcccagaagatgattgagatgtttgtgaggaccaagcacaagattgacaagagccatgaatttgccctggtggtggtgaatgatgacacagcctggctgagcggcctgaccagtgacccccgggagctgtgcagctgcctgtatgacctggagacagccagctgcagcaccttcaacatcagcggggccagccctgcccggcagcagaagacagagctgcctgtgacagaaaatgtgcagaccatccccccaccctacgtggtgaggaccatcctggtgtacagccggcccccctgccagccccagttcagcctgacagagcccatgaagaagatgttccagtgcccctacttcttctttgatgtggtgtacatccacaacggcacagaggagaaggaggaggagatgtcctggaaggacatgtttgccttcatgggcagcctggacaccaagggcaccagctacaagtatgaggtggccctggccggccctgccctggagctgcacaactgcatggccaagctgctggcccaccccctgcagaggccctgccagagccacgccagctacagcctgctggaggaggaggatgaggccatcgaggtggaggccaccgtgtag

SEQ ID NO: 21511 - DNA, 1620 bp, Artificial Sequence; identical to SEQ ID NO: 19050
  Description of Artificial Sequence: Synthetic coding sequence

SEQ ID NO: 21512 - DNA, 3558 bp, Artificial Sequence
  Description of Artificial Sequence: Synthetic coding sequence
atgtgtgaggtgatgcccaccatcaatgaaggagaccggctgggccccccccacggggctgatgctgatgccaactttgagcagctgatggtgaacatgctggatgagcgggagaagctgctggagagcctgcgggagagccaggagaccctggccgccacccagagccggctgcaggatgccatccacgagcgggaccagctgcagaggcacctgaacagcgccctgccccaggagtttgccaccctgacccgggagctgtccatgtgccgggagcagctgctggagcgggaggaggagatcagcgagctgaaggccgagaggaacaacacccggctgctgctggagcacctggagtgcctggtgtccagacatgagaggagcctgaggatgacagtggtgaagaggcaggcccagagccccagcggcgtgagcagcgaggtggaggtgctgaaggccctgaagagcctgtttgagcaccacaaggccctggatgagaaggtgcgggagcggctgcgggccgccctggagcgggtgaccaccctggaggagcagctggccggggcccaccagcaggtgtctgccctgcagcagggcgctggggtgagagatggagctgctgaggaggagggcaccgtggagctgggccccaagaggctgtggaaggaggacaccggccgggtggaggagctgcaggagctgctggagaagcagaactttgagctgagccaggcccgggagcggctggtgaccctgaccaccaccgtgacagagctggaggaggacctgggcacagcccggcgggacctgatcaagtctgaggagctgagcagcaagcaccagagggacctgcgggaggccctggcccagaaggaggacatggaggagcgcatcaccaccctggagaagcgctacctggccgcccagcgggaggccaccagcatccatgacctgaatgacaagctggagaatgagctggccaacaaggagagcctgcaccggcagtgtgaggagaaggcccggcacctgcaggagctgctggaggtggccgagcagaagctgcagcagaccatgaggaaggccgagaccctgcctgaggtggaggccgagctggcccagagaattgctgccctgaccaaggccgaggagagacatggcaacatcgaggagcacctgcggcagctggagggccagctggaggagaagaaccaggagctggccaggacagctgtgcaggtgcggcagcgggagaagatgaatgaagaccacaacaagaggctgagtgacacagtggaccggctgctgtctgagagcaatgaaaggctgcagctgcacctgaaggagaggatggccgccctggaggagaagaacaccctcatccaggagctggagagcagccagaggcagatcgaggagcagcaccaccacaagggccgcctgtctgaggagattgagaagctgcggcaggaggtggaccagctgaagggccggggcggcccctttgtggatggagtgcacagccgcagccacatgggcagcgctgctgatgtgcgcttcagcctgggcaccaccacccacgcccctcctggggtgcaccggcgctacagcgccctgcgggaggagagcgccaagctggccctgcccctgactgtgaccctgcggagccccacctggatgaggatgagccagggcgtgtgctgcaacctggagtaccacagcagcggcaccctgtgtggcagcagcggccccctgcctgtgcctgagatgatccaggaggagaaggagagcacagagctgcgggcagaggagattgagaccagggtgaccagcggctccatggaggccctgaacctgaagcagctgaggaagaggggcagcatccccaccagcctgacagccctgagcctggccagcgccagcccccccctgagcggccgcagcacccccaagctgaccagccgctctgctgcccaggacctggacaggatgggcgtgatgaccctgcccagcgacctgaggaagcacaggaggaagctgctgagccctgtgtcccgggaggagaaccgggaggacaaggccaccatcaagtgtgagaccagcccccccagcagccccaggaccctgcggctggagaagctgggccacccagccctgagccaggaggagggcaagagcgccctggaggaccagggcagcaaccccagcagcagcaacagcagccaggacagcctgcacaagggggccaagaggaagggcatcaagagcagcatcggccgcctgtttgggaagaaggagaagggccgcctcatccagctgagcagagatggagccaccggccacgtgctgctgacagacagcgagttctccatgcaggagcccatggtgcctgccaagctgggcacccaggccgagaaggaccggcggctgaagaagaagcaccagctgctggaggatgcccggaggaagggcatgccctttgcccagtgggatggccccaccgtggtgtcctggctggagctgtgggtgggcatgcctgcctggtacgtggccgcctgccgggccaacgtgaagagcggggccatcatgtctgccctgagtgacacagagatccagcgggagatcggcatcagcaatgccctgcaccggctgaagctgcggctggccatccaggagatggtgtccctgaccagccccagcgccccacccaccagcaggaccagcagtggaaatgtgtgggtgacccatgaggagatggagaccctggagaccagcaccaagacagattctgaggagggctcctgggcccagaccctggcctacggggacatgaaccacgagtggattggaaatgagtggctgcccagcctgggcctgccccagtaccgcagctacttcatggagtgcctggtggatgccaggatgctggaccacctgaccaagaaggacctgcgggtgcacctgaagatggtggacagcttccacaggaccagcctgcagtatggcatcatgtgcctgaagaggctgaactatgacaggaaggagctggagaagaggcgggaggagagccagcacgagatcaaggatgtgctggtgtggaccaatgaccaggtggtgcactgggtgcagagcatcggcctgcgggactatgccggcaacctgcacgagagcggcgtgcatggagccctgctggccctggatgaaaattttgaccacaacaccctggccctgatcctgcagatccccacccagaacacccaggcccggcaggtgatggagcgggagttcaacaacctgctggccctgggcacagacaggaagctggatgatggagatgacaaggtgttccggcgggcccccagctggaggaagcgcttccggccccgggagcaccacggccggggcggcatgctgagcgccagcgctgagaccctgcctgctggcttccgggtgtccaccctgggcaccctgcagcccccaccagccccacccaagaagatcatgcctgaggcccacagccactacctgtatggccacatgctgagcgccttccgggactag

SEQ ID NO: 21513 - DNA, 1383 bp, Artificial Sequence
  Description of Artificial Sequence: Synthetic coding sequence
atggagatctgtgacatcatcaatgaaacagaggagggccccaaggatgccctgcgggctgtgaagaagagaattgtgggcaacaagaacttccacgaggtgatgctggccctgactgtgctggagacctgtgtgaagaactgtggccaccgcttccacgtgctggtggccagccaggactttgtggagagcgtgctggtgaggaccatcctgcccaagaacaacccccccaccatcgtgcatgacaaggtgctgaacctgatccagagctgggcagatgccttccgcagcagcccagacctgactggagtggtgaccatctatgaggacctgcggaggaagggcctggagttccccatgacagacctggacatgctgagccccatccacaccccccagaggacagtgttcaacagcgagacccagagcggccaggacagcgtgggcacagacagcagccagcaggaggacagcggccagcacgccgcccccctgcctgccccacccatcctgagcggggacacccccatcgcccccaccccagagcagatcggcaagctgcggtctgagctggagatggtgtctggaaatgtgcgggtgatgtctgagatgctgacagagctggtgcccacccaggccgagcctgctgacctggagctgctgcaggagctgaacagaacctgccgggccatgcagcagagggtgctggagctgatcccccagatcgccaatgagcagctgacagaggagctgctgattgtgaatgacaacctgaacaacgtgttcctgcggcatgaaagatttgagcgcttcagaacaggccagaccaccaaggcccccagcgaggccgagcctgctgctgacctgattgacatgggccctgaccctgctgccactggaaacctgagcagccagctggccggcatgaacctgggcagcagctctgtgcgggccggcctgcagagcctggaggccagcggccgcctggaggatgaatttgacatgtttgccctgacccggggcagcagcctggccgaccagaggaaggaggtgaagtatgaggccccccaggccacagatggcctggccggggccctggatgcccggcagcagagcactggagccatccctgtgacccaggcctgcctgatggaggacatcgagcagtggctgagcacagatgtgggcaatgatgctgaggagcccaagggcgtgaccagcgagggcaagtttgacaagttcctggaggagcgggccaaggctgctgaccggctgcccaacctgagcagccccagcgctgagggccccccaggccccccatctggccctgcccccaggaagaagacccaggagaaggatgatgacatgctgtttgccctgtag

SEQ ID NO: 21514 - DNA, 180 bp, Artificial Sequence
  Description of Artificial Sequence: Synthetic coding sequence
atgatgatgaagatgatgatgaggatgaagatcaggaagatccgctaccactgccagaggaagcagaacctgatccacaacaatggaaatggcctgggctctgtgcctgtggagaagctggtgctgcaccccagccccatccagaacccccagcagagcgctgtggtgtcctgtgagtag

SEQ ID NO: 21515 - DNA, 537 bp, Artificial Sequence
  Description of Artificial Sequence: Synthetic coding sequence
atgctgggcctggatgcctgtgagctgggcgcccagctgctggagctgctgcggctggccctgtgtgcccgggtgctgctggccgacaaggagggcggccccccagctgtggatgaggtgctggatgaggccgtgcctgagtaccgggcccctggcaggaagagcctgctggagatccggcagctggaccctgatgacaggagcctggccaagtacaagagggtgctgctgggccccctgcccccagctgtggaccccagcctgcccaacgtgcaggtgacccggctgaccctgctgtctgagcaggcccctggccctgtggtgatggacctgaccggggacctggccgtgctgaaggaccaggtgtttgtgctgaaggagggcgtggactacagagtgcaccgggagatcgtgtctggcctgaagtgcctgcaccacacctacagaagaggcctgcgggtggacaagacagtgtacatggtgggcagctatggccccagcgcccaggagtatgaatttgtgacccctgtggagtag

SEQ ID NO: 21516 - DNA, 1119 bp, Artificial Sequence
  Description of Artificial Sequence: Synthetic coding sequence
atggattctgtgcgcagcggccccttcggccaggtgttccggccagacaacttcatcttcggccagtgtggggccggcaacaactgggccaagggccactacacagaaggagctgagctgatggagagcgtgatggatgtggtgaggaaggaggccgagagctgtgactgcctgcagggcttccagctgacccacagcctgggcggcggcactggaagtggcatgggcaccctgctgctgagcaagatccgggaggagtacccagaccgcatcatcaacaccttcagcatcctgcccagccccaaggtgtctgacacagtggtggagccctacaatgccaccctgtctgtgcaccagctgattgaaaatgctgatgagaccttctgcatcgacaatgaggccctgtatgacatctgcagcaagaccctgaagctgcccacccccacctacggggacctgaaccacctggtgtctgccaccatgtctggagtgaccacctgcctgcgcttccctggccagctgaatgctgacctgaggaagctggccgtgaacatggtgcccttcccccggctgcacttcttcatgcctggctttgcccccctgaccagccggggcagccagcagtaccgggccctgactgtggccgagctgacccagcagatgtttgatgccaagaacatgatggccgcctgtgaccccaggcatggccgctacctgacagctgctgccatcttccggggccgcatgcccatgagggaggtggatgagcagatgttcaacatccaggacaagaacagcagctactttgctgactggctgcccaacaacgtgaagacagctgtgtgtgacatccccccccggggcctgaagatgtctgccaccttcatcggcaacaacacagccatccaggagctgttcaagagggtgtctgagcagttcaccgccatgttccggaggaaggccttcctgcactggtacacaggagagggcatggatgagatggagttcacagaagctgagagcaacatgaatgacctggtgtctgagtaccagcagtaccaggatgccacagctgaggaggaggaggatgaggagtatgcagaggaggaggtggcctag

SEQ ID NO: 21517 - DNA, 576 bp, Artificial Sequence
  Description of Artificial Sequence: Synthetic coding sequence
atggctgctgccaaggacacccatgaagatcatgacaccagcacagagaacacagatgagagcaaccacgacccccagtttgagcccatcgtgtccctgcctgagcaggagatcaagaccctggaggaggatgaggaggagctgttcaagatgagggccaagctgttccgctttgcctctgaaaatgacctgcctgagtggaaggagcggggcactggagatgtgaagctgctgaagcacaagaccctgaagatctgtgccaaccactacatcacccccatgatggagctgaagcccaatgccggcagtgaccgggcctgggtgtggaacacccatgctgactttgctgatgagtgccccaagccagagctgctggccatccgcttcctgaatgctgagagcgagccccgggccctgggcacctgcctgacctggggcagccctgcctggcagagaggaggcctgtgtgccaccaatgctgtggccttctggggcgagggcgctgtgactggaaaatgtgtggtgtgggccgccctgccctgctgcctgggcgccatgccccggctgaagccctag

SEQ ID NO: 21518 - DNA, 369 bp, Artificial Sequence; identical to SEQ ID NO: 21112
  Description of Artificial Sequence: Synthetic coding sequence

SEQ ID NO: 21519 - DNA, 1383 bp, Artificial Sequence
  Description of Artificial Sequence: Synthetic coding sequence
atggccagcctgctgcagagcgacagagtgctgtacctggtgcagggcgagaagaaggtgcgggcccccctgagccagctgtacttctgccgctactgcagcgagctgcggagcctggagtgtgtgtcccatgaggtggacagccactactgccccagctgcctggagaacatgcccagcgctgaggccaagctgaagaagaacagatgtgccaactgctttgactgccccggctgcatgcacaccctgagcacccgggccaccagcatcagcacccagctgcctgatgatcctgccaagaccaccatgaagaaggcctactacctggcctgtggcttctgccgctggaccagcagagatgtgggcatggctgacaagtctgtggccagcggcggctggcaggagcctgagaacccccacacccagaggatgaacaagctgattgagtactaccagcagctggcccagaaggagaaggtggagcgggacaggaagaagctggccaggagaagaaactacatgcccctggccttcagtgacaagtatggcctgggcacccggctgcagaggcccagggctggggccagcatcagcaccctggccggcctgagcctgaaggagggggaggaccagaaggagatcaagattgagcccgcccaggccgtggatgaggtggagcccctgcctgaggactactacaccaggcctgtgaacctgacagaggtgaccaccctgcagcagaggctgctgcagcctgacttccagcctgtgtgtgccagccagctgtaccccaggcacaagcacctgctgatcaagaggagcctgcgctgcaggaaatgtgagcacaacctgagcaagccagagttcaaccccaccagcatcaagttcaagatccagctggtggccgtgaactacatccctgaggtgcgcatcatgagcatccccaacctgcgctacatgaaggagagccaggtgctgctgaccctgaccaaccctgtggagaacctgacccacgtgaccctgtttgaatgtgaggagggggaccctgatgacatcaacagcacagccaaggtggtggtgccccccaaggagctggtgctggccggcaaggatgctgctgctgaatatgatgagctggccgagccccaggacttccaggatgatcctgacatcatcgccttcaggaaggccaacaaggtgggcatcttcatcaaggtgaccccccagcgggaggagggggaggtgacagtgtgcttcaagatgaagcatgacttcaagaacctggccgcccccatccggcccatcgaggagagtgaccagggcacagaggtgatctggctgacccagcacgtggagctgagcctgggccccctgctgccctag

SEQ ID NO: 21520 - DNA, 3336 bp, Artificial Sequence
  Description of Artificial Sequence: Synthetic coding sequence
atggagatggatgccccccggccccccagcctggccgtgcctggggccgccagccggcccggccgcctgctggatggcggccacggccggcagcaggtgcaggccctgagcagccagctgctggaggtgatcccagacagcatgaggaagcaggaggtgaggacaggccgggaggccggccagggccatggaacaggcagccctgctgagcaggtgaaggccctgatggacctgctggccggcaagggcagccagggcagccaggccccccaggccctggacaggaccccagatgcccccctgggcccctgcagcaatgacagccgcatccagaggcacaggaaggccctgctgagcaaggtgggcggcggccctgagctgggcggcccctggcaccggctggccagcctgctgctggtggagggcctgacagacctgcagctgcgggagcatgacttcacccaggtggaggccacccggggcggcggccacccagccaggacagtggccctggacaggctcttcctgcccctgagccgggtgtctgtgcccccccgggtgtccatcaccatcggcgtggccggcatgggcaagaccaccctggtgcgccactttgtgcggctgtgggcccacggccaggtgggcaaggacttcagcctggtgctgcccctgaccttccgggacctgaacacccatgagaagctgtgtgccgacaggctcatctgcagcgtcttcccccacgtgggggagcccagcctggccgtggccgtgcctgcccgggccctgctgatcctggatggcctggatgagtgcaggacccccctggacttcagcaacacagtggcctgcacagaccccaagaaggagatccctgtggaccacctgatcaccaacatcatccggggcaacctcttccctgaggtgtccatctggatcaccagccggcccagcgccagcggccagatccctgggggcctggtggacaggatgacagagatccggggcttcaatgaggaggagatcaaggtgtgcctggagcagatgtttcctgaggaccaggccctgctgggctggatgctgagccaggtgcaggccgaccgggccctgtacctgatgtgcaccgtgcctgccttctgccgcctgaccggcatggccctgggccacctgtggaggagcaggacaggcccccaggatgctgagctgtggccacccaggaccctgtgtgagctgtacagctggtacttcaggatggccctgagcggggagggccaggagaagggcaaggccagccccagaattgagcaggtggcccacggcggcaggaagatggtgggcaccctgggccgcctggccttccacggcctgctgaagaagaagtatgtgttctatgagcaggacatgaaggccttcggcgtggacctggccctgctgcagggcgccccctgcagctgcttcctgcagcgggaggagaccctggccagctctgtggcctactgcttcacccacctgagcctgcaggagtttgtggccgccgcctactactatggagccagcagaagagccatctttgacctcttcacagaaagtggagtgtcctggccccggctgggcttcctgacccacttccgctctgctgcccagagggccatgcaggctgaagatggccgcctggatgtgttcctgcgcttcctgagcggcctgctgagcccccgggtgaatgccctgctggccggcagcctgctggcccagggcgagcaccaggcctaccgcacccaggtggccgagctgctgcagggctgcctgcggccagatgctgctgtgtgtgcccgggccatcaacgtgctgcactgcctgcacgagctgcagcacacagagctggcccggtctgtggaggaggccatggagagcggggccctggcccggctgactggacctgcccacagagctgccctggcctacctgctgcaggtgtctgatgcctgtgcccaggaggccaacctgagcctgagcctgagccagggcgtgctgcagagcctgctgccccagctgctgtactgcaggaagctgcggctggacaccaaccagttccaggaccctgtgatggagctgctgggctctgtgctgagcggcaaggactgccgcatccagaagatcagcctggccgagaaccagatcagcaacaagggggccaaggccctggcccggagcctgctggtgaacagaagcctgaccagcctggacctgcggggcaacagcatcggcccccagggcgccaaggccctggctgatgccctgaagatcaacagaaccctgaccagcctgagcctgcagggcaacacagtgagagatgatggagcccgctccatggccgaggccctggccagcaacagaaccctgtccatgctgcacctgcagaagaacagcatcggccccatgggcgcccagaggatggctgacctgaagcagaacagaagcctgaaggagctgatgttcagcagcaacagcattggagatggaggagccaaggccctggccgaggccctgaaggtgaaccagggcctggagagcctggacctgcagagcaacagcatcagtgatgctggggtggccgccctgatgggcgccctgtgcaccaaccagaccctgctgagcctgagcctgagagaaaattccatcagccctgagggcgcccaggccatcgcccacgccctgtgtgccaacagcaccctgaagaacctggacctgacagccaacctgctgcatgaccagggcgcccgggccatcgctgtggccgtgcgggagaacagaaccctgaccagcctgcacctgcagtggaacttcatccaggccggggccgcccaggccctgggccaggccctgcagctgaacagaagcctgaccagcctggacctgcaggagaatgccatcggagatgatggagcctgtgctgtggcccgggccctgaaggtgaacacagccctgacagccctgtacctgcaggtggccagcatcggggccagcggggcccaggtgctgggggaggccctggccgtgaacagaaccctggagatcctggacctgcggggaaatgccatcggcgtggccggggccaaggccctggccaatgccctgaaggtgaacagcagcctgcggcggctgaacctgcaggagaacagcctgggcatggatggagccatctgcatcgccacagccctgagcggcaaccaccggctgcagcacatcaacctgcagggcaaccacatcggggacagcggggccaggatgatcagcgaggccatcaagaccaatgcccccacctgcaccgtggagatgtag

SEQ ID NO: 21521 - DNA, 2424 bp, Artificial Sequence
  Description of Artificial Sequence: Synthetic coding sequence
atgctggagcggcgggccctgctgtggcagcgggaggccggccctggctggggagaccgggcccgggccggcactggaggagctgggggcggctgcggcggggccatggccgagcggggccctgccttctgtggcctgtatgacaccagcagcctgctgcgctactgcaatgatgacaacctgagcggcaccagcggcatggaggtggatgacagagtgtctgccctggagcagaggctgcagctgcaggaggatgagctggccgtgctgaaggccgccctggctgatgccctgcggcggctgcgggcctgtgaggagcagggcgccgccctgcgggcccggggcacccccaagggccgggccccaccccggctgggcaccacagcctctgtgtgccagctgctgaagggcctgcccaccaggacccccctgaatggaagtggccccccaagaagagtgggcggctacgccaccagccccagcagccccaagaaggaggccaccagcggccgcagctctgtgcggcgctacctgagccctgagcggctggcctctgtgagaagagaggaccccaggagcaggaccaccagcagcagcagcaactgcagcgccaagaaggagggcaagaccaaggaggtgatcttctctgtggaggatggctctgtgaagatgttcctgcggggccggcctgtgcccatgatgatcccagatgagctggcccccacctacagcctggacaccaggtctgagctgcccagctgccgcctgaagctggagtgggtgtatggctaccggggccgggactgccgggccaacctgtacctgctgcccaccggggagatcgtgtactttgtggcctctgtggccgtgctgtacagcgtggaggagcagaggcagaggcactacctgggccacaatgatgacatcaagtgcctggccatccacccagacatggtgaccatcgccaccggccaggtggccggcaccaccaaggagggcaagcccctgccccctcatgtgcgcatctgggacagcgtgtccctgagcaccctgcacgtgctgggcctgggcgtgtttgacagagctgtgtgctgcgtgggcttcagcaagagcaatggaggcaacctgctgtgtgctgtggatgagagcaatgaccacatgctgtctgtgtgggactgggccaaggagaccaaggtggtggatgtgaagtgcagcaatgaggccgtgctggtggccaccttccaccccacagaccccaccgtgctgatcacctgtgggaagagccacatctacttctggaccctggagggcggcagcctgagcaagaggcagggcctgtttgagaagcatgagaagcccaagtatgtgctgtgtgtgaccttcctggagggcggagatgtggtgactggagacagcggcggcaacctgtatgtgtggggcaaaggaggcaaccgcatcacccaggccgtgctgggcgcccatgatggaggagtgtttggcctgtgtgccctgagagatggcaccctggtgtctgggggcggcagaaattccatcctgcagggctctgtgcacacaggcttcagcctgctggtgcagggccacgtggaggagctgtggggcctggccacccaccccagccgggcccagtttgtgacctgtggccaggacaagctggtgcacctgtggagcagtgacagccaccagcccctgtggagccgcatcatcgaggaccctgcccggtctgctggcttccaccccagcggctctgtgctggccgtgggcaccgtgacaggccgctggctgctgctggacacagagacccatgacctggtggccatccacacagatggaaatgagcagatctctgtggtgtccttctccccagatggagcctacctggccgtgggcagccatgacaacctggtgtatgtgtacacagtggaccagggcggcaggaaggtgtcccggctgggcaaatgttctggccacagcagcttcatcacccacctggactgggcccaggacagcagctgctttgtgaccaacagcggggactatgagatcctgtactgggaccctgccacctgcaagcagatcaccagcgcagatgctgtgaggaacatggagtgggccacagccacctgtgtgctgggctttggagtgtttggcatctggagcgagggcgcagatggaacagacatcaatgctgtggcccggagccatgatggcaagctgctggccagcgcagatgactttgggaaggtgcacctgttctcctacccctgctgccagccccgggccctgagccacaagtatggaggccacagcagccacgtgaccaacgtggccttcctgtgggatgacagcatggccctgaccaccggcggcaaggacacctctgtgctgcagtggagggtggtgtag

SEQ ID NO: 21522 - DNA, 1413 bp, Artificial Sequence
  Description of Artificial Sequence: Synthetic coding sequence
atggaggagaccatcaaggacccccccaccagcgctgtgctgctggaccactgccacttcagccaggtgatcttcaacagcgtggagaagttctacatccctggaggagatgtgacctgccactacaccttcacccagcacttcatccccaggaggaaggactggattggcatcttccgggccttcaagtgcttccaggacaagctggagcaggagctgctgaagtggaggagccagggccagaagctgcaggtgggctggaagaccacccgggagtactacaccttcatgtgggtgaccctgcccatcgacctgaacaacaagagcgccaagcagcaggaggtgcagttcaaggcctactacctgcccaaggatgatgagtactaccagttctgctacgtggatgaagatggagtggtgcggggggccagcatccccttccagttccggccagaaaatgaggaggacatcctggtggtgaccacccagggcgaggtggaggagattgagcagcacaacaaggagctgtgcaaggagaaccaggagctgaaggacagctgcatcagcctgcagaagcagaacagcgacatgcaggccgagctgcagaagaagcaggaggagctggagaccctgcagagcatcaacaagaagctggagctgaaggtgaaggagcagaaggactactgggagacagagctgctgcagctgaaggagcagaaccagaagatgagcagtgaaaatgagaagatgggcatccgggtggaccagctgcaggcccagctgagcacccaggagaaggagatggagaagctggtgcagggcgaccaggacaagacagagcagctggagcagctgaagaaggaaaatgaccacctgttcctgagcctgacagagcagaggaaggaccagaagaagctggagcagacagtggagcagatgaagcagaatgagaccacagccatgaagaagcagcaggagctgatggatgagaactttgacctgagcaagaggctgtctgaaaatgagatcatctgcaatgccctgcagaggcagaaggagcggctggagggggagaatgacctgctgaagcgggagaacagccggctgctgagctacatgggcctggacttcaacagcctgccctaccaggtgcccaccagtgatgagggcggggcccggcagaaccctggcctggcctacggcaacccctacagcggcatccaggagagcagcagccccagccccctgagcatcaagaagtgccccatctgcaaggcagatgacatctgtgaccacaccctggagcagcagcagatgcagcccctgtgcttcaactgccccatctgtgacaagatcttccctgccacagagaagcagatctttgaggaccacgtgttctgccacagcctgtag

SEQ ID NO: 21523 - DNA, 1023 bp, Artificial Sequence
  Description of Artificial Sequence: Synthetic coding sequence
atgagcaagacccatgaccaccagctggagagcagcctgagccctgtggaggtgtttgccaagaccagcgccagcctggagatgaaccagggcgtgtctgaggagcgcatccacctgggcagcagccccaagaagggcggcaactgtgacctgagccaccaggagcggctgcagagcaagagcctgcacctgagcccccaggagcagagcgccagctaccaggaccggcggcagagctggaggcgggcctccatgaaggagaccaacagaaggaagagcctgcaccccatccaccagggcatcacagagctgagccgcagcatctctgtggacctggccgagagcaagaggctgggctgcctgctgctgagcagcttccagttcagcatccagaagctggagcccttcctgcgggacaccaagggcttcagcctggagagcttccgggccaaggccagcagcctgtctgaggagctgaagcactttgctgatggcctggagacagatggcaccctgcagaagtgctttgaggacagcaatggcaaggccagtgacttcagcctggaggcctctgtggccgagatgaaggagtacatcaccaagttcagcctggagcggcagacctgggaccagctgctgctgcactaccagcaggaggccaaggagatcctgagccggggcagcacagaggccaagatcacagaggtgaaggtggagcccatgacctacctgggcagcagccagaatgaggtgctgaacaccaagccagactaccagaagatcctgcagaaccagagcaaggtgtttgactgcatggagctggtgatggatgagctgcagggctctgtgaagcagctgcaggccttcatggatgagagcacccagtgcttccagaaggtgtctgtgcagctgggcaagaggtccatgcagcagctggaccccagccctgccaggaagctgctgaagctgcagctgcagaaccccccagccatccacggcagcggcagcggcagctgccagtag

SEQ ID NO: 21524 - DNA, 522 bp, Artificial Sequence
  Description of Artificial Sequence: Synthetic coding sequence
atgacccacgtggccagccagtttgccagcagctatgtgttctactggagggactactttgaggaccagcccctgctgtacccacctggctttgatggccgggtggtggtgtaccccagcaaccagaccctgaaggactacctgtcctggaggcaggccgactgccacatcaacaacctgtacaacacagtgttctgggccctgatccagcagagcggcctgacccctgtgcaggcccagggccgcctgcagggcaccctggccgctgacaagaatgagatcctcttcagcgagttcaacatcaactacaacaatgagctgcccatgtacaggaagggcaccgtgctgatctggcagaaggtggatgaggtgatgaccaaggagatcaagctgcccacagagatggagggcaagaagatggctgtgaccaggaccaggaccaagcctgtgcccctgcactgtgacatcattggagatgccttctggaaggagcaccctgagatcctggatgaggacagctag

SEQ ID NO: 21525 - DNA, 285 bp, Artificial Sequence
  Description of Artificial Sequence: Synthetic coding sequence
atggagatggagagcgctgctgccagcacccgcttccaccagccccacatggagaggaagatgtctgccatggcctgtgagatcttcaatgagctgcggctggagggcaagctgtgtgatgtggtgatcaaggtgaatggatttgagttcagcgcccacaagaacatcctgtgcagctgcagcagctacttccgggccctcttcaccagcggctggaacaacacagagaagaaggtgtacaacatccctggcatcagcccagacatgatgaagctgatcatctag

SEQ ID NO: 21526 - DNA, 1572 bp, Artificial Sequence; identical to SEQ ID NO: 18903
  Description of Artificial Sequence: Synthetic coding sequence

SEQ ID NO: 21527 - DNA, 372 bp, Artificial Sequence
  Description of Artificial Sequence: Synthetic coding sequence
atgggcactggagacttcatctgcatctccatgactggaggagccccctggggcttccggctgcagggcggcaaggagcagaagcagcccctgcaggtggccaagatccggaaccagagcaaggccagcggcagcggcctgtgtgaaggagatgaggtggtgtccatcaatggaaacccctgtgccgacctgacctacccagaggtgatcaagctgatggagagcatcacagacagcctgcagatgctgatcaagagaagagtgggcgcccccttcctgttcctggaggaccagagccacccccccttcctgcacctgctgggctacaccagcctgctgattgtgaccctggtgaaccagcccatggactag

SEQ ID NO: 21528 - DNA, 1146 bp, Artificial Sequence; identical to SEQ ID NO: 20186
  Description of Artificial Sequence: Synthetic coding sequence

SEQ ID NO: 21529 - DNA, 615 bp, Artificial Sequence
  Description of Artificial Sequence: Synthetic coding sequence
atggtgatggccgagggcacagctgtgctgcggaggaacagacctggcaccaaggcccagtacatccagcagaacatccgggctgactgcagcaacatcgacaagatcctggagcccccagagggccaggatgagggcgtgtggaagtatgagcacctgcggcagttctgcctggagctgaatggcctggccgtgaagctgcagagcgagtgccacccagacacctgcacccagatgacagccacagagcagtggatcttcctgtgtgccgcccacaagacccccaaggaatgtcctgccatcgactacaccaggcacaccctggatggagctgcctgcctgctgaacagcaacaagtacttccccagccgggtgtccatcaaggagagctctgtggccaagctgggctctgtgtgccgccgcatctaccgcatcttcagccacgcctacttccaccaccggcagatctttgatgaatatgaaaatgagaccttcctgtgccaccgcttcaccaagtttgtgatgaagtacaacctgatgagcaaggacaacctgattgtgcccatcctggaggaggaggtgcagaacagcgtgtctggagagagcgaggcctag

SEQ ID NO: 21530 - DNA, 1293 bp, Artificial Sequence
  Description of Artificial Sequence: Synthetic coding sequence
atggccgccaacctgagcagaaatggacctgccctgcaggaggcctacgtgcgggtggtgacagagaagagccccacagactgggccctcttcacctatgagggcaacagcaatgacatccgggtggccggcactggagagggcggcctggaggagatggtggaggagctgaacagcggcaaggtgatgtatgccttctgccgggtgaaggaccccaacagcggcctgcccaagtttgtgctgatcaactggacaggagagggcgtgaatgatgtgaggaagggggcctgtgccagccacgtgtccaccatggccagcttcctgaagggggcccacgtgaccatcaatgcccgggcagaagaagatgtggagcctgagtgcatcatggagaaggtggccaaggccagcggggccaactacagcttccacaaggagagcggccgcttccaggatgtgggcccccaggcccctgtgggctctgtgtaccagaagaccaatgctgtgtctgagatcaagagggtgggcaaggacagcttctgggccaaggccgagaaggaggaggagaacagaaggctggaggagaagagaagagctgaggaggcccagaggcagctggagcaggagcggcgggagcgggagctgcgggaggccgcccggcgggagcagcgctaccaggagcagggcggggaggccagcccccagaggacctgggagcagcagcaggaggtggtgtccaggaacagaaatgagcaggagagcgctgtgcacccccgggagatcttcaagcagaaggagcgggccatgagcaccaccagcatcagcagcccccagcccgggaagctgcggagccccttcctgcagaagcagctgacccagcctgagacccacttcggccgggagcctgctgctgccatcagccggcccagggctgacctgcctgctgaggagcccgcccccagcaccccaccctgcctggtgcaggccgaggaggaggccgtgtatgaggagcccccagagcaggagaccttctatgagcagccccccctggtgcagcagcagggcgccggcagcgagcacatcgaccaccacatccagggccagggcctgagcggccagggcctgtgtgcccgggccctgtatgactaccaggccgcagatgacacagagatcagctttgatcctgaaaatctcatcactggaattgaggtgattgatgagggctggtggaggggctacggcccagatggccacttcggcatgtttcctgccaactacgtggagctgattgaatag

SEQ ID NO: 21531 - DNA, 3189 bp, Artificial Sequence
  Description of Artificial Sequence: Synthetic coding sequence
atggtgagcagcgcccagatgggcttcaacctgcaggccctgctggagcagctgagccaggatgagctgagcaagttcaagtacctgatcaccaccttcagcctggcccacgagctgcagaagatcccccacaaggaggtggacaaggcagatggcaagcagctggtggagatcctgaccacccactgtgacagctactgggtggagatggccagcctgcaggtgtttgagaagatgcacaggatggacctgtctgagcgggccaaggatgaggtgcgggaggccgccctgaagagcttcaacaagaggaagcccctgagcctgggcatcaccaggaaggagcggccccccctggatgtggatgagatgctggagcgcttcaagacagaggcccaggccttcacagagaccaagggaaatgtcatctgcctgggcaaggaggtgttcaagggcaagaagccagacaaggacaaccgctgccgctacatcctgaagaccaagttccgggagatgtggaagtcctggccaggggacagcaaggaggtgcaggtgatggccgagcgctacaagatgctgatccccttcagcaacccccgggtgctgcccggccccttctcctacacagtggtgctgtatggccctgctggcctgggcaagaccaccctggcccagaagctgatgctggactgggccgaggacaacctgatccacaagttcaagtatgccttctacctgagctgccgggagctgagccggctgggcccctgcagctttgctgagctggtgttccgggactggccagagctgcaggatgacatcccccacatcctggcccaggccaggaagatcctgtttgtgattgatggctttgatgagctgggcgccgcccctggggccctgattgaggacatctgtggggactgggagaagaagaagcctgtgcctgtgctgctgggcagcctgctgaacagagtgatgctgcccaaggccgccctgctggtgaccacccggccccgggccctgcgggacctgcgcatcctggccgaggagcccatctacatccgggtggagggcttcctggaggaggaccggcgggcctacttcctgcggcactttggagatgaggaccaggccatgagggcctttgagctgatgaggagcaatgctgccctcttccagctgggcagcgccccagctgtgtgctggatcgtgtgcaccaccctgaagctgcagatggagaagggggaggaccctgtgcccacctgcctgaccaggacaggcctcttcctgcgcttcctgtgcagccgcttcccccagggcgcccagctgcggggggccctgcggaccctgagcctgctggccgcccagggcctgtgggcccagacctctgtgctgcaccgggaggacctggagcggctgggcgtgcaggagagtgacctgcggctcttcctggatggagacatcctgcggcaggacagagtgtccaagggctgctacagcttcatccacctgtccttccagcagttcctgacagccctcttctacaccctggagaaggaggaggaggaggacagagatggccacacctgggacattggagatgtgcagaagctgctgagcggcgtggagcggctgaggaacccagacctgatccaggccggctactacagctttggcctggccaatgagaagagggccaaggagctggaggccaccttcggctgcaggatgagcccagacatcaagcaggagctgctgcgctgtgacatcagctgcaagggcggccacagcacagtgacagacctgcaggagctgctgggctgcctgtatgagagccaggaggaggagctggtgaaggaggtgatggcccagttcaaggagatcagcctgcacctgaatgctgtggatgtggtgcccagcagcttctgtgtgaagcactgcaggaacctgcagaagatgagcctgcaggtgatcaaggagaacctgcctgaaaatgtgacagccagcgagagtgatgctgaggtggagaggagccaggatgaccagcacatgctgcccttctggacagacctgtgcagcatcttcggcagcaacaaggacctgatgggcctggccatcaatgacagcttcctgagcgccagcctggtgcgcatcctgtgtgagcagatcgccagtgacacctgccacctgcagagggtggtgttcaagaacatcagccctgcagatgcccacaggaacctgtgcctggccctgcggggccacaagacagtgacctacctgaccctgcagggcaatgaccaggatgacatgtttcctgccctgtgtgaggtgctgcggcaccctgagtgcaacctgcgctacctgggcctggtgtcctgcagcgccaccacccagcagtgggccgacctgagcctggccctggaggtgaaccagagcctgacctgtgtgaacctgagtgacaatgagctgctggatgaaggagccaagctgctgtacaccaccctgcggcaccccaagtgcttcctgcagaggctgagcctggagaactgccacctgacagaggccaactgcaaggacctggccgctgtgctggtggtgtcccgggagctgacccacctgtgcctggccaagaaccccatcggcaacacaggagtgaagttcctgtgtgagggcctgcgctacccagagtgcaagctgcagaccctggtgctgtggaactgtgacatcaccagtgatggctgctgtgacctgaccaagctgctgcaggagaagagcagcctgctgtgcctggacctgggcctgaaccacatcggcgtgaagggcatgaagttcctgtgtgaggccctgaggaagcccctgtgcaacctgcgctgcctgtggctgtggggctgcagcatcccccccttcagctgtgaggacctgtgcagcgccctgagctgcaaccagagcctggtgaccctggacctgggccagaaccccctgggcagcagtggagtgaagatgctgtttgagaccctgacctgcagcagcggcaccctgcggaccctgcggctgaagattgatgacttcaatgatgagctgaacaagctgctggaggagattgaggagaagaacccccagctgatcatcgacacagagaagcaccacccctgggccgagcggcccagcagccatgacttcatgatctag

SEQ ID NO: 21532 - DNA, 390 bp, Artificial Sequence; identical to SEQ ID NO: 19988
  Description of Artificial Sequence: Synthetic coding sequence

SEQ ID NO: 21533 - DNA, 516 bp, Artificial Sequence
  Description of Artificial Sequence: Synthetic coding sequence
atggaggtggccgagcccagcagccccacagaggaggaggaggaggaggaggagcacagcgctgagccccggcccaggaccaggagcaaccctgagggcgcagaagatagagctgtgggcgcccaggcctctgtgggcagccgctctgagggggagggggaggccgccagcgcagatgatggcagcctgaacaccagcggggccggccccaagtcctggcaggtgcccccaccagcccctgaggtgcagatccgcaccccccgggtgaactgcccagagaaggtgatcatctgcctggacctgtctgaggagatgagcctgcccaagctggagagcttcaacggccagcagaagacagagctgcctgtgacagaaaatgtgcagaccatccccccaccctacgtggtgaggaccatcctggtgtacagcaggcctccctgccagccccagttcagcctgacagagcccatgaaggtgggggaggcctgggagcgggagggctgcctgcagccctag

SEQ ID NO: 21534 - DNA, 1446 bp, Artificial Sequence; identical to SEQ ID NO: 21094
  Description of Artificial Sequence: Synthetic coding sequence

SEQ ID NO: 21535 - DNA, 1986 bp, Artificial Sequence
  Description of Artificial Sequence: Synthetic coding sequence
atgaacacaggccgggacagccagagcccagacagcgcctggaggagctacaatgatggcaaccaggagaccctgaatggagatgccacctacagcagcctggccgccaagggcttccgctctgtgcggcccaacctgcaggacaagaggagccccacccagagccagatcaccgtgaatggaaattctggaggagctgtgagccccatgagctactaccagaggcccttcagccccagcgcctacagcctgcctgccagcctgaacagcagcatcgtgatgcagcacggcaccagcctggacagcacagacacctacccccagcacgcccagagcctggatggcaccaccagcagcagcatccccctgtaccgcagcagcgaggaggagaagagggtgaccgtcatcaaggccccccactacccaggcatcggccctgtggatgagagcggcatccccacagccatccgcaccaccgtggaccggcccaaggactggtacaagaccatgttcaagcagatccacatggtgcacaagccagatgatgacacagacatgtacaacaccccctacacctacaatgccggcctgtacaaccccccctacagcgcccagagccaccctgctgccaagacccagacctaccggcccctgagcaagagccacagcgacaacagccccaatgccttcaaggatgccagcagccctgtgcccccacctcatgtgcccccacctgtgccccccctgcggccccgggacaggagcagcacagagaagcatgactgggaccccccagacaggaaggtggacaccaggaagttccgctctgagcccaggagcatctttgaatatgagcccgggaagagcagcatcctgcagcacgagcggcccccacccaagaagcccctggactatgtgcaggaccacagcagtggagtcttcaatgaggccagcctgtaccagagcagcattgacaggagcctggagcggcccatgagcagcgcctccatggccagtgacttcaggaagaggaggaagtctgagcctgctgtgggccccccccggggcctgggggaccagagcgccagcaggaccagccctggccgggtggacctgcccggcagcagcaccaccctgaccaagagcttcaccagcagcagccccagcagccccagccgggccaaggaccgggagagccccaggagctacagcagcaccctgacagacatgggccgcagcgccccccgggagcggcggggcaccccagagaaggagaagctgcctgccaaggctgtgtatgacttcaaggcccagaccagcaaggagctgtccttcaagaagggggacacagtgtacatcctgaggaagattgaccagaactggtatgaaggagagcaccacggccgggtgggcatcttccccatctcctatgtggagaagctgaccccacctgagaaggcccagcctgcccggcccccacctccagcccagcccggggagattggagaggccatcgccaagtacaacttcaatgctgacaccaacgtggagctgagcctgaggaagggggacagagtcatcctgctgaagagggtggaccagaactggtatgagggcaagatccctggcaccaaccggcagggcatcttccctgtgtcctatgtggaggtggtgaagaagaacaccaagggagctgaggactacccagacccccccatcccccacagctacagcagtgaccgcatccacagcctgagcagcaacaagccccagaggcctgtgttcacccatgagaacatccagggcggcggggagcccttccaggccctgtacaactacaccccaagaaatgaagatgagctggagctgcgggagagtgatgtgattgatgtgatggagaagtgtgatgatggctggtttgtgggcaccagcaggaggaccaagttcttcggcaccttccctggcaactacgtgaagaggctgtag

SEQ ID NO: 21536 - DNA, 483 bp, Artificial Sequence; identical to SEQ ID NO: 20009
  Description of Artificial Sequence: Synthetic coding sequence

SEQ ID NO: 21537 - DNA, 717 bp, Artificial Sequence
  Description of Artificial Sequence: Synthetic coding sequence
atggactgccgggagatggacctgtatgaggactaccagagcccctttgattttgatgctggggtgaacaagagctacctgtacctgagccccagcggcaacagcagccccccaggcagccccaccctgcagaagtttggcctgctgaggacagatcctgtgcctgaggagggagaagatgtggccgccaccatcagcgccacagagaccctgtctgaggaggagcaggaggagctgcggcgggagctggccaaggtggaggaggagatccagaccctgagccaggtgctggccgccaaggagaagcacctggccgagatcaagaggaagctgggcatcaacagcctgcaggagctgaagcagaacatcgccaagggctggcaggatgtgacagccaccagcgcctacaagaagaccagcgagaccctgagccaggccggccagaaggccagcgctgccttcagctctgtgggcagcgtcatcaccaagaagctggaggatgtgaacatccgcagcatccagcacagcatctccatgcctgccatgaggaacagccccaccttcaagagctttgaggagaaggtggagaacctgaagagcaaggtgggcggcaccaagccagctggaggagactttggagaggtgctgaacagcgctgccaatgccagcgccaccaccacagagcccctgcctgagaagacccaggagagcctgtag

SEQ ID NO: 21538 - DNA, 108 bp, Artificial Sequence
  Description of Artificial Sequence: Synthetic coding sequence
atgcagaccagcagcagccgctctgtgcacctgtctgagtggcagaagaactactttgccatcaccagcggcatctgcaccggccccaaggcagatgcctacagatag

SEQ ID NO: 21539 - DNA, 327 bp, Artificial Sequence
  Description of Artificial Sequence: Synthetic coding sequence
atgacccggggcaaccagcgggagctggcccggcagaagaacatgaagaagcagagcgacagcgtgaagggcaagagaagagatgatggcctgtctgctgctgccaggaagcagagcgccatcaccagcagcaggaacttcctgtacccagcctacgtgtacttccccagctctgtgcccagcccccccaggaagtacacccagacctactatgctgctgtgcctgctggctggtggggcagcggcggcggccctgccacccagcctgctgctgggggccgctggaggttcctgcacatcctgggcacccagccccagagccactag

SEQ ID NO: 21540 - DNA, 846 bp, Artificial Sequence
  Description of Artificial Sequence: Synthetic coding sequence
atgggcgccggcaacctgccccccatcacccaggaggaggccctgcacatcctgggcttccagcccccatttgaggacatccgcttcggccccttcaccggcaacaccaccctgatgcgctggttccggcagatcaatgaccacttccacgtgaagggctgcagctatgtgctgtacaagccccacggcaagaacaagacagctggggagacagccagcggggccctgagcaagctgacccggggcctgaaggatgagagcctggcctacatctaccactgccagaaccactacttctgccccatcggctttgaggccacccctgtgaaggccaacaaggccttcagccggggccccctgagcccccaggaggtggagtactggatcctgattggagagagcagcaggaagcacccagccatccactgcaagaagtgggccgacatcgtgacagacctgaacacccagaaccctgagtacctggacatccgccacctggagcggggcctgcagtacaggaagaccaagaagcccaccttcttcagcagccaggtgggcggcaacctgcactgcatcatcgccttccagaggctgaactggcagagatttggcctgtggaacttccccttcggcaccatccggcaggagagccagccccccacccacgcccagggcatcgccaagtctgagagcgaggacaacatcagcaagaagcagcacggccgcctgggccgctccttcagcgccagcttccaccaggacagcgcctggaagaagatgagcagcatccacgagaggagaaattctggctaccagggctacagcgactatgatggaaatgactag

SEQ ID NO: 21541 - DNA, 213 bp, Artificial Sequence
  Description of Artificial Sequence: Synthetic coding sequence
atgagggccctgactgtgcagagggtgaagtttgccatggacctgcccctgctgaagagagctggccaggacctggccgagaagaccaagaactttgtgagccgcagcctggtgattggagaggtgctgtccatggctgacatggccaccggggtgaagtgtggcatcatctactggctgtttggaggagccatccggaacctgggcagctag

SEQ ID NO: 21542 - DNA, 1644 bp, Artificial Sequence; identical to SEQ ID NO: 19587
  Description of Artificial Sequence: Synthetic coding sequence

SEQ ID NO: 21543 - DNA, 489 bp, Artificial Sequence
  Description of Artificial Sequence: Synthetic coding sequence
atgagctacaactgctgcagcaggaacttcagcagctgcagccatggaggctacctgcactacccaggcagcagctgtggcagcagctaccccagcaacctggtgtacagcacagacctgtgcagccccagcacctgccagctgggcagcagcctgtaccggggctgccaggagacctgctggaggcccaacagctgccagaccttctgctactaccccaggacccacatgctgtgcaacagctgcctgaccatgcacgtgggcagccggggcttcggcagcaacagctgctgcagcctgagctgtggcagccgcagctgcagcagcctgggctgcggcagcaatggcttccgctacctgaactaccgcatccacaccagccccagccagagctaccgcagccgcttctgccaccccatctacttccccccccggcgctggttccacagcagctgctaccagcccttctgccgcagcggcttctactag

SEQ ID NO: 21544 - DNA, 495 bp, Artificial Sequence
  Description of Artificial Sequence: Synthetic coding sequence
atgttcatctccttctatgacttcaagaacatcccccaggacagccgctgtgatggccagctgttcatcaatggaagaaacaacaagaacaacagcatcagcctgtacttccagggcggcctgcggcatgccagcgccagcatcggcggcagcgaggcctaccgccacatgaagtttgaaggaggagtgcaccgggtgcagagggtgcccaagacagagaagcagggccgggtgcacaccagcaccatgacagtggccatcctgccccagcccacagagatcaacctggtgatcaaccccaaggacctgagaattgacaccaagagggccagcggggccggcggccagcacgtgaacaccacagattctgctgtgagaattgtgcacctgcccaccggggtggtgtctgagtgccagcaggagaggagccagctgaagaacaaggagctggccatgaccaagctgcgggccaagctgtacagcatgcacctgtag

SEQ ID NO: 21545 - DNA, 2166 bp, Artificial Sequence
  Description of Artificial Sequence: Synthetic coding sequence
atggaggaggagctgaagtgccctgtgtgtggcagcctcttccgggagcccatcatcctgccctgcagccacaacgtgtgcctgccctgtgcccggaccatcgctgtgcagaccccagatggcggcagcgctgctgggggcctgggcggcggggccggcggcggcggggaccatgctgacaagctgagcctgtacagcgagacagacagcggctacggcagctacacccccagcctgaagagccccaatggagtgcgggtgctgcccatggtgcctgcccctcctggcagcagcgctgctgctgcccggggagctgcctgcagcagcctgagcagcagcagcagcagcatcacctgcccccagtgccacaggtctgccagcctggaccaccggggcctgcggggcttccagaggaaccggctgctggaggccatcgtgcagcgctaccagcagggcagaggagctgtgcccggcaccagcgctgctgctgctgtggccatctgccagctgtgtgacaggaccccacctgagcctgctgccaccctgtgtgagcagtgtgatgtgctgtactgcagcgcctgccagctgaagtgccaccccagccggggcccctttgccaagcaccggctgggcgcccccagcggcggcggcggctgcaagagccctgggggcgctggggccggggccaccggcggcagcacagccaggaagttccccacctgcccagagcacgagatggagaactacagcatgtactgtgtgtcctgcaggacccctgtgtgctacctgtgcctggaggagggcagacatgccaagcatgaggtgaagcccctgggcgccatgtggaagcagcacaaggcccagctgagccaggccctgaatggagtgtctgacaaggccaaggaggccaaggagttcctggtgcagctgaagaacatcctgcagcagatccaggagaatggcctggactatgaggcctgcctggtggcccagtgtgatgccctggtggatgccctgacccggcagaaggccaagctgctgaccaaggtgaccaaggagcgggagcacaagctgaagatggtgtgggaccagatcaaccactgcaccctgaagctgcggcagagcacaggcctgatggagtactgcctggaggtgatcaaggaaaatgaccccagcggcttcctgcagatcagtgatgccctgatcaagagggtgcaggtgtcccaggagcagtgggtgaagggggccctggagcccaaggtgtctgctgagtttgacctgaccctggacagcgagcccctgctgcaggccatccaccagctggacttcatccagatgaagtgccgggtgccccctgtgcccctgctgcagctggagaagtgctgcaccaggaacaacagcgtgaccctggcctggaggatgccacccttcacccacagccctgtggatggctacatcctggagctggatgatggagctgggggccagttccgggaggtgtatgtgggcaaggagaccctgtgcaccattgatggcctgcacttcaacagcacctacaatgcccgggtgaaggccttcaacagcagtggagtgggcccctacagcaagacagtggtgctgcagaccagtgatgtggcctggttcacctttgaccccaacagcggccaccgggacatcatcctgagcaatgacaaccagacagccacctgcagcagctatgatgacagagtggtgctgggcacagctgccttcagcaagggcgtgcactactgggagctgcacgtggacagatatgacaaccacccagaccctgccttcggcgtggcccgggcctctgtggtgaaggacatgatgctgggcaaggatgacaaggcctgggccatgtatgtggacaacaacagatcctggttcatgcactgcaacagccacaccaacagaacagaaggaggagtgtgcaagggggccaccgtgggcgtgctgctggacctgaacaagcacaccctgaccttcttcatcaatggccagcagcagggccccacagccttcagccacgtggatggagtcttcatgcctgccctgagcctgaacagaaatgtgcaggtgaccctgcacacaggcctggaggtgcccaccaacctgggccggcccaagctgagcggcaactag

SEQ ID NO: 21546 - DNA, 1479 bp, Artificial Sequence
  Description of Artificial Sequence: Synthetic coding sequence
atggacttcctgctgggcaaccccttcagcagccctgtgggccagagaattgagaaggccacagatggcagcctgcagagcgaggactgggccctgaacatggagatctgtgacatcatcaatgaaacagaggagggccccaaggatgccctgcgggctgtgaagaagagaattgtgggcaacaagaacttccacgaggtgatgctggccctgactgtgctggagacctgtgtgaagaactgtggccaccgcttccacgtgctggtggccagccaggactttgtggagagcgtgctggtgaggaccatcctgcccaagaacaacccccccaccatcgtgcatgacaaggtgctgaacctgatccagagctgggcagatgccttccgcagcagcccagacctgactggagtggtgaccatctatgaggacctgcggaggaagggcctggagttccccatgacagacctggacatgctgagccccatccacaccccccagaggacagtgttcaacagcgagacccagagcggccaggacagcgtgggcacagacagcagccagcaggaggacagcggccagcacgccgcccccctgcctgccccacccatcctgagcggggacacccccatcgcccccaccccagagcagatcggcaagctgcggtctgagctggagatggtgtctggaaatgtgcgggtgatgtctgagatgctgacagagctggtgcccacccaggccgagcctgctgacctggagctgctgcaggagctgaacagaacctgccgggccatgcagcagagggtgctggagctgatcccccagatcgccaatgagcagctgacagaggagctgctgattgtgaatgacaacctgaacaacgtgttcctgcggcatgaaagatttgagcgcttcagaacaggccagaccaccaaggcccccagcgaggccgagcctgctgctgacctgattgacatgggccctgaccctgctgccaccggcaacctgagcagccagctggccggcatgaacctgggcagcagctctgtgcgggccggcctgcagagcctggaggccagcggccgcctggaggatgaatttgacatgtttgccctgacccggggcagcagcctggccgaccagaggaaggaggtgaagtatgaggccccccaggccacagatggcctggccggggccctggatgcccggcagcagagcactggagccatccctgtgacccaggcctgcctgatggaggacatcgagcagtggctgagcacagatgtgggcaatgatgctgaggagcccaagggcgtgaccagcgaggagtttgacaagttcctggaggagcgggccaaggctgctgaccggctgcccaacctgagcagccccagcgctgagggccccccaggccccccatctggccctgcccccaggaagaagacccaggagaaggatgatgacatgctgtttgccctgtag

SEQ ID NO: 21547 - DNA, 747 bp, Artificial Sequence; identical to SEQ ID NO: 20797
  Description of Artificial Sequence: Synthetic coding sequence

SEQ ID NO: 21548 - DNA, 21 bp, Artificial Sequence
  Description of Artificial Sequence: Synthetic coding sequence
atgagcagaagacgcttctag

SEQ ID NO: 21549 - DNA, 165 bp, Artificial Sequence
  Description of Artificial Sequence: Synthetic coding sequence
atgtctgagcagggcgacctgaaccaggccatcgccgaggagggcggcacagagcaggagacagccaccccagaaaatggcatcgtgaagtctgagagcctggatgaggaggagaagctggagctgcagaggcggctggaggcccagaaccaggagaggaggtag

SEQ ID NO: 21550 - DNA, 1446 bp, Artificial Sequence; identical to SEQ ID NO: 21094
  Description of Artificial Sequence: Synthetic coding sequence

SEQ ID NO: 21551 - DNA, 312 bp, Artificial Sequence; identical to SEQ ID NO: 19804
  Description of Artificial Sequence: Synthetic coding sequence

SEQ ID NO: 21552 - DNA, 2919 bp, Artificial Sequence
  Description of Artificial Sequence: Synthetic coding sequence
atggagaggatgaactggctgagccggctggccagccggggccctggccaccgcatcccccagggcgccaacctgcagacccctgtgatggctgaccctgagacctgcctgatggtgttcaagaaccactggagccaggtggtgcgcatcctggagcggcagggcccccgggccgcccctgggggcgcagatgacctgtctgctgtgaggaaccacacctaccagatgctgaccctgctggccgaggacagagctgtgcccagcgcccccactggacctggccccctgctggagtttgccctgcacgaggacctgctgaccagggtgctgacctggcagctgcagtgggatgagctgggagatggagtggaggagcggcgggcagagcagctgaagctgtttgagatgctggtgtctgaggcccggcagcccctgctgcggcacggccctgtgcgggaggccctgctgaccctgctggatgcctgtggccggcctgtgcccagcagccctgccctggatgagggcctggtgctgctgctgagccagctgtgtgtgtgtgtggcccaggagcccagcctgctggagttcttcctgcagcccccacctgagcccggggccgccccccggctgctgctcttcagccggctggtgccctttgtgcaccgggagggcaccctgggccagcaggccagagatgccctgctgctgctgatggccctgtctgctggcagccccaccgtgggccgctacatcgctgaccacagctacttctgccctgtgctggccaccggcctgagcgccctgtacagcagcctgcccaggaagattgaggtgcctggagatgactggcactgcctgcggcgggaggactggctgggcgtgcctgccctggccctcttcatgagcagcctggagttctgcaatgctgtgatccaggtggcccaccccctggtgcagaagcagctggtggactacatccacaacggcttcctggtgcctgtgatgggccctgccctgcacaagacctctgtggaggagatgattgccagcacagcctacctggagctgttcctgcggagcatcagcgagcccgccctgctgcggaccttcctgcgcttcctgctgctgcacagacatgacacccacaccatcctggacaccctggtggcccgcatcggcagcaacagccggctgtgcatggtgtccctgagcctcttccgcaccctgctgaacctgagctgtgaagatgtgctgctgcagctggtgctgcgctacctggtgccctgcaaccacgtgatgctgagccagaagccagctgtgagagatgtggacctgtatggccgggctgctgacaagttcctgagcctcatcccccgctgctgccgccaccacgcccccagcccccccaggcctgagcacgcctcctgggcccggggccctggcagccccagcgtggacagcagctctgtgaccaccgtgccccggcccagcacccccagccggctggccctcttcctgcggcagcagagcctgggcggcagcgagagccctggccctgccccctgcagccctggcctgagcgccagccctgccagcagccctggccggcggcccaccccagctgaggagcccggggagctggaggacaactacctggagtacctgcgggaggccaggagaggagtggacagatgtgtgcgggcctgcaggacctggagcgccccctatgatggagagcggcccagccctgagcccagccccttcggcagcaggaccaagaagaggagcctgctgcctgaagaagatagaaataatgtgggggagggggaggaggaggagctgggccggcggggccgggccggcggggccggggagggccctggccacctgcccccaccccagctgaatggagtgcccggctcctggccagagggcgccaagaaggtgcggctggtgcccaaggagggcgctggggagctgctggagggcatcagcgagggcatggccggcctggagggcttcggccaggagctgcgggagctggaggtggccctgagcaatggaggcaccggcagcgagagccccctggagccccccctgcccctggaggaggaggaggcctatgagagcttcacctgccccccagagcccccaggccccttcctgagcagccccctgcggaccctgaaccagctgcccagccagcccttcaccggccccttcatggctgtgctgtttgccaagctggagaacatgctgcagaacagcgtgtatgtgaacttcctgctgaccggcctggtggcccagctggcctgccacccccagcccctgctgcggagcttcctgctgaacaccaacatggtgttccagcccagcgtgaagagcctgctgcaggtgctgggctctgtgaagaacaagattgagaactttgctgccagccaggaggacttccctgccctgctgagcaaggccaagaagtacctgattgcccggggcaagctggactgggccgagggccctgctgctggccctgcccccaggagaagtgaccccctggtgaagagccggcggcccagcctgggggagctgctgctgcggcatgcccacagccccacccgggcccggcaggccgcccagctggtgctgcagcccggcagagatggagctggcctgggcctgagcggcggcagccctggggccagcacccctgtgctgctgacccggggcggggcccctgagcggcagggcgaggccctgcgggtgaagaatgctgtgtactgtgccgtcatcttccctgagttcctgaaggagctggccgccatcagccaggcccatgctgtgaccagccccttcctgctggagaccagcgaggagggcagcggccccctcatcagcggctgcggccccctgaacccctag

SEQ ID NO: 21553 - DNA, 1929 bp, Artificial Sequence; identical to SEQ ID NO: 21382
  Description of Artificial Sequence: Synthetic coding sequence

SEQ ID NO: 21554 - DNA, 1935 bp, Artificial Sequence
  Description of Artificial Sequence: Synthetic coding sequence
atgtctgtgaccctgacctctgtgaagagggtgcagagcagccccaacctgctggccgccggccgggacagccagagcccagattctgcctggaggagctacaatgatggcaaccaggagaccctgaatggagatgccacctacagcagcctggccgccaagggcttccgctctgtgcggcccaacctgcaggacaagaggagccccacccagagccagatcaccgtgaatggaaacagcggcggcgctgtgagccccatgagctactaccagaggcccttcagccccagcgcctacagcctgcctgccagcctgaacagcagcatcgtgatgcagcacggcaccagcctggacagcacagacacctacccccagcacgcccagagcctggatggcaccaccagcagcagcatccccctgtaccgcagcagcgaggaggagaagagggtgaccgtcatcaaggccccccactacccaggcatcggccctgtggatgaaagtggcatccccacagccatccgcaccaccgtggaccggcccaaggactggtacaagaccatgttcaagcagatccacatggtgcacaagccaggcctgtacaaccccccctacagcgcccagagccaccctgctgccaagacccagacctaccggcccctgagcaagagccacagcgacaacagccccaatgccttcaaggatgccagcagccctgtgcccccacctcatgtgcccccacctgtgccccccctgcggccccgggacaggagcagcacagagaagcatgactgggaccccccagacaggaaggtggacaccaggaagttccgctctgagcccaggagcatctttgaatatgagcccgggaagagcagcatcctgcagcacgagaggcctgccagcctgtaccagagcagcattgacaggagcctggagcggcccatgagcagcgcctccatggccagtgacttcaggaagaggaggaagtctgagcctgctgtgggccccccccggggcctgggggaccagagcgccagcaggaccagccctggccgggtggacctgcccggcagcagcaccaccctgaccaagagcttcaccagcagcagccccagcagccccagccgggccaaggaccgggagagccccaggagctacagcagcaccctgacagacatgggccgcagcgccccccgggagcggcggggcaccccagagaaggagaagctgcctgccaaggctgtgtatgacttcaaggcccagaccagcaaggagctgtccttcaagaagggggacacagtgtacatcctgaggaagattgaccagaactggtatgaaggagagcaccacggccgggtgggcatcttccccatctcctatgtggagaagctgaccccacctgagaaggcccagcctgcccggcccccacctccagcccagcctggagagatcggggaggccatcgccaagtacaacttcaatgctgacaccaacgtggagctgagcctgaggaaaggagacagagtcatcctgctgaagagggtggaccagaactggtatgagggcaagatccctggcaccaaccggcagggcatcttccctgtgtcctatgtggaggtggtgaagaagaacaccaagggagctgaggactacccagacccccccatcccccacagctacagcagtgaccgcatccacagcctgagcagcaacaagccccagaggcctgtgttcacccatgagaacatccagggcggcggggagcccttccaggccctgtacaactacaccccaagaaatgaagatgagctggagctgcgggagagtgatgtgattgatgtgatggagaagtgtgatgatggctggtttgtgggcaccagcaggaggaccaagttcttcggcaccttccctggcaactacgtgaagaggctgtag

SEQ ID NO: 21555 - DNA, 294 bp, Artificial Sequence
  Description of Artificial Sequence: Synthetic coding sequence
atgggcaagagctgcaaggtggtggtgtgtggccaggcctctgtgggcaagaccagcatcctggagcagctgctgtatggcaaccacgtggtgggcagcgagatgattgagacccaggaggacatctacgtgggcagcattgaaacagaccggggcgtgcgggagcagattgctgagagcctcttctctgtgtggagctgcagcagaagaaggctgaccaaccccaggaccaggagaagaagccccagctggagcctggccacctctgtgacctaccgcagcagtggagtgtag

SEQ ID NO: 21556 - DNA, 915 bp, Artificial Sequence
  Description of Artificial Sequence: Synthetic coding sequence
atgagcaagacccatgaccaccagctggagagcagcctgagccctgtggaggtgtttgccaagaccagcgccagcctggagatgaaccagggcgtgtctgaggagcgcatccacctgggcagcagccccaagaagggcggcaactgtgacctgagccaccaggagcggctgcagagcaagagcctgcacctgagcccccaggagcagagcgccagctaccaggaccggcggcagagctggaggcgggcctccatgaaggagaccaacagaaggaagagcctgcaccccatccaccagggcatcacagagctgagccgcagcatctctgtggacctggccgagagcaagaggctgggctgcctgctgctgagcagcttccagttcagcatccagaagctggagcccttcctgcgggacaccaagggcttcagcctggagagcttccgggccaaggccagcagcctgtctgaggagctgaagcactttgctgatggcctggagacagatggcaccctgcagaagtgctttgaggacagcaatggcaaggccagtgacttcagcctggaggcctctgtggccgagatgaaggagtacatcaccaagttcagcctggagcggcagacctgggaccagctgctgctgcactaccagcaggaggccaaggagatcctgagccggggcagcacagaggccaagatcacagaggtgaaggtggagcccatgacctacctgggcagcagccagaatgaggtgctgaacaccaagccagactaccagaagatcctgcagaaccagagcaaggtgtttgactgcatggagctggtgatggatgagctgcagggctctgtgaagcagctgcaggccttcatggatgagagcacccagtgcttccagaaggtgtctgtgcagctgtag

SEQ ID NO: 21557 - DNA, 1842 bp, Artificial Sequence; identical to SEQ ID NO: 18580
  Description of Artificial Sequence: Synthetic coding sequence

SEQ ID NO: 21558 - DNA, 1560 bp, Artificial Sequence
  Description of Artificial Sequence: Synthetic coding sequence
atggagggcgtgctgtacaagtggaccaactacctgagcggctggcagccccgctggttcctgctgtgtggcggcatcctgagctactatgacagcccagaagatgcctggaagggctgcaagggcagcatccagatggctgtgtgtgagatccaggtgcacagcgtggacaacaccaggatggacctgatcatccctggagagcagtacttctacctgaaggcccggtctgtggccgagcggcagcgctggctggtggccctgggcagcgccaaggcctgcctgacagacagcaggacccagaaggagaaggagtttgctgagaacacagagaacctgaagaccaagatgtctgagctgcggctgtactgtgacctgctggtgcagcaggtggacaagaccaaggaggtgaccaccaccggggtgagcaacagcgaggagggcattgatgtgggcaccctgctgaagagcacctgcaacaccttcctgaagaccctggaggagtgcatgcagatcgccaatgctgccttcaccagcgagctgctgtaccgcaccccacctggcagcccccagctggccatgctgaagagcagcaagatgaagcaccccatcatccccatccacaacagcctggagcggcagatggagctgagcacctgtgaaaatggcagcctgaacatggagatcaacggggaggaggagatcctgatgaagaacaagaacagcctgtacctgaagtctgctgagattgactgcagcatcagcagcgaggagaacacagatgacaacatcaccgtgcagggcgagatcagaaaagaagatggcatggagaacctgaagaaccacgacaacaacctgacccagagcggcagtgacagcagctgcagccctgagtgcctgtgggaggagggcaaggaggtgatccccaccttcttcagcaccatgaacaccagcttcagtgacatcgagctgctggaggacagcggcatccccacagaggccttcctggccagctgctatgctgtggtgcctgtgctggacaagctgggccccaccgtgtttgcccctgtgaagatggacctggtgggcaacatcaagaaggtgaaccagaagtacatcaccaacaaggaggagttcaccaccctgcagaagatcgtgctgcacgaggtggaggctgatgtggcccaggtgaggaacagcgccacagaggccctgctgtggctgaagaggggcctgaagttcctgaagggcttcctgacagaggtgaagaatggagagaaggacatccagacagccctgaacaatgcctacggcaagaccctgcggcagcaccacggctgggtggtgcggggcgtgtttgccctggccctgcgggccgcccccagctatgaggactttgtggccgccctgactgtgaaggagggggaccaccagaaggaggccttcagcatcggcatgcagagggacctgagcctgtacctgcctgccatggagaagcagctggccatcctggacaccctgtatgaggtgcacggcctggagagtgatgaggtggtgtag

SEQ ID NO: 21559 - DNA, 1446 bp, Artificial Sequence; identical to SEQ ID NO: 21094
  Description of Artificial Sequence: Synthetic coding sequence

SEQ ID NO: 21560 - DNA, 1173 bp, Artificial Sequence
  Description of Artificial Sequence: Synthetic coding sequence
atgtctgctgccaaccctgagacccccaacagcaccatcagccgggaggccagcacccagagcagcagcgctgctgccagccagggctgggtgctgcctgagggcaagatcgtgcccaacacagtgtttgtgggcggcattgatgccaggatggatgaaacagagatcggcagctgcttcggccgctatggctctgtgaaggaggtgaagatcatcaccaacagaactggagtgtccaagggctacggctttgtgtcctttgtgaatgatgtggatgtgcagaagatcgtgggcagccagatccacttccacggcaagaagctgaagctgggccctgccatcaggaagcagaagctgtgtgcccggcacgtgcagccccggcccctggtggtgaaccccccacctccaccccagttccagaatgtgtggaggaaccccaacacagagacctacctgcagccccagatcacccccaaccctgtgacccagcacgtgcaggcctacagcgcctacccccacagccctggccaggtgatcaccggctgccagctgctggtgtacaactaccaggagtaccccacctacccagacagcgccttccaggtgaccaccggctaccagctgcctgtgtacaactaccagcccttccctgcctaccccaggagccccttccaggtgacagctggctaccagctgcctgtgtacaactaccaggccttccctgcctaccccaacagccccttccaggtggccaccggctaccagtttcctgtgtacaactaccagcccttccctgcctaccccagcagccccttccaggtgacagctggctaccagctgcctgtgtacaactaccaggccttccctgcctaccccaacagccccttccaggtggccaccggctaccagtttcctgtgtacaactaccaggccttccctgcctaccccaacagccctgtgcaggtgaccaccggctaccagctgcctgtgtacaactaccaggccttccctgcctaccccaacagcgctgtgcaggtgaccaccggctaccagttccacgtgtacaactaccagatgccaccccagtgccctgtgggggagcagaggaggaacctgtggacagaggcctacaagtggtggtacctggtgtgcctgatccagaggcgggactag

SEQ ID NO: 21561 - DNA, 1143 bp, Artificial Sequence
  Description of Artificial Sequence: Synthetic coding sequence
atggagaagaagaagatggtgacccagggcaaccaggagcccaccaccaccccagatgccatggtgcagcccttcaccaccatccccttccccccaccaccccagaatggcatccccacagaatatggagtgccccacacccaggactatgccggccagacaggagagcacaacctgaccctgtatggcagcacccaggcccacggggagcagagcagcaacagccccagcacccagaatggcagcctgaccacagaaggaggagcccagacagatggccagcagagccagacccagagcagcgagaacagcgagagcaagagcacccccaagaggctgcacgtgagcaacatccccttccgcttccgggaccctgacctgcggcagatgtttggccagtttgggaagatcctggatgtggagatcatcttcaatgaaagaggcagcaagggcttcggctttgtgacctttgagaacagcgcagatgctgaccgggcccgggagaagctgcatggaacagtggtggagggcaggaagattgaggtgaacaatgccacagcccgggtgatgaccaacaagaagatggtgaccccctatgccaacggctggaagctgagccctgtggtgggcgctgtgtatggccctgagctgtatgctgccagcagcttccaggctgatgtgtccctgggcaatgatgctgctgtgcccctgagcggccggggcggcatcaacacctacatccccctcatcagcctgcccctggtgcccggcttcccctaccccacagctgccaccacagctgctgccttccggggggcccacctgcggggccggggccgcacagtgtatggagctgtgcgggctgtgcccccaacagccatcccagcctacccaggagtggtgtaccaggacggcttctatggagctgacctgtatggaggctacgccgcctaccgctatgcccagcctgccacagccacagctgccacagctgctgctgctgctgctgctgcctacagtgatggctacggccgggtgtacacagctgacccctaccacgccctggccccagctgccagctatggagtgggcgctgtggccagcctgtaccggggcggctacagcagatttgccccctactag

SEQ ID NO: 21562 - DNA, 1614 bp, Artificial Sequence
  Description of Artificial Sequence: Synthetic coding sequence
atggaccctggagatgctgccatcctggagagcagcctgcgcatcctgtaccgcctgtttgagagcgtgctgccccccctgcctgctgccctgcagagcaggatgaatgtcatcgaccacgtgcgggacatggctgctgctggcctgcacagcaatgtgcggctgctgagcagcctgctgctgaccatgagcaacaacaaccctgagctgttcagccccccccagaagtaccagctgctggtgtaccacgccgacagcctcttccatgacaaggagtacagaaatgctgtgtccaagtacaccatggccctgcagcagaagaaggccctgagcaagaccagcaaggtgcggcccagcacaggcaacagcgccagcaccccccagagccagtgcctgcccagcgagattgaggtgaagtacaagatggccgagtgctacaccatgctgaagcaggacaaggatgccatcgccatcctggatggcatccccagccggcagaggacccccaagatcaacatgatgctggccaacctgtacaagaaggccggccaggagcggcccagcgtgaccagctacaaggaggtgctgcggcagtgccccctggccctggatgccatcctgggcctgctgagcctgtctgtgaagggagctgaggtggcctccatgaccatgaatgtcatccagacagtgcccaacctggactggctgtctgtgtggatcaaggcctatgcctttgtgcacactggagacaacagccgggccatcagcaccatctgcagcctggagaagaagagcctgctgcgggacaacgtggacctgctgggcagcctggccgacctgtacttccgggccggggacaacaagaacagcgtgctgaagtttgagcaggcccagatgctggacccctacctgatcaagggcatggatgtgtatggctacctgctggcccgggagggccgcctggaggatgtggagaacctgggctgccgcctcttcaacatcagtgaccagcacgccgagccctgggtggtgtctggctgccacagcttctacagcaagcgctacagccgggccctgtacctgggcgccaaggccatccagctgaacagcaacagcgtgcaggccctgctgctgaagggagctgccctgaggaacatgggccgggtgcaggaggccatcatccacttccgggaggccatccggctggccccctgccgcctggactgctatgagggcctgattgagtgctacctggccagcaacagcatccgggaggccatggtgatggccaacaacgtgtacaagaccctgggcgccaatgcccagaccctgaccctgctggccaccgtgtgcctggaggaccctgtgacccaggagaaggccaagaccctgctggacaaggccctgacccagaggccagactacatcaaggctgtggtgaagaaggccgagctgctgagccgggagcagaagtatgaagatggcatcgccctgctgagaaatgccctggccaaccagagcgactgtgtgctgcaccgcatcctgggggacttcctggtggccgtgaatgagtaccaggaggccatggaccagtacagcatcgccctgaggtag

SEQ ID NO: 21563 - DNA, 351 bp, Artificial Sequence
  Description of Artificial Sequence: Synthetic coding sequence
atggccttcatgaccaggaagctgtgggacctggagcagcaggtgaaggcccagacagatgagatcctgagcaaggaccagaagattgctgccctggaggacctggtgcagaccctgcggccccaccctgctgaggccaccctgcagaggcaggaggagctggagaccatgtgtgtgcagctgcagaggcaggtgcgggagatggagcgcttcctgagtgactatggcctgcagtgggtgggggagcccatggaccaggaggacagcgagagcaagacagtgtctgaacatggagagcgggactggatgacagccaagaagttctggaagccaggccgggccggccgctag

SEQ ID NO: 21564 - DNA, 285 bp, Artificial Sequence
  Description of Artificial Sequence: Synthetic coding sequence
atgacaggcagcaggaactggagggccacccgggacatgtgccgctaccgccacaactacccagacctggtggagcgggactgcaatggagacacccccaacctgtccttctacagaaatgagatccgcttcctgcccaacggctgcttcatcgaggacatcctgcagaactggacagacaactatgacctgctggaggacaaccacagctacatccagtggctgttccccctgcgggagcccggggtgaactggcacgccaagcccctgaccctgcgggagtag

SEQ ID NO: 21565 - DNA, 1029 bp, Artificial Sequence
  Description of Artificial Sequence: Synthetic coding sequence
atgaggttctgggccccctggggcagcaggaccccatctggccgcagcctgtggacagatcctgtgacctactacacagccctgcacatcgctgtgctgaggaaccagcctgacatggtggagctgctggtgcaccacggggctgatgtgaacagaagagaccgcatccacgagagcagccccctggacctggccagcgaggagcctgagcggctgccctgcctgcagaggctgctggacctgggcgcagatgtgaatgctgctgacaagcacggcaagacagccctgctgcacgccctggccagcagtgatggagtgcagatccacaacacagagaacatccggctgctgctggagggcggcgcagatgtgaaggccaccaccaaggatggagacacagtgttcacctgcatcatcttcctgctgggggagaccgtgggcggggacaaggaggaggcccagatgatcaaccgcttctgcttccaggtgacccggctgctgctggcccacggggctgaccccagcgagtgcccagcccacgagagcctgacccacatctgcctgaagagcttcaagctgcacttccccctgctgcgcttcctgctggagagcggggccgcctacaactgcagcctgcatggagccagctgctggagcggcttccacatcatctttgagcggctgtgcagccaccctggctgcacagaagatgagagccatgctgacctgctgaggaaggccgagaccgtgctggacctgatggtgaccaacagccagaagctgcagctgcctgaaaattttgacatccaccctgtgggcagcctggccgagaagatccaggccctgcacttcagcctgcggcagctggagagctaccccccacccctgaagcacctgtgccgggtggccatccggctgtacctgcagccctggcctgtggatgtgaaggtgaaggccctgcccctgcctgaccggctgaagtggtacctgctgtctgagcacagcggctctgtggaggatgacatctag

SEQ ID NO: 21566 - DNA, 3192 bp, Artificial Sequence; identical to SEQ ID NO: 20250
  Description of Artificial Sequence: Synthetic coding sequence

SEQ ID NO: 21567 - DNA, 96 bp, Artificial Sequence
  Description of Artificial Sequence: Synthetic coding sequence
atgtctgatgaggtgttcagcaccaccctggcctacaccaagagccccaaggtgaccaagaggaccaccttccaggatgagctgatccgggcctag

SEQ ID NO: 21568 - DNA, 606 bp, Artificial Sequence
  Description of Artificial Sequence: Synthetic coding sequence
atgcccctgcagctgaagaacccccggctgcggcagaagagcaggacccgctgcaacaagagccagaagaaggccgagctgctggacaatgagaagccagctgctgtggtggcccccatcaccaccggctacacagtgaagatcagcaactacggctgggaccagagcgacaagtttgtgaagatctacatcaccctgactggagtgcaccaggtgcccacagaaaatgtgcaggtgcacttcacagagaggagctttgacctgctggtgaagaacctgaatggcaagagctacagcatgattgtgaacaacctgctgaagcccatctctgtggagggcagcagcaagaaggtgaagacagacacagtgctgatcctgtgcaggaagaaggtggagaacacccgctgggactacctgacccaggtggagaaggagtgcaaggagaaggagaagcccagctatgacacagaaacagaccccagcgagggcctgatgaatgtgctgaagaagatctatgaagatggagatgatgacatgaagaggaccatcaacaaggcctgggtggagagccgggagaagcaggccaagggggacacagagttctag

SEQ ID NO: 21569 - DNA, 480 bp, Artificial Sequence; identical to SEQ ID NO: 20848
  Description of Artificial Sequence: Synthetic coding sequence

SEQ ID NO: 21570 - DNA, 4599 bp, Artificial Sequence
  Description of Artificial Sequence: Synthetic coding sequence
atgcagcgggagctggtgtatgcccggggagatggccctggggccccccggcccggcagcacagcccaccccccccacgccatccccaacagcccccccagcacccctgtgccccacagcatgccacccagccccagccgcatcccctacggcggcaccaggtccatggtggtgcctggaaatgccaccatcccccgggaccgcatcagcagcctgcctgtgtcccggcccatcagccccagccccagcgccatcctggagaggagagatgtgaagccagatgaggacatgtctgggaagaacatcgccatgtacagaaatgaaggcttctacgccgacccctacctgtaccacgagggccgcatgagcatcgccagcagccacggcggccaccccctggatgtgcctgaccacatcatcgcctaccacaggacagccatccgcagcgccagcgcctactgcaaccccagcatgcaggccgagatgcacatggagcagagcctgtaccggcagaagagcaggaagtacccagacagccacctgcccaccctgggcagcaagaccccaccagccagcccccaccgggtgtctgacctgaggatgattgacatgcacgcccactacaatgcccacggccccccccacaccatgcagcctgaccgggccagccccagccggcaggccttcaagaaggagcccggcaccctggtgtacatcgagaagcccaggtctgctgctggcctgagcagcctggtggacctgggcccccccctgatggagaagcaggtgtttgcctacagcacagccaccatccccaaggaccgggagaccagcgagaagatgatgaagaccacagccaacagaaaccacacagattctgctggcaccccccacgtgtctgggggcaagatgctgagcgccctggagagcacagtgccccccagccagcccccacctgtgggcaccagcgccatccacatgagcctgctggagatgagaagatctgtggccgagctgcggctgcagctgcagcagatgaggcagctgcagctgcagaaccaggagctgctgcgggccatgatgaagaaggccgagctggagatcagcggcaaggtgatggagaccatgaagaggctggaggaccctgtgcagaggcagagggtgctggtggagcaggagcggcagaagtacctgcacgaggaggagaagatcgtgaagaagctgtgtgagctggaggactttgtggaggacctgaagaaggacagcacagctgccagccggctggtgaccctgaaggatgtggaggatggagccttcctgctgcggcaggtgggggaggccgtggccaccctgaagggggagttccccaccctgcagaacaagatgagggccatcctgcgcatcgaggtggaggccgtgcgcttcctgaaggaggagccccacaagctggacagcctgctgaagagggtgcgctccatgacagatgtgctgaccatgctgcggagacatgtgacagatggcctgctgaagggcacagatgctgcccaggccgcccagtacatggccatggagaaggccacagctgctgaggtgctgaagagccaggaggaggccgcccacaccagcggccagcccttccacagcactggagcccctggagatgccaagtctgaggtggtgcccctgagcggcatgatggtgagacatgcccagagcagccctgtggtgatccagcccagccagcacagcgtggccctgctgaacccagcccagaacctgccccacgtggccagcagccctgctgtgccccaggaggccaccagcaccctgcagatgagccaggccccccagagcccccagatccccatgaatggcagcgccatgcagagcctcttcatcgaggagatccacagcgtgtctgccaagaacagagctgtgtccattgagaaggccgagaagaagtgggaggagaagaggcagaacctggaccactacaacgggaaggagtttgagaagctgctggaggaggcccaggccaacatcatgaagagcatccccaacctggagatgcccccagccaccggccccctgcccagaggagatgcccctgtggacaaggtggagctgtctgaggacagccccaacagcgagcaggacctggagaagctgggcggcaagagccccccacctcctcctcctccaccccggcgcagctacctgcccggcagcggcctgaccaccaccaggtctggagatgtggtgtacacaggcaggaaggagaacatcacagccaaggccagcagtgaagatgctggccccagcccccagacccgggccaccaagtacccagctgaggagcccgccagcgcctggacccccagccccccacctgtgaccaccagcagcagcaaggatgaggaggaggaggaggaggagggggacaagatcatggccgagctgcaggccttccagaagtgcagcttcatggatgtgaacagcaacagccatgctgagcccagcagagctgacagccacgtgaaggacaccaggtctggggccaccgtgccccccaaggagaagaagaacctggagttcttccatgaagatgtgaggaagagtgatgtggagtatgaaaatggcccccagatggagttccagaaggtgaccaccggggctgtgcggcccagcgacccccccaagtgggagcggggcatggagaacagcatcagtgatgccagcaggaccagcgagtacaagacagagatcatcatgaaggagaacagcatcagcaacatgagcctgctgcgggacagcaggaactacagccaggagaccgtgcccaaggccagctttggcttcagcggcatcagccccctggaggatgagatcaacaagggcagcaagatcagcggcctgcagtacagcatcccagacacagagaaccagaccctgaactacggcaagaccaaggagatggagaagcagaacacagacaagtgccacgtgagcagccacacccggctgacagagagctctgtgcatgacttcaagacagaggaccaggaggtgatcaccacagactttggccaggtggtgctgcggcccaaggaggcccggcatgccaacgtgaaccccaatgaagatggagagagcagcagcagcagccccacagaagaaaatgctgccacagacaacatcgccttcatgatcacagagaccaccgtgcaggtgctgagcagcggggaggtgcatgacatcgtgtcccagaagggggaggacatccagacagtgaacattgatgccaggaaggagatgaccccccggcaggagggcacagacaatgaagatcctgtggtgtgcctggacaagaagcctgtgatcatcatctttgatgagcccatggacatccgcagcgcctacaagaggctgagcaccatctttgaagaatgtgatgaggagctggagaggatgatgatggaggagaagattgaggaggaggaggaggaggagaatggagacagcgtggtgcagaacaacaacaccagccagatgagccacaagaaggtggcccctggcaacctgaggacaggccagcaggtggagaccaagagccagccccacagcctggccacagagaccaggaaccctgggggccaggagatgaacagaacagagctgaacaagttcagccacgtggacagccccaacagcgagtgcaagggggaggatgccacagatgaccagtttgagagccccaagaagaagttcaagttcaagttccccaagaagcagctggccgccctgacccaggccatcagaacaggcaccaagacaggcaagaagaccctgcaggtggtggtgtatgaggaggaggaggaggatggcaccctgaagcagcacaaggaggccaagagatttgagatcgcccggagccagcctgaggacacccccaccagcatccccagcgccagcaggaagggcagcagcggggccccccagaccagcaggatgcctgtgcccatgtctgccaagaacagacctggcaccctggacaagccaggcaagcagagcaagctgcaggacccccggcagtaccggcaggccaatggaagtgccaagaagtctggaggagacttcaagcccaccagccccagcctgcctgccagcaagatcccagccctgagccccagcagcggcaagagcagcagcctgcccagcagcagcggggacagcagcaacctgcccaaccccccagccaccaagcccagcatcgccagcaaccccctgagcccccagacaggccccccagcccacagcgccagcctcatccccagcgtgtccaatggcagcctgaagttccagagcctgacccacacaggcaagggccaccacctgtccttcagcccccagagccagaatggccgggcccccccacccctgtccttcagcagcagcccccccagccctgccagctctgtgtccctgaaccagggcgccaagggcaccaggaccatccacacccccagcctgaccagctacaaggcccagaatggcagcagcagcaaggccacccccagcacagccaaggagaccagctag

SEQ ID NO: 21571 - DNA, 1566 bp, Artificial Sequence
  Description of Artificial Sequence: Synthetic coding sequence
atgaccagcgccttcaagctggacttcctgcctgacatgatggtggagggccgcctgctggtgcctgaccgcatcaatggaacagccaacaagatgaatggagccctggaccacagcgaccagcctgaccctgatgccatcaagatgtttgtgggccagatccccaggtcctggagcgagaaggagctgaaggagctgtttgagccctacggggctgtgtaccagatcaacgtgctgcgggacaggagccagaaccccccccagagcaagggctgctgctttgtgaccttctacaccaggaaggccgccctggaggcccagaatgccctgcacaacatcaagaccctgcccggcatgcaccaccccatccagatgaagccagctgacagcgagaagagcaatgctgtggaggacaggaagctgttcatcggcatggtgtccaagaagtgcaatgaaaatgacatccgggtgatgttcagccccttcggccagattgaagaatgtcgcatcctgcggggcccagatggcctgagccggggctgtgcctttgtgaccttcagcacccgggccatggcccagaatgccatcaaggccatgcaccagagccagaccatggagggctgcagcagccccatcgtggtgaagtttgctgacacccagaaggacaaggagcagaggcggctgcagcagcagctggcccagcagatgcagcagctgaacacagccacctggggcaacctgaccggcctgggcggcctgaccccccagtacctggccctgctgcagcaggccaccagcagcagcaacctgggcgccttcagcggcatccagcagatggccggcatgaatgccctgcagctgcagaacctggccaccctggccgctgctgctgctgctgcccagaccagcgccaccagcaccaatgccaaccccctgagcaccaccagcagcgccctgggcgccctgaccagccctgtggccgccagcacccccaacagcacagctggagctgccatgaacagcctgaccagcctgggcaccctgcagggcctggccggggccaccgtgggcctgaacaacatcaatgccctggccgtggcccagatgctgagcggcatggccgccctgaatggaggcctgggcgccaccggcctgaccaatggaacagctggcaccatggatgccctgacccaggcctacagcggcatccagcagtatgctgctgctgccctgcccaccctgtacagccagagcctgctgcagcagcagagcgctgctggcagccagaaggagggccctgagggcgccaacctcttcatctaccacctgccccaggagtttggagaccaggacatcctgcagatgttcatgccctttggaaatgtcatcagcgccaaggtgttcatcgacaagcagaccaacctgagcaaatgttttggatttgtgtcctatgacaaccctgtgtctgcccaggccgccatccaggccatgaatggcttccagatcggcatgaagaggctgaaggtgcagctgaagaggagcaagaatgacagcaagccctactag

SEQ ID NO: 21572 - DNA, 315 bp, Artificial Sequence
  Description of Artificial Sequence: Synthetic coding sequence
atgtctgagcagggcgacctgaaccaggccatcgccgaggagggcggcacagagcaggagacagccaccccagaaaatggcatcgtgaagtctgagagcctggatgaggaggagaagctggagctgcagaggcggctggaggcccagaaccaggagaggaggaagagcaagagcggggccggcaagggcaagctgaccaggagcctggccgtgtgtgaggagagcagcgcccggcctggaggagagagcctgcaggaccaggagagcatccacctgcagctgagcagcttcagcagcctgcaggaggaggactag

SEQ ID NO: 21573 - DNA, 1653 bp, Artificial Sequence
  Description of Artificial Sequence: Synthetic coding sequence
atggagcccccccaggagaccaaccggcccttcagcaccctggacaacagaagtggccaggtgcaggtgctgagcgccacccccctgctgcagaggaacccctacagcagcccagacatcatgcacatcaagggcagcgaggccagctctgtgccctatgccctgaaccagggcaccacagccctgcccaagaacaagaaccaggagggcaccggccaccggctgctgaacatgctgaggaagaccctgaaggagagtgacagcgaggagctggagatcacccaggagacccccaacctggtgccctttggagatgtggtgggctgcctgggcatccacatcaagaactgccgccacttcatgcccaagatcagcctgcagcactacgccaacctcttcatccgcatcagcatcaacaaggctgtgaagtgcaccaagatgtgcagcctgctgagcaagaatgatgagaagaacacagtcatcaagtttgatgaggtgaagtacttctctgtgcaggtgcccaggagatatgatgacaagaggaacaacatcctgctggagctgatccagtatgacaaccgggagaagagggccttcctgctgggctctgtgcagatccacctgtatgaagtcatccagaagggctgcttcatcgaggaggtgcaggtgctgcacggcaacatctttgtgtgccgcctggaggtggagttcatgttctcctatggcaactttggctacggcttcagccaccagctgaagcccctgcagaagatcacagagcccagcatgttcatgaacctggcccctcctcctgagaggacagatcctgtgaccaaggtgatcaccccccagacagtggagtacccagccttcctgagcccagacctgaatgtgacagtgggcaccccagctgtgcagagcagcaaccagcccagcgtggtgcggctggagaagctgcagcagcagccccgggagcggctggagaagatgaagaaggagtacagaaacctgaacacctggattgacaaggccaactacctggagagcatcctgatgcccaagctggagcacaaggacagcgaggagaccaacattgatgaggccagcgagaacaccaagagcaaccaccctgaggaggagctggagaacatcgtgggcgtggacatccccctggtgaatgaggaggccgagaccacagccaatgagctgctggacaatgacagcgagaagggcctgaccatccccaccctgaaccagagcgaccaggacaacagcacagcagatgccagcaagaatgatgagagcacccccagccccacagaggtgcacagcctgtgcaccatcagcaaccaggagaccatcaaggccggccgcatcccccccctgggggagcggcagagcgagagcatgccagacaggaagatgaagaatgtgttcttccccctggaggtgaagctgaaggacaactaccccagcatcctgaaggctgacagcagcctgtctgaggtgaacctgcggagcatctgcatcaaccccaagagcaggaacctggacagcagccccacagagatctcctggcagaacaacaacctgaacctggccgagagagaaaatacaggcctggtgtccacccggctgaagatcaagaggtag

SEQ ID NO: 21574 - DNA, 363 bp, Artificial Sequence
  Description of Artificial Sequence: Synthetic coding sequence
atgagcatcagcagtgatgaggtgaacttcctggtgtaccgctacctgcaggagagcggcttcagccacagcgccttcaccttcggcatcgagagccacatcagccagagcaacatcaacggggccctggtgcccccagctgccctgatcagcatcatccagaagggcctgcagtatgtggaggccgaggtgtccatcaatgaagatggcaccctgtttgatggccggcccatcgagagcctgagcctgattgatgctgtgatgccagatgtggtgcagacccggcagcaggcctacagagacaagctggcccagcagcaggccgctgctgctgctgctgctgctgctgctgccagccagtag

SEQ ID NO: 21575 - DNA, 222 bp, Artificial Sequence
  Description of Artificial Sequence: Synthetic coding sequence
atgagctactaccagaggcccttcagccccagcgcctacagcctgcctgccagcctgaacagcagcatcgtgatgcagcacggcaccagcctggacagcacagacacctacccccagcacgcccagagcctggatggcaccaccagcagcagcatccccctgtaccgcagcagcgaggaggagaagagggtgaccgtcatcaaggccccccactacccctag

SEQ ID NO: 21576 - DNA, 717 bp, Artificial Sequence
  Description of Artificial Sequence: Synthetic coding sequence
atgacagaggacagccagaggaacttccgctctgtgtactatgagaaggtgggcttccggggcgtggaggagaagaagagcctggagatcctgctgaaggatgaccggctgggcatcctgcccccccaccacgagagccacgccaaggtgatgatgtacaggaaggagcagtacctggatgtgctgcacgccctgaaggtggtgcgctttgtgtctgatgccaccccccaggccgaggtgtacctgaggatgtaccagctggagagcggcaagctgcccaggagccccagcttccccctggagccagatgatgaggtgttcctggccatcgccaaggccatggaggagatggtggaggacagcgtggactgctactggatcaccaggagatttgtgaaccagctgaacaccaagtacagagacagcctgccccagctgcccaaggcctttgagcagtacctgaacctggaggatggccgcctgctgacccacctgaggatgtgcagcgctgcccccaagctgccctatgacctgtggttcaagcgctgctttgctggctgcctgcctgagagcagcctgcagagggtgtgggacaaggtggtgtctggcagctgcaagatcctggtgtttgtggccgtggagatcctgctgaccttcaagatcaaggtgatggccctgaacagcgctgagaagatcaccaagttcctggagaactag

SEQ ID NO: 21577 - DNA, 1620 bp, Artificial Sequence; identical to SEQ ID NO: 19050
  Description of Artificial Sequence: Synthetic coding sequence

SEQ ID NO: 21578 - DNA, 609 bp, Artificial Sequence
  Description of Artificial Sequence: Synthetic coding sequence
atgggccagaaggtgactggaggcatcaagacagtggacatgagggaccccacctaccggcccctgaagcaggagctgcagggcctggactactgcaagcccacccggctggacctgctgctggacatgcctcctgtgtcctatgatgtgcagctgctgcacagctggaacaacaatgacaggagcctgaatgtgtttgtgaaggaggatgacaagctgatcttccaccgccaccctgtggcccagagcacagatgccatccggggcaaggtgggctacacccggggcctgcacgtgtggcagatcacctgggccatgaggcagaggggcacccatgctgtggtgggcgtggccacagcagatgcccccctgcacagcgtgggctacaccaccctggtgggcaacaaccacgagagctggggctgggacctgggcaggaacagactctaccatgatggcaagaaccagcccagcaagacctacccagccttcctggagccagatgagaccttcatcgtgcctgacagcttcctggtggccctggacatggatgatggcaccctgtccttcatcgtggatggccagtacatgggcgtggccttcagatag

SEQ ID NO: 21579 - DNA, 174 bp, Artificial Sequence
  Description of Artificial Sequence: Synthetic coding sequence
aacctgcccatctgcatggccaagacccacctgagcctgagccaccagcctgacaagaagggcgtgccccgggacttcatcctgcccatcagtgatgtgcgggccagcattggagctggcttcatctaccccctggtgggcaccggcggccgggaggcccccctgtggctgtag

SEQ ID NO: 21580 - DNA, 468 bp, Artificial Sequence
  Description of Artificial Sequence: Synthetic coding sequence
atgaacaaccagaagcagcagaagcccaccctgagcggccagcgcttcaagaccaggaagagagatgagaaggagagatttgaccccacccagttccaggactgcatcatccagggcctgacagaaacaggaacagacctggaggccgtggccaagttcctggatgccagcggggccaagctggactaccgccgctatgcagagaccctgtttgacatcctggtggccggcggcatgctggcccctgggggcaccctggctgatgacatgatgaggacagatgtgtgtgtgtttgctgcccaggaggacctggagaccatgcaggcctttgcccaggtgttcaacaagctgatccgccgctacaagtacctggagaagggctttgaagatgaggtgaagaagctgctgctcttcctgaagggcttcagcgagagcgagaggaacaagctggccatgctgaccggctag

SEQ ID NO: 21581 - DNA, 528 bp, Artificial Sequence
  Description of Artificial Sequence: Synthetic coding sequence
tgatttgatgaccagaggaggatgagcctgcacctgcatggagctgactgtgaccccaagacccagaatgagatgaacatctgtgaggaggagtttgtggagtacaagaacagagatgccatcagcgccctgatgcccctcttcagcgaggaggagagcagtgatggcagcaagcacaacaacggcctgcctgaccacatcagcgcccagctgcagaacacctacaccctgaaggccttcaccgtgggcagcaaatgtgtggtgtggagcagcctgaggaacacctggagcaaatgtgagatcctggagacagctgaggagggcaccagggtgctgaacctgagcaatggcatggaggagatcgtgaacccagaaaatgtgtggaatggcatccccaagctggacaagagccccccagaggccgtgtcccagagggtgggcaaggacctgtacttcatgtctgtgggggacaccaccatcaaggagaagggctttggaggagatggagacctgactgtggacctgtag

SEQ ID NO: 21582 - DNA, 2814 bp, Artificial Sequence
  Description of Artificial Sequence: Synthetic coding sequence
tgactgcggagccagcccggctgcggctgcctgtggcaggaggcccccacccacagcacaggccccagcgtggagggggaggcccccagcagcgagaccggcaccagcctggacagccccagcgcctacccccagggccccctggtgcccggcagcagcctgagcccagaccactatgagcacacctctgtgggcgcctacggcctgtacagcggccccccaggccagcagcagaggacccggcggcccaagctgcagcacagcaccagcatcctgaggaagcaggccgaggaggaggccatcaagaggagccgcagcctgtctgagagctatgagctgagcagtgacctgcaggacaagcaggtggagatgctggagaggaaatatggaggccgcctggtgaccaggcatgctgcccggaccatccagacagccttccggcagtaccagatgaacaagaactttgagcggctgcggagctccatgtctgagaacaggatgagcagaagaattgtgctgagcaacatgaggatgcagttctcctttgagggccctgagaaggtgcacagcagctactttgagggcaagcaggtgtctgtgaccaatgatggcagccagctgggcgccctggtgtccccagaatgtggggacctgtctgagcccaccaccctgaagagccctgcccccagcagtgactttgctgatgccatcacagagctggaggatgccttcagccggcaggtgaagagcctggccgagagcattgatgatgccctgaactgccgcagcctgcacacagaggaggccccagccctggatgctgcccgggcccgggacacagagccccagacagccctgcacggcatggaccacaggaagctggatgagatgacagccagctacagtgatgtgaccctgtacattgatgaggaggagctgagcccccccctgcccctgagccaggccggggaccggcccagcagcacagaaagtgacctgcggctgcgggccggcggggccgccccagactactgggccctggcccacaaggaggacaaggctgacacagacaccagctgccgcagcacccccagcctggagcggcaggagcagaggctgcgggtggagcacctgcccctgctgaccatcgagcccccaagtgacagctctgtggacctgagtgacagaagtgagcggggcagcctgaagaggcagagcgcctatgaaagaagcctgggcggccagcagggcagccccaagcacggcccccacagcggggcccccaagagcctgccccgggaggagcctgagctgcggccccggcccccccggcccctggacagccacctggccatcaatggaagtgccaaccggcagagcaagtctgagagtgactacagtgatggagacaatgacagcatcaacagcaccagcaacagcaatgacaccatcaactgcagcagcgagagcagcagccgggacagcctgcgggagcagaccctgagcaagcagacctaccacaaggaggccagaaattcctgggacagccctgccttcagcaatgatgtgatcaggaagaggcactacagaattggcctgaacctcttcaacaagaagccagagaagggcgtgcagtacctgattgaaagaggatttgtgcctgacacccctgtgggcgtggcccacttcctgctgcagaggaagggcctgagccggcagatgattggagagttcctgggcaaccggcagaagcagttcaacagagatgtgctggactgtgtggtggatgagatggacttcagcaccatggagctggatgaggccctgaggaagttccaggcccacatccgggtgcagggcgaggcccagaaggtggagcggctgattgaggccttcagccagcgctactgcatctgcaaccctggggtggtgcggcagttcaggaacccagacaccatcttcatcctggcctttgccatcatcctgctgaacacagacatgtacagccccaacgtgaagccagagaggaagatgaagctggaggacttcatcaagaacctgcggggcgtggatgatggagaggacatcccccgggagatgctgatgggcatctatgagcgcatcaggaagcgggagctgaagaccaatgaagatcatgtgtcccaggtgcagaaggtggagaagctgattgtgggcaagaagcccatcggcagcctgcaccctggcctgggctgtgtgctgagcctgccccaccggcggctggtgtgctactgccgcctgtttgaggtgcctgaccccaacaagccccagaagctgggcctgcaccagcgggagatcttcctgttcaatgacctgctggtggtgaccaagatcttccagaagaagaagaacagcgtgacctacagcttccggcagagcttcagcctgtatggcatgcaggtgctgctgtttgagaaccagtactaccccaacggcatccggctgaccagctctgtgcctggagctgacatcaaggtgctgatcaacttcaatgcccccaacccccaggacaggaagaagttcacagatgacctgcgggagagcattgctgaggtgcaggagatggagaagcacagaattgaaagtgagctggagaagcagaagggcgtggtgcggcccagcatgagccagtgcagcagcctgaagaaggagagcggaaatggcaccctgagccgggcctgcctggatgacagctatgccagcggggagggcctgaagaggtctgccctgagcagcagcctgcgggacctgtctgaggccggcgtgcaccactag

SEQ ID NO: 21583 - DNA, 198 bp, Artificial Sequence
  Description of Artificial Sequence: Synthetic coding sequence
atggtggaggccgctgaccgggagaaggtggagctgctgaaccagctggaggaggagaagaggaaggtggaggacctgcagttccgggtggaggaggagagcatcaccaagggggacctggagcagaagagccagatcagcgaggaccctgaaaatgtggccaccgtgtctgagaagagccgcatcatggagctgtag

SEQ ID NO: 21584 - DNA, 630 bp, Artificial Sequence
  Description of Artificial Sequence: Synthetic coding sequence
atggacttcctgctgggcaaccccttcagcagccctgtgggccagagaattgagaaggccacagatggcagcctgcagagcgaggactgggccctgaacatggagatctgtgacatcatcaatgaaacagaggagggccccaaggatgccctgcgggctgtgaagaagagaattgtgggcaacaagaacttccacgaggtgatgctggccctgactgtgctggagacctgtgtgaagaactgtggccaccgcttccacgtgctggtggccagccaggactttgtggagagcgtgctggtgaggaccatcctgcccaagaacaacccccccaccatcgtgcatgacaaggtgctgaacctgatccagagctgggcagatgccttccgcagcagcccagacctgactggagtggtgaccatctatgaggacctgcggaggaagggcctggagttccccatgacagacctggacatgctgagccccatccacaccccccggggcccctgcagcacccagaggcacaaccaggaccgcatcctgtgggccctgaccccagccagcaagaggaccctggcctccatgctgcccctgtgccccccccggccctacagccctgtgacccggccctag

SEQ ID NO: 21585 - DNA, 255 bp, Artificial Sequence
  Description of Artificial Sequence: Synthetic coding sequence
atggctgacacagacctcttcatggagtgtgaggaggaggagctggagccctggcagaagatcagtgatgtgattgaggacagcgtggtggaggactacaacagcgtggacaagaccaccacagctggcaaccccctggtgcagcagggcggccagcccctcatcctgacccagaacccagcccctggcctgggcaccatggtgacccagcctgtgctgcggcctgtgcaggtgatgcagaatgccaaccactag

SEQ ID NO: 21586 - DNA, 618 bp, Artificial Sequence
  Description of Artificial Sequence: Synthetic coding sequence
atggccacccccctgggctggagcaaggccggcagcggctctgtgtgcctggccctggaccagctgagagatgtgattgagagccaggaggagctgatccaccagctgagaaatgtgatggtgctgcaggatgaaaattttgtgtccaaggaggagttccaggccgtggagaagaagctggtggaggagaaggccgcccacgccaagaccaaggtgctgctggccaaggaggaggagaagctgcagtttgccctgggggaggtggaggtgctgagcaagcagctggagaaggagaagctggcctttgagaaggccctgagctctgtgaagagcaaggtgctgcaggagagcagcaagaaggaccagctgatcaccaagtgcaatgaaattgagagccacatcatcaagcaggaggacatcctgaatggcaaggaaaatgagatcaaggagctgcagcaggtgatcagccagcagaagcagatcttcaggaaccacatgtctgacttccgcatccagaagcagcaggagagctacatggcccaggtgctggaccagaagcacaagaaggccagcggcacccggcaggcccggagccaccagcacccccgggagaagtag

SEQ ID NO: 21587 - DNA, 330 bp, Artificial Sequence
  Description of Artificial Sequence: Synthetic coding sequence
atggagcccagcgcccagcagctgcagctggccgccagcctgcctgccaacctgagcaacttctgccagggcagcgagatgcccaccaccagcaggcctgccctggatgtgaagggcggcaccagccctgccaaggaggatgccaaccaggagatgagctctgtggcctacagcaacctggccgtgaaggacaggaaggctgtggccatcctgcactacccaggagtggccagcaatggcaccaaggccagcggggcccccaccagcagcagcggcagccccatcggcagccccaccaccaccccacccaccaagccacccagcttctag

SEQ ID NO: 21588 - DNA, 1737 bp, Artificial Sequence
  Description of Artificial Sequence: Synthetic coding sequence
atgcctgagatccgggtgacccccctgggcgccggccaggatgtgggccgcagctgcatcctggtgtccattgctgggaagaatgtgatgctggactgtggcatgcacatgggcttcaatgatgaccggcgcttcccagacttctcctacatcacccagaatggccgcctgacagacttcctggactgtgtgatcatcagccacttccacctggaccactgtggggccctgccctacttcagcgagatggtgggctatgatggccccatctacatgacccaccccacccaggccatctgccccatcctgctggaggactacaggaagattgctgtggacaagaagggggaggccaacttcttcaccagccagatgatcaaggactgcatgaagaaggtggtggccgtgcacctgcaccagacagtgcagatcaaggtgggcagcgagagcgtggtgtacaccggggactacaacatgaccccagacagacacctgggcgccgcctggattgacaagtgccggcccaacctgctgatcacagagagcacctacgccaccaccatccgggacagcaagcgctgccgggagcgggacttcctgaagaaggtgcatgagaccgtggagcggggcggcaaggtgctgatccctgtgtttgccctgggccgggcccaggagctgtgcatcctgctggagaccttctgggagaggatgaacctgaaggtgcccatctacttcagcacaggcctgacagagaaggccaaccactactacaagctgttcatcccctggaccaaccagaagatcaggaagacctttgtgcagaggaacatgtttgagttcaagcacatcaaggcctttgaccgggcctttgctgacaaccctggccccatggtggtgtttgccaccccaggcatgctgcacgccggccagagcctgcagatcttcaggaagtgggccggaaatgagaagaacatggtgatcatgcctggctactgtgtgcagggcaccgtgggccacaagatcctgagcggccagaggaagctggagatggagggccggcaggtgctggaggtgaagatgcaggtggagtacatgtccttcagcgcccatgctgatgccaagggcatcatgcagctggtgggccaggccgagcctgagagcgtgctgctggtgcacggggaggccaagaagatggagttcctgaagcagaagattgagcaggagctgcgggtgaactgctacatgcctgccaacggggagaccgtgaccctgcccaccagccccagcatccctgtgggcatcagcctgggcctgctgaagcgggagatggcccagggcctgctgcctgaggccaagaagccccggctgctgcacggcaccctcatcatgaaggacagcaacttccggctggtgtcctctgagcaggccctgaaggagctgggcctggccgagcaccagctgcgcttcacctgccgggtgcacctgcatgacaccaggaaggagcaggagacagccctgcgggtgtacagccacctgaagtctgtgctgaaggaccactgtgtgcagcacctgcctgatggctctgtgacagtggagagcgtgctgctgcaggccgccgcccccagtgaagatcctggcaccaaggtgctgctggtgtcctggacctaccaggatgaggagctgggcagcttcctgaccagcctgctgaagaagggcctgccccaggcccccagctag

SEQ ID NO: 21589 - DNA, 570 bp, Artificial Sequence
  Description of Artificial Sequence: Synthetic coding sequence
atgcagcccatgagctttggctgggaccacagcctgcacaagaggaagaggctgccccctgtgaagaggagcctggtgtactacctgaagaaccgggaggtgcggctgcagaatgagaccagctacagccgggtgctgcacggctacgccgcccagcagctgcccagcctgctgaaggagcgggagttccacctgggcaccctgaacaaggtgtttgccagccagtggctgaaccaccggcaggtggtgtgtggcaccaagtgcaacaccctgtttgtggtggatgtgcagaccagccagatcaccaagatccccatcctgaaggaccgggagcccggcggcgtgacccagcagggctgcggcatccacgccatcgagctgaaccccagcaggaccctgctggccaccggcggggacaaccccaacagcctggccatctaccgcctgcccaccctggaccctgtgtgtgtgggagatgatggccacaaggactggatcttcagcatcgcctggatcagtgacaccatggctgtgtctggcagcagagatggctccatgggcctgtggtag

SEQ ID NO: 21590 - DNA, 2289 bp, Artificial Sequence; identical to SEQ ID NO: 20891
  Description of Artificial Sequence: Synthetic coding sequence

SEQ ID NO: 21591 - DNA, 1362 bp, Artificial Sequence
  Description of Artificial Sequence: Synthetic coding sequence
atggccggggctgctggccgggtgcaggaccgggccctgcggcgcttccccatcaccctgcctgtgggggacctgagcaacctgcacctgaaggaggagaagatcaagccagacaccaacggggctgtggtgaagaccaatgccaatgctgagaagacagatgaggaggagaaggaggaccgggccgcccagagcctgctgaacaagctgatccgcagcaacctggtggacaacaccaaccaggtggaggtgctgcagagggaccccaacagccccctgtacagcgtgaagagctttgaggagctgcggctgccccagaacctgattgcccagagccagagcggcaccgggaagacagctgcctttgtgctggccatgctgagccaggtggagcccgccaacaagtacccccagtgcctgtgcctgagccccacctatgagctggccctgcagacaggcaaggtgattgagcagatgggcaagttctacccagagctgaagctggcctatgctgtgcggggcaacaagctggagcggggccagaagatcagcgagcagatcgtgattggcaccccaggcaccgtgctggactggtgcagcaagctgaagttcatcgaccccaagaagatcaaggtgtttgtgctggatgaagcagatgtgatgattgccacccagggccaccaggaccagagcatccgcatccagaggatgctgcccaggaactgccagatgctgctcttcagcgccacctttgaggacagcgtgtggaagtttgcccagaaggtggtgcctgaccccaacgtcatcaagctgaagcgggaggaggagaccctggacaccatcaagcagtactacgtgctgtgcagcagcagagatgagaagttccaggccctgtgcaacctgtatggagccatcaccatcgcccaggccatgatcttctgccacaccaggaagacagcctcctggctggccgctgagctgagcaaggagggccaccaggtggccctgctgagcggggagatgatggtggagcagagagctgctgtgattgagcgcttccgggagggcaaggagaaggtgctggtgaccaccaacgtgtgtgcccggggcattgatgtggagcaggtgtctgtggtgatcaactttgacctgcctgtggacaaggatggcaacccagacaatgagacctacctgcacagaattggaagaacaggccgctttgggaagaggggcctggccgtgaacatggtggacagcaagcacagcatgaacatcctgaaccgcatccaggagcacttcaacaagaagattgagcggctggacacagatgacctggatgaaattgagaagatcgccaactag

SEQ ID NO: 21592 - DNA, 921 bp, Artificial Sequence
  Description of Artificial Sequence: Synthetic coding sequence
atggcccgggtgcccctgggccgcagcctgaccctgagcccccggctggagcacaacggcatgaccagcgcccaccacaacttccggctgcccggcagccgggacagccctgccagcgccagccaggtggccgagatcatcgacctggagtggtatgagaagtctgaggagacccacgccagccagatcgagctgctggagaccagcagcacccaggagcccctgaatgccagcgaggccttctgcccccgggactgcatggtgcctgtggtgtttcctggccctgtgtcccaggagggctgctgccagttcacctgtgagctgctgaagcacatcatgtaccagaggcagcagctgcccctgccctatgagcagctgaagcacttctacaggaagcccagcccccaggccgaggagatgctgaagaagaagccccgggccaccacagaggtgagcagcaggaagtgccagcaggccctggccgagctggagagcgtgctgagccacctggaggacttctttgcccggaccctggtgccccgggtgctgatcctgctgggcggcaatgccctgagccccaaggagttctatgagctggacctgagcctgctggccccctacagcgtggaccagagcctgagcacagctgcctgcctgcggcggctcttccgggccatcttcatggctgatgccttcagcgagctgcaggccccacccctgatgggcaccgtggtgatggcccagggccacaggaactgtggggaggactggttccggcccaagctgaactacagagtgcccagccggggccacaagctgactgtgaccctgagctgtggccggcccagcatccgcaccacagcctgggaggactacatctggttccaggcccctgtgaccttcaagggcttccgggagtag

SEQ ID NO: 21593 - DNA, 426 bp, Artificial Sequence
  Description of Artificial Sequence: Synthetic coding sequence
atgccccagctgctgcagaacatcaatggcatcatcgaggccttccgccgctatgccaggacagagggcaactgcacagccctgaccagaggagagctgaagaggctgctggagcaggagtttgctgatgtgattgtgaagccccatgaccctgccaccgtggatgaggtgctgcggctgctggatgaggaccacacaggcaccgtggagttcaaggagttcctggtgctggtgttcaaggtggcccaggcctgcttcaagaccctgtctgagagcgctgagggcgcctgtggcagccaggagagcggcagcctgcacagcggggccagccaggagctgggcttccggccccgggtgcggcccctggccctgcggggcagcgctgccatgaccgggaagctgagcccccgggccaggaaggagtag

SEQ ID NO: 21594 - DNA, 480 bp, Artificial Sequence; identical to SEQ ID NO: 20848
  Description of Artificial Sequence: Synthetic coding sequence

SEQ ID NO: 21595 - DNA, 1506 bp, Artificial Sequence
  Description of Artificial Sequence: Synthetic coding sequence
atggacttcctgctgggcaaccccttcagcagccctgtgggccagagaattgagaaggccacagatggcagcctgcagagcgaggactgggccctgaacatggagatctgtgacatcatcaatgaaacagaggagggccccaaggatgccctgcgggctgtgaagaagagaattgtgggcaacaagaacttccacgaggtgatgctggcccacagcgcccggcggcacctgagcgccctgcaggtgctggagacctgtgtgaagaactgtggccaccgcttccacgtgctggtggccagccaggactttgtggagagcgtgctggtgaggaccatcctgcccaagaacaacccccccaccatcgtgcatgacaaggtgctgaacctgatccagagctgggcagatgccttccgcagcagcccagacctgactggagtggtgaccatctatgaggacctgcggaggaagggcctggagttccccatgacagacctggacatgctgagccccatccacaccccccagaggacagtgttcaacagcgagacccagagcggccaggacagcgtgggcacagacagcagccagcaggaggacagcggccagcacgccgcccccctgcctgccccacccatcctgagcggggacacccccatcgcccccaccccagagcagatcggcaagctgcggtctgagctggagatggtgtctggaaatgtgcgggtgatgtctgagatgctgacagagctggtgcccacccaggccgagcctgctgacctggagctgctgcaggagctgaacagaacctgccgggccatgcagcagagggtgctggagctgatcccccagatcgccaatgagcagctgacagaggagctgctgattgtgaatgacaacctgaacaacgtgttcctgcggcatgaaagatttgagcgcttcagaacaggccagaccaccaaggcccccagcgaggccgagcctgctgctgacctgattgacatgggccctgaccctgctgccactggaaacctgagcagccagctggccggcatgaacctgggcagcagctctgtgcgggccggcctgcagagcctggaggccagcggccgcctggaggatgaatttgacatgtttgccctgacccggggcagcagcctggccgaccagaggaaggaggtgaagtatgaggccccccaggccacagatggcctggccggggccctggatgcccggcagcagagcactggagccatccctgtgacccaggcctgcctgatggaggacatcgagcagtggctgagcacagatgtgggcaatgatgctgaggagcccaagggcgtgaccagcgaggagtttgacaagttcctggaggagcgggccaaggctgctgaccggctgcccaacctgagcagccccagcgctgagggccccccaggcccccccagcggccctgcccccaggaagaagacccaggagaaggatgatgacatgctgtttgccctgtag

SEQ ID NO: 21596 - DNA, 117 bp, Artificial Sequence
  Description of Artificial Sequence: Synthetic coding sequence
gagcctgtgtactttgctgagaaggtgatgagcctgggcaggaactggcaccggccctgcctgcgctgccagcgctgccacaagaccctgacagctggcagccacgccgaggtgtag

SEQ ID NO: 21597 - DNA, 1122 bp, Artificial Sequence; identical to SEQ ID NO: 19391
  Description of Artificial Sequence: Synthetic coding sequence

SEQ ID NO: 21598 - DNA, 453 bp, Artificial Sequence
  Description of Artificial Sequence: Synthetic coding sequence
atgcacactggagaccccaagcaggacctggcctatgaaaggcagtatgagcagcagacctaccaggtgattcctgaggtgatcaagaacttcatccagtacttccacaagacagtgtctgacctgattgaccagaaggtgtatgagctgcaggccagccgggtgtccagtgatgtgattgaccagaaggtgtatgagatccaggacatctatgagaacagctggaccaagctgacagagcgcttcttcaagaacaccccctggccagaggccgaggccatcgccccccaggtgggcaatgatgctgtgttcctgatcctgtacaaggagctgtactaccgccacatctatgccaaggtgtctgggggccccagcctggagcagagatttgagagctactacaactactgcaacctcttcaactacatcctgaatgctgatggccctgcctag

SEQ ID NO: 21599 - DNA, 2136 bp, Artificial Sequence
  Description of Artificial Sequence: Synthetic coding sequence
atggccatgcaggagaagtaccccacagagggcatcagccacgtgaccagccccaacttctgcagcagcagcggcagcccccccttccagcccatcaagagccacgtgaccatccccacagcccacgtgatgcccagcaccctgggcaccagccctgccaagcccaacagcacccctgtgggccccagcagcagcaagctgcccctgagcggcctggccgagagcgtgggcatgaccagaaatggagacctgggcgccatgaagcacagccctggcctgagccgggacctgatgtacttcagcggggccaccggggagaatggaattgagcagagctggttccctgctgtgggccacgagcggcaggaggaggccaggaagtttgacatccccagcatggagagcaccctgaaccagagcgccatgatggagaccctgtacagcgacccccaccaccgggtgcgcttccacaaccccaggaccagcaccagcaaggagctgtacagagtgctgcctgaggccaagaaggcccctggcagcggggctgtgtttgaaagaaatggcccccacagcaacagcagcggcgtgctgcccctgggcctgcagcctgcccctggcctgagcaagcccctgcccagccaggtgtggcagcccagcccagacacctggcacccccgggagcagagctgtgagctgagcacctgccggcagcagctggagctgatccggctgcagatggagcagatgcagctgcagaatggagccatctgccaccaccctgctgccttcggccccagcctgcccatcctggagcccgcccagtggatcagcatcctgaacagcaatgagcacctgctgaaggagaaggagctgctgattgacaagcagaggaagcacatcagccagctggagcagaaggtgcgggagagcgagctgcaggtgcacagcgccctgctgggccggcctgccccctttggagatgtgtgcctgctgcggctgcaggagctgcagcgggagaacaccttcctgcgggcccagtttgcccagaagacagaggccctgagccgggagaagattgacctggagaagaagctgagcgccagcgaggtggaggtgcagctgatccgggagagcctgaaggtggccctgcagaagcacagcgaggaggtgaagaagcaggaggagcgggtgaagggccgggacaagcacatcaacaacctgaagaagaagtgccagaaggagagcgagcagaaccgggagaagcagcagagaattgagaccctggagcgctacctggccgacctgcccaccctggaggaccaccagaagcagagccagcagctgaaggacagcgagctgaagagcacagagctgcaggagaaggtgacagagctggagagcctgctggaggagacccaggccatctgccgggagaaggagatccagctggagagcctgcggcagcgggaggccgagttcagcagcgctggccacagcctgcaggacaagcagagcgtggaggagaccagcggggagggccctgaggtggagatggagagctggcagaagagatatgacagcctgcagaagatcgtggagaagcagcagcagaagatggaccagctgcggagccaggtgcagagcctggagcaggaggtggcccaggaggagggcaccagccaggccctgcgggaggaggcccagaggcgggacagcgccctgcagcagctgaggacagctgtgaaggagctgtctgtgcagaaccaggacctgattgagaagaacctgaccctgcaggagcacctgcggcaggcccagcccggcagcccccccagcccagacacagcccagctggccctggagctgcaccaggagctggccagctgcctgcaggacctgcaggccgtgtgcagcatcgtgacccagagggcccagggccatgaccccaacctgagcctgctgctgggcatccacagcgcccagcaccctgagacccagctggacctgcagaagccagatgtgatcaagaggaagctggaggaggtgcagcagctgcggcgggacatcgaggacctgcggaccaccatgtctgacagatatgcccaggacatgggagagaactgtgtgacccagtag

SEQ ID NO: 21600 - DNA, 531 bp, Artificial Sequence
  Description of Artificial Sequence: Synthetic coding sequence
atggctgctgccactggagaccccggcctgagcaagctgcagtttgcccccttcagcagcgccctggatgtgggcttctggcatgagctgacccagaagaagctgaatgagtaccgcctggatgaggcccccaaggacatcaagggctactactacaatggagacagcgctggcctgcctgcccggctgaccctggagttcagcgcctttgacatgtctgcccccaccccagcccgctgctgcccagccatcggcaccctgtacaacaccaacaccctggagagcttcaagacagctgacaagaagctgctgctggagcaggccgccaatgagatctgggagagcatcaagagcggcacagccctggagaaccctgtgctgctgaacaagttcctgctgctgacctttgctgacctgaagaagtaccacttctactactggttctgctacccagccctgtgcctgcctgagagcctgcccctcatccagggccctgtgggcctggaccagcgcttcagcctgaagcagtag

SEQ ID NO: 21601 - DNA, 1443 bp, Artificial Sequence
  Description of Artificial Sequence: Synthetic coding sequence
atgaagctgaaggagctggagaggcctgctgtgcaggcctggagccctgccagccagtaccccctgtacctggccaccggcaccagcgcccagcagctggacagcagcttcagcaccaacggcaccctggagatctttgaggtggacttccgggaccccagcctggacctgaagcacagaggagtgctgagcgccctgagccgcttccacaagctggtgtggggcagctttggaagtggcctgctggagagcagtggagtcatcgtgggcggcggggacaatggcatgctgatcctgtacaacgtgacccacatcctgagcagcggcaaggagcccgtcatcgcccagaagcagaagcacactggagctgtgcgggccctggacctgaaccccttccagggcaacctgctggccagcggggccagtgacagcgagatcttcatctgggacctgaacaacctgaatgtgcccatgaccctgggcagcaagagccagcagcccccagaggacatcaaggccctgtcctggaaccggcaggcccagcacatcctgagcagcgcccaccccagcggcaaggctgtggtgtgggacctgaggaagaatgagcccatcatcaaggtgtctgaccacagcaacaggatgcactgcagcggcctggcctggcacccagacatcgccacccagctggtgctgtgcagtgaagatgaccggctgcctgtgatccagctgtgggacctgcgctttgccagcagccccctgaaggtgctggagagccacagccggggcatcctgtctgtgtcctggagccaggctgatgctgagctgctgctgaccagcgccaaggacagccagatcctgtgcaggaacctgggcagcagcgaggtggtgtacaagctgcccacccagagctcctggtgctttgatgtgcagtggtgcccccgggaccccagcgtcttctctgctgccagcttcaacggctggatcagcctgtacagcgtgatgggccgctcctgggaggtgcagcacatgaggcaggccgacaagatcagcagcagcttcagcaagggccagcccctgccccccctgcaggtgcctgagcaggtggcccaggcccccctcatcccccccctgaagaagccacccaagtggatcagaagacccaccggggtgtcctttgccttcggcggcaagctggtgaccttcggcctgcccagcaccccagcccacctggtgccccagccctgcccccggctggtgttcatcagccaggtgaccacagagagcgagttcctgatgaggtctgctgagctgcaggaggccctgggcagcggcaacctgctgaactactgccagaacaagagccagcaggccctgctgcagagcgagaagatgctgtggcagttcctgaagccagcccgggacagcagcggggcccggaggtag

SEQ ID NO: 21602 - DNA, 1842 bp, Artificial Sequence; identical to SEQ ID NO: 18580
  Description of Artificial Sequence: Synthetic coding sequence

SEQ ID NO: 21603 - DNA, 1446 bp, Artificial Sequence; identical to SEQ ID NO: 21094
  Description of Artificial Sequence: Synthetic coding sequence

SEQ ID NO: 21604 - DNA, 537 bp, Artificial Sequence
  Description of Artificial Sequence: Synthetic coding sequence
atgagcagcaatgaatgcttcaagtgtggccgcagcggccactgggcccgggagtgccccactggaggcggccggggccggggcatgaggagccggggccggggcggcttcaccagtgaccggggcttccagtttgtgagcagcagcctgcctgacatctgctaccgctgtggggagagcggccacctggccaaggactgtgacctgcaggaggatgaggcctgctacaactgtggccggggcggccacatcgccaaggactgcaaggagcccaagcgggagcgggagcagtgctgctacaactgtgggaagccaggccacctggcccgggactgtgaccatgctgatgagcagaagtgctacagctgtggggagtttggccacatccagaaggactgcaccaaggtgaagtgctaccgctgtggggagaccggccacgtggccatcaactgcagcaagaccagcgaggtgaactgctaccgctgtggggagagcggccacctggccagagaatgtaccatcgaggccacagcctag

SEQ ID NO: 21605 - DNA, 87 bp, Artificial Sequence
  Description of Artificial Sequence: Synthetic coding sequence
atggccatggcccccagccccagcctggtgcaggtgtacaccagccctgctgctgtggccgtgtgggagtggcaggacggcctgtag

SEQ ID NO: 21606 - DNA, 603 bp, Artificial Sequence
  Description of Artificial Sequence: Synthetic coding sequence
atggccgccacagccagagaagatggagccagcggccaggagcggggccagaggggctgtgagcactatgaccggggctgcctgctgaaggccccctgctgtgacaagctgtacacctgccgcctgtgccacgacaacaatgaagaccaccagctggaccgcttcaaggtgaaggaggtgcagtgcatcaactgtgagaagatccagcacgcccagcagacctgtgaagaatgttccaccctgtttggagagtactactgtgacatctgccacctgtttgacaaggacaagaagcagtaccactgtgagaactgtggcatctgccgcatcggccccaaggaggacttcttccactgcctgaagtgcaacctgtgcctggccatgaacctgcagggccgccacaagtgcattgaaaatgtgtcccggcagaactgccccatctgcctggaggacatccacaccagccgggtggtggcccacgtgctgccctgtggccacctgctgcacaggacctgctatgaggagatgctgaaggagctgcagatgagcatcatgtatgccctgtgcttccgctatgaccaggtgctggagacagctggatag

SEQ ID NO: 21607 - DNA, 567 bp, Artificial Sequence
  Description of Artificial Sequence: Synthetic coding sequence
atggccacccccctgggctggagcaaggccggcagcggctctgtgtgcctggccctggaccagctgagagatgtgattgagagccaggaggagctgatccaccagctgagaaatgtgatggtgctgcaggatgaaaattttgtgtccaaggaggagttccaggccgtggagaagaagctggtggaggagaaggccgcccacgccaagaccaaggtgctgctggccaaggaggaggagaagctgcagtttgccctgggggaggtggaggtgctgagcaagcagctggagaaggagaagctggcctttgagaaggccctgagctctgtgaagagcaaggtgctgcaggagagcagcaagaaggaccagctgatcaccaagtgcaatggccggcgggaggcccgggccctgcaccacggctacatcaatggcctcttccccaaccaccctgtgcctgtgtccaaggccggcttccacagcaacacctgcccccagctgcgcatccaggccggccctgggggcccccacctgaggaagggcctgaagggccctggccggcccaggaagtag

SEQ ID NO: 21608 - DNA, 381 bp, Artificial Sequence
  Description of Artificial Sequence: Synthetic coding sequence
atggacaggagcaagaggaacagcattgctggcttccccccccgggtggagcggctggaggagtttgagggcggcggcggcggggagggcaatgtgtcccaggtgggccgggtgtggcccagcagctaccgggccctgatcagcgccttcagccggctgacccggctggatgacttcacctgtgagaagattggcagcggcttcttcagcgaggtgttcaaggtgcgccaccgggccagcggccaggtgatggccctgaagatgaacaccctgagcagcaacagagccaacatgctgaaggaggtgcagctgatgaaccggctgagccaccccaacatcctgcgctgccgctccatgaaccagaacttcagccccaactag

SEQ ID NO: 21609 - DNA, 1443 bp, Artificial Sequence
  Description of Artificial Sequence: Synthetic coding sequence
atggagacagacctgaacagccaggacaggaaggacctggacaagttcatcaagttctttgccctgaagacagtgcaggtgattgtgcaggcccggctgggggagaagatctgcaccaggagcagcagcagccccaccggcagtgactggttcaacctggccatcaaggacatccctgaggtgacccatgaggccaagaaggccctggccggccagctgcctgctgtgggccgctccatgtgtgtggagatcagcctgaagaccagcgagggggacagcatggagctggagatctggtgcctggagatgaatgagaagtgtgacaaggagatcaaggtgtcctacacagtgtacaaccggctgagcctgctgctgaagagcctgctggccatcaccagggtgaccccagcctaccgcctgagcaggaagcagggccacgagtatgtgatcctgtaccgcatctactttggagaggtgcagctgagcggcctgggggagggcttccagacagtgcgggtgggcaccgtgggcacccctgtgggcaccatcaccctgagctgtgcctaccgcatcaacctggccttcatgagcacccggcagtttgagaggaccccacccatcatgggcatcatcatcgaccactttgtggaccggccctaccccagcagcagccccatgcacccctgcaactacagaacagctggggaggacaccggggtcatctaccccagcgtggaggacagccaggaggtgtgcaccaccagcttcagcaccagcccccccagccagctgatggtgcctgggaaggagggcggcgtgcccctggcccccaaccagcctgtgcacggcacccaggccgaccaggagcggctggccacctgcacccccagcgacaggacccactgtgccgccacccccagcagcagcgaggacacagagaccgtgagcaacagcagcgagggccgggccagcccccatgatgtgctggagaccatctttgtgaggaaggtgggcgcctttgtgaacaagcccatcaaccaggtgaccctgaccagcctggacatcccctttgccatgtttgcccccaagaacctggagctggaggacacagaccccatggtgaaccccccagacagccctgagacagagagccccctgcagggcagcctgcacagtgatggcagcagcggcggcagcagcggcaacacccatgatgactttgtgatgattgacttcaagccagccttcagcaaggatgacatcctgcccatggacctgggcaccttctaccgggagttccagaaccccccccagctgagcagcctgagcattgacatcggggcccagagcatggccgaggacctggacagcctgcctgagaagctggccgtgcatgagaagaatgtgcgggagtttgatgcctttgtggagaccctgcagtag

SEQ ID NO: 21610 - DNA, 390 bp, Artificial Sequence; identical to SEQ ID NO: 19988
  Description of Artificial Sequence: Synthetic coding sequence

SEQ ID NO: 21611 - DNA, 348 bp, Artificial Sequence
  Description of Artificial Sequence: Synthetic coding sequence
atggtggaggatgagctggccctgtttgacaagagcatcaatgagttctggaacaagttcaagagcacagacaccagctgccagatggccggcctgcgggacacctacaaggacagcatcaaggcctttgctgagaagctgtctgtgaagctgaaggaggaggagaggatggtggagatgttcctggagtaccagaaccagatcagccggcagaacaagctgatccaggagaagaaggacaacctgctgaagctgattgctgaggtgaagggcaagaagcaggagctggaggtgctgacagccaacatccaggacctgaaggaggagtacagcaggaagaaggagtag

SEQ ID NO: 21612 - DNA, 402 bp, Artificial Sequence
  Description of Artificial Sequence: Synthetic coding sequence
atggccagcagcgcccgggagcacctgctgtttgtgagaagaagaaacccccagatgagatacaccctgagccctgagaacctgcagagcctggccgcccagagctccatgcctgagaacatgaccctgcagagggccaacagcgacacagacctggtgaccagcgagagccgcagcagcctgacagcctccatgtatgagtacaccctgggccaggcccagaacctgatcatcttctgggacatcaaggaggaggtggaccccagcgactggattggcctgtaccacattgatgagaacagccctgccaacttctgggacagcaagaacagaggagtgacaggcacccagaagggccagatcgtgtggagaattgagcccggcccctacttcatggagtag

SEQ ID NO: 21613 - DNA, 264 bp, Artificial Sequence
  Description of Artificial Sequence: Synthetic coding sequence
atgagcctgtttggcaccaccagcggcttcggcaccagcggcacctccatgtttggcagcgccaccacagacaaccacaaccccatgaaggacatcgaggtgaccagcagcccagatgacagcatcggctgcctgtccttcagcccccccaccctgcccggcaacttcctgattgctggctcctgggccaatgatgtgcgctgctgggaggtgcaggacagcggccagaccatccccaaggcccagcagatgcacactggatag

SEQ ID NO: 21614 - DNA, 1329 bp, Artificial Sequence
  Description of Artificial Sequence: Synthetic coding sequence
atggccaacagctttgctgcccgcatcttcaccaccctgagtgacctgcagaccaacatggccaacctgaaggtgattggcatcgtcatcggcaagacagatgtgaagggcttcccagacaggaagagcatcggcagcgagcgctacaccttctccttcaccatccgggacagccctgcccactttgtgaatgctgcctcctggggcaatgaagactacatcaagagcctgagtgacagcttccgggtgggggactgtgtgatcatcgagaaccccctcatccagaggaaggagattgagcgggaggagaagttctccccagccacccccagcaactgcaagctgctgctgtctgagaaccacagcacagtgaaggtgtgcagcagctatgaggtggacaccaagctgctgagcctcatccacctgcctgtgaaggagagccatgactactacagcctgggggacatcgtggccaacggccacagcctgaatggccgcatcatcaacgtgctggccgctgtgaagtctgtgggggagcccaagtacttcaccaccagtgacaggaggaagggccagagatgtgaggtgcggctgtatgatgaaacagagagcagctttgccatgacctgctgggacaatgaaagcatcctgctggcccagagctggatgccccgggagaccgtcatctttgccagtgatgtgcgcatcaactttgacaagttcaggaactgcatgacagccaccgtcatcagcaagaccatcatcaccaccaacccagacatccctgaggccaacatcctgctgaacttcatccgggagaacaaggagaccaacgtgctggatgatgaaattgacagctacttcaaggagagcatcaacctgagcaccatcgtggatgtgtacacagtggagcagctgaagggcaaggccctgaagaatgaaggcaaggctgaccccagctatggcatcctgtatgcctacatcagcaccctgaacattgatgatgagaccaccaaggtggtgaggaaccgctgcagcagctgtggctacatcgtgaatgaggccagcaacatgtgcaccacctgcaacaagaacagcctggacttcaagtctgtgttcctgtccttccacgtgctgattgacctgacagaccacacaggcaccctgcacagctgcagcctgactggatctgtggccgaggagaccctgggctgcacctttgtgctgagccaccgggcccggagcggcctgaagatctctgtgctgagctgcaagctggccgaccccacagaggccagcaggaacctgagcggccagaagcacgtgtag

SEQ ID NO: 21615 - DNA, 651 bp, Artificial Sequence
  Description of Artificial Sequence: Synthetic coding sequence
atgaacaaccagaagcagcagaagcccaccctgagcggccagcgcttcaagaccaggaagagagatgagaaggagagatttgaccccacccagttccaggactgcatcatccagggcctgacagaaacaggaacagacctggaggccgtggccaagttcctggatgccagcggggccaagctggactaccgccgctatgcagagaccctgtttgacatcctggtggccggcggcatgctggcccctgggggcaccctggctgatgacatgatgaggacagatgtgtgtgtgtttgctgcccaggaggacctggagaccatgcaggcctttgcccaggtgttcaacaagctgatccgccgctacaagtacctggagaagggctttgaagatgaggtgaagaagctgctgctcttcctgaagggcttcagcgagagcgagaggaacaagctggccatgctgactggagtgctgctggccaacggcaccctgaatgccagcatcctgaacagcctgtacaatgaaaacctggtgaaggagggcgtgtctgctgcctttgctgtgaagctgttcaagtcctggatcaatgagaaggacatcaatgctgtggccgccagcctgaggaaggtgtccatggacaaccggctgatgtag

SEQ ID NO: 21616 - DNA, 429 bp, Artificial Sequence; identical to SEQ ID NO: 21135
  Description of Artificial Sequence: Synthetic coding sequence

SEQ ID NO: 21617 - DNA, 447 bp, Artificial Sequence
  Description of Artificial Sequence: Synthetic coding sequence
gccatccacatcctggatgtgctggtgctgaatggaacagatgtgcgggagcagcacttcaaccagaggatccagctggccgagaagtttgtgaaggctgtgtccaagcccagcaggccagacatgaaccccatccgggtgaaggaggtgtaccgcctggaggagatggagaagatctttgtgcggctggagatgaagatcatcaagggcagcagcggcacccccaagctgagctacacaggaagagatgacagacactttgtgcccatgggcctgtacatcgtgaggacagtgaatgagccctggaccatgggcttcagcaagagcttcaagaagaagttcttctacaacaagaagaccaaggacagcacctttgacctgccctactaccccttccccagcttcttcttccccaacagacgctacaacctgctgctgtttgtgtag

SEQ ID NO: 21618 - DNA, 300 bp, Artificial Sequence
  Description of Artificial Sequence: Synthetic coding sequence
atggaggagatcccagcccaggaggccgccggcagcccccgggtgcagttccagagcctggagacccagagtgaatgtctgagccctgagccccagtttgtgcaggacacagacatggagcagggcctgaccggcggcatcctgctgcggctgcccaccacccgcatccacagcgtgaacagctgcccagccctgagccacacccaggccagcgccttcagcggggagaccctggccgtgctgacagctggcatcagcaagcgctggcccaagtaccgcctgcccatcgacatcgcctag

SEQ ID NO: 21619 - DNA, 2493 bp, Artificial Sequence
  Description of Artificial Sequence: Synthetic coding sequence
atgaagaggggccgcctgcccagcagcagtgaagattctgatgacaatggcagcctgagcaccacctggagccagaacagccgcagccagcaccggcgcagcagctgcagcagacatgaggacaggaagcccagcgaggtgttcagaacagacctgatcacagccatgaagctgcatgacagctaccagctgaacccagatgagtactacgtgctggccgacccctggaggcaggagtgggagaagggcgtgcaggtgcctgtgtccccaggcaccatcccccagcctgtggcccggcccaagaagtacatcgtgagcagcggcagcgagcccccagagctgggctacgtggacatccgcaccctggccgacagcgtgtgccgctatgacctgaatgacatggatgctgcctggctggagctgaccaatgaggagttcaaggagatgggcatgcctgagctggatgagtacaccatggagcgggtgctggaggagtttgagcagcgctgctatgacaacatgaaccacgccatcgagacagaggagggcctgggcatcgagtatgatgaagatgtggtgtgtgatgtgtgccagagcccagatggagaagatggaaatgagatggtgttctgtgacaagtgcaacatctgtgtgcaccaggcctgctacggcatcctgaaggtgcctgagggctcctggctgtgcaggacctgtgccctgggcgtgcagcccaagtgcctgctgtgccccaagaagggcggggccatgaagcccaccaggagcggcaccaagtgggtgcacgtgtcctgtgccctgtggatccctgaggtgtccatcggcagccctgagaagatggagcccatcaccaaggtgagccacatccccagcagccgctgggccctggtgtgcagcctgtgcaatgagaagtttggagccagcatccagtgcagcgtgaagaactgcaggacagccttccacgtgacctgtgcctttgaccggggcctggagatgaagaccatcctggctgaaaatgatgaggtgaagttcaagagctactgccccaagcacagcagccacaggaagccagaggagagcctgggcaagggggccgcccaggagaatggagcccctgagtgcagccccaggaaccccctggagccctttgccagcctggagcagaaccgggaggaggcccaccgggtgtctgtgaggaagcagaagctgcagcagctggaggatgagttctacacctttgtgaacctgctggatgtggcccgggccctgcggctgcctgaggaggtggtggacttcctgtaccagtactggaagctgaagaggaaggtgaacttcaacaagcccctcatcacccccaagaaggatgaggaggacaacctggccaagcgggagcaggatgtgctcttccggcggctgcagctgttcacccacctgcggcaggacctggagcgggtgaggaacctgacctacatggtgacccggcgggagaagatcaagaggtctgtgtgcaaggtgcaggagcagatcttcaacctgtacaccaagctgctggagcaggagcgggtgtctggagtgcccagcagctgcagcagcagcagcctggagaacatgctgctcttcaacagccccagcgtgggcccagatgcccccaagattgaggacctgaagtggcacagcgccttcttcaggaagcagatgggcaccagcctggtgcacagcctgaagaagccccacaagagggaccccctgcagaacagccctggcagcgagggcaagaccctgctgaagcagcctgacctgtgtggccggcgggagggcatggtggtgcctgagagcttcctgggcctggagaagacctttgctgaggcccggctcatcagcgcccagcagaagaatggagtggtgatgccagaccacggcaagagaagagacaaccgcttccactgtgacctgatcaagggggacctgaaggacaagagcttcaagcagagccacaagcccctgcggagcacagatgtgtcccagaggcacctggacaacacccgggccgccaccagccctggggtgggccagagcgcccctggcaccaggaaggagatcgtgcccaagtgcaatggcagcctcatcaaggtgaactacaaccagacagctgtgaaggtgcccaccaccccagccagccctgtgaagaactggggcggcttccgcatccccaagaagggggagcggcagcagcagggcgaggcccatgatggagcctgccaccagcacagcgactacccctacctgggcctgggccgggtgcctgccaaggagcgggccaagagcaagctgaagagtgacaatgaaaatgatggctacgtgcctgatgtggagatgtctgacagcgagagcgaggccagcgagaagaagtgcatccacaccagcagcaccatcagcagaagaacagacatcatccgccgcagcatcctggccagctag

SEQ ID NO: 21620 - DNA, 402 bp, Artificial Sequence
  Description of Artificial Sequence: Synthetic coding sequence
atggccagcgaggacatcgccaagctggccgagaccctggccaagacccaggtggccggcggccagctgtccttcaagggcaagagcctgaagctgaacacagcagaagatgccaaggatgtgatcaaggagattgaggactttgacagcctggaggccctgcggctggagggcaacacagtgggcgtggaggccgcccgggtgattgccaaggccctggagaagaagtctgagctgaagcgctgccactggagcgacatgttcaccggccgcctgaggacagagatccccccagccctgatcagcctgggggagggcctcatcacagctggggcccagctggtggagctggacctgagtgacaatgccttcggcccagatggagtgcagggctttgaatag

SEQ ID NO: 21621 - DNA, 390 bp, Artificial Sequence
  Description of Artificial Sequence: Synthetic coding sequence
atgagccctggcagcggcgtgaagtctgagtacatgaagcgctaccaggagccccgctgggaggagtatggcccctgctaccgggagctgctgcactaccgcctgggccgccgcctgctggagcaggcccacgccccctggctgtgggatgactggggccctgctggcagcagtgaagattctgccagcagcgagagcagtggagctgggggccctgccccccgctgtgccccacccagccccccacctcctgtggagcccgccacccaggaggaggccgagcggcgggcccggggggcccctgaggagcaggatgctgaggccggagatgctgaggccgaggatgctgaagatgctgccctgcctggaaatgcctggctgcggacctag

SEQ ID NO: 21622 - DNA, 390 bp, Artificial Sequence; identical to SEQ ID NO: 19988
  Description of Artificial Sequence: Synthetic coding sequence

SEQ ID NO: 21623 - DNA, 402 bp, Artificial Sequence
  Description of Artificial Sequence: Synthetic coding sequence
atggccgagaagctgatcacccagaccttcagccaccacaaccagctggcccagaagacccggcgggagaagagggcccggcaggaggccgagcggcgggagaaggccgagagagctgcccggctggccaaggaggccaagtctgagaccagcggcccccagatcaaggagctgacagatgaggaggccgagcggctgcagctggagattgaccagaagaaggatgctgaaaatcatgaggcccagctgaagaatggcagcctggacagccctgggaagcaggacacagaggaggatgaggaggaggatgagaaggacaagggcaagctgaagcccaacctgggcaatggagctgacctgcccaactaccgctggacccagaccctgtctgagctggactag

SEQ ID NO: 21624 - DNA, 2373 bp, Artificial Sequence; identical to SEQ ID NO: 18522
  Description of Artificial Sequence: Synthetic coding sequence

SEQ ID NO: 21625 - DNA, 1356 bp, Artificial Sequence
  Description of Artificial Sequence: Synthetic coding sequence
atgtacggggcccctggggccccagcccagagcgcctctgtgacagtggtgcgcagcctgcggcggcccccaccccaggccaccggggtgtccttcatgaacaaccagaagcagcagaagcccaccctgagcggccagcgcttcaagaccaggaagagagatgagaaggagagatttgaccccacccagttccaggactgcatcatccagggcctgacagaaacaggaacagacctggaggccgtggccaagttcctggatgccagcggggccaagctggactaccgccgctatgcagagaccctgtttgacatcctggtggccggcggcatgctggcccctgggggcaccctggctgatgacatgatgaggacagatgtgtgtgtgtttgctgcccaggaggacctggagaccatgcaggcctttgcccaggtgttcaacaagctgatccgccgctacaagtacctggagaagggctttgaagatgaggtgaagaagctgctgctcttcctgaagggcttcagcgagagcgagaggaacaagctggccatgctgactggagtgctgctggccaacggcaccctgaatgccagcatcctgaacagcctgtacaatgaaaacctggtgaaggagggcgtgtctgctgcctttgctgtgaagctgttcaagtcctggatcaatgagaaggacatcaatgctgtggccgccagcctgaggaaggtgtccatggacaaccggctgatggagctgtttcctgccaacaagcagagcgtggagcacttcaccaagtacttcacagaggccggcctgaaggagctgtctgaatatgtgaggaaccagcagaccatcggggccaggaaggagctgcagaaggagctgcaggagcagatgagcagaggagaccccttcaaggacatcatcctgtatgtgaaggaggagatgaagaagaacaacatccctgagcctgtggtgattggaattgtgtggagctctgtgatgagcacagtggagtggaacaagaaggaggagctggtggccgagcaggccatcaagcacctgaagcagtacagccccctgctggccgccttcaccacccagggccagagcgagctgaccctgctgctgaagatccaggagtactgctatgacaacatccacttcatgaaggccttccagaagatcgtggtgctcttctacaaggccgaggtgctgtctgaggagcccatcctgaagtggtacaaggatgcccacgtggccaagggcaagtctgtgttcctggagcagatgaagaagtttgtggagtggctgaagaatgctgaggaggagagcgagagcgaggccgaggagggggactag

SEQ ID NO: 21626 - DNA, 948 bp, Artificial Sequence
  Description of Artificial Sequence: Synthetic coding sequence
atggccggcggggcccgggaggtgctgaccctgcagctgggccactttgctggctttgtgggcgcccactggtggaaccagcaggatgctgccctgggccgggccacagacagcaaggagcccccaggagagctgtgcccagatgtgctgtacagaactggaagaaccctgcacggccaggagacctacacccccaggctcatcctgatggacctgaagggcagcctgagcagcctgaaggaggagggcggcctgtacagagacaagcagctggatgctgccatcgcctggcagggcaagctgaccacccacaaggaggagctgtaccccaagaacccctacctgcaggacttcctgtctgctgagggcgtgctgagcagtgatggagtgtggagggtgaagagcatccccaacgggaagggcagcagccccctgcccacagccaccacccccaagcccctcatccccacagaggccagcatccgggtgtggagcgacttcctgcgggtgcacctgcaccccaggagcatctgcatgatccagaagtacaaccatgatggagaggccggccgcctggaggccttcggccagggcgagagcgtgctgaaggagcccaagtaccaggaggagctggaggaccggctgcacttctacgtggaggagtgtgactacctgcaggtggtggcctggcagtgtgccctgcagggcggcagcagcagccacccagccaactacctgagcagcctgaccccagcccagggcttccagatcctgtgtgacctgcatgatggcttcagcggcgtgggcgccaaggctgctgagctgctgcaggatgagtacagcggccggggcatcatcacctggggcctgctgcccggcccctaccaccggggcgtgtctggcacctggaggagcaagcacagcaaccccatcggccgggtggcctag

SEQ ID NO: 21627 - DNA, 285 bp, Artificial Sequence
  Description of Artificial Sequence: Synthetic coding sequence
tgcaccagcagctgcacccccagctgctgccagcagagcagctgccagcctgcctgctgcaccagcagcccctgccagcaggcctgctgcgtgcctgtgtgctgcaagacagtgtgctgcaagcccagcagctgccagcctgcctgctgcatcagcagcccctgccagcagagctgctgcgtgcctgtgtgctgcaagcccatctgctgcgtgcccccagcctgctgcaccaccagctgctgccggcccagcagctctgtgtccctgctgtgcaggcctgtgtag

SEQ ID NO: 21628 - DNA, 1221 bp, Artificial Sequence
  Description of Artificial Sequence: Synthetic coding sequence
atggccgccaacctgagcagaaatggacctgccctgcaggaggcctacgtgcgggtggtgacagagaagagccccacagactgggccctcttcacctatgagggcaacagcaatgacatccgggtggccggcactggagagggcggcctggaggagatggtggaggagctgaacagcggcaaggtgatgtatgccttctgccgggtgaaggaccccaacagcggcctgcccaagtttgtgctgatcaactggggcgcccacgtgaccatcaatgcccgggcagaggaggatgtggagcctgagtgcatcatggagaaggtggccaaggccagcggggccaactacagcttccacaaggagagcggccgcttccaggatgtgggcccccaggcccctgtgggctctgtgtaccagaagaccaatgctgtgtctgagatcaagagggtgggcaaggacagcttctgggccaaggccgagaaggaggaggagaacagaaggctggaggagaagagaagagctgaggaggcccagaggcagctggagcaggagcggcgggagcgggagctgcgggaggccgcccggcgggagcagcgctaccaggagcagggcggggaggccagcccccagagcaggacctgggagcagcagcaggaggtggtgtccaggaacagaaatgagcaggagagcgctgtgcacccccgggagatcttcaagcagaaggagcgggccatgagcaccaccagcatcagcagcccccagcccgggaagctgcggagccccttcctgcagaagcagctgacccagcctgagacccacttcggccgggagcctgctgctgccatcagccggcccagggctgacctgcctgctgaggagcccgcccccagcaccccaccctgcctggtgcaggccgaggaggaggccgtgtatgaggagcccccagagcaggagaccttctatgagcagccccccctggtgcagcagcagggcgccggcagcgagcacatcgaccaccacatccagggccagggcctgagcggccagggcctgtgtgcccgggccctgtatgactaccaggccgcagatgacacagagatcagctttgatcctgaaaatctcatcactggaattgaggtgattgatgagggctggtggaggggctacggcccagatggccacttcggcatgtttcctgccaactacgtggagctgattgaatag

SEQ ID NO: 21629 - DNA, 981 bp, Artificial Sequence; identical to SEQ ID NO: 20766
  Description of Artificial Sequence: Synthetic coding sequence

SEQ ID NO: 21630 - DNA, 684 bp, Artificial Sequence
  Description of Artificial Sequence: Synthetic coding sequence
atgctgtgctggggctactggagcctgggccagcccggcatcagcaccaacctgcagggcatcgtggccgagccccaggtgtgtggcttcatcagtgacagatctgtgaaggaggtggcctgtggcggcaaccacagcgtcttcctgctggaggatggagaggtgtacacctgtggcctgaacaccaagggccagctgggccacgagcgggagggcaacaagccagagcagatcggggccctggccgaccagcacatcatccacgtggcctgtggggagagccacagcctggccctgagtgaccggggccagctgttctcctggggcgccggcagtgatggccagctgggcctgatgaccacagaggacagcgtggccgtgcccaggctcatccagaagctgaaccagcagaccatcctgcaggtgtcctgtggcaactggcactgcctggccctggccgcagatggccagttcttcacctggggcaagaacagccacggccagctgggcctgggcaaggagttccccagccaggccagcccccagagggtgcgcagcctggagggcatccccctggcccaggtggccgccggcggggcccacagctttgccctgagcctgagcggggctgtgtttggctggggcatgaacaatgccggccagctgggcctgagtgatgaatag

SEQ ID NO: 21631 - DNA, 624 bp, Artificial Sequence
  Description of Artificial Sequence: Synthetic coding sequence
atgagcagccccctggccagcctgagcaagaccaggaaggtgcccctgcccagcgagcccatgaaccctggaagaagaggcatccgcatctatggagatgtgcctgccagccatgacagcgagctgatggccttcatgaccaggaagctgtgggacctggagcagcaggtgaaggcccagacagatgagatcctgagcaaggaccagaagattgctgccctggaggacctggtgcagaccctgcggccccaccctgctgaggccaccctgcagaggcaggaggagctggagaccatgtgtgtgcagctgcagaggcaggtgcgggagatggagcgcttcctgagtgactatggcctgcagtgggtgggggagcccatggaccaggaggacagcgagagcaagacagtgtctgaacatggagagcgggactggatgacagccaagaagttctggaagccaggggacagcctggcccctcctgaggtggactttgaccggctgctggccagcctgcaggacctgtctgagctggtggtggagggggacacccaggtgacccctgtgcctggaggagcccggctgcggaccctggagcccatccccctgaagctgtacagaaattag

SEQ ID NO: 21632 - DNA, 717 bp, Artificial Sequence; identical to SEQ ID NO: 21576
  Description of Artificial Sequence: Synthetic coding sequence

SEQ ID NO: 21633 - DNA, 369 bp, Artificial Sequence
  Description of Artificial Sequence: Synthetic coding sequence
gtgcgggagctggaggccgagctggatgctgagcagaagaagcacgccgaggccctgaagggcgtgaggaagcatgaaagaagagtgaaggagctggcctaccaggccgaggaggacaggaagaacctggccaggatgcaggacctggtggacaagctgcagagcaaggtgaagagctacaagaggcagtttgaggaggccgagcagcaggccaacaccaacctggccaagtacaggaaggcccagcacgagctggatgatgctgaggagagagctgacatggccgagacccaggccaacaagctgcgggcccggaccagagatgccctgggccccaagctgagcctgagcccccagcacaaggagtag

SEQ ID NO: 21634 - DNA, 483 bp, Artificial Sequence
  Description of Artificial Sequence: Synthetic coding sequence
tgagaaagcctggtgggcctgcaggagggcaagagcacagagcagggcaaccacgaccagctgaaggagctgtacagcgctggcaacctgactgtgctggccacagaccccctgctgcaccaggaccctgtgcagctggacttccacttccggctgaccagccagaccagcgcccactggcacggcctgctgtgtgacagaagactcttcctggacatcccctaccaggccctggaccagggcaaccgggagagcctgacagccaccctggagtatgtggaggagaagaccaacgtggacagcgtgtttgtgaacttccagaatgacagaaatgacagaggagccctgctgcgggccttctcctacatgggctttgaggtggtgcggccagaccacccagccctgccccccctggacaacgtcatcttcatggtgtaccccctggagagagatgtgggccacctgcccagcgagcccccatag

SEQ ID NO: 21635 - DNA, 102 bp, Artificial Sequence
  Description of Artificial Sequence: Synthetic coding sequence
atgtctgtgacctatgatgacagcgtgggcgtggaggtgtccagtgacagcttctgggaggtgggcaactacaagaggacagtgaagagaattgatgactag

SEQ ID NO: 21636 - DNA, 402 bp, Artificial Sequence
  Description of Artificial Sequence: Synthetic coding sequence
atgtggagcctgacagccagcgagggggagagcaccacagcccacttcttcctgggcgctggagatgagggcctgggcacccggggcatcggcatgaggcctgaggagagtgacagcgagctgctggaggatgaggaggatgaggtgcccccagagccccagatcatcgtgggcatctgtgccatgaccaagaagagcaagagcaagcccatgacccagatcctggagcggctgtgccgctttgactacctgactgtggtgatcctgggagaagatgtgatcctgaatgaacctgtggagaactggcccagctgccactgcctgatctccttccacagcaagggcttccccctggacaaggctgtggcctacagcaagctgaggaaccccttcctgatctag

SEQ ID NO: 21637 - DNA, 939 bp, Artificial Sequence; identical to SEQ ID NO: 20845
  Description of Artificial Sequence: Synthetic coding sequence

SEQ ID NO: 21638 - DNA, 1308 bp, Artificial Sequence
  Description of Artificial Sequence: Synthetic coding sequence
tgaagcatcctgaacagcaatgagcacctgctgaaggagaaggagctgctgattgacaagcagaggaagcacatcagccagctggagcagaaggtgcgggagagcgagctgcaggtgcacagcgccctgctgggccgcccagccccctttggagatgtgtgcctgctgcggctgcaggagctgcagcgggagaacaccttcctgcgggcccagtttgcccagaagacagaggccctgagccgggagaagattgacctggagaagaagctgagcgccagcgaggtggaggtgcagctgatccgggagagcctgaaggtggccctgcagaagcacagcgaggaggtgaagaagcaggaggagcgggtgaagggccgggacaagcacatcaacaacctgaagaagaagtgccagaaggagagcgagcagaaccgggagaagcagcagagaattgagaccctggagcgctacctggccgacctgcccaccctggaggaccaccagaagcagagccagcagctgaaggacagcgagctgaagagcacagagctgcaggagaaggtgacagagctggagagcctgctggaggagacccaggccatctgccgggagaaggagatccagctggagagcctgcggcagcgggaggccgagttcagcagcgctggccacagcctgcaggacaagcagagcgtggaggagaccagcggggagggccctgaggtggagatggagagctggcagaagagatatgacagcctgcagaagatcgtggagaagcagcagcagaagatggaccagctgcggagccaggtgcagagcctggagcaggaggtggcccaggaggagggcaccagccaggccctgcgggaggaggcccagaggcgggacagcgccctgcagcagctgaggacagctgtgaaggagctgtctgtgcagaaccaggacctgattgagaagaacctgaccctgcaggagcacctgcggcaggcccagcccggcagcccccccagcccagacacagcccagctggccctggagctgcaccaggagctggccagctgcctgcaggacctgcaggccgtgtgcagcatcgtgacccagagggcccagggccatgaccccaacctgagcctgctgctgggcatccacagccagcaccctgagacccagctggacctgcagaagccagatgtgatcaagaggaagctggaggaggtgcagcagctgcggcgggacatcgaggacctgcggaccaccatgtctgacagatatgcccaggacatgggagagaactgtgtgacccagtag

SEQ ID NO: 21639 - DNA, 474 bp, Artificial Sequence
  Description of Artificial Sequence: Synthetic coding sequence
atggagctgcgctgtggcggcctgctcttcagcagcagatttgacagcggcaacctggcccacgtggagaaggtggagagcctgagcagtgatggagagggcgtgggcggcggggccagcgccctgaccagcggcatcgccagcagcccagactatgagttcaacgtgtggaccaggccagactgtgccgagacagaatttgaaaatggaaacagatcctggttctacttctctgtgcggggcggcatgcctgggaagctgatcaagatcaacatcatgaacatgaacaagcagagcaagctgtacagccagggcatggccccctttgtgaggaccctgcccacccggccccgctgggagcgcatccgggaccggcccacctttgagatgacagagacccagtttgtgctgagctttgtgcacagatttgtggagggccgcggggccaccaccttctttgccttctgctactag

SEQ ID NO: 21640 - DNA, 1620 bp, Artificial Sequence; identical to SEQ ID NO: 19050
  Description of Artificial Sequence: Synthetic coding sequence

SEQ ID NO: 21641 - DNA, 6141 bp, Artificial Sequence
  Description of Artificial Sequence: Synthetic coding sequence
atggatgaggtggagcaggaccagcacgaggcccggctgaaggagctgtttgacagctttgacaccactggaacaggcagcctgggccaggaggagctgacagacctgtgccacatgctgagcctggaggaggtggcccctgtgctgcagcagaccctgctgcaggacaacctgctgggccgggtgcactttgaccagttcaaggaggccctgatcctgatcctgagcaggaccctgagcaatgaggagcacttccaggagccagactgcagcctggaggcccagcccaagtatgtgcggggcggcaagagatatggaagaagaagcctgcctgagttccaggagagcgtggaggagttccctgaggtgaccgtcatcgagcccctggatgaggaggcccggcccagccacatcccagctggggactgcagcgagcactggaagacccagaggtctgaggagtatgaagctgagggccagctgcgcttctggaacccagatgacctgaatgccagccagagcggcagcagccccccccaggactggattgaggagaagctgcaggaggtgtgtgaggacctgggcatcaccagagatggccacctgaacaggaagaagctggtgtccatctgtgagcagtatggcctgcagaatgtggatggagagatgctggaggaggtgttccacaacctggaccctgatggcaccatgtctgtggaggacttcttctacggcctcttcaagaatggcaagagcctgacccccagcgccagcaccccctaccggcagctgaagaggcacctgtccatgcagagctttgatgagagcggccgccgcaccaccaccagcagcgccatgaccagcaccatcggcttccgggtcttcagctgcctggatgatggcatgggccacgcctctgtggagcgcatcctggacacctggcaggaggagggcatcgagaacagccaggagatcctgaaggccctggacttcagcctggatggcaacatcaacctgacagagctgaccctggccctggagaatgagctgctggtgaccaagaacagcatccaccaggccgccctggccagcttcaaggccgagatccgccacctgctggagcgggtggaccaggtggtgcgggagaaggagaagctgcggagtgacctggacaaggccgagaagctgaagagcctgatggccagcgaggtggatgaccaccacgccgccattgaaagaagaaatgagtacaacctgaggaagctggatgaggagtacaaggagagaattgctgccctgaagaatgagctgaggaaggagcgggagcagatcctgcagcaggccggcaagcagaggctggagctggagcaggagattgagaaggccaagacagaggagaactacatccgggaccggctggccctgagcctgaaggagaacagccggctggagaatgagctgctggagaatgctgagaagctggccgagtatgagaacctgaccaacaagctgcagaggaacctggagaatgtgctggccgagaagtttggagacctggaccccagcagcgctgagttcttcctgcaggaggagcggctgacccagatgagaaatgaatatgaaaggcagtgccgggtgctgcaggaccaggtggatgagctgcagagcgagctggaggagtaccgggcccagggccgggtgctgcggctgcccctgaagaacagccccagcgaggaggtggaggccaacagcggcggcatcgagcctgagcacggcctgggcagcgaggagtgcaaccccctgaacatgagcattgaagctgagctggtgattgagcagatgaaggagcagcaccaccgggacatctgctgcctgcggctggagctggaggacaaggtgcgccactatgagaagcagctggatgaaacagtggtgtcctgcaagaaggcccaggagaacatgaagcagagacatgaaaatgagacccacaccctggagaagcagatcagtgacctgaagaatgaaattgctgagctgcagggccaggccgctgtgctgaaggaggcccaccacgaggccacctgcagacatgaggaggagaagaagcagctgcaggtgaagctggaggaggagaagacccacctgcaggagaagctgcggctgcagcacgagatggagctgaaggcccggctgacccaggcccaggccagctttgagcgggagcgggagggcctgcagagcagcgcctggacagaggagaaggtgcggggcctgacccaggagctggagcagttccaccaggagcagctgaccagcctggtggagaagcacaccctggagaaggaggagctgaggaaggagctgctggagaagcaccagcgggagctgcaggagggccgggagaagatggagacagagtgcaacagaaggaccagccagatcgaggcccagttccagagcgactgccagaaggtgacagagcgctgtgagagcgccctgcagagcctggagggccgctaccggcaggagctgaaggacctgcaggagcagcagcgggaggagaagagccagtgggagtttgagaaggatgagctgacccaggagtgtgccgaggcccaggagctgctgaaggagaccctgaagcgggagaagaccaccagcctggtgctgacccaggagcgggagatgctggagaagacctacaaggagcacctgaacagcatggtggtggagcggcagcagctgctgcaggacctggaggacctgagaaatgtgtctgagacccagcagagcctgctgagtgaccagatcctggagctgaagagcagccacaagcgggagctgcgggagcgggaggaggtgctgtgccaggccggggccagcgagcagctggccagccagaggctggagcggctggagatggagcatgaccaggagcggcaggagatgatgagcaagctgctggccatggagaacatccacaaggccacctgtgaaacagctgaccgggagcgggcagagatgagcacagagatcagccggctgcagagcaagatcaaggagatgcagcaggccaccagccccctgtccatgctgcagagcggctgccaggtgattggagaggaggaggtggagggagatggagccctgagcctgctgcagcagggcgagcagctgctggaggagaatggagatgtgctgctgagcctgcagagggcccacgagcaggccgtgaaggaaaatgtgaagatggccacagagatcagccggctgcagcagaggctgcagaagctggagcccggcctggtgatgagcagctgcctggatgagcccgccacagagttcttcggcaacacagctgagcagacagagcagttcctgcagcagaacagaaccaagcaggtggagggcgtgacccggcggcacgtgctgagtgacctggaggatgatgaggtgcgggacctgggcagcacaggcaccagctctgtgcagaggcaggaggtgaagattgaggagagcgaggcctctgtggagggcttcagcgagctggagaacagcgaggagaccaggacagagagctgggagctgaagaaccagatcagccagctgcaggagcagctgatgatgctgtgtgccgactgtgaccgggccagcgagaagaagcaggacctgctgtttgatgtgtctgtgctgaagaagaagctgaagatgctggagcgcatccctgaggccagccccaagtacaagctgctgtatgaagatgtgtcccgggagaatgactgcctgcaggaggagctgaggatgatggagaccaggtatgatgaggccctggagaacaacaaggagctgacagctgaggtgttccggctgcaggatgagctgaagaagatggaggaggtgacagagaccttcctgagcctggagaagagctatgatgaggtgaagattgaaaatgaaggcctgaatgtgctggtgctgcggctgcagggcaagattgagaagctgcaggagagcgtggtgcagagatgtgactgctgcctgtgggaggccagcctggagaacctggagattgaaccagatggcaacatcctgcagctgaaccagaccctggaggagtgtgtgccccgggtgcgctctgtgcaccacgtgattgaggagtgcaagcaggagaaccagtacctggagggcaacacccagctgctggagaaggtgaaggcccatgaaattgcctggctgcacggcaccatccagacccaccaggagcggccccgggtgcagaaccaggtgatcctggaggagaacaccaccctgctgggcttccaggacaagcacttccagcaccaggccaccatcgccgagctggagctggagaagaccaagctgcaggagctgaccaggaagctgaaggagcgggtgaccatcctggtgaagcagaaggatgtgctgagccacggggagaaggaggaggagctgaaggccatgatgcatgacctgcagatcacctgcagcgagatgcagcagaaggtggagctgctgcgctatgagagcgagaagctgcagcaggagaacagcatcctgagaaatgagatcaccaccctgaatgaggaggacagcatcagcaacctgaagctgggcaccctgaatggcagccaggaggagatgtggcagaagacagagaccgtgaagcaggagaatgctgctgtgcagaagatggtggagaacctgaagaagcagatcagcgagctgaagatcaagaaccagcagctggacctggagaacacagagctgagccagaagaacagccagaaccaggagaagctgcaggagctgaaccagaggctgacagagatgctgtgccagaaggagaaggagcccggcaacagcgccctggaggagcgggagcaggagaagttcaacctgaaggaggagctggagcgctgcaaggtgcagagcagcaccctggtgagcagcctggaggccgagctgtctgaggtgaagatccagacccacatcgtgcagcaggagaaccacctgctgaaggatgagctggagaagatgaagcagctgcaccgctgcccagacctgagtgacttccagcagaagatcagctctgtgctgagctacaatgagaagctgctgaaggagaaggaggccctgtctgaggagctgaacagctgtgtggacaagctggccaagagcagcctgctggagcaccgcatcgccaccatgaagcaggagcagaagtcctgggagcaccagagcgccagcctgaagagccagctggtggccagccaggagaaggtgcagaacctggaggacacagtgcagaatgtgaacctgcagatgagcaggatgaagagtgacctgcgggtgacccagcaggagaaggaggccctgaagcaggaggtgatgagcctgcacaagcagctgcagaatgccggcggcaagtcctgggcccctgagatcgccacccaccccagcggcctgcacaaccagcagaagaggctgtcctgggacaagctggaccacctgatgaatgaggagcagcagctgctgtggcaggagaatgaaaggctgcagaccatggtgcagaacaccaaggccgagctgacccacagccgggagaaggtgcggcagctggagagcaacctgctgcccaagcaccagaagcacctgaaccccagcggcaccatgaaccccacagagcaggagaagctgagcctgaagagagaatgtgaccagttccagaaggagcagagccctgccaacaggaaggtgtcccagatgaacagcctggagcaggagctggagaccatccacctggagaatgaaggcctgaagaagaagcaggtgaagctggatgagcagctgatggagatgcagcacctgcggagcacagccacccccagccccagcccccacgcctgggacctgcagctgctgcagcagcaggcctgccccatggtgccccgggagcagttcctgcagctgcagaggcagctgctgcaggccgagcgcatcaaccagcacctgcaggaggagctggagaacagaaccagcgagaccaacaccccccaggccctgctgcctgagcagagagctgtgcatgctgacagctacagaagaattggccacctgtag

SEQ ID NO: 21642 - DNA, 1203 bp, Artificial Sequence
  Description of Artificial Sequence: Synthetic coding sequence
atggccggggagaaccaccagtggcagggcagcatcctgtacaacatgctgatgtctgccaagcagaccagggctgcccctgaggcccctgagacccggctggtggaccagtgctggggctgcagctgtggagatgagcccggggtgggccgggagggcctgctgggcggcagaaatgtggccctgctgtaccgctgctgcttctgtgggaaggaccacccccggcagggcagcatcctgtacagcatgctgaccagcgccaagcagacctacgccgcccccaaggcccctgaggccaccctgggcccctgctggggctgcagctgtggcagtgaccccggggtgggccgggccggcctgcccggcggccggcctgtggccctgctgtaccgctgctgcttctgtggggaggaccacccccggcagggcagcatcctgtacagcctgctgaccagcagcaagcagacccacgtggccccagctgcccctgaggcccggcctggaggagcctggtgggacaggagctactttgcccagaggcctgggggcaaggaggccctgcccggcggccgggccacagccctgctgtaccgctgctgcttctgtggggaggaccacccccagcagggcagcaccctgtactgtgtgcccaccagcaccaaccaggcccaggccgcccctgaggagcggccccgggccccctggtgggacaccagcagcggggccctgcggcctgtggccctgaagagcccccaggtggtgtgtgaggccgccagcgctggcctgctgaagaccctgcgctttgtgaagtacctgccctgcttccaggtgctgcccctggaccagcagctggtgctggtgaggaactgctgggccagcctgctgatgctggagctggcccaggaccggctgcagtttgagaccgtggaggtgtctgagcccagcatgctgcagaagatcctgaccaccaggagaagagagaccggcggcaatgagcccctgcctgtgcccaccctgcagcaccacctggcccctcctgctgaggccaggaaggtgcccagcgccagccaggtgcaggccatcaagtgcttcctgagcaagtgctggagcctgaacatcagcaccaaggagtatgcctacctgaagggcaccgtgctcttcaaccctgggaagggcaaggaaaatgactgcaaccaccactag

SEQ ID NO: 21643 - DNA, 627 bp, Artificial Sequence
  Description of Artificial Sequence: Synthetic coding sequence
atgaagcagctggaggaccacgaggcctttgagaccagcagcctcatcggccacagcgcccgggtgtatgccctgtactacaaggatggcctgctgtgcaccggcagtgatgacctgagcgccaagctgtgggatgtgtccacaggccagtgtgtgtatggcatccagacccacacctgtgccgctgtgaagtttgatgagcagaagctggtgacaggcagctttgacaacacagtggcctgctgggagtggagcagcggggcccggacccagcacttccggggccacactggagctgtgttttctgtggactacaatgatgagctggacatcctggtgtctggcagcgctgacttcaccgtgaaggtgtgggccctgtctgctggcacctgcctgaacaccctgaccggccacacagagtgggtgaccaaggtggtgctgcagaagtgcaaggtgaagagcctgctgcacagccctggggactacatcctgctgtctgctgacaagtatgagatcaagatctggcccatcggccgggagatcaactgcaagtgcctgaagaccctgtctgtgtctgaagatagaagcatctgcctgcagccccggctgcactttgatggcaagtag

SEQ ID NO: 21644 - DNA, 639 bp, Artificial Sequence
  Description of Artificial Sequence: Synthetic coding sequence
atgtttggagtgaccaagtttggagacaacattgaagatgagtggttcatcgtgtatgtgatcaagcagatcaccaaggagttccctgagctggtggccagaattgaggacaatgatggagagttcctgctgattgaagctgctgacttcctgcccaagtggctggaccctgagaacagcaccaacagagtcttcttctgccacggggagctgtgcatcatcccagcccccaggaagagcggggctgagagctggctgcccaccaccccacccaccatcccccaggccctgaacatcatcacagcccacagcgagaagatcctggccagcgagagcatccgggctgctgtgaacagacgcatccggggctacccagagaagatccaggccagcctgcaccgggcccactgcttcctgcctgctggcatcgtggccgtgctgaagcagaggccccggctggtggccgctgctgtgcaggccttctacctgcgggaccccatcgacctgcgggcctgcagggtcttcaagaccttcctgcctgagacccgcatcatgacctctgtgaccttcaccaagtgcctgtatgcccagctggtgcagcagagatttgtgcctgacagaagaagtggctacagatag

SEQ ID NO: 21645 - DNA, 474 bp, Artificial Sequence; identical to SEQ ID NO: 20844
  Description of Artificial Sequence: Synthetic coding sequence

SEQ ID NO: 21646 - DNA, 4773 bp, Artificial Sequence
  Description of Artificial Sequence: Synthetic coding sequence
atgtctgccacctcctggttcctggtgagcagcagcggggcccggcaccggctgccccgggagctgatctttgtgggccgggaggagtgtgagctgatgctgcagagccgctctgtggacaagcagcacgccgtcatcaactatgaccaggacagagatgagcactgggtgaaggacctgggcagcctgaatggcacctttgtgaatgacatgaggatcccagaccagaagtatgtgaccctgaagctgaatgatgtgatccgcttcggctatgacagcaacatgtatgtgctggagcgggtgcagcaccgggtgcctgaggaggccctgaagcatgagaagtacaccagccagctgcaggtgtctgtgaagggcctggcccccaagaggtctgaggccctgcctgagcacaccccctactgtgaggccagcaaccccaggcctgagaagggggacagaagacctggaacagaagctgccagctaccgcacccccctgtatggccagcccagctggtggggagaagatgatggcagcaccctgcctgatgcccagaggcagggcgagccctacccagctgagcggcccaagggccctgtgcagcaggatggagagctgcacggcttccgggccccagctgagccccagggctgcagcttcagaagagagcccagctactttgagatccccaccaaggagaccccccagcccagccagcccccagaggtgcctgcccacgagatgcccaccaaggatgctgaggccggcggcggcggggccgcccctgtggtgcagagccacgccagcttcaccatcgagtttgatgactgcagccctgggaagatgaagatcaaggaccacatcaccaagttcagcctgcggcagaggcggcccccaggcaaggaggccaccccaggagagatggtgtctgctgagaccaaggtggccgactggctggtgcagaatgaccccagcctgctgcaccgggtgggccctggagatgacagacacagcaccaagagtgacctgcctgtgcacaccaggaccctgaagggccacaagcatgaagatggcacccagagcgacagcgaggaccccctggccaaggccgccagcgctgctggggtgcccctggaggccagcggggagcaggtgcggctgcagaggcagatcaagagggacccccaggagctgctgcacaaccagcaggcctttgtgattgagttctttgatgaggacacccccaggaagaagaggagccagagcttcacccacagccccagcggggaccccaaggctgacaagaggcggggccccaccccagctgaccgggaccggcccagcgtgcctgcccctgtgcaggccggcggccgcagcagcggcccccagagagctggcagcctgaagcgggagaagacagaggagcggctgggcagccccagccctgccagcaggaccccagcccggccctttggatctgtgggccgccgcagccggctggcccaggacttcatggcccagtgcctgcgggagagcagccctgctgcccggcccagccctgagaaggtgccccctgtgctgcctgcccccctgaccccccacggcaccagccctgtgggcccccccaccccacctccagcccccacagacccccagctgaccaaggccaggaagcaggaggaggatgacagcctgagtgatgctggcacctacaccattgaaacagaggcccaggacacagaggtggaggaggccaggaagatgattgaccaggtgtttggagtgctggagagccctgagctgagccgggccagcagcgccaccttccggcctgtgatccggggggacagagatgaaagtgatgatggcggcgtggcccagaggatggccctgctgcaggagtttgccagccggcccctgggcgccgccccccaggccgagcaccagggcctgcctgtgcccggcagccctgggggccagaagtgggtgagccgctgggccagcctggccgacagctacagcgaccccggcctgacagaagatggcctgggcagaagaggaggagagcctgagggcagcctgcctgtgaggatgagaagaaggctgccccagctgcccagcgagagagctgacagccctgctggccctgagagcagccgccgcagcggccctggccccccagagctggacagcgagcagcccagccggctgtttggccaggaggagctggaccctgacagcctgagtgatgccagcggcagtgatggcggccggggccctgagcccggggtggagccccaggacagcagaagaagaagcccccaggagggccccacctggagccggggccgccgcagcccccgggcccctggagagcccaccccagccagcttcttcatcggggaccagaatggagatgctgtgctgagcaggaagcccctggccgcccctggagatggagagggcctgggccagacagcccagcccagccccccagccagagatggagtgtatgtgtctgccaacggccgcatggtgatccagctgcggcccggccgcagccctgagccagatggccctgccccagccttcctgcggcaggagagcttcaccaaggagcccgccagcggccccccagcccctgggaagccaccccacatcagcagccaccccctgctgcaggacctggccgccaccagggctgccaggatggacttccacagccaggacacccacctgatcctgaaggagacagaaacagccctggccgccctggaggcccggctgctgagcaacagcgtggatgctgaatgtgagggcggcagcaccccccggcccccagaagatgccctgagcggggacagtgatgtggacacagccagcacagtgtccctgcggagcggcaagagcggccccagccccaccaccccccagcccctgcgggcccagaaggagatgagccccagccccccagctgcccaggaccccggcggcacagccctggtgtctgcccgggagcagagcagcgagcggcagcaccaccccctgggccccacagacatgggccgcggggagcctgtgcggcgcagcgccatcagaagaggccaccggccccggggcagcctggactggcccagcgaggagcggggccctgtgctggcccacctgcccagcagtgatgtgatggccagcaaccacgagaccccagaggccaccggggccggccgcctgggcagcaggaggaagccagctgcccccccacccagccctgctgcccgggaggagcagagccgcagcagcgccagcagccagaagggcccccaggccctgaccaggagcaacagcctgagcaccccccggcccacccgggccagccggctgcggcgggcccggctgggagatgccagtgacacagaggccgcagatggagagcggggcagcctgggcaaccctgagcctgtgggccggcctgctgctgagcaggccaagaagctgagccggctggacatcctggccatgcccaggaagagagctggcagcttcaccggcaccagtgaccctgaggccgccccagcccggaccagcttcagcggccgctctgtggagctgtgctgtgccagcaggaagcccaccatggccgaggcccgggctgtgtccaggaaggccgccaacacagccaccaccaccggcccccggcagcccttcagccgggcccggagcggcagcgcccgctacaccagcaacacccggcggcggcagcagggcagtgactacaccagcaccagcgaggaggagtatggcagccgccacggcagccccaagcacaccaggagccacaccagcacagccacccagacccccagggctggcagcagcagccgggcccggagccgggcccctggcccccgggacacagatgatgatgaggaggagccagacccctacggcttcatcgtgcagacagctgagattgctgagatcgcccggctgagccagaccctggtgaaggatgtggccatcctggcccaggagatccatgatgtggccggagatggagacaccctgggcagcagcgagcccgcccacagcgccagcctgagcaacatgcccagcaccccagccagcaccatcagcgcccgggaggagctggtgcagagaattcctgaggccagcctgaacttccagaaggtgcccccaggcagcctgaacagccgggactttgaccagaacatgaatgacagctgtgaagatgccctggccaacaagacccggcccaggaaccgggaggaggtgatctttgacaacctgatgctgaaccctgtgtcccagctgagccaggccatccgggagaacacagagcacctggccgagaagatgaagatcctcttccagaacacaggccgggcctgggaggacctggaggcccgcatcaatgcagaaaatgaggtgcccatcctgaagaccagcaacaaggagatcagcagcatcctgaaggagctgcggcgggtgcagaagcagctggaggtgatcaatgccatcgtggaccccagcggcagcctggacctgctgaccggcaacagaagcctggccagcagcgcccagcccggcctgggcaagggccgggtggccgcccagagcccccccagccctgccagcgctgaggccctgctgcctgccctgcccctgaggaacttcccccagagggccagctgtggcccccccagcctgcctgaccccaccttcctgcctgatgctgagcgcttcctgatctag

SEQ ID NO: 21647 - DNA, 1452 bp, Artificial Sequence
  Description of Artificial Sequence: Synthetic coding sequence
atgtctgggggcggccccagcggcggcggccctgggggcagcggccgggcccggaccagcagctttgctgagcccggcggcggcggcggcggcggcggcggcggccctgggggcagcgccagcggccctgggggcaccggcggcggcaaggcctctgtgggcgccatgggcggcggcgtgggcgccagcagcagcggcggcggccctgggggcagcggcggcggcggcagcggcggccctggggccggcaccagcttccccccacctggggtgaagctgggccgggacagcggcaaggtgaccaccgtggtggccaccctgggccagggccctgagaggagccaggaggtggcctacacagacatcaaggtgattggaaatggcagctttggagtggtgtaccaggcccggctggccgagacccgggagctggtggccatcaagaaggtgctgcaggacaagcgcttcaagaaccgggagctgcagatcatgaggaagctggaccactgcaacatcgtgcggctgcgctacttcttctacagcagcggggagaagaaggatgagctgtacctgaacctggtgctggagtatgtgcctgagaccgtgtacagagtggcccggcacttcaccaaggccaagctgaccatccccatcctgtatgtgaaggtgtacatgtaccagctgttccgcagcctggcctacatccacagccagggcgtgtgccaccgggacatcaagccccagaacctgctggtggaccctgacacagctgtgctgaagctgtgtgactttggcagcgccaagcagctggtgcggggggagcccaacgtgtcctacatctgcagccgctactaccgggcccctgagctgatctttggagccacagactacaccagcagcattgatgtgtggagcgctggctgtgtgctggccgagctgctgctgggccagcccatcttccctggggacagcggcgtggaccagctggtggagatcatcaaggtgctgggcacccccacccgggagcagatccgggagatgaaccccaactacacagagttcaagttcccccagatcaaggcccacccctggaccaaggtgttcaagagcaggaccccacctgaggccatcgccctgtgcagcagcctgctggagtacacccccagcagccggctgagccccctggaggcctgtgcccacagcttctttgatgagctgcgctgcctgggcacccagctgcccaacaaccggcccctgcccccactcttcaacttctctgctggggagctgagcatccagcccagcctgaatgccatcctgatccccccccacctgcggagccctgctggcaccaccaccctgacccccagcagccaggccctgacagagacccccaccagcagtgactggcagagcacagatgccacccccaccctgaccaacagcagctag

SEQ ID NO: 21648 - DNA, 1389 bp, Artificial Sequence
  Description of Artificial Sequence: Synthetic coding sequence
atgggcggcgctgaggccgagccctggggccgggcccctggccctgccatcggcggccggcgggccggggacagctgccccggctggaggagaagaagccgcagccggggccggggccagaggctgagccacggcccccggcggcggccccagctgctgacagctgccccacccctgcaggcccggggggccttccgctccttcccccacagctggggcgaggacttcctggccagcctgatgttcaagatccagctggagcccctgaagctgcgggcctggaccctgaatggatttgtgaagttcaggaacaaggagaccagcgctggccctgtggccgtgatgggcaaggactactacaagatcctgggcatccccagcggggccaatgaagatgagatcaagaaggcctacaggaagatggccctgaagtaccacccagacaagaacaaggagcccaatgctgaggagaagttcaaggagattgctgaggcctatgatgtgctgagtgaccccaagaagaggggcctgtatgaccagtatggagaggagggcctgaagacaggaggcggcaccagcggcggcagcagcggcagcttccactacaccttccatggagacccccacgccacctttgccagcttcttcggcggcagcaacccctttgacatcttctttgccagcagccgcagcacccggcccttcagcggctttgatcctgatgacatggatgtggatgaagatgaggacccctttggagccttcggccgcttcggcttcaacggcctgagccggggcccccggcgggcccctgagcccctgtaccccaggaggaaggtgcaggacccccctgtggtgcatgagctgcgggtgtccctggaggagatctaccacggcagcaccaagaggatgaagatcacccggcggcggctgaacccagatggccgcacagtgaggacagaggacaagatcctgcacatcgtcatcaagaggggctggaaggagggcaccaagatcaccttccccaaggagggagatgccaccccagacaacatcccagctgacatcgtgtttgtgctgaaggacaagccccacgcccacttcagaagagatggcaccaacgtgctgtacagcgccctgatcagcctgaaggaggccctgtgtggctgcaccgtgaacatccccaccattgatggccgggtcatccccctgccctgcaatgatgtgatcaagccaggcaccgtgaagaggctgcggggggagggcctgcccttccccaaggtgcccacccagagaggagacctgattgtggagttcaaggtgcgcttcccagaccggctgaccccccagacccggcagatcctgaagcagcacctgccctgcagctag

SEQ ID NO: 21649 - DNA, 279 bp, Artificial Sequence
  Description of Artificial Sequence: Synthetic coding sequence
gtgtatggagccaaggacatcgagctgagccctgaggcccaggccaagattgaccgctacacccagcagggctttggaaacctgcccatctgcatggccaagacccacctgagcctgagccaccagcctgacaagaagggcgtgccccgggacttcatcctgcccatcagtgatgtgcgggccagcattggagctggcttcatctaccccctggtgggcaccaggagcagccccctggccctggtgggggagagccagcccaagcaggtgcacccctag

SEQ ID NO: 21650 - DNA, 468 bp, Artificial Sequence
  Description of Artificial Sequence: Synthetic coding sequence
atgtctgtgacctatgatgacagcgtgggcgtggaggtgtccagtgacagcttctgggaggtgggcaactacaagaggacagtgaagagaattgatgatggccaccggctgtgcagcgacctgatgaactgcctgcacgagcgggccagaattgagaaggcctatgcccagcagctgacagagtgggcccggcgctggaggcagctggtggagaagggcccccagtatggcaccgtggagaaggcctggatggccttcatgtctgaggccgagcgggtgtctgagctgcacctggaggtgaaggccagcctgatgaatgatgactttgagaagatcaagaactggcagaaggaggccttccacaagcagatgatgggcggcttcaaggagaccaaggaggctgaagatggcttcaggaaggcccagaagccctgggccaagaagctgaaggaggtgcacctgtcctag

SEQ ID NO: 21651 - DNA, 483 bp, Artificial Sequence; identical to SEQ ID NO: 20009
  Description of Artificial Sequence: Synthetic coding sequence

SEQ ID NO: 21652 - DNA, 660 bp, Artificial Sequence; identical to SEQ ID NO: 21179
  Description of Artificial Sequence: Synthetic coding sequence

SEQ ID NO: 21653 - DNA, 318 bp, Artificial Sequence
  Description of Artificial Sequence: Synthetic coding sequence
atgaacatgatctggaggaacagcatcagctgcctgcggctgggcaaggtgccccaccgctaccagagcggctaccaccctgtggcccccctgggcagccgcatcctgacagatcctgccaaggtgtttgagcacaacatgtgggaccacatgcagtggagcaaggaggaggaggccgccgccaggaagaaggtgaaggaaaattctgctgtgcgggtgctgctggaggagcaggtgaagtatgagcgggaggccagcaagtactgggacaccttctacaagatccacaagaacaagttcttcaaggacaggaactag

SEQ ID NO: 21654 - DNA, 366 bp, Artificial Sequence
  Description of Artificial Sequence: Synthetic coding sequence
tgagaaggagagagccccacagccagcccccacagcagcgccacagatgacctgcaccacagcgaccgctaccagaccttcctgcgggtgcgggccaaccggcagacccggctgaatgcccgcatcggcaagatgaagaggaggaagcaggatgagggccaggtgtgccccctgtgcaaccggcccctggccggcagcgagcaggagatgagcagacatgtggagcactgcctgagcaagcgggagggcagctgcatggccgaggatgatgctgtggacatcgagcacgagaacaacaacagatttgaggagtatgagtggtgtggccagaagaggatccgggccaccaccctgctggagggctag

SEQ ID NO: 21655 - DNA, 1701 bp, Artificial Sequence; identical to SEQ ID NO: 19423
  Description of Artificial Sequence: Synthetic coding sequence

SEQ ID NO: 21656 - DNA, 4719 bp, Artificial Sequence
  Description of Artificial Sequence: Synthetic coding sequence
atgctgctgcacctgtgcagcgtgaagaacctgtaccagaaccgcttcctgggcctggccgccatggccagccccagcaggaacagccagagcagaagacgctgcaaggagcccctgcgctacagctacaacccagaccagttccacaacatggacctgcggggcggcccccatgatggagtgaccatccccaggagcaccagtgacacagacctggtgaccagtgacagccgcagcaccctgatggtgagcagcagctactacagcatcggccacagccaggacctggtgatccactgggacatcaaggaggaggtggatgctggggactggattggcatgtacctgattgatgaggtgctgtctgagaacttcctggactacaagaacagaggagtgaatggcagccaccggggccagatcatctggaagattgatgccagcagctactttgtggagcctgagaccaagatctgcttcaagtactaccacggcgtgtctggggccctgcgggccaccacccccagcgtgacagtgaagaacagcgctgcccccatcttcaagagcatcggggctgatgaaacagtgcagggccagggcagccggcggctcatctccttcagcctgagtgacttccaggccatgggcctgaagaagggcatgttcttcaacccagacccctacctgaagatcagcatccagcccgggaagcacagcatcttccctgccctgccccaccacggccaggagaggaggagcaagatcatcggcaacacagtgaaccccatctggcaggccgagcagttctcctttgtgtccctgcccacagatgtgctggagattgaggtgaaggacaagtttgccaagagccggcccatcatcaagcgcttcctgggcaagctgtccatgcctgtgcagaggctgctggagagacatgccatcggggacagagtggtgtcctacaccctgggccgccgcctgcccacagaccacgtgtctggccagctgcagttccgctttgagatcaccagcagcatccacccagatgatgaggagatcagcctgagcacagagcctgagagcgcccagatccaggacagccccatgaacaacctgatggagagcggcagcggggagcccaggtctgaggcccctgagagcagcgagagctggaagccagagcagctgggggagggctctgtgcctgatggccctggcaaccagagcattgagctgagcaggcctgctgaggaggccgccgtcatcacagaagctggggaccagggcatggtgtctgtgggccctgagggcgctggggagctgctggcccaggtgcagaaggacatccagcctgcccccagcgctgaggagctggccgagcagctggacctgggggaggaggccagcgccctgctgctggaggatggagaggccccagccagcaccaaggaggagcccctggaggaggaggccaccacccagagcagagctggccgggaggaggaggagaaggagcaggaggaggagggagatgtgtccaccctggagcagggcgagggccgcctgcagctgcgggcctctgtgaagaggaagagccggccctgcagcctgcctgtgtctgagctggagaccgtcatcgccagcgcctgtggggaccctgagacccccaggacccactacatccgcatccacaccctgctgcacagcatgcccagcgcccagggcggcagcgctgctgaggaggaggatggagctgaggaggagagcaccctgaaggacagcagcgagaaggatggcctgtctgaggtggacacagtggccgctgaccccagcgccctggaggaggaccgggaggagcctgagggcgccaccccaggcacagcccaccctggccacagcggcggccacttccccagcctggccaacggggccgcccaggatggagacacccaccccagcacaggcagcgagagtgacagcagcccccggcagggcggggaccacagctgtgagggctgtgatgccagctgctgcagccccagctgctacagcagcagctgctacagcaccagctgctacagcagcagctgctacagcgccagctgctacagccccagctgctacaatggaaacagatttgccagccacacccgcttcagctctgtggacagcgccaagatcagcgagagcacagtgttcagcagccaggatgatgaggaggaggagaacagcgcctttgagagcgtgcctgacagcatgcagagccctgagctggaccctgagagcaccaacggggccggcccctggcaggatgagctggccgcccccagcggccacgtggagaggagccctgagggcctggagagccctgtggccggccccagcaacagaagagaggactgggaggccagaattgacagccacggccgggtcttctacgtggaccacgtgaacagaaccaccacctggcagaggcccacagctgctgccaccccagatggcatgaggaggagcggcagcatccagcagatggagcagctgaacagacgctaccagaacatccagaggaccatcgccacagagaggagtgaagaagattctggcagccagagctgtgagcaggccccagctgggggcggcggcggcggcggcagtgacagcgaggccgagagcagccagagcagcctggacctgcggcgggagggcagcctgagccctgtgaacagccagaagatcaccctgctgctgcagagccctgctgtgaagttcatcaccaaccctgagttcttcaccgtgctgcacgccaactacagcgcctacagagtcttcaccagcagcacctgcctgaagcacatgatcctgaaggtgagaagagatgccaggaactttgagcgctaccagcacaacagagacctggtgaacttcatcaacatgtttgctgacacccggctggagctgccccggggctgggagatcaagacagaccagcagggcaagagcttctttgtggaccacaacagccgggccaccaccttcatcgacccccgcatccccctgcagaatggccgcctgcccaaccacctgacccaccggcagcacctgcagaggctgcggagctacagcgctggggaggccagcgaggtgtccaggaacagaggagccagcctgctggcccggcccggccacagcctggtggccgccatccgcagccagcaccagcacgagagcctgcccctggcctacaatgacaagatcgtggccttcctgcggcagcccaacatctttgagatgctgcaggagcggcagcccagcctggccaggaaccacaccctgcgggagaagatccactacatcagaacagagggcaaccacggcctggagaagctgagctgtgatgctgacctggtgatcctgctgagcctgtttgaggaggagatcatgtcctatgtgcccctgcaggccgccttccaccctggctacagcttcagcccccgctgcagcccctgcagcagcccccagaacagccctggcctgcagagggccagcgcccgggcccccagcccctaccgccgggactttgaggccaagctgaggaacttctacaggaagctggaggccaagggcttcggccagggccctgggaagatcaagctgatcatcagaagagaccacctgctggagggcaccttcaaccaggtgatggcctacagcaggaaggagctgcagaggaacaagctgtatgtgacctttgtgggggaggagggcctggactacagcggccccagccgggagttcttcttcctgctgagccaggagctgttcaacccctactacggcctgtttgagtacagcgccaatgacacctacacagtgcagatcagccccatgtctgcctttgtggagaaccacctggagtggttccgcttcagcggccgcatcctgggcctggccctgatccaccagtacctgctggatgccttcttcacccggcccttctacaaggccctgctgcggctgccctgtgacctgagtgacctggagtacctggatgaggagttccaccagagcctgcagtggatgaaggacaacaacatcacagacatcctggacctgaccttcaccgtgaatgaggaggtgtttggccaggtgacagagcgggagctgaagagcggcggggccaacacccaggtgacagagaagaacaagaaggagtacatcgagaggatggtgaagtggagggtggagcggggcgtggtgcagcagacagaggccctggtgcggggcttctatgaggtggtggacagccggctggtgtctgtgtttgatgcccgggagctggagctggtgattgctggaacagctgagattgacctgaatgactggaggaacaacacagagtacagaggaggctaccatgatggccacctggtgatccgctggttctgggccgctgtggagcgcttcaacaatgagcagaggctgcggctgctgcagtttgtgacaggcaccagctctgtgccctatgagggctttgctgccctgcggggcagcaatggcctgcggcgcttctgcatcgagaagtggggcaagatcaccagcctgccccgggcccacacctgcttcaaccggctggacctgcccccctaccccagctacagcatgctgtatgagaagctgctgacagctgtggaggagaccagcaccttcggcctggagtag

SEQ ID NO: 21657 - DNA, 1629 bp, Artificial Sequence
  Description of Artificial Sequence: Synthetic coding sequence
atgagcggcctggtgctgggccagagagatgagcctgctggccaccggctgagccaggaggagatcctgggcagcacccggctggtgtcccagggcctggaggccctgcggtctgagcaccaggccgtgctgcagagcctgagccagaccatcgagtgcctgcagcagggcggccacgaggagggcctggtgcatgagaaggcccggcagctgcggcgctccatggagaacatcgagctgggcctgtctgaggcccaggaggagaaggagggagatgccaccaaggacagcctggatgacctcttccccaatgaggaggaggaggaccccagcaatggcctgagccggggccagggcgccacagctgcccagcagggcggctatgagatcccagcccggctgcggaccctgcacaacctggtgatccagtatgctgcccagggccgctatgaggtggccgtgcccctgtgcaagcaggccctggaggacctggagaggaccagcggccggggccacccagatgtggccaccatgctgaacatcctggccctggtgtacagagaccagaacaagtacaaggaggccgcccacctgctgaatgatgccctgagcatccgggagagcaccctgggccctgaccaccctgctgtggccgccaccctgaacaacctggccgtgctgtatggcaagaggggcaagtacaaggaggccgagcccctgtgccagagggccctggagatccgggagaaggtgctgggcaccaaccacccagatgtggccaagcagctgaacaacctggccctgctgtgccagaaccagggcaagtatgaggccgtggagcgctactaccagagggccctggccatctatgagggccagctgggccctgacaaccccaacgtggcccggaccaagaacaacctggccagctgctacctgaagcagggcaagtatgcagaggccgagaccctgtacaaggagatcctgacccgggcccacgtgcaggagtttggatctgtggatgatgaccacaagcccatctggatgcatgctgaggagcgggaggagatgagcaagagccgccaccatgaaggaggcaccccctatgcagaatatggaggctggtacaaggcctgcaaggtgagcagccccaccgtgaacaccaccctgaggaacctgggcgccctgtaccgccggcagggcaagctggaggccgctgagaccctggaggagtgtgccctgcggagccggcggcagggcacagaccccatcagccagaccaaggtggccgagctgctgggggagagtgatggaagaaggaccagccaggagggccctggggacagcgtgaagtttgagggcggggaggatgcctctgtggccgtggagtggagcggagatggcagcggcaccctgcagaggagcggcagcctgggcaagatcagagatgtgctgcggcgcagcagcgagctgctggtgaggaagctgcagggcacagagccccggcccagcagcagcaacatgaagagagctgccagcctgaactacctgaaccagcccagcgctgcccccctgcaggtgtcccggggcctgagcgccagcaccatggacctgagcagcagcagctag

SEQ ID NO: 21658 - DNA, 1548 bp, Artificial Sequence
  Description of Artificial Sequence: Synthetic coding sequence
atgtgccaggtgggggaggactatggagagcccgcccctgaggagcccccaccagccccccggcccagccgggagcagaagtgtgtgaagtgcaaggaggcccagcctgtggtggtgatccgggctggagatgccttctgccgggactgcttcaaggccttctacgtgcacaagttccgggccatgctgggcaagaacagactcatcttccctggagagaaggtgctgctggcctggagcggcggccccagcagcagctccatggtgtggcaggtgctggagggcctgagccaggacagcgccaagaggctgcgctttgtggccggggtcatctttgtggatgagggcgccgcctgtggccagagcctggaggagaggagcaagaccctggccgaggtgaagcccatcctgcaggccaccggcttcccctggcacgtggtggccctggaggaggtgttcagcctgccccccagcgtgctgtggtgcagcgcccaggagctggtgggcagcgagggcgcctacaaggctgctgtggacagcttcctgcagcagcagcacgtgctgggcgctgggggcggccctggccccacccagggcgaggagcagcccccccagccccccctggacccccagaacctggcccggcccccagccccagcccagacagaggccctgagccagctgttctgcagcgtgaggaccctgacagccaaggaggagctgctgcagaccctgcggacccacctgatcctgcacatggcccgggcccacggctacagcaaggtgatgaccggggacagctgcacccggctggccatcaagctgatgaccaacctggccctgggccgcggggccttcctggcctgggacaccggcttcagtgatgaaagacatggagatgtggtggtggtgcggcccatgagggaccacaccctgaaggaggtggccttctacaacagactcttctctgtgcccagcgtcttcaccccagctgtggacaccaaggcccctgagaaggccagcatccaccggctgatggaggccttcatcctgcggctgcagacccagttccccagcacagtgtccacagtgtaccgcaccagcgagaagctggtgaagggccccagagatggccctgctgctggggacagcggcccccgctgcctgctgtgcatgtgtgccctggatgtggatgctgctgacagcgccacagccttcggggcccagaccagcagccggctgagccagatgcagagccccatccccctgacagagaccaggaccccacctggcccctgctgcagccctggggtgggctgggcccagagatgtggccagggcgcctgccggcgggaggacccccaggcctgcatcgaggagcagctgtgctacagctgccgggtgaacatgaaggacctgcccagcctggaccccctgcccccctacatcctggccgaggcccagctgcggacccagagggcctggggcctgcaggagatccgggactgcctgattgaggacagtgatgatgaggccggccagagctag

SEQ ID NO: 21659 - DNA, 1263 bp, Artificial Sequence
  Description of Artificial Sequence: Synthetic coding sequence
atgttcaagaggacagtgctgagctgccccccacctgctgccccacccctgcaggcccggggggccttccgctccttcccccacagctggggcgaggacttcctggccagcctgatgttcaagatccagctggagcccctgaagctgcgggcctggaccctgaatggatttgtgaagttcaggaacaaggagaccagcgctggccctgtggccgtgatgggcaaggactactacaagatcctgggcatccccagcggggccaatgaagatgagatcaagaaggcctacaggaagatggccctgaagtaccacccagacaagaacaaggagcccaatgctgaggagaagttcaaggagattgctgaggcctatgatgtgctgagtgaccccaagaagaggggcctgtatgaccagtatggagaggagggcctgaagacaggaggcggcaccagcggcggcagcagcggcagcttccactacaccttccatggagacccccacgccacctttgccagcttcttcggcggcagcaacccctttgacatcttctttgccagcagccgcagcacccggcccttcagcggctttgatcctgatgacatggatgtggatgaagatgaggacccctttggagccttcggccgcttcggcttcaacggcctgagccggggcccccggcgggcccctgagcccctgtaccccaggaggaaggtgcaggacccccctgtggtgcatgagctgcgggtgtccctggaggagatctaccacggcagcaccaagaggatgaagatcacccggcggcggctgaacccagatggccgcacagtgaggacagaggacaagatcctgcacatcgtcatcaagaggggctggaaggagggcaccaagatcaccttccccaaggagggagatgccaccccagacaacatcccagctgacatcgtgtttgtgctgaaggacaagccccacgcccacttcagaagagatggcaccaacgtgctgtacagcgccctgatcagcctgaaggaggccctgtgtggctgcaccgtgaacatccccaccattgatggccgggtcatccccctgccctgcaatgatgtgatcaagccaggcaccgtgaagaggctgcggggggagggcctgcccttccccaaggtgcccacccagagaggagacctgattgtggagttcaaggtgcgcttcccagaccggctgaccccccagacccggcagatcctgaagcagcacctgccctgcagctag

SEQ ID NO: 21660 - DNA, 2979 bp, Artificial Sequence
  Description of Artificial Sequence: Synthetic coding sequence
atgtatggcagcgcccggtctgtgggcaaggtggagcccagcagccagagccctggccgcagcccccggctgcccaggagcccccggctgggccacaggaggaccaacagcactggaggcagcagcggcagctctgtgggcggcggcagcggcaagaccctgtccatggagaacatccagagcctgaatgctgcctatgccaccagcggccccatgtacctgagtgaccatgaaaatgtgggcagcgagacccccaagagcaccatgaccctgggccgcagcggcggccgcctgccctacggcgtgaggatgacagccatgggcagcagccccaacatcgccagcagcggcgtggccagtgacaccatcgcctttggagagcaccacctgccccctgtgtccatggccagcacagtgccccacagcctgcggcaggcccgggacaacaccatcatggacctgcagacccagctgaaggaggtgctgcgggagaatgacctgctgaggaaggatgtggaggtgaaggagagcaagctgagcagctccatgaacagcatcaagaccttctggagccctgagctgaagaaggagcgggccctgaggaaggatgaggccagcaagatcaccatctggaaggagcagtacagagtggtgcaggaggagaaccagcacatgcagatgaccatccaggccctgcaggatgagctgcgcatccagagggacctgaaccagctgttccagcaggacagcagcagcaggactggagagccctgtgtggccgagctgacagaggagaacttccagaggctgcacgccgagcacgagcggcaggccaaggagctgttcctgctgaggaagaccctggaggagatggagctgagaattgagacccagaagcagaccctgaatgccagagatgagagcatcaagaagctgctggagatgctgcagagcaagggcctgagcgccaaggccacagaggaggaccacgagaggacccggcggctggccgaggccgagatgcacgtgcaccacctggagagcctgctggagcagaaggagaaggagaacagcatgctgcgggaggagatgcacagaagatttgaaaatgccccagacagcgccaagaccaaggccctgcagaccgtcatcgagatgaaggacagcaagatcagctccatggagcggggcctgcgggacctggaggaggagatccagatgctgaagagcaatggagccctgagcacagaggagcgggaggaggagatgaagcagatggaggtgtaccgcagccacagcaagttcatgaagaacaagattggccaggtgaagcaggagctgagcaggaaggacacagagctgctggccctgcagaccaagctggagaccctgaccaaccagttcagtgacagcaagcagcacatcgaggtgctgaaggagagcctgacagccaaggagcagagagctgccatcctgcagacagaggtggatgccctgcggctgcggctggaggagaaggagaccatgctgaacaagaagaccaagcagatccaggacatggccgaggagaagggcacccaggccggggagatccatgacctgaaggacatgctggatgtgaaggagaggaaggtgaatgtgctgcagaagaagattgagaacctgcaggagcagctgcgggacaaggagaagcagatgagcagcctgaaggagcgggtgaagagcctgcaggccgacaccaccaacacagacacagccctgaccaccctggaggaggccctggccgagaaggagaggaccatcgagcggctgaaggagcagagggacagagatgagcgggagaagcaggaggagattgacaactacaagaaggacctgaaggacctgaaggagaaggtgtccctgctgcagggcgacctgtctgagaaggaggccagcctgctggacctgaaggagcacgccagcagcctggccagcagcggcctgaagaaggacagccggctgaagaccctggagatcgccctggagcagaagaaggaggagtgcctgaagatggagagccagctgaagaaggcccatgaagctgccctggaggcccgggccagccctgagatgtctgaccgcatccagcacctggagcgggagatcacccgctacaaggatgagagcagcaaggcccaggccgaggtggaccggctgctggagatcctgaaggaggtggagaatgagaagaatgacaaggacaagaagattgctgagctggagagcctcttcagccggcaggtgaaggaccagaacaagaaggtggccaacctgaagcacaaggagcaggtggagaagaagaagagcgcccagatgctggaggaggcccggcggcgggaggacaacctgaatgacagcagccagcagctgcaggacagcctgaggaagaaggatgacagaattgaggagctggaggaggccctgcgggagagcgtgcagatcacagctgagcgggagatggtgctggcccaggaggagagcgcccggaccaatgctgagaagcaggtggaggagctgctgatggccatggagaaggtgaagcaggagctggagagcatgaaggccaagctgagcagcacccagcagagcctggccgagaaggagacccacctgaccaacctgcgggcagagaggaggaagcacctggaggaggtgctggagatgaagcaggaggccctgctggccgccatcagcgagaaggatgccaacatcgccctgctggagctgagcagcagcaagaagaagacccaggaggaggtggccgccctgaagcgggagaaggaccggctggtgcagcagctgaagcagcagacccagaacaggatgaagctgatggctgacaactatgaagatgaccacttcaagagcagccacagcaaccagaccaaccacaagcccagcccagaccaggatgaggaggagggcatctgggcctag

SEQ ID NO: 21661 - DNA, 180 bp, Artificial Sequence
  Description of Artificial Sequence: Synthetic coding sequence
atggagcccagcgcccagcagctgcagctggccgccagcctgcctgccaacctgagcaacttctgccagggcagcgagatgcccaccaccagcaggcctgccctggatgtgaagggcggcaccagccctgccaaggaggatgccaaccaggagatgagctctgtggcctacagcaactag

SEQ ID NO: 21662 - DNA, 6978 bp, Artificial Sequence
  Description of Artificial Sequence: Synthetic coding sequence
atgaagaagggcagccagcagaagatcttcagcaaggccaagatccccagcagcagccacagccccatccccagctccatgagcaacatgaggagccgcagcctgagccccctgattggcagcgagaccctgcccttccacagcggcggccagtggtgtgagcaggtggagattgctgatgagaacaacatgctgctggactaccaggaccacaagggagctgacagccacgccggcgtgcgctacatcacagaggccctgatcaagaagctgaccaagcaggacaacctggccctgatcaagagcctgaacctgagcctgagcaaggatggcggcaagaagttcaagtacatcgagaacctggagaagtgtgtgaagctggaggtgctgaacctgagctacaacctgattggcaagattgagaagctggacaagctgctgaagctgcgggagctgaacctgagctacaacaagatcagcaagattgagggcatcgagaacatgtgcaacctgcagaagctgaacctggccggaaatgaaattgagcacatccctgtgtggctgggcaagaagctgaagagcctgcgggtgctgaacctgaagggcaacaagatcagcagcctgcaggacatcagcaagctgaagcccctgcaggacctgatcagcctcatcctggtggagaaccctgtggtgaccctgccccactacctgcagttcaccatcttccacctgcggagcctggagagcctggagggccagcctgtgaccacccaggaccggcaggaggcctttgagcgcttcagcctggaggaggtggagcggctggagcgggacctggagaagaagatgattgaaacagaggagctgaagagcaagcagacccgcttcctggaggagatcaagaaccaggacaagctgaacaagagcctgaaggaggaggccatgctgcagaagcagagctgtgaggagctgaagagtgacctgaacaccaagaatgagctgctgaagcagaagaccatcgagctgacccgggcctgccagaagcagtatgagctggagcaggagctggccttctacaagattgatgccaagtttgagcccctgaactactaccccagtgaatatgcagaaattgacaaggccccagatgagagcccctacatcggcaagagccgctacaagaggaacatgtttgccacagagagctacatcattgattctgcccaggccgtgcagatcaagaagatggagccagatgagcagctgagaaatgaccacatgaacctgcggggccacacccccctggacacccagctggaggacaaggagaagaagatctctgctgcccagacccggctgtctgagctgcatgatgaaattgagaaggccgagcagcagatcctgcgggccacagaggagttcaagcagctggaggaggccatccagctgaagaagatcagcgaggccggcaaggacctgctgtacaagcagctgagcggccgcctgcagctggtgaacaagctgcggcaggaggccctggacctggagctgcagatggagaagcagaagcaggagattgctgggaagcagaaggagatcaaggacctgcagatcgccatcgacagcctggacagcaaggaccccaagcacagccacatgaaggcccagaagagcggcaaggagcagcagctggacatcatgaacaagcagtaccagcagctggagagccggctggatgagatcctgagcagaattgccaaggagacagaggagatcaaggacctggaggagcagctgacagagggccagattgctgccaatgaggccctgaagaaggacctggagggcgtcatcagcggcctgcaggagtacctgggcaccatcaagggccaggccacccaggcccagaatgaatgtaggaagctgagagatgagaaggagaccctgctgcagaggctgacagaggtggagcaggagcgggaccagctggagatcgtggccatggatgctgagaacatgaggaaggagctggccgagctggagagcgccctgcaggagcagcacgaggtgaatgccagcctgcagcagacccagggcgacctgagcgcctatgaggccgagctggaggcccggctgaacctgagagatgctgaggccaaccagctgaaggaggagctggagaaggtgacccggctgacccagctggagcagagcgccctgcaggccgagctggagaaggagcggcaggccctgaagaatgccctgggcaaggcccagttcagcgaggagaaggagcaggagaacagcgagctgcacgccaagctgaagcacctgcaggatgacaacaacctgctgaagcagcagctgaaggacttccagaaccacctgaaccacgtggtggatggcctggtgcggcctgaggaggtggccgcccgggtggatgagctgcggaggaagctgaagctgggcaccggggagatgaacatccacagccccagtgatgtgctgggcaagagcctggccgacctgcagaagcagttcagcgagatcctggcccggagcaagtgggagagagatgaggcccaggtgcgggagaggaagctgcaggaggagatggccctgcagcaggagaagctggccaccggccaggaggagttccggcaggcctgtgagcgggccctggaggccaggatgaactttgacaagaggcagcacgaggcccgcatccagcagatggagaatgagatccactacctgcaggagaacctgaagtccatggaggagatccagggcctgacagacctgcagctgcaggaggctgatgaggagaaggagcgcatcctggcccagctgcgggagctggagaagaagaagaagctggaggatgccaagagccaggagcaggtgtttggcctggacaaggagctgaagaagctgaagaaggctgtggccaccagtgacaagctggccacagctgagctgaccatcgccaaggaccagctgaagagcctgcatggaacagtgatgaagatcaaccaggagcgggcagaggagctgcaggaggccgagcgcttcagcaggaaggccgcccaggccgcccgggacctgaccagggctgaggccgagattgagctgctgcagaacctgctgcggcagaagggggagcagttccggctggagatggagaagacaggagtgggcaccggggccaacagccaggtgctggagattgagaagctgaatgagaccatggagcggcagaggacagaaattgcccggctgcagaatgtgctggacctgactggaagtgacaacaagggcggctttgaaaatgtgctggaggagattgctgagctgcggcgggaggtgtcctaccagaatgactacatcagctccatggctgaccccttcaagagaagaggctactggtacttcatgcctcctccacccagcagcaaggtgagcagccacagcagccaggccaccaaggacagcggcgtgggcctgaagtacagcgccagcacccctgtgaggaagccccggcccggccagcaggacggcaaggagggcagccagcccccaccagccagcggctactgggtgtacagccccatccgcagcggcctgcacaagctgttccccagcagagatgctgacagcggcggggacagccaggaggagagcgagctggatgaccaggaggagcccccatttgtgcccccacctggctacatgatgtacacagtgctgcctgatggcagccctgtgccccagggcatggccctgtatgcccctcctccacccctgcccaacaacagccggcccctgaccccaggcaccgtggtgtatggccccccacctgctggggcccccatggtgtatggccccccaccacccaacttcagcatccccttcatccccatgggcgtgctgcactgcaatgtgcctgagcaccacaacctggagaatgaggtgtcccggctggaggacatcatgcagcacctgaagagcaagaagcgggaggagcgctggatgagggccagcaagaggcagagcgagaaggagatggaggagctgcaccacaacattgatgacctgctgcaggagaagaagagcctggagtgtgaggtggaggagctgcacaggacagtgcagaagaggcagcagcagaaggacttcattgatggaaatgtggagagcctgatgacagagctggagattgagaagagcctgaagcaccatgaagatattgtggatgaaattgagtgcatcgagaagaccctgctgaagagaagaagtgagctgcgggaggccgaccggctgctggccgaggccgagagcgagctgagctgcaccaaggagaagaccaagaatgctgtggagaagttcacagatgccaagaggagcctgctgcagacagaaagtgatgctgaggagctggagcggcgggcccaggagacagctgtgaacctggtgaaggctgaccagcagctgcggagcctgcaggctgatgccaaggacctggagcagcacaagatcaagcaggaggagatcctgaaggagatcaacaagatcgtggccgccaaggacagcgacttccagtgcctgagcaagaagaaggagaagctgacagaggagctgcagaagctgcagaaggacatcgagatggccgagagaaatgaagaccaccacctgcaggtgctgaaggagagcgaggtgctgctgcaggccaagagagctgagctggagaagctgaagagccaggtgaccagccagcagcaggagatggctgtgctggaccggcagctgggccacaagaaggaggagctgcacctgctgcagggctccatggtgcaggccaaggctgacctgcaggaggccctgcggctgggggagacagaggtgacagagaagtgcaaccacatccgggaggtgaagagcctgctggaggagctgtccttccagaagggggagctgaatgtgcagatcagcgagaggaagacccagctgaccctcatcaagcaggagattgagaaggaggaggagaacctgcaggtggtgctgcggcagatgagcaagcacaagacagagctgaagaacatcctggacatgctgcagctggagaaccacgagctgcagggcctgaagctgcagcacgaccagagggtgtctgagctggagaagacccaggtggccgtgctggaggagaagctggagctggagaacctgcagcagatcagccagcagcagaagggggagattgagtggcagaagcagctgctggagcgggacaagcgggagattgaaagaatgacagctgagagccgggccctgcagagctgtgtggagtgcctgagcaaggagaaggaggacctgcaggagaagtgtgacatctgggagaagaagctggcccagaccaagagggtgctggccgctgctgaggagaacagcaagatggagcagagcaacctggagaagctggagctgaatgtgaggaagctgcagcaggagctggaccagctgaacagagacaagctgagcctgcacaatgacatcagcgccatgcagcagcagctgcaggagaagcgggaggccgtgaacagcctgcaggaggagctggccaacgtgcaggaccacctgaacctggccaagcaggacctgctgcacaccaccaagcaccaggatgtgctgctgtctgagcagacccggctgcagaaggacatcagcgagtgggccaacagatttgaggactgccagaaggaggaggagaccaagcagcagcagctgcaggtgctgcagaatgaaattgaggagaacaagctgaagctggtgcagcaggagatgatgttccagaggctgcagaaggagcgggagagcgaggagagcaagctggagaccagcaaggtgaccctgaaggagcagcagcaccagctggagaaggagctgacagaccagaagagcaagctggaccaggtgctgagcaaggtgctggccgctgaggagcgggtgaggaccctgcaggaggaggagcgctggtgtgagagcctggagaagaccctgagccagaccaagaggcagctgtctgagcgggagcagcagctggtggagaagagcggggagctgctggccctgcagaaggaggccgacagcatgagagctgacttcagcctgctgaggaaccagttcctgacagagaggaagaaggccgagaagcaggtggccagcctgaaggaggccctgaagatccagaggagccagctggagaagaacctgctggagcagaagcaggagaacagctgcatccagaaggagatggccaccatcgagctggtggcccaggacaaccacgagcgggcccggcggctgatgaaggagctgaaccagatgcagtatgagtacacagagctgaagaagcagatggccaaccagaaggacctggagcggcggcagatggagatcagtgatgccatgaggaccctgaagtctgaggtgaaggatgagatccgcaccagcctgaagaacctgaaccagttcctgcctgagctgcctgctgacctggaggccatcctggagagaaatgaaaacctggagggggagctggagagcctgaaggagaacctgcccttcaccatgaatgaaggcccctttgaggagaagctgaacttcagccaggtgcacatcatggatgagcactggagaggagaggccctgcgggagaagctgcggcacagagaagatcggctgaaggcccagctgcggcactgcatgagcaagcaggccgaggtgctgatcaagggcaagaggcagacagagggcaccctgcacagcctgcggcggcaggtggatgccctgggggagctggtgaccagcaccagcgctgacagcgccagcagccccagcctgagccagctggagagcagcctgacagaggacagccagctgggccagaaccagaagcagaacaacagcctgaggtag

SEQ ID NO: 21663 - DNA, 657 bp, Artificial Sequence
  Description of Artificial Sequence: Synthetic coding sequence
atggatgagctggtgaccctggaggaggctgatggcggcagtgacatcctgctggtggtgcccaaggccaccgtgctgcagaaccagctggatgagagccagcaggagagaaatgacctgatgcagctgaagctgcagctggagggccaggtgacagagctgcggagccgggtgcaggagctggagcgggccctggccacagcccggcaggagcacacagagctgatggagcagtacaagggcatcagccgcagccacggggagatcacagaggagcgggacatcctgagccggcagcagggcgaccacgtggcccgcatcctggagctggaggatgacatccagaccatcagcgagaaggtgctgaccaaggaggtggagctggaccggctgcgggacacagtgaaggccctgacccgggagcaggagaagctgctgggccagctgaaggaggtgcaggccgacaaggagcagagcgaggccgagctgcaggtggcccagcaggagaaccaccacctgaacctggacctgaaggaggccaagtcctggcaggaggagcagagcgcccaggcccagaggctgaaggacaaggtggcccagatgaaggacaccctgggccaggcccagcagagggtgcggcccagctggagcccctag

SEQ ID NO: 21664 - DNA, 693 bp, Artificial Sequence
  Description of Artificial Sequence: Synthetic coding sequence
atgaagaagcccaggcctgctgctgctgcccccagcccccggcccccagcctgcagcagaggagcccaccctggaacagccagcgagctgcgggtgcctgccctgcggcggggcggctgtggggaccggcggctgcgggaggaggccgcccctgagcaggccgccgccggccccaggaggagcacagtgggcgccctgctggccagcgagctgggctggaagttctatgatgctgatgactaccacccagaagaaaatagaaggaagatgggcaagggcatccccctgaatgaccaggaccgcatcccctggctgtgcaacctgcatgacatcctgctgagagatgtggccagcggccagagggtggtgctggcctgcagcgccctgaagaagacctacagagacatcctgacccagggcaaggatggagtggccctgaagtgtgaggagagcggcaaggaggccaagcaggccgagatgcagctgctggtggtgcacctgagcggcagctttgaagtcatcagcggccgcctgctgaagcgggagggccacttcatgcctcctgagctgctgcagagccagtttgagaccctggagcccccagctgcccctgagaacttcatccagatctctgtggacaagaatgtgtctgagatcatcgccaccatcatggagaccctgaagatgaagtag

SEQ ID NO: 21665 - DNA, 957 bp, Artificial Sequence
  Description of Artificial Sequence: Synthetic coding sequence
atgtgcaggacagccctgggcgtgaccaccctgcaggacctgggcgtgtgctggaggaaggagcatgaccctgctgagatgctgcgggtgggccgggcagagctgggcggctggaagcccagctgggaggccatcgtgaaggaggtggccgccgccaccggccacacagtggtgctggtggaccagacagaggacatcctggccaagagcaagaagggcatcgaggagagcctgaggaaggtggccaagaagaagtttgctgagaacctgaaggctggagatgaatttgtggagaagaccctgagcaccatcgccaccagcacagatgctgcctctgtggtgcacagcacagacctggtggtggaggccatcgtggagaacctgaaggtgaagaatgagctgttcaagaggctggacaagtttgctgctgagcacaccatctttgccagcaacaccagcagcctgcagatcaccagcatcgccaatgccaccacccggcaggacagatttgctggcctgcacttcttcaaccctgtgcctgtgatgaagctggtggaggtgatcaagacccccatgaccagccagaagacctttgagagcctggtggacttcagcaaggccctgggcaagcaccctgtgtcctgcaaggacaccccaggcttcatcgtgaaccggctgctggtgccctacctgatggaggccatccggctgtatgaaagaggagatgccagcaaggaggacatcgacacagccatgaagctgggcgccggctaccccatgggcccctttgagctgctggactatgtgggcctggacaccaccaagttcatcgtggatggctggcatgagatggatgctgagaaccccctgcaccagcccagccccagcctgaacaagctggtggccgagaacaagtttgggaagaagacaggagagggcttctacaagtacaagtag

SEQ ID NO: 21666 - DNA, 666 bp, Artificial Sequence
  Description of Artificial Sequence: Synthetic coding sequence
atggccatcgtgcagaccctgcctgtgcccctggagcccgcccctgaggccgccacagccccccaggcccctgtgatgggctctgtgagcagcctcatcagcggccggccctgccctgggggccctgccccacccaggcaccacggccccccaggccccaccttcttccggcagcaggacggcctgctgcggggcggctatgaggcccaggagcccctgtgcccagctgtgccccccaggaaggctgtgcctgtgaccagcttcacctacatcaatgaagacttcagaacagagagcccccccagccccagcagtgatgtggaggatgcccgggagcagagggcccacaatgcccacctgcggggccccccacccaagctgatccctgtgtctgggaagctggagaagaacatggagaagatcctgatccggcccacagccttcaagcctgtgctgcccaagcccaggggggcccccagcctgcccagcttcatgggcccccgggccaccggcctgagcggcagccagggcagcctgacccagctgtttggaggccctgccagcagcagcagcagcagcagcagcagcagcgctgctgacaagcccctggccttcagcggctgggccagcggctgccccagcggcaccctgagtgacagcggctag

SEQ ID NO: 21667 - DNA, 585 bp, Artificial Sequence
  Description of Artificial Sequence: Synthetic coding sequence
atgagggagctggccgctgtggtgtcccgggacatctacctgcacaaccccaacatcaagtggaatgacatcatcggcctggatgctgccaagcagctggtgaaggaggccgtggtgtaccccatccgctacccccagctgttcaccggcatcctgagcccctggaagggcctgctgctgtatggccccccaggcaccgggaagaccctgctggccaaggctgtggccacagagtgcaagaccaccttcttcaacatcagcgccagcaccatcgtgtccaagtggaggggggacagcgagaagctggtgcgggtgctgtttgagctggcccgctaccacgcccccagcaccatcttcctggatgagctggagagcgtgatgagccagaggggcacagccagcggcggggagcacgagggcagcctgaggatgaagacagagctgctggtgcagatggatggcctggcccggtctgaggacctggtgtttgtgctggccgccagcaacctgccctgcctgaaggccatcgccctgcagcccggggaccgggcccggctgcggctgaagaagaagaagtgcacctag

SEQ ID NO: 21668 - DNA, 555 bp, Artificial Sequence
  Description of Artificial Sequence: Synthetic coding sequence
atgaccttccagttcaacttcaccatcgaggaccacctggagaatgagctgacccccatcagagatggagccctgaccctggacagcagcaaggagctgtctgtgtctgagagccagaagggggaggagcgggacagaaaatgttctgctgagcagtttgacctgccccaggaccacctgtgggagcacaagtccatggagaatgctgcccccagccaggacacagacagccccctgtctgctgccagcagcagcaggaacctggagccccacggcaagcagcccagcctgcgggccgccaaggagcacgccatgcccaaggacctgaagaagatgctggagaacaaggtgattgagaccctgcccggcttccagcacgtgaagctgtctgtggtgaagaccatcctgctgaaggagaacttccctggagagaacatcgtgtccaagagcttcagcagccacagcgacctgatcactggagtgtatgagggcggcctgaagatctgggagtgcacctttgacctgctggcctacttcaccaaggccaaggtgtag

SEQ ID NO: 21669 - DNA, 354 bp, Artificial Sequence
  Description of Artificial Sequence: Synthetic coding sequence
atggtgctgatcctgggccgccgcctgaaccgggaggacctgggcgtgcgggacagccctgccaccaagaggaaggtgtttgagatggaccccaagagcctgactggacatgagttctttgacttcagcagcggcagcagccatgctgagaacatcctgcagatcttcaatgagttccgggacagccgcctcttcacagatgtgatcatctgtgtggagggcaaggagttcccctgccacagagctgtgctgagcgcctgcagcagctacttccgggccatgttctgcaatgaccaccgggagagccgggagatgctggtggagatcaatggcatcctggccgaggccatgtag

SEQ ID NO: 21670 - DNA, 498 bp, Artificial Sequence
  Description of Artificial Sequence: Synthetic coding sequence
atgatcctgaatgtgctggagtatggcagccagcaggtggccgacctgaccctgaacctggatgactacattgatgctgagcacctgggggacttccacaggacctacaagaacagcgaggagctgcggagccgcatcgtgtctggcatcatcacccccatccacgagcagtgggagaaggccaacgtgagcagcccccaccgggagttccccccagccacagcccgggaggtggaccccctgcgcatccccccccaccacccccacaccagccggcagcccccctggccccggcggggcggcatgattgtggaccccctgcggagcggcttcccccgggccctgattgaccccagcagcggcctgcccaaccggctgcccccaggagctgtgcccccaggggccaggtttgaccccttcggccccatcggcaccagccccccaggccccaacccagaccacctgcccccacctggctatgatgacatgtacctgtag

SEQ ID NO: 21671 - DNA, 369 bp, Artificial Sequence
  Description of Artificial Sequence: Synthetic coding sequence
gccctgaccttcagcctgcgggccggggccgccagcgcccaggacggccgctgcccctgtggggcccggcggccagacagccggctgctgcagctgcacatcaccatgcccttcagcagccccatggaggccgagctggtgcggcgcatcctgagcagagatgctgcccccctgcccaggcctggagctgtgctgaaggacttcaccgtgtctggcaacctgctcttcatccggctgacagctgctgaccaccggcagctgcagctgagcatcagcagctgcctgcagcagctgagcctgctgatgtggatcacccagtgcttcctgcccgtcttcctggcccaggcccccagcggccagaggaggtag

SEQ ID NO: 21672 - DNA, 2415 bp, Artificial Sequence
  Description of Artificial Sequence: Synthetic coding sequence
atgaagagcattggagtgaagacagtgaaggtgtgtggcagcaagagctctgtgcgcatcgagggccagccctgcagcctgggccagagcaggaggaaggtgaagctgatgggagagaggagctacaccctgagcattggaaatggagactacttctgggccaacaaggagatgctgtgggactatgtgcagaccctgagtgaccagggcgctgagaagcatgagggcaccggccagagcagcggcatcacagaccaggagaaggagctgagcaccaatgccttccaggccttcaccagcggcaactatgatgcctgcctgcagcacctggcctgcctgcaggacatcaacaaggatgactacaagatcatcctgaacacagctgtggccgagttcttcaagagcaaccagaccaccacagacaacctgcggcagaccctgaaccagctgaagaaccaggtgcacagcgctgtggaggagatggatggcctggatgatgtggagaacagcatgctgtactacaaccaggccgtcatcctgtaccacctgcggcagtacacagaggccatctctgtgggggagaagctgtaccagttcatcgagccctttgaggagaagtttgcccaggccgtgtgcttcctgctggtggacctgtacatcctgacctaccaggccgagaaggccctgcacctgctggccgtgctggagaagatgatcagccagggcaacaacaacaagaatggcaagaatgagaccggcaacaacaacaacaaggatggcagcaaccacaaggccgagagcggggccctgattgaagctgccaagagcaagatccaccagtacaaggtgcgggcctacatccagatgaagagcctgaaggcctgcaagcgggagatcaagtctgtgatgaacacagctggcaacagcgcccccagcctcttcctgaagagcaactttgagtacctgcggggcaactacaggaaggctgtgaagctgctgaacagcagcaacattgctgagcaccctggcttcatgaagacaggagaatgtctgcgctgcatgttctggaacaacctgggctgcatccactttgccatgagcaagcacaacctgggcatcttctacttcaagaaggccctgcaggagaatgacaacgtgtgtgcccagctgtctgctggcagcacagatcctgggaagaagttcagcggccggcccatgtgcaccctgctgaccaacaagagatatgagctgctgtacaactgtggcatccagctgctgcacatcggccggcccctggccgcctttgagtgcctgattgaagctgtgcaggtgtaccacgccaacccccggctgtggctgcggctggccgagtgctgcatcgccgccaacaagggcaccagcgagcaggagaccaagggcctgcccagcaagaagggcatcgtgcagagcatcgtgggccagggctaccacaggaagatcgtgctggccagccagagcatccagaacacagtgtacaatgatggccagagcagcgccatccctgtggcctccatggagtttgctgccatctgcctgagaaatgccctgctgctgctgcctgaggagcagcaggaccccaagcaggagaatggagccaagaacagcaaccagctgggcggcaacacagagagcagcgagagcagcgagacctgcagcagcaagagccatgatggagacaagttcatcccagccccacccagcagccccctgaggaagcaggagctggagaacctgaagtgcagcatcctggcctgcagcgcctacgtggccctggccctgggggacaacctgatggccctgaaccacgccgacaagctgctgcagcagcccaagctgagcggcagcctgaagttcctgggccacctgtatgctgctgaggccctgatcagcctggaccgcatcagtgatgccatcacccacctgaacccagaaaatgtgacagatgtgtccctgggcatcagcagcaatgagcaggaccagggcagtgacaagggagaaaatgaggccatggagagcagcggcaagagggccccccagtgctaccccagctctgtgaacagcgccaggacagtgatgctgttcaacctgggcagcgcctactgcctgcggagtgaatatgacaaggccaggaagtgcctgcaccaggccgcctccatgatccaccccaaggaggtgcccccagaggccatcctgctggccgtgtacctggagctgcagaatggaaacacccagctggccctgcagatcatcaagaggaaccagctgctgcctgctgtgaagacccacagcgaggtgaggaagaagcctgtgttccagcctgtgcaccccatccagcccatccagatgcctgccttcaccaccgtgcagaggaagtag

SEQ ID NO: 21673 - DNA, 1899 bp, Artificial Sequence; identical to SEQ ID NO: 18887
  Description of Artificial Sequence: Synthetic coding sequence

SEQ ID NO: 21674 - DNA, 585 bp, Artificial Sequence
  Description of Artificial Sequence: Synthetic coding sequence
atggaggacctgtttgagaccttccaggatgagatgggcttcagcaacatggaggatgatggccctgaggaggaggagcgggtggccgagccccaggccaacttcaacaccccccaggccctgcgctttgaggagctgctggccaacctgctgaatgagcagcaccagatcgccaaggagctgtttgagcagctgaagatgaagaagcccagcgccaagcagcagaaggaggtggagaaggtgaagccccagtgcaaggaggtgcaccagaccctcatcctggaccctgcccagaggaagaggctgcagcagcagatgcagcagcacgtgcagctgctgacccagatccacctgctggccacctgcaaccccaacctgaaccctgaggccagcagcacccgcatctgcctgaaggagctgggcacctttgcccagagcagcatcgccctgcaccaccagtacaaccccaagttccagaccctcttccagccctgcaacctgatgggcgccatgcagctgattgaggacttcagcacccacgtgtccattgactgcagcccccacaagacagtgaagaagacctag

SEQ ID NO: 21675 - DNA, 1803 bp, Artificial Sequence; identical to SEQ ID NO: 18330
  Description of Artificial Sequence: Synthetic coding sequence

SEQ ID NO: 21676 - DNA, 1620 bp, Artificial Sequence; identical to SEQ ID NO: 19050
  Description of Artificial Sequence: Synthetic coding sequence

SEQ ID NO: 21677 - DNA, 567 bp, Artificial Sequence
  Description of Artificial Sequence: Synthetic coding sequence
tgatatgtgaatgctgtggacagccgctggagcagctatggaaatgaggccaccagcagcgcccactacgtggagcgggaccgcttcatcgtgacagacctgagcggccacaggaagcacagcagcactggagacctgctgagcctggagctgcagcaggccaagagcaacagcctgctgctgcagcgggaggccaatgccctggccatgcagcagaagtggaacagcctggatgagggccgccacctgaccctgaacctgctgagcaaggagattgagctgagaaatggagagctgcagagcgactacacagaagatgccacagacaccaagccagaccgggacatcgagctggagctgagcgccctggacacagatgagccagatggccagagcgagcccatcgaggagatcctggacatccagctgggcatcagcagccagaatgaccagctgctgaatggcatggctgtggagaatggccaccctgtgcagcagcaccagaaggagccccccaagcagaagaagcagagcctgggccgcagcaagaagcagttctgcaggtag

SEQ ID NO: 21678 - DNA, 1806 bp, Artificial Sequence
  Description of Artificial Sequence: Synthetic coding sequence
atggaggagaccatgaagctggccaccatggaggacacagtggagtactgcctcttcctgatcccagatgagagccgggacagcgacaagcacaaggagatcctgcagaagtacatcgagcgcatcatcaccaggtttgcccccatgctggtgccctacatctggcagaaccagcccttcaacctgaagtacaagccaggcaagggcggcgtgcctgcccacatgtttggagtgaccaagtttggagacaacattgaagatgagtggttcatcgtgtatgtgatcaagcagatcaccaaggagttccctgagctggtggccagaattgaggacaatgatggagagttcctgctgattgaagctgctgacttcctgcccaagtggctggaccctgagaacagcaccaacagagtcttcttctgccacggggagctgtgcatcatcccagcccccaggaagagcggggctgagagctggctgcccaccaccccacccaccatcccccaggccctgaacatcatcacagcccacagcgagaagatcctggccagcgagagcatccgggctgctgtgaacagacgcatccggggctacccagagaagatccaggccagcctgcaccgggcccactgcttcctgcctgctggcatcgtggccgtgctgaagcagaggccccggctggtggccgctgctgtgcaggccttctacctgcgggaccccatcgacctgcgggcctgcagggtcttcaagaccttcctgcctgagacccgcatcatgaccagcgcccacggctttgagatcctgtgcagcaagtgcagcccccacttcagtgactgcaagaagagcctggtgacagccagccccctgtgggccagcttcctggagagcctgaagaagaatgactacttcaagggcctgattgagggcagcgcccagtaccgggagcggctggagatggccgagaactacttccagctgtctgtggactggccagagagcagcctggccatgagccctggagaggagatcctgaccctgctgcagaccatcccctttgatattgaggacctgaagaaggaggccgccaacctgcccccagaagatgatgaccagtggctggacctgagcccagaccagctggaccagctgctgcaggaggccgtgggcaagaaggagagcgagagcgtgtccaaggaggagaaggagcagaactatgacctgacagaggtgtctgagagcatgaaggccttcatcagcaaggtgtccacccacaagggagctgagctgccccgggagcccagcgaggcccccatcacctttgatgctgacagcttcctgaactactttgacaagatcctgggcccccggcccaatgaaagtgacagtgatgacctggatgatgaggactttgaatgtctggacagtgatgatgacctggactttgagacccatgagcccggggaggaggccagcctgaagggcaccctggacaacctgaagagctacatggcccagatggaccaggagctggcccacacctgcatcagcaagagcttcaccaccaggaaccaggtggagcctgtgtcccagaccacagacaacaacagtgatgaagaagattctggaactggagagagcgtgatggcccctgtggatgtggacctgaacctggtgagcaacatcctggagagctacagcagccaggccggcctggccggccctgccagcaacctgctgcagagcatgggcgtgcagctgcctgacaacacagaccaccggcccaccagcaagcccaccaagaactag

SEQ ID NO: 21679 - DNA, 405 bp, Artificial Sequence
  Description of Artificial Sequence: Synthetic coding sequence
atgaagaagaagcatgatggcatcgtgtatgagaccaaggaggtgctgaaccccagccccaaggtgacccactgctgcaagagcctgtggctgaagtacagcttccagaaggcctacatgacccagctggtgagcagccagcctgtgcctgccatgagcaggaacccagaccacaacctgctgagccagcccaaggagcacagcatcgtgcagaagcaccaccaggaggagatcatccacaagctggccatgcagctgcggcacatcggggacaacatcgaccacaggatggtgcgggaggacctgcagcaggacggcagagatgccctggaccactttgtgttcttcttcttcagaagagtgcaggtgctgctgcacttcttctggaacaaccacctgctgtag

SEQ ID NO: 21680 - DNA, 1791 bp, Artificial Sequence
  Description of Artificial Sequence: Synthetic coding sequence
atggaggatgccccccagaggctgcgctggcaggcccacctggagttcacccacaaccatgatgtgggggacctgacctgggacaagattgctgtgtccctgcccaggtctgagaagctgcggagcctggtgctggccggcatcccccacggcatgaggccccagctgtggatgaggctgagcggggccctgcagaagaagaggaacagcgagctgagctaccgggagatcgtgaagaacagcagcaatgatgagaccatcgccgccaagcagatcgagaaggacctgctgcggaccatgcccagcaatgcctgctttgcctccatgggcagcattggagtgccccggctgcggcgggtgctgcgggccctggcctggctgtacccagaaattggctactgccagggcaccggcatggtggccgcctgcctgctgctcttcctggaggaggaggatgccttctggatgatgtctgccatcatcgaggacctgctgcctgccagctacttcagcaccaccctgctgggcgtgcagacagaccagagggtgctgcggcacctgattgtgcagtacctgccccggctggacaagctgctgcaggagcatgacatcgagctgagcctcatcaccctgcactggttcctgacagcctttgcctctgtggtggacatcaagctgctgctgcgcatctgggacctcttcttctatgagggcagccgggtgctcttccagctgaccctgggcatgctgcacctgaaggaggaggagctgatccagagtgaaaattctgccagcatcttcaacaccctgagtgacatccccagccagatggaggatgctgagctgctgctgggcgtggccatgaggctggccggcagcctgacagatgtggccgtggagacccagaggaggaagcacctggcctacctgattgctgaccagggccagctgctgggcgccggcaccctgaccaacctgagccaggtggtgagaagaaggacccagaggaggaagagcaccatcacagccctgctgtttggagaagatgacctggaggccctgaaggccaagaacatcaagcagacagagctggtggccgacctgcgggaggccatcctgcgggtggcccggcacttccagtgcacagaccccaagaactgcagcgtggagctgaccccagactacagcatggagagccaccagagggaccatgaaaattatgtggcctgcagccgcagccacagaagaagagccaaggccctgctggactttgaaagacatgatgatgatgagctgggcttcaggaagaatgacatcatcaccatcgtgtcccagaaggatgagcactgctgggtgggggagctgaatggcctgcggggctggttccctgccaagtttgtggaggtgctggatgagaggagcaaggagtacagcattgctggagatgacagcgtgacagagggcgtgacagacctggtgcggggcaccctgtgcccagccctgaaggccctgtttgaacatggcctgaagaagcccagcctgctgggcggggcctgccacccctggctgttcatcgaggaggccgccggccgggaggtggagcgggactttgcctctgtgtacagccggctggtgctgtgcaagaccttccggctggatgaagatggcaaggtgctgaccccagaggagctgctgtacagagctgtgcagagcgtgaatgtgacccatgatgctgtgcacgcccagatggatgtgaagctgcggagcctcatctgtgtgggcctgaagtag

SEQ ID NO: 21681 - DNA, 399 bp, Artificial Sequence
  Description of Artificial Sequence: Synthetic coding sequence
atggagagccgggtggctgatgctggcaccggggagacagcccgggctgctgggggcagccctgctgtgggctgcaccacccggggccctgtggtgtctgcccccctgggcgccgcccgctggaagctgctgcggcaggtgctgaagcagaagcacctggatgactgcctgcggcacgtgtctgtgagaagatttgagagcttcaacctcttctctgtgacagagggcaaggagcgggagacagaggaggaggtgggcgcctgggtgcagtacaccagcatcttctgcccagagtacagcatcagcctgcggcacaacagcggcagcctgaatgtggaggatgtgctgaccagctttgacaacacaggaaatgtgtggagcttcagccggggcaagtag

SEQ ID NO: 21682 - DNA, 1620 bp, Artificial Sequence; identical to SEQ ID NO: 19050
  Description of Artificial Sequence: Synthetic coding sequence

SEQ ID NO: 21683 - DNA, 2193 bp, Artificial Sequence
  Description of Artificial Sequence: Synthetic coding sequence
atgaacaacagcagcagcgagacccggggccacccccacagcgccagcagccccagcgagagggtcttccccatgcccctgcccaggaaggcccccctgaacatccctggcacccctgtgctggaggacttcccccagaatgatgatgagaaggagcggctgcagaggagaagaagccgggtgtttgacctgcagttcagcacagacagcccccggctgctggccagccccagcagccgcagcattgacatcagcgccaccatccccaagttcaccaacacccagatcacagagcactacagcacctgcatcaagctgagcacagagaacaagatcaccaccaagaatgccttcggcctgcacctgattgacttcatgtctgagatcctgaagcagaaggacacagagcccaccaacttcaaggtggccgccggcaccctggatgccagcaccaagatctatgctgtgcgggtggatgctgtgcatgctgatgtgtacagagtgctgggcggcctgggcaaggatgcccccagcctggaggaggtggagggccacgtggctgatggcagcgccacagagatgggcaccaccaagaaggctgtgaagcccaagaagaagcacctgcacaggaccatcgagcagaacatcaacaacctgaatgtgtctgaggccgacagaaaatgtgaaattgaccccatgttccagaagacagctgccagctttgatgaatgttccacagctggggtcttcctgagcaccctgcactgccaggactacagaagtgagctgctcttccccagtgatgtgcagaccctgagcactggagagcccctggagctgcctgagctgggctgtgtggagatgacagacctgaaggcccccctgcagcagtgtgccgaggaccggcagatctgccccagcctggccggcttccagttcacccagtgggacagcgagacccacaatgaatctgtgtctgccctggtggacaagttcaagaagaatgaccaggtgtttgacatcaatgctgaggtggatgaaagtgactgtggggacttcccagatggcagcctgggagatgactttgatgccaatgatgagccagaccacacagctgtgggggaccacgaggagttccgctcctggaaggagccctgccaggtgcagagctgccaggaggagatgatcagcctgggagatggagacatccgcaccatgtgccccctgctgtccatgaagccaggagagtacagctacttcagccccaggaccatgtccatgtgggccggccctgaccactggaggttccggcccaggaggaagcaggatgcccccagccagagcgagaacaagaagaagagcaccaagaaggactttgaaattgactttgaagatgacatcgactttgatgtgtacttcaggaagaccaaggccgccaccatcctgaccaagagcaccctggagaaccagaactggagggccaccaccctgcccacagacttcaactacaacgtggacaccctggtgcagctgcacctgaagccaggcacccggctgctgaagatggcccagggccaccgggtggagacagagcactatgaggagattgaagattatgactacaacaaccccaatgacaccagcaacttctgccccggcctgcaggccgctgacagtgatgatgaggacctggatgacctgtttgtgggccctgtgggcaacagcgacctgagcccctacccctgccacccccccaagacagcccagcagaatggagacaccccagaggcccagggcctggacatcaccacctatggagagagcaacctggtggccgagccccagaaggtgaacaagattgagatccactacgccaagacagccaagaagatggacatgaagaagctgaagcagagcatgtggagcctgctgacagccctgagcggcaaggaggctgatgctgaggccaaccaccgggaggccggcaaggaggccgccctggccgaggtggctgatgagaagatgctgagcggcctgaccaaggacctgcagaggagcctgccccctgtgatggcccagaacctgagcatccccctggcctttgcctgcctgctgcacctggccaatgagaagaacctgaagctggagggcacagaggacctgagtgatgtgctggtgcggcagggcgactag

SEQ ID NO: 21684 - DNA, 900 bp, Artificial Sequence
  Description of Artificial Sequence: Synthetic coding sequence
atggagacccagtttcctgtgtctgagggcaaggtggacccctaccgcagctgtggcttctcctatgagcaggaccccaccctgcgggaccctgaggccgtggcccggcgctggccctggatggtgtctgtgcgggccaacggcacccacatctgtgccggcaccatcatcgccagccagtgggtgctgactgtggcccactgcctgatctggagagatgtgatctacagcgtgcgggtgggcagcccctggattgaccagatgacccagacagccagtgatgtgcctgtgctgcaggtgatcatgcacagccgctaccgggcccagcgcttctggagctgggtgggccaggccaatgacatcggcctgctgaagctgaagcaggagctgaagtacagcaactacgtgcggcccatctgcctgcccggcacagattatgtgctgaaggaccacagccgctgcaccgtgacaggctggggcctgagcaaggcagatggcatgtggccccagttccgcaccatccaggagaaggaggtgatcatcctgaacaacaaggaatgtgacaacttctaccacaacttcaccaagatccccaccctggtgcagatcatcaagagccagatgatgtgtgccgaggacacccaccgggagaagttctgctatgagctgaccggggagcccctggtgtgcagcatggagggcacctggtacctggtgggcctggtgtcctggggcgccggctgccagaagtctgaggccccacccatctacctgcaggtgagcagctaccagcactggatctgggactgcctgaatggccaggccctggccctgcctgcccccagcaggaccctgctgctggccctgcccctgcccctgagcctgctggccgccctgtag

SEQ ID NO: 21685 - DNA, 1089 bp, Artificial Sequence
  Description of Artificial Sequence: Synthetic coding sequence
atgctggtgcccggcagcacccggccctacagcaagaagaggcagaacagcaagagcgcccagggcctggccggcctgaggaacctgggcaacacctgcttcatgaacagcatcctgcagtgcctgagcaacacccgggagctgcgggactactgcctgcagaggctgtacatgagggacctgcaccacggcagcaatgcccacacagccctggtggaggagtttgccaagctgatccagaccatctggaccagcagccccaatgatgtggtgagccccagcgagttcaagacccagatccagagatatgcccccaggtttgtgggctacaaccagcaggatgcccaggagttcctgcgcttcctgctggatggcctgcacaatgaggtgaacagagtgaccctgcggcccaagagcaaccctgagaacctggaccacctgcctgatgatgagaagggccggcagatgtggaggaagtacctggagcgggaggacagccgcatcggggacctgtttgtgggccagctgaagagcagcctgacctgcacagactgtggctactgcagcacagtgtttgaccccttctgggacctgagcctgcccatcgccaagaggggctacccagaggtgaccctgatggactgcatgaggctcttcaccaaggaggatgtgctggatggagatgagaagcccacctgctgccgctgccggggcaggaagcgctgcatcaagaagttcagcatccagcgcttccccaagatcctggtgctgcacctgaagcgcttcagcgagagccgcatccgcaccagcaagctgaccacctttgtgaacttccccctgcgggacctggacctgcgggagtttgccagcgagaacaccaaccacgctgtgtacaacctgtatgctgtgagcaaccacagcggcaccaccatgggcggccactacacagcctactgccgcagccctggcaccggggagtggcacaccttcaatgacagctctgtgacccccatgagcagcagccaggtgaggaccagtgatgcctacctgctcttctatgagctggccagcccccccagcaggatgtag

SEQ ID NO: 21686 - DNA, 1800 bp, Artificial Sequence
  Description of Artificial Sequence: Synthetic coding sequence
atggaccctggagatgctgccatcctggagagcagcctgcgcatcctgtaccgcctgtttgagagcgtgctgccccccctgcctgctgccctgcagagcaggatgaatgtcatcgaccacgtgcgggacatggctgctgctggcctgcacagcaatgtgcggctgctgagcagcctgctgctgaccatgagcaacaacaaccctgagctgttcagccccccccagaagtaccagctgctggtgtaccacgccgacagcctcttccatgacaaggagtacagaaatgctgtgtccaagtacaccatggccctgcagcagaagaaggccctgagcaagaccagcaaggtgcggcccagcacaggcaacagcgccagcaccccccagagccagtgcctgcccagcgagattgaggtgaagtacaagatggccgagtgctacaccatgctgaagcaggacaaggatgccatcgccatcctggatggcatccccagccggcagaggacccccaagatcaacatgatgctggccaacctgtacaagaaggccggccaggagcggcccagcgtgaccagctacaaggaggtgctgcggcagtgccccctggccctggatgccatcctgggcctgctgagcctgtctgtgaagggagctgaggtggcctccatgaccatgaatgtcatccagacagtgcccaacctggactggctgtctgtgtggatcaaggcctatgcctttgtgcacactggagacaacagccgggccatcagcaccatctgcagcctggagaagaagagcctgctgcgggacaacgtggacctgctgggcagcctggccgacctgtacttccgggccggggacaacaagaacagcgtgctgaagtttgagcaggcccagatgctggacccctacctgatcaagggcatggatgtgtatggctacctgctggcccgggagggccgcctggaggatgtggagaacctgggctgccgcctcttcaacatcagtgaccagcacgccgagccctgggtggtgtctggctgccacagcttctacagcaagcgctacagccgggccctgtacctgggcgccaaggccatccagctgaacagcaacagcgtgcaggccctgctgctgaagggagctgccctgaggaacatgggccgggtgcaggaggccatcatccacttccgggaggccatccggctggccccctgccgcctggactgctatgagggcctgattgagtgctacctggccagcaacagcatccgggaggccatggtgatggccaacaacgtgtacaagaccctgggcgccaatgcccagaccctgaccctgctggccaccgtgtgcctggaggaccctgtgacccaggagaaggccaagaccctgctggacaaggccctgacccagaggccagactacatcaaggctgtggtgaagaaggccgagctgctgagccgggagcagaagtatgaagatggcatcgccctgctgagaaatgccctggccaaccagagcgactgtgtgctgcaccgcatcctgggggacttcctggtggccgtgaatgagtaccaggaggccatggaccagtacagcatcgccctgagcctggaccccaatgaccagaagagcctggagggcatgcagaagatggagaaggaggagagccccacagatgccacccaggaggaggatgtggatgacatggagggcagcggggaggagggggacctggagggcagtgacagcgaggccgcccagtgggccgaccaggagcagtggtttggcatgcagtag

SEQ ID NO: 21687 - DNA, 507 bp, Artificial Sequence
  Description of Artificial Sequence: Synthetic coding sequence
atgcctgccaccaggaagcccatgagatatggccacacagagggccacacagaggtgtgctttgatgacagcggcagcttcatcgtgacctgtggcagtgatggagatgtgcgcatctgggaggacctggatgatgatgaccccaagttcatcaacgtgggggagaaggcctacagctgtgccctgaagagcggcaagctggtgacagctgtgagcaacaacaccatccaggtgcacaccttccctgagggcgtgcctgatggcatcctgacccgcttcaccaccaatgccaaccacgtggtgttcaatggagatggcaccaagattgctgctggcagcagtgacttcctggtgaagatcgtggatgtgatggacagcagccagcagaagaccttccggggccatgatgcccctgtgctgagcctgagctttgaccccaaggacatcttcctggccagcgccagctgtgatggctctgtgcgggtgtggcagatcagtgaccagtag

SEQ ID NO: 21688 - DNA, 141 bp, Artificial Sequence
  Description of Artificial Sequence: Synthetic coding sequence
atggtgaacagctgctgcggctctgtgtgcagcgaccagggctgcggcctggagaactgctgccggcccagctgctgccagaccacctgctgcaggaccacctgctgccggcccctgtgctgtgccagcagctgctgctag

SEQ ID NO: 21689 - DNA, 669 bp, Artificial Sequence
  Description of Artificial Sequence: Synthetic coding sequence
atggcctctgtggtggagtacaagggcctgcgggccggctaccactgcggctactgtgacagcaaggagggcaaggccagctgtggcatgtgggcccacagcatgacagtgcaggactaccaggacctgattgaccggggctggaggagaagtggcaagtatgtgtacaagcctgtgatgaaccagacctgctgcccccagtacaccatccgctgccggcccctgcagttccagcccagcaagagccacaagaaggtgctgaagaagatgctgaagttcctggccaagggggaggtgcccaagggcagctgtgaagatgagcccatggacagcaccatggatgatgctgtggccggggactttgccctgatcaacaagctggacatccagtgtgacctgaagaccctgagtgatgacatcaaggagagcctggagagcgagggcaagaacagcaagaaggaggagccccaggagctgctgcagagccaggactttgtgggggagaagctgggcagcggggagcccagccacagcgtgaaggtgcacacagtgcccaagccaggaaaaggagctgacctgagcaagccaccctgcaggaaggccaaggagatcaggaaggagaggaagaggctgaagctgatgcagcagaacccagctggggagctgtag

SEQ ID NO: 21690 - DNA, 495 bp, Artificial Sequence
  Description of Artificial Sequence: Synthetic coding sequence
atgctgaaggccgtcatcctgattggaggcccccagaagggcacccgcttccggcccctgagctttgaggtgcccaagcccctcttccctgtggccggcgtgcccatgatccagcaccacatcgaggcctgtgcccaggtgcccggcatgcaggagatcctgctgattggcttctaccagccagatgagcccctgacccagttcctggaggccgcccagcaggagttcaacctgcctgtgcgctacctgcaggagtttgcccccctgggcactggaggcggcctgtaccacttccgggaccagatcctggccggcagccctgaggccttctttgtgctgaatgctgatgtgtgcagcgacttccccctgagcgccatgctggaggcccaccggcggcagaggcaccccttcctgctgctgggcaccacagccaacagaacccagagcctgaactacggctgcatcgtggagaacccccagacccatgaggtgtag

SEQ ID NO: 21691 - DNA, 339 bp, Artificial Sequence
  Description of Artificial Sequence: Synthetic coding sequence
atgtttgtgtctgacttcaggaaggagttctatgaggtggtgcagagccagagggtgctgctgtttgtggccagtgatgtggatgccctgtgtgcctgcaagatcctgcaggccctcttccagtgtgaccacgtgcagtacaccctggtgcctgtgtctggctggcaggagctggagacagccttcctggagcacaaggagcagttccactacttcatcctgatcaactgtggggccaacgtggacctgctggacatcctgcagccagatgaggacaccatcttctttgtgtgtgacacccacaggcctgtgaatgtggtgaatgtgtacaatgactag

SEQ ID NO: 21692 - DNA, 942 bp, Artificial Sequence
  Description of Artificial Sequence: Synthetic coding sequence
accctggtggtgtctggaagagatgacccccccacccacagccagcctgacagtgatgatgaggccgaggagatccagtggagcgatgatgaaaatacagccaccctgacagcccctgagttccctgagtttgccaccaaggtgcaggaggccatcaacagcctgggcggcagcgtcttccccaagctgaactggagcgcccccagagatgcctactggatcgccatgaacagcagcctgaagtgcaagaccctgagtgacatcttcctgctcttcaagagcagtgacttcatcacccgggacttcacccagcccttcatccactgcacagatgacagcccagacccctgcatcgagtatgagctggtgctgaggaagtggtgtgagctgatccctggagctgagttccgctgctttgtgaaggagaacaagctgattggcatcagccagagggactacacccagtactatgaccacatcagcaagcagaaggaggagatccgccgctgcatccaggacttcttcaagaagcacatccagtacaagttcctggatgaggactttgtgtttgacatctacagagacagccgggacagccctgccttccgctgcaccaacagcgaggtgacagtgcagcccagcccctacctgagctaccgcctgcccaaggactttgtggacctgagcactggagaagatgcccacaagctgattgacaagtctgctgggggccgcctgatgtctgtgctggagctggagaagagaagaccccggcccacagcccctggggccgcccaccagccccagctgcctgctgaccctgatgctgggggccccagctctgtggacatcagccacttcctgtacagctgcaccttcacctggggcaagaagagaagagactttgccacctgcaagaacaacatcatcaacagaagctag

SEQ ID NO: 21693 - DNA, 1017 bp, Artificial Sequence; identical to SEQ ID NO: 21239
  Description of Artificial Sequence: Synthetic coding sequence

SEQ ID NO: 21694 - DNA, 1119 bp, Artificial Sequence; identical to SEQ ID NO: 19903
  Description of Artificial Sequence: Synthetic coding sequence

SEQ ID NO: 21695 - DNA, 408 bp, Artificial Sequence
  Description of Artificial Sequence: Synthetic coding sequence
tgacagctggcctccatggtgtggaacaaccccagccagcagcagttcatgcagtttggaggcagcagcggcagccagctgccccagatccagacagatgtggtgctgcccagctgcaagaagaaggccccagctgagacccctgtgaaggagcggctcttcatcgtgttcaacccccaccccctgcccctggatgtgctggaggacatcttctgccgcttcggcaacctgattgaggtgtacctggtgtctgggaagaatgtgggctacgccaagtatgctgaccgcatcagcgccaatgatgccatcgccaccctgcacggcaagatcctgaatggagtgcggctgaaggtgatgctggccgacagcccccgggaggagagcaacaagaggcagaggacctactag

SEQ ID NO: 21696 - DNA, 1764 bp, Artificial Sequence; identical to SEQ ID NO: 19443
  Description of Artificial Sequence: Synthetic coding sequence

SEQ ID NO: 21697 - DNA, 1842 bp, Artificial Sequence; identical to SEQ ID NO: 18580
  Description of Artificial Sequence: Synthetic coding sequence

SEQ ID NO: 21698 - DNA, 477 bp, Artificial Sequence
  Description of Artificial Sequence: Synthetic coding sequence
atgacccactgctgcagcccctgctgccagcccacctgctgcaggaccacctgctgcaggaccacctgctggaagcccaccaccgtgaccacctgcagcagcaccccctgctgccagcctgcctgctgcgtgagcagctgctgccagccctgctgccggcccacctgctgccagaacacctgctgcaggaccacctgctgccagcccacctgccccacctgctgcggcagcagctgctgcggccagaccagctgtggcagcagctgtggccagagcagcagctgtgcccctgtgtactgcaggaggacctgctactaccccaccaccgtgtgcctgcccggctgcctgaaccagagctgtggcagcaactgctgccagccctgctgcaggcctgcctgctgtgagaccacctgctgcaggaccacctgcttccagcccacctgtgtgagcagctgctgccagcccagctgctgctag

SEQ ID NO: 21699 - DNA, 1620 bp, Artificial Sequence; identical to SEQ ID NO: 19050
  Description of Artificial Sequence: Synthetic coding sequence

SEQ ID NO: 21700 - DNA, 2511 bp, Artificial Sequence
  Description of Artificial Sequence: Synthetic coding sequence
atggctgctgccctgggccccccagaggtgattgcccagctggagaatgctgccaaggtgctgatgcagaccctggcctgcagcatcctgacagccctgctgtctgagttcagcagcagcagcaagaccagcaacatcggcctgtccatggagttccacggcaactgcaagagggtcttccaggaggaggacctgcggcagatcttcatgctgactgtggaggtgctgcaggagttcagcagaagagagaacctgaatgcccagatgagctctgtgttccagcgctacctggccctggccaaccaggtgctgtcctggaacttcctgccccccaagctgggccgccactacatcgccatgtttgagagcagccagaatgtgctgctgaagcccacagagagctggagggagaccctgctggacagccgggtgatggagctgttcttcaccgtgcacaggaagatcagagaagattctgacatggcccaggacagcctgcagtgcctggcccagctggccagcctgcacggccccatcttcccagatgagggcagccaggtggactacctggcccacttcatcgagggcctgctgaacaccatcaatggcatcgagattgaagattctgaggccgtgggcatcagcagcatcatcagcaacctgatcaccgtcttccccagaaatgtgctgacagccatccccagcgagctgttcagcagctttgtgaactgcctgacccacctgacctgcagctttggccgctctgctgccctggaggaggtgctggacaaggatgacatggtgtacatggaggcctatgacaagctgctggagagctggctgaccctggtgcaggatgacaagcacttccacaagggcttcttcacccagcacgctgtgcaggtgttcaacagctacatccagtgccacctggccgccccagatggcaccaggaacctgacagccaatggagtggccagccgggaggaggaggagatcagcgagctgcaggaggatgaccgggaccagttcagtgaccagctggcctctgtgggcatgctgggcagaattgctgctgagcactgcatccccctgctgaccagcctgctggaggagcgggtgacccggctgcacggccagctgcagaggcaccagcagcagctgctggccagccctggcagcagcacagtggacaacaagatgctggatgacctgtatgaggacatccactggctgatcctggtgacaggctacctgctggctgatgacacccagggcgagacccccctcatccccccagagatcatggagtacagcatcaagcacagcagcgaggtggacatcaacaccaccctgcagatcctgggcagccctggagagaaggccagcagcatccctggctacaacagaacagattctgtcatccggctgctgagcgccatcctgcgggtgtctgaggtggagagccgggccatccgggctgacctgacccacctgctgagcccccagatgggcaaggacatcgtgtggttcctgaagcgctgggccaagacctacctgctggtggatgagaagctgtatgaccagatcagcctgcccttcagcacagccttcggggctgacacagagggcagccagtggatcatcggctacctgctgcagaaggtgatcagcaacctgtctgtgtggagcagcgagcaggacctggccaatgacacagtgcagctgctggtgaccctggtggagcggcgggagcgggccaacctggtgatccagtgtgagaactggtggaacctggccaagcagtttgccagccgcagcccccccctgaacttcctgagcagccctgtgcagaggaccctgatgaaggccctggtgctgggcggctttgcccacatggacacagagaccaagcagcagtactggacagaggtgctgcagcccctgcagcagcgcttcctgcgggtcatcaaccaggagaacttccagcagatgtgccagcaggaggaggtgaagcaggagatcacagccaccctggaggccctgtgtggcattgctgaggccacccagattgacaacgtggccatcctcttcaacttcctgatggacttcctgaccaactgcatcggcctgatggaggtgtacaagaacaccccagagaccgtgaacctgatcatcgaggtgtttgtggaggtggcccacaagcagatctgctacctgggggagagcaaggccatgaacctgtatgaggcctgcctgaccctgctgcaggtgtacagcaagaacaacctgggccggcagagaattgatgtgacagctgaggaggagcagtaccaggacctgctgctgatcatggagctgctgaccaacctgctgagcaaggagttcatcgacttcagtgacacagatgaggtgttccggggccacgagcccggccaggccgccaacagatctgtgtctgctgctgatgtggtgctgtatggagtgaacctgatcctgcccctgatgtag

SEQ ID NO: 21701 - DNA, 1008 bp, Artificial Sequence
  Description of Artificial Sequence: Synthetic coding sequence
atggacttcctgctgggcaaccccttcagcagccctgtgggccagagaattgagaaggccacagatggcagcctgcagagcgaggactgggccctgaacatggagatctgtgacatcatcaatgaaacagaggagggccccaaggatgccctgcgggctgtgaagaagagaattgtgggcaacaagaacttccacgaggtgctggagacctgtgtgaagaactgtggccaccgcttccacgtgctggtggccagccaggactttgtggagagcgtgctggtgaggaccatcctgcccaagaacaacccccccaccatcgtgcatgacaaggtgctgaacctgatccagagctgggcagatgccttccgcagcagcccagacctgactggagtggtgaccatctatgaggacctgcggaggaagggcctggagttccccatgacagacctggacatgctgagccccatccacaccccccagaggacagtgttcaacagcgagacccagagcggccaggacagcgtgggcacagacagcagccagcaggaggacagcggccagcacgccgcccccctgcctgccccacccatcctgagcggggacacccccatcgcccccaccccagagcagatcggcaagctgcggtctgagctggagatggtgtctggaaatgtgcgggtgatgtctgagatgctgacagagctggtgcccacccaggccgagcctgctgacctggagctgctgcaggagctgaacagaacctgccgggccatgcagcagagggtgctggagctgatcccccagatcgccaatgagcagctgacagaggagctgctgattgtgaatgacaacctgaacaacgtgttcctgcggcatgaaagatttgagcgcttcagaacaggccagaccaccaaggcccccagcgaggccgagcctgctgctgacctgattgacatgggccctgaccctgctgccaccggcaacctgagcagccagctggccggctag

SEQ ID NO: 21702 - DNA, 5193 bp, Artificial Sequence
  Description of Artificial Sequence: Synthetic coding sequence
atgggcaacagcgacagccagtacaccctgcagggcagcaagaaccacagcaacaccatcactggagccaagcagatcccctgcagcctgaagatccggggcatccacgccaaggaggagaagagcctgcacggctggggccacggcagcaatggagctggctacaagagccgcagcctggcccggagctgcctgagccacttcaagagcaaccagccctatgccagccggctgggcggccccacctgcaaggtgtcccggggcgtggcctacagcacccacaggaccaatgcccctgggaaggacttccagggcatctctgctgccttcagcacagaaaatggcttccacagcgtgggccacgagctggccgacaaccacatcaccagccgggactgcaatggccacctgctgaactgctatggaagaaatgaaagcatcgccagcaccccacctggagaggacaggaagagcccccgggtgctgatcaagaccctgggcaagctggatggctgcctgcgggtggagttccacaatggaggcaaccccagcaaggtgcctgctgaggactgcagcgagcctgtgcagctgctgcgctacagccccaccctggccagcgagaccagccctgtgcctgaggcccggcggggcagcagcgctgacagcctgcccagccaccggcccagccccacagacagccggctgcggagcagcaagggcagcagcctgagcagcgagagctcctggtatgacagcccctggggcaatgctggggagctgtctgaggccgagggcagcttcctggcccctggcatgccagaccccagcctgcacgccagcttccccccaggagatgccaagaagcccttcaaccagagcagcagcctgagcagcctgcgggagctgtacaaggatgccaacctgggcagcctgagccccagcggcatccggctgagtgatgagtacatgggcacccacgccagcctgagcaacagagtgtcctttgccagtgacattgatgtgcccagccgggtggcccatggagaccccatccagtacagcagcttcaccctgccctgcaggaagcccaaggcctttgtggaggacacagccaagaaggacagcctgaaggccaggatgaggcgcatcagtgactggacaggcagcctgagcaggaagaagaggaagctgcaggagcccaggagcaaggagggcagtgactactttgacagcagaagtgatggcctgaacacagatgtgcagggcagcagccaggccagcgccttcctgtggagcggcggcagcacccagatcctgagccagaggtctgagagcacccacgccatcggcagtgaccccctgcggcagaacatctatgagaacttcatgagggagctggagatgagcaggaccaacacagagaacatcgagaccagcacagaaacagctgagagcagcagcgagagcctgagcagcctggagcagctggacctgctgtttgagaaggagcagggcgtggtgaggaaggccggctggctgttcttcaagcccctggtgacagtgcagaaggagaggaagctggagctggtggcccggaggaagtggaagcagtactgggtgaccctgaagggctgcaccctgctcttctatgagacctacggcaagaacagcatggaccagagcagcgccccccgctgtgccctgtttgctgaagattccatcgtgcagagcgtgcctgagcaccccaagaaggaaaatgtgttctgcctgagcaacagctttggagatgtgtacctgttccaggccaccagccagacagacctggagaactgggtgacagctgtgcacagcgcctgtgccagcctgtttgccaagaagcacggcaaggaggacaccctgcggctgctgaagaaccagaccaagaacctgctgcagaagattgacatggacagcaagatgaagaagatggccgagctgcagctgtctgtggtgtctgaccccaagaacaggaaggccatcgagaaccagatccagcagtgggagcagaacctggagaagttccacatggacctcttcaggatgcgctgctacctggccagcctgcagggcggggagctgcccaaccccaagagcctgctggccgccgccagccggcccagcaagctggccctgggccgcctgggcatcctgtctgtgagcagcttccacgccctggtgtgcagcagagatgattctgccctgaggaagaggaccctgagcctgacccagagaggaagaaacaagaagggcatcttcagcagcctgaagggcctggacaccctggccaggaagggcaaggagaagaggcccagcatcacccaggtggatgagctgctgcacatctacggcagcacagtggatggagtgccccgggacaatgcctgggagatccagacctacgtgcacttccaggacaaccacggcgtgacagtgggcatcaagccagagcaccgggtggaggacatcctgaccctggcctgcaagatgaggcagctggagcccagccactacggcctgcagctgaggaagctggtggatgacaacgtggagtactgcatcccagccccctatgagtacatgcagcagcaggtgtatgatgaaattgaggtgttccccctgaatgtgtatgatgtgcagctgaccaagacaggctctgtgtgtgactttggatttgctgtgacagcccaggtggatgagcggcagcacctgagccgcatcttcatcagtgatgtgctgcctgatggcctggcctatggagagggcctgaggaaaggaaatgagatcatgaccctgaatggagaggccgtgtctgacctggacctgaagcagatggaggccctcttcagcgagaagtctgtgggcctgaccctgattgcccggcccccagacaccaaggccaccctgtgcacctcctggagcgacagcgacctcttcagccgggaccagaagagcctgctgcccccacccaaccagagccagctgctggaggagttcctggacaacttcaagaagaacacagccaatgacttcagcaatgtgcctgacatcaccaccggcctgaagaggagccagacagatggcaccctggaccaggtgagccaccgggagaagatggagcagaccttccgctctgctgagcagatcacagccctgtgccgctccttcaatgacagccaggccaacggcatggagggcccccgggagaaccaggaccccccacccaggagcctggcccggcacctgagtgatgctgaccggctgaggaaggtgatccaggagctggtggacacagagaagagctatgtgaaggacctgagctgcctgtttgagctgtacctggagcccctgcagaatgagaccttcctgacccaggatgagatggagagcctgtttggcagcctgcctgagatgctggagttccagaaggtgttcctggagaccctggaggatggcatcagcgccagcagtgacttcaacaccctggagacccccagccagttcaggaagctgctcttcagcctgggcggcagcttcctgtactatgctgaccacttcaagctgtacagcggcttctgtgccaaccacatcaaggtgcagaaggtgctggagcgggccaagacagacaaggccttcaaggccttcctggatgccaggaaccccaccaagcagcacagcagcaccctggagagctacctgatcaagcctgtgcagagggtgctgaagtaccccctgctgctgaaggagctggtgtccctgacagaccaggagagcgaggagcactaccacctgacagaggccctgaaggccatggagaaggtggccagccacatcaatgagatgcagaagatctatgaggactatggcaccgtgtttgaccagctggtggccgagcagagcggcacagagaaggagcagcctgagtggagcagcgaggtgatggatgtgctggacccccggggcaagctgaccaagggcaccctggaggagcccaggaccctggtgacagagctgtccatgggagagctgctgatgcacagcacagtgtcctggctgaaccccttcctgagcctgggcaaggccaggaaggacctggagctgactgtgtttgtgttcaagagagctgtgatcctggtgtacaaggagaactgcaagctgaagaagaagctgcccagcaacagcaggcctgcccacaacagcacagacctggaccccttcaagttccgctggctgatccccatcagcgccctgcaggtgcggctgggcaacccagctggaacagagaacaacagcatctgggagctgatccacaccaagtcagaaattgagggccggcctgagaccatcttccagctgtgctgcagcgacagcgagagcaagaccaacatcgtgaaggtgatccgcagcatcctgcgggagaacttccgccgccacatcaagtgtgagctgcccctggagaagacctgcaaggaccggctggtgcccctgaagaacagagtgcctgtgtctgccaagctggccagcagccgcagcctgaaggtgctgaagaacagcagcagcaatgagtggacaggagaaacaggcaagggcaccctgctggacagtgatgagggcagcctgagcagcggcacccagagcagcggctgccccacagctgagggccggcaggacagcaagagcaccagccctgggaagtacccccaccctggcctggccgactttgctgacaacctgatcaaggagagtgacatcctgagtgatgaagatgatgaccaccggcagacagtgaagcagggcagccccaccaaggacatcgagatccagttccagaggctgcgcatcagcgaggaccctgatgtgcaccctgaggccgagcagcagcccggccctgagagcggggagggccagaagggcggggagcagcccaagctggtgcggggccacttctgccccatcaagaggaaggccaacagcaccaagagggaccggggcaccctgctgaaggcccagatccgccaccagagcctggacagccagagtgaaaatgccaccatcgacctgaacagcgtgctggagcgggagttctctgtgcagagcctgacctctgtggtgtctgaggagtgcttctatgaaacagagagccacggcaagagctag

SEQ ID NO: 21703 - DNA, 348 bp, Artificial Sequence
  Description of Artificial Sequence: Synthetic coding sequence
atggccccagccaagaagggcggggagaagaagaagggccgcagcgccatcaatgaggtggtgacccgggagtacaccatcaacatccacaagaggatccacggcgtgggcttcaagaagagggccccccgggccctgaaggagatcaggaagtttgccatgaaggagatgggcaccccagatgtgagaattgacacccggctgaacaaggctgtgtgggccaagggcatcagaaatgtgccctaccgcatccgggtgcggctgagcaggaagagaaatgaagatgaggacagccccaacaagctgtacaccctggtgacctacgtgcctgtgaccaccttcaagtag

SEQ ID NO: 21704 - DNA, 747 bp, Artificial Sequence
  Description of Artificial Sequence: Synthetic coding sequence
atggccctggaggtgggggacatggaggatggccagctgagtgacagcgacagcgacatgacagtggcccccagcgaccggcccctgcagctgcccaaggtgctgggcggggacagcgccatgagggccttccagaacacagccacagcctgtgcccctgtgagccactacagagctgtggagagcgtggacagcagcgaggagagcttcagtgacagtgatgatgacagctgcctgtggaagaggaagaggcagaagtgcttcaaccccccacccaagccagagcccttccagtttggccagagcagccagaagccccctgtggccggcggcaagaagatcaacaacatctggggcgctgtgctgcagaagctgaggaaggagagccaggagcacaccaaggacctggacaaggagctggatgagtacatgcatggaggcaagaagatgggcagcaaggaggaggagaatggccagggccacctgaagaggaagaggcctgtgaaggaccggctgggcaacagacctgagatgaactacaagggccgctatgagatcacagctgaggacagccaggagaaggtggctgatgagatctccttccggctgcaggagcccaagaaggacctgattgcccgggtggtgaggaacaagctgcggaccttcagcaccctgaagaccaagaggaacatgaagatcaagaagctgctgggccgcggggagcacaagtgctggggcaagaggtag

SEQ ID NO: 21705 - DNA, 78 bp, Artificial Sequence
  Description of Artificial Sequence: Synthetic coding sequence
atggccatggcccccagccccagcctggtgcaggtgtacaccagccctgctgctgtggccgtgtgggagtggcagtag

SEQ ID NO: 21706 - DNA, 171 bp, Artificial Sequence
  Description of Artificial Sequence: Synthetic coding sequence
atgagctactaccagaggcccttcagccccagcgcctacagcctgcctgccagcctgaacagcagcatcgtgatgcagcacggcaccagcctggacagcacagacacctacccccagcacgcccagagcctggatggcaccaccagcagcagcatccccctgtacagatag

SEQ ID NO: 21707 - DNA, 450 bp, Artificial Sequence
  Description of Artificial Sequence: Synthetic coding sequence
gtgcgggagctggaggccgagctggatgctgagcagaagaagcacgccgaggccctgaagggcgtgaggaagcatgaaagaagagtgaaggagctggcctaccaggccgaggaggacaggaagaacctggccaggatgcaggacctggtggacaagctgcagagcaaggtgaagagctacaagaggcagtttgaggaggccgagcagcaggccaacaccaacctggccaagtacaggaaggcccagcacgagctggatgatgctgaggagagagctgacatggccgagacccaggccaacaagctgcgggcccggaccagagatgccctgggccccaaggtgcgcagcggccggggcatcgccctgtgtgccggcggcctgtggggcctgaccggcagcacagcccacagcgccatccccttcagcagcgcccagggcgtgacagcctag

SEQ ID NO: 21708 - DNA, 468 bp, Artificial Sequence
  Description of Artificial Sequence: Synthetic coding sequence
agcaatgtgatggaggccaatgctgcccggcaggccaccccagctgagtggagccaggatgacagcaatgacatgtgggaggaccaggaggaggaggaggaggaggaggaggatggcctggccggccagctgctgagtgacatcctggccaccagcaaatatgaggaggactactatgaagatgatgaggaggatgatcctgatgccctgaaggaccccctgtaccagattgacctgcaggccaccctgatgaccatgagaggagagttctaccggcccagcgccagcaagaagggcagcctgagcacctttgcccccagcggccctgctgccaaccactttgctgccctgaccggcctggagatgcacttcctgctgaacctgaagtggcacctggacccctggcccctggccagcgctgtgaccctgatgaccatccagacccggctgactggagctgtgacctag

SEQ ID NO: 21709 - DNA, 1620 bp, Artificial Sequence; identical to SEQ ID NO: 19050
  Description of Artificial Sequence: Synthetic coding sequence

SEQ ID NO: 21710 - DNA, 645 bp, Artificial Sequence
  Description of Artificial Sequence: Synthetic coding sequence
atgcccagcccctggggctggtttgctgtgacagcctgtggggcccagaggaacaactttgaggagcctgtggccctgcaggagatggacaccagcaatggagtgctgctgcccttctatgaccctgacagcagcatcgtgtacctgtgtgggaagggggacagcagcatccgctactttgagatcacagatgagcccccatttgtgcactacctgaacaccttcagcagcaaggagccccagaggggcatgggcttcatgcccaagaggggcctggatgtgtccaaatgtgaaattgcccgcttctacaagctgcacgagaggaaatgtgagcccatcatcatgacagtgcccaggaagagtgacctcttccaggatgctgagcctgtgctgatcagcctgagagatggctacgtgccccccaagcaccgggagctgcgggtgaccaagaggaacatcctggatgtgcggccccccagcggccccaggaggagccagagcgccagtgatgcccccctgagccagcacaccctggagaccctgctggaggagatcaaggccctgcgggagcgggtgcaggcccaggagcagaggatcacagccctggagaacatgctgtgtgagctggtggatggaacagactag

SEQ ID NO: 21711 - DNA, 690 bp, Artificial Sequence
  Description of Artificial Sequence: Synthetic coding sequence
atgctgcagctgcgggacagcgtggacagcgctggcaccagccccacagctgtgctggccgccggggaggagcccggcagcattgagcaggccgtggaggagatccgggtggtggtgcggcctgtggaggatggagagatccagggcgtgtggctgctgacagaggtggaccactggaacaatgagaaggagcggctggtgctggtgacagagcagagcctgctgatctgcaagtatgacttcatcagcctgcagtgccagcaggtggtgcgcatcgccctgaatgctgtggacaccatctcctatggagagttccagttcccccccaagagcctgaacaagcgggagggcttcggcatccgcatccagtgggacaagcagagccggcccagcttcatcaaccgctggaacccctggagcaccaacgtgccctatgccaccttcacagagcaccccatggccggggctgatgagaagacagccagcctgtgccagctggagagcttcaaggccctgctgatccaggccgtgaagaaggcccagaaggagagccccctgcccggccaggccaatggagtgctgatcctggagcggcccctgctgattgagacctacgtgggcctgatgtccttcatcaacaatgaggccaagctgggctacagcatgacccggggcaagattggcttctag

SEQ ID NO: 21712 - DNA, 390 bp, Artificial Sequence
  Description of Artificial Sequence: Synthetic coding sequence
atgtgtgaggtgtcccggggctggaagccctgcacagagggcatcctgaaggtgcggcccaccaggaagatctcctatgagggcaacatcacccccaccgtggagctgaatgccctgtgcatgaagctgggcaagaagcccatgtacaagcctgtggacccctacagcaggatgcagagcacctacaactacaacatgaggggcggggcctacccaccccgctacttctaccccttccctgtgccccccctgctgtaccaggtggagctgtctgtgggcggccagcagttcaacgggaagggcaagacccggcaggccgccaagcatgatgctgctgccaaggccctgcgcatcctgcagaatgagcccctgcctgagcggctggagtag

SEQ ID NO: 21713 - DNA, 3042 bp, Artificial Sequence
  Description of Artificial Sequence: Synthetic coding sequence
atggacctcttcaggatgcgctgctacctggccagcctgcagggcggggagctgcccaaccccaagagcctgctggccgccgccagccggcccagcaagctggccctgggccgcctgggcatcctgtctgtgagcagcttccacgccctggtgtgcagcagagatgattctgccctgaggaagaggaccctgagcctgacccagagaggaagaaacaagaagggcatcttcagcagcctgaagggcctggacaccctggccaggaagggcaaggagaagaggcccagcatcacccaggtggatgagctgctgcacatctacggcagcacagtggatggagtgccccgggacaatgcctgggagatccagacctacgtgcacttccaggacaaccacggcgtgacagtgggcatcaagccagagcaccgggtggaggacatcctgaccctggcctgcaagatgaggcagctggagcccagccactacggcctgcagctgaggaagctggtggatgacaacgtggagtactgcatcccagccccctatgagtacatgcagcagcaggtgtatgatgaaattgaggtgttccccctgaatgtgtatgatgtgcagctgaccaagacaggctctgtgtgtgactttggatttgctgtgacagcccaggtggatgagcggcagcacctgagccgcatcttcatcagtgatgtgctgcctgatggcctggcctatggagagggcctgaggaaaggaaatgagatcatgaccctgaatggagaggccgtgtctgacctggacctgaagcagatggaggccctcttcagcgagaagtctgtgggcctgaccctgattgcccggcccccagacaccaaggccaccctgtgcacctcctggagcgacagcgacctcttcagccgggaccagaagagcctgctgcccccacccaaccagagccagctgctggaggagttcctggacaacttcaagaagaacacagccaatgacttcagcaatgtgcctgacatcaccaccggcctgaagaggagccagacagatggcaccctggaccaggtgagccaccgggagaagatggagcagaccttccgctctgctgagcagatcacagccctgtgccgctccttcaatgacagccaggccaacggcatggagggcccccgggagaaccaggaccccccacccaggagcctggcccggcacctgagtgatgctgaccggctgaggaaggtgatccaggagctggtggacacagagaagagctatgtgaaggacctgagctgcctgtttgagctgtacctggagcccctgcagaatgagaccttcctgacccaggatgagatggagagcctgtttggcagcctgcctgagatgctggagttccagaaggtgttcctggagaccctggaggatggcatcagcgccagcagtgacttcaacaccctggagacccccagccagttcaggaagctgctcttcagcctgggcggcagcttcctgtactatgctgaccacttcaagctgtacagcggcttctgtgccaaccacatcaaggtgcagaaggtgctggagcgggccaagacagacaaggccttcaaggccttcctggatgccaggaaccccaccaagcagcacagcagcaccctggagagctacctgatcaagcctgtgcagagggtgctgaagtaccccctgctgctgaaggagctggtgtccctgacagaccaggagagcgaggagcactaccacctgacagaggccctgaaggccatggagaaggtggccagccacatcaatgagatgcagaagatctatgaggactatggcaccgtgtttgaccagctggtggccgagcagagcggcacagagaaggaggtgacagagctgtccatgggagagctgctgatgcacagcacagtgtcctggctgaaccccttcctgagcctgggcaaggccaggaaggacctggagctgactgtgtttgtgttcaagagagctgtgatcctggtgtacaaggagaactgcaagctgaagaagaagctgcccagcaacagcaggcctgcccacaacagcacagacctggaccccttcaagttccgctggctgatccccatcagcgccctgcaggtgcggctgggcaacccagctggaacagagaacaacagcatctgggagctgatccacaccaagtcagaaattgagggccggcctgagaccatcttccagctgtgctgcagcgacagcgagagcaagaccaacatcgtgaaggtgatccgcagcatcctgcgggagaacttcagaagacacatcaagtgtgagctgcccctggagaagacctgcaaggaccggctggtgcccctgaagaacagagtgcctgtgtctgccaagctggccagcagccgcagcctgaaggtgctgaagaacagcagcagcaatgagtggacaggagagaccgggaagggcaccctgctggacagtgatgagggcagcctgagcagcggcacccagagcagcggctgccccacagctgagggccggcaggacagcaagagcaccagccctgggaagtacccccaccctggcctggccgactttgctgacaacctgatcaaggagagtgacatcctgagtgatgaagatgatgaccaccggcagacagtgaagcagggcagccccaccaaggacatcgagatccagttccagaggctgcgcatcagtgaagatcctgatgtgcaccctgaggccgagcagcagcccggccctgagagcggggagggccagaagggcggggagcagcccaagctggtgcggggccacttctgccccatcaagaggaaggccaacagcaccaagagggaccggggcaccctgctgaaggcccagatccgccaccagagcctggacagccagagtgaaaatgccaccatcgacctgaacagcgtgctggagcgggagttctctgtgcagagcctgacctctgtggtgtctgaggagtgcttctatgaaacagagagccacggcaagagctag

SEQ ID NO: 21714 - DNA, 1149 bp, Artificial Sequence
  Description of Artificial Sequence: Synthetic coding sequence
atggccgccaacctgagcagaaatggacctgccctgcaggaggcctacgtgcgggtggtgacagagaagagccccacagactgggccctcttcacctatgagggcaacagcaatgacatccgggtggccggcactggagagggcggcctggaggagatggtggaggagctgaacagcggcaaggtgatgtatgccttctgccgggtgaaggaccccaacagcggcctgcccaagtttgtgctgatcaactggacaggagagggcgtgaatgatgtgaggaagggggcctgtgccagccacgtgtccaccatggccagcttcctgaagggctctgtgtaccagaagaccaatgctgtgtctgagatcaagagggtgggcaaggacagcttctgggccaaggccgagaaggaggaggagaacagaaggctggaggagaagagaagagctgaggaggcccagaggcagctggagcaggagcggcgggagcgggagctgcgggaggccgcccggcgggagcagcgctaccaggagcagggcggggaggccagcccccagagcaggacctgggagcagcagcaggaggtggtgtccaggaacagaaatgagcaggagagcgctgtgcacccccgggagatcttcaagcagaaggagcgggccatgagcaccaccagcatcagcagcccccagcccgggaagctgcggagccccttcctgcagaagcagctgacccagcctgagacccacttcggccgggagcctgctgctgccatcagccggcccagggctgacctgcctgctgaggagcccgcccccagcaccccaccctgcctggtgcaggccgaggaggaggccgtgtatgaggagcccccagagcaggagaccttctatgagcagccccccctggtgcagcagcagggcgccggcagcgagcacatcgaccaccacatccagggccagggcctgagcggccagggcctgtgtgcccgggccctgtatgactaccaggccgcagatgacacagagatcagctttgatcctgaaaatctcatcactggaattgaggtgattgatgagggctggtggaggggctacggcccagatggccacttcggcatgtttcctgccaactacgtggagctgattgaatag

SEQ ID NO: 21715 - DNA, 660 bp, Artificial Sequence
  Description of Artificial Sequence: Synthetic coding sequence
atggtggtgctgtctgtgcctgctgaggtgaccgtcatcctgctggacatcgagggcaccaccacccccatcgcctttgtgaaggacatcctcttcccctacattgaagaaaatgtgaaggagtacctgcagacccactgggaggaggaggagtgccagcaggatgtgtccctgctgaggaagcaggccgaggaggatgcccacctggatggagctgtgcccatcccagctgccagcggaaatggagtggatgacctgcagcagatgatccaggccgtggtggacaacgtgtgctggcagatgagcctggacaggaagaccacagccctgaagcagctgcagggccacatgtggagggctgccttcaccgctggccgcatgaaggccgagttctttgctgatgtggtgcctgctgtgaggaagtggagggaggccggcatgaaggtgtacatctacagcagcggctctgtggaggcccagaagctgctgtttggccacagcacagaaggagacatcctggagctggtggatggccactttgacaccaagattggccacaaggtggagagcgagagctacaaggactgccggcagcactgggtgctgaaccagcagcactttgtgtctgaccgctgctacagccggggccagtgctgctag

SEQ ID NO: 21716 - DNA, 1446 bp, Artificial Sequence; identical to SEQ ID NO: 21094
  Description of Artificial Sequence: Synthetic coding sequence

SEQ ID NO: 21717 - DNA, 1644 bp, Artificial Sequence; identical to SEQ ID NO: 19587
  Description of Artificial Sequence: Synthetic coding sequence

SEQ ID NO: 21718 - DNA, 1887 bp, Artificial Sequence; identical to SEQ ID NO: 21506
  Description of Artificial Sequence: Synthetic coding sequence

SEQ ID NO: 21719 - DNA, 474 bp, Artificial Sequence
  Description of Artificial Sequence: Synthetic coding sequence
atgaggagcggcttccgctgtgatgagcctgctgaggccgtggcccctgagcggcagacagtgtctggagctgtggccctggccagcttcaccagcccccacacccaccctgtggatgatggcggccgccactacagctggggcagccccaagaggatcctgggcctgggccctggagatgctgccaaggaggccggcctggtgcggcccctgcagggccagagcgagaagatcctgctgcggaccaggaaccggcagcccatggagccccccatggagcccagcggcggggagcaggagcctggagctgtgcgcttcctggacctgccctgggaggatgtgctgctgccccacgtgctgaacagagtgcccctgcggcagctgctgcggctgcagagggtgtcccgggccttccgcagcctggtgcagctgcacctggccggcctgcggagatttgatgctgcccaggtgtag

SEQ ID NO: 21720 - DNA, 483 bp, Artificial Sequence; identical to SEQ ID NO: 20009
  Description of Artificial Sequence: Synthetic coding sequence

SEQ ID NO: 21721 - DNA, 402 bp, Artificial Sequence
  Description of Artificial Sequence: Synthetic coding sequence
atggccgccctgcggcccctggtgaagcccaagatcgtgaagaagaggaccaagaagttcatccgccaccagagcgaccgctacgtgaagatcaagaggaactggaggaagccccggggcatcgacaacagagtgagaagacgcttcaagggccagatcctgatgcccaacatcggctacggcagcaacaagaagaccaagcacatgctgcccagcggcttcaggaagttcctggtgcacaacgtgaaggagctggaggtgctgctgatgtgcaacaagagctactgtgccgagatcgcccacaacgtgagcagcaagaacaggaaggccatcgtggagagagctgcccagctggccatccgggtgaccaaccccaatgcccggctgcggtctgaggagtag

SEQ ID NO: 21722 - DNA, 639 bp, Artificial Sequence
  Description of Artificial Sequence: Synthetic coding sequence
atggacctgtttggagacctgcctgagcctgagaggagccccaggcctgctgctgggaaggaggcccagaagggccccctgctgtttgatgacctgcccccagccagcagcacagacagcggcagcggcggccccctgctgtttgatgacctgcccccagccagcagcggggacagcggcagcctggccaccagcatcagccagatggtgaagacagagggcaaaggagccaagaggaagaccagcgaggaggagaagaatggaagtgaggagctggtggagaagaaggtgagcagcagcgtcatcttcggcctgaagggctacgtggccgagaggaaaggagagcgggaggagatgcaggatgcccacgtgatcctgaatgacatcacagaggagtgcaggcctcccagcagcctcatcaccagggtgtcctactttgctgtgtttgatggccacggcggcatccgggccagcaagtttgctgcccagaacctgcaccagaacctgatcaggaagttccccaagggagatgtgatctctgtggagaagacagtgaagcgctgcctgctggacaccttcaagcacacagatgaggagttcctgaagcaggccagcagccagaagccagcctggaagtag

SEQ ID NO: 21723 - DNA, 1131 bp, Artificial Sequence; identical to SEQ ID NO: 19363
  Description of Artificial Sequence: Synthetic coding sequence

SEQ ID NO: 21724 - DNA, 1485 bp, Artificial Sequence
  Description of Artificial Sequence: Synthetic coding sequence
atggctgctgctgctgaatgtgatgtggtgatggccgccacagagcctgagctgctggatgaccaggaggccaagcgggaggccgagaccttcaaggagcagggcaatgcctactatgccaagaaggactacaatgaggcctacaactactacaccaaggccatcgacatgtgccccaagaatgccagctactacggcaacagagctgccaccctgatgatgctgggccgcttccgggaggccctgggagatgcccagcagagcgtgcggctggatgacagctttgtgcggggccacctgcgggagggcaagtgccacctgagcctgggcaatgccatggccgcctgccgctccttccagagggccctggagctggaccacaagaatgcccaggcccagcaggagttcaagaatgccaatgctgtgatggagtatgagaagattgctgagacagactttgagaagagggacttcaggaaggtggtgttctgcatggaccgggccctggagtttgccccagcctgccaccgcttcaagatcctgaaggccgagtgcctggccatgctgggccgctacccagaggcccagagcgtggccagtgacatcctgaggatggacagcaccaatgctgatgccctgtatgtgcggggcctgtgcctgtactatgaggactgcatcgagaaggctgtgcagttctttgtgcaggccctgaggatggccccagaccacgagaaggcctgcatcgcctgcagaaatgccaaggccctgaaggccaagaaggaggatggcaacaaggccttcaaggagggcaactacaagctggcctatgagctgtacacagaggccctgggcatcgaccccaacaacatcaagaccaatgccaagctgtactgcaacagaggcaccgtgaacagcaagctgaggaagctggatgatgccatcgaggactgcaccaatgctgtgaagctggatgacacctacatcaaggcctacctgcggcgggcccagtgctacatggacacagagcagtatgaggaggccgtgcgggactatgagaaggtgtaccagacagagaagaccaaggagcacaagcagctgctgaagaatgcccagctggagctgaagaagagcaagaggaaggactactacaagatcctgggcgtggacaagaatgcctctgaagatgagatcaagaaggcctacaggaagagggccctgatgcaccacccagacagacacagcggggccagcgctgaggtgcagaaggaggaggagaagaagttcaaggaggtgggggaggccttcaccatcctgagtgaccccaagaagaagaccaggtatgattctggccaggacctggatgaggagggcatgaacatgggagactttgaccccaacaacatcttcaaggccttctttggaggccctgggggcttctcctttgaggccagcggccctggcaacttcttcttccagtttggatag

SEQ ID NO: 21725 - DNA, 1329 bp, Artificial Sequence
  Description of Artificial Sequence: Synthetic coding sequence
aatgaggtgtacaacctgacccaggagttcttcagacatgacaagcctgtgaatgctgagagccagaacagcgtgggcgtcttcacccgggaggaggtgaggaaccgcatcagaaatgaccctgatgatcctgaggccaccaagaggctgaagctggccatgatccagcagtacctgaaggtggagagctgtgagagcagcagccacagcatggatgaggtgtccctgagcgcctttggagagtggacagagatccctggggcccaccacatcatccccagcggcttcatgagggtggtggagctgctggccgagggcatcccagcccacgtgatccagctgggcaagcctgtgcgctgcatccactgggaccaggccagcgcccggccccggggccctgagattgagcccagaggagagggggaccacaaccacgacacaggagagggcggccagggcggggaggagccccggggcggccgctgggatgaagatgagcagtggagcgtggtggtggagtgtgaggactgtgagctgatcccagctgaccacgtgattgtgacagtgtccctgggcgtgctgaagaggcagtacaccagcttcttccggcccggcctgcccacagagaaggtggccgccatccaccggctgggcatcggcaccacagacaagatcttcctggagtttgaggagcccttctggggccctgagtgcaacagcctgcagtttgtgtgggaggatgaagctgagagccacaccctgacctacccacctgagctgtggtacaggaagatctgtggctttgatgtgctgtacccacctgagagatatggccacgtgctgagcggctggatctgtggggaggaggccctggtgatggagaagtgtgatgatgaggccgtggccgagatctgcacagagatgctgcggcagttcaccggcaaccccaacatccccaagccccggcgcatcctgcggagcgcctggggcagcaacccctacttccggggcagctacagctacacccaggtgggcagcagtggagcagatgtggagaagctggccaagcccctgccctacacagagagcagcaagacagcccacggcagcagcaccaagcagcagcccggccacctgttcagcagcaaatgtcctgagcagcccctggatgccaacagaggagctgtgaagcccatgcaggtgctcttcagcggggaggccacccacaggaagtactacagcaccacccatggagccctgctgagcggccagcgggaggccgcccggctgattgagatgtacagagacctcttccagcagggcacctag

SEQ ID NO: 21726 - DNA, 180 bp, Artificial Sequence
  Description of Artificial Sequence: Synthetic coding sequence
atgagctactaccagaggcccttcagccccagcgcctacagcctgcctgccagcctgaacagcagcatcgtgatgcagcacggcaccagcctggacagcacagacacctacccccagcacgcccagagcctggatggcaccaccagcagcagcatccccctgtaccgcagcagcgagtag

SEQ ID NO: 21727 - DNA, 837 bp, Artificial Sequence
  Description of Artificial Sequence: Synthetic coding sequence
atgaagtgtgagcactgcaccaggaaggagtgcagcaagaagaccaagacagatgaccaggagaatgtgtctgcagatgcccccagccctgcccaggagaatggagagaagggggagttccacaagctggctgatgccaagatcttcctgagtgactgcctggcctgtgacagctgcatgacagctgaggagggcgtgcagctgagccagcagaatgccaaggacttcttccgggtgctgaacctgaacaagaagtgtgacaccagcaagcacaaggtgctggtggtgtctgtgtgcccccagagcctgccctactttgctgccaagttcaacctgtctgtgacagatgccagccggcggctgtgtggcttcctgaagagcctgggctgggtgcgctatgcagagcgggtgctgggccggcccatcacagcccacctgtgcacagccaagagcccccagcaggtgatgggcagcctggtgaaggactactttgcccggcagcagaacctgagccctgagaagatcttccacgtgattgtggccccctgctatgacaagaagctggaggccctgcaggagagcctgcccccagccctgcacggcagcagaggagctgactgtgtgctgaccagcggcaccggcagcctgtgggagtgcacccctgtgatcacagccacccaggaggccgccgcccgggagagcctggagcccggccggcagaggctgcagagggacaagatcgcccccctggacagcagcctgggcggcggcggggagatcgcccagatcatggagcagggcgacctgtctgtgagagatgctgctgtggacacctag

SEQ ID NO: 21728 - DNA, 471 bp, Artificial Sequence
  Description of Artificial Sequence: Synthetic coding sequence
tgaggaaaggcccagaggaagatcagcgccatccacatcctggatgtgctggtgctgaatggaacagatgtgcgggagcagcacttcaaccagaggatccagctggccgagaagtttgtgaaggctgtgtccaagcccagcaggccagacatgaaccccatccgggtgaaggaggtgtaccgcctggaggagatggagaagatctttgtgcggctggagatgaagatcatcaagggcagcagcggcacccccaagctgagctacacaggaagagatgacagacactttgtgcccatgggcctgtacatcgtgaggacagtgaatgagccctggaccatgggcttcagcaagagcttcaagaagaagttcttctacaacaagaagaccaaggacagcacctttgacctgcctgctgacagcatcgcccccttccacctgcccagcctggcctgcctgagcaagatggactag

SEQ ID NO: 21729 - DNA, 1200 bp, Artificial Sequence; identical to SEQ ID NO: 21077
  Description of Artificial Sequence: Synthetic coding sequence

SEQ ID NO: 21730 - DNA, 819 bp, Artificial Sequence
  Description of Artificial Sequence: Synthetic coding sequence
atggccagcctgctgcaggaccagctgaccacagaccaggacctgctgctgatgcaggagggcatgcccatgaggaaggtgcgcagcaagtcctggaagaagctgcgctacttccggctgcagaatgatggcatgacagtgtggcacgcccggcaggcccggggcagcgccaagcccagcttcagcatcagtgatgtggagaccatcagaaatggacatgattctgagctgctgcggagcctggccgaggagctgcccctggagcagggcttcaccatcgtgttccacggccgccgcagcaacctggacctgatggccaacagcgtggaggaggcccagatctggatgaggggcctgcagctgctggtggacctggtgacctccatggaccaccaggagcggctggaccgctggctgagtgactggttccagagaggagacaagaaccaggacggcaagatgtccttccaggaggtgcagaggctgctgcacctgatgaatgtggagatggaccaggagtatgccttcagcctcttccaggccgctgacaccagccagagcggcaccctggagggggaggagtttgtgcagttctacaaggccctgaccaagagagctgaggtgcaggagctgtttgagagcttcagcgcagatggccagaagctgaccctgctggagttcctggacttcctgcaggaggagcagaaggagcgggactgcaccagcgagctggccctggagctgattgacagatatgagcccagcgacagcggggccagcgaggaggaccccggggagggggaggaggtgaacacctag

SEQ ID NO: 21731 - DNA, 360 bp, Artificial Sequence; identical to SEQ ID NO: 20655
  Description of Artificial Sequence: Synthetic coding sequence

SEQ ID NO: 21732 - DNA, 1881 bp, Artificial Sequence; identical to SEQ ID NO: 19875
  Description of Artificial Sequence: Synthetic coding sequence

SEQ ID NO: 21733 - DNA, 189 bp, Artificial Sequence
  Description of Artificial Sequence: Synthetic coding sequence
atggccatggcccccagccccagcctggtgcaggtgtacaccagccctgctgctgtggccgtgtgggagtggcaggacggcctgggcacctggcacccctacagcgccaccgtgtgcagcttcatcgagcagcagtttgtgcagcagaagggccagcgcttcggcctgggcagcctggcccacagctag

SEQ ID NO: 21734 - DNA, 228 bp, Artificial Sequence
  Description of Artificial Sequence: Synthetic coding sequence
atgaggctgagcctgcccctgctgctgctgctgctgggcgcctgggccatccctgggggcctgggggaccgggcccccctgacagccacagccccccagctggatgatgaggagatgtacagcgcccacatgcctgcccacctgcgctgtgatgcctgcagagctgtggcctaccagaggctgtgcagctacccaccccacctgcccctgacagagcagcagagctag

SEQ ID NO: 21735 - DNA, 2619 bp, Artificial Sequence
  Description of Artificial Sequence: Synthetic coding sequence
atgggagacagtgatgatgaatatgacagaagaagaagagacaagttcagaagagagaggagtgactatgacaggagccgggagagagatgagaggagaagaggagatgactggaatgaccgggagtgggaccggggccgggagaggaggagcagaggagagtacagagattatgacaggaacagaagagagcgcttcagcccccccaggcatgagctgagccccccccagaagaggatgagaagagactgggatgagcacagcagtgacccctaccacagcggctatgagatgccctatgccggcggcggcggcggccccacctacggccccccccagccctggggccacccagatgtgcacatcatgcagcaccacgtgctgcccatccaggcccggctgggcagcattgctgagattgacctgggcgtgcccccacctgtgatgaagaccttcaaggagttcctgctgagcctggatgacagcgtggatgaaacagaggccgtgaagcgctacaatgactacaagctggacttccggcggcagcagatgcaggacttcttcctggcccacaaggatgaggagtggttccgcagcaagtaccacccagatgaggtgggcaagaggcggcaggaggcccggggggccctgcagaaccggctgcgggtcttcctgagcctgatggagaccggctggtttgacaacctgctgctggacatcgacaaggcagatgccatcgtgaagatgctggatgctgctgtgatcaagatggagggcggcacagaaaatgacctgcgcatcctggagcaggaggaggaggaggagcaggccggcaagccaggagagcccagcaagaaggaggagggccgggccggggccggcctgggagatggagagaggaagaccaatgacaaggatgagaagaaggaggatggcaagcaggccgagaatgacagcagcaatgatgacaagaccaagaagtcagaaggagatggagacaaggaggagaagaaggaggacagcgagaaggaggccaagaagagcagcaagaagaggaacaggaagcacagcggagatgacagctttgatgagggctctgtgtctgagagcgagagcgagagcgagagcggccaggccgaggaggagaaggaggaggccgaggaggccctgaaggagaaggagaagcccaaggaggaggagtgggagaagcccaaggatgctgctggcctggagtgcaagccccggcccctgcacaagacctgcagcctcttcatgaggaacatcgcccccaacatcagcagagctgagatcatcagcctgtgcaagcgctacccaggcttcatgagggtggccctgtctgagccccagcctgagcggcgcttcttcagaagaggctgggtgacctttgacagatctgtgaacatcaaggagatctgctggaacctgcagaacatccggctgagagaatgtgagctgagccctggggtgaacagagacctgacccggcgggtgaggaacatcaatggcatcacccagcacaagcagatcgtgagaaatgacatcaagctggccgccaagctgatccacaccctggatgacaggacccagctgtgggccagcgagcccggcaccccacccctgcccaccagcctgcccagccagaaccccatcctgaagaacatcacagactacctgattgaggaggtgtctgctgaggaggaggagctgctgggcagcagcggcggggcccctcctgaggagccccccaaggagggcaacccagctgagatcaacgtggagagagatgagaagctgatcaaggtgctggacaagctgctgctgtacctgcgcatcgtgcacagcctggactactacaacacctgtgagtacccaaatgaagatgagatgcccaacagatgtggcatcatccacgtgcggggccccatgccacccaaccgcatcagccacggggaggtgctggagtggcagaagacctttgaggagaagctgacccccctgctgtctgtgcgggagagcctgtctgaggaggaggcccagaagatgggcaggaaggaccctgagcaggaggtggagaagtttgtgaccagcaacacccaggagctgggcaaggacaagtggctgtgccccctgagcggcaagaagttcaagggccctgagtttgtgaggaagcacatcttcaacaagcatgctgagaagattgaggaggtgaagaaggaggtggccttcttcaacaacttcctgacagatgccaagaggcctgccctgcctgagatcaagccagcccagcccccaggccctgcccagagcctgaccccaggcctgccctacccccaccagaccccccagggcctgatgccctacggccagcccaggcctcccatcctgggctacggggccggggctgtgcggcctgctgtgcccactggaggccccccctacccccacgccccctatggagctggccggggcaactatgatgccttccggggccagggcggctacccaggcaagcccaggaacaggatggtgcggggggacccccgggccatcgtggagtacagagacctggatgccccagatgatgtggacttcttctag

SEQ ID NO: 21736 - DNA, 483 bp, Artificial Sequence
  Description of Artificial Sequence: Synthetic coding sequence
tgaccagaagatgtgcaggccctggtgtctgggaagctggccctgcgctatgccggccggcagacagaggccctgaagtgtgtggcccaggccagcaagaacagaagcctggccgactttgagaaggccctgacagactacagagctgagctgagagatgaccccatcatcagcacccacctggccaagctgtatgacaacctgctggagcagaacctgatccgggtgattgagcccttcagccgggtgcagatcgagcacatcagcagcctcatcaagctgagcaaggcagatgtggagaggaagctgagccagatgatcctggacaagaagttccacggcatcctggaccagggcgagggcgtgctgatcatctttgatgagccccctgtggacaagacctatgaagctgccctggagaccatccagaacatgagcaaggtggtggacagcctgtacaacaaggccaagaagctgacctag

SEQ ID NO: 21737 - DNA, 3906 bp, Artificial Sequence
  Description of Artificial Sequence: Synthetic coding sequence
atgtggaggaggaagcaccccaggaccagcggcggcacccggggcgtgctgagcggcaacagaggagtggagtatggcagcggccggggccacctgggcacctttgagggccgctggaggaagctgcccaagatgcctgaggccgtgggcacagaccccagcaccagcaggaagatggccgagctggaggaggtgaccctggatggcaagcccctgcaggccctgcgggtgacagacctgaaggccgccctggagcagaggggcctggccaagagcggccagaagagcgccctggtgaagaggctgaagggggccctgatgctggagaacctgcagaagcacagcacccctcatgctgccttccagcccaacagccagattggagaggagatgagccagaacagcttcatcaagcagtacctggagaagcagcaggagctgctgcggcagaggctggagcgggaggcccgggaggccgctgagctggagggcaagagcagcagcatcagcgaggagaagggggacagtgatgatgagaagcccaggaaaggagagcggcgcagcagccgggtgcggcaggcccgggccgccaagctgtctgagggcagccagcctgctgaggaggaggaggaccaggagacccccagcaggaacctgcgggtgcgggctgacaggaacctgaagacagaggaggaggaggaggaggaggaggaggaggaggaggatgatgaggaggaggagggagatgatgagggccagaagagccgggaggcccccatcctgaaggagttcaaggaggagggggaggagatcccccgggtgaagccagaggagatgatggatgagcggcccaagaccaggagccaggagcaggaggtgctggagcggggcggccgcttcaccaggagccaggaggaggccaggaagagccacctggcccggcagcagcaggagaaggagatgaagaccaccagccccctggaggaggaggagcgggagatcaagagcagccagggcctgaaggagaagagcaagagccccagccccccccggctgacagaggacaggaagaaggccagcctggtggccctgcctgagcagacagccagcgaggaggagaccccaccacccctgctgaccaaggaggccagcagccccccaccccacccccagctgcacagcgaggaggagattgagcccatggagggccctgccccagctgtgctgatccagctgagcccccccaacacagatgctgacacccgggagctgctggtgtcccagcacacagtgcagctggtgggcggcctgagccccctgagcagccccagcgacaccaaggccgagagccctgctgagaaggtgcctgaggagagcgtgctgcccctggtgcagaagagcaccctggccgactacagcgcccagaaggacctggagcctgagagtgacagaagtgcccagcccctgcccctgaagattgaggagctggccctggccaagggcatcacagaagaatgtctgaagcagcccagcctggagcagaaggagggccggcgggccagccacaccctgctgcccagccaccggctgaagcagagcgctgacagcagcagcagccgcagcagcagcagcagcagcagcagcagccgcagccgcagccgcagcccagacagcagcggcagccgcagccacagccccctgcggagcaagcagagagatgtggcccaggcccggacccacgccaacccccggggccggcccaagatgggcagccgcagcaccagcgagagccgcagccgcagccgcagccgcagccgcagcgccagcagcaacagcaggaagagcctgagccctggggtgtcccgggacagcagcaccagctacacagagaccaaggaccccagcagcggccaggaggtggccaccccacctgtgccccagctgcaggtgtgtgagcccaaggagaggaccagcaccagcagcagctctgtgcaggcccggcggctgagccagcctgagagcgctgagaagcacgtgacccagaggctgcagcctgagcggggcagccccaagaagtgtgaggccgaggaggccgagcccccagctgccacccagccccagaccagcgagacccagaccagccacctgcctgagagcgagcgcatccaccacacagtggaggagaaggaggaggtgaccatggacaccagcgagaacagaccagaaaatgatgtgcctgagccccccatgcccatcgctgaccaggtgtccaatgatgacaggcctgagggctctgtggaggatgaggagaagaaggagagcagcctgcccaagagcttcaagaggaagatctctgtggtgtctgccaccaagggcgtgcctgctggcaacagcgacacagagggcggccagcccggcaggaagaggcgctggggcgccagcacagccaccacccagaagaagcccagcatcagcatcaccacagagagcctgaagagcctcatcccagacatcaagcccctggccggccaggaggccgtggtggacctgcacgcagatgacagccgcatcagtgaagatgaaacagaaagaaatggagatgatggcacccatgacaagggcctgaagatctgcaggacagtgacccaggtggtgcctgctgagggccaggagaatggccagcgggaggaggaggaggaggagaaggagcctgaggccgagccccctgtgcccccccaggtgtctgtggaggtggccctgcccccacctgctgagcacgaggtgaagaaggtgaccctgggggacaccctgaccaggaggagcatcagccagcagaagtctggagtgtccatcaccattgatgatcctgtgaggacagcccaggtgcccagccccccccggggcaagatcagcaacatcgtgcacatcagcaacctggtgcggcccttcaccctgggccagctgaaggagctgctgggccgcacaggcaccctggtggaggaggccttctggattgacaagatcaagagccactgctttgtgacctacagcacagtggaggaggccgtggccaccaggacagccctgcacggcgtgaagtggccccagagcaaccccaagttcctgtgtgccgactatgcagagcaggatgagctggactaccaccggggcctgctggtggaccggcccagcgagaccaagacagaggagcagggcatcccccggcccctgcaccccccacctcctcctcctgtgcagcccccccagcaccccagggctgagcagcgggagcaggagagagctgtgcgggagcagtgggccgagcgggagcgggagatggagcggcgggagaggaccaggtctgagcgggagtgggaccgggacaaggtgcgggagggccccaggagccgcagccgcagccgggacagaagaaggaaggagcgggccaagagcaaggagaagaagtctgagaagaaggagaaggcccaggaggagcccccagccaagctgctggatgacctcttcaggaagaccaaggccgccccctgcatctactggctgcccctgacagacagccagatcgtgcagaaggaggccgagcgggcagagcgggccaaggagcgggagaagaggaggaaggagcaggaggaggaggagcagaaggagcgggagaaggaggccgagcgggagaggaaccggcagctggagcgggagaagaggcgggagcacagccgggagcgggaccgggagcgggagcgggagcgggagcgggacagaggagaccgggaccgggaccgggagcgggaccgggagcggggccgggagcgggaccggcgggacaccaagaggcacagccgcagccgcagccgcagcacccctgtgcgggaccggggcggcagaagatag

SEQ ID NO: 21738 - DNA, 231 bp, Artificial Sequence
  Description of Artificial Sequence: Synthetic coding sequence
atgctgctggagaacctgacagacaatgaaagtgagaacaccaacctgaagaagaaggtgtttgagaaggaggcccacatccaggagctgagctgcctcttccagagcgagaagagcctggagaccaagatcgccaagtggaacctgcagagcaggatgaacaagaatgaggccatcgtgatgaaggaggccagccggcagaagacagtggccctgaagaaggccagctag

SEQ ID NO: 21739 - DNA, 1749 bp, Artificial Sequence
  Description of Artificial Sequence: Synthetic coding sequence
atggaggtgcgggccagcctgcagaaggtgtctggcagcagtgacagcgtggccaccatgaacagcgaggagtttgtgctggtgccccagtatgcagatgacaacagcaccaagcatgaggagaagccccagctgaagatcgtgtccaatggagatgagcagctggagaaggccatggaggagatcctgcgggacagcgagaagaggcccagcagcctgctggtggactgccagagcagcagcgagatcagtgaccacagctttggagacatcccagccagccagaccaacaagcccagcctgcagctgatcctggaccccagcaacacagagatcagcaccccccggcccagcagccctgggggcctgcctgaggaggacagcgtgctcttcaacaagctgacctacctgggctgcatgaaggtgagcagccccagaaatgaggtggaggccctgcgggccatggccaccatgaagagcagcagccagtaccccttccctgtgaccctgtatgtgcccaacgtgcctgagggctctgtgcgcatcatcgaccagagcagcaatgtggagatcgccagcttccccatctacaaggtgctcttctgtgcccggggccatgatggcaccacagagagcaactgctttgccttcacagagagcagccacggcagcgaggagttccagatccacgtgttcagctgtgagatcaaggaggccgtgagccgcatcctgtacagcttctgcacagccttcaagaggagcagccggcaggtgtctgatgtgaaggacagcgtcatccccaccccagacagtgatgtgttcaccttctctgtgtccctggaggtgaaggaggatgatggcaagggcaacttccggctgctggtgatccccatcccctttgagtacttcagccctgtgcccaaggaccgggacaagttctacttcaagctgaagcagggcatcgagaagaaggtggtgatcaccgtgcagcagctgagcaacaaggagctggccatcgagcgctgcttcggcatgctgctgagccctggaagaaatgtgaagaacagcgacatgcacctgctggacatggagagcatgggcaagagctatgatggccgggcctacgtgatcaccggcatgtggaaccccaatgcccctgtgttcctggccctgaatgaggagacccccaaggacaagcaggtgtacatgacagtggccgtggacatggtggtgacagaggtggtggagcctgtgcgcttcctgctggagaccgtggtgcgggtgtacccagccaatgaacgcttctggtacttcagcaggaagaccttcacagagaccttcttcatgaggctgaagcagagcgagggcaagggccacaccaatgctggagatgccatctatgaggtggtgtccctgcagcgggagagtgacaaggaggagcctgtgacccccaccagcggcggcggccccatgagcccccaggatgatgaggccgaggaggagagtgacaatgagctgagcagcggcactggagatgtgtccaaggactgcccagagaagatcctgtacagctggggcgagctgctgggcaagtggcacagcaacctgggcgcccggcccaagggcctgagcaccctggtgaagtctggagtgcctgaggccctgcgggcagaggtgtggcagctgctggccggctgccacgacaaccaggccatgctggaccgctaccgcatcctgatcaccaagtag

SEQ ID NO: 21740 - DNA, 138 bp, Artificial Sequence
  Description of Artificial Sequence: Synthetic coding sequence
atggatgctgacagtgatgtggccctggacatcctgatcaccaacgtggtgtgtgtgttccgcacccgctgccacctgaacctgaggaagatcgccctggagggcgccaacgtcatctacaagagagatgtgggctag

SEQ ID NO: 21741 - DNA, 762 bp, Artificial Sequence
  Description of Artificial Sequence: Synthetic coding sequence
atggaggatgccccccagaggctgcgctggcaggcccacctggagttcacccacaaccatgatgtgggggacctgacctgggacaagattgctgtgtccctgcccaggtctgagaagctgcggagcctggtgctggccggcatcccccacggcatgaggccccagctgtggatgaggctgagcggggccctgcagaagaagaggaacagcgagctgagctaccgggagatcgtgaagaacagcagcaatgatgagaccatcgccgccaagcagatcgagaaggacctgctgcggaccatgcccagcaatgcctgctttgcctccatgggcagcattggagtgccccggctgcggcgggtgctgcgggccctggcctggctgtacccagaaattggctactgccagggcaccggcatggtggccgcctgcctgctgctcttcctggaggaggaggatgccttctggatgatgtctgccatcatcgaggacctgctgcctgccagctacttcagcaccaccctgctgggcgtgcagacagaccagagggtgctgcggcacctgattgtgcagtacctgccccggctggacaagctgctgcaggagcatgacatcgagctgagcctcatcaccctgcactggttcctgacagcctttgcctctgtggtggacatcaagctgctgctgcgcatctgggacctcttcttctatgagggcagccgggtgctcttccagctgaccctgggcatgctgcacctgaagtag

SEQ ID NO: 21742 - DNA, 336 bp, Artificial Sequence
  Description of Artificial Sequence: Synthetic coding sequence
tgacccctggtgaaggtgcagatctttggagtgcggctggacacagcccggcaggagaccaactacgtggagaacaacggcttcaacccctactggggccagaccctgtgcttccgggtgctggtgcctgagctggccatgctgcgctttgtggtgatggactatgactggaagagcagaaatgacttcatcggccagtacaccctgccctggacctgcatgcagcagggctaccgccacatccacctgctgagcaaggatggcatcagcctgcggcctgccagcatctttgtgtacatctgcatccaggagggcctggagggagatgagagctag

SEQ ID NO: 21743 - DNA, 552 bp, Artificial Sequence; identical to SEQ ID NO: 19200
  Description of Artificial Sequence: Synthetic coding sequence

SEQ ID NO: 21744 - DNA, 1215 bp, Artificial Sequence
  Description of Artificial Sequence: Synthetic coding sequence
atgatgctgagcacagagggccgggagggctttgtggtgaaggtgcggggcctgccctggagctgcagcgcagatgaggtgatgaggttcttcagtgactgcaagatccagaatggcaccagcggcatccgcttcatctacacccgggagggccggcccagcggggaggcctttgtggagctggagagcgaggaggaggtgaagctggccctgaagaaggaccgggagaccatgggccaccgctacgtggaggtgttcaagagcaacagcgtggagatggactggatgaccctgcctgtggacttccagggccgcagcactggagaggcctttgtgcagtttgccagccaggagattgctgagaaggccctgaagaagcacaaggagagaattggccaccgctacatcgagatcttcaagagcagcagagctgaggtgaggacccactatgacccccccaggaagctgatggccatgcagaggcctggcccctatgacaggcctggggccggccggggctacaacagcatcggcagaggagctggctttgagaggatgagaagaggagcctatggaggcggctatggaggctatgatgattatggaggctacaatgatggctacggcttcggcagtgacagatttggccgggacctgaactactgcttcagcggcatgtctgaccacagatatggagatggcggcagcagcttccagagcaccaccggccactgtgtgcacatgaggggcctgccctaccgggccacagaaaatgacatctacaacttcttcagccccctgaaccccatgagggtgcacatcgagatcggcccagatggccgggtgactggagaggctgatgtggagtttgccacccatgaagatgctgtggccgccatggccaaggacaaggccaacatgcagcacagatatgtggagctgttcctgaacagcacagctggcaccagcggcggggcctatgaccacagctatgtggagctgttcctgaacagcacagctggggccagcggcggggcctacggcagccagatgatgggcggcatgggcctgagcaaccagagcagctatggaggccctgccagccagcagctgagcggcggctatggaggcggctatggaggccagagctccatgagcggctatgaccaggtgctgcaggagaacagcagtgactaccagagcaacctggcctag

SEQ ID NO: 21745 - DNA, 1545 bp, Artificial Sequence; identical to SEQ ID NO: 21159
  Description of Artificial Sequence: Synthetic coding sequence

SEQ ID NO: 21746 - DNA, 2928 bp, Artificial Sequence
  Description of Artificial Sequence: Synthetic coding sequence
atgaagtttgtgtctgaggacctgcaccgctgtgccctgctgacagctgacagctttggagaccccttcttccccaggaccacccagatcctgctggagtaccagctgggccgctgggtgccccggctgcgggagccccgggacctgtatggagtgagcagcagcggccccctgagccccacccgctggccctaccactgtgaggtgattgatgagaaggtgcagcacatcgactggacccccagctgcccagagcctgtgtacatccccaccggcctggagacagagcccctgtacccagacagcaaggaggccaccgtggtgtacctggccgaggatgcctacaaggagccctgctttgtgtacagccgggtgggcggcaacagaacacccctgaagcagcctgtggactacagagacaacaccctgatgtttgaggccaggtttgaaagtggcaacctgcagaaggtggtgaaggtggccgagtatgagtaccagctgactgtgcggccagacctcttcaccaacaagcacacccagtggtactacttccaggtgaccaacatgagagctggcatcgtgtaccgcttcaccatcgtgaacttcaccaagccagccagcctgtacagccggggcatgaggcccctcttctacagcgagaaggaggccaaggcccaccacatcggctggcagagaattggagaccagatcaagtactacagaaacaaccctggccaggacggccgccactacttcagcctgacctggaccttccagttcccccacaacaaggacacctgctactttgcccactgctacccctacacctacaccaacctgcaggagtacctgagcggcatcaacaatgaccctgtgcgcagcaagttctgcaagatccgggtgctgtgccacaccctggccaggaacatggtgtacatcctgaccatcaccacccccctgaagaacagcgacagcaggaagaggaaggccgtcatcctgacagcccgggtgcaccctggagagaccaacagctcctggatcatgaagggcttcctggactacatcctgggcaacagcagtgatgcccagctgctgcgggacacctttgtgttcaaggtggtgcccatgctgaacccagatggagtgattgtgggcaactaccgctgcagcctggccggccgggacctgaacagaaactacaccagcctgctgaaggagagcttccccagcgtgtggtacaccaggaacatggtgcaccggctgatggagaagcgggaggtgatcctgtactgtgacctgcacggccacagcaggaaggagaacatcttcatgtatggctgtgatggcagtgacaggagcaagaccctgtacctgcagcagaggatcttccccctgatgctgagcaagaactgcccagacaagttctccttcagcgcctgcaagttcaacgtgcagaagagcaaggagggcaccggccgggtggtgatgtggaagatgggcatccggaacagcttcaccatggaggccaccttctgtggcagcaccctgggcaacaagaggggcacccacttcagcaccaaggacctggagagcatgggctaccacttctgtgacagcctgctggactactgtgaccctgacaggaccaagtactaccgctgcctgaaggagctggaggagatggagcggcacatcaccctggagaaggtgtttgaggacagcgacacccctgtgattgacatcaccctggatgtggagagcagcagccggggcagtgacagcagcgagagcattgacagcctgacctacctgctgaagctgaccagccagaagaagcacctgaagaccaagaaggagaggaacagcaccatcgccagccaccagaatgcccggggccaggaggtgtatgaccggggccacctgctgcagaggcacacccagagcaacagtgatgtgaaggacacccggcccaatgaaccagatgactacatggtggactacttccggcggcagctgcccaaccagggcctggcccactgcaagctgcggctgcccggcagccgccacagccctgccagcgccagccgggtggccggcaccaccggcaccaggcaccacacctggctgatctttgtgttcctggtggagatgggcaagaagatccccctgaagggcacagacctgtatggcaactgcttcaaggtgaccagcctgcagagccccatgggcaagcagaccagcacctggacagagaagacccgcatccccacagaggacctgcaccacaacctgaagagcaagatcaaggagtgcatctccttccagagcaagaagacaggcatcaactggacagatgatgagaagaggagctacaaggacaagggcatcgtgcagacccaggagatcctgcagtacctgctgcccatcgtgcacagcaccaagaacatgcagaccacccagatcaagcagctgttcaaccccaggaccaacttccagatccagcaccagctgaacccagccacctgcaggaacatcaagaagtacagcacctcctggacagcccccaggaaccaccccttcgtcatccagggagatgtgatggccaacagcagcgagtgggtgcagagcaagccccacaggagcctggagagcctgagccccctgaagggccccaagaagaacaagcacagccagatctgggccatcaagaatgaagacatcaagcccctgagcagcaagtgggagacagccagcagcagctttggcatggatgccaacgtgctgaagtacaagagcctgcaggccgaggagaccaaccagcagagcagcaagcacacagccctgcacctgaccaagaacaaggatgagcaggccaacaagaatgatggccagcccaccctgtacctgaagttccagcgggagagctag

SEQ ID NO: 21747 - DNA, 1626 bp, Artificial Sequence
  Description of Artificial Sequence: Synthetic coding sequence
atgagcagcagcggctacccacccaaccagggcgccttcagcacagagcagagccgctacccaccccacagcgtgcagtacaccttccccaacaccaggcaccagcaggagtttgctgtgcctgactaccgcagcagccacctggaggtgtcccaggccagccagctgctgcagcagcagcagcagcagcagctgcggcggcggcccagcctgctgtctgagttccaccctggcagtgaccggccccaggagaggaggaccagctatgagcccttccaccctggccccagccctgtggaccatgacagcctggagagcaagaggccccggctggagcaggtgtctgacagccacttccagagggtgtctgctgctgtgctgcccctggtgcaccccctgcctgagggcctgcgggccagcgcagatgccaagaaggaccctgcctttggaggcaagcatgaggcccccagcagccccatcagcggccagccctgtggagatgaccagaatgccagccccagcaagctgagcaaggaggagctgatccagagcatggacagagtggaccgggagatcgccaaggtggagcagcagatcctgaagctgaagaagaagcagcagcagctggaggaggaggccgccaagcccccagagcctgagaagcctgtgtccccacctcctgtggagcagaagcacaggagcatcgtgcagatcatctatgatgagaacaggaagaaggccgaggaggcccacaagatctttgagggcctgggccccaaggtggagctgcccctgtacaaccagcccagcgacaccaaggtgtaccacgagaacatcaagacaggagtgcctgcccggaggatgatgaagaaccaggtgatgaggaagaagctgatcctcttcttcaagagaagaaatcatgccaggaagcagcgggagcagaagatctgccagagatatgaccagctgatggaggcctgggagaagaaggtggacagaattgagaacaaccccaggaggaaggccaaggagagcaagacccgggagtactatgagaagcagtttcctgagatcaggaagcagcgggagcagcaggagcgcttccagagggtgggccagagaggagctggcctgagcgccaccatcgcccggagtgaacatgagatcagcgagatcattgatggcctgtctgagcaggagaacaatgagaagcagatgaggcagctgagcgtcatcccccccatgatgtttgatgctgagcagaggagagtgaagttcatcaacatgaatggcctgatggaggaccccatgaaggtgtacaaggaccggcagttcatgaatgtgtggacagaccacgagaaggagatcttcaaggacaagttcatccagcaccccaagaactttggcctgattgccagctacctggagaggaagtctgtgcctgactgtgtgctgtactactacctgaccaagaagaatgaaaactacaaggccctggtgagaagaaactacggcaagagaagaggaagaaaccagcagatcgcccggcccagccaggaggagaaggtggaggagaaggaggaggacaaggccgagaagacagagaagaaggaggaggagaagtag

SEQ ID NO: 21748 - DNA, 840 bp, Artificial Sequence
  Description of Artificial Sequence: Synthetic coding sequence
atgaagttccccttcctgcccatcctggtgatgaagttcatcgagaaggcccagaacatgagcaaatatgtgctgattgacaccccaggccagatcgaggtgttcacctggagcgccagcggcaccatcatcacagaggccctggccagcagcttccccaccgtggtgatctacgtgatggacaccagccgcagcaccaaccctgtgaccttcatgagcaacatgctgtatgcctgcagcatcctgtacaagaccaagctgcccttcatcgtggtgatgaacaagacagacatcatcgaccacagctttgctgtggagtggatgcaggactttgaggccttccaggatgccctgaaccaggagaccacctacgtgagcaacctgaccaggtccatgagcctggtgctggatgagttctacagcagcctgcgggtggtgggcgtgtctgctgtgctgggcaccggcctggatgagctgtttgtgcaggtgaccagcgctgctgaggagtatgaaagagagtacagaccagaatatgaaaggctgaagaagagcctggccaatgctgagagccagcagcagcgggagcagctggagcggctgaggaaggacatgggctctgtggccctggatgctggaacagccaaggacagcctgagccctgtgctgcaccccagcgacctgatcctgacccggggcaccctggatgaagaagatgaggaggccgacagcgacacagatgacatcgaccaccgggtgacagaggagagccatgaggagcccgccttccagaacttcatgcaggagagcatggcccagtactggaagaggaacaacaagtag

SEQ ID NO: 21749 - DNA, 1230 bp, Artificial Sequence
  Description of Artificial Sequence: Synthetic coding sequence
atgaaggacacccaggacatccaggaggccagcaaggccatgcagaacaaggtgcatgagcaggaggacaagaatgagaagcagaagcagcgggaggacaagctgggcgtgtacagcctggtgcacttcagccccaagatgctgggctctgtggccaccaccctgcccctgagcagcagcaacagcagcggcatgcccctgggctactacctgagcagcccccagatcagccgggtgaccatcagcaccaccggccagctgaccagcaaggccaccgtgggcagctgcagccgggtggagaacagcctggatgccagccccttctctgtgcccaagaagcaggatgagagccccatgattggagatggagaggactacttcctgagcctgtttggagacagcaagaagctgacagcccacagcaactacacccagaagaccctgaagtacttctccatgatcctggaggaggtgggccagttcaccagcagcagcctgggagatgtggagattgctgaggtgaatgtgaagggcctgtttgtgaagctgatcaacagcagcctggacaaggagatggccatcggggaccacatcctgcagcagaatgtgaatggccagaccatcagcctgtaccgcttcctgcccaacatcgtgatgcaggccaacagcacagtgacagtgtgggccgccgccagcgaggccaagcaccagccccccagcgacttcctgtggaaggagcaggacaagttccgggccagcccagactgcatcaccatcctgtgcaagcccaacggccaggccatcgcctggtacacccccatccactggaagcaggcctgggagaagctggatgctgatgtggagttcaaccgctgcagcgtggtgagccccaccttcaggaagagggtcttccagtggacagccagcacagccaccatcaccaaggagaagcaggaccagcccaagaaggacatcagcaactaccaggtggagcaggcccaggtgctgctgaagcgggagaaggagatcccccccaccgtcttccccaacagaagcccctggtgccagaacccctacgtgtctgcccacccctactgccccctgattgagccccacaacaccagcacagctgggggccgcctggaccggcagcccaggaccaggagcacccggcccaacagagccagcggcagcaagaagaagaagaccagcgagagccagaagcagtag

SEQ ID NO: 21750 - DNA, 2442 bp, Artificial Sequence; identical to SEQ ID NO: 20895
  Description of Artificial Sequence: Synthetic coding sequence

SEQ ID NO: 21751 - DNA, 1773 bp, Artificial Sequence
  Description of Artificial Sequence: Synthetic coding sequence
atgcccagcccccagctgctggtgctgtttggcagccagacaggaacagcccaggatgtgtctgagcggctgggccgggaggccaggagaagaaggctgggctgccgggtgcaggccctggacagctaccctgtggtgaacctgatcaatgagcccctggtgatctttgtgtgtgccaccaccggccagggcgaccccccagacaacatgaagaacttctggaggttcatcttcaggaagaacctgcccagcacagccctgtgccagatggactttgctgtgctgggcctgggggacagcagctatgccaagttcaactttgtggccaagaagctgcaccggcggctgctgcagctgggcggcagcgccctgctgcctgtgtgcctgggagatgaccagcacgagctgggcccagatgctgctgtggacccctggctgcgggacctgtgggacagagtgctgggcctgtacccacctcctcctggcctgacagagatccccccaggagtgcccctgcccagcaagttcaccctgctcttcctgcaggaggcccccagcactggaagtgagggccagagggtggcccaccctggcagccaggagccccccagcgagagcaagcccttcctggcccccatgatcagcaaccagagggtgacaggccccagccacttccaggatgtgcggctgattgaatttgacatcctgggcagcggcatcagctttgctgctggagatgtggtgctgatccagcccagcaacagcgctgcccacgtgcagcgcttctgccaggtgctgggcctggaccctgaccagctgttcatgctgcagccccgggagccagatgtgagcagccccacccggctgccccagccctgcagcatgaggcacctggtgagccactacctggacatcgcctctgtgccccggcgctccttctttgagctgctggcctgcctgagcctgcacgagctggagcgggagaagctgctggagttcagcagcgcccagggccaggaggagctgtttgagtactgcaaccggcccaggaggaccatcctggaggtgctgtgtgacttcccccacacagctgctgccatccccccagactacctgctggacctgatccctgtgatccggccccgggccttcagcatcgccagcagcctgctgatcctggtggccgtggtgcagttccagacccggctgaaggagccccggcggggcctgtgcagctcctggctggccagcctggaccccggccagggccctgtgcgggtgcccctgtgggtgcggcccggcagcctggccttccctgagaccccagacacccctgtgatcatggtgggccctggcactggagtggcccccttccgggccgccatccaggagcgggtggcccagggccagacaggcaacttcctgttcttcggctgccgctggagggaccaggacttctactgggaggccgagtggcaggagctggagaagagggactgcctgaccctcatcccagccttcagccgggagcaggagcagaaggtgtatgtgcagcaccggctgcgggagctgggcagcctggtgtgggagctgctggaccggcagggcgcctacttctacctggccggaaatgccaagtccatgccagcagatgtgtctgaggccctgatgagcatcttccaggaggagggcggcctgtgcagcccagatgctgctgcctacctggcccggctgcagcagacccggcgcttccagacagagacctgggcctag

SEQ ID NO: 21752 - DNA, 2436 bp, Artificial Sequence; identical to SEQ ID NO: 19035
  Description of Artificial Sequence: Synthetic coding sequence

SEQ ID NO: 21753 - DNA, 189 bp, Artificial Sequence
  Description of Artificial Sequence: Synthetic coding sequence
atgcctgagatccgggtgacccccctgggcgcctgccctgtgctgtcctggaacctggtgctgcccccaggccggggcagccgggcccccagcagcacagacaccaggacaggcttccacgtgctgccccacggcgtgtctgccagcagcgagggcgcccccaggcctggggtggacacagtgctgtag

SEQ ID NO: 21754 - DNA, 948 bp, Artificial Sequence
  Description of Artificial Sequence: Synthetic coding sequence
atgagcggcctggtgctgggccagagagatgagcctgctggccaccggctgagccaggaggagatcctgggcagcacccggctggtgtcccagggcctggaggccctgcggtctgagcaccaggccgtgctgcagagcctgagccagaccatcgagtgcctgcagcagggcggccacgaggagggcctggtgcatgagaaggcccggcagctgcggcgctccatggagaacatcgagctgggcctgtctgaggcccaggtgatgctggccctggccagccacctgagcacagtggagagcgagaagcagaagctgcgggcccaggtgcggcggctgtgccaggagaaccagtggctgagagatgagctggccggcacccagcagaggctgcagaggtctgagcaggccgtggcccagctggaggaggagaagaagcacctggagttcctgggccagctgcggcagtatgatgaagatggccacaccagcgaggagaaggagggagatgccaccaaggacagcctggatgacctcttccccaatgaggaggaggaggaccccagcaatggcctgagccggggccagggcgccacagctgcccagcagggcggctatgagatcccagcccggctgcggaccctgcacaacctggtgatccagtatgctgcccagggccgctatgaggtggccgtgcccctgtgcaagcaggccctggaggacctggagaggaccagcggccggggccacccagatgtggccaccatgctgaacatcctggccctggtgtacagagaccagaacaagtacaaggaggccgcccacctgctgaatgatgccctgagcatccgggagagcaccctgggccctgaccaccctgctgtgtccatcccctgccccccccaccccacccccaggaccccccaccactgctgcttcggcctgtcctag

SEQ ID NO: 21755 - DNA, 2055 bp, Artificial Sequence; identical to SEQ ID NO: 18417
  Description of Artificial Sequence: Synthetic coding sequence

SEQ ID NO: 21756 - DNA, 4050 bp, Artificial Sequence
  Description of Artificial Sequence: Synthetic coding sequence
atggaggagaatgaaagccagaagtgtgagccctgcctgccctacagcgctgaccggcggcagatgcaggagcagggcaaaggaaacctgcacgtgaccagcccagaagatgctgaatgtagaaggaccaaggagcggctgagcaatggaaacagccggggctctgtgtccaagagcagcaggaacatccccaggaggcacaccctgggcggccccaggagcagcaaggagatcctgggcatgcagaccagcgagatggacaggaagcgggaggccttcctggagcacctgaagcagaagtacccccaccacgccagcgccatcatgggccaccaggagcggctgcgggaccagaccaggagccccaagctgagccacagcccccagccccccagcctgggggaccctgtggagcacctgtctgagaccagcgctgacagcctggaggccatgtctgaaggagatgcccccacccccttcagccggggcagcaggacccgggccagcctgcctgtggtgcgcagcaccaaccagaccaaggagaggagcctgggcgtgctgtacctgcagtatggagatgagaccaagcagctgaggatgcccaatgagatcaccagcgctgacaccatccgggccctgtttgtgtctgccttcccccagcagctgaccatgaagatgctggagagccccagcgtggccatctacatcaaggatgagagcagaaatgtgtactatgagctgaatgatgtgaggaacatccaggacaggagcctgctgaaggtgtacaacaaggaccctgcccacgccttcaaccacacccccaagaccatgaatggagacatgaggatgcagcgggagctggtgtatgcccggggagatggccctggggccccccggcccggcagcacagcccaccccccccacgccatccccaacagcccccccagcacccctgtgccccacagcatgccacccagccccagccgcatcccctacggcggcaccaggtccatggtggtgcctggaaatgccaccatcccccgggaccgcatcagcagcctgcctgtgtcccggcccatcagccccagccccagcgccatcctggagaggagagatgtgaagccagatgaggacatgtctgggaagaacatcgccatgtacagaaatgaaggcttctacgccgacccctacctgtaccacgagggccgcatgagcatcgccagcagccacggcggccaccccctggatgtgcctgaccacatcatcgcctaccacaggacagccatccgcagcgccagcgcctactgcaaccccagcatgcaggccgagatgcacatggagcagagcctgtaccggcagaagagcaggaagtacccagacagccacctgcccaccctgggcagcaagaccccaccagccagcccccaccgggtgtctgacctgaggatgattgacatgcacgcccactacaatgcccacggccccccccacaccatgcagcctgaccgggccagccccagccggcaggccttcaagaaggagcccggcaccctggtgtacatcgagaagcccaggtctgctgctggcctgagcagcctggtggacctgggcccccccctgatggagaagcaggtgtttgcctacagcacagccaccatccccaaggaccgggagaccagcgagaagatgatgaagaccacagccaacagaaaccacacagattctgctggcaccccccacgtgtctgggggcaagatgctgagcgccctggagagcacagtgccccccagccagcccccacctgtgggcaccagcgccatccacatgagcctgctggagatgagaagatctgtggccgagctgcggctgcagctgcagcagatgaggcagctgcagctgcagaaccaggagctgctgcgggccatgatgaagaaggccgagctggagatcagcggcaaggtgatggagaccatgaagaggctggaggaccctgtgcagaggcagagggtgctggtggagcaggagcggcagaagtacctgcacgaggaggagaagatcgtgaagaagctgtgtgagctggaggactttgtggaggacctgaagaaggacagcacagctgccagccggctggtgaccctgaaggatgtggaggatggagccttcctgctgcggcaggtgggggaggccgtggccaccctgaagggggagttccccaccctgcagaacaagatgagggccatcctgcgcatcgaggtggaggccgtgcgcttcctgaaggaggagccccacaagctggacagcctgctgaagagggtgcgctccatgacagatgtgctgaccatgctgcggagacatgtgacagatggcctgctgaagggcacagatgctgcccaggccgcccagtacatggccatggagaaggccacagctgctgaggtgctgaagagccaggaggaggccgcccacaccagcggccagcccttccacagcactggagcccctggagatgccaagtctgaggtggtgcccctgagcggcatgatggtgagacatgcccagagcagccctgtggtgatccagcccagccagcacagcgtggccctgctgaacccagcccagaacctgccccacgtggccagcagccctgctgtgccccaggaggccaccagcaccctgcagatgagccaggccccccagagcccccagatccccatgaatggcagcgccatgcagagcctcttcatcgaggagatccacagcgtgtctgccaagaacagagctgtgtccattgagaaggccgagaagaagtgggaggagaagaggcagaacctggaccactacaacgggaaggagtttgagaagctgctggaggaggcccaggccaacatcatgaagagcatccccaacctggagatgcccccagccaccggccccctgcccagaggagatgcccctgtggacaaggtggagctgtctgaggacagccccaacagcgagcaggacctggagaagctgggcggcaagagccccccacctcctcctcctccaccccggcgcagctacctgcccggcagcggcctgaccaccaccaggtctggagatgtggtgtacacaggcaggaaggagaacatcacagccaaggccagcagtgaagatgctggccccagcccccagacccgggccaccaagtacccagctgaggagcccgccagcgcctggacccccagccccccacctgtgaccaccagcagcagcaaggatgaggaggaggaggaggaggagggggacaagatcatggccgagctgcaggccttccagaagtgcagcttcatggatgtgaacagcaacagccatgctgagcccagcagagctgacagccacgtgaaggacaccaggtctggggccaccgtgccccccaaggagaagaagggcagcagcggggccccccagaccagcaggatgcctgtgcccatgtctgccaagaaccggcccggcaccctggacaagccaggcaagcagagcaagctgcaggacccccggcagtaccggcaggccaacggcagcgccaagaagagcggcggggacttcaagcccaccagccccagcctgcctgccagcaagatcccagccctgagccccagcagcggcaagagcagcagcctgcccagcagcagcggggacagcagcaacctgcccaaccccccagccaccaagcccagcatcgccagcaaccccctgagcccccagacaggccccccagcccacagcgccagcctcatccccagcgtgtccaatggcagcctgaagttccagagcctgacccacacaggcaagggccaccacctgtccttcagcccccagagccagaatggccgggcccccccacccctgtccttcagcagcagcccccccagccctgccagctctgtgtccctgaaccagggcgccaagggcaccaggaccatccacacccccagcctgaccagctacaaggcccagaatggcagcagcagcaaggccacccccagcacagccaaggagaccagctag

SEQ ID NO: 21757 - DNA, 177 bp, Artificial Sequence
  Description of Artificial Sequence: Synthetic coding sequence
tgaatcatccacaagctggccatgcagctgcggcacatcggggacaacatcgaccacaggatggtgcgggaggacctgcagcaggacggcagagatgccctggaccactttgtgttcttcttcttcagaagagtgcaggtgctgctgcacttcttctggaacaaccacctgctgtag

SEQ ID NO: 21758 - DNA, 429 bp, Artificial Sequence
  Description of Artificial Sequence: Synthetic coding sequence
atgcctgaggaccaggtgggcaagctggaggccacagagaacaccatcagcgccatggctgctgctgctgctgagcagcagcagttctacctgctgctgggcaacctgctgagcccagacaacgtggtgaggaagcaggccgaggagacctatgagaacatccctggccagagcaagatcaccttcctgctgcaggccatccggaacaccacagctgctgaggaggcccggcagatggctgctgtgctgctgcggcggctgctgagcagcgcctttgatgaggtgtacccagccctgcccagtgatgtgcagacagccatcaagtctgagctgctgatgatcatccagatggagacccagagctccatgaggaagaaggtgtgtgacattgctgctgagctggccaggaacctgattggagtgtactag

SEQ ID NO: 21759 - DNA, 93 bp, Artificial Sequence
  Description of Artificial Sequence: Synthetic coding sequence
atgggcagcaggaagaaggagatcgccctgcaggtgaacatcagcacccaggagctgtgggaggagatgctgagcagcaagggcctgacctag

SEQ ID NO: 21760 - DNA, 645 bp, Artificial Sequence; identical to SEQ ID NO: 18781
  Description of Artificial Sequence: Synthetic coding sequence

SEQ ID NO: 21761 - DNA, 1158 bp, Artificial Sequence; identical to SEQ ID NO: 18912
  Description of Artificial Sequence: Synthetic coding sequence

SEQ ID NO: 21762 - DNA, 255 bp, Artificial Sequence
  Description of Artificial Sequence: Synthetic coding sequence
atgagcggcctggtgctgggccagagagatgagcctgctggccaccggctgagccaggaggagatcctgggcagcacccggctggtgtcccagggcctggaggccctgcggtctgagcaccaggccgtgctgcagagcctgagccagaccatcgagtgcctgcagcagggcggccacgaggagggcctggtgcatgagaaggcccggcagctgcggcgctccatggagaacatcgagctgggcctgtctgagtag

SEQ ID NO: 21763 - DNA, 483 bp, Artificial Sequence
  Description of Artificial Sequence: Synthetic coding sequence
atgtctgtgaacagcgagaagagcagcagcagcgagaggcctgagccccagcagaaggcccccctggtgcccccacctcctcctcctcctcctcctcctcctccacccctgcctgaccccaccccacctgagcctgaggaggagatcctgggcagtgatgatgaggagcaggaggaccctgctgactactgcaagggcggctaccaccctgtgaagattggagacctcttcaacggccgctaccacgtgatcaggaagctgggctggggccacttcagcacagtgtggctgtgctgggacatgcagggcaagagatttgtggccatgaaggtggtgaagagcgcccagcactacacagaaacagccctggatgagatcaagctgctgaagtgtgtgcgggagagtgaccccagcgaccccaacaaggacatggtggtgcagctgattgatgacttcaagatcagcggcatgaatggcatctag

SEQ ID NO: 21764 - DNA, 66 bp, Artificial Sequence
  Description of Artificial Sequence: Synthetic coding sequence
atgaacccagccagcgcccccccacccctgcccccacctggccagcaggtgattcatgtgacctag

SEQ ID NO: 21765 - DNA, 1212 bp, Artificial Sequence; identical to SEQ ID NO: 18994
  Description of Artificial Sequence: Synthetic coding sequence

SEQ ID NO: 21766 - DNA, 5106 bp, Artificial Sequence; identical to SEQ ID NO: 18955
  Description of Artificial Sequence: Synthetic coding sequence

SEQ ID NO: 21767 - DNA, 408 bp, Artificial Sequence
  Description of Artificial Sequence: Synthetic coding sequence
atgggcaagagctgcaaggtggtggtgtgtggccaggcctctgtgggcaagaccagcatcctggagcagctgctgtatggcaaccacgtggtgggcagcgagatgattgagacccaggaggacatctacgtgggcagcattgaaacagaccggggcgtgcgggagcaggtgaccatcgtggtgctgggcaacaagtgtgacctgcaggagcagaggagagtggaccctgatgtggcccagcactgggccaagtctgagaaggtgaagctgtgggaggtgtctgtggccgaccggcgcagcctgctggagccctttgtgtacctggccagcaagatgacccagccccagagcaagagcgccttccccctgagcaggaagaacaagggcagcggcagcctggatggatag

SEQ ID NO: 21768 - DNA, 3693 bp, Artificial Sequence; identical to SEQ ID NO: 19544
  Description of Artificial Sequence: Synthetic coding sequence

SEQ ID NO: 21769 - DNA, 267 bp, Artificial Sequence
  Description of Artificial Sequence: Synthetic coding sequence
atgcctgaggaccaggtgggcaagctggaggccacagagaacaccatcagcgccatggctgctgctgctgctgagcagcagcagttctacctgctgctgggcaacctgctgagcccagacaacgtggtgaggaagcaggccgaggagacctatgagaacatccctggccagagcaagatcaccttcctgctgcaggccatccggaacaccacagctgctgaggaggcccggcagatggctgctgtgctgctgcggcggctgctgtag

SEQ ID NO: 21770 - DNA, 3627 bp, Artificial Sequence; identical to SEQ ID NO: 19599
  Description of Artificial Sequence: Synthetic coding sequence

SEQ ID NO: 21771 - DNA, 1743 bp, Artificial Sequence
  Description of Artificial Sequence: Synthetic coding sequence
atggtgctggtgggcacccaggatgccatctctgctgccaacccccgggtgattgatgacagccgggccaggaagctgagcacagacctgaagcgctgcacctactatgagacctgtgccacctacggcctgaatgtggagagggtcttccaggatgtggcccagaaggtggtggccctgaggaagaagcagcagctggccatcggcccctgcaagagcctgcccaacagccccagccacagcgctgtgtctgctgccagcatcccagctgtgcacatcaaccaggccaccaacggcggcggcagcgccttcagtgactacagcagctctgtgcccagcacccccagcatcagccagcgggagctgcgcatcgagaccatcgccgccagcagcacccccacccccatcaggaagcagagcaagaggaggagcaacatcttcaccagcaggaaaggagctgacctggaccgggagaagaaggctgctgagtgcaaggtggacagcatcggcagcggccgggccatccccatcaagcagggcatcctgctgaagaggtctgggaagagcctgaacaaggagtggaagaagaagtatgtgaccctgtgtgacaatggcctgctgacctaccaccccagcctgcatgactacatgcagaacatccacggcaaggagattgacctgctgcggaccaccgtgaaggtgcctgggaagaggctgccccgggccaccccagccacagcccctggcaccagcccccgggccaacggcctgtctgtggagaggagcaacacccagctgggcggcggcacagaggccgaggagagctttgaatttgtggtggtgtccctgaccggccagacctggcactttgaggccagcacagctgaggagcgggagctgtgggtgcagagcgtgcaggcccagatcctggccagcctgcagggctgccgcagcgccaaggacaagacccggctgggcaaccagaatgctgccctggccgtgcaggccgtgaggacagtgcggggcaacagcttctgcatcgactgtgatgcccccaacccagactgggccagcctgaacctgggcgccctgatgtgcatcgagtgcagcggcatccaccgccacctgggcgcccacctgagccgggtgcgcagcctggacctggatgactggcccccagagctgctggccgtgatgacagccatgggaaatgccctggccaacagcgtgtgggagggcgccctgggcggctacagcaagccaggcccagatgcctgccgggaggagaaggagcgctggatccgggccaagtatgagcagaagctgttcctggcccccctgcccagcagtgatgtgcccctgggccagcagctgctgcgggctgtggtggaggatgacctgcggctgctggtgatgctgctggcccacggcagcaaggaggaggtgaatgagacctatggagatggagatggccgcacagccctgcacctgagcagcgccatggccaacgtggtgttcacccagctgctgatctggtatggagtggatgtgcgcagcagagatgcccggggcctgacccccctggcctatgcccggcgggccggcagccaggagtgtgccgacatcctgatccagcacggctgccctggagagggctgcggcctggcccccacccccaaccgggagcccgccaacggcaccaaccccagcgctgagctgcacaggagccccagcctgctgtag

SEQ ID NO: 21772 - DNA, 312 bp, Artificial Sequence
  Description of Artificial Sequence: Synthetic coding sequence
atggccgagctgatccagaagaagctgcagggcgaggtggagaagtaccagcagctgcagaaggacctgagcaagtccatgagcggccggcagaagctggaggcccagctgacagagaacaacatcgtgaaggaggagctggccctgctggatggcagcaatgtggtgttcaagctgctgggccctgtgctggtgaagcaggagctgggggaggcccgggccaccgtgggcaagaggctggactacatcacagctgagatcttcctgcggaccatcccagaccctggagatgtgcctgacagcttcttctag

SEQ ID NO: 21773 - DNA, 453 bp, Artificial Sequence
  Description of Artificial Sequence: Synthetic coding sequence
atgaccagcaggaagaaggtgctgctgaaggtgatcatcctgggggacagcggcgtgggcaagaccagcctgatgaaccagtatgtgaacaagaagttcagcaaccagtacaaggccaccatcggggctgacttcctgaccaaggaggtgatggtggatgaccggctggtgaccatgcagatctgggacacagctggccaggagcgcttccagagcctgggcgtggccttctacagaggagctgactgctgcgtgctggtgtttgatgtgacagcccccaacaccttcaagaccctggacagctggagagatgagttcctgatccaggccagcccccgggaccctgagaacttcccctttgtggtgctgggcaacaagattgacctggagaaccggcaggtggccaccaagagggcccaggcctggtgctacagcaagaacaacatcccctag

SEQ ID NO: 21774 - DNA, 540 bp, Artificial Sequence; identical to SEQ ID NO: 20359
  Description of Artificial Sequence: Synthetic coding sequence

SEQ ID NO: 21775 - DNA, 171 bp, Artificial Sequence
  Description of Artificial Sequence: Synthetic coding sequence
atggacagcagcatccacctgagcagcctcatcagcagacatgatgatgaggccaccaggaccagcaccagcgagggcctggaggagggggaggtggagggggagaccctgctgattgtggagagcgaggaccaggcctctgtggacctgagccatgaccagagcggctag

SEQ ID NO: 21776 - DNA, 153 bp, Artificial Sequence
  Description of Artificial Sequence: Synthetic coding sequence
atgtgcagcaccagcggctgtgacctggaggagatccccctggatgatgatgacctgaacaccatcgagttcaagatcctggcctactacaccaggcaccacgtgttcaagagcaccccagccctcttcagccccaagctgctgcggacctag

SEQ ID NO: 21777 - DNA, 1203 bp, Artificial Sequence; identical to SEQ ID NO: 19568
  Description of Artificial Sequence: Synthetic coding sequence

SEQ ID NO: 21778 - DNA, 513 bp, Artificial Sequence
  Description of Artificial Sequence: Synthetic coding sequence
atgcccaggaagggcacccagcccagcacagccaggagaagagaggagggccccccaccacccagcccagatggagccagcagtgatgctgagcctgagccccccagcggccgcacagagagccctgccacagctgctgagacagccagcgaggagctggacaacagaagcctggaggagatcctgaacagcatccccccacctcctcctccagccatgaccaatgaagctggggccccccggctgatgatcacccacatcgtgaaccagaacttcaagagctatgctggggagaagatcctgggccccttccacaagcgcttcagctgcatcatcggccccaatggaagtggcaagagcaatgtgattgacagcatgctgtttgtgtttggctaccgggcccagaagatccgcagcaagaagctgtctgtgctgatccacaacagtgatgagcacaaggacatccagagctgcaccgtggaggtgcacttccagaagatcatcgacaagtag

SEQ ID NO: 21779 - DNA, 504 bp, Artificial Sequence
  Description of Artificial Sequence: Synthetic coding sequence
atggagaaggctgtgaatgatggcagccacagcgaggagctgttctgccacctgaagaccatcagcgagaaggaggacctgccccgctgcaccagcgagagccacctgagctgcctgaagcaggacatcctgaatgagaagacagagctggaggccaccctgaaggaggccgagctggtgacccacagcgtggagctgctgctgcccctcttcaaggacaccatcgagaagatcaactttgaaaatgccaacctgagcgccctgaacctgaagatcagcgagcagaaggagatcctgatcaaggagctggacaccttcaagtctgtgaagctggccctggagcacctgctgaggaagagggactacaagcagacaggagacaacctgagctccatgctgctggagaacctgacagacaatgaaagtgagaacaccaacctgaagaagaaggtgtttgagaaggaggcccacatccaggagctgagctgcctcttccagagctag

SEQ ID NO: 21780 - DNA, 2376 bp, Artificial Sequence; identical to SEQ ID NO: 19027
  Description of Artificial Sequence: Synthetic coding sequence

SEQ ID NO: 21781 - DNA, 687 bp, Artificial Sequence
  Description of Artificial Sequence: Synthetic coding sequence
atgacagaccagacctactgtgaccggctggtgcaggacacccccttcctgaccggccacggccgcctgtctgagcagcaggtggaccgcatcatcctgcagctgaaccgctactacccccagatcctgaccaacaaggaggccgagaagttcaggaaccccaaggccagcctgcgggtgcggctgtgtgacctgctgagccacctgcagaggtctggagagcgggactgccaggagttctaccgggccctgtacatccacgcccagcccctgcacagccggctgcccagcagacatgccctgaggaagttccacatcaccaaccacgcctgcctggtgctggcccggggcggccaccccagcctgcccctgatggcctggatgagctccatgaccacccaggtgtgctgcagccctggcctggccagccccctggccagcgccccaccccagaggcctccttctggccctgagggccgggtgtggcaggcccaggccgtgcagatgctggtgtctgtgagccacttcctgcccctgccccccagcctgagccacggcagcttccacacagcctggggcatcctgtatgtgcacagctgccccagcttcagcaacctgatcccccggggcagcctgcacgtgtgtgtggacagcaacctggtgcccacagctgcctggaggagctag

SEQ ID NO: 21782 - DNA, 948 bp, Artificial Sequence; identical to SEQ ID NO: 18394
  Description of Artificial Sequence: Synthetic coding sequence

SEQ ID NO: 21783 - DNA, 1203 bp, Artificial Sequence; identical to SEQ ID NO: 19568
  Description of Artificial Sequence: Synthetic coding sequence

SEQ ID NO: 21784 - DNA, 381 bp, Artificial Sequence
  Description of Artificial Sequence: Synthetic coding sequence
atggtgctgatcctgggccgccgcctgaaccgggaggacctgggcgtgcgggacagccctgccaccaagaggaaggtgtttgagatggaccccaagagcctgactggacatgagttctttgacttcagcagcggcagcagccatgctgagaacatcctgcagatcttcaatgagttccgggacagccgcctcttcacagatgtgatcatctgtgtggagggcaaggagttcccctgccacagagctgtgctgagcgcctgcagcagctacttccgggccatgttctgcaatgaccaccgggagagccgggagatgctggtggagatcaatggcatcctggccgaggccatggagtgcttcctgcagtatgtgtacacctag

SEQ ID NO: 21785 - DNA, 312 bp, Artificial Sequence; identical to SEQ ID NO: 21772
  Description of Artificial Sequence: Synthetic coding sequence

SEQ ID NO: 21786 - DNA, 237 bp, Artificial Sequence
  Description of Artificial Sequence: Synthetic coding sequence
atggtgctgatcctgggccgccgcctgaaccgggaggacctgggcgtgcgggacagccctgccaccaagaggaaggtgtttgagatggaccccaagagcctgactggacatgagttctttgacttcagcagcggcagcagccatgctgagaacatcctgcagatcttcaatgagttccgggacagccgcctcttcacagatgtgatcatctgtgtggagggcaaggagttcccctag

SEQ ID NO: 21787 - DNA, 1320 bp, Artificial Sequence
  Description of Artificial Sequence: Synthetic coding sequence
atggccgccaacctgagcagaaatggacctgccctgcaggaggcctacgtgcgggtggtgacagagaagagccccacagactgggccctcttcacctatgagggcaacagcaatgacatccgggtggccggcactggagagggcggcctggaggagatggtggaggagctgaacagcggcaaggtgatgtatgccttctgccgggtgaaggaccccaacagcggcctgcccaagtttgtgctgatcaactggacaggagagggcgtgaatgatgtgaggaagggggcctgtgccagccacgtgtccaccatggccagcttcctgaagggggcccacgtgaccatcaatgcccgggcagaagaagatgtggagcctgagtgcatcatggagaaggtggccaaggccagcggggccaactacagcttccacaaggagagcggccgcttccaggatgtgggcccccaggcccctgtgggctctgtgtaccagaagaccaatgctgtgtctgagatcaagagggtgggcaaggacagcttctgggccaaggccgagaaggaggaggagaacagaaggctggaggagaagagaagagctgaggaggcccagaggcagctggagcaggagcggcgggagcgggagctgcgggaggccgcccggcgggagcagcgctaccaggagcagggcggggaggccagcccccagagcaggacctgggagcagcagcaggaggtggtgtccaggaacagaaatgagcagggcagcacctgtgccagcctgcaggagagcgctgtgcacccccgggagatcttcaagcagaaggagcgggccatgagcaccaccagcatcagcagcccccagcccgggaagctgcggagccccttcctgcagaagcagctgacccagcctgagacccacttcggccgggagcctgctgctgccatcagccggcccagggctgacctgcctgctgaggagcccgcccccagcaccccaccctgcctggtgcaggccgaggaggaggccgtgtatgaggagcccccagagcaggagaccttctatgagcagccccccctggtgcagcagcagggcgccggcagcgagcacatcgaccaccacatccagggccagggcctgagcggccagggcctgtgtgcccgggccctgtatgactaccaggccgcagatgacacagagatcagctttgatcctgagaacctgatcaccggcatcgaggtgattgatgagggctggtggaggggctacggcccagatggccacttcggcatgtttcctgccaactacgtggagctgattgaatag

SEQ ID NO: 21788 - DNA, 219 bp, Artificial Sequence
  Description of Artificial Sequence: Synthetic coding sequence
atgagctaccagcagcagcagtgcaagcagccctgccagcccccacctgtgtgcccagcccccaagtgcccagagccctgccccccacccaagtgcccagagccctgcccccccagcaagtgcccccagagctgccccccccagcagtgccagcagaagtgcccccctgtgacccccagccccccctgccagcccaagtgcccccccaagagcaagtag

SEQ ID NO: 21789 - DNA, 342 bp, Artificial Sequence
  Description of Artificial Sequence: Synthetic coding sequence
atgtctgccatccagaacctgcacagctttgacccctttgctgatgccagcaaaggagatgacctgctgcctgctggaacagaggactacatccacatccgcatccagcagagaaatggaaggaagaccctgaccaccgtgcagggcattgctgatgattatgacaagaagaagctggtgaaggccttcaagaagaagtttgcctgcaatggcaccgtcatcgagcacccagaatatggagaggtgatccagctgcagggcgaccagaggaagaacatctgccagttcctggtggagatcggcctggccaaggatgaccagctgaaggtgcacggcttctag

SEQ ID NO: 21790 - DNA, 927 bp, Artificial Sequence; identical to SEQ ID NO: 18993
  Description of Artificial Sequence: Synthetic coding sequence

SEQ ID NO: 21791 - DNA, 1809 bp, Artificial Sequence
  Description of Artificial Sequence: Synthetic coding sequence
atgattgagaagatgcagggcagcaggatggatgagcagcgctgcagcttccccccacccctgaagacagaggaggactacatcccctaccccagcgtgcatgaggtgctgggccgggagggccccttccccctcatcctgctgccccagtttggaggctactggattgagggcaccaaccacgagatcaccagcatccctgagacagagcccctgcagagccccaccaccaaggtgaagctggagtgcaaccccacagcccgcatctacaggaagcacttcctgggcaaggagcacttcaactactacagcctggatgctgccctgggccacctggtgttcagcctgaagtatgatgtgattggagaccaggagcacctgcggctgctgctgcggaccaagtgcaggacctaccatgatgtgatccccatcagctgcctgacagagttccccaacgtggtgcagatggccaagctggtgtgtgaagatgtgaatgtggaccgcttctaccctgtgctgtaccccaaggccagccggctgattgtgacctttgatgaacatgtgatcagcaacaacttcaagtttggagtcatctaccagaagctgggccagaccagcgaggaggagctgttcagcaccaatgaggagagccctgcctttgtggagttcctggagttcctgggccagaaggtgaagctgcaggacttcaagggcttccggggcggcctggatgtgacccacggccagacaggaacagagagcgtgtactgcaacttcaggaacaaggagatcatgtttcatgtgtccaccaagctgccctacacagaaggagatgcccagcagctgcagaggaagaggcacatcggaaatgacatcgtggccgtggtgttccaggatgagaacaccccatttgtgcctgacatgattgccagcaacttcctgcacgcctacgtggtggtgcaggccgagggcggcggcccagatggccccctgtacaaggtgtctgtgacagccagagatgatgtgcccttctttggaccacccctgcctgaccctgctgtgttcagaaaaggacctgagttccaggagttcctgctgaccaagctgatcaatgcagaatatgcctgctacaaggccgagaagtttgccaagctggaggagaggaccagggctgccctgctggagaccctgtatgaggagctgcacatccacagccagagcatgatgggcctgggcggagatgaggacaagatggagaatggcagcggcggcggcggcttctttgagagcttcaagagggtcatccgcagccgcagccagagcatggatgccatgggcctgagcaacaagaagcccaacacagtgtccaccagccacagcggcagctttgcccccaacaacccagacctggccaaggccgccggcatcagcctgattgtgcctgggaagagccccaccaggaagaagagcggccccttcggcagccgccgcagcagcgccatcggcatcgagaacatccaggaggtgcaggagaagcgggagagccccccagctggccagaagaccccagattctggccacgtgtcccaggagcccaagtctgagaacagcagcacccagagcagccctgagatgcccaccaccaagaacagagctgagacagctgcccagagagctgaggccctgaaggacttcagccgcagcagcagcagcgccagcagctttgcctctgtggtggaggagacagagggcgtggatggagaggacaccggcctgcacgtggccggcggccagtgccagcaccactag

SEQ ID NO: 21792 - DNA, 177 bp, Artificial Sequence
  Description of Artificial Sequence: Synthetic coding sequence
atgggccgggtgtgggacctgcccggggtgctgaaggtggagggcttccgggccaccatggcccagaggctggtgcgggtgctgcagatctgtgccggccacgtgcctggggtgtctgccctgaacctgctgagcctgctgcggagcagcgagggccccagcctggaggacctgtag

SEQ ID NO: 21793 - DNA, 2199 bp, Artificial Sequence
  Description of Artificial Sequence: Synthetic coding sequence
atgctgccctgtgccgccggggcccggggccgcggggccatggtggtgctgcgggccggcaagaagaccttcctgccccccctgtgccgggcctttgcctgccggggctgccagctggcccctgagagaggagctgagcggcgggacacagcccccagcggcgtgagccgcttctgcccccccaggaagagctgccacgactggattggccccccagacaagtacagcaacctgcggcctgtgcacttctacatcccagaaaatgaaagccccctggagcagaagctgaggaagctgcggcaggagacccaggagtggaaccagcagttctgggccaaccagaacctgaccttcagcaaggagaaggaggagttcatccacagccggctgaagaccaagggcctgggcctgaggacagaaagtggccagaaggccaccctgaatgctgaggagatggctgacttctacaaggagttcctgagcaagaacttccagaagcacatgtactacaacaggatgtatgacaacatgagcaccatggtgtacatcaaggaggacaagctggagaagctgacccaggatgagatcatcagcaagaccaagcaggtgatccagggcctggaggccctgaagaatgagcacaacagcatcctgcagagcctgctggagaccctgaagtgcctgaagaaggatgatgagagcaacctggtggaggagaagagcaacatgatcaggaagagcctggagatgctggagctgggcctgtctgaggcccaggtgatgatggccctgagcaaccacctgaatgctgtggagagcgagaagcagaagctgcgggcccaggtgcggcggctgtgccaggagaaccagtggctgagagatgagctggccaacacccagcagaagctgcagaagtctgagcagagcgtggcccagctggaggaggagaagaagcacctggagttcatgaaccagctgaagaagtatgatgatgacatcagccccagcgaggacaaggacacagacagcaccaaggagcccctggatgacctcttccccaatgatgaagatgatcctggccagggcatccagcagcagcacagcagcgctgctgctgctgcccagcagggcggctatgagatcccagcccggctgcggaccctgcacaacctggtgatccagtatgccagccagggccgctatgaggtggccgtgcccctgtgcaagcaggccctggaggacctggagaagaccagcggccatgaccacccagatgtggccaccatgctgaacatcctggccctggtgtacagagaccagaacaagtacaaggatgctgccaacctgctgaatgatgccctggccatccgggagaagaccctgggcaaggaccaccctgctgtggccgccaccctgaacaacctggccgtgctgtatggcaagaggggcaagtacaaggaggccgagcccctgtgcaagagggccctggagatccgggagaaggtgctgggcaaggaccacccagatgtggccaagcagctgaacaacctggccctgctgtgccagaaccagggcaagtatgaggaggtggagtactactaccagagggccctggagatctaccagaccaagctgggcccagatgaccccaacgtggccaagaccaagaacaacctggccagctgctacctgaagcagggcaagttcaagcaggccgagaccctgtacaaggagatcctgacccgggcccacgagcgggagtttggatctgtggatgatgagaacaagcccatctggatgcacgccgaggagcgggaggagtgcaagggcaagcagaaggatggcaccagctttggagaatatggaggctggtacaaggcctgcaaggtggacagccccaccgtgaccaccaccctgaagaacctgggcgccctgtaccgccggcagggcaagtttgaggccgctgagaccctggaggaggccgccatgaggagcaggaagcagggcctggacaacgtgcacaagcagagggtggccgaggtgctgaatgaccctgagaacatggagaagagaagaagccgggagagcctgaatgtggatgtggtgaagtatgagagcggcccagatggaggagaggaggtgtccatgtctgtggagtggaatggcatgaggaagatgaagctgggcctggtgaactag

SEQ ID NO: 21794 - DNA, 249 bp, Artificial Sequence
  Description of Artificial Sequence: Synthetic coding sequence
atgagcggcctggtgctgggccagagagatgagcctgctggccaccggctgagccaggaggagatcctgggcagcacccggctggtgtcccagggcctggaggccctgcggtctgagcaccaggccgtgctgcagagcctgagccagaccatcgagtgcctgcagcagggcggccacgaggagggcctggtgcatgagaaggcccggcagctgcggcgctccatggagaacatcgagctgggcctgtag

SEQ ID NO: 21795 - DNA, 222 bp, Artificial Sequence
  Description of Artificial Sequence: Synthetic coding sequence
atggtgctgatcctgggccgccgcctgaaccgggaggacctgggcgtgcgggacagccctgccaccaagaggaaggtgtttgagatggaccccaagagcctgactggacatgagttctttgacttcagcagcggcagcagccatgctgagaacatcctgcagatcttcaatgagttccgggacagccgcctcttcacagatgtgatcatctgtgtggagtag

SEQ ID NO: 21796 - DNA, 1191 bp, Artificial Sequence
  Description of Artificial Sequence: Synthetic coding sequence
atgaacttccaggccggcggcggccagagcccccagcagcagcagagcctggccgcccctgggggcggcggggccgccgcccagcagctggtgtgtggcggccagtttggaggagctggccctggagctgggggcggcggcggccccagccagcagctggccggcggccccccccagcagtttgccctgagcaacagcgctgccatccgggcagagatccagagatttgagagcgtgcaccccaacatctatgccatctatgacctgattgaaagaattgaggacctggccctgcagaaccagatccgggagcacgtgatcagcattgaggacagctttgtgaacagccaggagtggaccctgagccgctctgtgcctgagctgaaggtgggcatcgtgggcaacctgagcagcggcaagagcgccctggtgcaccgctacctgaccggcacctacgtgcaggaggagagccctgagggcggccgcttcaagaaggagatcgtggtggatggccagagctacctgctgctgatcagagatgagggcggccccccagagctgcagtttgctgcctgggtggatgctgtggtgtttgtgttcagcctggaggatgagatctccttccagacagtgtacaactacttcctgcggctgtgcagcttcagaaatgccagcgaggtgcccatggtgctggtgggcacccaggatgccatctctgctgccaacccccgggtgattgatgacagccgggccaggaagctgagcacagacctgaagcgctgcacctactatgagacctgtgccacctacggcctgaatgtggagagggtcttccaggatgtggcccagaaggtggtggccctgaggaagaagcagcagctggccatcggcccctgcaagagcctgcccaacagccccagccacagcgctgtgtctgctgccagcatcccagctgtgcacatcaaccaggccaccaacggcggcggcagcgccttcagtgactacagcagctctgtgcccagcacccccagcatcagccagcgggagctgcgcatcgagaccatcgccgccagcagcacccccacccccatcaggaagcagagcaagaggaggagcaacatcttcaccatctgtgccaccgtgagcaacttcagcagcaccaagaggcccttccagctgctgcccaactag

SEQ ID NO: 21797 - DNA, 1110 bp, Artificial Sequence
  Description of Artificial Sequence: Synthetic coding sequence
atggacagctgcctgatggtgtggcacatgaagccccagagccgggcctaccgcttcaccggccacaaggatgctgtgacctgtgtgaacttcagccccagcggccacctgctggccagcggcagccgggacaagacagtgcgcatctgggtgcccaacgtgaagggggagagcacagtgttccgggcccacacagccaccgtgcgctctgtgcacttctgcagtgatggccagagctttgtgacagccagtgatgacaagacagtgaaggtgtgggccacccaccggcagaagttcctgttcagcctgagccagcacatcaactgggtgcgctgtgccaagttctccccagatggccgcctcatcgtgtctgccagtgatgacaagacagtgaagctgtgggacaagagcagccgggagtgtgtgcacagctactgtgagcacggcggctttgtgacctacgtggacttccaccccagcggcacctgcatcgctgctgctggcatggacaacacagtgaaggtgtgggatgtgaggacccaccggctgctgcagcactaccagctgcacagcgctgctgtgaatggcctgtccttccaccccagcggcaactacctgatcacagccagcagtgacagcaccctgaagatcctggacctgatggagggccgcctgctgtacaccctgcacggccaccagggccctgccaccaccgtggccttcagcaggactggagagtactttgccagcggcggcagtgatgagcaggtgatggtgtggaagagcaactttgacatcgtggaccatggagaggtgaccaaggtgccccggcccccagccaccctggccagctccatgggcaacctgcctgaggtggacttccctgtgcccccaggccggggccgctctgtggagagcgtgcagagccagccccaggagcctgtgtctgtgccccagaccctgaccagcaccctggagcacatcgtgggccagctggatgtgctgacccagacagtgtccatcctggagcagaggctgaccctgacagaggacaagctgaagcagtgcctggagaaccagcagctgatcatgcagagggccaccccctag

SEQ ID NO: 21798 - DNA, 312 bp, Artificial Sequence; identical to SEQ ID NO: 21772
  Description of Artificial Sequence: Synthetic coding sequence

SEQ ID NO: 21799 - DNA, 270 bp, Artificial Sequence; identical to SEQ ID NO: 20498
  Description of Artificial Sequence: Synthetic coding sequence

SEQ ID NO: 21800 - DNA, 1140 bp, Artificial Sequence
  Description of Artificial Sequence: Synthetic coding sequence
atgtggcacctggactttggcctgcacacaggcaagaccttccagcccctgcccttcatcatcgtggtgtacccaggagctggaagacgctggggcctggtgctgagcctggccagccacagaagaagaacagaggccggcggcggcaccggccccaccagtgacaccggctggggctgcatgctgcgctgtggccagatgatctttgcccaggccctggtgtgccgccacctgggccgggactggcgctggacccagaggaagaggcagcctgacagctacttctctgtgctgaatgccttcatcgacaggaaggacagctactacagcatccaccagatcgcccagatgggcgtgggggagggcaagagcatcggccagtggtacggccccaacacagtggcccaggtgctgaagaagctggccgtgtttgacacctggagcagcctggccgtgcacatcgccatggacaacacagtggtgatggaggagatccggcggctgtgcaggacctctgtgccctgtgccggggccacagccttccctgctgacagcgacagacactgcaatggcttccctgctggagctgaggtgaccaaccggcccagcccctggaggcccctggtgctgctgatccccctgcggctgggcctgacagacatcaatgaggcctacgtggagaccctgaagcactgcttcatgatgccccagagcctgggcgtcatcggcggcaagcccaacagcgcccactacttcatcggctacgtgggggaggagctgatctacctggacccccacaccacccagcctgctgtggagcccacagatggctgcttcatcccagatgagagcttccactgccagcaccccccctgcaggatgagcattgctgagctggaccccagcattgctgtgggcttcttctgcaagacagaagatgacttcaatgactggtgccagcaggtgaagaagctgagcctgctgggcggggccctgcccatgtttgagctggtggagctgcagcccagccacctggcctgcccagatgtgctgaacctgagcctggacagcagtgatgtggagcggctggagcgcttctttgattctgaagatgaggactttgagatcctgagcctgtag

SEQ ID NO: 21801 - DNA, 1683 bp, Artificial Sequence; identical to SEQ ID NO: 20948
  Description of Artificial Sequence: Synthetic coding sequence

SEQ ID NO: 21802 - DNA, 330 bp, Artificial Sequence
  Description of Artificial Sequence: Synthetic coding sequence
atgaacccagccagcgcccccccacccctgcccccacctggccagcaggtgattcatgtgacccaggacctggacacagacctggaggccctcttcaacagcgtgatgaaccccaagcccagctcctggaggaagaagatcctgcctgagagcttcttcaaggagccagacagcggcagccacagccggcagagcagcacagacagcagcggcggccaccctggcccccggctggccggcggggcccagcacgtgcgcagccacagcagccctgccagcctgcagctgggcaccggggccggggctgctggcagccctgcccagcagtag

SEQ ID NO: 21803 - DNA, 609 bp, Artificial Sequence
  Description of Artificial Sequence: Synthetic coding sequence
atgggcagcaggaagaaggagatcgccctgcaggtgaacatcagcacccaggagctgtgggaggagatgctgagcagcaagggcctgactgtggtggatgtgtaccagggctggtgtggcccctgcaagcctgtggtgtccctcttccagaagatgagaattgaggtgggcctggacctgctgcactttgccctggccgaggccgaccggctggatgtgctggagaagtaccggggcaaatgtgagcccaccttcctgttctacgccggcggggagctggtggccgtggtgcggggggccaatgcccccctgctgcagaagaccatcctggaccagctggaggccgagaagaaggtgctggccgagggccgggagaggaaggtgatcaaggatgaggccctgagtgatgaagatgaatgtgtgagccacggcaagaacaatggagaagatgaggacatggtgagcagcgagaggacctgcaccctggccatcatcaagccagatgctgtggcccacggcaagacagatgagatcatcatgaagatccaggaggccggctttgagatcctgaccaatgaggagaggaccatgacagaggccgaggtgtag

SEQ ID NO: 21804 - DNA, 195 bp, Artificial Sequence
  Description of Artificial Sequence: Synthetic coding sequence
atggccccccagaaggacaggaagcccaagaggagcacctggaggttcaacctggacctgacccaccctgtggaggatggcatctttgattctggcaactttggcaccttccccagcgagtacctgggcttcagcagcctggtgctgcacttcttctgcttcaagatcggggccatcagcactggagagggctag

SEQ ID NO: 21805 - DNA, 372 bp, Artificial Sequence
  Description of Artificial Sequence: Synthetic coding sequence
atggagaacctgcagaccaacttcagcctggtgcagggcagcaccaagaagctgaatggcatgggagatgatggcagccccccagccaagaagatgatcacagacatccacgccaacgggaagaccatcaacaaggtgcccaccgtgaagaaggagcacctggatgattatggagaggcccctgtggagacagatggagagcacgtgaagaggacctgcacctctgtgcctgagaccctgcacctgaaccccagcctgaagcacaccctggcccagttccacctgagcagccagagcagcctgggcggccctgctgccttcagcgcccggcacagccaggagagcatgagccccaccgtcttcctgccctag

SEQ ID NO: 21806 - DNA, 201 bp, Artificial Sequence
  Description of Artificial Sequence: Synthetic coding sequence
atgaaccccagcatgaagcagaagcaggaggagatcaaggagaacatcaagaacagctctgtgcccaggaggaccctgaagatgatccagcccagcgccagcggcagcctggtgggcagagaaaatgagctgtctgctggcctgagcaagaggaagcacagaaatgaccacctgaccagcaccaccagcagccctggatag

SEQ ID NO: 21807 - DNA, 1614 bp, Artificial Sequence
  Description of Artificial Sequence: Synthetic coding sequence
atggtgctgatcctgggccgccgcctgaaccgggaggacctgggcgtgcgggacagccctgccaccaagaggaaggtgtttgagatggaccccaagagcctgactggacatgagttctttgacttcagcagcggcagcagccatgctgagaacatcctgcagatcttcaatgagttccgggacagccgcctcttcacagatgtgatcatctgtgtggagggcaaggagttcccctgccacagagctgtgctgagcgcctgcagcagctacttccgggccatgttctgcaatgaccaccgggagagccgggagatgctggtggagatcaatggcatcctggccgaggccatggagtgcttcctgcagtatgtgtacaccgggaaggtgaagatcaccacagaaaatgtgcagtacctgtttgagaccagcagcctcttccagatctctgtgctgagagatgcctgtgccaagttcctggaggagcagctggacccctgcaactgcctgggcatccagagatttgctgacacccacagcctgaagaccctcttcaccaagtgcaagaactttgccctgcagacctttgaagatgtgtcccagcacgaggagttcctggagctggacaaggatgagctgattgactacatctgcagtgatgagctggtgattggcaaggaggagatggtgtttgaggccgtgatgcgctgggtgtacagagctgtggacctgcggcggcccctgctgcacgagctgctgacccacgtgcggctgcccctgctgcaccccaactactttgtgcagacagtggaggtggaccagctgatccagaacagccctgagtgctaccagctgctgcacgaggcccggcgctaccacatcctgggcaatgagatgatgagccccaggacccggccccggcgcagcacaggctacagcgaggtgattgtggtggtgggcggctgtgagcgggtgggcggcttcaacctgccctacacagaatgttatgaccctgtgactggagagtggaagagcctggccaagctgcctgagttcaccaagtcagaatatgctgtgtgtgccctgagaaatgacatcctggtgtctgggggccgcatcaacagcagagatgtgtggatctacaacagccagctgaacatctggatccgggtggccagcctgaacaagggccgctggaggcacaagatggctgtgctgctgggcaaggtgtatgtggtgggcggctatgatggccagaaccggctgagctctgtggagtgctatgacagcttcagcaaccgctggacagaggtggcccccctgaaggaggccgtgagcagccctgctgtgaccagctgtgtgggcaagctgtttgtgattggaggcggcccagatgacaacacctgcagcgacaaggtgcagagctatgaccctgagaccaacagctggctgctgcgggccgccatccccatcgccaagcgctgcatcacagctgtgtccctgaacaacctgatctacgtggccggcggcctgaccaaggccatctactgctatgaccctgtggaggactactggatgcacgtgcagaacaccttcagccggcaggtgatcacctag

SEQ ID NO: 21808 - DNA, 1611 bp, Artificial Sequence
  Description of Artificial Sequence: Synthetic coding sequence
atgaggctggaggagctgaagaggctgcagaaccccctggagcaggtgaatgatggcaagtacagctttgagaacatccagagggcctggagggagtacctgcagaggcaggagcccctgggcaagaggagccccagccccccatctgtgagcagcgagaagctgagcagctctgtgtccatgaacaccttcagtgacagcagcaccccagactaccgggaggatggcatggacctgggcagtgatgctggcagcagcagcagcagcagccgggccagcagccagagcaacagcaccaaggtgaccccctgcagcgagtgcaagagcagcagcagccctgggggcagcctggacctggtgtctgccctggaggactatgaggagcccttccctgtgtaccagaagaaggtgattgatgagtgggccccagaagaagatggagaggaggaggaggaggaggatgagcgggaccagaggggctacagagatgacaggagccctgcccgggagcctggagatgtgtctgcccggaccaggtctgggggcggcggcggccgcagcgccaccacagccatgcctcctcctgtgcccaacggcaacctgcaccagcacgacccccaggacctgcggcacaatggaaatgtggtggtggccggccggcccagctgcagccggggcccccggcgggccatccagaagccccagcctgctgggggccgccgcagcggccggggccctgctgctgggggcctgtgcctgcagcccccagatggcggcacctgtgtgcctgaggagccccctgtgccccccatggactgggaggccctggagaagcacctggccggcctgcagttccgggagcaggaggtgaggaaccagggccaggcccggaccaacagcaccagcgcccagaagaatgaaagagagagcatccggcagaagctggccctgggcagcttctttgatgatggccctggcatctacaccagctgcagcaagagcggcaagcccagcctgagcagccggctgcagagcggcatgaacctgcagatctgctttgtgaatgattctggcagtgacaaggacagtgatgctgatgacagcaagacagagaccagcctggacacccccctgagccccatgagcaagcagagcagcagctacagcgaccgggacaccacagaggaggagagcgagagcctggatgacatggacttcctgacccggcagaagaagctgcaggccgaggccaagatggccctggccatggccaagcccatggccaagatgcaggtggaggtggagaagcagaacaggaagaagagccctgtggccgacctgctgccccacatgccccacatcagcgagtgcctgatgaagaggagcctgaagcccacagacctgcgggacatgaccatcggccagctgcaggtgattgtgaatgacctgcacagccagatcgagagcctgaatgaggagctggtgcagctgctgctgatcagagatgagctgcacacagagcaggatgccatgctggtggacatcgaggacctgaccaggcatgctgagagccagcagaagcacatggccgagaagatgcctgccaagtag

SEQ ID NO: 21809 - DNA, 630 bp, Artificial Sequence
  Description of Artificial Sequence: Synthetic coding sequence
atgtctgaaaatgctgcccctggcctcatcagcgagctgaagctggccgtgccctggggccacatcgccgccaaggcctggggcagcctgcagggcccccctgtgctgtgcctgcacggctggctggacaatgccagcagctttgacaggctcatccccctgctgccccaggacttctactacgtggccatggactttggaggccacggcctgagcagccactacagccctggggtgccctactacctgcagacctttgtgtctgagatcagaagagtggtggccgccctgaagtggaaccgcttcagcatcctgggccacagctttggaggagtggtgggcggcatgttcttctgcaccttccctgagatggtggacaagctgatcctgctggacacccccctcttcctgctggagagtgatgagatggagaacctgctgacctacaagagaagagccatcgagcacgtgctgcaggtggaggccagccaggagcccagccacgtgttcagcctgaagcagctgctgcagaggctgctgaagagcaacagccacctgtctgaagaatgtggggagctgctgctgcagaggggcaccaccaaggtggccaccggccgggagcagcactag

SEQ ID NO: 21810 - DNA, 201 bp, Artificial Sequence
  Description of Artificial Sequence: Synthetic coding sequence
atgcctgaggaccaggtgggcaagctggaggccacagagaacaccatcagcgccatggctgctgctgctgctgagcagcagcagttctacctgctgctgggcaacctgctgagcccagacaacgtggtgaggaagcaggccgaggagacctatgagaacatccctggccagagcaagatcaccttcctgctgcaggcctag

SEQ ID NO: 21811 - DNA, 2061 bp, Artificial Sequence
  Description of Artificial Sequence: Synthetic coding sequence
atggccatcagccagcaccagttctacctggacaggaagcagagcaaggccaagatccccagcgcccggagcctggatgagatcgccatggacctgacagaaacaggcacccagagggccagcaagctggtgaccctggagaccaagagccagttcatcatggccagcaatggcagcctcatcagcagcggcagccaggacagcgaggtgtctgaggagcagaagcgggagaagatcctggagctgaagaagaaggagaagctgctgcaggagaagctgctgaagaaggtggaggagctgaagaagatctgcctgcgggaggccgagctgaccgggaagatgcccaaggagtaccccctgaacatcggggagaagccaccccaggtgagaagaagagtgggcacagccttcaagctggatgacaacctgctgcccagcgaggaggaccctgccctgcaggagctggagagcaacttcctgatccagcagaagctggtggaggccgccaagaagctggccaatgaaccagacctgtgcaagacagtgaagaagaagaggaagcaggactacacagatgccatgaagaagctgcaggagattgaaaatgccatcaatgagtaccgcatccgctgtgggaagaagcccagccagaaggccaccgtgctgcctgaggacatcatccccagcgagagcagcagcctgagtgacaccaccacctatgatgaccccagtgatgccttcaccttccctggccagaggagcagctctgtgccccacagcccccgcatcctgccccccaagagcctgggcatcgagcgcatccacttcaggaagagcagcatcaatgagcagtttgtggacacccggcagagccgggagatgctgagcacccacagcagcccctacaagaccctggagcggcggccccagggcggccgctccatgcccaccacccctgtgctgaccagaaatgcctacagcagcagccacctggagcctgagagcagcagccagcactgccggcagaggagcggcagcctggagagccagagccacctgctgtctgagatggacagcgacaagcccttcttcagcctgagcaagagccagaggagcagcagcacagagatcctggatgatggcagcagctacaccagccagagcagcacagagtactactgtgtgacccctgtgacaggcccctactacaccacccagaccctggacaccaggacccggggcagaagaagaagcaagaagcagaatgtgtccaccagcaacagcggctccatgcccaacctggcccagaaggacagcctgagaaatggagtgtacagcaagagccaggagccccccagcagcagctactacatcgccggctacaccccctatgcagaatgtgacttctactacagcggcggctacgtgtatgaaaatgacacagagggccagtacagcgtgaaccccagctaccgcagcagcgcccactacggctatgagcggcagagggactacagccgctccttccatgaagatgaggtggacagagtgccccacaacccctatgccaccctgcggctgcccaggaaggccgccgccaagtctgagcacatcaccaagaacatccacaaggccctggtggccgagcacctgcggggctggtaccagagggccagcggccagaaggaccagggccacagcccccagaccagctttgacagcgaccggggcagccagcgctgcctgggctttgctggcctgcaggtgccctgcagccccagcagccgggccagcagctacagctctgtgagcagcaccaatgccagcggcaactggaggacccagctgaccatcggcctgagtgactatgagaccccagcccacagcagctacaccagctgctatggaaatgtgtacaaccccctgcccagccccagccggcagtacacagagatcagccagctggatggaacagatggcaaccagctggaggacaacctggagagcagcgagcagaggctcttctggcatgaggacagcaagccaggcaccctggtgtag

SEQ ID NO: 21812 - DNA, 219 bp, Artificial Sequence
  Description of Artificial Sequence: Synthetic coding sequence
atgatggaggagatcagcatcatggtggcctatgatgcccacgtgttcagccagctgcatgatgaggacttcctgaccagcctggtggccatcagcaagcccaggtccatggtgcccaccaagaagctgaagaagtatgagaaggagtaccagaccatgagggagagccagctgcagcaggaggaccccatggaccgctacaagtttgtgtacctgtag

SEQ ID NO: 21813 - DNA, 1965 bp, Artificial Sequence
  Description of Artificial Sequence: Synthetic coding sequence
atggacagcctgcctgatgagttctttgtgcgccaccctgctgtggaggaccagaggaaggaggagacagagaacaagctggagaagagcagcggccagctgaacaagcaggagaatgacatccccacagacctggtgcctgtgaacctgctgctggaggtgaagaagctgctgaatgccatcaacaccctgcccaagggcgtggtgccccacatcaagaagttcctgcaggaggacttctccttccagaccatgcagcgggaggtggccgccaacagccagaatggagaggagatcgtgcctgccctgaccctgcgcttcctgatcacccagctggaggccgccctgaggaacatccaggccggcaactacacagcccaccagatcaacatcggctactacctgaccctgctcttcctgtatggagtggccctgacagagcggggcaagaaggaggactacacagaagctgagaacaagttcctggtgatgaagatgatgatccaggagaatgagatctgtgagaacttcatgagcctggtgtacttcggccggggcctgctgcgctgtgcccagaagcgctacaacggcggcctgctggagttccacaagagcctgcaggagattggagacaagaatgaccactggtttgatattgaccccacagaagatgaggacctgcccaccaccttcaaggacctgctgaacaacttcatcaagaccacagagagcaacatcatgaagcagaccatctgcagctacctggactgtgagaggagctgtgaggccgacatcctgaagaacaccagctacaagggcttcttccagctgatgtgcagcaagagctgctgcgtgtacttccacaagatctgctggaagaagttcaagaacctgaagtacccaggagaaaatgaccagagcttcagcggcaagaagtgcctgaaggagggctgcacaggagacatggtgaggatgctgcagtgtgatgtgcccggcatcgtgaagatcctgtttgaggtggtgaggaaggatgagtacatcaccatcgagaacctgggcgccagctacaggaagctgatcagcctgaagatcacagacacagacatccggcccaagatcagcctgaagttcaacaccaaggatgagatgcccatcttcaagctggactacaactacttctaccacctgctgcacatcatcatcatctctggaacagacatcgtgcggcagatctttgatgaggccatgcccccacccctgctgaagaaggagctgctgatccacaagaatgtgctggagagctactacaaccacctgtggaccaaccaccccctgggcggctcctggcacctgctgtacccacccaacaaggagctgccccagagcaagcagtttgacctgtgcctgctgctggccctgatcaagcacctgaatgtgtttcctgcccccaagaagggctggaacatggagccccccagcagtgacatcagcaagtctgctgacatcctgcggctgtgcaagtacagagacatcctgctgtctgagatcctgatgaatggcctgacagagagccagttcaacagcatctggaagaaggtgtctgacatcctgctgcggctgggcatgatgcaggaggacatcgacaaggtgaaggagaaccccatcgagaacatcagcctggactaccaccagctgtctgtgtacctgggcatccctgtgcctgagatcatccagaggatgctgagctgctaccagcagggcatcgccctgcagagcatcaccggcagccagagaattgaaattgaggagctgcagaatgaggaggaggagctgagcccccccctgatggagtacaacatcaacgtgaagagccaccctgagatccagtttgctgagatcaacaaggatggcaccagcatccccagcgagagcagcacagagagcctgaaggacctgcaggagtag

SEQ ID NO: 21814 - DNA, 570 bp, Artificial Sequence
  Description of Artificial Sequence: Synthetic coding sequence
atgaacccagccagcgcccccccacccctgcccccacctggccagcaggtgattcatgtgacccaggacctggacacagacctggaggccctcttcaacagcgtgatgaaccccaagcccagctcctggaggaagaagatcctgcctgagagcttcttcaaggagccagacagcggcagccacagccggcagagcagcacagacagcagcggcggccaccctggcccccggctggccggcggggcccagcacgtgcgcagccacagcagccctgccagcctgcagctgggcaccggggccggggctgctggcagccctgcccagcagcacgcccacctgcggcagcagagctatgatgtgacagatgagctgcccctgcccccaggctgggagatgaccttcaccgccaccggccagcgctacttcctgaaccacatcgagaagatcaccacctggcaggaccccaggaaggccatgaaccagcccctgaaccacatgaacctgcaccctgctgtgagcagcacccctgtgccccagaggtccatggctgtgtcccagcccaacctgtag

SEQ ID NO: 21815 - DNA, 849 bp, Artificial Sequence
  Description of Artificial Sequence: Synthetic coding sequence
atgggccccctgcccaggacagtggagctgttctatgatgtgctgagcccctacagctggctgggctttgagatcctgtgccgctaccagaacatctggaacatcaacctgcagctgcggcccagcctcatcaccggcatcatgaaggacagcggcaacaagcccccaggcctgctgcccaggaagggcctgtacatggccaatgacctgaagctgctgcggcaccacctgcagatccccatccacttccccaaggacttcctgtctgtgatgctggagaagggcagcctgagcgccatgaggttcctgacagctgtgaacctggagcaccctgagatgctggagaaggccagccgggagctgtggatgagggtgtggagccgggtgtctgtgggcctgtgggagagcagcggccgcaccctggatgacttcctgaccttccccaggcatgtgttccgggtgatgatcctgcccccacctgggggcagcacagtgctgcctgtgacccccctgagcccccaccggctgcctgctgtgttcagcagcagccagaatgaagacatcacagagccccagagcatcctggccgctgctgagaaggccggcatgtctgctgagcaggcccagggcctgctggagaagatcgccacccccaaggtgaagaaccagctgaaggagaccacagaggccgcctgccgctacggggccttcggcctgcccatcaccgtggcccacgtggatggccagacccacatgctgtttggaagtgacaggatggagctgctggcccacctgctgggggagaagtggatgggccccatccccccagctgtgaatgcccggctgtag

SEQ ID NO: 21816 - DNA, 1221 bp, Artificial Sequence
  Description of Artificial Sequence: Synthetic coding sequence
atggaccagctggagaatgccaagatggagcacaccaatgccagctttgacaccttcttctgtgagaccagggctgggaagcacgtgccccgggccctgtttgtggacctggagcccaccgtgattgatggcatcagaacaggccagcacaggagcctcttccaccctgagcagctgctgagcggcaaggaggatgctgccaacaactatgcccggggccgctacagcgtgggcagcgaggtgattgacctggtgctggagaggaccaggaagctggccgagcagtgtggcggcctgcagggcttcctgatcttccgcagctttggaggcggcaccggcagcggcttcaccagcctgctgatggagcggctgactggagagtacagcaggaagaccaagctggagttctctgtgtacccagccccccgcatcagcacagctgtggtggagccctacaacagcgtgctgaccacccacagcaccacagagcacacagactgcaccttcatggtggacaatgaagctgtgtatgacatctgccacaggaagctgggcgtggagtgccccagccacgccagcatcaaccggctggtggtgcaggtggtgagcagcatcacagccagcctgcgctttgagggccccctgaatgtggacctgattgagttccagaccaacctggtgccctacccccgcatccacttccccatgacagcctttgcccccatcgtgtctgctgacaaggcctaccacgagcagttctctgtgtctgacatcaccacagcctgctttgagagcagcaaccagctggtgaagtgtgacccccggctgggcaagtacatggcctgctgcctgctgtacagaggagatgtggtgcccaaggaggtgaatgctgccatcgccgccaccaagagccgccacagcgtgcagtttgtggactggtgccccaccggcttcaaggtgggcatcaacaaccggccccccaccgtgatgcctggaggagacctggccaaggtgcacaggagcatctgcatgctgagcaacaccacagccatcgtggaggcctgggcccggctggaccacaagtttgacctgatgtatgccaagagggccttcctgcactggtacctgcgggagggcatggaggaggccgagttcctggaggcccgggaggacctggccgccctggagcgggactatgaggaggtggcccagagcttctag

SEQ ID NO: 21817 - DNA, 1860 bp, Artificial Sequence; identical to SEQ ID NO: 19352
  Description of Artificial Sequence: Synthetic coding sequence

SEQ ID NO: 21818 - DNA, 294 bp, Artificial Sequence; identical to SEQ ID NO: 21555
  Description of Artificial Sequence: Synthetic coding sequence

SEQ ID NO: 21819 - DNA, 387 bp, Artificial Sequence
  Description of Artificial Sequence: Synthetic coding sequence
atgacagacctggtggccgtgtgggatgtggccctgagtgatggagtgcacaagattgaatttgaacatggcaccaccagcggcaagagggtggtgtatgtggatggcaaggaggagatcaggaaggagtggatgttcaagctggtgggcaaggagaccttctacgtgggcgccgccaagaccaaggccaccatcaacattgatgccatcagcggctttgcctatgagtacaccctggagatcaacgggaagagcctgaagaagtacatggaggacaggagcaagaccaccaacacctgggtgctgcacatggatggagagaacttcagaattgtgctggagaaggatgccatggatgtgtggtgcaatggcaagaagctggagtag

SEQ ID NO: 21820 - DNA, 879 bp, Artificial Sequence
  Description of Artificial Sequence: Synthetic coding sequence
atgacagtgtccaagttcatggccatccagaaggccctgcagcctgactggttccagtgcctgagtgatggagaggtgtcctgcaaggaggccaccagcatcaagagggtgaggaagtctgtggacaggagcctgctcttcctggacaactgcctgcggctgcaggaggagagcgaggtgctgcagaagagcgtcatcattggagtcatcgagggcggagatgtgatggaggagcggctgcggagcgcccgggagacagccaagaggcctgtgggcggcttcctgctggatggcttccagggcaaccccaccaccctggaggcccggctgcggctgctgagctctgtgacagctgagctgcctgaggacaagcccaggctcatctctggagtgtccaggccagatgaggtgctggagtgcatcgagcggggcgtggacctgtttgagagcttcttcccctaccaggtgacagagcggggctgtgccctgaccttctcctttgactaccagcccaaccctgaggagaccctgctgcagcagaatggcacccaggaggagatcaagtgcatggaccagatcaagaagattgagaccaccggctgcaaccaggagatcaccagctttgagatcaacctgaaggagaagaagtaccaggaggacttcaaccccctggtgcggggctgcagctgctactgctgcaagaaccacacccgggcctacatccaccacctgctggtgaccaatgagctgctggccggcgtgctgctgatgatgcacaactttgagcactacttcggcttcttccactacatccgggaggccctgaagagtgacaagctggcccagctgaaggagctgatccaccggcaggccagctag

SEQ ID NO: 21821 - DNA, 600 bp, Artificial Sequence; identical to SEQ ID NO: 18542
  Description of Artificial Sequence: Synthetic coding sequence

SEQ ID NO: 21822 - DNA, 354 bp, Artificial Sequence
  Description of Artificial Sequence: Synthetic coding sequence
atgcctgaggaccaggtgggcaagctggaggccacagagaacaccatcagcgccatggctgctgctgctgctgagcagcagcagttctacctgctgctgggcaacctgctgagcccagacaacgtggtgaggaagcaggccgaggagacctatgagaacatccctggccagagcaagatcaccttcctgctgcaggccatccggaacaccacagctgctgaggaggcccggcagatggctgctgtgctgctgcggcggctgctgagcagcgcctttgatgaggtgtacccagccctgcccagtgatgtgcagacagccatcaagtctgagctgctgatgatcatccagatgtag

SEQ ID NO: 21823 - DNA, 888 bp, Artificial Sequence
  Description of Artificial Sequence: Synthetic coding sequence
tgaaccaagctggccaccggcagcaaggacaccaccgtcatcatctggcaggtggaccctgacacccacctgctgaagctgctgaagaccctggagggccacgcctacggcgtgtcctacatcgcctggagcccagatgacaactacctggtggcctgtggcccagatgactgcagcgagctgtggctgtggaatgtgcagacaggagagctgcggaccaagatgagccagagccatgaggacagcctgacctctgtggcctggaacccagatggcaagagatttgtgactggaggccagaggggccagttctaccagtgtgacctggatggcaacctgctggacagctgggagggcgtgcgggtgcagtgcctgtggtgcctgagtgatggcaagacagtgctggccagtgacacccaccagaggatccggggctacaactttgaggacctgacagacaggaacatcgtgcaggaggaccaccccatcatgtccttcaccatcagcaagaatggccgcctggccctgctgaatgtggccacccagggcgtgcacctgtgggacctgcaggacagagtgctggtgaggaagtaccagggcgtgacccagggcttctacaccatccacagctgcttcggcggccacaatgaagacttcatcgccagcggcagcgaggaccacaaggtgtacatctggcacaagaggtctgagctgcccatcgccgagctgaccggccacaccaggacagtgaactgtgtgtcctggaacccccagatccccagcatgatggccagcgccagtgatgatggcaccgtgcgcatctggggccctgcccccttcatcgaccaccagaacatcgaggaggagtgcagctccatggacagctag

SEQ ID NO: 21824 - DNA, 1053 bp, Artificial Sequence
  Description of Artificial Sequence: Synthetic coding sequence
atggcccgctggatccccaccaagaggcagaagtatggagtggccatctacaactacaatgccagccaggatgtggagctgagcctgcagattggagacacagtgcacatcctggagatgtatgagggctggtaccggggctacaccctgcagaacaagagcaagaagggcatcttccctgagacctacatccacctgaaggaggccaccgtggaggacctgggccagcatgaaacagtcatccctggagagctgcccctggtgcaggagctgaccagcaccctgcgggagtgggccgtcatctggaggaagctgtatgtgaacaacaagctgaccctcttccggcagctgcagcagatgacctacagcctgattgagtggaggagccagatcctgagcggcaccctgcccaaggatgagctggccgagctgaagaagaaggtgacagccaagattgaccacggcaacaggatgctgggcctggacctggtggtgagagatgacaatggaaacatcctggaccctgatgagaccagcaccatcgccctcttcaaggcccacgaggtggccagcaagagaattgaggagaagatccaggaggagaagagcatcctgcagaacctggacctgcggggccagagcatcttcagcaccatccacacctacggcctgtatgtgaacttcaagaactttgtgtgcaacattggagaagatgctgagctgttcatggccctgtatgaccctgaccagagcaccttcatcagcgagaactacctgatccgctggggcagcaatggcatgcccaaggagattgagaagctgaacaacctgcaggccgtgttcacagacctgagctccatggacctgatccggccccgggtgtccctggtgtgccagatcgtgcgggtgggccacatggagctgaaggagggcaagaagcacacctgtggcctgcggcggcccttcggcgtggccgtgatggacatcacagacatcatccacggcaaggtggatgatgaggagaagcagcacttcatccccttccagcagtag

SEQ ID NO: 21825 - DNA, 360 bp, Artificial Sequence
  Description of Artificial Sequence: Synthetic coding sequence
atgcctgaggaccaggtgggcaagctggaggccacagagaacaccatcagcgccatggctgctgctgctgctgagcagcagcagttctacctgctgctgggcaacctgctgagcccagacaacgtggtgaggaagcaggccgaggagacctatgagaacatccctggccagagcaagatcaccttcctgctgcaggccatccggaacaccacagctgctgaggaggcccggcagatggctgctgtgctgctgcggcggctgctgagcagcgcctttgatgaggtgtacccagccctgcccagtgatgtgcagacagccatcaagtctgagctgctgatgatcatccagatggagacctag

SEQ ID NO: 21826 - DNA, 279 bp, Artificial Sequence
  Description of Artificial Sequence: Synthetic coding sequence
atgagcggcctggtgctgggccagagagatgagcctgctggccaccggctgagccaggaggagatcctgggcagcacccggctggtgtcccagggcctggaggccctgcggtctgagcaccaggccgtgctgcagagcctgagccagaccatcgagtgcctgcagcagggcggccacgaggagggcctggtgcatgagaaggcccggcagctgcggcgctccatggagaacatcgagctgggcctgtctgaggcccaggtgatgctggccctggcctag

SEQ ID NO: 21827 - DNA, 405 bp, Artificial Sequence
  Description of Artificial Sequence: Synthetic coding sequence
atggtgctgatcctgggccgccgcctgaaccgggaggacctgggcgtgcgggacagccctgccaccaagaggaaggtgtttgagatggaccccaagagcctgactggacatgagttctttgacttcagcagcggcagcagccatgctgagaacatcctgcagatcttcaatgagttccgggacagccgcctcttcacagatgtgatcatctgtgtggagggcaaggagttcccctgccacagagctgtgctgagcgcctgcagcagctacttccgggccatgttctgcaatgaccaccgggagagccgggagatgctggtggagatcaatggcatcctggccgaggccatggagtgcttcctgcagtatgtgtacaccgggaaggtgaagatcaccacagaatag

SEQ ID NO: 21828 - DNA, 312 bp, Artificial Sequence; identical to SEQ ID NO: 21772
  Description of Artificial Sequence: Synthetic coding sequence

SEQ ID NO: 21829 - DNA, 1923 bp, Artificial Sequence
  Description of Artificial Sequence: Synthetic coding sequence
atgggcagaagaagtggcctgctgggcctgcggcccggccctgagcctgtggccctggagagggtcatcaacaaggtgcacctgaaggccaaccacgtggtgaagagagatgtggatgagcacctgcgcatcaagacagtgtatgacaagtctgtggaggagctgctgcctgagaagaagaacctggtgaagaacaagctgttcccccaggccatctcctacctggagaagaccttccaggtgcggcggcctgctggcaccatcctgctgagccggcagtgtgccaccaaccagtacctgaggaaagaaaatgacccccaccgctactgcacaggagaatgtgccgcccacaccaagtgtggccctgtgattgtgcctgaggagcacctgcagcagtgccgggtgtaccggggcggcaagtggccccatggagctgtgggcgtgcctgaccaggagggcatcagtgatgctgactttgtgctgtatgtgggcgccctggccacagagcgctgcagccatgagaacatcatctcctatgctgcctactgccagcaggaggccaacatggaccggcccatcgccggctacgccaacctgtgccccaacatgatcagcacccagccccaggagtttgtgggcatgctgagcacagtgaagcatgaggtgatccacgccctgggcttctctgctggcctgtttgccttctaccatgacaaggatggcaaccccctgaccagcagatttgctgatggcctgccccccttcaactacagcctgggcctgtaccagtggagcgacaaggtggtgaggaaggtggagcggctgtgggatgtgcgggacaacaagatcgtgcgccacacagtgtacctgctggtgaccccccgggtggtggaggaggccaggaagcactttgactgccctgtgctggagggcatggagctggagaaccagggcggcgtgggcacagagctgaaccactgggagaagaggctgctggagaatgaggccatgacaggcagccacacccagaacagagtgctgagccgcatcaccctggccctgatggaggacaccggctggtacaaggccaactacagcatggccgagaagctggactggggccggggcatgggctgtgactttgtgaggaagagctgcaagttctggattgaccagcagaggcagaagaggcagatgctgagcccctactgtgacaccctgcggagcaaccccctgcagctgacctgccggcaggaccagagagctgtggccgtgtgcaacctgcagaagttccccaagcccctgccccaggagtaccagtactttgatgagctgagcggcatcccagctgaggacctgccctactacggcggctctgtggagattgctgactactgccccttcagccaggagttctcctggcacctgtctggagagtaccagaggagcagtgactgccgcatcctggagaaccagcctgagatcttcaagaactatggagctgagaagtatggcccccacagcgtgtgcctgatccagaagagcgcctttgtgatggagaagtgtgagaggaagctgagctacccagactggggcagcggctgctaccaggtgtcctgcagcccccagggcctgaaggtgtgggtgcaggacaccagctacctgtgcagcagagctggccaggtgctgcctgtgtccatccagatgaatggctggattcatgatggcaacctgctgtgccccagctgctgggacttctgtgagctgtgccccccagagacagaccccccagccaccaacctgacccgggccctgcccctggacctgtgcagctgcagcagcagcctggtggtgaccctgtggctgctgctgggcaacctcttccccctgctggccggcttcctgctgtgcatctggcactag

SEQ ID NO: 21830 - DNA, 783 bp, Artificial Sequence
  Description of Artificial Sequence: Synthetic coding sequence
atgaacctggacagtgatggcatggatgacatcatcagccaggagagcagcctggacatggagggcaactacaagaaggcccagaagaatgaaagagagagcatccggcagaagctggccctgggcagcttctttgatgatggccctggcatctacaccagctgcagcaagagcggcaagcccagcctgagcagccggctgcagagcggcatgaacctgcagatctgctttgtgaatgattctggcagtgacaaggacagtgatgctgatgacagcaagacagagaccagcctggacacccccctgagccccatgagcaagcagagcagcagctacagcgaccgggacaccacagaggaggagagcgagagcctggatgacatggacttcctgacccggcagaagaagctgcaggccgaggccaagatggccctggccatggccaagcccatggccaagatgcaggtggaggtggagaagcagaacaggaagaagagccctgtggccgacctgctgccccacatgccccacatcagcgagtgcctgatgaagaggagcctgaagcccacagacctgcgggacatgaccatcggccagctgcaggtgattgtgaatgacctgcacagccagatcgagagcctgaatgaggagctggtgcagctgctgctgatcagagatgagctgcacacagagcaggatgccatgctggtggacatcgaggacctgaccaggcatgctgagagccagcagaagcacatggccgagaagatgcctgccaagtag

SEQ ID NO: 21831 - DNA, 633 bp, Artificial Sequence; identical to SEQ ID NO: 19581
  Description of Artificial Sequence: Synthetic coding sequence

SEQ ID NO: 21832 - DNA, 381 bp, Artificial Sequence
  Description of Artificial Sequence: Synthetic coding sequence
atgaaccagaggagccacctgggcaccacctacctggacacagccaagggagctgtggagaccttcatgaagctgcgggcccgggaccctgccagcagaggagaccgctacatgctggtgacctttgaggagcccccctatgccatcaaggccggctggaaggaaaatcatgccaccttcatgaatgagctgaagaacctgcaggccgagggcctgaccaccctgggccagagcctgaggacagcctttgacctgctgaacctgaaccggctggtgactggaattgacaactacggccagggcaggaaccccttcttcctggagcccgccatcatcatcaccatcacagatggcagcaagctgaccaccaccagcggctag

SEQ ID NO: 21833 - DNA, 1188 bp, Artificial Sequence
  Description of Artificial Sequence: Synthetic coding sequence
atggccaatgaccccctggagggcttccacgaggtgaacctggccagccccaccagcccagacctgctgggcgtgtatgagagcggcacccaggagcagaccaccagccccagcgtcatctaccggccccaccccagcgccctgagctctgtgcccatccaggccaatgccctggatgtgtctgagctgcccacccagcctgtgtacagcagcccccggcggctgaactgtgccgagatcagcagcatctccttccacgtgacagatcctgccccctgcagcaccagcggcgtgacagctggcctgaccaagctgaccaccaggaaggacaactacaatgctgagcgggagttcctgcagggcgccaccatcacagaggcctgtgatggcagtgatgacatcttcggcctgagcacagacagcctgagccggctgcggagccccagcgtgctggaggtgcgggagaagggctatgaaaggctgaaggaggagctggccaaggcccagcgggagctgaagctgaaggatgaggagtgtgagcggctgagcaaggtgcgggaccagctgggccaggagctggaggagctgacagccagcctgtttgaggaggcccacaagatggtgcgggaggccaacatcaagcaggccacagctgagaagcagctgaaggaggcccagggcaagattgatgtgctgcaggccgaggtggccgccctgaagaccctggtgctgagcagcagccccaccagccccacccaggagcccctgcccggcggcaagacccccttcaagaagggccacaccaggaacaagagcaccagcagcgccatgagcggcagccaccaggacctgagcgtcatccagcccatcgtgaaggactgcaaggaggccgacctgagcctgtacaatgagttccggctgtggaaggatgagcccaccatggacaggacctgccccttcctggacaagatctaccaggaggacatcttcccctgcctgaccttcagcaagtctgagctggccagcgctgtgctggaggccgtggagaacaacaccctgagcattgagcctgtgggcctgcagcccatccgctttgtgaaggccagcgctgtggagtgtggcggccccaagagcctgctgtatgtgaccttcctgcacacctttgacaccttcagccgggacagctag

SEQ ID NO: 21834 - DNA, 786 bp, Artificial Sequence; identical to SEQ ID NO: 19275
  Description of Artificial Sequence: Synthetic coding sequence

SEQ ID NO: 21835 - DNA, 1284 bp, Artificial Sequence
  Description of Artificial Sequence: Synthetic coding sequence
atggtgtgctggcaggacctggaggagagcctgaggatgaagctgagcctgaccaaggtggtgaatggctgccgcctgggcaagatcaagaacctgggcaagacaggagaccacaccatggacatccctggctgcctgctgtacaccaagacaggcagcgccccccacctgacccaccacaccctgcacaacatccacggcgtgcctgccatggcccagctgaccctgagcagcctggccgagcaccacgaggtgctgacagagtacaaggagggcgtgggcaagttcatcggcatgcctgagagcctgctgtactgcagcctgcatgaccctgtgagcccctgcccagctggctacgtgaccaacaagtctgtgtctgtgtggagcgtggccggccgggtggagatgacagtgtccaagttcatggccatccagaaggccctgcagcctgactggttccagtgcctgagtgatggagaggtgtcctgcaaggaggccaccagcatcaagagggtgaggaagtctgtggacaggagcctgctcttcctggacaactgcctgcggctgcaggaggagagcgaggtgctgcagaagagcgtcatcatcggcgtgattgaaggaggagatgtgatggaggagcggctgcggagcgcccgggagacagccaagaggcctgtgggcggcttcctgctggatggcttccagggcaaccccaccaccctggaggcccggctgcggctgctgagctctgtgacagctgagctgcctgaggacaagcccaggctcatcagcggcgtgtccaggccagatgaggtgctggagtgcatcgagcggggcgtggacctgtttgagagcttcttcccctaccaggtgacagagcggggctgtgccctgaccttctcctttgactaccagcccaaccctgaggagaccctgctgcagcagaatggcacccaggaggagatcaagtgcatggaccagatcaagaagattgagaccaccggctgcaaccaggagatcaccagctttgagatcaacctgaaggagaagaagtaccaggaggacttcaaccccctggtgcggggctgcagctgctactgctgcaagaaccacacccgggcctacatccaccacctgctggtgaccaatgagctgctggccggcgtgctgctgatgatgcacaactttgagcactacttcggcttcttccactacatccgggaggccctgaagagtgacaagctggcccagctgaaggagctgatccaccggcaggccagctag

SEQ ID NO: 21836 - DNA, 393 bp, Artificial Sequence
  Description of Artificial Sequence: Synthetic coding sequence
atgaaccagaggagccacctgggcaccacctacctggacacagccaagggagctgtggagaccttcatgaagctgcgggcccgggaccctgccagcagaggagaccgctacatgctggtgacctttgaggagcccccctatgccatcaaggccggctggaaggaaaatcatgccaccttcatgaatgagctgaagaacctgcaggccgagggcctgaccaccctgggccagagcctgaggacagcctttgacctgctgaacctgaaccggctggtgactggaattgacaactacggccagggcaggaaccccttcttcctggagcccgccatcatcatcaccatcacagatggcagcaagctgaccaccaccagcggcgtgcaggatgaatag

SEQ ID NO: 21837 - DNA, 417 bp, Artificial Sequence
  Description of Artificial Sequence: Synthetic coding sequence
atgaacccagccagcgcccccccacccctgcccccacctggccagcaggtgattcatgtgacccaggacctggacacagacctggaggccctcttcaacagcgtgatgaaccccaagcccagctcctggaggaagaagatcctgcctgagagcttcttcaaggagccagacagcggcagccacagccggcagagcagcacagacagcagcggcggccaccctggcccccggctggccggcggggcccagcacgtgcgcagccacagcagccctgccagcctgcagctgggcaccggggccggggctgctggcagccctgcccagcagcacgcccacctgcggcagcagagctatgatgtgacagatgagctgcccctgcccccaggctgggagatgaccttcaccgccactggatag

SEQ ID NO: 21838 - DNA, 1692 bp, Artificial Sequence
  Description of Artificial Sequence: Synthetic coding sequence
atgaggctggaggagctgaagaggctgcagaaccccctggagcaggtgaatgatggcaagtacagctttgagaaccaccagctggccatggatgctgagaacaacatcgagaagtaccccctgaacctgcagcccctggagagcaaggtgaagatcatccagagggcctggagggagtacctgcagaggcaggagcccctgggcaagaggagccccagcccccccagcgtgtcctctgagaagctgagcagctctgtgtccatgaacaccttcagtgacagcagcaccccagactacagagaagatggcatggacctgggcagtgatgctggcagcagcagcagcagcagccgggccagcagccagagcaacagcaccaaggtgaccccctgcagcgagtgcaagagcagcagcagccctgggggcagcctggacctggtgtctgccctggaggactatgaggagcccttccctgtgtaccagaagaaggtgattgatgagtgggcccctgaggaggatggagaggaggaggaggaggaggatgagcgggaccagaggggctacagagatgacaggagccctgcccgggagcctggagatgtgtctgcccggaccaggtctgggggcggcggcggccgcagcgccaccacagccatgcctcctcctgtgcccaatggaaacctgcaccagcacgacccccaggacctgcggcacaatggaaatgtggtggtggccggccggcccagctgcagccggggcccccggcgggccatccagaagccccagcctgctgggggcagaagaagtggccggggccctgctgctgggggcctgtgcctgcagcccccagatggcggcacctgtgtgcctgaggagccccctgtgccccccatggactgggaggccctggagaagcacctggccggcctgcagttccgggagcaggaggtgaggaaccagggccaggcccggaccaacagcaccagcgcccagaagaatgaaagagagagcatccggcagaagctggccctgggcagcttctttgatgatggccctggcatctacaccagctgcagcaagagcggcaagcccagcctgagcagccggctgcagagcggcatgaacctgcagatctgctttgtgaatgacagcggcagtgacaaggacagtgatgctgatgacagcaagacagagaccagcctggacacccccctgagccccatgagcaagcagagcagcagctacagcgaccgggacaccacagaggaggagagcgagagcctggatgacatggacttcctgacccggcagaagaagctgcaggccgaggccaagatggccctggccatggccaagcccatggccaagatgcaggtggaggtggagaagcagaacaggaagaagagccctgtggccgacctgctgccccacatgccccacatcagtgaatgtctgatgaagaggagcctgaagcccacagacctgcgggacatgaccatcggccagctgcaggtgattgtgaatgacctgcacagccagatcgagagcctgaatgaggagctggtgcagctgctgctgatcagagatgagctgcacacagagcaggatgccatgctggtggacatcgaggacctgaccaggcatgctgagagccagcagaagcacatggccgagaagatgcctgccaagtag

SEQ ID NO: 21839 - DNA, 228 bp, Artificial Sequence
  Description of Artificial Sequence: Synthetic coding sequence
atgcctgaggaccaggtgggcaagctggaggccacagagaacaccatcagcgccatggctgctgctgctgctgagcagcagcagttctacctgctgctgggcaacctgctgagcccagacaacgtggtgaggaagcaggccgaggagacctatgagaacatccctggccagagcaagatcaccttcctgctgcaggccatccggaacaccacagctgctgaggagtag

SEQ ID NO: 21840 - DNA, 2712 bp, Artificial Sequence; identical to SEQ ID NO: 19194
  Description of Artificial Sequence: Synthetic coding sequence

SEQ ID NO: 21841 - DNA, 522 bp, Artificial Sequence
  Description of Artificial Sequence: Synthetic coding sequence
atgcccaggaagggcacccagcccagcacagccaggagaagagaggagggccccccaccacccagcccagatggagccagcagtgatgctgagcctgagccccccagcggccgcacagagagccctgccacagctgctgagacagccagcgaggagctggacaacagaagcctggaggagatcctgaacagcatccccccacctcctcctccagccatgaccaatgaagctggggccccccggctgatgatcacccacatcgtgaaccagaacttcaagagctatgctggggagaagatcctgggccccttccacaagcgcttcagctgcatcatcggccccaatggaagtggcaagagcaatgtgattgacagcatgctgtttgtgtttggctaccgggcccagaagatccgcagcaagaagctgtctgtgctgatccacaacagtgatgagcacaaggacatccagagctgcaccgtggaggtgcacttccagaagatcatcgacaaggagggggactag

SEQ ID NO: 21842 - DNA, 2262 bp, Artificial Sequence
  Description of Artificial Sequence: Synthetic coding sequence
atgtacagccccatcatctaccaggccctgtgtgaacatgtgcagacccagatgagcctgatgaatgacctgaccagcaagaacatccccaacggcatcccagctgtgccctgccacgcccccagccacagcgagagccaggccaccccccacagcagctatggcctgtgcaccagcacccctgtgtggagcctgcagaggcctccctgcccccccaaggtgcacagcgaggtgcagacagatggcaacagccagtttgccagccagggcaagacagtgtctgccacctgcacagatgtgctgaggaacagcttcaacaccagccctggggtgccctgcagcctgcccaagacagacatcagcgccatccccaccctgcagcagctgggcctggtgaatggcatcctgccccagcagggcatccacaaggagacagacctgctgaagtgcatccagacctacctgagcctcttccgcagccacggcaaggagacccacctggacagccagacccacaggagccccacccagagccagcctgccttcctggccaccaatgaggagaagtgtgcccgggagcagatccgggaggccaccagcgagaggaaggacctgaacatccacgtgcgggacaccaagacagtgaaggatgtgcagaaggccaagaatgtgaacaagacagctgagaaggtgcgcatcatcaagtacctgctgggggagctgaaggccctggtggccgagcaggaggacagcgagatccagaggctcatcacagagatggaggcctgcatctctgtgctgcccaccgtgtctggcaacacagacatccaggtggagatcgccctggccatgcagcccctgcggagtgaaaatgcccagctgcggcggcagctgcgcatcctgaaccagcagctgcgggagcagcagaagacccagaagcccagcggggctgtggactgcaacctggagctgttcagcctgcagagcctgaacatgagcctgcagaaccagctggaggagagcctgaagagccaggagctgctgcagagcaagaatgaggagctgctgaaggtgattgagaaccagaaggatgagaacaagaagttcagcagcatcttcaaggacaaggaccagaccatcctggagaacaagcagcagtatgacatcgagatcacccgcatcaagattgagctggaggaggccctggtgaatgtgaagagcagccagttcaagctggagacagctgagaaggagaaccagatcctgggcatcaccctgcggcagagagatgctgaggtgacccggctgcgggagctgaccaggaccctgcagacctccatggccaagctgctgagtgacctgtctgtggacagcgcccgctgcaagccaggcaacaacctgaccaagagcctgctgaacatccatgacaagcagctgcagcacgaccctgccccagcccacaccagcatcatgagctacctgaacaagctggagaccaactacagcttcacccacagcgagcccctgagcaccatcaagaatgaggagaccatcgagccagacaagacctatgaaaatgtgctgagcagccggggcccccagaacagcaacacccggggcatggaggaggccagcgcccctggcatcatcagcgccctgagcaagcaggacagtgatgagggcagcgagaccatggccctgattgaagatgagcacaacctggacaacaccatctacatcccctttgcccggagcaccccagagaagaagagccccctgagcaagaggctgagcccccagccccagatccgggccgccaccacccagctggtgagcaacagcggcctggccgtgtctgggaaggagaacaagctgtgcacccctgtgatctgcagcagcagcaccaaggaggctgaagatgcccctgagaagctgagccgggccagtgacatgaaggacacccagctgctgaagaagatcaaggaggccatcggcaagatcccagctgccaccaaggagcctgaggagcagacagcctgccacggccccagcggctgcctgagcaacagcctgcaggtgaagggcaacacagtgtgtgatggcagcgtcttcaccagtgacctgatgtctgactggagcatcagcagcttcagcaccttcaccagcagagatgagcaggacttcagaaatggcctggccgccctggatgccaacatcgcccggctgcagaagagcctgaggacaggcctgctggagaagtag

SEQ ID NO: 21843 - DNA, 219 bp, Artificial Sequence; identical to SEQ ID NO: 21812
  Description of Artificial Sequence: Synthetic coding sequence

SEQ ID NO: 21844 - DNA, 588 bp, Artificial Sequence
  Description of Artificial Sequence: Synthetic coding sequence
atgtggcacatgaccaggaactggcccctggtgggcaagaccagcctcatcacccgcttcatgtatgacagctttgacaacacctaccaggccaccatcggcatcgacttcctgagcaagaccatgtacctggaggacagaacagtgcggctgcagctgtgggacacagctggccaggagcgcttccgcagcctcatccccagctacatccgggacagcacagtggccgtggtggtgtatgacatcaccaacctgaacagcttccagcagaccagcaagtggattgatgatgtgaggacagagcggggcagtgatgtgatcatcatgctggtgggcaacaagacagacctggccgacaagaggcagatcaccatcgaggagggggagcagagggccaaggagctgtctgtgatgttcatcgagaccagcgccaagacaggctacaacgtgaagcagctgttcagaagagtggccagcgccctgcccggcatggagaatgtgcaggagaagagcaaggagggcatgattgacatcaagctggacaagccccaggagcccccagccagcgagggcggctgcagctgctag

SEQ ID NO: 21845 - DNA, 1047 bp, Artificial Sequence; identical to SEQ ID NO: 20002
  Description of Artificial Sequence: Synthetic coding sequence

SEQ ID NO: 21846 - DNA, 2862 bp, Artificial Sequence
  Description of Artificial Sequence: Synthetic coding sequence
atgaagaggggcatccggcgggaccccttcaggaagaggaagctgggcggccgggccaagaaggtgcgggagcccacagctgtgaacagcttctaccgggaggccagcctgcccagcgtgtgggccagcctgcggcggcgggagatggtgcgcagcggggcccggcccggccaggtgctgagcagcggccgccacacaggccctgccaagctgaccaacgggaagaaggccacctacctgaggaagatcccccgcttcaatgctgacagcggctacagcatccacagcgacagcgagagccaggccgagaccgtgcacggcctggatggctgtgccagcctgctgcgggacatcctgagaaatgaagacagcggcagcgagacagcctacctggagaacagaagcaacagccggcccctggagagcaagagatatggcagcaagaagaagagacatgagaagcacaccatccccctggtggtgcagaaggagaccagcagcagtgacaacaagaagcagatccccaatgaggccagcgcccggtctgagcgggacaccagtgacctggagcagaactggagcctgcaggaccactacaggatgtacagccccatcatctaccaggccctgtgtgaacatgtgcagacccagatgagcctgatgaatgacctgaccagcaagaacatccccaacggcatcccagctgtgccctgccacgcccccagccacagcgagagccaggccaccccccacagcagctatggcctgtgcaccagcacccctgtgtggagcctgcagaggcctccctgcccccccaaggtgcacagcgaggtgcagacagatggcaacagccagtttgccagccagggcaagacagtgtctgccacctgcacagatgtgctgaggaacagcttcaacaccagccctggggtgccctgcagcctgcccaagacagacatcagcgccatccccaccctgcagcagctgggcctggtgaatggcatcctgccccagcagggcatccacaaggagacagacctgctgaagtgcatccagacctacctgagcctcttccgcagccacggcaaggagacccacctggacagccagacccacaggagccccacccagagccagcctgccttcctggccaccaatgaggagaagtgtgcccgggagcagatccgggaggccaccagcgagaggaaggacctgaacatccacgtgcgggacaccaagacagtgaaggatgtgcagaaggccaagaatgtgaacaagacagctgagaaggtgcgcatcatcaagtacctgctgggggagctgaaggccctggtggccgagcaggaggacagcgagatccagaggctcatcacagagatggaggcctgcatctctgtgctgcccaccgtgtctggcaacacagacatccaggtggagatcgccctggccatgcagcccctgcggagtgaaaatgcccagctgcggcggcagctgcgcatcctgaaccagcagctgcgggagcagcagaagacccagaagcccagcggggctgtggactgcaacctggagctgttcagcctgcagagcctgaacatgagcctgcagaaccagctggaggagagcctgaagagccaggagctgctgcagagcaagaatgaggagctgctgaaggtgattgagaaccagaaggatgagaacaagaagttcagcagcatcttcaaggacaaggaccagaccatcctggagaacaagcagcagtatgacatcgagatcacccgcatcaagattgagctggaggaggccctggtgaatgtgaagagcagccagttcaagctggagacagctgagaaggagaaccagatcctgggcatcaccctgcggcagagagatgctgaggtgacccggctgcgggagctgaccaggaccctgcagacctccatggccaagctgctgagtgacctgtctgtggacagcgcccgctgcaagccaggcaacaacctgaccaagagcctgctgaacatccatgacaagcagctgcagcacgaccctgccccagcccacaccagcatcatgagctacctgaacaagctggagaccaactacagcttcacccacagcgagcccctgagcaccatcaagaatgaggagaccatcgagccagacaagacctatgaaaatgtgctgagcagccggggcccccagaacagcaacacccggggcatggaggaggccagcgcccctggcatcatcagcgccctgagcaagcaggacagtgatgagggcagcgagaccatggccctgattgaagatgagcacaacctggacaacaccatctacatcccctttgcccggagcaccccagagaagaagagccccctgagcaagaggctgagcccccagccccagatccgggccgccaccacccagctggtgagcaacagcggcctggccgtgtctgggaaggagaacaagctgtgcacccctgtgatctgcagcagcagcaccaaggaggctgaagatgcccctgagaagctgagccgggccagtgacatgaaggacacccagctgctgaagaagatcaaggaggccatcggcaagatcccagctgccaccaaggagcctgaggagcagacagcctgccacggccccagcggctgcctgagcaacagcctgcaggtgaagggcaacacagtgtgtgatggcagcgtcttcaccagtgacctgatgtctgactggagcatcagcagcttcagcaccttcaccagcagagatgagcaggacttcagaaatggcctggccgccctggatgccaacatcgcccggctgcagaagagcctgaggacaggcctgctggagaagtag

SEQ ID NO: 21847 - DNA, 1683 bp, Artificial Sequence; identical to SEQ ID NO: 20948
  Description of Artificial Sequence: Synthetic coding sequence

SEQ ID NO: 21848 - DNA, 153 bp, Artificial Sequence
  Description of Artificial Sequence: Synthetic coding sequence
atgcctgaggaccaggtgggcaagctggaggccacagagaacaccatcagcgccatggctgctgctgctgctgagcagcagcagttctacctgctgctgggcaacctgctgagcccagacaacgtggtgaggaagcaggccgaggtgacctag

SEQ ID NO: 21849 - DNA, 288 bp, Artificial Sequence
  Description of Artificial Sequence: Synthetic coding sequence
atggccatcggcaagaggctggccaccctgcccaccaaggagcagaagacccagaggctcatcagcgagctgagcctgctgaaccacaagctgcctgcccgggtgtggctgcccacagctggctttgaccaccacgtggtgcgggtgccccacacccaggccgtggtgctgaacagcaaggacaaggccccctacctgatctacgtggaggtgctggagtgtgaaaattttgacaccacctctgtgcctgcccgcatccctgagaaccgcatccgcagcaccaggtag

SEQ ID NO: 21850 - DNA, 1260 bp, Artificial Sequence
  Description of Artificial Sequence: Synthetic coding sequence
atggccggcagcggctgtgcctggggcgctgagcccccacgcttcctggaggccttcggccgcctgtggcaggtgcagagccggctgggcagcggcagcagcgcctctgtgtacagagtgcgctgctgcggcaaccctggcagccccccaggggccctgaagcagttcctgcccccaggcaccaccggggctgctgccagcgctgctgaatatggcttcaggaaggagcgggccgccctggagcagctgcagggccacagaaatattgtgaccctgtatggagtcttcaccatccacttcagccccaacgtgcccagccgctgcctgctgctggagctgctggatgtgtctgtgtctgagctgctgctgtacagcagccaccagggctgcagcatgtggatgatccagcactgtgccagagatgtgctggaggccctggccttcctgcaccacgagggctacgtgcatgctgacctgaagcccaggaacatcctgtggagcgcagaaaatgaatgcttcaagctgattgactttggcctgtccttcaaggagggcaaccaggatgtgaagtacatccagacagatggctaccgggcccctgaggccgagctgcagaactgcctggcccaggccggcctgcagagcgacacagagtgcaccagcgctgtggacctgtggagcctgggcatcatcctgctggagatgttttctggcatgaagctgaagcacacagtgcgcagccaggagtggaaggccaacagcagcgccatcatcgaccacatctttgccagcaaggctgtggtgaatgctgccatcccagcctaccacctgcgggacctgatcaagtccatgctgcatgatgaccccagccgccgcatcccagctgagatggccctgtgcagccccttcttcagcatcccctttgccccccacatcgaggacctggtgatgctgcccacccctgtgctgcggctgctgaatgtgctggatgatgactacctggagaatgaggaggagtatgaagatgtggtggaggatgtgaaggaggagtgccagaagtatggccctgtggtgtccctgctggtgcccaaggaaaatcctggccggggccaggtgtttgtggagtatgccaatgctggggacagcaaggccgcccagaagctgctgaccggccgcatgtttgatggcaagtttgtggtggccaccttctaccccctgagcgcctacaagaggggctacctgtaccagaccctgctgtag

SEQ ID NO: 21851 - DNA, 1272 bp, Artificial Sequence
  Description of Artificial Sequence: Synthetic coding sequence
atgcccaggaagggcacccagcccagcacagccaggagaagagaggagggccccccaccacccagcccagatggagccagcagtgatgctgagcctgagccccccagcggccgcacagagagccctgccacagctgctgagacagccagcgaggagctggacaacagaagcctggaggagatcctgaacagcatccccccacctcctcctccagccatgaccaatgaagctggggccccccggctgatgatcacccacatcgtgaaccagaacttcaagagctatgctggggagaagatcctgggccccttccacaagcgcttcagctgcatcatcggccccaatggaagtggcaagagcaatgtgattgacagcatgctgtttgtgtttggctaccgggcccagaagatccgcagcaagaagctgtctgtgctgatccacaacagtgatgagcacaaggacatccagagctgcaccgtggaggtgcacttccagaagatcatcgacaaggagggagatgattatgaagtcatccccaacagcaacttctacgtgtccaggacagcctgccgggacaacacctctgtgtaccacatcagcggcaagaagaagaccttcaaggatgtgggcaacctgctgcggagccacggcatcgacctggaccacaaccgcttcctgatcctgcagggcgaggtggagcagatcgccatgatgaagcccaagggccagacagaacatgatgagggcatgctggagtacctggaggacatcatcggctgcggccgcctgaatgagcccatcaaggtgctgtgccggcgggtggagatcctgaatgagcacagaggagagaagctgaacagagtgaagatggtggagaaggagaaggatgccctggagggggagaagaacatcgccatcgagttcctgaccctggagaatgagatcttcaggaagaagaaccacgtgtgccagtactacatctatgagctgcagaagagaattgctgagatggagacccagaaggagaagatccacgaggacaccaaggagatcaatgagaagagcaacatcctgagcaatgagatgaaggccaagaacaaggatgtgaaggacacagagaagaagctgaacaagatcaccaagttcatcgaggagaacaaggagaagttcacccagctggacctggaggatgtgcaggtgcgggagaagctgaagcacgccaccagcaaggccaagaagctggagaagcagctgcagaaggacaaggagtag

SEQ ID NO: 21852 - DNA, 1113 bp, Artificial Sequence
  Description of Artificial Sequence: Synthetic coding sequence
atggaggagggcgtgccctgcccagccccagctgccaagctgaccccacctgtgaagaagagccaggacatgcatgatgagaggagcaagctggtgaatgaatatgcctgccgggtgctggagctgctgggcatgggccaccggctgtttgtgccccggctgctggccaccagcaaggaggacctgctgcaggccgactttgaaggagccctgaagttcttccgggtgcagctgcccaagcgctacagagctgaggagaatgcccggcggctgatggagcaggcctgcaacatcaaggtgcccaccaagaagctgaagaagtatgagaaggagtaccagaccatgagggagagccagctgcagcaggaggaccccatggaccgctacaagcgggagaacagaaggctgcaggaggcctccatgaggctggagcaggagaatgatgacctggcccacgagctggtgaccagcaagatcgccctgagaaatgacctggaccaggccgaggacaaggcagatgtgctgaacaaggagctgctgctgaccaagcagaggctggtggagacagaggaggagaagaggaagcaggaggaggagacagcccagctgaaggaggtgttcaggaagcagctggagaaggccgagtatgagatcaagaagaccacagccatcatcgccgagtacaagcagatctgcagccagctgagcacccggctggagaagcagcaggccgccagcaaggaggagctggaggtggtgaagggcaagatgatggcctgcaagcactgcagcgacatcttcagcaaggagggcgccctgaagctggccgccaccggccgggaggaccagggcattgaaacagatgatgagaaggacagcctgaagaagcagctgcgggagatggagctggagctggcccagaccaagctgcagctggtggaggccaagtgcaagatccaggagctggagcaccagagaggagccctgatgaatgagatccaggccgccaagaacagctggttcagcaagaccctgaacagcatcaagacagccaccggcacccagcccctgcagcctgcccctgtgacccagccccccaaggagagcacctag

SEQ ID NO: 21853 - DNA, 2262 bp, Artificial Sequence; identical to SEQ ID NO: 21842
  Description of Artificial Sequence: Synthetic coding sequence

SEQ ID NO: 21854 - DNA, 2067 bp, Artificial Sequence; identical to SEQ ID NO: 19474
  Description of Artificial Sequence: Synthetic coding sequence

SEQ ID NO: 21855 - DNA, 543 bp, Artificial Sequence
  Description of Artificial Sequence: Synthetic coding sequence
atgcccaggaagggcacccagcccagcacagccaggagaagagaggagggccccccaccacccagcccagatggagccagcagtgatgctgagcctgagccccccagcggccgcacagagagccctgccacagctgctgagacagccagcgaggagctggacaacagaagcctggaggagatcctgaacagcatccccccacctcctcctccagccatgaccaatgaagctggggccccccggctgatgatcacccacatcgtgaaccagaacttcaagagctatgctggggagaagatcctgggccccttccacaagcgcttcagctgcatcatcggccccaatggaagtggcaagagcaatgtgattgacagcatgctgtttgtgtttggctaccgggcccagaagatccgcagcaagaagctgtctgtgctgatccacaacagtgatgagcacaaggacatccagagctgcaccgtggaggtgcacttccagaagatcatcgacaaggagggagatgattatgaagtcatccccaactag

SEQ ID NO: 21856 - DNA, 4689 bp, Artificial Sequence
  Description of Artificial Sequence: Synthetic coding sequence
atgcctggagaggccgcccgggcagagctgctgctgcctgaggccgaccggcccggccccaggacagacctgagctgtgatgctgctgctgccaccaccatcctgggcggggacagaagagagccctgtgccctgaccccaggccccagccacctggccctgaccttcctgcccagcaagccaggggcccggccccagcctgagggcgcctcctgggatgctggccctgggggcgcccccagcgcctgggccgaccccggggagggcggccccagccccatgctgctgcctgagggcctgagcagccaggccctgagcacagaggcccccctgcctgccaccctggagcccagaattgtgatgggagaggagacctgccaggccctgctgagcccccgggccgccaggacagccctgcgggaccaggagggcggccacgccagcccagaccccccacctgagctgtgcagccagggcgacctgtctgtgcccagccccccaccagaccctgacagcttcttcaccccacccagcacccccaccaagaccacctacgccctgctgcctgcctgtggcccccatggagatgcccgggacagcgaggccgagctgagagatgagctgctggacagccccccagccagccccagcggcagctacatcacagcagatggagacagctgggccagcagccccagctgcagcctgagcctgctggccccagctgagggcctggacttccccagcggctggggcctgagcccccagggctccatggtggatgagcgggagctgcaccctgctggcaccccagagccccccagcagcgagagcagcctgtctgctgacagcagcagctcctggggccaggagggccacttctttgacctggacttcctggccaatgaccccatgatcccagctgccctgctgcccttccagggcagcctcatcttccaggtggaggccgtggaggtgacccccctgagccctgaggaggaggaggaggaggccgtggccgaccctgaccccggcggggacctggccggggagggggaggaggacagcaccagcgccagcttcctgcagagcctgagtgacctgagcatcacagagggcatggatgaggcctttgccttcagagatgacaccagcgctgccagcagtgacagcgacagcgccagctatgcagaggctgatgatgagcggctgtacagcggggagccccacgcccaggccaccctgctgcaggacagcgtgcagaagacagaggaggagagcggcggcggggccaagggcctgcaggcccaggacggcaccgtgtcctgggccgtggaggccgccccccagaccagtgacagaggagcctacctgagccagaggcaggagctgatcagcgaggtgacagaggagggcctggccctgggccaggagagcacagccaccgtgaccccccacaccctgcaggtggcccctggcctgcaggtggaggtggccaccagggtgaccccccaggccggggaggaggagacagacagcacagctggccaggagagcgctgccatggccatgccccagcccagccaggagggcatcagcgagatcctgggccaggagagcgtgacagctgagaagctgcccaccccccaggaggagaccagcctgaccctgtgcccagacagcccccagaacctgaaggaggagggcggcctggacctgcccagcggcaggaagcctgtggccgccgccaccatcgtgccccggcaggccaaggaggacctgaccctgccccaggacagcgccatgaccccacccctgcccctgcaggacacagacctgagcagcgcccccaagcctgtggccgccgccaccatcgtgtcccagcaggccgaggagggcctgaccctgccccaggacagcgtgatgaccccacccctgcccctgcaggacacagagctgagcagcgcccccaagcctgtggccgccgccaccctggtgtcccagcaggccgaggagggcctgaccctgccccaggacagcgccatgaccccacccctgcccctgcaggacacagacctgagcagcgcccccaagcctgtggccgccgccaccctggtgtcccagcaggccgaggagggcctgaccctgccccaggacagcgccatgaccccacccctgcccctgcaggacacagacctgagcagcgcccccaagcctgtggccgccgccaccctggtgtcccagcaggccgaggagggcctgaccctgccccaggacagcgccatgaccccacccctgcccctgcaggacacagacctgagcagcgcccccaagcctgtggccgccgccaccatcgtgtcccagcaggccgaggagggcctgaccctgccccaggacagcgccatgaccccacccctgcccctgcaggacacagacctgagcagcgcccccaagcctgtggccgccgccaccatcgtgtcccagcaggccgaggagggcctgaccctgccccaggacagcgccatgaccccacccctgcccctgcaggacacagacctgagcagcgcccccaagcctgtggccgccgccacccctgtgtcccagcaggccgaggagggcctgaccctgccccaggacagcgccatgaccccacccctgcccctgcaggacacagacctgagcagcgcccccaagcctgtggccgccgccacccctgtgtcccagcaggccgaggagggcctgaccctgccccaggacagcgccatgacagcccccctgcccctgcaggacaccggccccaccagcggccctgagcccctggccgtggccaccccccagaccctgcaggccgaggccggctgtgcccctggaacagagcctgtggccaccatggcccagcaggaggtgggggaggccctgggccccaggcctgcccctgaggagaagaatgctgccctgcccaccgtgcctgagcctgctgccctggaccaggtgcagcaggatgacccccagcctgctgctgaggccggcaccccctgggccgcccaggaggatgctgacagcaccctgggcatggaggccctgagcctgcctgagcccgccagcggggccggggaggagattgctgaggccctgagccggcccggccgggaggcctgcctggaggcccgggcccacactggagatggagccaagccagacagcccccagaaggagaccctggaggtggagaaccagcaggagggcggcctgaagcccctggcccaggagcacggccccaggtctgccctgggcggggcccgggaggtgcctgatgcccctcctgctgcctgcccagaggtgtcccaggcccggctgctgagccctgcccgggaggagcggggcctgagcggcaagagcaccccagagcccaccctgcccagcgctgtggccacagaggccagcctggacagctgcccagagagctctgtgggcgctgtgagcagcctggaccggggctgcccagatgccccagcccccaccagcgcccccaccagccagcagcctgagcctgtgctgggcctgggctctgtggagcagccccatgaggtgcccagcgtgctgggcacccccctgctgcagcccccagagaacctggccaagggccagcccagcacccctgtggaccggcccctgggccctgaccccagcgcccctggcaccctggccggggccgccctgccccccctggagcccccagccccctgcctgtgccaggacccccaggaggacagcgtggaggatgaggagcccccaggcagcctgggcctgcccccaccccaggccggcgtgcagcctgctgctgctgctgtgtctggcaccacccagcccctgggcaccggcccccgggtgtccctgagcccccacagccccctgctgagccccaaggtggcctccatggatgccaaggacctggccctgcagatcctgcccccctgccaggtgcccccacccagcggcccccagagccctgctggcccccagggcctgagcgcccctgagcagcaggaggatgaggacagcctggaggaggacagcccccgggccctgggcagcggccagcacagcgacagccacggggagagcagcgctgagctggatgagcaggacatcctggccccccagacagtgcagtgcccagcccaggccccagctgggggcagcgaggagaccatcgccaaggccaagcagagccgctctgagaagaaggccaggaaggccatgagcaagctgggcctgcggcagatccagggcgtgacccgcatcaccatccagaagagcaagaacatcctgtttgtgattgccaagccagatgtgttcaagagccctgccagtgacacctacgtggtgtttggagaggccaagattgaggacctgagccagcaggtgcacaaggctgctgctgagaagttcaaggtgcccagcgagcccagcgccctggtgcctgagagcgccccccggccccgggtgcggctggagtgcaaggaggaggaggaggaggaggaggaggaggtggatgaagctggcctggagctgcgggacatcgagctggtgatggcccaggccaacgtgtcccgggccaaggctgtgcgggccctgcgggacaaccacagcgacatcgtgaatgccatcatggagctgaccatgtag

SEQ ID NO: 21857 - DNA, 3294 bp, Artificial Sequence; identical to SEQ ID NO: 19486
  Description of Artificial Sequence: Synthetic coding sequence

SEQ ID NO: 21858 - DNA, 1011 bp, Artificial Sequence
  Description of Artificial Sequence: Synthetic coding sequence
atgaaggccacagccatgaccagcgcctggctggcccagggcggggcccacgtgaccatcaatgcccgggcagaggaggatgtggagcctgagtgcatcatggagaaggtggccaaggccagcggggccaactacagcttccacaaggagagcggccgcttccaggatgtgggcccccaggcccctgtgggctctgtgtaccagaagaccaatgctgtgtctgagatcaagagggtgggcaaggacagcttctgggccaaggccgagaaggaggaggagaacagaaggctggaggagaagagaagagctgaggaggcccagaggcagctggagcaggagcggcgggagcgggagctgcgggaggccgcccggcgggagcagcgctaccaggagcagggcggggaggccagcccccagagcaggacctgggagcagcagcaggaggtggtgtccaggaacagaaatgagcaggagagcgctgtgcacccccgggagatcttcaagcagaaggagcgggccatgagcaccaccagcatcagcagcccccagcccgggaagctgcggagccccttcctgcagaagcagctgacccagcctgagacccacttcggccgggagcctgctgctgccatcagccggcccagggctgacctgcctgctgaggagcccgcccccagcaccccaccctgcctggtgcaggccgaggaggaggccgtgtatgaggagcccccagagcaggagaccttctatgagcagccccccctggtgcagcagcagggcgccggcagcgagcacatcgaccaccacatccagggccagggcctgagcggccagggcctgtgtgcccgggccctgtatgactaccaggccgcagatgacacagagatcagctttgatcctgaaaatctcatcactggaattgaggtgattgatgagggctggtggaggggctacggcccagatggccacttcggcatgtttcctgccaactacgtggagctgattgaatag

SEQ ID NO: 21859 - DNA, 78 bp, Artificial Sequence
  Description of Artificial Sequence: Synthetic coding sequence
atgtggatgcacgtggccaaggtgcaccccaagggcggggagatggtgggcgccatcagaaatgctgccttcctgtag

SEQ ID NO: 21860 - DNA, 312 bp, Artificial Sequence; identical to SEQ ID NO: 21772
  Description of Artificial Sequence: Synthetic coding sequence

SEQ ID NO: 21861 - DNA, 4101 bp, Artificial Sequence
  Description of Artificial Sequence: Synthetic coding sequence
atggctgacacagacctcttcatggagtgtgaggaggaggagctggagccctggcagaagatcagtgatgtgattgaggacagcgtggtggaggactacaacagcgtggacaagaccaccacagctggcaaccccctggtgcagcagggcggccagcccctcatcctgacccagaacccagcccctggcctgggcaccatggtgacccagcctgtgctgcggcctgtgcaggtgatgcagaatgccaaccacgtgaccagcagccctgtggccagccagcccatcttcatcaccacccagggcttccctgtgagaaatgtgcggcctgtgcagaatgccatgaaccaggtgggcatcgtgctgaatgtgcagcagggccagacagtgcggcccatcaccctggtgcctgcccctggcacccagtttgtgaagcccaccgtgggcgtgccccaggtgttcagccagatgacccctgtgcggcccggcagcaccatgcctgtgcggcccaccaccaacaccttcaccaccgtcatcccagccaccctgaccatccgcagcacagtgccccagagccagagccagcagaccaagagcacccccagcaccagcaccacccccacagccacccagcccaccagcctgggccagctggccgtgcagagccctggccagagcaaccagaccaccaaccccaagctggcccccagcttccccagccccccagctgtgtccatcgccagctttgtgacagtgaagaggcctggggtgactggagagaacagcaatgaggtggccaagctggtgaacaccctgaacaccatccccagcctgggccagagccctggccctgtggtggtgagcaacaacagcagcgcccacggcagccagaggaccagcggccctgagagctccatgaaggtgaccagcagcatccctgtgtttgacctgcaggacggcggcaggaagatctgcccccgctgcaatgcccagttccgggtgacagaggccctgcggggccacatgtgctactgctgcccagagatggtggagtaccagaagaagggcaagagcctggacagcgagcccagcgtgcccagcgctgccaagccacccagccctgagaagacagcccctgtggccagcacccccagcagcacccccatcccagccctgagcccccccaccaaggtgcctgagcccaatgaaaatgtgggagatgctgtgcagaccaagctgatcatgctggtggatgacttctactacggcagagatggcggcaaggtggcccagctgaccaacttccccaaggtggccaccagcttccgctgcccccactgcaccaagaggctgaagaacaacatccgcttcatgaaccacatgaagcaccacgtggagctggaccagcagaatggagaggtggatggccacaccatctgccagcactgctaccggcagttcagcacccccttccagctgcagtgccacctggagaatgtgcacagcccctatgagagcaccaccaagtgcaagatctgtgagtgggcctttgagagcgagcccctcttcctgcagcacatgaaggacacccacaagccaggagagatgccctacgtgtgccagccctacttccccagctatgtgacccaggtgtgccagtaccgcagcagcctgtacagcgaggtggatgtgcacttcaggatgattcatgaggacaccaggcacctgctgtgcccctactgcctgaaggtgttcaagaatggaaatgccttccagcagcactacatgaggcaccagaagagaaatgtgtaccactgcaacaagtgccgcctgcagttcctgtttgccaaggacaagattgagcacaagctgcagcaccacaagaccttcaggaagcccaagcagctggagggcctgaagccaggcaccaaggtgaccatccgggccagccggggccagcccaggacagtgcctgtgagcagcaatgacaccccacccagcgccctgcaggaggccgcccccctgaccagctccatggaccccctgcccgtcttcctgtacccacctgtgcagaggagcatccagaagagagctgtgaggaagatgtctgtgatgggccggcagacctgcctggagtgcagctttgagatcccagacttccccaaccacttccccacctacgtgcactgcagcctgtgccgctacagcacctgctgcagccgggcctatgccaaccacatgatcaacaaccacgtgcccaggaagagccccaagtacctggccctcttcaagaacagcgtgtctggcatcaagctggcctgcaccagctgcacctttgtgacctctgtgggagatgccatggccaagcacctggtgttcaaccccagccacaggagcagcagcatcctgccccggggcctgacctggatcgcccacagccgccacggccagacccgggacagagtgcatgacagaaatgtgaagaacatgtaccccccacccagcttccccaccaacaaggccgccaccgtgaagtctgctggggccaccccagctgagcctgaggagctgctgacccccctggccccagccctgcccagccctgccagcacagccaccccaccacccacccccacccacccccaggccctggccctgccccccctggccacagagggcgctgagtgcctgaatgtggatgaccaggatgagggcagccctgtgacccaggagcctgagctggccagcggcggcggcggcagcggcggcgtgggcaagaaggagcagctgtctgtgaagaagctgcgggtggtgctgtttgccctgtgctgcaacacagagcaggccgctgagcacttcaggaacccccagaggcgcatccgccgctggctgcggcgcttccaggccagccagggcgagaacctggagggcaagtacctgagctttgaagctgaggagaagctggccgagtgggtgctgacccagcgggagcagcagctgcctgtgaatgaggagaccctcttccagaaggccaccaagattggccgcagcctggagggcggcttcaagatctcctatgagtgggccgtgcgcttcatgctgcggcaccacctgaccccccacgcccggcgggctgtggcccacaccctgcccaaggatgtggctgaaaatgccggcctcttcatcgactttgtgcagaggcagatccacaaccaggacctgcccctgtccatgattgtggccattgatgagatcagcctcttcctggacacagaggtgctgagcagtgatgacagaaaagaaaatgccctgcagacagtgggcaccggggagccctggtgtgatgtggtgctggccatcctggctgatggcaccgtgctgcccaccctggtgttctaccggggccagatggaccagcctgccaacatgccagacagcatcctgctggaggccaaggagagcggctacagtgatgatgagatcatggagctgtggagcaccagggtgtggcagaagcacacagcctgccagaggagcaagggcatgctggtgatggactgccacaggacccacctgtctgaggaggtgctggccatgctgagcgccagcagcaccctgcctgctgtggtgcctgctggctgcagcagcaagatccagcccctggatgtgtgcatcaagaggacagtgaagaacttcctgcacaagaagtggaaggagcaggcccgggagatggctgacacagcctgtgacagtgatgtgctgctgcagctggtgctggtgtggctgggggaggtgctgggcgtcatcggggactgcccagagctggtgcagaggagcttcctggtggcctctgtgctgcccggcccagatggcaacatcaacagccccaccagaaatgctgacatgcaggaggagctgattgccagcctggaggagcagctgaagctgagcggggagcacagcgagagcagcaccccccggcccaggagcagccctgaggagaccatcgagcctgagagcctgcaccagctgtttgaaggagagagcgagacagagagcttctacggctttgaggaggccgacctggacctgatggagatctag

SEQ ID NO: 21862 - DNA, 564 bp, Artificial Sequence
  Description of Artificial Sequence: Synthetic coding sequence
atggacatcagcaagggcctgcccggcatgcagggcggcctgcacatctggatcagcgagaacaggaagatggtgcctgtgcctgagggcgcctacggcaacttctttgaggagcactgctacgtgatcctgcacgtgccccagagccccaaggccacccagggcgccagcagtgacctgcactactgggtgggcaagcaggccggggctgaggcccagggcgctgctgaggccttccagcagaggctgcaggatgagctgggcggccagacagtgctgcaccgggaggcccagggccacgagagtgactgcttctgcagctacttccggcccggcatcatctacagaaaaggaggcctggccagtgacctgaagcacgtggagaccaacctcttcaacatccagaggctgctgcacatcaagggcaggaagcacgtgtctgccacagaggtggagctgtcctggaacagcttcaacaagggggacatcttcctgctggacctgggcaagatgatgatccagtggaatggccccaagaccagcatcagcgagaaggccaggtag

SEQ ID NO: 21863 - DNA, 1329 bp, Artificial Sequence
  Description of Artificial Sequence: Synthetic coding sequence
atgcccctggagaacctggaggaggagggcctgcccaagaacccagacctgagaattgcccagctgcgcttcctgctgagcctgcctgagcacagaggagatgctgctgtgagagatgagctgatggctgctgtgcgggacaacaacttctggaaccgcatccggcaggagcagacagaggactgcccccccagcagccccagccggggctggcactgccaggactggcccagcaggaagccacccaccagcatccggctgtgctttgccaagcccatcatcaagaggcacaggatgcccagctacatggccccctactatgaggccctgtgcaagagcctggactggcagattgatgtggacctgctgaacaagatgaagaaggccaatgaagatgagctgaagaggctggatgaggagctggaggatgctgagaagaacctgggggagagcgagatcagagatgccatgatggccaaggccgagtacctgtgcagaattggagacaaggagggcgccctgacagccttcaggaagacctatgacaagacagtggccctgggccaccggctggacatcgtgttctacctgctgcgcatcggcctcttctacatggacaatgacctgatcaccaggaacacagagaaggccaagagcctgattgaggagggcggggactgggacagaagaaaccggctgaaggtgtaccagggcctgtactgtgtggccatccgggacttcaagcaggccgctgagctgttcctggacacagtgtccaccttcaccagctatgagctgatggactacaagacctttgtgacctacacagtgtatgtgtccatgattgccctggagaggccagacctgcgggagaaggtgatcaagggagctgagatcctggaggtgctgcacagcctgcctgctgtgcggcagtacctgttcagcctgtatgagtgccgctacagcgtcttcttccagagcctggccgtggtggagcaggagatgaagaaggactggctgtttgccccccactaccgctactacgtgcgggagatgagaattcatgcctacagccagctgctggagagctaccgcagcctgaccctgggctacatggccgaggccttcggcgtgggcgtggagttcatcgaccaggagctgagccgcttcatcgctgctggccgcctgcactgcaagattgacaaggtgaatgagatcgtggagaccaacagaccagacagcaagaactggcagtaccaggagaccatcaagaagggggacctgctgctgaacagagtgcagaagctgagcagggtcatcaacatgtag

SEQ ID NO: 21864 - DNA, 333 bp, Artificial Sequence
  Description of Artificial Sequence: Synthetic coding sequence
atgctgtgctggggcaatgccagctttggccagctgggcctgggcggcattgatgaggagatcgtgctggagcccaggaagagtgacttcttcatcaacaagagggtgagagatgtgggctgcggcctgcggcacacagtgtttgtgctggatgatggcaccgtgtacacctgtggctgcaatgacctgggccagctgggccacgagaagagcaggaagaagccagagttccgcagctgcttccctggccgcagcgccatggcccccagccggctgacagccaccagcgccagccaggtgcaggccatcctgctgccccagcccccagagtag

SEQ ID NO: 21865 - DNA, 930 bp, Artificial Sequence
  Description of Artificial Sequence: Synthetic coding sequence
atggtgtgctggcagagcgtgtctgtgtggagcgtggccggccgggtggagatgacagtgtccaagttcatggccatccagaaggccctgcagcctgactggttccagtgcctgagtgatggagaggtgtcctgcaaggaggccaccagcatcaagagggtgaggaagtctgtggacaggagcctgctcttcctggacaactgcctgcggctgcaggaggagagcgaggtgctgcagaagagcgtcatcatcggcgtgattgaaggaggagatgtgatggaggagcggctgcggagcgcccgggagacagccaagaggcctgtgggcggcttcctgctggatggcttccagggcaaccccaccaccctggaggcccggctgcggctgctgagctctgtgacagctgagctgcctgaggacaagcccaggctcatcagcggcgtgtccaggccagatgaggtgctggagtgcatcgagcggggcgtggacctgtttgagagcttcttcccctaccaggtgacagagcggggctgtgccctgaccttctcctttgactaccagcccaaccctgaggagaccctgctgcagcagaatggcacccaggaggagatcaagtgcatggaccagatcaagaagattgagaccaccggctgcaaccaggagatcaccagctttgagatcaacctgaaggagaagaagtaccaggaggacttcaaccccctggtgcggggctgcagctgctactgctgcaagaaccacacccgggcctacatccaccacctgctggtgaccaatgagctgctggccggcgtgctgctgatgatgcacaactttgagcactacttcggcttcttccactacatccgggaggccctgaagagtgacaagctggcccagctgaaggagctgatccaccggcaggccagctag

SEQ ID NO: 21866 - DNA, 384 bp, Artificial Sequence
  Description of Artificial Sequence: Synthetic coding sequence
atggtgctgatcctgggccgccgcctgaaccgggaggacctgggcgtgcgggacagccctgccaccaagaggaaggtgtttgagatggaccccaagagcctgactggacatgagttctttgacttcagcagcggcagcagccatgctgagaacatcctgcagatcttcaatgagttccgggacagccgcctcttcacagatgtgatcatctgtgtggagggcaaggagttcccctgccacagagctgtgctgagcgcctgcagcagctacttccgggccatgttctgcaatgaccaccgggagagccgggagatgctggtggagatcaatggcatcctggccgaggccatggagtgcttcctgcagtatgtgtacacaggatag

SEQ ID NO: 21867 - DNA, 1581 bp, Artificial Sequence; identical to SEQ ID NO: 21050
  Description of Artificial Sequence: Synthetic coding sequence

SEQ ID NO: 21868 - DNA, 195 bp, Artificial Sequence
  Description of Artificial Sequence: Synthetic coding sequence
atgcctgaggaccaggtgggcaagctggaggccacagagaacaccatcagcgccatggctgctgctgctgctgagcagcagcagttctacctgctgctgggcaacctgctgagcccagacaacgtggtgaggaagcaggccgaggagacctatgagaacatccctggccagagcaagatcaccttcctgctgtag

SEQ ID NO: 21869 - DNA, 741 bp, Artificial Sequence; identical to SEQ ID NO: 18792
  Description of Artificial Sequence: Synthetic coding sequence

SEQ ID NO: 21870 - DNA, 1296 bp, Artificial Sequence
  Description of Artificial Sequence: Synthetic coding sequence
atggccgccaacctgagcagaaatggacctgccctgcaggaggcctacgtgcgggtggtgacagagaagagccccacagactgggccctcttcacctatgagggcaacagcaatgacatccgggtggccggcactggagagggcggcctggaggagatggtggaggagctgaacagcggcaaggtgatgtatgccttctgccgggtgaaggaccccaacagcggcctgcccaagtttgtgctgatcaactggacaggagagggcgtgaatgatgtgaggaagggggcctgtgccagccacgtgtccaccatggccagcttcctgaagggggcccacgtgaccatcaatgcccgggcagaagaagatgtggagcctgagtgcatcatggagaaggtggccaaggccagcggggccaactacagcttccacaaggagagcggccgcttccaggatgtgggcccccaggcccctgtgggctctgtgtaccagaagaccaatgctgtgtctgagatcaagagggtgggcaaggacagcttctgggccaaggccgagaaggaggaggagaacagaaggctggaggagaagagaagagctgaggaggcccagaggcagctggagcaggagcggcgggagcgggagctgcgggaggccgcccggcgggagcagcgctaccaggagcagggcggggaggccagcccccagagcaggacctgggagcagcagcaggaggtggtgtccaggaacagaaatgagcaggagagcgctgtgcacccccgggagatcttcaagcagaaggagcgggccatgagcaccaccagcatcagcagcccccagcccgggaagctgcggagccccttcctgcagaagcagctgacccagcctgagacccacttcggccgggagcctgctgctgccatcagccggcccagggctgacctgcctgctgaggagcccgcccccagcaccccaccctgcctggtgcaggccgaggaggaggccgtgtatgaggagcccccagagcaggagaccttctatgagcagccccccctggtgcagcagcagggcgccggcagcgagcacatcgaccaccacatccagggccagggcctgagcggccagggcctgtgtgcccgggccctgtatgactaccaggccgcagatgacacagagatcagctttgatcctgagaacctgatcaccggcatcgaggtgattgatgagggctggtggaggggctacggcccagatggccacttcggcatgtttcctgccaactacgtggagctgattgaatag

SEQ ID NO: 21871 - DNA, 1854 bp, Artificial Sequence
  Description of Artificial Sequence: Synthetic coding sequence
atgattgagaagatgcagggcagcaggatggatgagcagcgctgcagcttccccccacccctgaagacagaggaggactacatcccctaccccagcgtgcatgaggtgctgggccgggagggccccttccccctcatcctgctgccccagtttggaggctactggattgagggcaccaaccacgagatcaccagcatccctgagacagagcccctgcagagccccaccaccaaggtgaagctggagtgcaaccccacagcccgcatctacaggaagcacttcctgggcaaggagcacttcaactactacagcctggatgctgccctgggccacctggtgttcagcctgaagtatgatgtgattggagaccaggagcacctgcggctgctgctgcggaccaagtgcaggacctaccatgatgtgatccccatcagctgcctgacagagttccccaacgtggtgcagatggccaagctggtgtgtgaagatgtgaatgtggaccgcttctaccctgtgctgtaccccaaggccagccggctgattgtgacctttgatgaacatgtgatcagcaacaacttcaagtttggagtcatctaccagaagctgggccagaccagcgaggaggagctgttcagcaccaatgaggagagccctgcctttgtggagttcctggagttcctgggccagaaggtgaagctgcaggacttcaagggcttccggggcggcctggatgtgacccacggccagacaggaacagagagcgtgtactgcaacttcaggaacaaggagatcatgtttcatgtgtccaccaagctgccctacacagaaggagatgcccagcagctgcagaggaagaggcacatcggaaatgacatcgtggccgtggtgttccaggatgagaacaccccatttgtgcctgacatgattgccagcaacttcctgcacgcctacgtggtggtgcaggccgagggcggcggcccagatggccccctgtacaaggtgtctgtgacagccagagatgatgtgcccttctttggaccacccctgcctgaccctgctgtgttcagaaaaggacctgagttccaggagttcctgctgaccaagctgatcaatgcagaatatgcctgctacaaggccgagaagtttgccaagctggaggagaggaccagggctgccctgctggagaccctgtatgaggagctgcacatccacagccagagcatgatgggcctgggcggagatgaggacaagatggagaatggcagcggcggcggcggcttctttgagagcttcaagagggtcatccgcagccgcagccagagcatggatgccatgggcctgagcaacaagaagcccaacacagtgtccaccagccacagcggcagctttgcccccaacaacccagacctggccaaggccgccggcatcagcctgctgatccctgggaagagcgccagccgcttcggccggcggggcagcgccatcggcattggaacagtggaggaggtggtggtgagaggagctgctggcagcggcggctgcctgcacgccctcttcagcgcccggagccaggacggcggccacatcggagatgtggcccccctgcccccaggccaggcccctggccgggccggctggagcggcggcagcagtgatggcacccagcacctgctgtggggcctggtgcctgtgcctgagcctgtgcccctgacccggggcttctggccctgcctgggcccctgggaccccggccctgtgcctgcccgcatccgctaccccaaggccctgcaccctgctgcccggccccccatcagccctgtgtgcatggagcggcaccccagccccctgccctag

SEQ ID NO: 21872 - DNA, 1224 bp, Artificial Sequence
  Description of Artificial Sequence: Synthetic coding sequence
atgggcaacaccagcttcaatgaggtgatggaggcccagctgcccagccatggaggccccaagcccagcgctgagagtgacatgggcacccggcgggactacatcatggccaagtatgtggagcacagatttgcccggcgctgcaccccagagccccagaggctgtggacagccatctgcaacagagacctgctgtctgtgctggaggcctttgccaacggccaggactttggccagcccctgcccggcccagatgcccaggcccctgaggagctggtgctgcacctggccgtgaaggtggccaaccaggccagcctgcccctggtggacttcatcatccagaatggaggccacctggatgccaaggccgcagatggcaacacagccctgcactatgctgccctgtacaaccagcctgactgcctgaagctgctgctgaagggccgggccctggtgggcaccgtgaatgaggccggggagacagccctggacatcgccaggaagaagcaccacaaggaatgtgaggagctgctggagcaggcccaggccggcacctttgccttccccctgcacgtggactacagctgggtgatcagcacagagcccggcagtgacagcgaggaggatgaggaggagaagcgctgcctgctgaagctgcctgcccaggcccactgggccagcggccgcctggacatcagcaacaagacctatgaaacagtggccagcctgggcgccgccaccccccagggcgagagcgaggactgccccccacccctgcctgtgaagaacagcagcaggaccctggtgcagggctgtgcccggcatgccagcggggacagaagtgaggtgagcagcctgagcagcgaggcccctgagaccccagagagcctgggcagccctgccagcagcagcagcctgatgagccccctggagcccggggaccccagccaggccccacccaacagcgaggagggcctgcgggagcccccaggcaccagccggcccagcctgaccagcggcaccacccccagcgagatgtacctgcctgtgcgcttcagcagcgagagcaccaggagctacagaagaggagcccggagcccagaagatggccccagcgcccggcagcccctgcccaggagaaatgtgcctgtgggcatcacagaaggagatggcagcaggacaggcagcctgcctgccagctctgtgcagctgctgcaggactag

SEQ ID NO: 21873 - DNA, 813 bp, Artificial Sequence
  Description of Artificial Sequence: Synthetic coding sequence
atggccatggagatgaggctgcctgtggccaggaagcccctgtctgagcggctgggccgggacaccaagaagcacctggtggtgcctggggacaccatcaccacagacaccggcttcatgaggggccacggcacctacatgggagaggagaagctgattgcctctgtggccggctctgtggagcgggtgaacaagctgatctgtgtgaaggccctgaagacccgctacatcggggaggtgggggacatcgtggtgggccgcatcacagaggtgcagcagaagcgctggaaggtggagaccaacagccggctggacagcgtgctgctgctgagctccatgaacctgcccggcggggagctgcggcggcgctctgcagaagatgagctggccatgaggggcttcctgcaggagggggacctgatcagcctgggccagggcgtgctggtgcaggtgagccccagcctggtgaagaggcagaagacccacttccatgacctgccctgtggggccagcgtcatcctgggcaacaacggcttcatctggatctaccccaccccagagcacaaggaggaggaggccggcggcttcatcgccaacctggagcctgtgtccctggccgaccgggaggtgatcagccggctgaggaactgcatcatcagcctggtgacccagaggatgatgctgtatgacaccagcatcctgtactgctatgaggccagcctgccccaccagatcaaggacatcctgaagccagagatcatggaggagatcgtgatggagacccggcagaggctgctggagcaggagggctag

SEQ ID NO: 21874 - DNA, 297 bp, Artificial Sequence
  Description of Artificial Sequence: Synthetic coding sequence
atgcctgaggaccaggtgggcaagctggaggccacagagaacaccatcagcgccatggctgctgctgctgctgagcagcagcagttctacctgctgctgggcaacctgctgagcccagacaacgtggtgaggaagcaggccgaggagacctatgagaacatccctggccagagcaagatcaccttcctgctgcaggccatccggaacaccacagctgctgaggaggcccggcagatggctgctgtgctgctgcggcggctgctgagcagcgcctttgatgaggtgtacccagcctag

SEQ ID NO: 21875 - DNA, 306 bp, Artificial Sequence
  Description of Artificial Sequence: Synthetic coding sequence
atggatgaggtggagcaggaccagcacgaggcccggctgaaggagctgtttgacagctttgacaccactggaacaggcagcctgggccaggaggagctgacagacctgtgccacatgctgagcctggaggaggtggcccctgtgctgcagcagaccctgctgcaggacaacctgctgggccgggtgcactttgaccagttcaaggaggccctgatcctgatcctgagcaggaccctgagcaatgaggagcacttccaggagccagactgcagcctggaggcccagcccaagtatgtgcggggctag

SEQ ID NO: 21876 - DNA, 1065 bp, Artificial Sequence
  Description of Artificial Sequence: Synthetic coding sequence
atggcccacagccctgtggccgtgcaggtgcccggcatgcagaacaacattgctgaccctgaggagctgttcaccaagctggagcgcatcggcaagggcagctttggagaggtgttcaagggcatcgacaacagaacccagcaggtggtggccatcaagatcatcgacctggaggaggctgaagatgaaattgaggacatccagcaggagatcaccgtgctgagccagtgtgacagcagctatgtgaccaagtactacggcagctacctgaagggcagcaagctgtggatcatcatggagtacctgggcggcggcagcgccctggacctgctgcgggccggcccctttgatgagttccagatcgccaccatgctgaaggagatcctgaagggcctggactacctgcacagcgagaagaagatccaccgggacatcaaggccgccaacgtgctgctgtctgagcagggagatgtgaagctggccgactttggagtggccggccagctgacagacacccagatcaagaggaacacctttgtgggcacccccttctggatggcccctgaggtgatccagcagagcgcctatgacagcaagaggcccacagccaaggagctgctgaagcacaagttcatcgtgaagaacagcaagaagaccagctacctgacagagctgattgaccgcttcaagcgctggaaggccgagggccacagtgatgatgaaagtgacagcgagggcagtgacagcgagagcaccagccgggagaacaacacccaccctgagtggagcttcaccaccgtgaggaagaagccagaccccaagaaggtgcagaatggagctgagcaggacctggtgcagaccctgagctgcctgtccatgatcatcaccccagcctttgctgagctgaagcagcaggatgaaaataatgccagcaggaaccaggccatcgaggagctggagaagagcattgctgtggccgaggccgcctgccccggcatcacagacaagatggtgaagaagctgattgagaagttccagaagtgcagcgcagatgagagcccctag

SEQ ID NO: 21877 - DNA, 522 bp, Artificial Sequence; identical to SEQ ID NO: 21841
  Description of Artificial Sequence: Synthetic coding sequence

SEQ ID NO: 21878 - DNA, 801 bp, Artificial Sequence
  Description of Artificial Sequence: Synthetic coding sequence
tgacccagggctgctgcccgggtgcgggctgctggggaggccctggagaggagaagacgctggctgggccgcctgagccccagcgccccccggccccggcgggcccggcccagcctgcggcgggccagcgcctgggtgcgggacagagtggccggccggcctggggccctgcccggcttccaggccagcggcgtggccggggaggcccagaaggcccctggccaccctgctgccccagccccagctgccagctgcctgacagaagcagatggccgggtcttcctgcacgccttccggctggccctgatccagctgcagatcagcagcatcaagagtgacaacgtgacccgggcctgcagcttcatccgggaggccgccacccagggcgccaagatcgtgtccctgcctgagtgcttcaacagcccctatggagccaagtacttcccagaatatgcagagaagatccctggagagagcacccagaagctgtctgaggtggccaaggaatgttccatctacctgattggaggcagcatccctgaggaggatgctgggaagctgtacaacacctgtgctgtgtttggaccagatggcaccctgctggccaagtacaggaagatccacctgtttgatattgatgtgcctgggaagatcaccttccaggagagcaagaccctgagccctggggacagcttcagcacctttgacaccccctactgccgggtgggcctgggcatctgctatgacatgagatttgctgagctggcccagatctatgcccagagaggagaggccgtgtag

SEQ ID NO: 21879 - DNA, 216 bp, Artificial Sequence
  Description of Artificial Sequence: Synthetic coding sequence
atggacagcctgcctgatgagttctttgtgcgccaccctgctgtggaggaccagaggaaggaggagacagagaacaagctggagaagagcagcggccagctgaacaagcaggagaatgacatccccacagacctggtgcctgtgaacctgctgctggaggtgaagaagctgctgaatgccatcaacaccctgcccaagggcgtggtgccccactag

SEQ ID NO: 21880 - DNA, 2130 bp, Artificial Sequence
  Description of Artificial Sequence: Synthetic coding sequence
atgtctgtggagagcgagcagctgactggagtgcccctggatgacagcgccatcacccccatgtgtgaggtgactggaggccgcagctacagcgtgtgcagccccaggatgctgaaccagtgcctggagagcctggtgcagaaggtgcagagcggcgtggtgatcaactttgagaaggccggccctgaccccagccctgtggaggatggccagcctgacatcagccggcccttcggcagccagccctggcacagctgccacaagctgatctacgtgcggcccaaccccaagacaggagtgcccatcggccactggcctgtgcctgagagcttctggccagaccagaacagccccaccctgccccccaggaccagccaccctgtggtgaagttcagctgcacagactgtgagcccatggtgattgacaagctgccctttgacaagtatgagctggagcccagccccctgacccagttcatcctggagaggaagagcccccagacctgctggcaggtgtatgtgagcaacagcgccaagtacagcgagctgggccaccccttcggctacctgaaggccagcacagccctgaactgtgtgaacctgtttgtgatgccctacaactaccctgtgctgctgcccctgctggatgacctcttcaaggtgcacaaggccaagcccaccctgaagtggaggcagagctttgagagctacctgaagaccatgccaccctactacctgggccccctgaagaaggctgtgaggatgatgggcgcccccaacctgattgctgacagcatggagtatggcctgagctacagcgtcatctcctacctgaagaagctgagccagcaggccaagattgaaagtgacagagtgattggctctgtgggcaagaaggtggtgcaggagaccggcatcaaggtgcgcagccgcagccacggcctgtccatggcctacaggaaggacttccagcagctgctgcagggcatcagtgaagatgtgccccaccggctgctggacctgaacatgaaggagtacacaggcttccaggtggccctgctgaacaaggacctgaagccccagaccttcagaaatgcctatgacatccccaggaggaacctgctggaccacctgaccaggatgaggagcaacctgctgaagagcacccggcgcttcctgaagggccaggatgaggaccaggtgcacagcgtgcccatcgcccagatgggcaactaccaggagtacctgaagcaggtgcccagccccctgcgggagctggaccctgaccagccccggcggctgcacacctttggaaaccccttcaagctggacaagaagggcatgatgattgatgaagcagatgaatttgtggccggcccccagaacaagcacaagaggcctggagagcccaacatgcagggcatccccaagagaagacgctgcatgagccccctgctgcggggccggcagcagaaccctgtggtgaacaaccacatcggcggcaagggccccccagcccccaccacccaggcccagcctgacctgatcaagcccctgcccctgcacaagatcagcgagaccaccaatgacagcatcatccatgatgtggtggagaaccacgtggccgaccagctgagcagtgacatcaccccaaatgccatggacacagagttcagcgccagcagccctgccagcctgctggagcggcccaccaaccacatggaggccctgggccatgaccacctgggcaccaatgacctgactgtgggcggcttcctggagaaccacgaggagccccgggacaaggagcagtgtgccgaggagaacatcccagccagcagcctgaacaagggcaagaagctgatgcactgccgcagccatgaggaggtgaacacagagctgaaggcccagatcatgaaggagatcaggaagccaggcaggaaatatgagcgcatcttcaccctgctgaagcacgtgcagggcagcctgcagaccaggctcatcttcctgcagaatgtcatcaaggaggccagccgcttcaagaagaggatgctgattgagcagctggagaacttcctggatgagatccaccggcgggccaaccagatcaaccacatcaacagcaactag

SEQ ID NO: 21881 - DNA, 387 bp, Artificial Sequence
  Description of Artificial Sequence: Synthetic coding sequence
atggccagcagcaacacagtgctgatgaggctggtggccagcgcctacagcatcgcccagaaggccggcatgattgtgagaagagtgattgctgagggggacctgggcatcgtggagaagacctgtgccacagacctgcagaccaaggctgaccggctggcccagatgagcatctgcagcagcctggccaggaagttccccaagctgaccatcatcggggaggaggacctgcccagcgaggaggtggaccaggagctgattgaggacagccagtgggaggagatcctgaagcagccctgccccagccagtacagcgccatcaaggaggaggacctggtggtgtgggtggaccccctggatggcaccaaggagtacacagagggctag

SEQ ID NO: 21882 - DNA, 237 bp, Artificial Sequence; identical to SEQ ID NO: 18655
  Description of Artificial Sequence: Synthetic coding sequence

SEQ ID NO: 21883 - DNA, 171 bp, Artificial Sequence
  Description of Artificial Sequence: Synthetic coding sequence
atggtgatggagaagcccagccccctgctggtgggccgggagtttgtgcggcagtactacaccctgctgaacaaggcccctgagtacctgcaccgcttctacggcaggaacagcagctatgtgcacggcggcgtggatgccagcggcaagccccaggaggccgtgtactag

SEQ ID NO: 21884 - DNA, 357 bp, Artificial Sequence
  Description of Artificial Sequence: Synthetic coding sequence
atgaagatctttgtgggcaatgtggatggagctgacaccaccccagaggagctggccgccctgtttgccccctatggaacagtgatgagctgtgctgtgatgaagcagtttgcctttgtgcacatgagagaaaatgctggggccctgcgggccatcgaggccctgcacggccacgagctgcggcccggccgggccctggtggtggagatgagccggccccggcccctgaacacctggaagatctttgtgggcaatgtgtctgctgcctgcaccagccaggagctgcggagcctgtttgaaagaagaggccgggtgattgaatgtgatgtggtgaagggcggcatgtgtgtgggctag

SEQ ID NO: 21885 - DNA, 438 bp, Artificial Sequence
  Description of Artificial Sequence: Synthetic coding sequence
atgagcagcccccgggacttccgggcagagcctgtgaatgactatgagggcaatgacagcgaggccgaggacctgaacttccgggagaccctgcccagcagcagccaggagaacacccccaggagcaaggtgtttgagaacaaggtgaacagcgagaaggtgaagctgagcctgaggaacttcccccacaatgactatgaagatgtgtttgaggagcccagcgagagcggcagtgaccccagcatgtggacagcccggggccccttccggcgggaccgctggagcagtgaagatgaggaggccgccggccccagccaggccctgagccccctgctgtctgtgcagcaccacggctacagcggccccaatgaaagaaccaccttctggcacggcagcaatgaaggagctgtgtccctgctgctgcgctactgtgcctag

SEQ ID NO: 21886 - DNA, 438 bp, Artificial Sequence; identical to SEQ ID NO: 20460
  Description of Artificial Sequence: Synthetic coding sequence

SEQ ID NO: 21887 - DNA, 444 bp, Artificial Sequence; identical to SEQ ID NO: 19235
  Description of Artificial Sequence: Synthetic coding sequence

SEQ ID NO: 21888 - DNA, 300 bp, Artificial Sequence
  Description of Artificial Sequence: Synthetic coding sequence
atggatgagagcgccctgctggacctgctggagtgccctgtgtgcctggagcggctggatgccagcgccaaggtgctgccctgccagcacaccttctgcaagcgctgcctgctgggcatcgtgggcagcagaaatgagctgcgctgcccagaatgtaggaccctggtgggcagcggcgtggaggagctgcccagcaacatcctgctggtgcggctgctggatggcatcaagcagaggccctggaagccaggccctgggggcggcagcggcaccaactgcaccaatgccctgcggagctag

SEQ ID NO: 21889 - DNA, 3675 bp, Artificial Sequence
  Description of Artificial Sequence: Synthetic coding sequence
atggccctgcggcctggagctggcagcggcggcggcggcgctgctggagctggagctggcagcgctgggggcggcggcttcatgtttcctgtggccggcggcatccggcccccccaggccggcctgatgcccatgcagcagcagggcttccccatggtgtctgtgatgcagcccaacatgcagggcatcatgggcatgaactacagcagccagatgagccagggccccatcgccatgcaggccggcatccccatgggccccatgcctgctgctggcatgccctacctgggccaggcccccttcctgggcatgaggcctcctggcccccagtacaccccagacatgcagaagcagtttgctgaggagcagcagaagagatttgagcagcagcagaagctgctggaggaggagaggaagaggcggcagtttgaggagcagaagcagaagctgcggctgctgagctctgtgaagcccaagacaggagagaagagcagagatgatgccctggaggccatcaagggcaacctggatggcttcagcagagatgccaagatgcaccccaccccagccagccaccccaagaagccaggagtgggcgtcttccccagccaggaccctgcccagcccaggatgccaccctggatctacaatgaaagcctggtgcctgatgcctacaagaagatcctggagaccaccatgacccccaccggcatcgacacagccaagctgtaccccatcctgatgagcagcggcctgccccgggagaccctgggccagatctgggccctggccaacagaaccaccccaggcaagctgaccaaggaggagctgtacacagtgctggccatgattgctgtgacccagaggggcgtgcctgccatgagcccagatgccctgaaccagtttcctgctgcccccatccccaccctgagcggcttctccatgaccctgcccacccctgtgtcccagcccaccgtcatccccagcggccctgctggctccatgcccctgagcctgggccagcctgtgatgggcatcaacctggtgggccctgtgggcggggccgccgcccaggccagcagcggcttcatccccacctacccagccaaccaggtggtgaagccagaagaagatgacttccaggacttccaggatgccagcaagagcggcagcctggatgacagcttcagtgacttccaggagctgcctgccagcagcaagaccagcaacagccagcacggcaacagcgcccccagcctgctgatgcccctgcccggcaccaaggccctgcccagcatggacaagtatgctgtgttcaagggcattgctgctgacaagagcagtgaaaatacagtgcccccaggggaccccggggacaagtacagcgccttccgggagctggagcagacagctgagaacaagcccctgggggagagctttgctgagttccgctctgctggaacagatgatggcttcacagacttcaagacagctgacagcgtgagccccctggagccccccaccaaggacaagaccttcccccccagcttccccagcggcaccatccagcagaagcagcagacccaggtgaagaaccccctgaacctggccgacctggacatgttcagctctgtgaactgcagcagcgagaagcccctgtccttctctgctgtgttcagcaccagcaagtctgtgtccaccccccagagcactggatctgctgccaccatgacagccctggccgccaccaagaccagcagcctggctgatgactttggagagttcagcctgtttggagagtacagcggcctggcccctgtgggggagcaggatgactttgctgacttcatggccttcagcaacagcagcatcagcagcgagcagaagccagatgacaagtatgatgccctgaaggaggaggccagccctgtgcccctgaccagcaatgtgggcagcacagtgaagggcggccagaacagcacagctgccagcaccaagtatgatgtgttccggcagctgagcctggagggcagcggcctgggcgtggaggacctgaaggacaacaccccatctgggaagagtgatgatgactttgctgacttccacagcagcaagttcagcagcatcaacagcgacaagagcctgggggagaaggctgtggccttccgccacaccaaggaggacagcgcctctgtgaagagcctggacctgcccagcatcggcggcagctctgtgggcaaggaggacagtgaagatgccctgtctgtgcagtttgacatgaagctggctgatgtgggcggggacctgaagcacgtgatgtctgacagcagcctggacctgcccaccgtgtctggccagcaccccccagctgctgacatcgaggacctgaagtatgctgccttcggcagctacagcagcaactttgctgtgtccaccctgaccagctatgactggagcgacagagatgatgccacccagggcaggaagctgagcccctttgtgctgtctgctggcagcggcagccccagcgccaccagcatcctgcagaagaaggagaccagctttggcagcagcgagaacatcaccatgaccagcctgagcaaggtgaccacctttgtgtctgaagatgccctgcctgagaccaccttccctgccctggccagcttcaaggacaccatcccccagaccagcgagcagaaggagtatgaaaatagagactacaaggacttcaccaagcaggacctgcccacagctgagaggagccaggaggccacctgccccagccctgccagcagcggggccagccaggagaccccaaatgaatgttctgatgactttggagagttccagagcgagaagcccaagatcagcaagtttgacttcctggtggccaccagccagagcaagatgaagagcagcgaggagatgatcaagtctgagctggccacctttgacctgtctgtgcagggcagccacaagaggagcctgagcctgggggacaaggagatcagccgcagcagccccagccctgccctggagcagcccttccgggacaggagcaacaccctgaatgagaagccagccctgcccgtcatccgggacaagtacaaggacctgaccggggaggtggaggagaatgaaagatatgcctatgagtggcagcgctgcctgggcagcgccctgaatgtcatcaagaaggccaatgacaccctgaatggcatcagcagcagctctgtgtgcacagaggtgatccagagcgcccagggcatggagtacctgctgggcgtggtggaggtgtacagagtgaccaagagggtggagctgggcatcaaggccacagctgtgtgcagcgagaagctgcagcagctgctgaaggacatcgacaaggtgtggaacaacctgattggcttcatgagcctggccaccctgaccccagatgagaacagcctggacttcagcagctgcatgctgcggcccggcatcaagaatgcccaggagctggcctgtggggtgtgcctgctgaatgtggacagccgcagccgggccttcaacagcgagacagacagcttcaagctggcctacggcggccaccagtaccacgccagctgtgccaacttctggatcaactgtgtggagcccaagcccccaggcctggtgctgcctgacctgctgtag

SEQ ID NO: 21890 - DNA, 354 bp, Artificial Sequence; identical to SEQ ID NO: 20420
  Description of Artificial Sequence: Synthetic coding sequence

SEQ ID NO: 21891 - DNA, 621 bp, Artificial Sequence; identical to SEQ ID NO: 20459
  Description of Artificial Sequence: Synthetic coding sequence

SEQ ID NO: 21892 - DNA, 582 bp, Artificial Sequence
  Description of Artificial Sequence: Synthetic coding sequence
atggaggagaccatcaaggacccccccaccagcgctgtgctgctggaccactgccacttcagccaggtgatcttcaacagcgtggagaagttctacatccctggaggagatgtgacctgccactacaccttcacccagcacttcatccccaggaggaaggactggattggcatcttccgggtgggctggaagaccacccgggagtactacaccttcatgtgggtgaccctgcccatcgacctgaacaacaagagcgccaagcagcaggaggtgcagttcaaggcctactacctgcccaaggatgatgagtactaccagttctgctacgtggatgaagatggagtggtgcggggggccagcatccccttccagttccggccagaaaatgaggaggacatcctggtggtgaccacccagggcgaggtggaggagattgagcagcacaacaaggagctgtgcaaggagaaccaggagctgaaggacagctgcatcagcctgcagaagcagaacagcgacatgcaggccgagctgcagaagaagcaggaggagctggagaccctgcagagcatcaacaagaagtag

SEQ ID NO: 21893 - DNA, 156 bp, Artificial Sequence
  Description of Artificial Sequence: Synthetic coding sequence
atggacttcttcagcagccacctgctggccgacagcagcagccctgccaccaacagcagccacacagatgcccacgagatcctggtgtctgacttcctggtgtctgatgagaacctgcagaagatggagaatgtgctggacctgtggagcagctag

SEQ ID NO: 21894 - DNA, 513 bp, Artificial Sequence
  Description of Artificial Sequence: Synthetic coding sequence
atgagcagcaatgaatgcttcaagtgtggccgcagcggccactgggcccgggagtgccccactggaggcggccggggccggggcatgaggagccggggccggggcttccagtttgtgagcagcagcctgcctgacatctgctaccgctgtggggagagcggccacctggccaaggactgtgacctgcaggaggatgcctgctacaactgtggccggggcggccacatcgccaaggactgcaaggagcccaagcgggagcgggagcagtgctgctacaactgtgggaagccaggccacctggcccgggactgtgaccatgctgatgagcagaagtgctacagctgtggggagtttggccacatccagaaggactgcaccaaggtgaagtgctaccgctgtggggagaccggccacgtggccatcaactgcagcaagaccagcgaggtgaactgctaccgctgtggggagagcggccacctggccagagaatgtaccatcgaggccacagcctag

SEQ ID NO: 21895 - DNA, 399 bp, Artificial Sequence
  Description of Artificial Sequence: Synthetic coding sequence
atgaaccaggaggacctggaccctgacagcaccacagatgtgggagatgtgaccaacacagaggaggagctgatcagagaatgtgaggagatgtggaaggacatggaggagtgccagaacaagctgagcctgattggaacagagaccctgacagacagcaatgcccagctgagcctgctgatcatgcaggtgaagtgcctgacagctgagctgagccagtggcagaagaagaccccagagaccatccccctgacagaagatgtgctgatcaccctgggcaaggaggagttccagaagctgcggcaggacctggagatggtgctgagcaccaaggagagcaagaatgagaagctgaaggaggacctggagcgggagcagcgctggctggatgagcagtag

SEQ ID NO: 21896 - DNA, 1095 bp, Artificial Sequence
  Description of Artificial Sequence: Synthetic coding sequence
atggtgaagctgttcatcggcaacctgccccgggaggccacagagcaggagatccgcagcctgtttgagcagtatggcaaggtgctggagtgtgacatcatcaagaactacggctttgtgcacatcgaggacaagacagctgctgaagatgccatccggaacctgcaccactacaagctgcatggagtgaacatcaacgtggaggccagcaagaacaagagcaagaccagcaccaagctgcacgtgggcaacatcagccccacctgcaccaacaaggagctgcgggccaagtttgaggagtatggccctgtgattgaatgtgacatcgtgaaggactatgcctttgtgcacatggagcgggcagaagatgctgtggaggccatccggggcctggacaacacagagttccagggcaagaggatgcacgtgcagctgagcaccagccggctgaggacagcccctggcatgggagaccagagcggctgctaccgctgtgggaaggagggccactggagcaaggagtgccccatcgacaggagcggccgggtggccgacctgacagagcagtacaatgagcagtacggggctgtgaggaccccctacaccatgtcctatggagacagcctgtactacaacaatgcctatggagccctggatgcctactacaagcgctgcagagctgcccggagctatgaagctgtggccgctgctgctgcctctgtgtacaactatgcagagcagaccctgagccagctgccccaggtgcagaacacagccatggccagccacctgaccagcaccagcctggacccctatgacagacacctgctgcccaccagcggggctgctgccacagctgctgctgctgctgctgctgctgctgctgtgacagctgccagcaccagctactacggccgggacaggagccccctgcggcgggccacagcccctgtgcccaccgtgggggagggctacggctacggccatgaaagtgagctgagccaggccagcgctgctgccaggaacagcctgtatgacatggcccgctatgaaagagagcagtatgctgaccgggcccgctacagcgccttctag

SEQ ID NO: 21897 - DNA, 420 bp, Artificial Sequence
  Description of Artificial Sequence: Synthetic coding sequence
atggccactggagacctgaagaggagcctgaggaacctggagcaggtgctgcggctgctgaactacccagaggaggtggactgtgtgggcctcatcaagggggaccctgctgccagcctgcccatcatctcctacagcttcaccagctacagcccctacgtgacagagctgatcatggagagcaatgtggagctgattgccaagaatgacctgcgcttcattgatgctgtgtacaagctgctgcgggaccagttcaactacaagcccatcctgaccaagaagcagttcatccagtgtggctttgctgagtggaagatccagatcgtgtgtgacatcctgaactgtgtgatgaagaagcacaaggagctgagcagcctgcagaagatccccagccagcagaggaagaagatcagcagctag

SEQ ID NO: 21898 - DNA, 450 bp, Artificial Sequence
  Description of Artificial Sequence: Synthetic coding sequence
atggccaacattgctgtgcagaggatcaagcgggagttcaaggaggtgctgaagtctgaggaggtgcgcttcatcaccaagatctggcaccccaacatcagctctgtgactggagccatctgcctggacatcctgaaggaccagtgggccgccgccatgaccctgaggacagtgctgctgagcctgcaggccctgctggccgctgctgagccagatgacccccaggatgctgtggtggccaaccagtacaagcagaaccctgagatgttcaagcagacagcccggctgtgggcccacgtgtatgctggggcccctgtgagcagccctgagtacaccaagaagattgagaacctgtgtgccatgggctttgacagaaatgctgtgattgtggccctgagcagcaagtcctgggatgtggagacagccacagagctgctgctgagcaactag

SEQ ID NO: 21899 - DNA, 597 bp, Artificial Sequence
  Description of Artificial Sequence: Synthetic coding sequence
atggtgatggagaagcccagccccctgctggtgggccgggagtttgtgcggcagtactacaccctgctgaacaaggcccctgagtacctgcaccgcttctacggcaggaacagcagctatgtgcacggcggcgtggatgccagcggcaagccccaggaggccgtgtatggccagaatgacatccaccacaaggtgctgagcctgaacttcagcgagtgccacaccaagatcagacatgtggatgcccacgccaccctgagtgatggagtggtggtgcaggtgatgggcctgctgagcaacagcggccagcctgagaggaagttcatgcagacctttgtgctggcccctgagggctctgtgcccaacaagttctacgtgcacaatgacatgttccgctatgaagatgaggtgtttggagacagcgagcctgagctggatgaggagagtgaagatgaggtggaggaggagcaggaggagcggcagcccagccctgagcctgtgcaggagaatgccaacagcggctactatgaggcccaccctgtgaccaatggaattgaggagcccctggaggagagcagccatgagcctgagccctag

SEQ ID NO: 21900 - DNA, 150 bp, Artificial Sequence
  Description of Artificial Sequence: Synthetic coding sequence
atgatgctgggcacagaaggaggagagggctttgtggtgaaggtgcggggcctgccctggagctgcagcgcagatgaggtgcagcgcttcttcagtgactgcaagatccagaatggagcccagggcatccgcttcatctacaccaggtag

SEQ ID NO: 21901 - DNA, 1266 bp, Artificial Sequence; identical to SEQ ID NO: 20986
  Description of Artificial Sequence: Synthetic coding sequence

SEQ ID NO: 21902 - DNA, 1173 bp, Artificial Sequence; identical to SEQ ID NO: 18714
  Description of Artificial Sequence: Synthetic coding sequence

SEQ ID NO: 21903 - DNA, 390 bp, Artificial Sequence
  Description of Artificial Sequence: Synthetic coding sequence
atgaagaggggccgcctgcccagcagcagtgaagattctgatgacaatggcagcctgagcaccacctggagccagaacagccgcagccagcaccggcgcagcagctgcagcagacatgaggacaggaagcccagcgaggtgttcagaacagacctgatcacagccatgaagctgcatgacagctaccagctgaacccagatgagtactacgtgctggccgacccctggaggcaggagtgggagaagggcgtgcaggtgcctgtgtccccaggcaccatcccccagcctgtggcccgggtggtgtctgaggagaagagcctgatgttcatccggcccaagaagtacatcgtgagcagcggcagcgagcccccagagctgggctacgtgtag

SEQ ID NO: 21904 - DNA, 489 bp, Artificial Sequence
  Description of Artificial Sequence: Synthetic coding sequence
atggacttcttcagcagccacctgctggccgacagcagcagccctgccaccaacagcagccacacagatgcccacgagatcctggtgtctgacttcctggtgtctgatgagaacctgcagaagatggagaatgtgctggacctgtggagcagcggcctgaagaccaacatcatcagcgagctgagcaagtggaggctgaacttcatcgactggcacaggatggagatgaggaaggagaaggagaagcacgccgcccacctgaagcagctgtgcaaccagatcaatgagctgaaggagctgcagaagacctttgagatcagcatcggcaggaaggatgaggtgatcagcagcctgagccacgccatcggcaagcagaaggagaagattgagctgatgaggaccttcttccactggagaattggccacgtgcgggcccggcaggatgtgtatgagggcaagctggccgaccagtactaccagaggacatag

SEQ ID NO: 21905 - DNA, 411 bp, Artificial Sequence
  Description of Artificial Sequence: Synthetic coding sequence
atgattgtgaatgactatgagggcaatgattctgaggccgaggacctgaacttccgggagaccctgcccagcagcagccaggagaacacccccaggagcaaggtgtttgagaacaaggtgaacagcgagaaggtgaagctgagcctgaggaacttcccccacaatgactatgaagatgtgtttgaggagcccagcgagagcggcagtgaccccagcatgtggacagcccggggccccttcagaagagaccgctggagcagtgaagatgaggaggccgccggccccagccaggccctgagccccctgctgtctgtgcagcaccacggctacagcggccccaatgaaagaaccaccttctggcacggcagcaatgaaggagctgtgtccctgctgctgcgctactgtgcctag

SEQ ID NO: 21906 - DNA, 321 bp, Artificial Sequence
  Description of Artificial Sequence: Synthetic coding sequence
atggccagccagctgcaggtgttcagcccccccagcgtgagcagcagcgccttctgcagcgccaagaagctgaagattgagcccagcggctgggatgtgtctggccagagcagcaatgacaagtactacacccacagcaagaccctgcctgccacccagggccaggccaacagcagccaccaggtggccaacttcaacatcccagcctatgaccagggcctgctgctgcctgccccagctgtggagcacatcgtggtgacagctgctgacagcagcggcagcgctgccaccagcaccttccagagcagccagaccctgtag

SEQ ID NO: 21907 - DNA, 411 bp, Artificial Sequence
  Description of Artificial Sequence: Synthetic coding sequence
atgaagaggggccgcctgcccagcagcagtgaagattctgatgacaatggcagcctgagcaccacctggagccagaacagccgcagccagcaccggcgcagcagctgcagcagacatgaggacaggaagcccagcgaggtgttcagaacagacctgatcacagccatgaagctgcatgacagctaccagctgaacccagatgagtactacgtgctggccgacccctggaggcaggagtgggagaagggcgtgcaggtgcctgtgtccccaggcaccatcccccagcctgtggcccgggtggtgtctgaggagaagagcctgatgttcatccggcccaagaagtacatcgtgagcagcggcagcgagcccccagagctgggctacgtggacatccgcaccctggccgactag

SEQ ID NO: 21908 - DNA, 396 bp, Artificial Sequence
  Description of Artificial Sequence: Synthetic coding sequence
atggaggatggcacccccaagcacatcatccagatgacaggcttcaagatggaggagaaggaggccctggtgaagctgctgctgaagctggactgcaccttcatcaagtctgagaagtacaagaactgcacccacctgattgctgagcggctgtgcaagtctgagaagttcctggccgcctgtgccgccggcaagtggatcctgaccaaggactacatcatccacagcgccaagagcggccgctggctggatgagaccacctatgagtggggctacaagattgagaaggacagccgctacagcccccagatgcagagcgcccccaagcgctggagggaggagctgaagaggactggagcccctggggccttccaccgctggaaggtggtgctgtag

SEQ ID NO: 21909 - DNA, 1668 bp, Artificial Sequence; identical to SEQ ID NO: 18508
  Description of Artificial Sequence: Synthetic coding sequence

SEQ ID NO: 21910 - DNA, 1635 bp, Artificial Sequence; identical to SEQ ID NO: 19452
  Description of Artificial Sequence: Synthetic coding sequence

SEQ ID NO: 21911 - DNA, 393 bp, Artificial Sequence
  Description of Artificial Sequence: Synthetic coding sequence
atgggccgcctggatggcaaggtgatcatcctgacagctgctgcccagggcatcggccaggccgccgccctggcctttgcccgggagggcgccaaggtgattgccacagacatcaatgaaagcaagctgcaggagctggagaagtacccaggcatccagaccagggtgctggatgtgaccaagaagaagcagattgaccagtttgccaatgaggtggagcggctggatgtgctcttcaacgtggccggctttgtgcaccacggcaccgtgctggactgtgaggagaaggactgggacttctccatgaacctgaatgtgcgctccatgtacctgatgatcaaggccttcctgcccaagatgctggcccagaagagcggcaacatcatcaactag

SEQ ID NO: 21912 - DNA, 1119 bp, Artificial Sequence
  Description of Artificial Sequence: Synthetic coding sequence
atgcagggccctgctggaaatgccagccggggcctgcccggcggcccccccagcacagtggccagcggggccggccgctgtgagagcggggccctgatgcacagctttggcatcttcctgcagggcctgctgggcgtggtggccttcagcaccctgatgctgaagcgcttccgggagcccaagcatgagcggcggccctggaggatctggttcctggacaccagcaagcaggccatcggcatgctgttcatccactttgccaacgtgtacctggccgacctgacagaggaggacccctgcagcctgtacctgatcaacttcctgctggatgccaccgtgggcatgctgctgatctacgtgggcgtgcgggctgtgtctgtgctggtggagtggcagcagtgggagagcctgcgctttggagaatatggagaccccctgcagtgtggggcctgggtgggccagtgtgccctgtacatcgtcatcatgatctttgagaagtctgtggtgttcatcgtgctgctgatcctgcagtggaagaaggtggccctgctgaaccccatcgagaacccagacctgaagctggccatcgtgatgctgattgtgcccttctttgtgaatgccctgatgttctgggtggtggacaacttcctgatgaggaagggcaagaccaaggccaagctggaggagcggggggccaaccaggacagcagaaatggcagcaaggtgcgctacagaagagctgccagccatgaggagagcgagagcgagatcctgatctctgcagatgatgagatggaggagagtgatgtggaggaggacctgcggcggctgacccccctgaagcctgtgaagaagaagaagcaccgcttcggcctgcctgctggggcccaggaggcccccatcaagaagaagaggcctcctgtgaaggatgaggacctgaagggggcccggggcaacctgaccaagaaccaggagatcaagagcaagacctaccaggtgatgagagaatgtgagcaggccggcagcgctgcccccagcgtcttcagcaggaccaggactggaacagaaacagtgtttgagaagcccaaggccggccccaccaagtctgtgtttggatag

SEQ ID NO: 21913 - DNA, 507 bp, Artificial Sequence
  Description of Artificial Sequence: Synthetic coding sequence
atgatgctgggcacagaaggaggagagggctttgtggtgaaggtgcggggcctgccctggagctgcagcgcagatgaggtgcagcgcttcttcagtgactgcaagatccagaatggagcccagggcatccgcttcatctacacccgggagggccggcccagcggggaggcctttgtggagctggagagtgaagatgaggtgaagctggccctgaagaaggaccgggagaccatgggccaccgctacgtggaggtgttcaagagcaacaacgtggagatggactgggtgctgaagcacacaggccccaacagcccagacacagccaatgatggctttgtgcggctgcggggcctgcccttcggctgcagcaaggaggagatcgtgcagttcttcagcggcctggagatcgtgcccaacggcatcaccctgcctgtggacttccagggccgcagcactggagaggcctttgtgcagtttgccagccaggagattgctgagaaggcctag

SEQ ID NO: 21914 - DNA, 9 bp, Artificial Sequence
  Description of Artificial Sequence: Synthetic coding sequence
atggcctag

SEQ ID NO: 21915 - DNA, 1131 bp, Artificial Sequence
  Description of Artificial Sequence: Synthetic coding sequence
atgaccaccgtggtggtgcacgtggacagcaaggccgagctgaccaccctgctggagcagtgggagaaggagcacggcagcggccaggacatggtgcccatcctgaccaggatgagccagctgattgagaaggagacagaggagtacagaaaaggagaccctgacccctttgatgacagacaccctggccgggctgaccctgagtgcatgctgggccacctgctgcgcatcctcttcaagaatgatgacttcatgaatgccctggtgaatgcctacgtgatgaccagccgggagccccccctgaacacagctgcctgccgcctgctgctggacatcatgcctggcctggagacagctgtggtgttccaggagaaggagggcatcgtggagaacctcttcaagtgggcccgggaggccgaccagcccctgcggacctacagcacaggcctgctgggcggggccatggagaaccaggacattgctgccaactacagagatgagaacagccagctggtggccatcgtgctgcggcggctgcgggagctgcagctgcaggaggtggccctgcggcaggagaacaagaggcccagccccaggaagctgagcagcgagcccctgctgcccctggatgaggaggccgtggacatggactatggagacatggctgtggatgtggtggatggagaccaggaggaggccagcggggacatggagatctccttccacctggacagcggccacaagaccagcagccgggtgaacagcaccaccaagccagaagatggcggcctgaagaagaacaagagcgccaagcagggcgaccgggagaacttcaggaaggccaagcagaagctgggcttcagcagcagtgaccctgacaggatgtttgtggagctgagcaacagctcctggagcgagatgagcccctgggtgattggcaccaactacaccctgtaccccatgaccccagccatcgagcagaggctcatcctgcagtacctgacccccctgggggagtaccaggagctgctgcccatcttcatgcagctgggcagccgggagctgatgatgttctacatcgacctgaagcagaccaatgatgtgctgctgacctttgaggccctgaagtag

SEQ ID NO: 21916 - DNA, 504 bp, Artificial Sequence
  Description of Artificial Sequence: Synthetic coding sequence
atgagcagcaatgaatgcttcaagtgtggccgcagcggccactgggcccgggagtgccccactggaggcggccggggccggggcatgaggagccggggccggggcggcttcaccagtgaccgggacatctgctaccgctgtggggagagcggccacctggccaaggactgtgacctgcaggaggatgcctgctacaactgtggccggggcggccacatcgccaaggactgcaaggagcccaagcgggagcgggagcagtgctgctacaactgtgggaagccaggccacctggcccgggactgtgaccacgcagatgagcagaagtgctacagctgtggggagtttggccacatccagaaggactgcaccaaggtgaagtgctaccgctgtggggagactggacatgtggccatcaactgcagcaagaccagcgaggtgaactgctaccgctgtggggagagcggccacctggcccgggagtgcaccatcgaggccacagcctag

SEQ ID NO: 21917 - DNA, 999 bp, Artificial Sequence; identical to SEQ ID NO: 19500
  Description of Artificial Sequence: Synthetic coding sequence

SEQ ID NO: 21918 - DNA, 615 bp, Artificial Sequence
  Description of Artificial Sequence: Synthetic coding sequence
atgtctgacctgcgcatcacagaggccttcctgtacatggactacctgtgcttccgggccctgtgctgcaagggccccccaccagcccggccagaatatgacctggtgtgcatcggcctgactggaagtggcaagaccagcctgctgagcaagctgtgcagcgagagcccagacaacgtggtgtccaccaccggcttcagcatcaaggctgtgcccttccagaatgccatcctgaatgtgaaggagctgggcggcgctgacaacatcaggaagtactggagccgctactaccagggcagccagggcgtcatctttgtgctggacagcgccagcagtgaagatgacctggaggccgccagaaatgagctgcacagcgccctgcagcacccccagctgtgcaccctgcccttcctgatcctggccaaccaccaggacaagccagctgcccggtctgtgcaggagatcaagaagtactttgagctggagcccctggcccggggcaagcgctggatcctgcagccctgcagcctggatgacatggatgccctgaaggacagcttcagccagctgatcaacctgctggaggagaaggaccatgaagctgtgaggatgtag

SEQ ID NO: 21919 - DNA, 6315 bp, Artificial Sequence
  Description of Artificial Sequence: Synthetic coding sequence
atggagagccaggagttcatcgtgctgtacacccaccagaagatgaagaagagcaaggtgtggcaggacggcatcctgaagatcacccacctgggcaacaaggccatcctgtatgatgacaagggggcctgcctggagagcctcttcctgaagtgcctggaggtgaagccaggagatgacctggagagtgaccgctacctgatcaccgtggaggaggtgaaggtggccggggccatcggcatcgtgaagcagaatgtgaacaaggaggcccctgagctgaacagcaggaccttcatcagcagcggccgcagcctgggctgccagcccagcggcctgaagaggaagttcaccggcttccagggcccccggcaggtgcccaagaagatggtgatcatggagagcggggagagcgctgccagccatgaggccaagaagacaggccccaccatcttcagccccttctgcagcatgccacccctcttccccaccgtgggcaagaaggatgtgaacaacatcctggccgaccctgaaaatattgtgacctacaagaaccgggagagaaatgccatggacttcagcagcgtcttcagccccagcttccagatcaaccctgaggtgctgtgtgaggagaactacttctgcagccctgtgaacagcggcaacaagctgagtgacagcctgctgaccaatgaacctgtgaagagggacagcctggccagccactacagcggcgtgtcccagaacatccgcagcaaggcccagatcctggccctgctgaagtctgagagcagcagcagctgtgaggagctgaacagcgagatgacagagcacttcccccagaagcagccccagggcagcctgaagatcgccaccaagcccaagtacctgatccagcaggaggagtgtgccgagatgaagagcacagaaaatctctactaccagcaccagagcgagaacaccatgaggaacaagagccgctgggccatgtacctgagcagccagagcagccccatccacagcagcacagtggatggaaatgacacagagaggaagcccaaggcccaggaggatgatgtgaacagcaacctgaaggacctgagcctgcagaagatcatccagtttgtggagacctatgcagaggagaggaagaagtacaacgtggaccagagcgtgggcaacaatgaccccagctggaaccaggaggtgaagctggagatccccagcttcaatgaaagcagcagcctgcaggtgacctgcagcagcgcagaaaatgatggcatcctgtctgagagtgacatccaggaggacaacaagatccccttcaaccagaatgacaagggctgcatcaagggctctgtgctgatcaaggaaaatgcccaggaggtgaacacctgtggcaccctggagaaggagtatgagcagagcgagagcagcctgcctgagctgaagcacctgcagatcgagagcagcaacaacagccgcatcagtgatgacatcacagacatgatcagcgagagcaagatggacaatgaaagcctgaacagcatccacgagagcctgagcaatgtgacccagcccttcctggaggtgaccttcaacctgaacaactttgagaccagtgacacagaggaggagagccaggagagcaacaagatcagccaggacagcgagagctgggtgaaggacatcctggtgaatgatggcaacagctgcttccagaagagaagtgagaacaccaactgtgaggagattgaaggagagcacctgcccttcctgacctctgtgtctgacaagcccaccgtgaccttccctgtgaaggagaccctgcccagccagttctgtgacaagacctacgtgggctttgacatgggcatctgcaagacagaaaatacaggcaaggagattgaggagtacagcgacaccctgagcaactttgagagcttcaagtggacagatgctgtgtatggagacaacaaggaggatgccaacaagcccatccaggaggtgcgcatcaactatgactttgccctgccccccaacaagagcaagggcatcaacatgaacctgcacatcccccacatccagaaccagattgctgagaacagcaacctcttctctgaagatgcccagccccagcccttcatcctgggcagtgacctggacaagaatgatgagcacgtgctgcccagcaccagcagcagtgacaacagcgtgcagctgctgaacaccaaccagaaccactatgaatgtattgccctggacaagagcaacacccacatcagcaacagcctcttctaccccctgggcaagaagcacctgatcagcaaggacacagaggcccacatcagcgagcctgaggacctgggcaagatccgcagccccccaccagaccacgtggaggtggagacagcccgggagggcaagcagtactggaaccccaggaacagcagcgagctgagcggcctggtgaacaccatcagcatcctgaagagcctgtgtgagcacagcacagccctggacagcctggagatcctgaagaagaagaacacagtgttccagcagggcacccagcagacctatgagccagacagccccccagaggtgaggaagcccttcatcaccgtggtgagccccaagagcccccacctgcacaaggacagccagcagatcctgaaggaggatgaggtggagctgtctgagcccctgcagagcgtgcagttcagcagcagcggcagcaaggaggagacagccttccaggccgtcatccccaagcagatcgagaggaagacctgtgaccccaagcctgtggagttccagggccaccaggtgaagggcagcgccaccagcggcgtgatggtgcggggccacagcagccagctgggctgcagccagttcccagacagcacagaatatgagaacttcatgacagagaccccagagctgcccagcacctgcatgcagattgacttcctgcaggtgaccagccctgaggagaacatcagcaccctgagccctgtgtccaccttcagcctgaacagcagagatgaggacttcatggtggagttcagcgagaccagcctgaaggcccggaccctgcctgatgacctgcacttcctgaacctggagggcatgaagaagagccgcagcctggagaatgaaaacctgcagaggctgagcctgctgagcaggacccaggtgcccctcatcaccctgcccaggacagatggccccccagacctggacagccacagctacatgatcaacagcaacacctatgagagcagcggcagccccatgctgaacctgtgtgagaagtctgctgtgctgtccttcagcattgagcctgaggaccagaatgagaccttcttcagcgaggagagccgggaggtgaaccctggagatgtgtccctgaacaacatcagcacccagagcaagtggctgaagtaccagaacaccagccagtgcaatgtggccacccccaacagagtggacaagaggatcacagatggcttctttgctgaggccgtgtctggcatgcacttccgggacaccagcgagcggcagagtgatgctgtgaatgaaagcagcctggacagcgtgcacctgcagatgatcaagggcatgctgtaccagcagaggcaggacttcagcagccaggacagcgtgtccaggaagaaggtgctgagcctgaacctgaagcagaccagcaagacagaggagatcaagaatgtgctgggcggcagcacctgctacaactacagcgtgaaggacctgcaggagatcagcggcagcgagctgtgcttccccagcggccagaagatcaagagcgcctacctgccccagaggcagatccacatcccagctgtgttccagagccctgcccactacaagcagaccttcaccagctgcctgattgagcacctgaacatcctgctgtttggcctggcccagaacctgcagaaggccctgagcaaggtggacatctccttctacaccagcctgaagggggagaagctgaagaatgcagaaaataatgtgcccagctgccaccacagccagcctgccaagctggtgatggtgaagaaggagggccccaacaagggccgcctcttctacacctgtgatggccccaaggctgaccgctgcaagttcttcaagtggctggaggatgtgaccccaggctacagcacccaggagggcgcccggcccggcatggtgctgagtgacatcaagagcatcggcctgtacctgcggagccagaagatccccctgtatgaggagtgccagctgctggtgaggaagggctttgacttccagaggaagcagtatggcaagctgaagaagttcaccaccgtgaaccctgagttctacaatgagcccaagaccaagctgtacctgaagctgagcaggaaggagaggagcagcgcctacagcaagaatgacctgtgggtggtgtccaagaccctggactttgagctggacaccttcatcgcctgcagcgccttcttcggccccagcagcatcaatgaaattgagatcctgcccctgaagggctacttccccagcaactggcccaccaacatggtggtgcacgccctgctggtgtgcaatgccagcacagagctgaccaccctgaagaacatccaggactacttcaacccagccaccctgcccctgacccagtacctgctgaccaccagcagccccaccatcgtgagcaacaagagggtgtccaagaggaagttcatccccccagccttcaccaacgtgtccaccaagtttgagctgctgagcctgggcgccaccctgaagctggccagcgagctgatccaggtgcacaagctgaacaaggaccaggccacagccctgatccagatcgcccagatgatggccagccatgagagcattgaggaggtgaaggagctgcagacccacaccttccccatcaccatcatccatggagtgtttggagctgggaagagctacctgctggccgtggtgatcctcttctttgtgcagctgtttgagaagtctgaggcccccaccatcggaaatgcccggccctggaagctgctgatcagcagcagcaccaacgtggccgtggacagagtgctgctgggcctgctgagcctgggctttgagaacttcatccgggtgggctctgtgaggaagatcgccaagcccatcctgccctacagcctgcacgccggctctgaaaatgaaagtgagcagctgaaggagctgcacgccctgatgaaggaggacctgacccccacagagcgggtgtatgtgaggaagagcattgagcagcacaagctgggcaccaacagaaccctgctgaagcaggtgcgggtggtgggcgtgacctgtgccgcctgccccttcccctgcatgaatgacctgaagtttcctgtggtggtgctggatgagtgcagccagatcacagagcccgccagcctgctgcccatcgccaggtttgaatgtgagaagctgatcctggtgggggaccccaagcagctgccccccaccatccagggcagtgatgctgcccatgaaaatggcctggagcagaccctgtttgaccggctgtgcctgatgggccacaagcccatcctgctgcggacccagtaccgctgccacccagccatcagcgccatcgccaatgacctcttctacaagggggccctgatgaatggagtgacagaaattgaaagaagccccctgctggagtggctgcccaccctgtgcttctacaacgtgaagggcctggagcagatcgagcgggacaacagcttccacaacgtggccgaggccaccttcaccctgaagctgatccagagcctgattgccagcggcattgctggctccatgattggagtcatcaccctgtacaagagccagatgtacaagctgtgccacctgctgtctgctgtggacttccaccacccagacatcaagacagtgcaggtgtccacagtggatgccttccagggcgctgagaaggagatcatcatcctgagctgtgtgaggacccggcaggtgggcttcattgattctgagaagaggatgaatgtggccctgacccggggcaagaggcacctgctgattgtgggcaacctggcctgcctgaggaagaaccagctgtggggccgggtcatccagcactgtgagggccgggaggatggcctgcagcacgccaaccagtatgagccccagctgaaccacctgctgaaggactactttgagaagcaggtggaggagaagcagaagaagaagtctgagaaggagaagagcaaggacaagagccacagctag

SEQ ID NO: 21920 - DNA, 567 bp, Artificial Sequence
  Description of Artificial Sequence: Synthetic coding sequence
atggccgccacagccagagaagatggagccagcggccaggagcggggccagaggggctgtgagcactatgaccggggctgcctgctgaaggccccctgctgtgacaagctgtacacctgccgcctgtgccacgacaacaatgaagaccaccagctggaccgcttcaaggtgaaggaggtgcagtgcatcaactgtgagaagatccagcacgcccagcagacctgtgaagaatgttccaccctgtttggagagtactactgtgacatctgccacctgtttgacaaggacaagaagcagtaccactgtgagaactgtggcatctgccgcatcggccccaaggaggacttcttccactgcctgaagtgcaacctgtgcctggccatgaacctgcagggccgccacaagtgcattgaaaatgtgtcccggcagaactgccccatctgcctggaggacatccacaccagccgggtggtggcccacgtgctgccctgtggccacctgctgcacaggacctgctatgaggagatgctgaaggagtatgaccaggtgctggagacagctggatag

SEQ ID NO: 21921 - DNA, 339 bp, Artificial Sequence
  Description of Artificial Sequence: Synthetic coding sequence
atggccactggagacctgaagaggagcctgaggaacctggagcaggtgctgcggctgctgaactacccagaggaggtggactgtgtgggcctcatcaagggggaccctgctgccagcctgcccatcatctcctacagcttcaccagctacagcccctacgtgacagagctgatcatggagagcaatgtggagctgattgccaagaatgacctgcgcttcattgatgctgtgtacaagctgctgcgggaccagttcaactacaagcccatcctgaccaagaagcagttcatccagtgtggctttgctgagtggaagatccagatcgtgtgtgacatctag

SEQ ID NO: 21922 - DNA, 363 bp, Artificial Sequence
  Description of Artificial Sequence: Synthetic coding sequence
atgtggaaggtggtgaacctgcccacagacctcttcaacagcgtgatgaatgtgggccgcttcacagaggagattgagtggctgaagttcctggccctggcctgcagcgccctgggcgtgaccatcaccaagaccctgaagatcgtgtgtgaggtgctgagctgtgaccacaacggcggcctgccccgcatccccttcagcaccttccagttcctgtacacctacatcgccgaggtggatggagagatctgtgccagccacgtgtccaggatgctgaactacatcgagcaggaggtgattggaccagatggcctcatcaccgtgaatgacttcacccagaacccccgggtgtggctggagtag

SEQ ID NO: 21923 - DNA, 2490 bp, Artificial Sequence
  Description of Artificial Sequence: Synthetic coding sequence
atggccaagtacaacacaggaggcaaccccacagaagatgtgtctgtgaacagccggcccttccgggtgacaggccccaacagcagcagcggcatccaggccaggaagaacctcttcaacaaccagggcaatgccagccccccagctggccccagcaatgtgcccaagtttggcagccccaagccccctgtggccgtgaagcccagcagcgaggagaagccagacaaggagcccaagccacccttcctgaagcccaccggggccggccagcgcttcggcaccccagccagcctgaccacccgggaccctgaggccaaggtgggcttcctgaagcctgtgggccccaagcccatcaacctgcccaaggaggacagcaagcccaccttcccctggcccccaggcaacaagcccagcctgcacagcgtgaaccaggaccatgacctgaagcccctgggccccaagagcggccccaccccacccaccagtgaaaatgagcagaagcaggccttccccaagctgactggagtgaagggcaagttcatgtctgccagccaggacctggagcccaagcccctcttccccaagccagccttcggccagaagccacccctgagcacagagaacagccatgaagatgagagccccatgaagaatgtgagcagcagcaagggcagccctgcccccctgggcgtgcgcagcaagagcggccccctgaagccagccagagaagattctgagaacaaggaccatgctggggagatcagcagcctgcccttccctggggtggtgctgaagccagctgccagcagaggaggccctggcctgagcaagaatggagaggagaagaaggaggacaggaagattgatgctgccaagaacaccttccagagcaagatcaaccaggaggagctggccagcggcaccccaccagcccgcttccccaaggcccccagcaagctgactgtgggcggcccctggggccagagccaggagaaggagaagggggacaagaacagcgccacccccaagcagaagcccctgcccccactcttcaccctgggccccccaccacccaagcccaacagacctccaaatgtggacctgaccaagttccacaagaccagcagcggcaacagcaccagcaagggccagaccagctacagcaccaccagcctgcccccacctccacccagccacccagccagccagccccccctgcctgccagccaccccagccagccccctgtgcccagcctgccccccaggaacatcaagcccccatttgacctgaagagccctgtgaatgaagacaaccaggatggagtgacccacagtgatggagctggcaacctggatgaggagcaggacagcgagggggagacctatgaagatattgaggccagcaaggagcgggagaagaagcgggagaaggaggagaagaagaggctggagctggagaagaaggagcagaaggagaaggagaagaaggagcaggagatcaagaagaagttcaagctgaccggccccatccaggtgatccacctggccaaggcctgctgtgatgtgaagggcggcaagaatgagctgtccttcaagcagggcgagcagatcgagatcatccgcatcacagacaaccctgagggcaagtggctgggccgcacagcccggggcagctatggctacatcaagaccacagctgtggagattgattatgacagcctgaagctgaagaaggacagcctgggcgcccccagccggcccattgaagatgaccaggaggtgtatgatgatgtggccgagcaggatgacatcagcagccacagccagagcggcagcggcggcatcttccccccacctccagatgatgacatctatgatggcatcgaggaggaggatgctgatgatggcagcaccctgcaggtgcaggagaagagcaacacctggagctggggcatcctgaagatgctgaagggcaaggatgacaggaagaagagcatccgggagaagcccaaggtgtctgacagcgacaacaatgaaggcagcagcttccctgccccacccaagcagctggacatgggagatgaggtgtatgatgatgtggacaccagtgacttccctgtgtcctctgctgagatgagccagggcaccaacgtgggcaaggccaagacagaggagaaggacctgaagaagctgaagaagcaggagaaggaggagaaggacttcaggaagaagttcaagtatgatggagagatccgggtgctgtacagcaccaaggtgaccaccagcatcaccagcaagaagtggggcacccgggacctgcaggtgaagccaggagagagcctggaggtgatccagaccacagatgacaccaaggtgctgtgcagaaatgaggagggcaagtatggctacgtgctgcggagctacctggccgacaatgatggagagatctatgatgacattgctgatggctgcatctatgacaatgactag

SEQ ID NO: 21924 - DNA, 795 bp, Artificial Sequence
  Description of Artificial Sequence: Synthetic coding sequence
atgccagacagcgccccagccatggctgacaagatggacatgagcctggatgacatcatcaagctgaacagaagccagaggggcggccggggcggcggccggggccggggccgggccggcagccagggcggccggggcggcggggcccaggccgccgcccgggtgaacagaggaggcggccccatccggaacagacctgccatcgcccggggagctgctgggggcggcggcaggaacagacctgccccctacagccggcccaagcagctgcctgacaagtggcagcacgacctgtttgattctggctttggaggaggagctggggtggagactggaggcaagctgctggtgagcaacctggactttggagtgtctgatgctgacatccaggagctgtttgctgagtttggcaccctgaagaaggctgctgtgcactatgacagaagtggccgcagcctgggcacagcagatgtgcactttgagaggaaggcagatgccctgaaggccatgaagcagtacaacggggtgcccctggatggccggcccatgaacatccagctggtgaccagccagattgatgcccagaggaggcctgcccagagcgtgaacagaggaggcatgaccaggaacagaggagctgggggctttggaggcggcggcggcacccggcggggcacccggggcggggcccggggccggggcagaggagctggaagaaacagcaagcagcagctgtctgctgaggagctggatgcccagctggatgcctacaatgccaggatggacaccagctag

SEQ ID NO: 21925 - DNA, 312 bp, Artificial Sequence
  Description of Artificial Sequence: Synthetic coding sequence
atggccaagcacggggctgatgagcccagcagccgcagcggcagcccagaccgggagggccgggccagcgaggacaggagcctgctgcaccagaggctggccgtgcgggagctgattgacacagaggtgtcctacctgcacatgctgcagctgtgtgccagtgacatccgcagccggctgcagcagctgccccagggcgacctggatgtgctcttcagcaacattgatgacatcatcaaggtgaacagccgcttcctgcatgacctgcaggagacagccagcaaggaggaggagcaggtgcagctggtgtag

SEQ ID NO: 21926 - DNA, 639 bp, Artificial Sequence
  Description of Artificial Sequence: Synthetic coding sequence
atgatgctgggcacagaaggaggagagggctttgtggtgaaggtgcggggcctgccctggagctgcagcgcagatgaggtgcagcgcttcttcagtgactgcaagatccagaatggagcccagggcatccgcttcatctacacccgggagggccggcccagcggggaggcctttgtggagctggagagtgaagatgaggtgaagctggccctgaagaaggaccgggagaccatgggccaccgctacgtggaggtgttcaagagcaacaacgtggagatggactgggtgctgaagcacacaggccccaacagcccagacacagccaatgatggctttgtgcggctgcggggcctgcccttcggctgcagcaaggaggagatcgtgcagttcttcagcggcctggagatcgtgcccaacggcatcaccctgcctgtggacttccagggccgcagcactggagaggcctttgtgcagtttgccagccaggagattgctgagaaggccctgaagaagcacaaggagcgcatcggccaccgctacatcgagatcttcaagagcagcagagctgaggtgaggacccactatgacccccccaggaagctgatggccatgcagaggcctggcccctatgacagatag

SEQ ID NO: 21927 - DNA, 1020 bp, Artificial Sequence; identical to SEQ ID NO: 19098
  Description of Artificial Sequence: Synthetic coding sequence

SEQ ID NO: 21928 - DNA, 3213 bp, Artificial Sequence
  Description of Artificial Sequence: Synthetic coding sequence
atggccggggccctgcggcggggccgggccctgggcagccggcccagcggccccaccgtgagcagcagaagaagcccccagtgccctgtggcccaggagggcctgggcgcccggagccggccccgggtggcccccaggagcctggcccgctgtggccccagcagccggctgatgggctggaagcccagcgaggcccggggccagagccagagcttccaggccagcggcctgcagcccaggagcctgaaggccgcccggcgggccaccggccgcccagacaggagcagagctgcccggcccaccatggaccccagcgcccacaggagcagagctgccccacccaacatggaccctgacccccaggccggcgtgcaggtgggcatgagggtggtgcggggcgtggactggaagtggggccagcaggacggcggggagggcggcgtgggcaccgtggtggagctgggcagacatggcagccccagcaccccagacagaacagtggtggtgcagtgggaccagggcaccaggaccaactacagagctggctaccagggcgcccatgacctgctgctgtatgacaatgcccagattggagtgcgccaccccaacatcatctgtgactgctgcaagaagcacggcctgcggggcatgcgctggaagtgccgggtgtgcctggactatgacctgtgcacccagtgctacatgcacaacaagcatgagctggcccacgcctttgacagatatgaaacagcccacagcaggcctgtgaccctgagcccccggcagggcctgccccgcatccccctgcggggcatcttccagggcgccaaggtggtgcggggccctgactgggagtggggcagccaggacggcggggagggcaagccaggccgggtggtggacatccggggctgggatgtggagaccggccgctctgtggcctctgtgacctgggcagatggcaccaccaacgtgtacagagtgggccacaagggcaaggtggacctgaagtgtgtgggggaggccgccggcggcttctactacaaggaccacctgccccggctgggcaagccagctgagctgcagaggagagtgtctgctgacagccagcccttccagcacggggacaaggtgaagtgcctgctggacacagatgtgctgcgggagatgcaggagggccacggcggctggaaccccaggatggccgagttcatcggccagacaggcaccgtgcaccgcatcacagacagaggagatgtgcgggtgcagttcaaccacgagacccgctggaccttccaccctggggccctgaccaagcaccacagcttctgggtgggagatgtggtgcgggtcatcggggacctggacacagtgaagaggctgcaggccggccatggagagtggacagatgacatggccccagccctgggccgggtgggcaaggtggtgaaggtgtttggagatggcaacctgcgggtggccgtggccggccagcgctggaccttcagccccagctgcctggtggcctacagacctgaggaggatgccaacctggatgtggccgagcgggcccgggagaacaagagcagcctgtctgtggccctggacaagctgcgggcccagaagagtgaccctgagcaccctggccgcctggtggtggaggtggccctgggcaatgctgcccgggccctggacctgctgcggcggcggcctgagcaggtggacaccaagaaccagggccgcacagccctgcaggtggccgcctacctgggccaggtggagctgatccggctgctgctgcaggcccgggccggcgtggacctgcctgatgatgagggcaacacagccctgcactacgccgccctgggcaaccagcctgaggccaccagggtgctgctgtctgctggctgcagagcagatgccatcaacagcacccagagcacagccctgcacgtggccgtgcagaggggcttcctggaggtggtgcgggccctgtgtgagcggggctgtgatgtgaacctgcctgatgcccacagcgacacccccctgcacagcgccatctctgctggcactggagccagcggcatcgtggaggtgctgacagaggtgcccaacattgatgtgacagccaccaacagccagggcttcaccctgctgcaccacgccagcctgaagggccacgccctggccgtgaggaagatcctggcccgggcccggcagctggtggatgccaagaaggaggatggcttcaccgccctgcacctggccgccctgaacaaccaccgggaggtggcccagatcctgatccgggagggccgctgtgatgtgaatgtgaggaacaggaagctgcagagccccctgcacctggccgtgcagcaggcccacgtgggcctggtgcccctgctggtggatgctggctgcagcgtgaatgcagaagatgaggagggggacacagccctgcacgtggccctgcagaggcaccagctgctgcccctggtggctgatggagctggaggagaccccggccccctgcagctgctgagccggctgcaggccagcggcctgcccggcagcgctgagctgactgtgggcgctgctgtggcctgcttcctggccctggagggcgcagatgtgtcctacaccaaccaccggggccgcagccccctggacctggccgctgagggccgggtgctgaaggccctgcagggctgtgcccagcgcttccgggagcggcaggccggcggcggggccgcccctggcccccggcagaccctgggcacccccaacacagtgaccaacctgcacgtgggcgccgcccctggccctgaggccgctgagtgcctggtgtgcagcgagctggccctgctggtgctcttcagcccctgccagcacaggacagtgtgtgaggagtgtgcccggaggatgaagaagtgcatccgctgccaggtggtggtgtccaagaagctgcggccagatggcagcgaggtggccagcgctgccccagcccctggccccccccggcagctggtggaggagctgcagagccgctaccggcagatggaggagcgcatcacctgccccatctgcatcgacagccacatccggctggtgttccagtgtggccacggggcctgtgccccctgtggcagcgccctgagcgcctgccccatctgccggcagcccatccgggaccgcatccagatctttgtgtag

SEQ ID NO: 21929 - DNA, 957 bp, Artificial Sequence; identical to SEQ ID NO: 21665
  Description of Artificial Sequence: Synthetic coding sequence

SEQ ID NO: 21930 - DNA, 1044 bp, Artificial Sequence; identical to SEQ ID NO: 19065
  Description of Artificial Sequence: Synthetic coding sequence

SEQ ID NO: 21931 - DNA, 108 bp, Artificial Sequence
  Description of Artificial Sequence: Synthetic coding sequence
atgccccagaccttcagcggcggccggggctttgagctggacagcggcagtgatgacatggaccccggccggcccaggcctccccgggaccctgatgagctgcactag

SEQ ID NO: 21932 - DNA, 1179 bp, Artificial Sequence; identical to SEQ ID NO: 20458
  Description of Artificial Sequence: Synthetic coding sequence

SEQ ID NO: 21933 - DNA, 2052 bp, Artificial Sequence; identical to SEQ ID NO: 18853
  Description of Artificial Sequence: Synthetic coding sequence

SEQ ID NO: 21934 - DNA, 99 bp, Artificial Sequence
  Description of Artificial Sequence: Synthetic coding sequence
atggacttcttcagcagccacctgctggccgacagcagcagccctgccaccaacagcagccacacagatgcccacgagatcctggtgtctgacttctag

SEQ ID NO: 21935 - DNA, 858 bp, Artificial Sequence; identical to SEQ ID NO: 19433
  Description of Artificial Sequence: Synthetic coding sequence

SEQ ID NO: 21936 - DNA, 354 bp, Artificial Sequence; identical to SEQ ID NO: 20420
  Description of Artificial Sequence: Synthetic coding sequence

SEQ ID NO: 21937 - DNA, 7614 bp, Artificial Sequence
  Description of Artificial Sequence: Synthetic coding sequence
atggaggacttccggggcattgctgaggagagcttccccagcttcctgaccaacagcctgtttggaaacagcggcatcctggagaatgtgaccctgagcagcaacctgggcctgcctgtggccgtgtccaccctggcccgggacaggagcagcacagacaaccgctacccagacatccaggccagctacctggtggagggccgcttctctgtgcccagcggcagcagccctggcagccagagtgatgctgagccccgggagcggctgcagctgtccttccaggatgatgacagcatcagcaggaagaagagctatgtggagagccagaggctgagcaatgccctgagcaagcagagcgccctgcagatggagacagctggccctgaggaggagcctgctggggccacagagagcctgcagggccaggacctcttcaacagagccagccccctggagcaggcccaggacagccccatcgacttccacctgcagagctggatgaacaacaaggagcccaagatcgtggtgctggatgctgggaagcactttgaggacaagaccctgaagagtgacctgagccacaccagcctgctggagaatgagaagctgatcctgcccaccagcctggaggacagcagtgatgatgacattgatgatgagatgttttatgatgaccacctggaggcctactttgagcagctggccatccctggcatgatctatgaggacctggagggccctgagcccccagagaagggcttcaagctgcccaccaacggcctgcggcaggccaatgaaaatggcagcctgaactgcaagttccagagcgagaacaacagcagcctcatcagcctggacagccacagcagcgagaccacccacaaggagagcgaggagagccaggtgatctgcctgcccggcaccagcaacagcatcggcaccggggacagccgccgctacacagatggcatgctgcccttcagcagcggcacctggggcacagagaaggagattgagaacctgaagggcatcgtgcctgacctgaacagtgaatgtgccagcaaggatgtgctggtgaagaccctgcgggccattgatgtgaagctgaacagcgacaacttccatgatgccaatgccaacagaggaggctttgacctgacagatcctgtgaagcagggcgcagaatgtccccaccagaacaagacagtgctgcacatggatggctgcctggacacagagacccccaccgtgtccatccaggagaatgtggatgtggccagcctgaagcccatcagtgacagcggcatcaacttcacagatgccatctggagccccacctgtgaaagaaggacctgtgaatgtcatgagagcattgagaagaacaaggacaagacagacctgccccagagcgtggtgtaccagaatgaggagggccgctgggtgacagacctggcctactacaccagcttcaacagcaagcagaacctgaatgtgtccctgagtgatgagatgaatgaagacttccgcagcggcagcgaggcctttgacctgattgcccaggatgaggaggagttcaacaaggagcaccagttcatccaggaggagaacattgatgcccacaacacctctgtggccctgggggacacctcctggggcgccaccatcaactacagcctgctgaggaagagccgcagcaccagtgacctggacaaggatgatgccagctacctgcggctgagcctgggggagttctttgcccagaggtctgaggccctgggctgcctgggcggcggcaacaacgtgaagaggcccagctttggctacttcatccgcagccctgagaagcgggagcccatcgccctgatcaggaagagtgatgtgtcccggggcaacctggagaaggagatggcccacctgaaccacgacctgtacagcggggacctgaatgagcagagccaggcccagctgtctgagggcagcatcaccctgcaggtggaggccgtggagagcaccagccaggtggatgaaaatgatgtgaccctgacagctgacaagggcaagacagaggacaccttcttcatgagcaacaagccccagcgctacaaggacaagctgcctgacagcggggacagcatgctgcgcatcagcaccatcgccagcgccatcgccgaggcctctgtgaacacagaccccagccagctggccgccatgatcaaggccctgagcaacaagacccgggacaagaccttccaggaggatgagaagcagaaggactacagccacgtgcgccacttcctgcccaatgacctggagaagagcaatggcagcaatgccctggacatggagaagtacctgaagaagacagaggtgagccgctatgaaagtgccctggagaacttcagccgggcctccatgtctgacacctgggacctgagcctgcccaaggagcagaccacccaggacatccaccctgtggacctgagcgccacctctgtgtctgtgcgggccccagaagaaaatacagctgccatcgtgtatgtggagaatggagagagcgagaaccaggagagcttccgcaccatcaacagcagcaacagcgtgaccaaccgggagaacaacagcgctgtggtggatgtgaagacctgcagcattgacaacaagctgcaggatgtgggcaatgatgagaaggccaccagcatcagcacccccagcgacagctacagctctgtgaggaacccccgcatcaccagcctgtgcctgctgaaggactgtgaggagatccgggacaaccgggagaaccagaggcagaatgaatgtgtgtctgagatcagcaacagcgagaagcacgtgacctttgagaaccacagaattgtgagccccaagaacagcgacctgaagaacaccagccctgagcacggcggccggggctctgaagatgagcaggagagcttccggcccagcaccagccccctgagccacagcagccccagcgagatcagcggcaccagcagcagcggctgtgccctggagagctttggcagcgctgcccagcagcagcagcccccctgtgagcaggagctgagccccctggtgtgcagccctgctggggtgtcccggctgacctacgtgtctgagcctgagagcagctaccccaccacagccacagatgatgccctggaggacaggaagagtgacatcaccagcgagctgagcaccaccatcatccagggcagccctgctgccctggaggagcgggccatggagaagctgcgggagaaggtgcccttccagaacagaggcaagggcaccctgagcagcatcatccagaacaacagcgacaccaggaaggccacagagaccaccagcctgagcagcaagccagaatatgtgaagccagacttccgctggagcaaggaccccagcagcaagagcggcaacctgctggagaccagcgaggtgggctggaccagcaaccctgaggagctggaccccatccggctggccctgctgggcaagagcggcctgagctgccaggtgggcagcgccaccagccaccctgtgtcctgccaggagcccattgatgaggaccagaggatcagccccaaggacaagagcacagctggccgggagttcagcggccaggtgagccaccagaccaccagcgagaaccagtgcacccccatccccagcagcacagtgcacagctctgtggccgacatgcagaacatgcctgctgctgtgcacgccctgctgacccagcccagcctgtctgctgccccctttgcccagcgctacctgggcaccctgcccagcacaggcagcaccaccctgccccagtgccacgccggaaatgccaccgtgtgtggcttcagcggcggcctgccctacccagctgtggccggggagcctgtgcagaacagcgtggccgtgggcatctgcctgggcagcaacatcggcagcggctggatgggcaccagcagcctgtgcaacccctacagcaacaccctgaaccagaacctgctgagcaccaccaagcccttccctgtgcccagcgtgggcaccaactgtggcatcgagccctgggacagcggcgtgaccagcggcctgggctctgtgcgggtgcctgaggagctgaagctgccccacgcctgctgcgtgggcatcgccagccagaccctgctgtctgtgctgaaccccacagaccgctggctgcaggtgtccattggagtgctgagcatctctgtgaatggagagaaggtggacctgagcacctaccgctgcctggtgttcaagaacaaggccatcatccggccccacgccacagaggagatcaaggtgctcttcatccccagcagccctggggtcttccgctgcaccttctctgtggcctcctggccctgcagcacagatgctgagaccatcgtgcaggccgaggccctggccagcacagtgaccctgacagccatcgccgagagccctgtgattgaggtggagacagagaagaaggatgtgctggactttggagacctgacctacggcggctggaaggccctgcccctgaagctgatcaacagaactcatgccaccgtgcccatccgcctcatcatcaatgccaatgctgtggcctggcgctgcttcaccttcagcaaggagagcgtgcgggcccctgtggaggtggccccctgtgctgatgtggtgacccggctggccggccccagcgtggtgaaccacatgatgcctgccagctatgatggccaggaccctgagttcctgatgatctgggtgctcttccacagccccaagaagcagatcagcagcagtgacatcctggacagcgctgaggagttcagcgccaaggtggacatcgaggtggacagccccaaccccacccctgtgctgcggtctgtgtccctgcgggcccgggccggcatcgcccgcatccacgccccccgggacctgcagaccatgcacttcctggccaaggtggccagcagcaggaagcagcacctgcccctgaagaatgccggcaacatcgaggtgtacctggacatcaaggtgcctgagcagggcagccacttctctgtggaccccaagaacctgctgctgaagccaggagaggagcacgaggtgattgtgtccttcacccccaaggaccctgaggcctgtgaggagcgcatcctgaagatctttgtgcagcccttcggcccccagtatgaggtggtgctgaagggggaggtgatcagcagcggcagcaagcccctgagccctggcccctgcctggacatccccagcatcctgagcaacaagcagttcctggcctggggcggcgtgcccctgggccgcacccagctgcagaagctggccctgaggaacaacagcgccagcaccacccagcacctgcggctgctgatccggggccaggaccaggactgcttccagctgcagaacaccttcggcagcgagcagaggctgaccagcaactgtgagatccgcatccaccccaaggaggacatcttcatctctgtgctgtttgcccccacccggctgagctgcatgctggcccggctggagatcaagcagctgggcaacagaagccagcccggcatcaagttcaccatccccctgagcggctacggcggcaccagcaacctgatcctggagggcgtgaagaagctgagtgacagctacatggtgacagtgaatggcctggtgcctgggaaggagagcaagatcgtgttttctgtgaggaacacaggcagccgggccgcctttgtgaaggctgtgggcttcaaggacagccagaagaaggtgctgctggaccccaaggtgctgcgcatcttcccagacaagtttgtgctgaaggagaggacccaggagaatgtgaccctcatctacaaccccagcgaccggggcatcaacaacaagacagccacagagctgagcacagtgtacctgtttggaggagatgagatcagccggcagcagtacagaagagccctgctgcacaagccagagatgatcaagcagatcctgcctgagcacagcgtgctgcagaacatcaactttgtggaggccttccaggatgagctgctggtgacagaggtgtatgacctgccccagaggcccaatgatgtgcagctgttctacggctccatgtgcaagatcatcctgagcgtcatcggggagttccgggactgcatcagcagccgggagttcctgcagcccagcagcaaggccagcctggagagcaccagtgacctgggcgccagcggcaagcatggaggaaatgtgtccctggatgtgctgcctgtgaagggcccccagggcagccccctgctgagccgggccgcccggccccccctggaccagctggccagcgaggagccctggacagtgctgcctgagcacctgatcctggtggcccccagcccctgtgacatggccaagacaggccgcttccagatcgtgaacaacagcgtgcggctgctgcgctttgagctgtgctggccagcccactgcctgactgtgaccccccagcacggctgtgtggcccctgagagcaagctgcagatcctggtgagccccaacagcagcctgagcaccaagcagagcatgttcccctggagcggcctcatctacatccactgtgatgatggccagaagaagatcgtgaaggtgcagatccgggaggacctgacccaggtggagctgctgacccggctgaccagcaagcccttcggcatcctgagccctgtgtctgagcccagcgtgagccacctggtgaagcccatgaccaagccacccagcaccaaggtggagatccggaacaagagcatcaccttccccaccacagagcccggggagaccagcgagagctgcctggagctggagaaccacggcaccacagatgtgaagtggcacctgagcagcctggccccaccctacgtgaagggcgtggatgagagcggagatgtgttccgggccacctatgctgccttccgctgcagccccatcagcggcctgctggagagccacggcatccagaaggtgtccatcaccttcctgccccggggccgcggggactatgcccagttctgggatgtggagtgccaccccctgaaggagccccacatgaagcacaccctgcgcttccagctgagcggccagagcattgaagcagaaaatgaaccagaaaatgcctgcctgagcacagacagcctcatcaagattgaccacctggtgaagccccggcggcaggccgtgtctgaggccagcgcccgcatccctgagcagctggatgtgacagcccggggcgtgtatgccccagaagatgtgtaccgcttccggcccacctctgtgggggagagcaggaccctgaaggtgaacctgaggaacaacagcttcatcacccacagcctgaagttcctgagcccccgggagcccttctacgtgaagcacagcaagtacagcctgcgggcccagcactacatcaacatgcctgtgcagttcaagcccaagtctgctgggaagtttgaggccctgctggtgatccagacagatgagggcaagagcatcgccatccgcctcatcggggaggccctgggcaagaactag

SEQ ID NO: 21938 - DNA, 90 bp, Artificial Sequence
  Description of Artificial Sequence: Synthetic coding sequence
atgctgtgctggggcaatgccagctttggccagctgggcctgggcggcattgatgaggagatcgtgctggagcccaggaagagtgactag

SEQ ID NO: 21939 - DNA, 66 bp, Artificial Sequence
  Description of Artificial Sequence: Synthetic coding sequence
atggccaagtacaacacaggaggcaaccccacagaagatgtgtctgtgaacagccggcccttctag

SEQ ID NO: 21940 - DNA, 261 bp, Artificial Sequence
  Description of Artificial Sequence: Synthetic coding sequence
atggaggccgacatcatcaccaacctgcgctgccgcctgaaggaggccgaggaggagcggctgaaggccgcccagtatggcctgcagctggtggagagccagaatgagctgcagaaccagctggacaagtgcagaaatgagatgatgaccatgacagagagctatgagcaggagaagtacaccctgcagcgggaggtggagctgaagagcaggatgctggagagcctgagctgtgaatgtgaggccatcaagcagcagtag

SEQ ID NO: 21941 - DNA, 1983 bp, Artificial Sequence
  Description of Artificial Sequence: Synthetic coding sequence
atggtgaccagcctgaatgaagataatgaatctgtgacagtggagtggattgaaaatggagacaccaagggcaaggagattgacctggagagcatcttcagcctgaacccagacctggtgcctgatgaggagattgagcccagccctgagaccccacctcctccagccagcagcgccaaggtgaacaagatcgtgaagaacagaagaacagtggccagcatcaagaatgacccccccagccgggacaacagagtggtgggcagcgcccgggcccggcccagccagtttcctgagcagagcagcagcgcccagcagaatgcccggaggaagagcaactgtgtgaaggaggtggagaagctgcaggagaagcgggagaagaggcggctgcagcagcaggagctgcgggagaagagggcccaggatgtggatgccaccaaccccaactatgagatcatgtgcatgatccgggacttccggggcagcctggactaccggcccctgaccacagctgaccccattgatgagcaccgcatctgtgtgtgtgtgaggaagaggcccctgaacaagaaggagacccagatgaaggacctggatgtgatcaccatccccagcaaggatgtggtgatggtgcatgagcccaagcagaaggtggacctgacccgctacctggagaaccagaccttccgctttgattatgcctttgatgattctgccccaaatgagatggtgtaccgcttcaccgcccggcccctggtggagaccatctttgagcggggcatggccacctgctttgcctacggccagacaggcagcggcaagacccacaccatgggcggggacttcagcggcaagaaccaggactgcagcaagggcatctatgccctggccgccagagatgtgttcctgatgctgaagaagcccaactacaagaagctggagctgcaggtgtatgccaccttctttgagatctacagcggcaaggtgtttgacctgctgaacaggaagaccaagctgcgggtgctggaggatggcaagcagcaggtgcaggtggtgggcctgcaggagcgggaggtgaagtgtgtggaggatgtgctgaagctgattgacatcggcaacagctgcaggaccagcggccagaccagcgccaatgcccacagcagccgcagccatgctgtgttccagatcatcctgcggaggaagggcaagctgcacggcaagttcagcctgattgacctggccggaaatgaaagaggagctgacaccagcagcgctgaccggcagacccggctggagggcgctgagatcaacaagagcctgctggccctgaaggagtgcatccgggccctgggcaggaacaagccccacacccccttccgggccagcaagctgacccaggtgctgcgggacagcttcatcggggagaacagcaggacctgcatgattgccaccatcagccctggcatggccagctgtgagaacaccctgaacaccctgcgctatgccaacagagtgaaggagctgactgtggaccccacagctgctggagatgtgcggcccatcatgcaccacccccccaaccagattgatgacctggagacccagtggggcgtgggcagcagcccccagagagatgacctgaagctgctgtgtgagcagaatgaggaggaggtgagcccccagctgttcaccttccatgaagctgtgtcccagatggtggagatggaggagcaggtggtggaggaccacagagctgtgttccaggagagcatccgctggctggaggatgagaaggccctgctggagatgacagaggaggtggactatgatgtggacagctatgccacccagctggaggccatcctggagcagaagattgacatcctgacagagctgcgggacaaggtgaagagcttccgggccgccctgcaggaggaggagcaggccagcaagcagatcaaccccaagaggccccgggccctgtag

SEQ ID NO: 21942 - DNA, 207 bp, Artificial Sequence
  Description of Artificial Sequence: Synthetic coding sequence
atgagcagcccccgggacttccgggcagagcctgtgaatgactatgagggcaatgacagcgaggccgaggacctgaacttccgggagaccctgcccagcagcagccaggagaacacccccaggagcaaggtgtttgagaacaaggtgaacagcgagaaggtgaagctgagcctgaggaacttcccccacaatgactatgaagattag

SEQ ID NO: 21943 - DNA, 294 bp, Artificial Sequence
  Description of Artificial Sequence: Synthetic coding sequence
atgaatggccgggctgacttccgggagcccaatgctgaggtgccccggcccatcccccacatcggccctgactacatccccacagaggaggagcggcgggtgtttgctgaatgtaatgatgagagcttctggttccgctctgtgcccctggccgccacctccatgctgatcacccagggcctcatcagcaagggcatcctgagcagccaccccaagtatggcagcatccccaagctgatcctggcctgcatcatgggctactttgctgggaagctgtcctatgtgaagacctag

SEQ ID NO: 21944 - DNA, 309 bp, Artificial Sequence
  Description of Artificial Sequence: Synthetic coding sequence
atggtgatggagaagcccagccccctgctggtgggccgggagtttgtgcggcagtactacaccctgctgaacaaggcccctgagtacctgcaccgcttctacggcaggaacagcagctatgtgcacggcggcgtggatgccagcggcaagccccaggaggccgtgtatggccagaatgacatccaccacaaggtgctgagcctgaacttcagcgagtgccacaccaagatcagacatgtggatgcccacgccaccctgagtgatggagtggtggtgcaggtgatgggcctgctgagcaacagcggctag

SEQ ID NO: 21945 - DNA, 597 bp, Artificial Sequence
  Description of Artificial Sequence: Synthetic coding sequence
atgggcaccacctgcctgcacctgggcaccctggagcagagcctggtgtttgagaacaaggtgaacagcgagaaggtgaagctgagcctgaggaacttcccccacaatgactatgaagatgtgtttgaggagcccagcgagagcggcagtgaccccagcatgtggacagcccggggccccttccggcgggaccgctggagcagtgaagatgaggaggccgccggccccagccaggccctgagccccctgctgagtgacaccaggaagatcgtgtctgagggggagctggaccagctggcccagatccggcccctcatcttcaacttccacgagcagacagccatcaaggactgcctgaagatcctggaggagaagacagctgcctatgacatcatgcaggagttcatggccctggagctgaagaacctgcccggggagttcaacagcggcaaccagcccagcaaccgggagaagaaccgctacagagacatcctgcccttccagcaccacggctacagcggccccaatgaaagaaccaccttctggcacggcagcaatgaaggagctgtgtccctgctgctgcgctactgtgcctag

SEQ ID NO: 21946 - DNA, 384 bp, Artificial Sequence; identical to SEQ ID NO: 18976
  Description of Artificial Sequence: Synthetic coding sequence

SEQ ID NO: 21947 - DNA, 426 bp, Artificial Sequence
  Description of Artificial Sequence: Synthetic coding sequence
atggtgatggagaagcccagccccctgctggtgggccgggagtttgtgcggcagtactacaccctgctgaacaaggcccctgagtacctgcaccgcttctacggcaggaacagcagctatgtgcacggcggcgtggatgccagcggcaagccccaggaggccgtgtatggccagaatgacatccaccacaaggtgctgagcctgaacttcagcgagtgccacaccaagatcagacatgtggatgcccacgccaccctgagtgatggagtggtggtgcaggtgatgggcctgctgagcaacagcggccagcctgagaggaagttcatgcagacctttgtgctggcccctgagggctctgtgcccaacaagttctacgtgcacaatgacatgttccgctatgaagatgaggtgtttggagacagctag

SEQ ID NO: 21948 - DNA, 135 bp, Artificial Sequence
  Description of Artificial Sequence: Synthetic coding sequence
atgctgctgctggactgcaaccctgaggtggatggcctgaagcacctgctggagactggagcctctgtgaatgcccccccagacccctgcaagcagagccctgtgcacctggccgccggcagcggcctggcctag

SEQ ID NO: 21949 - DNA, 399 bp, Artificial Sequence
  Description of Artificial Sequence: Synthetic coding sequence
atgaagaggggccgcctgcccagcagcagtgaagattctgatgacaatggcagcctgagcaccacctggagccagaacagccgcagccagcaccggcgcagcagctgcagcagacatgaggacaggaagcccagcgaggtgttcagaacagacctgatcacagccatgaagctgcatgacagctaccagctgaacccagatgagtactacgtgctggccgacccctggaggcaggagtgggagaagggcgtgcaggtgcctgtgtccccaggcaccatcccccagcctgtggcccgggtggtgtctgaggagaagagcctgatgttcatccggcccaagaagtacatcgtgagcagcggcagcgagcccccagagctgggctacgtggacatcagatag

SEQ ID NO: 21950 - DNA, 972 bp, Artificial Sequence; identical to SEQ ID NO: 20597
  Description of Artificial Sequence: Synthetic coding sequence

SEQ ID NO: 21951 - DNA, 312 bp, Artificial Sequence
  Description of Artificial Sequence: Synthetic coding sequence
atggcccagacagacaagcccacctgcatccccccagagctgcccaagatgctgaaggagtttgccaaggccgccatccgggcccagccccaggacctgatccagtggggcgctgactactttgaggccctgagcagaggagagaccccacctgtgcgggagaggtctgagcgggtggccctgtgcaactgggccgagctgaccccagagctgctgaagatcctgcacagccaggtggccggccgcctcatcatccgggcagaggagctggcccagatgtggaaggtggtgaacctgcccacagacctgtag

SEQ ID NO: 21952 - DNA, 540 bp, Artificial Sequence
  Description of Artificial Sequence: Synthetic coding sequence
atggaggatggcacccccaagcacatcatccagatgacaggcttcaagatggaggagaaggaggccctggtgaagctgctgctgaagctggactgcaccttcatcaagtctgagaagtacaagaactgcacccacctgattgctgagcggctgtgcaagtctgagaagttcctggccgcctgtgccgccggcaagtggatcctgaccaaggactacatcatccacagcgccaagagcggccgctggctggatgagaccacctatgagtggggctacaagattgagaaggacagccgctacagcccccagatgcagagcgcccccaagcgctggagggaggagctgaagaggactggagcccctggggccttccaccgctggaaggtggtgctgctggtgaggacagacaagagaagtgacagcctcatcaggaagaagttcaggatgatgaagatccccaagcccatcctgtttggcctgaacatcgccatgaagaagcagaccaagatcagcggcaagatgcaggacttcctgaagtag

SEQ ID NO: 21953 - DNA, 453 bp, Artificial Sequence
  Description of Artificial Sequence: Synthetic coding sequence
atggaggccgacatcatcaccaacctgcgctgccgcctgaaggaggccgaggaggagcggctgaaggccgcccagtatggcctgcagctggtggagagccagaatgagctgcagaaccagctggacaagtgcagaaatgagatgatgaccatgacagagagctatgagcaggagaagtacaccctgcagcgggaggtggagctgaagagcaggatgctggagagcctgagctgtgaatgtgaggccatcaagcagcagcagaagatgcacctggagaagctggaggagcagctgagccgcagccacggccaggaggtgaatgagctgaagaccaagattgagaagctgaaggtggagctggatgaggcccggctgtctgagaagcagctgaagcaccaggtggaccaccagaaggagctgctgagctgcaagtctgaggagctgcgggtgtag

SEQ ID NO: 21954 - DNA, 738 bp, Artificial Sequence; identical to SEQ ID NO: 18499
  Description of Artificial Sequence: Synthetic coding sequence

SEQ ID NO: 21955 - DNA, 180 bp, Artificial Sequence
  Description of Artificial Sequence: Synthetic coding sequence
atggtgatggagaagcccagccccctgctggtgggccgggagtttgtgcggcagtactacaccctgctgaacaaggcccctgagtacctgcaccgcttctacggcaggaacagcagctatgtgcacggcggcgtggatgccagcggcaagccccaggaggccgtgtatggccagaactag

SEQ ID NO: 21956 - DNA, 597 bp, Artificial Sequence; identical to SEQ ID NO: 21945
  Description of Artificial Sequence: Synthetic coding sequence

SEQ ID NO: 21957 - DNA, 465 bp, Artificial Sequence
  Description of Artificial Sequence: Synthetic coding sequence
atggccagcgccagcgcccggggcaaccaggacaaggatgcccacttccccccacccagcaagcagagcctgctcttctgccccaagagcaagctgcacatccacagagctgagatcagcaagatcatgagggagtgccaggaggagagcttctggaagagggccctgcccttcagcctggtgtccatgctggtgacccagggcctggtgtaccagggctacctggccgccaacagcagatttggcagcctgcccaaggtggccctggccggcctgctgggcttcggcctgggcaaggtgtcctacatcggcgtgtgccagagcaagttccacttctttgaggaccagctgcggggggccggcttcggcccccagcacaacagacactgcctgctgacctgtgaggagtgcaagatcaagcacggcctgtctgagaagggggacagccagcccagcgccagctag

SEQ ID NO: 21958 - DNA, 2520 bp, Artificial Sequence; identical to SEQ ID NO: 18712
  Description of Artificial Sequence: Synthetic coding sequence

SEQ ID NO: 21959 - DNA, 54 bp, Artificial Sequence
  Description of Artificial Sequence: Synthetic coding sequence
atggatgagggcatggagatcagcagcgagggcaacagcctcatcaaggcctag

SEQ ID NO: 21960 - DNA, 2394 bp, Artificial Sequence
  Description of Artificial Sequence: Synthetic coding sequence
atgggcgtgtcccggctgatggacctgctggccgacagccgggaggtgatcagaaatgatggagtgctgctgctgcaggccctgaccaggagcaatggagccatccagaagatcgtggcctttgaaaatgcctttgagcggctgctggacatcatcagcgaggagggcaacagtgatggcggcatcgtggtggaggactgcctgatcctgctgcagaacctgctgaagaacaacaacagcaaccagaacttcttcaaggagggcagctacatccagaggatgaagccctggtttgaggtgggagatgaaaattctggctggagcgcccagaaggtgaccaacctgcacctgatgctgcagctggtgcgggtgctggtgagccccaccaaccccccaggggccaccagcagctgccagaaggccatgttccagtgtggcctgctgcagcagctgtgcaccatcctgatggccaccggggtgcctgctgacatcctgacagagaccatcaacacagtgtctgaggtgatccggggctgccaggtgaaccaggactactttgcctctgtgaatgcccccagcaacccccccaggcctgccatcgtggtgctgctgatgtccatggtgaatgaaaggcagccctttgtgctgcgctgtgctgtgctgtactgcttccagtgcttcctgtacaagaaccagaagggccagggcgagatcgtgtccaccctgctgcccagcaccattgatgccaccggcaacagcgtgtctgctggccagctgctgtgtggcggcctcttcagcacagacagcctgagcaactggtgtgccgctgtggccctggcccacgccctgcaggagaatgccacccagaaggagcagctgctgcgggtgcagctggccaccagcatcggcaacccccctgtgtccctgctgcagcagtgcaccaacatcctgagccagggcagcaagatccagaccagggtgggcctgctgatgctgctgtgcacctggctgagcaactgccccatcgctgtgacccacttcctgcacaacagcgccaacgtgcccttcctgaccggccagattgctgagaacctgggggaggaggagcagctggtgcagggcctgtgtgccctgctgctgggcatcagcatctacttcaatgacaacagcctggagagctacatgaaggagaagctgaagcagctgattgagaagagaattggcaaggagaacttcatcgagaagctgggcttcatcagcaagcatgagctgtacagccgggccagccagaagccccagcccaacttccccagccctgagtacatgatctttgaccacgagttcaccaagctggtgaaggagctggagggcgtcatcaccaaggccatctacaagagcagcgaggaggacaagaaggaggaggaggtgaagaagaccctggagcagcacgacaacatcgtgacccactacaagaacatgatccgggagcaggacctgcagctggaggagctgcggcagcaggtgtccaccctgaagtgccagaatgagcagctgcagacagctgtgacccagcaggtgtcccagatccagcagcacaaggaccagtacaacctgctgaagatccagctgggcaaggacaaccagcaccagggcagctacagcgagggcgcccagatgaatggcatccagcctgaggagatcggccgcctgcgggaggagattgaggagctgaagaggaaccaggagctgctgcagagccagctgacagagaaggacagcatgattgagaacatgaagagcagccagaccagcggcaccaatgagcagagcagcgccatcgtgtctgcccgggacagcgagcaggtggccgagctgaagcaggagctggccaccctgaagagccagctgaacagccagagcgtggagatcaccaagctgcagacagagaagcaggagctgctgcagaagacagaggcctttgccaagtctgtggaggtgcagggcgagacagagaccatcatcgccaccaagaccacagatgtggagggccgcctgagcgccctgctgcaggagaccaaggagctgaagaatgagatcaaggccctgtctgaggagaggacagccatcaaggagcagctggacagcagcaacagcaccatcgccatcctgcagacagagaaggacaagctggagctggagatcacagacagcaagaaggagcaggatgacctgctggtgctgctggccgaccaggaccagaagatcctgagcctgaagaacaagctgaaggacctgggccaccctgtggaggaggaggatgagctggagagcggggaccaggaggatgaagatgatgaaagtgaggaccccgggaaggacctggaccacatctag

SEQ ID NO: 21961 - DNA, 441 bp, Artificial Sequence
  Description of Artificial Sequence: Synthetic coding sequence
tgaagacacctgcgggccacccccaacacccggggcagcgcccggctgctgtgtgccgagatgcccaagaaggccggggccaccaccaagggcaagagccagagcaaggagcctgagcggcccctgccccccctgggccctgtggccgtggaccccaagggctgtgtgaccatcgccatccacgccaagccaggcagcaagcagaatgctgtgacagacctgacagctgaggccgtgaatgtggccatcgccgccccacccagcgagggggaggccaatgctgagctgtgccgctacctgagcaaggtgctggagctgaggaagagtgatgtggtgctggacaagaagctgcgggacctgctgaagatcgtgccctgcaagctggccaccaggacccagatcctgggcctgctggtggagtgcagcttcagccggctgtag

SEQ ID NO: 21962 - DNA, 243 bp, Artificial Sequence
  Description of Artificial Sequence: Synthetic coding sequence
atgaatggccgggctgacttccgggagcccaatgctgaggtgccccggcccatcccccacatcggccctgactacatccccacagaggaggagcggcgggtgtttgctgaatgtaatgatgagagcttctggttccgctctgtgcccctggccgccacctccatgctgatcacccagggcctcatcagcaagggcatcctgagcagccaccccaagtatggcagcatccccaagctgatctag

SEQ ID NO: 21963 - DNA, 360 bp, Artificial Sequence
  Description of Artificial Sequence: Synthetic coding sequence
atgaagaggggccgcctgcccagcagcagtgaagattctgatgacaatggcagcctgagcaccacctggagccagaacagccgcagccagcaccggcgcagcagctgcagcagacatgaggacaggaagcccagcgaggtgttcagaacagacctgatcacagccatgaagctgcatgacagctaccagctgaacccagatgagtactacgtgctggccgacccctggaggcaggagtgggagaagggcgtgcaggtgcctgtgtccccaggcaccatcccccagcctgtggcccgggtggtgtctgaggagaagagcctgatgttcatccggcccaagaagtacatcgtgagcagctag

SEQ ID NO: 21964 - DNA, 69 bp, Artificial Sequence
  Description of Artificial Sequence: Synthetic coding sequence
atggccaagtacaacacaggaggcaaccccacagaagatgtgtctgtgaacagccggcccttcagatag

SEQ ID NO: 21965 - DNA, 1059 bp, Artificial Sequence
  Description of Artificial Sequence: Synthetic coding sequence
atggctgctgctgtgcggcaggacctggcccagctgatgaacagcagcggcagccacaaggacctggccggcaagtaccggcagatcctggagaaggccatccagctgtctggagctgagcagctggaggccctgaaggcctttgtggaggccatggtgaatgaaaatgtgtccctggtgatcagccggcagctgctgacagacttctgcacccacctgcccaacctgcctgacagcacagccaaggagatctaccacttcaccctggagaagatccagcccagggtcatcagctttgaggagcaggtggccagcatccggcagcacctggccagcatctatgagaaggaggaggactggagaaatgctgcccaggtgctggtgggcatccccctggagaccggccagaagcagtacaacgtggactacaagctggagacctacctgaagatcgcccggctgtacctggaggatgatgatcctgtgcaggccgaggcctacatcaacagagccagcctgctgcagaatgaaagcaccaatgagcagctgcagatccactacaaggtgtgctacgcccgggtgctggactacagaaggaagttcatcgaggccgcccagcgctacaatgagctgagctacaagaccatcgtgcatgagagcgagcggctggaggccctgaagcacgccctgcactgcaccatcctggccagcgctggccagcagaggagcaggatgctggccaccctcttcaaggatgagcgctgccagcagctggccgcctacggcatcctggagaagatgtacctggaccgcatcatccggggcaaccagctgcaggagtttgctgccatgctgatgccccaccagaaggccaccacagcagatggcagcagcatcctggacagagctgtgattgagcacaacctgctgagcgccagcaagctgtacaacaacatcacctttgaggagctgggcgccctgctggagatcccagctgccaagcatgagaagccctgccagaggggcatcagccgcagcaaccactttgtgtccaagtag

SEQ ID NO: 21966 - DNA, 378 bp, Artificial Sequence
  Description of Artificial Sequence: Synthetic coding sequence
atggtgatggagaagcccagccccctgctggtgggccgggagtttgtgcggcagtactacaccctgctgaacaaggcccctgagtacctgcaccgcttctacggcaggaacagcagctatgtgcacggcggcgtggatgccagcggcaagccccaggaggccgtgtatggccagaatgacatccaccacaaggtgctgagcctgaacttcagcgagtgccacaccaagatcagacatgtggatgcccacgccaccctgagtgatggagtggtggtgcaggtgatgggcctgctgagcaacagcggccagcctgagaggaagttcatgcagacctttgtgctggcccctgagggctctgtgcccaacaagttctactag

SEQ ID NO: 21967 - DNA, 657 bp, Artificial Sequence
  Description of Artificial Sequence: Synthetic coding sequence
atgaatggccgggctgacttccgggagcccaatgctgaggtgccccggcccatcccccctgtgcccctggccgccacctccatgctgatcacccagggcctcatcagcaagggcatcctgagcagccaccccaagtatggcagcatccccaagctgatcctggcctgcatcatgggctactttgctgggaagctgtcctatgtgaagacctgccaggagaagttcaagaagctggagaacagccccctgggggaggccctgcggagcggccaggcccggcgcagcagccccccaggccactactaccagaagagcaaatatgacagctctgtgtctggccagagcagctttgtgaccagccctgctgctgacaacatcgagatgctgccccactatgagcccatccccttcagcagctccatgaatgaaagtgcccccaccggcatcacagaccacatcgtgcagggccctgaccccaacctggaggagagccccaagaggaagaacatcacctatgaggagctgaggaacaagaaccgggagagctatgaggtgtccctgacccagaagacagaccccagcgtgcggcccatgcatgagcgggtgcccaagaaggaggtgaaggtgaacaagtacggggacacctgggatgaatag

SEQ ID NO: 21968 - DNA, 243 bp, Artificial Sequence; identical to SEQ ID NO: 21962
  Description of Artificial Sequence: Synthetic coding sequence

SEQ ID NO: 21969 - DNA, 654 bp, Artificial Sequence
  Description of Artificial Sequence: Synthetic coding sequence
atgattgtgaatgactatgagggcaatgattctgaggccgaggacctgaacttccgggagaccctgcccagcagcagccaggagaacacccccaggagcaaggtgtttgagaacaaggtgaacagcgagaaggtgaagctgagcctgaggaacttcccccacaatgactatgaagatgtgtttgaggagcccagcgagagcggcagtgaccccagcatgtggacagcccggggccccttcagaagagaccgctggagcagtgaagatgaggaggccgccggccccagccaggccctgagccccctgctgagtgacaccaggaagatcgtgtctgagggggagctggaccagctggcccagatccggcccctcatcttcaacttccacgagcagacagccatcaaggactgcctgaagatcctggaggagaagacagctgcctatgacatcatgcaggagttcatggccctggagctgaagaacctgcctggagagttcaacagcggcaaccagcccagcaaccgggagaagaaccgctacagagacatcctgcccttccagcaccacggctacagcggccccaatgaaagaaccaccttctggcacggcagcaatgaaggagctgtgtccctgctgctgcgctactgtgcctag

SEQ ID NO: 21970 - DNA, 351 bp, Artificial Sequence
  Description of Artificial Sequence: Synthetic coding sequence
atgggccgcctggatggcaaggtgatcatcctgacagctgctgcccagggcatcggccaggccgccgccctggcctttgcccgggagggcgccaaggtgattgccacagacatcaatgaaagcaagctgcaggagctggagaagtacccaggcatccagaccagggtgctggatgtgaccaagaagaagcagattgaccagtttgccaatgaggtggagcggctggatgtgctcttcaacgtggccggctttgtgcaccacggcaccgtgctggactgtgaggagaaggactgggacttctccatgaacctgaatgtgcgctccatgtacctgatgatcaaggccttctag

SEQ ID NO: 21971 - DNA, 504 bp, Artificial Sequence
  Description of Artificial Sequence: Synthetic coding sequence
atgaaggccatcaagaagagcctgacagaggaggagtacctgtacctggacttcagccaccagacagagggctgcatcttccccctgcacacctctgtgaccctcttcctgctgagctactgtgactgcaagatcttcaagatctgcctggtggtgaccaaggaggtgtcccgggacagcagcctgctgagagatgacctgatccaggatgtggagatccagatcatcagccggcaggagctgccccccatcgtgcagaactgctgcctgcctgctgtggtggagaggagtgacaacttctgcagagctggcctggccgtggtgctgcggcacatcatccagaagagctatgaagctgaccccctgaagaaggagctgctggagctgctgggcttcaagaagacctgcctgaaggcctgtgccgaggtgtcccagtggacccggctgtgtgagctgaccatccccctggccatcgagaacttcctgcgggagagcagtgactag

SEQ ID NO: 21972 - DNA, 933 bp, Artificial Sequence; identical to SEQ ID NO: 19043
  Description of Artificial Sequence: Synthetic coding sequence

SEQ ID NO: 21973 - DNA, 237 bp, Artificial Sequence
  Description of Artificial Sequence: Synthetic coding sequence
atggtgatggagaagcccagccccctgctggtgggccgggagtttgtgcggcagtactacaccctgctgaacaaggcccctgagtacctgcaccgcttctacggcaggaacagcagctatgtgcacggcggcgtggatgccagcggcaagccccaggaggccgtgtatggccagaatgacatccaccacaaggtgctgagcctgaacttcagcgagtgccacaccaagatcagatag

SEQ ID NO: 21974 - DNA, 681 bp, Artificial Sequence; identical to SEQ ID NO: 19967
  Description of Artificial Sequence: Synthetic coding sequence

SEQ ID NO: 21975 - DNA, 1020 bp, Artificial Sequence; identical to SEQ ID NO: 19098
  Description of Artificial Sequence: Synthetic coding sequence

SEQ ID NO: 21976 - DNA, 1179 bp, Artificial Sequence; identical to SEQ ID NO: 20458
  Description of Artificial Sequence: Synthetic coding sequence

SEQ ID NO: 21977 - DNA, 654 bp, Artificial Sequence; identical to SEQ ID NO: 21969
  Description of Artificial Sequence: Synthetic coding sequence

SEQ ID NO: 21978 - DNA, 438 bp, Artificial Sequence; identical to SEQ ID NO: 20460
  Description of Artificial Sequence: Synthetic coding sequence

SEQ ID NO: 21979 - DNA, 207 bp, Artificial Sequence; identical to SEQ ID NO: 21942
  Description of Artificial Sequence: Synthetic coding sequence

SEQ ID NO: 21980 - DNA, 525 bp, Artificial Sequence
  Description of Artificial Sequence: Synthetic coding sequence
atggccaagtacaacacaggaggcaaccccacagaagatgtgtctgtgaacagccggcccttccgggtgacaggccccaacagcagcagcggcatccaggccaggaagaacctcttcaacaaccagggcaatgccagccccccagctggccccagcaatgtgcccaagtttggcagccccaagccccctgtggccgtgaagcccagcagcgaggagaagccagacaaggagcccaagccacccttcctgaagcccaccggggccggccagcgcttcggcaccccagccagcctgaccacccgggaccctgaggccaaggtgggcttcctgaagcctgtgggccccaagcccatcaacctgcccaaggaggacagcaagcccaccttcccctggcccccaggcaacaagcccagcctgcacagcgtgaaccaggaccatgacctgaagcccctgggccccaagagcggccccaccccacccaccagtgaaaatgagcagaagcaggccttccccaagctgacctag

SEQ ID NO: 21981 - DNA, 405 bp, Artificial Sequence
  Description of Artificial Sequence: Synthetic coding sequence
atgtctgatgatgctggggacaccctggccactggagacaaggccgaggtgacagagatgcccaacagcgacagcctgcctgaagatgctgaggtgcactgtgacagcgctgctgtgtcccatgagcccaccccagctgaccccagaggagagggccatgaaaatgctgctgtgcagggcgctggggccgccgccatcggcccccctgtgcagccccaggatgccaatgccctggagccccccctgaatggagatgtgacagaggacaccctggctgaatgtattgattctgtgtccctggaggccgagcccaggtctgagatccccctgcaggagcagaactacctggccgtggacagccccccatctgggggcggctgggccggctggggctcctggggctag

SEQ ID NO: 21982 - DNA, 432 bp, Artificial Sequence
  Description of Artificial Sequence: Synthetic coding sequence
atgaagaggggccgcctgcccagcagcagtgaagattctgatgacaatggcagcctgagcaccacctggagccagaacagccgcagccagcaccggcgcagcagctgcagcagacatgaggacaggaagcccagcgaggtgttcagaacagacctgatcacagccatgaagctgcatgacagctaccagctgaacccagatgagtactacgtgctggccgacccctggaggcaggagtgggagaagggcgtgcaggtgcctgtgtccccaggcaccatcccccagcctgtggcccgggtggtgtctgaggagaagagcctgatgttcatccggcccaagaagtacatcgtgagcagcggcagcgagcccccagagctgggctacgtggacatccgcaccctggccgacagcgtgtgccgctatgacctgtag

SEQ ID NO: 21983 - DNA, 1200 bp, Artificial Sequence; identical to SEQ ID NO: 20179
  Description of Artificial Sequence: Synthetic coding sequence

SEQ ID NO: 21984 - DNA, 240 bp, Artificial Sequence
  Description of Artificial Sequence: Synthetic coding sequence
atggatgagagcgccctgctggacctgctggagtgccctgtgtgcctggagcggctggatgccagcgccaaggtgctgccctgccagcacaccttctgcaagcgctgcctgctgggcatcgtgggcagcagaaatgagctgcgctgcccagaatgtaggaccctggtgggcagcggcgtggaggagctgcccagcaacatcctgctggtgcggctgctggatggcatcaagcagaggtag

SEQ ID NO: 21985 - DNA, 621 bp, Artificial Sequence; identical to SEQ ID NO: 20459
  Description of Artificial Sequence: Synthetic coding sequence

SEQ ID NO: 21986 - DNA, 501 bp, Artificial Sequence
  Description of Artificial Sequence: Synthetic coding sequence
atgaaggccatcaagaagagcctgacagaggaggagtacctgtacctggacttcagccaccagacagagggctgcatcttccccctgcacacctctgtgaccctcttcctgctgagctactgtgactgcaagatcttcaagatctgcctggtggtgaccaaggaggtgtcccgggacagcagcctgctgagagatgacctgatccaggatgtggagatccagatcatcagccggcaggagctgccccccatcgtgcagaactgctgcctgcctgctgtggtggagaggagtgacaacttctgcagagctggcctggccgtggtgctgcggcacatcatccagaagagctatgaagctgaccccctgaagaaggagctgctggagctgctgggcttcaagaagacctgcctgaaggcctgtgccgaggtgtcccagtggacccggctgtgtgagctgaccatccccctggccatcgagaacttcctgcgggagagcagctag

SEQ ID NO: 21987 - DNA, 363 bp, Artificial Sequence; identical to SEQ ID NO: 21922
  Description of Artificial Sequence: Synthetic coding sequence

SEQ ID NO: 21988 - DNA, 351 bp, Artificial Sequence
  Description of Artificial Sequence: Synthetic coding sequence
atggtgatggagaagcccagccccctgctggtgggccgggagtttgtgcggcagtactacaccctgctgaacaaggcccctgagtacctgcaccgcttctacggcaggaacagcagctatgtgcacggcggcgtggatgccagcggcaagccccaggaggccgtgtatggccagaatgacatccaccacaaggtgctgagcctgaacttcagcgagtgccacaccaagatcagacatgtggatgcccacgccaccctgagtgatggagtggtggtgcaggtgatgggcctgctgagcaacagcggccagcctgagaggaagttcatgcagacctttgtgctggccccctag

SEQ ID NO: 21989 - DNA, 480 bp, Artificial Sequence
  Description of Artificial Sequence: Synthetic coding sequence
atgtctgaccacagatatggagatggcggcagcaccttccagagcaccaccggccactgtgtgcacatgaggggcctgccctaccgggccacagaaaatgacatctacaacttcttcagccccctgaaccctgtgcgggtgcacattgaaattggaccagatggccgggtgactggagaggctgatgtggagtttgccacccatgaagatgctgtggccgccatgagcaaggacaaggccaacatgcagcaccgctacgtggagctgttcctgaacagcacagctggggccagcggcggggcctacggcagccagatgctgggcggcatgggcctgagcaaccagagcagctatggaggccctgccagccagcagctgagcggcggctacggcggcggctacggcggccagagctccatgagcggctatgaccaggtgctgcaggagaacagcagtgacttccagagcaacatcgcctag

SEQ ID NO: 21990 - DNA, 411 bp, Artificial Sequence; identical to SEQ ID NO: 21905
  Description of Artificial Sequence: Synthetic coding sequence

SEQ ID NO: 21991 - DNA, 462 bp, Artificial Sequence
  Description of Artificial Sequence: Synthetic coding sequence
atgaagctgaccagcgagaagctgcccaagaaccccttctacgcctctgtgtcccagtatgctgccaagaaccagaagttcttccagtggaagaaggagaagacagactacacccacgccaacctggtggacaaggccctgcagctgctgaaggagcgcatcctgaagggggacaccctggcctacttcctgcggggccagctgtactttgaggagggctggtatgaggaggccctggagcagtttgaggagatcaaggagaaggaccaccaggccacctaccagctgggcgtgatgtactatgatggcctgggcaccaccctggatgctgagaagggcgtggactacatgaagaagatcctggacagcccctgccccaaggcccggcacctgaagtttgctgctgcctacaacctgggccgggcctactatgagggcaaaggagtgaagaggagcaactag

SEQ ID NO: 21992 - DNA, 489 bp, Artificial Sequence
  Description of Artificial Sequence: Synthetic coding sequence
atggaggccctgctggagggcatccagaacagaggacatggaggcggcttcctgaccagctgtgaggccgagctgcaggagctgatgaagcagattgacatcatggtggcccacaagaagtctgagtgggagggccgcacccacgccctggagacctgcctgaagatccgggagcaggagctgaagagcctgcggagccagctggatgtgacccacaaggaggtgggcatgctgcaccagcaggtggaggagcacgagaagatcaagcaggagatgaccatggagtacaagcaggagctgaagaagctgcacgaggagctgtgcatcctgaagaggagctatgagaagctgcagaagaagcagatgagggagttccggggcaacaccaagaaccaccgggaggacagaagtgaaattgagcggctgacagccaagattgaggagttccggcagaagagcctggactgggagaagcagaggctcatctag

SEQ ID NO: 21993 - DNA, 1530 bp, Artificial Sequence; identical to SEQ ID NO: 20810
  Description of Artificial Sequence: Synthetic coding sequence

SEQ ID NO: 21994 - DNA, 90 bp, Artificial Sequence
  Description of Artificial Sequence: Synthetic coding sequence
atgaatggccgggctgacttccgggagcccaatgctgaggtgccccggcccatcccccacatcggccctgactacatccccacagaatag

SEQ ID NO: 21995 - DNA, 1236 bp, Artificial Sequence
  Description of Artificial Sequence: Synthetic coding sequence
atgattgtgaatgactatgagggcaatgattctgaggccgaggacctgaacttccgggagaccctgcccagcagcagccaggagaacacccccaggagcaaggtgtttgagaacaaggtgaacagcgagaaggtgaagctgagcctgaggaacttcccccacaatgactatgaagatgtgtttgaggagcccagcgagagcggcagtgaccccagcatgtggacagcccggggccccttcagaagagaccgctggagcagtgaagatgaggaggccgccggccccagccaggccctgagccccctgctgagtgacaccaggaagatcgtgtctgagggggagctggaccagctggcccagatccggcccctcatcttcaacttccacgagcagacagccatcaaggactgcctgaagatcctggaggagaagacagctgcctatgacatcatgcaggagttcatggccctggagctgaagaacctgcctggagagttcaacagcggcaaccagcccagcaaccgggagaagaaccgctacagagacatcctgccctatgacagcaccagggtgcccctgggcaagagcaaggactacatcaatgccagctacatcagaattgtgaactgtggggaggagtacttctacatcgccacccagggccccctgctgagcaccattgatgacttctggcagatggtgctggagaacaacagcaatgtcatcgccatgatcacccgggagattgaaggaggcatcatcaagtgctaccactactggcccatcagcctgaagaagcccctggagctgaagcacttccgggtcttcctggagaactaccagatcctgcagtacttcatcatccgcatgttccaggtggtggagaagagcacaggcaccagccacagcgtgaagcagctgcagttcaccaagtggccagaccacggcaccccagccagcgctgacagcttcatcaagtacatccgctatgccaggaagagccacctgaccggccccatggtggtgcactgcagcgctggcatcggccgcactggagtcttcctgtgtgtggatgtggtgttctgtgccatcgtgaagaactgcagcttcaacatcatggacatcgtggcccagatgagggagcagaggagcggcatggtgcagaccaaggagcagtaccacttctgctatgacatcgtgctggaggtgctgaggaagctgctgaccctggactag

SEQ ID NO: 21996 - DNA, 300 bp, Artificial Sequence
  Description of Artificial Sequence: Synthetic coding sequence
atggtgatggagaagcccagccccctgctggtgggccgggagtttgtgcggcagtactacaccctgctgaacaaggcccctgagtacctgcaccgcttctacggcaggaacagcagctatgtgcacggcggcgtggatgccagcggcaagccccaggaggccgtgtatggccagaatgacatccaccacaaggtgctgagcctgaacttcagcgagtgccacaccaagatcagacatgtggatgcccacgccaccctgagtgatggagtggtggtgcaggtgatgggcctgctgtcctag

SEQ ID NO: 21997 - DNA, 705 bp, Artificial Sequence
  Description of Artificial Sequence: Synthetic coding sequence
atggccagcagcgccaagtctgctgagatgcccaccatcagcaagacagtgaaccccaccccagacccccaccaggagtacctggacccccgcatcaccatcgccctgtttgaaattggcagccacagccccagctcctggggcagcctgcccttcctgaagaacagcagccaccaggtgacagagcagcagacagcccagaagttcaacaacctgctgaaggagatcaaggacatcctgaagaacatggccggctttgaggagaagatcacagaggccaaggagctgtttgaggagaccaacatcacagaagatgtgtctgcccacaaggagaacatccggggcctggacaagatcaatgagatgctgagcaccaacctgcctgtgtccctggcccctgagaaggaggacaatgagaagaagcaggagatgatcctggagaccaacatcacagaagatgtgtctgcccacaaggagaacatccggggcctggacaagatcaatgagatgctgagcaccaacctgcctgtgtccctggcccctgagaaggaggacaatgagaagaagcagcagatgatcatggagaaccagaacagcgagaacacagcccaggtgtttgcccgggacctggtgaaccggctggaggagaagaaggtgctgaatgagacccagcagagccaggagaaggccaagaaccggctgtag

SEQ ID NO: 21998 - DNA, 1095 bp, Artificial Sequence
  Description of Artificial Sequence: Synthetic coding sequence
atgtacttctgctggggcgctgacagccgggagctgcagaggagaagaacagctggcagccctggagctgagctgctgcaggccgccagcggggagcggcacagcctgctgctgctgaccaaccaccgggtgctgagctgtggggacaacagccggggccagctgggcagaagaggagcccagagaggagagctgcctgagcccatccaggccctggagaccctcatcgtggacctggtgtcctgtgggaaggagcacagcctggccgtgtgccacaagggccgggtgtttgcctggggcgccggcagcgagggccagctgggcattggagagttcaaggagatctccttcacccccaagaagatcatgaccctgaatgacatcaagatcatccaggtgtcctgtggccactaccacagcctggccctgagcaaggacagccaggtgttctcctggggcaagaacagccacggccagctgggcctgggcaaggagttccccagccaggccagcccccagagggtgcgcagcctggagggcatccccctggcccaggtggccgccggcggggcccacagctttgccctgagcctgtgtggcaccagctttggctggggcagcaacagcgctggccagctggccctgagcggcagaaatgtgcctgtgcagagcaacaagcccctgtctgtgggcgccctgaagaacctgggcgtggtgtacatcagctgtggagatgcccacacagctgtgctgacccaggacggcaaggtgttcaccttcggggacaacagaagtggccagctgggctacagccccaccccagagaagaggggcccccagctggtggagagaattgatggcctggtgtcccagattgactgtggcagctaccacaccctggcctacgtgcacaccaccggccaggtggtgtcctttggccacggccccagcgacaccagcaagcccacccaccctgaggccctgacagagaactttgacatcagctgcctgatctctgcagaagattttgtggatgtgcaggtgaagcacatctttgctggcacctacgccaactttgtgaccacccaccagtag

SEQ ID NO: 21999 - DNA, 348 bp, Artificial Sequence
  Description of Artificial Sequence: Synthetic coding sequence
atggccaagtacaacacaggaggcaaccccacagaagatgtgtctgtgaacagccggcccttccgggtgacaggccccaacagcagcagcggcatccaggccaggaagaacctcttcaacaaccagggcaatgccagccccccagctggccccagcaatgtgcccaagtttggcagccccaagccccctgtggccgtgaagcccagcagcgaggagaagccagacaaggagcccaagccacccttcctgaagcccaccggggccggccagcgcttcggcaccccagccagcctgaccacccgggaccctgaggccaaggtgggcttcctgaagcctgtgggcccctag

SEQ ID NO: 22000 - DNA, 486 bp, Artificial Sequence
  Description of Artificial Sequence: Synthetic coding sequence
atggccggcatcctgcggctggtggtgcagtggcccccaggccgcctgcagacagtgaccaagggcgtggagagcctcatctgcacagactggatccgccacaagttcaccaggagccgcatccctgagaaggtgttccaggccagcccagaagatcatgagaagtatggaggagacccccagaacccccacaagctgcacatcgtgacccgcatcaagagcaccaggagaagaccctactgggagaaggacatcatcaagatgctgggcctggagaaggcccacaccccccaggtgcacaagaacatccccagcgtgaatgccaagctgaaggtggtgaagcacctgatccgcatcaagcccctgaagctgccccagggcctgcctgctgaggagaacatgagcaacacctgcctgaagagcactggagagctggtggtgcagtggcacctgaagcctgtggagcagaaggcccacgagagctag

SEQ ID NO: 22001 - DNA, 516 bp, Artificial Sequence
  Description of Artificial Sequence: Synthetic coding sequence
atgaatggccgggctgacttccgggagcccaatgctgaggtgccccggcccatcccccacatcggccctgactacatccccacagaggaggagcggcgggtgtttgctgaatgtaatgatgagagcttctggttccgctctgtgcccctggccgccacctccatgctgatcacccagggcctcatcagcaagggcatcctgagcagccaccccaagtatggcagcatccccaagctgatcctggcctgcatcatgggctactttgctgggaagctgtcctatgtgaagacctgccaggagaagttcaagaagctggagaacagccccctgggggaggccctgcggagcggccaggcccggcgcagcagccccccaggccactactaccagaagagcaaatatgacagctctgtgtctggccagagcagctttgtgaccagccctgctgctgacaacatcgagatgctgccccactatgagcccatccccttcagcagctccatgaatgaaagctag

SEQ ID NO: 22002 - DNA, 438 bp, Artificial Sequence; identical to SEQ ID NO: 21885
  Description of Artificial Sequence: Synthetic coding sequence

SEQ ID NO: 22003 - DNA, 243 bp, Artificial Sequence
  Description of Artificial Sequence: Synthetic coding sequence
atggtgaccagcctgaatgaagataatgaatctgtgacagtggagtggattgaaaatggagacaccaagggcaaggagattgacctggagagcatcttcagcctgaacccagacctggtgcctgatgaggagattgagcccagccctgagaccccacctcctccagccagcagcgccaaggtgaacaagatcgtgaagaacagaagaacagtggccagcatcaagaatgacccccccagctag

SEQ ID NO: 22004 - DNA, 123 bp, Artificial Sequence
  Description of Artificial Sequence: Synthetic coding sequence
atgaaggccatcaagaagagcctgacagaggaggagtacctgtacctggacttcagccaccagacagagggctgcatcttccccctgcacacctctgtgaccctcttcctgctgagctactag

SEQ ID NO: 22005 - DNA, 192 bp, Artificial Sequence
  Description of Artificial Sequence: Synthetic coding sequence
atggaggccctgctggagggcatccagaacagaggacatggaggcggcttcctgaccagctgtgaggccgagctgcaggagctgatgaagcagattgacatcatggtggcccacaagaagtctgagtgggagggccgcacccacgccctggagacctgcctgaagatccgggagcaggagctgaagagctag

SEQ ID NO: 22006 - DNA, 594 bp, Artificial Sequence
  Description of Artificial Sequence: Synthetic coding sequence
atgtggacagcccggggccccttcagaagagaccgctggagcagtgaagatgaggaggccgccggccccagccaggccctgagccccctgctgagtgacaccaggaagatcgtgtctgagggggagctggaccagctggcccagatccggcccctcatcttcaacttccacgagcagacagccatcaaggactgcctgaagatcctggaggagaagacagctgcctatgacatcatgcaggagttcatgacaggcaccagccacagcgtgaagcagctgcagttcaccaagtggccagaccacggcaccccagccagcgctgacagcttcatcaagtacatccgctatgccaggaagagccacctgaccggccccatggtggtgcactgcagcgctggcatcggccgcactggagtcttcctgtgtgtggatgtggtgttctgtgccatcgtgaagaactgcagcttcaacatcatggacatcgtggcccagatgagggagcagaggagcggcatggtgcagaccaaggagcagtaccacttctgctatgacatcgtgctggaggtgctgaggaagctgctgaccctggactag

SEQ ID NO: 22007 - DNA, 2529 bp, Artificial Sequence
  Description of Artificial Sequence: Synthetic coding sequence
atgaagaggggccgcctgcccagcagcagtgaagattctgatgacaatggcagcctgagcaccacctggagccagaacagccgcagccagcaccggcgcagcagctgcagcagacatgaggacaggaagcccagcgaggtgttcagaacagacctgatcacagccatgaagctgcatgacagctaccagctgaacccagatgagtactacgtgctggccgacccctggaggcaggagtgggagaagggcgtgcaggtgcctgtgtccccaggcaccatcccccagcctgtggcccgggtggtgtctgaggagaagagcctgatgttcatccggcccaagaagtacatcgtgagcagcggcagcgagcccccagagctgggctacgtggacatccgcaccctggccgacagcgtgtgccgctatgacctgaatgacatggatgctgcctggctggagctgaccaatgaggagttcaaggagatgggcatgcctgagctggatgagtacaccatggagcgggtgctggaggagtttgagcagcgctgctatgacaacatgaaccacgccatcgagacagaggagggcctgggcatcgagtatgatgaagatgtggtgtgtgatgtgtgccagagcccagatggagaagatggaaatgagatggtgttctgtgacaagtgcaacatctgtgtgcaccaggcctgctacggcatcctgaaggtgcctgagggctcctggctgtgcaggacctgtgccctgggcgtgcagcccaagtgcctgctgtgccccaagaagggcggggccatgaagcccaccaggagcggcaccaagtgggtgcacgtgtcctgtgccctgtggatccctgaggtgtccatcggcagccctgagaagatggagcccatcaccaaggtgagccacatccccagcagccgctgggccctggtgtgcagcctgtgcaatgagaagtttggagccagcatccagtgcagcgtgaagaactgcaggacagccttccacgtgacctgtgcctttgaccggggcctggagatgaagaccatcctggctgaaaatgatgaggtgaagttcaagagctactgccccaagcacagcagccacaggaagccagaggagagcctgggcaagggggccgcccaggagaatggagcccctgagtgcagccccaggaaccccctggagccctttgccagcctggagcagaaccgggaggaggcccaccgggtgtctgtgaggaagcagaagctgcagcagctggaggatgagttctacacctttgtgaacctgctggatgtggcccgggccctgcggctgcctgaggaggtggtggacttcctgtaccagtactggaagctgaagaggaaggtgaacttcaacaagcccctcatcacccccaagaaggatgaggaggacaacctggccaagcgggagcaggatgtgctcttccggcggctgcagctgttcacccacctgcggcaggacctggagcgggtgaggaacctgacctacatggtgacccggcgggagaagatcaagaggtctgtgtgcaaggtgcaggagcagatcttcaacctgtacaccaagctgctggagcaggagcgggtgtctggagtgcccagcagctgcagcagcagcagcctggagaacatgctgctcttcaacagccccagcgtgggcccagatgcccccaagattgaggacctgaagtggcacagcgccttcttcaggaagcagatgggcaccagcctggtgcacagcctgaagaagccccacaagagggaccccctgcagaacagccctggcagcgagggcaagaccctgctgaagcagcctgacctgtgtggccggcgggagggcatggtggtgcctgagagcttcctgggcctggagaagacctttgctgaggcccggctcatcagcgcccagcagaagaatggagtggtgatgccagaccacggcaagagaagagacaaccgcttccactgtgacctgatcaagggggacctgaaggacaagagcttcaagcagagccacaagcccctgcggagcacagatgtgtcccagaggcacctggacaacacccgggccgccaccagccctggggtgggccagagcgcccctggcaccaggaaggagatcgtgcccaagtgcaatggcagcctcatcaaggtgaactacaaccagacagctgtgaaggtgcccaccaccccagccagccctgtgaagaactggggcggcttccgcatccccaagaagggggagcggcagcagcagggcgaggcccatgatggagcctgccaccagcacagcgactacccctacctgggcctgggccgggtgcctgccaaggagcgggccaagagcaagctgaagagtgacaatgaaaatgatggctacgtgcctgatgtggagatgtctgacagcgagagcgaggccagcgagaagaagtgcatccacaccagcagcaccatcagcagaagaacagacatcatccgccgcagcatcctggccagctag

SEQ ID NO: 22008 - DNA, 2490 bp, Artificial Sequence; identical to SEQ ID NO: 21923
  Description of Artificial Sequence: Synthetic coding sequence

SEQ ID NO: 22009 - DNA, 810 bp, Artificial Sequence
  Description of Artificial Sequence: Synthetic coding sequence
atgattgtgaatgactatgagggcaatgattctgaggccgaggacctgaacttccgggagaccctgcccagcagcagccaggagaacacccccaggagcaaggtgtttgagaacaaggtgaacagcgagaaggtgaagctgagcctgaggaacttcccccacaatgactatgaagatgtgtttgaggagcccagcgagagcggcagtgaccccagcatgtggacagcccggggccccttcagaagagaccgctggagcagtgaagatgaggaggccgccggccccagccaggccctgagccccctgctgagtgacaccaggaagatcgtgtctgagggggagctggaccagctggcccagatccggcccctcatcttcaacttccacgagcagacagccatcaaggactgcctgaagatcctggaggagaagacagctgcctatgacatcatgcaggagttcatgacaggcaccagccacagcgtgaagcagctgcagttcaccaagtggccagaccacggcaccccagccagcgctgacagcttcatcaagtacatccgctatgccaggaagagccacctgaccggccccatggtggtgcactgcagcgctggcatcggccgcactggagtcttcctgtgtgtggatgtggtgttctgtgccatcgtgaagaactgcagcttcaacatcatggacatcgtggcccagatgagggagcagaggagcggcatggtgcagaccaaggagcagtaccacttctgctatgacatcgtgctggaggtgctgaggaagctgctgaccctggactag

SEQ ID NO: 22010 - DNA, 492 bp, Artificial Sequence
  Description of Artificial Sequence: Synthetic coding sequence
atgatgctgggcacagaaggaggagagggctttgtggtgaaggtgcggggcctgccctggagctgcagcgcagatgaggtgcagcgcttcttcagtgactgcaagatccagaatggagcccagggcatccgcttcatctacacccgggagggccggcccagcggggaggcctttgtggagctggagagtgaagatgaggtgaagctggccctgaagaaggaccgggagaccatgggccaccgctacgtggaggtgttcaagagcaacaacgtggagatggactgggtgctgaagcacacaggccccaacagcccagacacagccaatgatggctttgtgcggctgcggggcctgcccttcggctgcagcaaggaggagatcgtgcagttcttcagcggcctggagatcgtgcccaacggcatcaccctgcctgtggacttccagggccgcagcactggagaggcctttgtgcagtttgccagccaggagtag

SEQ ID NO: 22011 - DNA, 759 bp, Artificial Sequence
  Description of Artificial Sequence: Synthetic coding sequence
atggccgccacagccagagaagatggagccagcggccaggagcggggccagaggggctgtgagcactatgaccggggctgcctgctgaaggccccctgctgtgacaagctgtacacctgccgcctgtgccacgacaacaatgaagaccaccagctggaccgcttcaaggtgaaggaggtgcagtgcatcaactgtgagaagatccagcacgcccagcagacctgtgaagaatgttccaccctgtttggagagtactactgtgacatctgccacctgtttgacaaggacaagaagcagtaccactgtgagaactgtggcatctgccgcatcggccccaaggaggacttcttccactgcctgaagtgcaacctgtgcctggccatgaacctgcagggccgccacaagtgcattgaaaatgtgtcccggcagaactgccccatctgcctggaggacatccacaccagccgggtggtggcccacgtgctgccctgtggccacctgctgcaccggggctaccgctgccccctgtgcatgcacagcgccctggacatgacccgctactggaggcagctggatgatgaggtggcccagacccccatgcccagcgagtaccagaacatgacagtggacatcctgtgcaatgactgcaatggccgcagcacagtgcagttccacatcctgggcatgaagtgcaagatctgtgagagctacaacacagcccaggccggcggccgccgcatcagcctggaccagcagtag

SEQ ID NO: 22012 - DNA, 594 bp, Artificial Sequence; identical to SEQ ID NO: 22006
  Description of Artificial Sequence: Synthetic coding sequence

SEQ ID NO: 22013 - DNA, 4203 bp, Artificial Sequence
  Description of Artificial Sequence: Synthetic coding sequence
tgaccacctcctcctcctccacccatgtggaaccccatgatcccagcctttgacctcttccagggcaaccacggctttgtggcccctgtggtgaccacagctgcccactggaggtctgtgaactacaccttccccccatctgtcatcagccacaccagccccaccaaggtgtggaggaacaaggatggcaccagcgcctaccaggtgcaggagacccctgtgtcccaggtggtgaggaagaagaccagctatgtgggcctggtgctggtgctgctgcggggcctgcccggcagcggcaagagcttcctggcccggaccctgcaggaggacaaccccagcggggtcatcctgagcacagatgactacttctacatcaatggccagtaccagtttgatgtgaagtacctgggggaggcccacgagtggaaccagaacagagccaaggaggcctttgagaagaagatcagccccatcatcatcgacaacaccaacctgcaggcctgggagatgaagccctacgtggccctgagccagaagcacaagtacaaggtgctcttccgggagccagacacctggtggaagttcaagcccaaggagctggcccggaggaacatccacggcgtgtccaaggagaagatcaccaggatgctggagcactaccagagatttgtgtctgtgcccatcatcatgagcagctctgtgcctgagaagattgaaagaattgagctgtgtgcctacagctgtgaagatagaagcaccagccccagagatgatgaggacatcatcagcgagaaggaggagaacatcctgagcctgagcctgaagcacctggagttcacagaggagaagaacctggatgtgaccaaggagaccatgctgcctgaaaatgtggcctacctgagcaatgctgacctgaacaagaggaggaaggagatcagtgacatgaaccccagcatccagagcgccctgatcctggagaccccccacatgtacttcagtgacagcgagagcaagctgcaggccacagacaagtcagaaaatgagcagatcgagatggtggccgtgaagggctacagcaagacagacacagacagctccatggagcgggtgagccccagcacctgctgcagcgagaacaaccaggaggactgtgacctggccaacagcggccccctgcagaatgagaagagcagccctggagagatcgtggaggagcgggccaccgtgaccaagaaggccttcggcaagcagaagagcaagagcaccctggagaagttccccaggcatgagctgagcaactttgtgggggactggcctgtggacaagaccatcggccagaggaccaagaggaacaggaagacagagaagaccagctctgtgcagagcgacaagaagtacaactacccccagagccacaagctggtgaacagcgtgtctgtgaacacagactgtgtgcagcagaggggcagcccccatgagagcgtggaggatggcaggaagagccagtgtgatgatgccagcgagcccctgaacagctacaagtatgatgcctacaagaacatcgacaagaacagcttcaacatcatgggagactggcccagcagtgacagcctggcccagcgggagcacaggagcaggatgcccaagacaggcctgtctgagcccaacctggagatcggcaccaatgacaagatgaatgagatcagcctgagcacagcccacgaggcctgctggggcaccagcagccagaagctgaagaccctgggcagcagcaacctgggcagcagcgagatgctgctgtctgagatgacctgtgagagccagacctgcctgagcaagaagagccacggccagcacaccagcctgcccctgaccttcaccaacagcgcccccaccgtgtctggagtggtggagccccagaccctggccgagtgccaggagcagatgcccaagagggaccccgggaaggaggtgggcatgtgcacccagacagagccccaggactttgccctgctgtggaagattgagaagaacaagatcagcatcagtgacagcatcaaggtgctgaccggccgcctggatggcttcaagcccaaggtgttcaacatcaacaccaagagtgatgtgcaggaggccatcccctacagagtgatgtatgacaagagcacctttgtggaggagagcgagctgaccagcgcagatgaaagtgagaacctgaacatcctgtgcaagctgtttggcagcttcagcctggaggccctgaaggacctgtatgagcgctgcaacaaggacatcatctgggccaccagcctgctgctggacagcgagaccaagctgtgtgaggacacagaatttgagaacttccagaagagctgtgatggcagccagatcggccccttcagcctgggcctgaacctgaaggagatcatcagccagaggggcaccctggagaacagcaacagccctgtgcctgagttcagccacggcatcggcatcagcaatgctgacagccagagcacctgtgatgctgagcggggcaacagcgagcaggccgagatgagagctgtgaccccagaaaatcatgagagcatgaccagcatcttccccagcgctgctgtgggcctgaagaacaacaatgacatcctgcccaacagccaggaggagctgctgtacagcagcaagcagagcttccctggcatcctgaaggccaccacccccaaggacatgtctgaaacagagaagaacctggtggtgacagaaacaggagacaacatccacagccccagccacttcagtgacatcttcaactttgtgagcagcaccagcaacctggagctgaatgaggagatctacttcacagacagcctggagatcaagagaaatgaaaacttccccaaggactatgtgaagttcagtgatgaggaggagttcatgaatgaagatgagaaggagatgaaggagatcctgatggccggcagcagcctgtctgctggggtgtctggagaggacaagacagagatcctgaaccccaccccagccatggccaagagcctgaccatcgactgcctggagctggccctgcccccagagctggccttccagctgaatgagctgtttggacctgtgggcatcgacagcggcagcctgactgtggaggactgtgtggtgcacatcgacctgaacctggccaaggtgattcatgagaagtggaaggagagcgtgatggagcggcagaggcaggaggaggtgtcctgtgggaagttcatgcaggaccccagcctggtgggccacacaggcctggacaaccctgagcagaagagcagccagaggacaggcaagaagctgctgaagaccctgacagccagcgagatgctgcccctgctggaccactggaacacccagaccaagaaggtgtccctgcgggagatcatgtctgaggagatcgccctgcaggagaagcacaacctgaagcgggagaccctgatgtttgagaaggactgtgccaccaagctgaaggagaagcagctgttcaagatcttccctgccatcaaccagaacttcctggtggacatcttcaaggaccacaactacagcctggagcacacagtgcagttcctgaactgtgtgctggagggggaccctgtgaagacagtggtggcccaggagtttgtgcaccagaatgaaaatgtgaccagccacacaggccagaagagcaaggagaagaaggactttgagtacccagactatgatgactacagagctgaggccttcctgcaccagcagaagaggatggagtgctacagcaaggccaaggaggcctaccgcatcggcaagaagaatgtggccaccttctacgcccagcagggcaccctgcacgagcagaagatgaaggaggccaaccacctggccgccatcgagatctttgagaaggtgaatgccagcctgctgccccagaatgtgctggacctgcacggcctgcacgtggatgaggccctggagcacctgatgagggtgctggagaagaagacagaggagttcaagcagaatggaggcaagccctacctgagcgtcatcaccggccggggcaaccacagccagggcggcgtggcccgcatcaagccagctgtgatcaagtacctgatcagccacagcttccgcttcagcgagatcaagccaggctgcctgaaggtgatgctgaagtag

SEQ ID NO: 22014 - DNA, 237 bp, Artificial Sequence
  Description of Artificial Sequence: Synthetic coding sequence
atgctgtgctggggctactggagcctgggccagcccggcatcagcaccaacctgcagggcatcgtggccgagccccaggtgtgtggcttcatcagtgacagatctgtgaaggaggtggcctgtggcggcaaccacagcgtcttcctgctggaggatggagaggtgtacacctgtggcctgaacaccaagggccagctgggccacgagcgggagggcaacaagccagagcagatctag

SEQ ID NO: 22015 - DNA, 738 bp, Artificial Sequence; identical to SEQ ID NO: 18499
  Description of Artificial Sequence: Synthetic coding sequence

SEQ ID NO: 22016 - DNA, 2112 bp, Artificial Sequence; identical to SEQ ID NO: 19204
  Description of Artificial Sequence: Synthetic coding sequence

SEQ ID NO: 22017 - DNA, 573 bp, Artificial Sequence
  Description of Artificial Sequence: Synthetic coding sequence
atggccggcacagcccggcatgaccgggagatggccatccaggccaagaagaagctgaccacagccacagaccccatcgagcggctgcggctgcagtgcctggcccggggcagcgctggcatcaagggcctgggccgggtcttccgcatcatggatgatgacaacaacagaaccctggacttcaaggagttcatgaagggcctgaatgactatgctgtggtgatggagaaggaggaggtggaggagctgttcagaagatttgacaaggatggaaatggcaccatcgacttcaatgagttcctgctgaccctgcggccccccatgagccgggccaggaaggaggtgatcatgcaggccttcaggaagctggacaagacaggagatggagtcatcaccatcgaggacctgcgggaggtgtacaatgccaagcaccaccccaagtaccagaatggagagtggagcgaggagcaggtgttcaggaagttcctggacaactttgacagcccctatgacaaggatggcctggtgaccccagaggagttcatgaactactatgctggggtgtctgcctag

SEQ ID NO: 22018 - DNA, 231 bp, Artificial Sequence
  Description of Artificial Sequence: Synthetic coding sequence
atgaccccaccccagcagcccccacccctgcggtctgagcccggcaccctgggcagcgctgccagcagctacagccccctgggcctgaatggagtgcccggcagcatctgggactttgtgtctggcagcttcagccccagccccagccccatcctgtctgctggcccccccagcagcagcagcgccagccccaatggagctgagctggcccgggtgcggcggcagctgtag

SEQ ID NO: 22019 - DNA, 108 bp, Artificial Sequence
  Description of Artificial Sequence: Synthetic coding sequence
atggccaccctggtggtgaacaagctgggcgccggcgtggacagcggccggcagggcagccggggcacagctgtggtgaaggtgctggagtgtggggtgtgtgagtag

SEQ ID NO: 22020 - DNA, 477 bp, Artificial Sequence
  Description of Artificial Sequence: Synthetic coding sequence
atggaggccgacatcatcaccaacctgcgctgccgcctgaaggaggccgaggaggagcggctgaaggccgcccagtatggcctgcagctggtggagagccagaatgagctgcagaaccagctggacaagtgcagaaatgagatgatgaccatgacagagagctatgagcaggagaagtacaccctgcagcgggaggtggagctgaagagcaggatgctggagagcctgagctgtgaatgtgaggccatcaagcagcagcagaagatgcacctggagaagctggaggagcagctgagccgcagccacggccaggaggtgaatgagctgaagaccaagattgagaagctgaaggtggagctggatgaggcccggctgtctgagaagcagctgaagcaccaggtggaccaccagaaggagctgctgagctgcaagtctgaggagctgcgggtgatgtctgagcgggtgcaggagagctag

SEQ ID NO: 22021 - DNA, 393 bp, Artificial Sequence
  Description of Artificial Sequence: Synthetic coding sequence
atggcccagacagacaagcccacctgcatccccccagagctgcccaagatgctgaaggagtttgccaaggccgccatccgggcccagccccaggacctgatccagtggggcgctgactactttgaggccctgagcagaggagagaccccacctgtgcgggagaggtctgagcgggtggccctgtgcaactgggccgagctgaccccagagctgctgaagatcctgcacagccaggtggccggccgcctcatcatccgggcagaggagctggcccagatgtggaaggtggtgaacctgcccacagacctcttcaacagcgtgatgaatgtgggccgcttcacagaggagattgagtggctgaagttcctggccctggcctgcagcgccctgtag

SEQ ID NO: 22022 - DNA, 693 bp, Artificial Sequence
  Description of Artificial Sequence: Synthetic coding sequence
atggaggccgacatcatcaccaacctgcgctgccgcctgaaggaggccgaggaggagcggctgaaggccgcccagtatggcctgcagctggtggagagccagaatgagctgcagaaccagctggacaagtgcagaaatgagatgatgaccatgacagagagctatgagcaggagaagtacaccctgcagcgggaggtggagctgaagagcaggatgctggagagcctgagctgtgaatgtgaggccatcaagcagcagcagaagatgcacctggagaagctggaggagcagctgagccgcagccacggccaggaggtgaatgagctgaagaccaagattgagaagctgaaggtggagctggatgaggcccggctgtctgagaagcagctgaagcaccaggtggaccaccagaaggagctgctgagctgcaagtctgaggagctgcgggtgatgtctgagcgggtgcaggagagcatgagcagcgagatgctggccctgcagatcgagctgacagagatggagagcatgaagaccaccctgaaggaggaggtgaatgagctgcagtaccggcaggagcagctggagctgctgatcaccaacctgatgaggcaggtggaccggctgaaggaggagaaggaggagcgggagaaggaggccgtgtcctactacaatgccctggagaaggccaggtag

SEQ ID NO: 22023 - DNA, 639 bp, Artificial Sequence; identical to SEQ ID NO: 18369
  Description of Artificial Sequence: Synthetic coding sequence

SEQ ID NO: 22024 - DNA, 2844 bp, Artificial Sequence
  Description of Artificial Sequence: Synthetic coding sequence
atgaacttcctgcggggcgtgatgggcggccagagcgctggcccccagcacacagaggccgagaccgtgagaggagctgctgaccccaaggtgaccagcagctgtggcctgaagttccgccacagcttccggctggtgaagcacatcctgtaccacgtgaccatcaacgtgtacagcgacagcgagatcatcggctacgccctggacaccctgtacaacatcatcagcaatgaggaggaggaggaggtggaggagaacagcacccggcagagcgaggacctgggcagccagttcacagagatcttcatcaagcagcaggagaatgtgaccctgctgctgagcctgctggaggagtttgacttccacgtgcgctggccaggagtgaagctgctgaccagcctgctgaagcagctgggcccccaggtgcagcagatcatcctggtgagccccatgggcgtgtcccggctgatggacctgctggccgacagccgggaggtgatcagaaatgatggagtgctgctgctgcaggccctgaccaggagcaatggagccatccagaagatcgtggcctttgaaaatgcctttgagcggctgctggacatcatcagcgaggagggcaacagtgatggcggcatcgtggtggaggactgcctgatcctgctgcagaacctgctgaagaacaacaacagcaaccagaacttcttcaaggagggcagctacatccagaggatgaagccctggtttgaggtgggagatgaaaattctggctggagcgcccagaaggtgaccaacctgcacctgatgctgcagctggtgcgggtgctggtgagccccaccaaccccccaggggccaccagcagctgccagaaggccatgttccagtgtggcctgctgcagcagctgtgcaccatcctgatggccaccggggtgcctgctgacatcctgacagagaccatcaacacagtgtctgaggtgatccggggctgccaggtgaaccaggactactttgcctctgtgaatgcccccagcaacccccccaggcctgccatcgtggtgctgctgatgtccatggtgaatgaaaggcagccctttgtgctgcgctgtgctgtgctgtactgcttccagtgcttcctgtacaagaaccagaagggccagggcgagatcgtgtccaccctgctgcccagcaccattgatgccaccggcaacagcgtgtctgctggccagctgctgtgtggcggcctcttcagcacagacagcctgagcaactggtgtgccgctgtggccctggcccacgccctgcaggagaatgccacccagaaggagcagctgctgcgggtgcagctggccaccagcatcggcaacccccctgtgtccctgctgcagcagtgcaccaacatcctgagccagggcagcaagatccagaccagggtgggcctgctgatgctgctgtgcacctggctgagcaactgccccatcgctgtgacccacttcctgcacaacagcgccaacgtgcccttcctgaccggccagattgctgagaacctgggggaggaggagcagctggtgcagggcctgtgtgccctgctgctgggcatcagcatctacttcaatgacaacagcctggagagctacatgaaggagaagctgaagcagctgattgagaagagaattggcaaggagaacttcatcgagaagctgggcttcatcagcaagcatgagctgtacagccgggccagccagaagccccagcccaacttccccagccctgagtacatgatctttgaccacgagttcaccaagctggtgaaggagctggagggcgtcatcaccaaggccatctacaagagcagcgaggaggacaagaaggaggaggaggtgaagaagaccctggagcagcacgacaacatcgtgacccactacaagaacatgatccgggagcaggacctgcagctggaggagctgcggcagcaggtgtccaccctgaagtgccagaatgagcagctgcagacagctgtgacccagcaggtgtcccagatccagcagcacaaggaccagtacaacctgctgaagatccagctgggcaaggacaaccagcaccagggcagctacagcgagggcgcccagatgaatggcatccagcctgaggagatcggccgcctgcgggaggagattgaggagctgaagaggaaccaggagctgctgcagagccagctgacagagaaggacagcatgattgagaacatgaagagcagccagaccagcggcaccaatgagcagagcagcgccatcgtgtctgcccgggacagcgagcaggtggccgagctgaagcaggagctggccaccctgaagagccagctgaacagccagagcgtggagatcaccaagctgcagacagagaagcaggagctgctgcagaagacagaggcctttgccaagtctgtggaggtgcagggcgagacagagaccatcatcgccaccaagaccacagatgtggagggccgcctgagcgccctgctgcaggagaccaaggagctgaagaatgagatcaaggccctgtctgaggagaggacagccatcaaggagcagctggacagcagcaacagcaccatcgccatcctgcagacagagaaggacaagctggagctggagatcacagacagcaagaaggagcaggatgacctgctggtgctgctggccgaccaggaccagaagatcctgagcctgaagaacaagctgaaggacctgggccaccctgtggaggaggaggatgagctggagagcggggaccaggaggatgaagatgatgaaagtgaggaccccgggaaggacctggaccacatctag

SEQ ID NO: 22025 - DNA, 1095 bp, Artificial Sequence; identical to SEQ ID NO: 21896
  Description of Artificial Sequence: Synthetic coding sequence

SEQ ID NO: 22026 - DNA, 1236 bp, Artificial Sequence; identical to SEQ ID NO: 21995
  Description of Artificial Sequence: Synthetic coding sequence

SEQ ID NO: 22027 - DNA, 810 bp, Artificial Sequence; identical to SEQ ID NO: 22009
  Description of Artificial Sequence: Synthetic coding sequence

SEQ ID NO: 22028 - DNA, 360 bp, Artificial Sequence
  Description of Artificial Sequence: Synthetic coding sequence
atggccagccagctgcaggtgttcagcccccccagcgtgagcagcagcgccttctgcagcgccaagaagctgaagattgagcccagcggctgggatgtgtctggccagagcagcaatgacaagtactacacccacagcaagaccctgcctgccacccagggccaggccaacagcagccaccaggtggccaacttcaacatcccagcctatgaccagggcctgctgctgcctgccccagctgtggagcacatcgtggtgacagctgctgacagcagcggcagcgctgccaccagcaccttccagagcagccagaccctgacccacaggagcaatgtgtccctgctggagccctaccagtag

SEQ ID NO: 22029 - DNA, 339 bp, Artificial Sequence; identical to SEQ ID NO: 21921
  Description of Artificial Sequence: Synthetic coding sequence

SEQ ID NO: 22030 - DNA, 54 bp, Artificial Sequence
  Description of Artificial Sequence: Synthetic coding sequence
atgaagaggggccgcctgcccagcagcagtgaagattctgatgacaatggatag

SEQ ID NO: 22031 - DNA, 810 bp, Artificial Sequence; identical to SEQ ID NO: 18331
  Description of Artificial Sequence: Synthetic coding sequence

SEQ ID NO: 22032 - DNA, 339 bp, Artificial Sequence
  Description of Artificial Sequence: Synthetic coding sequence
atgaatggccgggctgacttccgggagcccaatgctgaggtgccccggcccatcccccacatcggccctgactacatccccacagaggaggagcggcgggtgtttgctgaatgtaatgatgagagcttctggttccgctctgtgcccctggccgccacctccatgctgatcacccagggcctcatcagcaagggcatcctgagcagccaccccaagtatggcagcatccccaagctgatcctggcctgcatcatgggctactttgctgggaagctgtcctatgtgaagacctgccaggagaagttcaagaagctggagaacagccccctgggggagtag

SEQ ID NO: 22033 - DNA, 687 bp, Artificial Sequence
  Description of Artificial Sequence: Synthetic coding sequence
atggaggagcagccccagatgcaggatgctgatgagcctgctgacagcggcggggagggccgggccggcggccccccccaggtggccggggcccaggccgcctgcagcgaggacaggatgaccctgctgctgcggctgcgggcccagaccaagcagcagctgctggagtacaagtccatggtggatgccagcgaggagaagaccccagagcagatcatgcaggagaagcagatcgaggccaagattgaggacctggagaatgaaattgaggaggtgaaggtggcctttgagatcaagaagctggccctggacagcgtgctgatggacaacatgaagcacctgctggagctgaacaagctgatcatgaagagccagcaggagagctgggacctggaggagaagctgctggacatcaggaagaagaggctgcagctgaagcaggccagcgagagcaagctgctggagatccagacagagaagaacaagcagaagattgacctggacagcatggagaacagcgagcgcatcaagatcatccggcagaacctgcagatggagatcaagatcaccaccgtcatccagcacgtgttccagaacctgatcctgggcagcaaggtgaactgggccgaggaccctgccctgaaggagatcgtgctgcagctggagaagaatgtggacatgatgtag

SEQ ID NO: 22034 - DNA, 2352 bp, Artificial Sequence; identical to SEQ ID NO: 19378
  Description of Artificial Sequence: Synthetic coding sequence

SEQ ID NO: 22035 - DNA, 393 bp, Artificial Sequence
  Description of Artificial Sequence: Synthetic coding sequence
atgatgctgggcacagaaggaggagagggctttgtggtgaaggtgcggggcctgccctggagctgcagcgcagatgaggtgcagcgcttcttcagtgactgcaagatccagaatggagcccagggcatccgcttcatctacacccgggagggccggcccagcggggaggcctttgtggagctggagagtgaagatgaggtgaagctggccctgaagaaggaccgggagaccatgggccaccgctacgtggaggtgttcaagagcaacaacgtggagatggactgggtgctgaagcacacaggccccaacagcccagacacagccaatgatggctttgtgcggctgcggggcctgcccttcggctgcagcaaggaggagatcgtgcagttctag

SEQ ID NO: 22036 - DNA, 267 bp, Artificial Sequence
  Description of Artificial Sequence: Synthetic coding sequence
atggaggccgacatcatcaccaacctgcgctgccgcctgaaggaggccgaggaggagcggctgaaggccgcccagtatggcctgcagctggtggagagccagaatgagctgcagaaccagctggacaagtgcagaaatgagatgatgaccatgacagagagctatgagcaggagaagtacaccctgcagcgggaggtggagctgaagagcaggatgctggagagcctgagctgtgaatgtgaggccatcaagcagcagcagaagtag

SEQ ID NO: 22037 - DNA, 1902 bp, Artificial Sequence; identical to SEQ ID NO: 19558
  Description of Artificial Sequence: Synthetic coding sequence

SEQ ID NO: 22038 - DNA, 597 bp, Artificial Sequence
  Description of Artificial Sequence: Synthetic coding sequence
atggccactggagacctgaagaggagcctgaggaacctggagcaggtgctgcggctgctgaactacccagaggaggtggactgtgtgggcctcatcaagggggaccctgctgccagcctgcccatcatctcctacagcttcaccagctacagcccctacgtgacagagctgatcatggagagcaatgtggagctgattgccaagaatgacctgcgcttcattgatgctgtgtacaagctgctgcgggaccagttcaactacaagcccatcctgaccaagaagcagttcatccagtgtggctttgctgagtggaagatccagatcgtgtgtgacatcctgaactgtgtgatgaagaagcacaaggagctgagcagcctgcagaagatccccagccagcagaggaagaagatcagcagcggcaagtctgagccccccctgggcaatgagaagatctctgctgaggccgtgggcgtggacatcagcggccgcttcatgaccagcggcaagaagaaggctgtggtgatccgccacctgtacaatgaagataatgtggacatcagcgaggacaccctgagccccatcacagatgtgaactag

SEQ ID NO: 22039 - DNA, 336 bp, Artificial Sequence
  Description of Artificial Sequence: Synthetic coding sequence
atggtgatggagaagcccagccccctgctggtgggccgggagtttgtgcggcagtactacaccctgctgaacaaggcccctgagtacctgcaccgcttctacggcaggaacagcagctatgtgcacggcggcgtggatgccagcggcaagccccaggaggccgtgtatggccagaatgacatccaccacaaggtgctgagcctgaacttcagcgagtgccacaccaagatcagacatgtggatgcccacgccaccctgagtgatggagtggtggtgcaggtgatgggcctgctgagcaacagcggccagcctgagaggaagttcatgcagacctag

SEQ ID NO: 22040 - DNA, 681 bp, Artificial Sequence; identical to SEQ ID NO: 19967
  Description of Artificial Sequence: Synthetic coding sequence

SEQ ID NO: 22041 - DNA, 1872 bp, Artificial Sequence
  Description of Artificial Sequence: Synthetic coding sequence
atgtctgatgaggtgttcagcaccaccctggcctacaccaagagccccaaggtgaccaagaggaccaccttccaggatgagctgatccgggccatcacagcccggagcgcccggcagaggagcagcgagtacagtgatgactttgacagtgatgaaattgtgtccctgggggacttcagtgacaccagcgcagatgagaacagcgtgaacaagaagatgaatgacttccacatcagtgatgatgaggagaagaaccccagcaagctgctcttcctgaagaccaacaagagcaatggaaacatcaccaaggatgagcctgtgtgtgccatcaagaatgaggaggagatggccccagatggctgtgaggacatcgtggtgaagagcttcagcgagagccagaacaaggatgaggagtttgagaaggacaagatcaagatgaagcccaagccccgcatcctgagcatcaagagcaccagcagcgctgagaacaacagcctggacacagatgaccacttcaagcccagcccccggcccaggtccatgctgaagaagaagagccacatggaggagaaggatggcctggaggacaaggagacagccctgtctgaggagctggagctgcacagcgcccccagcagcctgcccacccccaacggcatccagctggaggccgagaagaaggccttcagcgagaacctggaccctgaggacagctgcctgaccagcctggccagcagcagcctgaagcagatcctgggggacagcttcagccctggcagcgagggcaatgccagcggcaaggctgaccacgtgaccacagctgtggagaagagcaaggagagccaggtgacagcagatgacctggaggaggagaaggccaaggccgagctgatcatggatgatgacagaacagtggaccccctgctgagcaagagccagagcatcctgatcagcaccagcgccacagccagcagcaagaagaccatcgaggacaggaacatcaagaacaagaagagcaccaacaacagagccagcagcgccagcgcccggctgatgaccagcgagttcctgaagaagagcagcagcaagaggaggacccccagcaccaccaccagcagccactacctgggcaccctgaaggtgctggaccagaagcccagccagaagcagagcattgaaccagacagagctgacaacatccgggctgctgtgtaccaggagtggctggagaagaagaatgtgtacctgcacgagatgcaccgcatcaagagaattgaaagtgagaacctgcgcatccagaatgagcagaagaaggccgccaagcgggaggaggccctggccagctttgaggcctggaaggccatgaaggagaaggaggccaagaagattgctgccaagaagaggctggaggagaagaacaagaagaagacagaggaggagaatgctgccaggaaaggagaggccctgcaggcctttgagaagtggaaggagaagaagatggagtacctgaaggagaagaacaggaaggagcgggagtatgagcgggccaagaagcagaaggaggaggagaccgtggccgagaagaagaaggacaacctgacagctgtggagaagtggaatgagaagaaggaggccttcttcaagcagaaggagaaggagaagatcaatgagaagaggaaggaggagctgaagagagctgagaagaaggacaaggacaagcaggccatcaatgaatatgagaagtggctggagaacaaggagaagcaggagcgcatcgagaggaagcagaagaagaggcacagcttcctggagagcgaggccctgcccccctggagcccccccagcaggacagtgtttgccaaggtgttctag

SEQ ID NO: 22042 - DNA, 255 bp, Artificial Sequence
  Description of Artificial Sequence: Synthetic coding sequence
atgatgctgggcacagaaggaggagagggctttgtggtgaaggtgcggggcctgccctggagctgcagcgcagatgaggtgcagcgcttcttcagtgactgcaagatccagaatggagcccagggcatccgcttcatctacacccgggagggccggcccagcggggaggcctttgtggagctggagagtgaagatgaggtgaagctggccctgaagaaggaccgggagaccatgggccaccgctacgtggagtag

SEQ ID NO: 22043 - DNA, 993 bp, Artificial Sequence
  Description of Artificial Sequence: Synthetic coding sequence
atggaccagggcgacacccccaccctggaggaggacctgaagaagctgcagctgtctgagttctttgacatctttgagaaggagaaggtggacaaggaggccctggccctgtgcacagaccgggacctgcaggagatcggcatccccctgggccccaggaagaagatcctgaactacttcagcaccaggaagaacagcatgggcatcaagaggcctgccccccagcctgccagcggggccaacatccccaaggagagcgagttctgcagcagcagcaacaccagaaatggagactacctggatgtgggcatcggccaggtgtctgtgaagtaccccaggctcatctacaagccagagatcttctttgccttcggcagccccatcggcatgttcctgactgtgcggggcctgaagagaattgaccccaactaccgcttccccacctgcaagggcttcttcaacatctaccacccctttgatcctgtggcctaccgcatcgagcccatggtggtgcctggggtggagtttgagcccatgctgatcccccaccacaagggcaggaagaggatgcacctggagctgcgggagggcctgaccaggatgtccatggacctgaagaacaacctgctgggcagcctgaggatggcctggaagagcttcacccgggccccctacccagccctgcaggccagcgagaccccagaggagacagaagctgagcctgagagcaccagcgagaagcccagtgatgtgaacacagaggagacctctgtggccgtgaaggaggaggtgctgcccatcaacgtgggcatgctgaatggaggccagagaattgattatgtgctgcaggagaagcccatcgagagcttcaatgagtacctgtttgccctgcagagccacctgtgctactgggagagtgaagatactgtgctgctggtgctgaaggagatctaccagacccagggcatcttcctggaccagcccctgcagtag

SEQ ID NO: 22044 - DNA, 1383 bp, Artificial Sequence; identical to SEQ ID NO: 19538
  Description of Artificial Sequence: Synthetic coding sequence

SEQ ID NO: 22045 - DNA, 1068 bp, Artificial Sequence
  Description of Artificial Sequence: Synthetic coding sequence
atgacaggcagcgctgctgacacccaccgctgcccccaccccaagggggccaagggcaccaggagccgcagcagccacgcccggcctgtgtccctggccaccagcggcggcagcgaggaggaggacaaggatggcggcgtgctcttccacgtgaacaagagcggcttccccatcgacagccacacctgggagaggatgtggatgcacgtggccaaggtgcaccccaagggcggggagatggtgggcgccatcagaaatgctgccttcctggccaagcccagcatcccccaggtgcccaactaccgcctgtccatgaccatcccagactggctgcaggccatccagaactacatgaagaccctgcagtacaaccacacaggcacccagttctttgagatcaggaagatgaggcccctgagcggcctgatggagacagccaaggagatgacccgggagagcctgcccatcaagtgcctggaggccgtcatcctgggcatctacctgaccaacggccagcccagcattgagcgcttccccatctccttcaagacctacttcagcggcaactacttccaccacgtggtgctgggcatctactgcaatggccgctatggcagcctgggcatgagcagaagagctgagctgatggacaagcccctgaccttccgcaccctgagtgacctgatctttgattttgaagattcctacaagaagtacctgcacacagtgaagaaggtgaagattggcctgtatgtgccccatgagccccacagcttccagcccatcgagtggaagcagctggtgctgaatgtgtccaagatgctgcgggctgacatcaggaaggagctggagaagtatgcccgggacatgaggatgaagatcctgaagccagccagcgcccacagccccacccaggtgcgcagccggggcaagagcctgagcccccggcggcggcaggccagccccccccggcggctgggccggcgggagaagagccctgccctgcctgagaagaaggtggccgacctgagcaccctgaatgaggtgggctaccagatccgcatctag

SEQ ID NO: 22046 - DNA, 384 bp, Artificial Sequence
  Description of Artificial Sequence: Synthetic coding sequence
atggccagcaaccacaagagcagcgctgcccggcctgtgtcccggggcggcgtgggcctgaccggccggccccccagcggcatccggcccctgagcggcaacatccgggtggccacagccatgcctcctggaacagcccggcccggcagccggggctgccccatcggcactggaggagtgctgagcagccagatcaaggtggcccacaggcctgtgacccagcagggcctgaccggcatgaagacaggcaccaagggcccccagaggcagatcctggacaagagctactacctgggcctgctgcggagcaagatcagcgagctgaccacagaggtgaacaagctgcagaagggcatcgagatgtacaaccaggagaacagctag

SEQ ID NO: 22047 - DNA, 510 bp, Artificial Sequence
  Description of Artificial Sequence: Synthetic coding sequence
atgcacaagctgcagagcggcatcggccgcctcatcctgaaggaggagatgaaggcccggagcagcagctatgctgacccctggaccccacccaggagcagcaccagcagccgggaggccctgcacacagctggctatgagatgagcctgaatggcagccccaggagccactacctggccgacagcgaccccctcatcagcaagagcgccagcctgcctgcctacagaagaaatggcctgcacaggaccccatctgctgacctcttccactatgacagcatgaatgctgtgaactggggcatgagggagtacaagatctacccctatgagctgctgctggtgaccacccggggcaggaaccggctgcccaaggatgtggacaggacccggctggagcggcacctgagccaggaggagttctaccaggtgtttggcatgaccatcagcgagtttgaccggctggccctgtggaagagaaatgagctgaagaagcaggcccggctcttctag

SEQ ID NO: 22048 - DNA, 144 bp, Artificial Sequence
  Description of Artificial Sequence: Synthetic coding sequence
atggcctctgtgctgagccggcggctgggcaagaggagcctgctgggcgcccgggtgctgggccccagcgccagcgagggccccagcgctgccccacccagcgagcccctgctggagggcgccgccccccagcccttcacctag

SEQ ID NO: 22049 - DNA, 558 bp, Artificial Sequence
  Description of Artificial Sequence: Synthetic coding sequence
atggatgacagcatcaacaaccgcttctcctatgtgacccatgaggacatctgcaactgcttcaacggggacaccctgctggccatccaggcccccagcggcacccagctggaggtgcccatccctgagatgggccagaatggccagaagaagtaccagatcaacctgaagagccacagcggccccatccacgtgctgctgatcaacaaggagagcagcagcagcaagcctgtggtgtttcctgtgcccccaccagatgacctgacccagcccagcagccagagcctgacccctgtgaccccccagaagagctccatggccacccagaacctgcctgagcagcacgtgtctgagaggagccaggccctgcagcagaccagcgccacagacatcagcagcgctggcagcatcagcggggacatcattgatgagctgatgagcagtgatgtgttccccctgctgcggctgagccccaccccagcagatgactacaacttcaacctggatgacaatgaaggagtgtgtgacctgtttgatgtgcagatcctgaactactag

SEQ ID NO: 22050 - DNA, 492 bp, Artificial Sequence; identical to SEQ ID NO: 19389
  Description of Artificial Sequence: Synthetic coding sequence

SEQ ID NO: 22051 - DNA, 915 bp, Artificial Sequence
  Description of Artificial Sequence: Synthetic coding sequence
atgagcaagagaagaaggctgaagcagggcgagcccatcatgaccgggaagacccagaccagcaatgtgaccaacaagaatgaccccaagagcatcaacagcagggtcttcatcggcaacctgaacacagccatcgtgaagaaggtggacatcgaggccatcttcagcaaatatggcaagatcgtgggctgcagcgtgcacaagggctacgcctttgtgcagtacatgtctgaaagacatgcccgggctgctgtggccggggagaatgcccgggtgattgctggccagcccctggacatcaacatggccggggagcccaagccctaccggcccaagccaggcaacaagaggcccctgagcgccctgtaccgcctggagagcaaggagcccttcctgtctgtgggcggctacgtgtttgattatgactactacagagatgacttctacaaccggctgtttgactaccacggccgggtgcccccaccacccagggctgtgatccccctgaagaggccccgggtggccgtgaccaccacccggcggggcaaaggagtcttctccatgaagggcggcagccgcagcacagccagcggcagcacaggcagcaagctgaagagtgatgagctgcagaccatcaagaaggagctgacccagatcaagaccaagattgacagcctgctgggccgcctggagaagattgagaagcagcagaaggccgaggccgaggcccagaagaagcagctggaggagagcctggtgctgatccaggaggagtgtgtgtctgaaattgctgaccacagcacagaggagcctgctgagggcggcccagatgctgatggagaggagatgacagatggcattgaagaagattttgatgaagatggcggccacgagctgttcctgcagatcaagtag

SEQ ID NO: 22052 - DNA, 405 bp, Artificial Sequence
  Description of Artificial Sequence: Synthetic coding sequence
atgcccagcgctgaggccaagctgaagaagaacagatgtgccaactgctttgactgccccggctgcatgcacaccctgagcacccgggccaccagcatcagcacccagctgcctgatgatcctgccaagaccaccatgaagaaggcctactacctggcctgtggcttctgccgctggaccagcagagatgtgggcatggctgacaagtctgtggccagcggcggctggcaggagcctgagaacccccacacccagaggatgaacaagctgattgagtactaccagcagctggcccagaaggagaaggtggagcgggacaggaagaagctggccaggagaagaaactacatgcccctggccttcagtgacaagtatggcctgggcacccggctgcagaggccctag

SEQ ID NO: 22053 - DNA, 1230 bp, Artificial Sequence
  Description of Artificial Sequence: Synthetic coding sequence
atgtggagggtgattgagcccccctgccctggggcccccagcacagaaaatggcaagtctgtgcactggaagctgggcgctgacaaggaggtgtgggtgtgggtgatgggagagcaccacctggacaagccctatgatgtgctgtgcaatgagatcatcgccgagcgggcccggctgaaggccgagcaggaggccgaggagcccaggaagacccacagcgaggagttcaccaacagcctgaagaccaagagccagtaccatgacctgcaggccccagacaaccagcagaccaaggacatctggaagaaggtggccgagaaggaggagctggagcagggcagcaggcctgcccccaccctggaggaggagaagatccgcagcctgagcagcagcagcaggaacatccagcagatgctggccgacagcatcaacaggatgaaggcctatgccttccaccagaagaaggagagcatgaagaagaagcaggatgaggagatcaaccagatcgaggaggagaggaccaagcagatctgcaagtcctggaaggaggacagcgagtggcaggccagcctgaggaagagcaaggctgctgatgagaagagaagaagcctggccaagcaggcccgggaggactacaagaggctgagcctgggcgcccagaagggccggggcggggagcggctgcagagccccctgcgggtgccccagaagccagagaggcctcccctgccccccaagccccagttcctgaacagcggggcctacccccagaagcccctgaggaaccagggcgtggtgaggaccctgagcagcagcgcccaggaggacatcatccgctggttcaaggaggagcagctgcccctgcgggccggctaccagaagaccagtgacaccatcgccccctggttccacggcatcctgaccctgaagaaggccaatgagctgctgctgagcacaggcatgcctggcagcttcctgatccgggtgtctgagcgcatcaagggctacgccctgagctacctgtctgaagatggctgcaagcacttcctgattgatgccagcgcagatgcctacagcttcctgggcgtggaccagctgcagcacgccaccctggccgacctggtggagtaccacaaggaggagcccatcaccagcctgggcaaggagctgctgctgtacccctgtggccagcaggaccagctgcctgactacctggagctgtttgaatag

SEQ ID NO: 22054 - DNA, 390 bp, Artificial Sequence
  Description of Artificial Sequence: Synthetic coding sequence
atgtctgacaagagtgacctgaaggccgagctggagaggaagaagcagaggctggcccagatccgggaggagaagaagaggaaggaggaggagaggaagaagaaggaggccgacatgcagcagaagaaggagcctgtgcaggatgacagcgacctggacaggaagaggcgggagacagaggccctgctgcagagcatcggcatcagccctgagccccccctggtgcccacccccatgagccccagcagcaagtctgtgtccacccccagcgaggccggcagccaggacagcggggacctgggccccctgaccaggaccctgcagtgggacacagaccccagcgtgctgcagctgcagagcgacagcgagctgggctacatgtctgcctag

SEQ ID NO: 22055 - DNA, 780 bp, Artificial Sequence
  Description of Artificial Sequence: Synthetic coding sequence
atggtgggccgggagaaggagctgagcatccactttgtgcccggcagctgccgcctggtggaggaggaggtgaacatccccaacagaagagtgctggtgactggagccaccggcctgctgggccgggctgtgcacaaggagttccagcagaacaactggcatgctgtgggctgcggcttcagaagagcccggcccaagtttgagcaggtgaacctgctggacagcaatgctgtgcaccacatcatccatgacttccagccccacgtgattgtgcactgtgccgctgagaggaggccagatgtggtggagaaccagccagatgctgccagccagctgaatgtggatgccagcggcaacctggccaaggaggccgctgctgtgggcgccttcctgatctacatcagcagtgactatgtgtttgatggcaccaaccccccctaccgggaggaggacatcccagcccccctgaacctgtatggcaagaccaagctggatggagagaaggctgtgctggagaacaacctgggcgctgctgtgctgcgcatccccatcctgtatggagaggtggagaagctggaggagagcgctgtgacagtgatgtttgacaaggtgcagttcagcaacaagagcgccaacatggaccactggcagcagcgcttccccacccacgtgaaggatgtggccaccgtgtgccggcagctggccgagaagaggatgctggtgcggcgcatccctgagagctgcctgtctgagggccccctgtgcctcttccacgcctag

SEQ ID NO: 22056 - DNA, 549 bp, Artificial Sequence
  Description of Artificial Sequence: Synthetic coding sequence
tcctatgacagcaccttctcctatgtgacccatgaggacatctgcaactgcttcaatggagacaccctgctggccatccaggcccccagcggcacccagctggaggtgcccatccctgagatgggccagaatggccagaagaagtaccagatcaacctgaagagccacagcggccccatccacgtgctgctgatcaacaaggagagcagcagcagcaagcctgtggtgtttcctgtgcccccaccagatgacctgacccagcccagcagccagagcctgacccctgtgaccccccagaagagctccatggccacccagaacctgcctgagcagcacgtgtctgagaggagccaggccctgcagcagaccagcgccacagacatcagcagcgctggcagcatcagcggggacatcattgatgagctgatgagcagtgatgtgttccccctgctgcggctgagccccaccccagcagatgactacaacttcaacctggatgacaatgaaggagtgtgtgacctgtttgatgtgcagatcctgaactactag

SEQ ID NO: 22057 - DNA, 162 bp, Artificial Sequence
  Description of Artificial Sequence: Synthetic coding sequence
atggattctgagctgatgcacagcatcgtgggcagctaccacaagcccccagagcgggtgtttgtgcccagcttcacccagaatgagcccagccagaactgccacccagccaacctggaggtgaccagccccaagatcctgcacagccccaacagccagtag

SEQ ID NO: 22058 - DNA, 3018 bp, Artificial Sequence
  Description of Artificial Sequence: Synthetic coding sequence
atggccggggccctgcggcggggccgggccctgggcagccggcccagcggccccaccgtgagcagcagaagaagcccccagtgccctgtggcccaggagggcctgggcgcccggagccggccccgggtggcccccaggagcctggcccgctgtggccccagcagccggctgatgggctggaagcccagcgaggcccggggccagagccagagcttccaggccagcggcctgcagcccaggagcctgaaggccgcccggcgggccaccggccgcccagacaggagcagagctgcccggcccaccatggaccccagcgcccacaggagcagagctgccccacccaacatggaccctgacccccaggccggcgtgcaggtgggcatgagggtggtgcggggcgtggactggaagtggggccagcaggacggcggggagggcggcgtgggcaccgtggtggagctgggcagacatggcagccccagcaccccagacagaacagtggtggtgcagtgggaccagggcaccaggaccaactacagagctggctaccagggcgcccatgacctgctgctgtatgacaatgcccagattggagtgcgccaccccaacatcatctgtgactgctgcaagaagcacggcctgcggggcatgcgctggaagtgccgggtgtgcctggactatgacctgtgcacccagtgctacatgcacaacaagcatgagctggcccacgcctttgacagatatgaaacagcccacagcaggcctgtgaccctgagcccccggcagggcctgccccgcatccccctgcggggcatcttccagggcgccaaggtggtgcggggccctgactgggagtggggcagccaggacggcaagccagctgagctgcagaggagagtgtctgctgacagccagcccttccagcacggggacaaggtgaagtgcctgctggacacagatgtgctgcgggagatgcaggagggccatggaggctggaaccccaggatggccgagttcatcggccagacaggaacagtgcaccgcatcacagacagaggagatgtgcgggtgcagttcaaccacgagacccgctggaccttccaccctggggccctgaccaagcaccacagcttctgggtgggagatgtggtgcgggtgattggagacctggacacagtgaagaggctgcaggccggccacggggagtggacagatgacatggccccagccctgggccgggtgggcaaggtggtgaaggtgtttggagatggcaacctgcgggtggccgtggccggccagcgctggaccttcagccccagctgcctggtggcctacagaccagaagaagatgccaacctggatgtggccgagcgggcccgggagaacaagagcagcctgtctgtggccctggacaagctgcgggcccagaagagtgaccctgagcaccctggccgcctggtggtggaggtggccctgggcaatgctgcccgggccctggacctgctgcggcggcggcctgagcaggtggacaccaagaaccagggccgcacagccctgcaggtggccgcctacctgggccaggtggagctgatccggctgctgctgcaggcccgggccggcgtggacctgcctgatgatgagggcaacacagccctgcactatgctgccctgggcaaccagcctgaggccaccagggtgctgctgtctgctggctgcagagcagatgccatcaacagcacccagagcacagccctgcacgtggccgtgcagaggggcttcctggaggtggtgcgggccctgtgtgagcggggctgtgatgtgaacctgcctgatgcccacagcgacacccccctgcacagcgccatctctgctggcaccggggccagcggcatcgtggaggtgctgacagaggtgcccaacattgatgtgacagccaccaacagccagggcttcaccctgctgcaccacgccagcctgaagggccacgccctggccgtgaggaagatcctggcccgggcccggcagctggtggatgccaagaaggaggatggcttcaccgccctgcacctggccgccctgaacaaccaccgggaggtggcccagatcctgatccgggagggccgctgtgatgtgaatgtgaggaacaggaagctgcagagccccctgcacctggccgtgcagcaggcccacgtgggcctggtgcccctgctggtggatgctggctgcagcgtgaatgcagaagatgaggagggggacacagccctgcacgtggccctgcagaggcaccagctgctgcccctggtggctgatggagctggaggagaccccggccccctgcagctgctgagccggctgcaggccagcggcctgcccggcagcgctgagctgactgtgggcgctgctgtggcctgcttcctggccctggagggcgcagatgtgtcctacaccaaccaccggggccgcagccccctggacctggccgctgagggccgggtgctgaaggccctgcagggctgtgcccagcgcttccgggagcggcaggccggcggcggggccgcccctggcccccggcagaccctgggcacccccaacacagtgaccaacctgcacgtgggcgccgcccctggccctgaggccgcagaatgtctggtgtgcagcgagctggccctgctggtgctcttcagcccctgccagcacaggacagtgtgtgaagaatgtgcccggaggatgaagaagtgcatccgctgccaggtggtggtgtccaagaagctgcggccagatggcagcgaggtggccagcgctgccccagcccctggccccccccggcagctggtggaggagctgcagagccgctaccggcagatggaggagcgcatcacctgccccatctgcatcgacagccacatccggctggtgttccagtgtggccatggagcctgtgccccctgtggcagcgccctgagcgcctgccccatctgccggcagcccatccgggaccgcatccagatctttgtgtag

SEQ ID NO: 22059 - DNA, 294 bp, Artificial Sequence
  Description of Artificial Sequence: Synthetic coding sequence
atggccagcagcgctgagctggacttcaacctgcaggccctgctggagcagctgagccaggatgagctgagcaagttcaagagcctcatccgcaccatcagcctgggcaaggagctgcagacagtgccccagacagaggtggacaaggccaacgggaagcagctggtggagatcttcaccagccacagctgcagctactgggccggcatggccgccatccaggtgtttgagaagatgaaccagacccacctgagcggccgggcagatgagcactgtgtgatgcccccaccctag

SEQ ID NO: 22060 - DNA, 693 bp, Artificial Sequence
  Description of Artificial Sequence: Synthetic coding sequence
atggattctgagctgatgcacagcatcgtgggcagctaccacaagcccccagagcgggtgtttgtgcccagcttcacccagaatgagcccagccagaactgccacccagccaacctggaggtgaccagccccaagatcctgcacagccccaacagccaggccctgatcctggccctgaagaccctgcaggagaagatccaccggctggagctggagaggacccaggccgaggacaacctgaacatcctgagccgggaggccgcccagtacaagaaggccctggagaatgagaccaatgaaagaaacctggcccaccaggagctgatcaagcagaagaaggacatcagcatccagctgagcagcgcccagagccgctgcaccctgctggagaagcagctggagtacaccaagaggatggtgctgaatgtggagcgggagaagaacatgatcctggagcagcaggcccagctgcagcgggagaaggagcaggaccagatgaagctgtatgccaagctggagaagctggatgtgctggagaaggagtgcttccggctgaccaccacccagaagacagctgaggacaagatcaagcacctggaggagaagctgaaggaggaggagcaccagaggaagctgttccaggacaaggccagcgagctgcagacaggcctggagatcagcaagatcatctag

SEQ ID NO: 22061 - DNA, 624 bp, Artificial Sequence
  Description of Artificial Sequence: Synthetic coding sequence
atggacagaggagagcagggcctgctgaggacagatcctgtgcctgaggagggagaagatgtggccgccaccatcagcgccacagagaccctgtctgaggaggagcaggaggagctgcggcgggagctggccaaggtggaggaggagatccagaccctgagccaggtgctggccgccaaggagaagcacctggccgagatcaagaggaagctgggcatcaacagcctgcaggagctgaagcagaacatcgccaagggctggcaggatgtgacagccaccagcgcctacaagaagaccagcgagaccctgagccaggccggccagaaggccagcgctgccttcagctctgtgggcagcgtcatcaccaagaagctggaggatgtgaagctgcaggccttcagccacagcttcagcatccgcagcatccagcacagcatctccatgcctgccatgaggaacagccccaccttcaagagctttgaggagaaggtggagaacctgaagagcaaggtgggcggcaccaagccagctggaggagactttggagaggtgctgaacagcgctgccaatgccagcgccaccaccacagagcccctgcctgagaagacccaggagagcctgtag

SEQ ID NO: 22062 - DNA, 387 bp, Artificial Sequence
  Description of Artificial Sequence: Synthetic coding sequence
atgaagttcaacccctttgtgaccagtgacaggagcaagaacaggaagaggcacttcaatgcccccagccacgtgcggaggaagatcatgagcagccccctgagcaaggagctgcggcagaagtacaacgtgcgctccatgcccatcaggaaggatgatgaggtgcaggtggtgcggggccactacaagggccagcagatcggcaaggtggtgcaggtgtacaggaagaagtatgtgatctacatcgagcgggtgcagcgggagaaggccaacggcaccaccgtgcacgtgggcatccaccccagcaaggtggtgatcacccggctgaagctggacaaggacaggaagaagatcctggagaggaaggccaagagccggcaggtgtag

SEQ ID NO: 22063 - DNA, 120 bp, Artificial Sequence
  Description of Artificial Sequence: Synthetic coding sequence
ggcctgaccaagcagctgctggatgacaccatcggcatccaccccacctgtggggaggtgttcaccaccctggagatcaccaagagcagcggcctggacatcacccagaagggcggctag

SEQ ID NO: 22064 - DNA, 1365 bp, Artificial Sequence; identical to SEQ ID NO: 18526
  Description of Artificial Sequence: Synthetic coding sequence

SEQ ID NO: 22065 - DNA, 438 bp, Artificial Sequence; identical to SEQ ID NO: 18515
  Description of Artificial Sequence: Synthetic coding sequence

SEQ ID NO: 22066 - DNA, 621 bp, Artificial Sequence
  Description of Artificial Sequence: Synthetic coding sequence
atggattctgagctgatgcacagcatcgtgggcagctaccacaagcccccagagcgggtgtttgtgcccagcttcacccagaatgagcccagccagaactgccacccagccaacctggaggtgaccagccccaagatcctgcacagccccaacagccaggccctgatcctggccctgaagaccctgcaggagaagatccaccggctggagctggagaggacccaggccgaggacaacctgaacatcctgagccgggaggccgcccagtacaagaaggccctggagaatgagaccaatgaaagaaacctggcccaccaggagctgatcaagcagaagaaggacatcagcatccagctgagcagcgcccagagccgctgcaccctgctggagaagcagctggagtacaccaagaggatggtgctgaatgtggagcgggagaagaacatgatcctggagcagcaggcccagctgcagcgggagaaggagcaggaccagatgaagctgtatgccaagctggagaagctggatgtgctggagaaggagtgcttccggctgaccaccacccagaagacagctgaggacaagatcaagcacctggaggagaagctgaaggaggagtag

SEQ ID NO: 22067 - DNA, 1050 bp, Artificial Sequence; identical to SEQ ID NO: 18364
  Description of Artificial Sequence: Synthetic coding sequence

SEQ ID NO: 22068 - DNA, 429 bp, Artificial Sequence
  Description of Artificial Sequence: Synthetic coding sequence
atgcccagcatcaagctgcagagcagtgatggagagatctttgaggtggatgtggagatcgccaagcagagcgtgaccatcaagaccatgctggaggacctgggcatggatgatgaaggagatgatgatcctgtgcccctgcccaacgtgaatgctgccatcctgaagaaggtgatccagtggtgcacccaccacaaggatgatcctcctcctccagaagatgatgagaacaaggagaagaggacagatgacatccctgtgtgggaccaggagttcctgaaggtggaccagggcaccctgtttgagctgatcctggccgccaactacctggacatcaagggcctgctggatgtgacctgcaagacagtggccaacatgatcaagggcaagaccccagaggagatcaggaagaccttcaacatcaagtag

SEQ ID NO: 22069 - DNA, 375 bp, Artificial Sequence
  Description of Artificial Sequence: Synthetic coding sequence
atgtctgccaccgtggtggatgctgtgaatgctgcccccctgagcggcagcaaggagatgagcctggaggagcccaagaagatgacccgggaggactggaggaagaagaaggagctggaggagcagaggaagctgggcaatgccccagctgaggtggatgaggagggcaaggacatcaacccccacatcccccagtacatcagctctgtgccctggtacatcgaccccagcaagaggcccaccctgaagcaccagaggccccagcctgagaagcagaagcagttcagcagcagcggggagtggtacaagaggggcgtgaaggagaacagcatcatcaccaagtacagaaaaggagcctgtgagaactgtggctag

SEQ ID NO: 22070 - DNA, 750 bp, Artificial Sequence; identical to SEQ ID NO: 18913
  Description of Artificial Sequence: Synthetic coding sequence

SEQ ID NO: 22071 - DNA, 120 bp, Artificial Sequence
  Description of Artificial Sequence: Synthetic coding sequence
atgaagttcaacccctttgtgaccagtgacaggagcaagaacaggaagaggcacttcaatgcccccagccacgtgcggaggaagatcatgagcagccccctgagcaaggagctgaggtag

SEQ ID NO: 22072 - DNA, 1401 bp, Artificial Sequence; identical to SEQ ID NO: 18363
  Description of Artificial Sequence: Synthetic coding sequence

SEQ ID NO: 22073 - DNA, 528 bp, Artificial Sequence
  Description of Artificial Sequence: Synthetic coding sequence
atggccagcaaccacaagagcagcgctgcccggcctgtgtcccggggcggcgtgggcctgaccggccggccccccagcggcatccggcccctgagcggcaacatccgggtggccacagccatgcctcctggaacagcccggcccggcagccggggctgccccatcggcactggaggagtgctgagcagccagatcaaggtggcccacaggcctgtgacccagcagggcctgaccggcatgaagacaggcaccaagggcccccagaggcagatcctggacaagagctactacctgggcctgctgcggagcaagatcagcgagctgaccacagaggtgaacaagctgcagaagggcatcgagatgtacaaccaggagaacagcgtgtacctgtcctatgagaagagagctgagaccctggccgtggagatcaaggagctgcagggccagctggccgactacaacatgctggtggacaagctgaacaccaacacagagatggaggaggtgatgaatgactacaacatgtag

SEQ ID NO: 22074 - DNA, 438 bp, Artificial Sequence; identical to SEQ ID NO: 18515
  Description of Artificial Sequence: Synthetic coding sequence

SEQ ID NO: 22075 - DNA, 2136 bp, Artificial Sequence; identical to SEQ ID NO: 20524
  Description of Artificial Sequence: Synthetic coding sequence

SEQ ID NO: 22076 - DNA, 471 bp, Artificial Sequence
  Description of Artificial Sequence: Synthetic coding sequence
atggcctctgtgctgagccggcggctgggcaagaggagcctgctgggcgcccgggtgctgggccccagcgccagcgagggccccagcgctgccccacccagcgagcccctgctggagggcgccgccccccagcccttcaccaccagtgatgacaccccctgccaggagcagcccaaggaggtgctgaaggcccccagcaccagcggcctgcagcaggtggccttccagcccggccagaaggtgtatgtgtggtatggaggccaggagtgcaccggcctggtggagcagcacagctggatggagggccaggtgacagtgtggctgctggagcagaagctgcaggtgtgctgccgggtggaggaggtgtggctggccgagctgcagggcccctgcccccaggccccacccctggagcccggggcccaggccctggcctacagacctgtgtccagaaatattgatgtgccctag

SEQ ID NO: 22077 - DNA, 309 bp, Artificial Sequence
  Description of Artificial Sequence: Synthetic coding sequence
atgcccagcatcaagctgcagagcagtgatggagagatctttgaggtggatgtggagatcgccaagcagagcgtgaccatcaagaccatgctggaggacctgggcatggatgatgaaggagatgatgatcctgtgcccctgcccaacgtgaatgctgccatcctgaagaaggtgatccagtggtgcacccaccacaaggatgatcctcctcctccagaagatgatgagaacaaggagaagaggacagatgacatccctgtgtgggaccaggagttcctgaaggtggaccagggcaccctgtttgaatag

SEQ ID NO: 22078 - DNA, 465 bp, Artificial Sequence
  Description of Artificial Sequence: Synthetic coding sequence
atggctgatgacctggactttgaaacaggagatgctggggccagcgccaccttccccatgcagtgcagcgccctgaggaagaatggatttgtggtgctgaagggctggccctgcaagatcgtggagatgtctgccagcaagacaggcaagcacggccacgccaaggtgcacctggtgggcatcgacatcttcaccgggaagaagtatgaggacatctgccccagcacccacaacatggatgtgcccaacatcaagagaaatgacttccagctgattggcatccaggacggctacctgagcctgctgcaggacagcggggaggtgcctgaggacctgcggctgcctgagggggacctgggcaaggagattgagcagaagtatgactgtggggaggagatcctgatcaccgtgctgagcgccatgacagaggaggccgctgtggccatcaaggccatggccaagtag

SEQ ID NO: 22079 - DNA, 306 bp, Artificial Sequence
  Description of Artificial Sequence: Synthetic coding sequence
atgtctgccaccgtggtggatgctgtgaatgctgcccccctgagcggcagcaaggagatgagcctggaggagcccaagaagatgacccgggaggactggaggaagaagaaggagctggaggagcagaggaagctgggcaatgccccagctgaggtggatgaggagggcaaggacatcaacccccacatcccccagtacatcagctctgtgccctggtacatcgaccccagcaagaggcccaccctgaagcaccagaggccccagcctgagaagcagaagcagttcagcagcagcggggagtggtag

SEQ ID NO: 22080 - DNA, 3201 bp, Artificial Sequence
  Description of Artificial Sequence: Synthetic coding sequence
atggccggggccctgcggcggggccgggccctgggcagccggcccagcggccccaccgtgagcagcagaagaagcccccagtgccctgtggcccaggagggcctgggcgcccggagccggccccgggtggcccccaggagcctggcccgctgtggccccagcagccggctgatgggctggaagcccagcgaggcccggggccagagccagagcttccaggccagcggcctgcagcccaggagcctgaaggccgcccggcgggccaccggccgcccagacaggagcagagctgcccggcccaccatggaccccagcgcccacaggagcagagctgccccacccaacatggaccctgacccccaggccggcgtgcaggtgggcatgagggtggtgcggggcgtggactggaagtggggccagcaggacggcggggagggcggcgtgggcaccgtggtggagctgggcagacatggcagccccagcaccccagacagaacagtggtggtgcagtgggaccagggcaccaggaccaactacagagctggctaccagggcgcccatgacctgctgctgtatgacaatgcccagattggagtgcgccaccccaacatcatctgtgactgctgcaagaagcacggcctgcggggcatgcgctggaagtgccgggtgtgcctggactatgacctgtgcacccagtgctacatgcacaacaagcatgagctggcccacgcctttgacagatatgaaacagcccacagcaggcctgtgaccctgagcccccggcagggcctgccccgcatccccctgcggggcatcttccagggcgccaaggtggtgcggggccctgactgggagtggggcagccaggacggcggggagggcaagccaggccgggtggtggacatccggggctgggatgtggagaccggccgctctgtggcctctgtgacctgggcagatggcaccaccaacgtgtacagagtgggccacaagggcaaggtggacctgaagtgtgtgggggaggccgccggcggcttctactacaaggaccacctgccccggctgggcaagccagctgagctgcagaggagagtgtctgctgacagccagcccttccagcacggggacaaggtgaagtgcctgctggacacagatgtgctgcgggagatgcaggagggccacggcggctggaaccccaggatggccgagaccggcaccgtgcaccgcatcacagacagaggagatgtgcgggtgcagttcaaccacgagacccgctggaccttccaccctggggccctgaccaagcaccacagcttctgggtgggagatgtggtgcgggtcatcggggacctggacacagtgaagaggctgcaggccggccatggagagtggacagatgacatggccccagccctgggccgggtgggcaaggtggtgaaggtgtttggagatggcaacctgcgggtggccgtggccggccagcgctggaccttcagccccagctgcctggtggcctacagacctgaggaggatgccaacctggatgtggccgagcgggcccgggagaacaagagcagcctgtctgtggccctggacaagctgcgggcccagaagagtgaccctgagcaccctggccgcctggtggtggaggtggccctgggcaatgctgcccgggccctggacctgctgcggcggcggcctgagcaggtggacaccaagaaccagggccgcacagccctgcaggtggccgcctacctgggccaggtggagctgatccggctgctgctgcaggcccgggccggcgtggacctgcctgatgatgagggcaacacagccctgcactacgccgccctgggcaaccagcctgaggccaccagggtgctgctgtctgctggctgcagagcagatgccatcaacagcacccagagcacagccctgcacgtggccgtgcagaggggcttcctggaggtggtgcgggccctgtgtgagcggggctgtgatgtgaacctgcctgatgcccacagcgacacccccctgcacagcgccatctctgctggcactggagccagcggcatcgtggaggtgctgacagaggtgcccaacattgatgtgacagccaccaacagccagggcttcaccctgctgcaccacgccagcctgaagggccacgccctggccgtgaggaagatcctggcccgggcccggcagctggtggatgccaagaaggaggatggcttcaccgccctgcacctggccgccctgaacaaccaccgggaggtggcccagatcctgatccgggagggccgctgtgatgtgaatgtgaggaacaggaagctgcagagccccctgcacctggccgtgcagcaggcccacgtgggcctggtgcccctgctggtggatgctggctgcagcgtgaatgcagaagatgaggagggggacacagccctgcacgtggccctgcagaggcaccagctgctgcccctggtggctgatggagctggaggagaccccggccccctgcagctgctgagccggctgcaggccagcggcctgcccggcagcgctgagctgactgtgggcgctgctgtggcctgcttcctggccctggagggcgcagatgtgtcctacaccaaccaccggggccgcagccccctggacctggccgctgagggccgggtgctgaaggccctgcagggctgtgcccagcgcttccgggagcggcaggccggcggcggggccgcccctggcccccggcagaccctgggcacccccaacacagtgaccaacctgcacgtgggcgccgcccctggccctgaggccgctgagtgcctggtgtgcagcgagctggccctgctggtgctcttcagcccctgccagcacaggacagtgtgtgaggagtgtgcccggaggatgaagaagtgcatccgctgccaggtggtggtgtccaagaagctgcggccagatggcagcgaggtggccagcgctgccccagcccctggccccccccggcagctggtggaggagctgcagagccgctaccggcagatggaggagcgcatcacctgccccatctgcatcgacagccacatccggctggtgttccagtgtggccacggggcctgtgccccctgtggcagcgccctgagcgcctgccccatctgccggcagcccatccgggaccgcatccagatctttgtgtag

SEQ ID NO: 22081 - DNA, 348 bp, Artificial Sequence
  Description of Artificial Sequence: Synthetic coding sequence
atgatgctgggcacagaaggaggagagggctttgtggtgaaggtgcggggcctgccctggagctgcagcgcagatgaggtgcagcgcttcttcagtgactgcaagatccagaatggagcccagggcatccgcttcatctacacccgggagggccggcccagcggggaggcctttgtggagctggagagtgaagatgaggtgaagctggccctgaagaaggaccgggagaccatgggccaccgctacgtggaggtgttcaagagcaacaacgtggagatggactgggtgctgaagcacacaggccccaacagcccagacacagccaatgatggctttgtgcggctgtag

SEQ ID NO: 22082 - DNA, 375 bp, Artificial Sequence
  Description of Artificial Sequence: Synthetic coding sequence
atggcctctgtgctgagccggcggctgggcaagaggagcctgctgggcgcccgggtgctgggccccagcgccagcgagggccccagcgctgccccacccagcgagcccctgctggagggcgccgccccccagcccttcaccaccagtgatgacaccccctgccaggagcagcccaaggaggtgctgaaggcccccagcaccagcggcctgcagcaggtggccttccagcccggccagaaggtgtatgtgtggtatggaggccaggagtgcaccggcctggtggagcagcacagctggatggagggccaggtgacagtgtggctgctggagcagaagctgcaggtgtgctgccgggtggaggaggtgtggctgtag

SEQ ID NO: 22083 - DNA, 438 bp, Artificial Sequence; identical to SEQ ID NO: 18515
  Description of Artificial Sequence: Synthetic coding sequence

SEQ ID NO: 22084 - DNA, 339 bp, Artificial Sequence
  Description of Artificial Sequence: Synthetic coding sequence
atggattctgagctgatgcacagcatcgtgggcagctaccacaagcccccagagcgggtgtttgtgcccagcttcacccagaatgagcccagccagaactgccacccagccaacctggaggtgaccagccccaagatcctgcacagccccaacagccaggccctgatcctggccctgaagaccctgcaggagaagatccaccggctggagctggagaggacccaggccgaggacaacctgaacatcctgagccgggaggccgcccagtacaagaaggccctggagaatgagaccaatgaaagaaacctggcccaccaggagctgatcaagcagaagtag

SEQ ID NO: 22085 - DNA, 345 bp, Artificial Sequence
  Description of Artificial Sequence: Synthetic coding sequence
atgcccagcgctgaggccaagctgaagaagaacagatgtgccaactgctttgactgccccggctgcatgcacaccctgagcacccgggccaccagcatcagcacccagctgcctgatgatcctgccaagaccaccatgaagaaggcctactacctggcctgtggcttctgccgctggaccagcagagatgtgggcatggctgacaagtctgtggccagcggcggctggcaggagcctgagaacccccacacccagaggatgaacaagctgattgagtactaccagcagctggcccagaaggagaaggtggagcgggacaggaagaagctggccaggagaagatag

SEQ ID NO: 22086 - DNA, 648 bp, Artificial Sequence
  Description of Artificial Sequence: Synthetic coding sequence
atgcctggagaggccacagagaccgtgcctgccacagagcaggagctgccccagagccaggccgagactggaagtggcacagccagtgacagcggggagagcgtgcccggcatcgaggagcaggacagcacccagaccaccacccagaaggcctggctggtggccgctgctgagattgatgaggagcctgtgggcaaggccaagcagagccgctctgagaagagggccaggaaggccatgagcaagctgggcctgctgcaggtgactggagtgaccagggtgaccatctggaagagcaagaacatcctcttcgtcatcaccaagctggatgtgtacaagagccctgccagtgatgcctacatcgtgtttggagaggccaagatccaggacctgagccagcaggcccagctggccgctgctgagaagttccgggtgcagggcgaggccgtgggcaacatccaggagaacacccagacccccaccgtgcaggaggagagcgaggaggaggaggtggatgagaccggggtggaggtgaaggatgtgaagctggtgatgagccaggccaacgtgtcccgggccaaggctgtgcgggccctgaagaacaacagcaatgacatcgtgaatgccatcatggagctgactgtgtag

SEQ ID NO: 22087 - DNA, 432 bp, Artificial Sequence
  Description of Artificial Sequence: Synthetic coding sequence
atgtctgccaccgtggtggatgctgtgaatgctgcccccctgagcggcagcaaggagatgagcctggaggagcccaagaagatgacccgggaggactggaggaagaagaaggagctggaggagcagaggaagctgggcaatgccccagctgaggtggatgaggagggcaaggacatcaacccccacatcccccagtacatcagctctgtgccctggtacatcgaccccagcaagaggcccaccctgaagcaccagaggccccagcctgagaagcagaagcagttcagcagcagcggggagtggtacaagaggggcgtgaaggagaacagcatcatcaccaagtacagaaaaggagcctgtgagaactgtggggccatgacccacaagaagaaggactgctttgagcggccccggcgggtgggcgccaagtag

SEQ ID NO: 22088 - DNA, 567 bp, Artificial Sequence
  Description of Artificial Sequence: Synthetic coding sequence
atggcctctgtgctgagccggcggctgggcaagaggagcctgctgggcgcccgggtgctgggccccagcgccagcgagggccccagcgctgccccacccagcgagcccctgctggagggcgccgccccccagcccttcaccaccagtgatgacaccccctgccaggagcagcccaaggaggtgctgaaggcccccagcaccagcggcctgcagcaggtggccttccagcccggccagaaggtgtatgtgtggtatggaggccaggagtgcaccggcctggtggagcagcacagctggatggagggccaggtgacagtgtggctgctggagcagaagctgcaggtgtgctgccgggtggaggaggtgtggctggccgagctgcagggcccctgcccccaggccccacccctggagcccggggcccaggccctggcctacagacctgtgtccagaaatattgatgtgcccaagaggaagagtgatgctgtggagatggatgagatgatggccgccatggtgctgaccagcctgagctgcagccctgtggtgcagagccccccaggatag

SEQ ID NO: 22089 - DNA, 87 bp, Artificial Sequence
  Description of Artificial Sequence: Synthetic coding sequence
atgatgctgggcacagaaggaggagagggctttgtggtgaaggtgcggggcctgccctggagctgcagcgcagatgaggtgcagtag

SEQ ID NO: 22090 - DNA, 87 bp, Artificial Sequence
  Description of Artificial Sequence: Synthetic coding sequence
atggattctgagctgatgcacagcatcgtgggcagctaccacaagcccccagagcgggtgtttgtgcccagcttcacccagaactag

SEQ ID NO: 22091 - DNA, 1074 bp, Artificial Sequence; identical to SEQ ID NO: 19561
  Description of Artificial Sequence: Synthetic coding sequence

SEQ ID NO: 22092 - DNA, 483 bp, Artificial Sequence
  Description of Artificial Sequence: Synthetic coding sequence
atgcccagcatcaagctgcagagcagtgatggagagatctttgaggtggatgtggagatcgccaagcagagcgtgaccatcaagaccatgctggaggacctgggcatggatgatgaaggagatgatgatcctgtgcccctgcccaacgtgaatgctgccatcctgaagaaggtgatccagtggtgcacccaccacaaggatgatcctcctcctccagaagatgatgagaacaaggagaagaggacagatgacatccctgtgtgggaccaggagttcctgaaggtggaccagggcaccctgtttgagctgatcctggccgccaactacctggacatcaagggcctgctggatgtgacctgcaagacagtggccaacatgatcaagggcaagaccccagaggagatcaggaagaccttcaacatcaagaatgacttcacagaggaggaggaggcccaggtgggcagcacccagttctgcctgtag

SEQ ID NO: 22093 - DNA, 342 bp, Artificial Sequence
  Description of Artificial Sequence: Synthetic coding sequence
atggattctgagctgatgcacagcatcgtgggcagctaccacaagcccccagagcgggtgtttgtgcccagcttcacccagaatgagcccagccagaactgccacccagccaacctggaggtgaccagccccaagatcctgcacagccccaacagccaggccctgatcctggccctgaagaccctgcaggagaagatccaccggctggagctggagaggacccaggccgaggacaacctgaacatcctgagccgggaggccgcccagtacaagaaggccctggagaatgagaccaatgaaagaaacctggcccaccaggagctgatcaagcagaagaagtag

SEQ ID NO: 22094 - DNA, 309 bp, Artificial Sequence
  Description of Artificial Sequence: Synthetic coding sequence
atggcctctgtgctgagccggcggctgggcaagaggagcctgctgggcgcccgggtgctgggccccagcgccagcgagggccccagcgctgccccacccagcgagcccctgctggagggcgccgccccccagcccttcaccaccagtgatgacaccccctgccaggagcagcccaaggaggtgctgaaggcccccagcaccagcggcctgcagcaggtggccttccagcccggccagaaggtgtatgtgtggtatggaggccaggagtgcaccggcctggtggagcagcacagctggatggagggctag

SEQ ID NO: 22095 - DNA, 492 bp, Artificial Sequence; identical to SEQ ID NO: 19389
  Description of Artificial Sequence: Synthetic coding sequence

SEQ ID NO: 22096 - DNA, 441 bp, Artificial Sequence
  Description of Artificial Sequence: Synthetic coding sequence
atgtgccccggcaactggctgtgggcctccatgaccttcatggcccgcttcagccgcagcagcagccgcagccctgtgaggacccggggcaccctggaggagatgcccaccgtgcagcaccccttcctgaatgtgtttgagctggagcggctgctgtacaccgggaagacagcctgcaaccacgcagatgaggtgtggccaggcctgtacctgggggaccaggacatggccaacaacagaagagagctgcggcggctgggcatcacccacgtgctgaatgccagccacagccgctggaggggcaccccagaggcctatgagggcctgggcatccgctacctgggcgtggaggcccatgacagccctgcctttgacatgagcatccacttccagacagctgctgacttcatccaccgggccctgagccagcccggcggctag

SEQ ID NO: 22097 - DNA, 1542 bp, Artificial Sequence; identical to SEQ ID NO: 19319
  Description of Artificial Sequence: Synthetic coding sequence

SEQ ID NO: 22098 - DNA, 438 bp, Artificial Sequence
  Description of Artificial Sequence: Synthetic coding sequence
atggctgtgtccactggagtgaaggtgcccaggaacttccggctgctggaggagctggaggagggccagaagggcgtgggagatggcaccgtgtcctggggcctggaggatgatgaggacatgaccctgacccgctggacaggcatgatcatcggcccccccaggaccaactatgaaaatcgcatctacagcctgaaggtggagtgtggccccaagtacccagaggcccctccttctgtgcgctttgtgaccaagatcaacatgaatggcatcaacaacagcagcggcatggtggatgcccggagcatccctgtgctggccaagtggcagaacagctacagcatcaaggtggtgctgcaggagctgcggcggctgatgatgagcaaggagaacatgaagctgccccagcccccagagggccagacctacaacaactag

SEQ ID NO: 22099 - DNA, 1542 bp, Artificial Sequence; identical to SEQ ID NO: 19319
  Description of Artificial Sequence: Synthetic coding sequence

SEQ ID NO: 22100 - DNA, 57 bp, Artificial Sequence
  Description of Artificial Sequence: Synthetic coding sequence
atgcccagcatcaagctgcagagcagtgatggagagatctttgaggtggatgtgtag

SEQ ID NO: 22101 - DNA, 1929 bp, Artificial Sequence
  Description of Artificial Sequence: Synthetic coding sequence
gtggccagcgagggctctgtgcggcggcccagcggccctgtgcctgccccccagcccccagccttccgctttgtgtcccggcccggccgggcccggtctgagagcgagaccctggagaggagccccccccagagccctggccctgggaaggctggagatgcccccaacagaagaagtggccacgtgcggggggcccgggtgctgagccccccaggaagaagagcccggctgagcagccctggccccagccgcagcagcgaggcccgggaggagctgcggcggcacctggtgggcctcatcgagaggagccgggtggtgatcttcagcaagagctactgcccccacagcaccagggtgaaggagctgttcagcagcctgggcgtggagtgcaatgtgctggagctggaccaggtggatgatggagcccgggtgcaggaggtgctgtctgagatcaccaaccagaagacagtgcccaacatctttgtgaacaaggtgcacgtgggcggctgtgaccagaccttccaggcctaccagagcggcctgctgcagaagctgctgcaggaggacctggcctatgactatgacctgatcatcattggaggcggcagcggcggcctgagctgtgccaaggaggccgccatcctgggcaagaaggtgatggtgctggactttgtggtgcccagcccccagggcacctcctggggcctgggcggcacctgtgtgaatgtgggctgcatccccaagaagctgatgcaccaggccgccctgctgggccaggccctgtgtgacagcaggaagtttggctgggagtacaaccagcaggtgcgccacaactgggagaccatgaccaaggccatccagaaccacatcagcagcctgaactggggctaccgcctgagcctgcgggagaaggctgtggcctacgtgaacagctatggagaatttgtggagcaccacaagatcaaggccaccaacaagaagggccaggagacctactacacagctgcccagtttgtgattgccaccggggagcggccccgctacctgggcatccagggcgacaaggagtactgcatcaccagtgatgacctcttcagcctgccctactgccctgggaagaccctggtggtgggcgccagctatgtggccctggagtgtgccggcttcctggccggcttcggcctggatgtgacagtgatggtgcgcagcatcctgctgcggggctttgaccaggagatggccgagaaggtgggcagctacatggagcagcacggcgtgaagttcctgaggaagttcatccctgtgatggtgcagcagctggagaagggcagccctgggaagctgaaggtgctggccaagagcacagagggcacagagaccattgaaggagtgtacaacacagtgctgctggccatcggccgggacagctgcaccaggaagattggcctggagaagattggagtgaagatcaatgagaagagcggcaagatccctgtgaatgatgtggagcagaccaacgtgccctacgtgtatgctgtgggggacatcctggaggacaagccagagctgacccctgtggccatccagagcggcaagctgctggcccagaggctgtttggagccagcctggagaagatctaccacaccctcttctggcccctggagtggacagtggccggccgggagaacaacacctgctacgccaagatcatctgcaacaagtttgaccatgacagagtgattggcttccacatcctgggccccaatgctggggaggtgacccagggctttgctgctgccatgaagtgtggcctgaccaagcagctgctggatgacaccatcggcatccaccccacctgtggggaggtgttcaccaccctggagatcaccaagagcagcggcctggacatcacccagaagggctgctag

SEQ ID NO: 22102 - DNA, 1338 bp, Artificial Sequence
  Description of Artificial Sequence: Synthetic coding sequence
atgaacaagggcatcagcagcatccccatcaacctgcgggtgtacagcccccacgtgctgaacctgaccctgattgacctgcccggcatcaccaaggtgcctgtgggggaccagcccccagacatcgagtaccagatccgggagatgatcatgcagttcatcacccgggagaactgcctgatcctggccgtgaccccagccaacacagacctggccaacagtgatgccctgaagctggccaaggaggtggacccccagggcctgcggaccatcggggtcatcaccaagctggacctgatggatgagggcacagatgccagagatgtgctggagaacaagctgctgcccctgcggcggggctacgtgggcgtggtgaacagaagccagaaggacattgatggcaagaaggacatcaaggccgccatgctggccgagaggaagttcttcctgagccacccagcctaccgccacatcgctgacaggatgggcaccccccacctgcagaaggtgctgaaccagcagctgaccaaccacatccgggacaccctgcccaacttcaggaacaagctgcagggccagctgctgagcattgaacatgaggtggaggcctacaagaacttcaagccagaggaccccaccaggaagaccaaggccctgctgcagatggtgcagcagtttgctgtggactttgagaagagaattgagggcagcggggaccaggtggacaccctggagctgtctggaggagccaagatcaaccgcatcttccacgagcgcttcccctttgagatcgtgaagatggagttcaatgagaaggagctgcggcgggagatctcctatgccatcaagaacatccacggcatcagaacaggcctcttcaccccagacatggcctttgaggccatcgtgaagaagcagatcgtgaagctgaagggccccagcctgaagtctgtggacctggtgatccaggagctgatcaacacagtgaagaagtgcaccaagaagctggccaacttcccccggctgtgtgaggagacagaaagaattgtggccaaccacatccgggagcgggagggcaagaccaaggaccaggtgctgctgctgattgacatccaggtgtcctacatcaacaccaaccacgaggacttcatcggctttgccaatgcccagcagaggagcagccaggtgcacaagaagaccaccgtgggcaaccaggtgatcaggaagggctggctgaccatcagcaacatcggcatcatgaagggcggcagcaagggctactggtttgtgctgacagctgagagcctgtcctggtacaaggatgatgaggagaagtag

SEQ ID NO: 22103 - DNA, 1560 bp, Artificial Sequence
  Description of Artificial Sequence: Synthetic coding sequence
atgctgcagctgatggattctggcatcaccatctgcctgagaaatggagctgcctctgtgttcaagaagaaggagtggagcacccagggcgaggagaacaagcaggacagcaagctgaagaagctgtctgaggacagcctgaccaagcagcctgaggaggtgtttgatgtgctggagaagctgggggagggcagctatggcagcgtcttcaaggccatccacaaggagagcggccaggtggtggccatcaagcaggtgcctgtggagagtgacctgcaggagatcatcaaggagatcagcatcatgcagcagtgtgacagcccctacgtggtgaagtactacggcagctacttcaagaacacagacctgtggatcgtgatggagtactgtggggccggctctgtgtctgacatcatccggctgaggaacaagaccctgattgaagatgaaattgccaccatcctgaagagcaccctgaagggcctggagtacctgcacttcatgaggaagatccaccgggacatcaaggccggcaacatcctgctgaacacagagggccacgccaagctggccgactttggagtggccggccagctgacagacaccatggccaagaggaacacagtcatcggcacccccttctggatggcccctgaggtgatccaggagatcggctacaactgtgtggccgacatctggagcctgggcatcaccagcattgagatggccgagggcaagccaccctatgctgacatccaccccatgagggccatcttcatgatccccaccaaccccccacccaccttcaggaagccagagctgtggagcgatgacttcacagactttgtgaagaagtgcctggtgaagaaccctgagcagagggccacagccacccagctgctgcagcaccccttcatcaagaatgccaagcctgtgtccatcctgcgggacctgatcacagaggccatggagatcaaggccaagagacatgaggagcagcagcgggagctggaggaggaggaggagaacagtgatgaagatgagctggacagccacaccatggtgaagacctctgtggagagcgtgggcaccatgagggccaccagcaccatgtctgagggcgcccagaccatgattgagcacaacagcaccatgctggagagtgacctgggcaccatggtgatcaacagtgaagatgaggaggaggaggatggcaccatgaagagaaatgccaccagcccccaggtgcagaggcccagcttcatggactactttgacaagcaggacttcaagaacaagagccatgagaactgcaaccagaacatgcatgagcccttccccatgagcaagaatgtgtttcctgacaactggaaggtgccccaggatggagactttgacttcctgaagaacctgagcctggaggagctgcagatgaggctgaaggccctggaccccatgatggagcgggagattgaggagctgcggcagcgctacacagccaagaggcagcccatcctggatgccatggatgccaagaagaggcggcagcagaacttctag

SEQ ID NO: 22104 - DNA, 1392 bp, Artificial Sequence
  Description of Artificial Sequence: Synthetic coding sequence
atgaagatcatggacagcgagctgatgcacagcatcgtgggcagctaccacaagcccccagagcgggtgtttgtgcccagcttcacccagaatgagcccagccagaactgccacccagccaacctggaggtgaccagccccaagatcctgcacagccccaacagccaggccctgatcctggccctgaagaccctgcaggagaagatccaccggctggagctggagaggacccaggccgaggacaacctgaacatcctgagccgggaggccgcccagtacaagaaggccctggagaatgagaccaatgaaagaaacctggcccaccaggagctgatcaagcagaagaaggacatcagcatccagctgagcagcgcccagagccgctgcaccctgctggagaagcagctggagtacaccaagaggatggtgctgaatgtggagcgggagaagaacatgatcctggagcagcaggcccagctgcagcgggagaaggagcaggaccagatgaagctgtatgccaagctggagaagctggatgtgctggagaaggagtgcttccggctgaccaccacccagaagacagctgaggacaagatcaagcacctggaggagaagctgaaggaggaggagcaccagaggaagctgttccaggacaaggccagcgagctgcagacaggcctggagatcagcaagatcatcatgagctctgtgagcaacctgaagcacagcaaggagaagaagaagagcagcaagaagaccaagtgcatcaagaggcggcccccctggcagatctgcagcaagtttggagccctgccctttgtggccgagaagatgaggcagcaccgggacccccacatcctgcagaagcccttcaacgtgacagagacccgctgcctgcccaagcccagcaggaccacctcctggtgcaaggccatccccccagacagcgagaagagcatcagcatctgtgacaacctgtctgagctgctgatggccatgcaggatgagctggaccagatgtccatggagcaccaggagctgctgaagcagatgaaggagacagagagccacagcgtgtgtgatgacattgaatgtgagctggagtgcctgctgaagaagatggagatcaagggggagcagatcagcaagctgaagaagcaccaggacagcgtgtgcaagctgcagcagaaggtgcagaacagcaagatgtctgaggccagcggcatccagcaggaggacagctaccccaagggcagcaagaacatcaagaacagccccaggaagtgcctgacagacaccaacctcttccagaagaacagcagcttccaccccatccgggtgcacaacctgcagatgaagctgcggagagatgacatcatgtgggagcagtag

SEQ ID NO: 22105 - DNA, 1050 bp, Artificial Sequence; identical to SEQ ID NO: 18364
  Description of Artificial Sequence: Synthetic coding sequence

SEQ ID NO: 22106 - DNA, 636 bp, Artificial Sequence; identical to SEQ ID NO: 18393
  Description of Artificial Sequence: Synthetic coding sequence

SEQ ID NO: 22107 - DNA, 438 bp, Artificial Sequence
  Description of Artificial Sequence: Synthetic coding sequence
atgatccccatctggaagcagcaggcccggcctggagatggccctgtgatctgggactaccacgtggtgctgctgcacgtgtcctctgggggccagaacttcatctatgacctggacacagtgctgcccttcccctgcctgtttgacacctacgtggaggatgccttcaagagtgatgatgacatccacccccagttccggaggaagttccgggtcatccgggctgacagctacctgaagaactttgccagtgacaggagccacatgaaggacagcagcggcaactggagggagcccccaccaccctacccctgcatcgagaccggggacagcaagatgaacctgaatgacttcatctccatggaccccaaggtgggctggggcgctgtgtacaccctgtctgagttcacccaccgcttcggcagcaagaactgctag

SEQ ID NO: 22108 - DNA, 258 bp, Artificial Sequence
  Description of Artificial Sequence: Synthetic coding sequence
atgtctgacaagagtgacctgaaggccgagctggagaggaagaagcagaggctggcccagatccgggaggagaagaagaggaaggaggaggagaggaagaagaaggaggccgacatgcagcagaagaaggagcctgtgcaggatgacagcgacctggacaggaagaggcgggagacagaggccctgctgcagagcatcggcatcagccctgagccccccctggtgcccacccccatgagccccagcagcaagagctag

SEQ ID NO: 22109 - DNA, 588 bp, Artificial Sequence
  Description of Artificial Sequence: Synthetic coding sequence
atggattctgagctgatgcacagcatcgtgggcagctaccacaagcccccagagcgggtgtttgtgcccagcttcacccagaatgagcccagccagaactgccacccagccaacctggaggtgaccagccccaagatcctgcacagccccaacagccaggccctgatcctggccctgaagaccctgcaggagaagatccaccggctggagctggagaggacccaggccgaggacaacctgaacatcctgagccgggaggccgcccagtacaagaaggccctggagaatgagaccaatgaaagaaacctggcccaccaggagctgatcaagcagaagaaggacatcagcatccagctgagcagcgcccagagccgctgcaccctgctggagaagcagctggagtacaccaagaggatggtgctgaatgtggagcgggagaagaacatgatcctggagcagcaggcccagctgcagcgggagaaggagcaggaccagatgaagctgtatgccaagctggagaagctggatgtgctggagaaggagtgcttccggctgaccaccacccagaagacagctgaggacaagtag

SEQ ID NO: 22110 - DNA, 1272 bp, Artificial Sequence; identical to SEQ ID NO: 19799
  Description of Artificial Sequence: Synthetic coding sequence

SEQ ID NO: 22111 - DNA, 2091 bp, Artificial Sequence
  Description of Artificial Sequence: Synthetic coding sequence
ggtgtgggcggccgcggggagcggctgccccggggctttgcccgggtggtgcgggtggccagcgagggctctgtgcggcggcccagcggccctgtgcctgccccccagcccccagccttccgctttgtgtcccggcccggccgggcccggtctgagagcgagaccctggagaggagccccccccagagccctggccctgggaaggctggagatgcccccaacagaagaagtggccacgtgcggggggcccgggtgctgagccccccaggaagaagagcccggctgagcagccctggccccagccgcagcagcgaggcccgggaggagctgcggcggcacctggtgggcctcatcgagaggagccgggtggtgatcttcagcaagagctactgcccccacagcaccagggtgaaggagctgttcagcagcctgggcgtggagtgcaatgtgctggagctggaccaggtggatgatggagcccgggtgcaggaggtgctgtctgagatcaccaaccagaagacagtgcccaacatctttgtgaacaaggtgcacgtgggcggctgtgaccagaccttccaggcctaccagagcggcctgctgcagaagctgctgcaggaggacctggcctatgactatgacctgatcatcattggaggcggcagcggcggcctgagctgtgccaaggaggccgccatcctgggcaagaaggtgatggtgctggactttgtggtgcccagcccccagggcacctcctggggcctgggcggcacctgtgtgaatgtgggctgcatccccaagaagctgatgcaccaggccgccctgctgggccaggccctgtgtgacagcaggaagtttggctgggagtacaaccagcaggtgcgccacaactgggagaccatgaccaaggccatccagaaccacatcagcagcctgaactggggctaccgcctgagcctgcgggagaaggctgtggcctacgtgaacagctatggagaatttgtggagcaccacaagatcaaggccaccaacaagaagggccaggagacctactacacagctgcccagtttgtgattgccaccggggagcggccccgctacctgggcatccagggcgacaaggagtactgcatcaccagtgatgacctcttcagcctgccctactgccctgggaagaccctggtggtgggcgccagctatgtggccctggagtgtgccggcttcctggccggcttcggcctggatgtgacagtgatggtgcgcagcatcctgctgcggggctttgaccaggagatggccgagaaggtgggcagctacatggagcagcacggcgtgaagttcctgaggaagttcatccctgtgatggtgcagcagctggagaagggcagccctgggaagctgaaggtgctggccaagagcacagagggcacagagaccattgaaggagtgtacaacacagtgctgctggccatcggccgggacagctgcaccaggaagattggcctggagaagattggagtgaagatcaatgagaagagcggcaagatccctgtgaatgatgtggagcagaccaacgtgccctacgtgtatgctgtgggggacatcctggaggacaagccagagctgacccctgtggccatccagagcggcaagctgctggcccagaggctgtttggagccagcctggagaagtgtgactacatcaacgtgcccaccaccgtcttcacccccctggagtatggctgctgcggcctgtctgaggagaaggccatcgaggtgtacaagaaggagaacctggagatctaccacaccctcttctggcccctggagtggacagtggccggccgggagaacaacacctgctacgccaagatcatctgcaacaagtttgaccatgacagagtgattggcttccacatcctgggccccaatgctggggaggtgacccagggctttgctgctgccatgaagtgtggcctgaccaagcagctgctggatgacaccatcggcatccaccccacctgtggggaggtgttcaccaccctggagatcaccaagagcagcggcctggacatcacccagaagggctgctag

SEQ ID NO: 22112 - DNA, 609 bp, Artificial Sequence
  Description of Artificial Sequence: Synthetic coding sequence
atgacaggcagcaacagccacatcaccatcctgaccctgaaggtgctgccccactttgagagcctgggcaagcaggagaagatccccaacaagatgtctgccttcaggaaccactgcccccacctggacagcgtgggggagatcaccaaggaggacctgatccagaagagcctgggcacctgccaggactgcaaggtgcagggccccaacctgtgggcctgcctggagaaccgctgcagctatgtgggctgtggggagagccaggtggaccacagcaccatccacagccaggagaccaagcactacctgactgtgaacctgaccaccctgcgggtgtggtgctacgcctgcagcaaggaggtgttcctggacaggaagctgggcacccagcccagcctgccccacgtgcggcagccccaccagatccaggagaacagcgtgcaggacttcaagatccccagcaacaccaccctgaagacccccctggtggccgtgtttgatgacctggacattgaagcagatgaggaggatgagctgcgggcccggggcctgaccggcctgaagaacatcggcaacacctgctacatgaatgctgccctgcaggcctag

SEQ ID NO: 22113 - DNA, 1443 bp, Artificial Sequence; identical to SEQ ID NO: 21609
  Description of Artificial Sequence: Synthetic coding sequence

SEQ ID NO: 22114 - DNA, 309 bp, Artificial Sequence; identical to SEQ ID NO: 20332
  Description of Artificial Sequence: Synthetic coding sequence

SEQ ID NO: 22115 - DNA, 318 bp, Artificial Sequence
  Description of Artificial Sequence: Synthetic coding sequence
atgagccagagcggggctgtgtcctgctgccctggggccaccaacggcagcctgggccgcagtgatggagtggccaagatgagccccaaggacctgtttgagcagaggaagaagtacagcaacagcaatgtcatcatgcatgagaccagccagtaccacgtgcagcacctggccaccttcatcatggacaagtctgaggccatcacctctgtggatgatgccatcaggaagctggtgcagctgagcagcaaggagaagatctggacccaggagatgctgctgcaggtgaatgaccagagcctgcggctgctggactag

SEQ ID NO: 22116 - DNA, 222 bp, Artificial Sequence
  Description of Artificial Sequence: Synthetic coding sequence
atgtctgccttcaggaaccactgcccccacctggacagcgtgggggagatcaccaaggaggacctgatccagaagagcctgggcacctgccaggactgcaaggtgcagggccccaacctgtgggcctgcctggagaaccgctgcagctatgtgggctgtggggagagccaggtggaccacagcaccatccacagccaggagaccaagcactacctgacctag

SEQ ID NO: 22117 - DNA, 276 bp, Artificial Sequence
  Description of Artificial Sequence: Synthetic coding sequence
atggccatgacagtggtgaccaaggagaagaacaagaaggtgcccaccatcttcctgagcaagaagccccgggagaaggaggtggacagcaagagccaggtgattgagggcatcagccgcctcatctgcagcgccaagcagcagcagaccatgctgcgggtgtccattgatggagtggagtggagcgacatcaagttcttccagctggccgcccagtggcccacccacgtgaagcacttccctgtgggcctcttcagcggcagcaaggccacctag

SEQ ID NO: 22118 - DNA, 2535 bp, Artificial Sequence
  Description of Artificial Sequence: Synthetic coding sequence
atgttctggaagtttgacctgcacagcagcagccacatcgacaccctgctggagcgggaggatgtgaccctgaaggagctgatggatgaagaagatgtgctgcaggagtgcaaggcccagaacaggaagctgattgagttcctgctgaaggccgagtgcctggaggacctggtgtccttcatcatcgaggagcccccccaggacatggatgagaagatccgctacaagtaccccaacatcagctgtgagctgctgaccagtgatgtgtcccagatgaatgaccggctgggggaggatgagagcctgctgatgaagctgtacagcttcctgctgaatgacagccccctgaaccccctgctggccagcttcttcagcaaggtgctgagcatcctgatcagcaggaagccagagcagatcgtggacttcctgaagaagaagcatgactttgtggacctgatcatcaagcacatcggcaccagcgccatcatggacctgctgctgcggctgctgacctgcatcgagcccccccagccccggcaggatgtgctgaactggctgaatgaggagaagatcatccagaggctggtggagatcgtgcaccccagccaggaggaggacagacacagcaatgccagccagagcctgtgtgagatcgtgcggctgagccgggaccagatgctgcagatccagaacagcacagagccagaccccctgctggccaccctggagaagcaggagatcatcgagcagctgctgagcaacatcttccacaaggagaagaatgaaagtgccatcgtgtctgccatccagatcctgctgaccctgctggagacccggcggcccacctttgagggccacatcgagatctgccccccaggcatgagccacagcgcctgcagcgtgaacaagtctgtgctggaggccatccggggccgcctgggcagcttccacgagctgctgctggagccccccaagaagtctgtgatgaagaccacctggggcgtgctggacccccctgtgggcaacacccggctgaatgtcatccgcctcatcagcagcctgctgcagaccaacaccagcagcatcaatggagacctgatggagctgaacagcattggagtcatcctgaacatgttcttcaagtacacctggaacaacttcctgcacacccaggtggagatctgcatcgccctgatcctggccagcccctttgaaaatacagaaaatgccaccatcacagaccaggacagcactggagacaacctgctgctgaagcacctgttccagaagtgccagctgattgaaagaatcctggaggcctgggagatgaatgagaagaagcaggccgagggcggcagaagacatggctacatgggccacctgacccgcatcgccaactgcatcgtgcacagcacagacaagggccccaacagcgccctggtgcagcagctgatcaaggacctgcctgatgaggtgcgggagcgctgggagaccttctgcaccagcagcctgggggagaccaacaagaggaacacagtggacctggccttcagtgactaccagatgcagcagatgaccagcaacttcatcgaccagtttggcttcaatgatgagaagtttgctgaccaggatgacattggaaatgtgtcctttgacagagtgtctgacatcaacttcaccctgaacaccaatgaaagtggcaacatcgccctgtttgaggcctgctgcaaggagcgcatccagcagtttgatgatggcggcagtgatgaggaggacatctgggaggagaagcacatcgccttcaccccagagagccagaggaggagcagcagcggcagcacagacagcgaggagagcacagacagcgaggaggaggatggagccaagcaggacctgtttgagcccagcagcgccaacacagaggacaagatggaggtggacctgtctgagccccccaactggagcgccaactttgatgtgcccatggagaccacccacggggcccccctggacagcgtgggcagtgatgtgtggagcacagaggagcccatgcccaccaaggagaccggctgggccagcttcagcgagttcaccagcagcctgagcaccaaggacagcctgcggagcaacagccctgtggagatggagaccagcacagagcccatggaccccctgacccccagcgctgctgccctggccgtgcagcctgaggccgccggctctgtggccatggaggccagcagtgatggagaggaggatgctgagagcacagacaaggtgacagaaacagtgatgaatggaggcatgaaggagaccctgagcctgactgtggatgccaagacagaaacagctgtgttcaagtctgaggagggcaagctgagcaccagccaggatgctgcctgcaaggatgctgaggagtgcccagagacagctgaggccaagtgtgccgccccccggccccccagcagcagccctgagcagaggacaggccagcccagcgcccctggggacacctctgtgaatggacctgtgtag

SEQ ID NO: 22119 - DNA, 2604 bp, Artificial Sequence
  Description of Artificial Sequence: Synthetic coding sequence
atgttctggaagtttgacctgcacagcagcagccacatcgacaccctgctggagcgggaggatgtgaccctgaaggagctgatggatgaagaagatgtgctgcaggagtgcaaggcccagaacaggaagctgattgagttcctgctgaaggccgagtgcctggaggacctggtgtccttcatcatcgaggagcccccccaggacatggatgagaagatccgctacaagtaccccaacatcagctgtgagctgctgaccagtgatgtgtcccagatgaatgaccggctgggggaggatgagagcctgctgatgaagctgtacagcttcctgctgaatgacagccccctgaaccccctgctggccagcttcttcagcaaggtgctgagcatcctgatcagcaggaagccagagcagatcgtggacttcctgaagaagaagcatgactttgtggacctgatcatcaagcacatcggcaccagcgccatcatggacctgctgctgcggctgctgacctgcatcgagcccccccagccccggcaggatgtgctgaactggctgaatgaggagaagatcatccagaggctggtggagatcgtgcaccccagccaggaggaggacagacacagcaatgccagccagagcctgtgtgagatcgtgcggctgagccgggaccagatgctgcagatccagaacagcacagagccagaccccctgctggccaccctggagaagcaggagatcatcgagcagctgctgagcaacatcttccacaaggagaagaatgaaagtgccatcgtgtctgccatccagatcctgctgaccctgctggagacccggcggcccacctttgagggccacatcgagatctgccccccaggcatgagccacagcgcctgcagcgtgaacaagtctgtgctggaggccatccggggccgcctgggcagcttccacgagctgctgctggagccccccaagaagtctgtgatgaagaccacctggggcgtgctggacccccctgtgggcaacacccggctgaatgtcatccgcctcatcagcagcctgctgcagaccaacaccagcagcatcaatggagacctgatggagctgaacagcattggagtcatcctgaacatgttcttcaagtacacctggaacaacttcctgcacacccaggtggagatctgcatcgccctgatcctggccagcccctttgaaaatacagaaaatgccaccatcacagaccaggacagcactggagacaacctgctgctgaagcacctgttccagaagtgccagctgattgaaagaatcctggaggcctgggagatgaatgagaagaagcaggccgagggcggcagaagacatggctacatgggccacctgacccgcatcgccaactgcatcgtgcacagcacagacaagggccccaacagcgccctggtgcagcagctgatcaaggacctgcctgatgaggtgcgggagcgctgggagaccttctgcaccagcagcctgggggagaccaacaagaggaacacagtggacctggtgaccacctgccacatccacagcagcagtgatgatgaaattgacttcaaggagaccggcttcagccaggacagcagcctgcagcagatgcagcagatgaccagcaacttcatcgaccagtttggcttcaatgatgagaagtttgctgaccaggatgacattggaaatgtgtcctttgacagagtgtctgacatcaacttcaccctgaacaccaatgaaagtggcaacatcgccctgtttgaggcctgctgcaaggagcgcatccagcagtttgatgatggcggcagtgatgaggaggacatctgggaggagaagcacatcgccttcaccccagagagccagaggaggagcagcagcggcagcacagattctgaggagagcacagattctgaggaggaggatggagccaagcaggacctgtttgagcccagcagcgccaacacagaggacaagatggaggtggacctgtctgagccccccaactggagcgccaactttgatgtgcccatggagaccacccatggagcccccctggacagcgtgggcagtgatgtgtggagcacagaggagcccatgcccaccaaggagaccggctgggccagcttcagcgagttcaccagcagcctgagcaccaaggacagcctgcggagcaacagccctgtggagatggagaccagcacagagcccatggaccccctgaccccatctgctgctgccctggccgtgcagcctgaggccgccggctctgtggccatggaggccagcagtgatggagaagaagatgctgagagcacagacaaggtgacagagaccgtgatgaatggaggcatgaaggagaccctgagcctgactgtggatgccaagacagaaacagctgtgttcaagtctgaggagggcaagctgagcaccagccaggatgctgcctgcaaggatgctgaagaatgtcctgagacagctgaggccaagtgtgccgcccccaggcctcccagcagcagccctgagcagaggacaggccagcccagcgcccctggggacacctctgtgaatggacctgtgtag

SEQ ID NO: 22120 - DNA, 174 bp, Artificial Sequence
  Description of Artificial Sequence: Synthetic coding sequence
atgaccagcaagaagctggtgaacagcgtggccggctgtgctgatgatgccctggccggcctggtggcctgcaaccccaacctgcagctgctgcagggccaccgggtggccctgcggagtgacctggacagcctgaagggccgggtggccctgctgagcggcggcggcagctag

SEQ ID NO: 22121 - DNA, 2709 bp, Artificial Sequence; identical to SEQ ID NO: 18732
  Description of Artificial Sequence: Synthetic coding sequence

SEQ ID NO: 22122 - DNA, 537 bp, Artificial Sequence
  Description of Artificial Sequence: Synthetic coding sequence
atgaacagaagaaggaagttcctgctggcctctgtgctggccctgcagaacagcagcttcatctaccccagctgccagaagtgcttcagccgcatcatcctggtgtccaagaggagcaactgccccaagtgtggcagcactggagagagcggaaatgccaactaccgctacaagctgagcctgaaggtggccgagagcaacaagctgtttgtgatcaccgtgtttggcagctgcctggacaccttcttcggcctgacagccaccggcctgcaccgctacatccaggaccccaacaagatccctgagaccctggacaatgacaccacccagaacctgctgaccaaggctgtggagacctgctttgtgggccagagcttcatcttcggcgtgaccaactttgagaaccagcccggccagggcagtgatgccagcaacttcctgcagcagtgcagcgaccacaagaggaaggccaaggccctggtggcctgccagatcgtgctgcctgaccctgccacccaggatgccaagaccaagtag

SEQ ID NO: 22123 - DNA, 441 bp, Artificial Sequence
  Description of Artificial Sequence: Synthetic coding sequence
atggtggccatggccgaggccgaggccggcgtggccgtggaggtgcggggcctgcccccagctgtgcctgatgagctgctgaccctgtactttgagaacagaagaagaagtggcggcggccctgtgctgtcctggcagaggctgggctgcggcggcgtgctgaccttccgggagccagcagatgctgagcgggtgctggcccaggccgaccacgagctgcacggggcccagctgagcctgcggcctgccccaccccgggccccagcccggctgctgctgcagggcctgcccccaggcaccaccccccagaggctggagcagcacgtgcaggccctgctgcgggccagcggcctgcctgtgcagccctgctgtgccctggccagccccaggccagaccgggccctggtgcagctgcccaagcccctgtctgaggccggctag

SEQ ID NO: 22124 - DNA, 348 bp, Artificial Sequence
  Description of Artificial Sequence: Synthetic coding sequence
atggccggccggcccctgcgcatcggggaccagctggtgctggaggaggactatgatgagacctacatccccagcgagcaggagatcctggagtttgcccgggagatcggcatcgaccccatcaaggagcctgagctgatgtggctggcccgggagggcatcgtggcccccctgcctggagagtggaagccctgccaggacatcactggagacatctactacttcaactttgccaacggccagagcatgtgggaccacccctgtgatgagcactaccgcagcctggtgatccaggagcgggccaagctgagcaccagcggggccatcaagaagaagaagaagaagtag

SEQ ID NO: 22125 - DNA, 1191 bp, Artificial Sequence
  Description of Artificial Sequence: Synthetic coding sequence
atgaggaccagctacacagtgaccctgcctgaagatcctcctgctgcccccttccctgccctggccaaggagctgcggcccaggagccccctgagccccagcctgctgctgagcacctttgtgggcctgctgctgaacaaggccaagaacagcaagagcgcccagggcctggccggcctgaggaacctgggcaacacctgcttcatgaacagcatcctgcagtgcctgagcaacacccgggagctgcgggactactgcctgcagaggctgtacatgagggacctgcaccacggcagcaatgcccacacagccctggtggaggagtttgccaagctgatccagaccatctggaccagcagccccaatgatgtggtgagccccagcgagttcaagacccagatccagagatatgcccccaggtttgtgggctacaaccagcaggatgcccaggagttcctgcgcttcctgctggatggcctgcacaatgaggtgaacagagtgaccctgcggcccaagagcaaccctgagaacctggaccacctgcctgatgatgagaagggccggcagatgtggaggaagtacctggagcgggaggacagccgcatcggggacctgtttgtgggccagctgaagagcagcctgacctgcacagactgtggctactgcagcacagtgtttgaccccttctgggacctgagcctgcccatcgccaagaggggctacccagaggtgaccctgatggactgcatgaggctcttcaccaaggaggatgtgctggatggagatgagaagcccacctgctgccgctgccggggcaggaagcgctgcatcaagaagttcagcatccagcgcttccccaagatcctggtgctgcacctgaagcgcttcagcgagagccgcatccgcaccagcaagctgaccacctttgtgaacttccccctgcgggacctggacctgcgggagtttgccagcgagaacaccaaccacgctgtgtacaacctgtatgctgtgagcaaccacagcggcaccaccatgggcggccactacacagcctactgccgcagccctggcaccggggagtggcacaccttcaatgacagctctgtgacccccatgagcagcagccaggtgaggaccagtgatgcctacctgctcttctatgagctggccagcccccccagcaggatgtag

SEQ ID NO: 22126 - DNA, 633 bp, Artificial Sequence; identical to SEQ ID NO: 19581
  Description of Artificial Sequence: Synthetic coding sequence

SEQ ID NO: 22127 - DNA, 1428 bp, Artificial Sequence
  Description of Artificial Sequence: Synthetic coding sequence
atggagctgtggcaggccgccctgagcaccctgaaccccaaccccacagacagctgccccctgtacctgaactatgccaccgtggccgccctgccctgccgggtgagccgccacaacagccccagcgctgcccacttcatcacccggctggtgaggacctgcctgcccccaggggcccaccgctgcatcgtgatggtgtgtgagcagcctgaggtgtttgccagcgcctgtgccctggcccgggccttccccctcttcacccacaggtctggggccagccggcggctggagaagaagacagtgacagtggagttcttcctggtgggccaggacaatggacctgtggaggtgtccaccctgcagtgcctggccaatgccacagatggagtgcggctggccgcccgcatcgtggacaccccctgcaatgagatgaacacagacaccttcctggaggagatcaacaaggtgggcaaggagctgggcatcatccccaccatcatcagagatgaggagctgaagacccggggctttggaggcatctatggagtgggcaaggccgccctgcaccccccagccctggccgtgctgagccacaccccagatggagccacccagaccatcgcctgggtgggcaagggcatcgtgtatgacaccggcggcctgagcatcaagggcaagaccaccatgcctggcatgaagagggactgtggcggcgctgctgctgtgctgggcgccttccgggccgccatcaagcagggcttcaaggacaacctgcatgctgtgttctgcctggccgagaacagcgtgggccccaatgccaccaggccagatgacatccacctgctgtacagcggcaagacagtggagatcaacaacacagatgctgagggccgcctggtgctggctgatggagtgtcctatgcctgcaaggacctgggcgctgacatcatcctggacatggccaccctgaccggggcccagggcatcgccaccgggaagtaccacgccgctgtgctgaccaacagcgctgagtgggaggccgcctgtgtgaaggccggcaggaaatgtggggacctggtgcaccccctggtgtactgcccagagctgcacttcagcgagttcaccagcgctgtggccgacatgaagaacagcgtggccgaccgggacaacagccccagcagctgtgccggcctcttcatcgccagccacatcggctttgactggccaggagtgtgggtgcacctggacattgctgcccctgtgcatgctggggagcgggccaccggcttcggcgtggccctgctgctggccctgtttggccgggccagcgaggaccccctgctgaacctggtgagccccctgggctgtgaggtggatgtggaggagggggacctgggccgggacagcaagagaagaaggctggtgtag

SEQ ID NO: 22128 - DNA, 537 bp, Artificial Sequence
  Description of Artificial Sequence: Synthetic coding sequence
atggtggccatggccgaggccgaggccggcgtggccgtggaggtgcggggcctgcccccagctgtgcctgatgagctgctgaccctgtactttgagaacagaagaagaagtggcggcggccctgtgctgtcctggcagaggctgggctgcggcggcgtgctgaccttccgggagccagcagatgctgagcgggtgctggcccaggccgaccacgagctgcacggggcccagctgagcctgcggcctgccccaccccgggccccagcccggctgctgctgcagggcctgcccccaggcaccaccccccagaggctggagcagcacgtgcaggccctgctgcgggccagcggcctgcctgtgcagccctgctgtgccctggccagccccaggccagaccgggccctggtgcagctgcccaagcccctgtctgaggctgatgtgcgggtgctggaggagcaggcccagaacctgggcctggagggcaccctggtgtccctggcccgggtgccccaggcccgggctgtgcgggtggtgtag

SEQ ID NO: 22129 - DNA, 1893 bp, Artificial Sequence
  Description of Artificial Sequence: Synthetic coding sequence
atggagaaggtgctgggctgtgagctgctgaagggcctgaatgtgctggacctgggcctgaacatggagatcctggaggagcagatgctgcacgagatcctgtgccgggagtacccagagctggagacccgctggcaggacctgaagatccgggccctggacacctgcaaggctgtggaggccgctgaggagcggctgctgaccatgctgctcttccagaaccccaagaggcagaagccagccaagttcctgagaaatattgtgcgggcccagggcaagctgtgccagctgcgggcccactgtgaggagctggagggccagaagctgcaggagatggtgctgtgggccccctacagacctgtggtgtggcacggcatggccatggtgaaggccctgagccagctgcagaacctgctgcccctcttctgcatgagccctgagaactggctggccgtgaccaagcaggccctggacagcatgaagccccgggagatcaaccacggggaggacctggccagccacctgctgcagctgcgggcccacctgacccggcagctgctgggcagcacagtgacagccctgggcctgacccaggtgcccctggtgggcgccctgggcgccctggccctgctgcaggccaccgggaaggccagcgagctggagcggctggccctgtggccaggcctggccgccagccccagcacagtgcacagcaagcctgtgtctgatgtggcccggcctgcctggctgggccccaaggcctggcatgaatgtgagatgctggagctgctgcccccatttgtgggcctgtgtgccagcctggccggccacagcagcgcctggcaggcctacctgagcctgagcagcacagtgctgggccctgcccctggccctggccctgagcccctgagcctgctgcagaagctgatcctgtggagggtgctgcggcctgagtgcctggccggggccctggccgacttcaccaccagcctgctgggccggcccctggatgagaacacctacgcccccaccatgcccttcaagcacagccaggccacccagcccatgctgatcctgctgcccccacctggccaccccagcgccaccctgcaccccctgaccgtcatccagaagctggccgccaagtaccagcagggccagaagcagctgcaggtgattgccctgggcagcgaggcctgggaccctgtgtctgtggtggtgtccaccctgagccaggccatgtatgagggccactggctggtgctggacaactgccacctgatgccccactggcccaaggagctgctgcagctgctgctggagctgctgggccgggccaaggtggtggccgacctggagagcgagcagctgctggaccagcctgagagcagaaatgtgtccacagtgcaccgggacttccggctgtggctgattgtgcctgctgagagcagcgccagcctgcctgctgtgctgacccagcacagcatgcctgtgttctggaaccagagcctggagctgggccacgtgctgattgattctgtggagctggcccagcaggtgctgtacatgcagccccccacccaggccctgcccctgctgctgctgcacggcctgctgctgcaccggcagctgtatggcacccggctgcaggcccaccggggccgctggagccaggtgaccctgacccaggtgctgcagacccaggaccagctgtgggccagcctgagcaacccccgggccgccatgcaggagctggccggggagaccctgcccctgcccctgggcgtcatcagcccccaggagagcctggaggagggcggcggcggcatccagttcaccgccctggtgctggccgtggtggagacagagggcactggaacagagcggctgtag

SEQ ID NO: 22130 - DNA, 1488 bp, Artificial Sequence
  Description of Artificial Sequence: Synthetic coding sequence
atggagctgcacggcggcaacagaggaggctaccagcccaaggccctggagcagagcggctgctggctgtggcaggccgccctgagcaccctgaaccccaaccccacagacagctgccccctgtacctgaactatgccaccgtggccgccctgccctgccgggtgagccgccacaacagccccagcgctgcccacttcatcacccggctggtgaggacctgcctgcccccaggggcccaccgctgcatcgtgatggtgtgtgagcagcctgaggtgtttgccagcgcctgtgccctggcccgggccttccccctcttcacccacaggtctggggccagccggcggctggagaagaagacagtgacagtggagttcttcctggtgggccaggacaatggacctgtggaggtgtccaccctgcagtgcctggccaatgccacagatggagtgcggctggccgcccgcatcgtggacaccccctgcaatgagatgaacacagacaccttcctggaggagatcaacaaggtgggcaaggagctgggcatcatccccaccatcatcagagatgaggagctgaagacccggggctttggaggcatctatggagtgggcaaggccgccctgcaccccccagccctggccgtgctgagccacaccccagatggagccacccagaccatcgcctgggtgggcaagggcatcgtgtatgacaccggcggcctgagcatcaagggcaagaccaccatgcctggcatgaagagggactgtggcggcgctgctgctgtgctgggcgccttccgggccgccatcaagcagggcttcaaggacaacctgcatgctgtgttctgcctggccgagaacagcgtgggccccaatgccaccaggccagatgacatccacctgctgtacagcggcaagacagtggagatcaacaacacagatgctgagggccgcctggtgctggctgatggagtgtcctatgcctgcaaggacctgggcgctgacatcatcctggacatggccaccctgaccggggcccagggcatcgccaccgggaagtaccacgccgctgtgctgaccaacagcgctgagtgggaggccgcctgtgtgaaggccggcaggaaatgtggggacctggtgcaccccctggtgtactgcccagagctgcacttcagcgagttcaccagcgctgtggccgacatgaagaacagcgtggccgaccgggacaacagccccagcagctgtgccggcctcttcatcgccagccacatcggctttgactggccaggagtgtgggtgcacctggacattgctgcccctgtgcatgctggggagcgggccaccggcttcggcgtggccctgctgctggccctgtttggccgggccagcgaggaccccctgctgaacctggtgagccccctgggctgtgaggtggatgtggaggagggggacctgggccgggacagcaagagaagaaggctggtgtag

SEQ ID NO: 22131 - DNA, 618 bp, Artificial Sequence
  Description of Artificial Sequence: Synthetic coding sequence
atggagacagacctgaacagccaggacaggaaggacctggacaagttcatcaagttctttgccctgaagacagtgcaggtgattgtgcaggcccggctgggggagaagatctgcaccaggagcagcagcagccccaccggcagtgactggttcaacctggccatcaaggacatccctgaggtgacccatgaggccaagaaggccctggccggccagctgcctgctgtgggccgctccatgtgtgtggagatcagcctgaagaccagcgagggggacagcatggagctggagatctggtgcctggagatgaatgagaagtgtgacaaggagatcaaggtgtcctacacagtgtacaaccggctgagcctgctgctgaagagcctgctggccatcaccagggtgaccccagcctaccgcctgagcaggaagcagggccacgagtatgtgatcctgtaccgcatctactttggagaggtgcagctgagcggcctgggggagggcttccagacagtgcgggtgggcaccgtgggcacccctgtgggcaccatcaccctgagctgtgcctaccgcatcaacctggccttcatgagcacccggcagtttgagaggaccccctag

SEQ ID NO: 22132 - DNA, 117 bp, Artificial Sequence
  Description of Artificial Sequence: Synthetic coding sequence
atggccgccttcaagctggacttcctgcctgagatgatggtggaccactgcagcctgaacagcagccctgtgtccaagaagatgaatggcaccctggaccacccagaccagccctag

SEQ ID NO: 22133 - DNA, 1554 bp, Artificial Sequence; identical to SEQ ID NO: 18881
  Description of Artificial Sequence: Synthetic coding sequence

SEQ ID NO: 22134 - DNA, 768 bp, Artificial Sequence
  Description of Artificial Sequence: Synthetic coding sequence
atggagaggagcggccagagggtgaccacctgggactgtgaccagggcaagcacagcgacagcgcccagaagaatgaaagagagagcatccggcagaagctggccctgggcagcttctttgatgatggccctggcatctacaccagctgcagcaagagcggcaagcccagcctgagcagccggctgcagagcggcatgaacctgcagatctgctttgtgaatgacagcggcagtgacaaggacagtgatgctgatgacagcaagacagagaccagcctggacacccccctgagccccatgagcaagcagagcagcagctacagcgaccgggacaccacagaggaggagagcgagagcctggatgacatggacttcctgacccggcagaagaagctgcaggccgaggccaagatggccctggccatggccaagcccatggccaagatgcaggtggaggtggagaagcagaacaggaagaagagccctgtggccgacctgctgccccacatgccccacatcagtgaatgtctgatgaagaggagcctgaagcccacagacctgcgggacatgaccatcggccagctgcaggtgattgtgaatgacctgcacagccagatcgagagcctgaatgaggagctggtgcagctgctgctgatcagagatgagctgcacacagagcaggatgccatgctggtggacatcgaggacctgaccaggcatgctgagagccagcagaagcacatggccgagaagatgcctgccaagtag

SEQ ID NO: 22135 - DNA, 78 bp, Artificial Sequence
  Description of Artificial Sequence: Synthetic coding sequence
atgagccagagcggggctgtgtcctgctgccctggggccaccaacggcagcctgggccgcagtgatggagtggcctag

SEQ ID NO: 22136 - DNA, 360 bp, Artificial Sequence
  Description of Artificial Sequence: Synthetic coding sequence
atggtgctggagggcaaccctgaggtgggcagccccaggaccagtgacctgcagcaccggggcaacaagggcagctgtgtgctgagcagccctggagaagatgcccagcctggagaggagcccatcaagtacggggagctgattgtgctgggctgctgtgaggagggcggggaggagacagaggcccagagaggagaggtgacaggcccccgggcccacagctgctacaacggctgcctggccagcggggacaagggcagaagaagaagccggctggccctgagccgccgcagccacgccaatggagtgaagccagatgtgatgcaccacatcagcacccccctggtgtccaaggcctag

SEQ ID NO: 22137 - DNA, 348 bp, Artificial Sequence; identical to SEQ ID NO: 22124
  Description of Artificial Sequence: Synthetic coding sequence

SEQ ID NO: 22138 - DNA, 471 bp, Artificial Sequence
  Description of Artificial Sequence: Synthetic coding sequence
atgagctctgtgcagagccagcaggagcagctgagccagagcgaccccagccccagccccaacagctgcagcagctttgagctgattgacatggatgctggcagcctgtatgagcctgtgagcccccactggttctactgcaagatcatcgacagcaaggagacctggatccccttcaacagcgaggacagccagcagctggaggaggcctacagcagcggcaagggctgcaatggccgggtggtgcccacagatggcggccgctatgatgtgcacctgggggagaggatgagatatgctgtgtactgggatgagctggccagcgaggtgcggcgctgcacctggttctacaagggggacaaggacaacaagtatgtgccctacagcgagagcttcagccaggtgctggaggagacctacatgctggccgtgaccctggatgagtggaagaagaagctggagagcccctag

SEQ ID NO: 22139 - DNA, 14262 bp, Artificial Sequence; identical to SEQ ID NO: 18383
  Description of Artificial Sequence: Synthetic coding sequence

SEQ ID NO: 22140 - DNA, 390 bp, Artificial Sequence
  Description of Artificial Sequence: Synthetic coding sequence
atggtggccatggccgaggccgaggccggcgtggccgtggaggtgcggggcctgcccccagctgtgcctgatgagctgctgaccctgtactttgagaacagaagaagaagtggcggcggccctgtgctgtcctggcagaggctgggctgcggcggcgtgctgaccttccgggagccagcagatgctgagcgggtgctggcccaggccgaccacgagctgcacggggcccagctgagcctgcggcctgccccaccccgggccccagcccggctgctgctgcagggcctgcccccaggcaccaccccccagaggctggagcagcacgtgcaggccctgctgcgggccagcggcctgcctgtgcagccctgctgtgccctggccagcccctag

SEQ ID NO: 22141 - DNA, 867 bp, Artificial Sequence
  Description of Artificial Sequence: Synthetic coding sequence
atggagcgggagcccagcgccagcgaggccgccccagctgctgctgccctgtttgcctggggcgccaacagctatggccagctgggcctgggccacaaggaggatgtgctgctgccccagcagctgaatgacttctgcaagcccaggtctgtgcggcgcatcactggaggcggcggccacagcgctgtggtgacagatggaggagacctgtttgtgtgtggcctgaacaaggatggccagctgggcctgggccacacagaggacatcccctacttcaccccctgcaagagcctgtttggctgccccatccagcaggtggcctgtggctgggacttcaccatcatgctgacagaaaatggccaggtgctgagctgtggcagcaacagctttggccagctgggcgtgccccacggcccccggcgctgtgtggtgccccaggccatcgagctgcacaaggagaaggtggtgtgcatcgccgccggcctgcggcatgctgtggccgccacagccagcggcatcgtgttccagtggggcaccggcctggccagctgtggccggcggctgtgccccggccagaccctgcccctcttcttcaccgccaaggagcccagccgggtgacaggcctggagaacagcaaggccatgtgtgtgctggccggcagtgaccacagcgccagcctgacagatgctggggaggtgtatgtgtggggcagcaacaagcacggccagctggccaatgaggccgccttcctgcctgtgccccagaagattgaggcccactgcttccagaatgagaaggtgacagccatctggagcggctggacccacctggtggcccagacaggcctgctgtggctgcgggcctag

SEQ ID NO: 22142 - DNA, 372 bp, Artificial Sequence
  Description of Artificial Sequence: Synthetic coding sequence
atgaacagaagaaggaagttcctgctggcctctgtgctggccctgcagaacagcagcttcatctaccccagctgccagaagtgcttcagccgcatcatcctggtgtccaagaggagcaactgccccaagtgtggcagcactggagagagcggaaatgccaactaccgctacaagctgagcctgaaggtggccgagagcaacaagctgtttgtgatcaccgtgtttggcagctgcctggacaccttcttcggcctgacagccaccggcctgcaccgctacatccaggaccccaacaagatccctgagaccctggacaatgacaccacccagaacctgctgaccaaggctgtggagacctgctttgtgggctag

SEQ ID NO: 22143 - DNA, 324 bp, Artificial Sequence
  Description of Artificial Sequence: Synthetic coding sequence
atgctgcggctgtacccaggccccatggtgacagaagctgagggcaagggcggccctgagatggccagcctgagcagctctgtggtgcctgtgtccttcatcagcaccctgcgggagagcgtgctggaccccggggtgggcggggagggcgccagtgacaagcagaggagcaagctgagcctgagccacagcatgatcccagctgccaagatccacacagagctgtgcctgcctgccttcttctccccagctggcacccagaggcgcttccagcagccccagcaccacctgaccctgagcatcatccacacagctgccaggtag

SEQ ID NO: 22144 - DNA, 1653 bp, Artificial Sequence
  Description of Artificial Sequence: Synthetic coding sequence
atggagacagacctgaacagccaggacaggaaggacctggacaagttcatcaagttctttgccctgaagacagtgcaggtgattgtgcaggcccggctgggggagaagatctgcaccaggagcagcagcagccccaccggcagtgactggttcaacctggccatcaaggacatccctgaggtgacccatgaggccaagaaggccctggccggccagctgcctgctgtgggccgctccatgtgtgtggagatcagcctgaagaccagcgagggggacagcatggagctggagatctggtgcctggagatgaatgagaagtgtgacaaggagatcaaggtgtcctacacagtgtacaaccggctgagcctgctgctgaagagcctgctggccatcaccagggtgaccccagcctaccgcctgagcaggaagcagggccacgagtatgtgatcctgtaccgcatctactttggagaggtgcagctgagcggcctgggggagggcttccagacagtgcgggtgggcaccgtgggcacccctgtgggcaccatcaccctgagctgtgcctaccgcatcaacctggccttcatgagcacccggcagtttgagaggaccccacccatcatgggcatcatcatcgaccactttgtggaccggccctaccccagcagcagccccatgcacccctgcaactacagaacagctggggaggacaccggggtcatctaccccagcgtggaggacagccaggaggtgtgcaccaccagcttcagcaccagcccccccagccagtgtgtgttcaccgtgaccaaggcccacttccagacccccacccctgtggtgacagacaccctgcgggtgcccatggccggcctggccttcagccaccagctgagcagcagccggctgagctaccagcctgctgccctgggcgtgggcagcgctgacctggcctaccctgtggtgtttgctgctggcctgaatgccacccacccccaccagctgatggtgcctgggaaggagggcggcgtgcccctggcccccaaccagcctgtgcacggcacccaggccgaccaggagcggctggccacctgcacccccagcgacaggacccactgtgccgccacccccagcagcagcgaggacacagagaccgtgagcaacagcagcgagggccgggccagcccccatgatgtgctggagaccatctttgtgaggaaggtgggcgcctttgtgaacaagcccatcaaccaggtgaccctgaccagcctggacatcccctttgccatgtttgcccccaagaacctggagctggaggacacagaccccatggtgaaccccccagacagccctgagacagagagccccctgcagggcagcctgcacagtgatggcagcagcggcggcagcagcggcaacacccatgatgactttgtgatgattgacttcaagccagccttcagcaaggatgacatcctgcccatggacctgggcaccttctaccgggagttccagaaccccccccagctgagcagcctgagcattgacatcggggcccagagcatggccgaggacctggacagcctgcctgagaagctggccgtgcatgagaagaatgtgcgggagtttgatgcctttgtggagaccctgcagtag

SEQ ID NO: 22145 - DNA, 4104 bp, Artificial Sequence
  Description of Artificial Sequence: Synthetic coding sequence
atgggcaacagcgacagccagtacaccctgcagggcagcaagaaccacagcaacaccatcactggagccaagcagatcccctgcagcctgaagatccggggcatccacgccaaggaggagaagagcctgcacggctggggccacggcagcaatggagctggctacaagagccgcagcctggcccggagctgcctgagccacttcaagagcaaccagccctatgccagccggctgggcggccccacctgcaaggtgtcccggggcgtggcctacagcacccacaggaccaatgcccctgggaaggacttccagggcatctctgctgccttcagcacagaaaatggcttccacagcgtgggccacgagctggccgacaaccacatcaccagccgggactgcaatggccacctgctgaactgctatggaagaaatgaaagcatcgccagcaccccacctggagaggacaggaagagcccccgggtgctgatcaagaccctgggcaagctggatggctgcctgcgggtggagttccacaatggaggcaaccccagcaaggtgcctgctgaggactgcagcgagcctgtgcagctgctgcgctacagccccaccctggccagcgagaccagccctgtgcctgaggcccggcggggcagcagcgctgacagcctgcccagccaccggcccagccccacagacagccggctgcggagcagcaagggcagcagcctgagcagcgagagctcctggtatgacagcccctggggcaatgctggggagctgtctgaggccgagggcagcttcctggcccctggcatgccagaccccagcctgcacgccagcttccccccaggagatgccaagaagcccttcaaccagagcagcagcctgagcagcctgcgggagctgtacaaggatgccaacctgggcagcctgagccccagcggcatccggctgagtgatgagtacatgggcacccacgccagcctgagcaacagagtgtcctttgccagtgacattgatgtgcccagccgggtggcccatggagaccccatccagtacagcagcttcaccctgccctgcaggaagcccaaggcctttgtggaggacacagccaagaaggacagcctgaaggccaggatgaggcgcatcagtgactggacaggcagcctgagcaggaagaagaggaagctgcaggagcccaggagcaaggagggcagtgactactttgacagcagaagtgatggcctgaacacagatgtgcagggcagcagccaggccagcgccttcctgtggagcggcggcagcacccagatcctgagccagaggtctgagagcacccacgccatcggcagtgaccccctgcggcagaacatctatgagaacttcatgagggagctggagatgagcaggaccaacacagagaacatcgagaccagcacagaaacagctgagagcagcagcgagagcctgagcagcctggagcagctggacctgctgtttgagaaggagcagggcgtggtgaggaaggccggctggctgttcttcaagcccctggtgacagtgcagaaggagaggaagctggagctggtggcccggaggaagtggaagcagtactgggtgaccctgaagggctgcaccctgctcttctatgagacctacggcaagaacagcatggaccagagcagcgccccccgctgtgccctgtttgctgaagattccatcgtgcagagcgtgcctgagcaccccaagaaggaaaatgtgttctgcctgagcaacagctttggagatgtgtacctgttccaggccaccagccagacagacctggagaactgggtgacagctgtgcacagcgcctgtgccagcctgtttgccaagaagcacggcaaggaggacaccctgcggctgctgaagaaccagaccaagaacctgctgcagaagattgacatggacagcaagatgaagaagatggccgagctgcagctgtctgtggtgtctgaccccaagaacaggaaggccatcgagaaccagatccagcagtgggagcagaacctggagaagttccacatggacctcttcaggatgcgctgctacctggccagcctgcagggcggggagctgcccaaccccaagagcctgctggccgccgccagccggcccagcaagctggccctgggccgcctgggcatcctgtctgtgagcagcttccacgccctggtgtgcagcagagatgattctgccctgaggaagaggaccctgagcctgacccagagaggaagaaacaagaagggcatcttcagcagcctgaagggcctggacaccctggccaggaagggcaaggagaagaggcccagcatcacccaggtggatgagctgctgcacatctacggcagcacagtggatggagtgccccgggacaatgcctgggagatccagacctacgtgcacttccaggacaaccacggcgtgacagtgggcatcaagccagagcaccgggtggaggacatcctgaccctggcctgcaagatgaggcagctggagcccagccactacggcctgcagctgaggaagctggtggatgacaacgtggagtactgcatcccagccccctatgagtacatgcagcagcaggtgtatgatgaaattgaggtgttccccctgaatgtgtatgatgtgcagctgaccaagacaggctctgtgtgtgactttggatttgctgtgacagcccaggtggatgagcggcagcacctgagccgcatcttcatcagtgatgtgctgcctgatggcctggcctatggagagggcctgaggaaaggaaatgagatcatgaccctgaatggagaggccgtgtctgacctggacctgaagcagatggaggccctcttcagcgagaagtctgtgggcctgaccctgattgcccggcccccagacaccaaggccaccctgtgcacctcctggagcgacagcgacctcttcagccgggaccagaagagcctgctgcccccacccaaccagagccagctgctggaggagttcctggacaacttcaagaagaacacagccaatgacttcagcaatgtgcctgacatcaccaccggcctgaagaggagccagacagatggcaccctggaccaggtgagccaccgggagaagatggagcagaccttccgctctgctgagcagatcacagccctgtgccgctccttcaatgacagccaggccaacggcatggagggcccccgggagaaccaggaccccccacccaggagcctggcccggcacctgagtgatgctgaccggctgaggaaggtgatccaggagctggtggacacagagaagagctatgtgaaggacctgagctgcctgtttgagctgtacctggagcccctgcagaatgagaccttcctgacccaggatgagatggagagcctgtttggcagcctgcctgagatgctggagttccagaaggtgttcctggagaccctggaggatggcatcagcgccagcagtgacttcaacaccctggagacccccagccagttcaggaagctgctcttcagcctgggcggcagcttcctgtactatgctgaccacttcaagctgtacagcggcttctgtgccaaccacatcaaggtgcagaaggtgctggagcgggccaagacagacaaggccttcaaggccttcctggatgccaggaaccccaccaagcagcacagcagcaccctggagagctacctgatcaagcctgtgcagagggtgctgaagtaccccctgctgctgaaggagctggtgtccctgacagaccaggagagcgaggagcactaccacctgacagaggccctgaaggccatggagaaggtggccagccacatcaatgagatgcagaagatctatgaggactatggcaccgtgtttgaccagctggtggccgagcagagcggcacagagaaggaggtgacagagctgtccatgggagagctgctgatgcacagcacagtgtcctggctgaaccccttcctgagcctgggcaaggccaggaaggacctggagctgactgtgtttgtgttcaagagagctgtgatcctggtgtacaaggagaactgctag

SEQ ID NO: 22146 - DNA, 45 bp, Artificial Sequence
  Description of Artificial Sequence: Synthetic coding sequence
atgaatggcaccctggaccacccagaccagcctgacctggactag

SEQ ID NO: 22147 - DNA, 519 bp, Artificial Sequence
  Description of Artificial Sequence: Synthetic coding sequence
atggtggccatggccgaggccgaggccggcgtggccgtggaggtgcggggcctgcccccagctgtgcctgatgagctgctgaccctgtactttgagaacagaagaagaagtggcggcggccctgtgctgtcctggcagaggctgggctgcggcggcgtgctgaccttccgggagccagcagatgctgagcgggtgctggcccaggccgaccacgagctgcacggggcccagctgagcctgcggcctgccccaccccgggccccagcccggctgctgctgcagggcctgcccccaggcaccaccccccagaggctggagcagcacgtgcaggccctgctgcgggccagcggcctgcctgtgcagccctgctgtgccctggccagccccaggccagaccgggccctggtgcagctgcccaagcccctgtctgaggctgatgtgcgggtgctggaggagcaggcccagaacctgggcctggagggcaccctggtgtccctggcccgggtgccccaggcctag

SEQ ID NO: 22148 - DNA, 27 bp, Artificial Sequence
  Description of Artificial Sequence: Synthetic coding sequence
atgttctggaagtttgacctgcactag

SEQ ID NO: 22149 - DNA, 411 bp, Artificial Sequence
  Description of Artificial Sequence: Synthetic coding sequence
atggtggccatggccgaggccgaggccggcgtggccgtggaggtgcggggcctgcccccagctgtgcctgatgagctgctgaccctgtactttgagaacagaagaagaagtggcggcggccctgtgctgtcctggcagaggctgggctgcggcggcgtgctgaccttccgggagccagcagatgctgagcgggtgctggcccaggccgaccacgagctgcacggggcccagctgagcctgcggcctgccccaccccgggccccagcccggctgctgctgcagggcctgcccccaggcaccaccccccagaggctggagcagcacgtgcaggccctgctgcgggccagcggcctgcctgtgcagccctgctgtgccctggccagccccaggccagaccgggccctggtgtag

SEQ ID NO: 22150 - DNA, 5844 bp, Artificial Sequence
  Description of Artificial Sequence: Synthetic coding sequence
ggccggcccatcgacccccgggagggccctggccggccccccctggatggccgggaccacttcggccggccccctgtggacatccgggagaacctggtgcggcccggcatcgaccacctgggccggcgggaccacttcggcttcaaccctgagaagccctggggccacagaggagactttgatgagcgggagcaccgggtgctgcctgtgtatggaggccccaagggcctgcacgaggagcggggccgcttccgcagcggcaactacagatttgaccccaggagcggcccctggaacagaggcttcggccaggaggtgcaccgggactttgatgacagaagaagaccctgggagcggcagagggacagagatgaccgggactttgacttctgccgggagatgaatggaaaccggctgggccgggaccgcatccagaacacctgggtgcccccacctcatgcccgggtgtttgactactttgagggcgccaccagccagaggaagggggacaacgtgccccaggtgaatggagagaacacagaaagacatgcccagcccccacccatccctgtgcagaatgaccctgagctgtatgagaagctgaccagcagcaatgagatcaacaaggagaagagtgacacagtggccgacatcgagagcgagcctgtggtggagagcacagaaacagagggcacccccctgaccagcctgacagctgagacccggcggcaggtgaagatgggcaacagcgacagccagtacaccctgcagggcagcaagaaccacagcaacaccatcactggagccaagcagatcccctgcagcctgaagatccggggcatccacgccaaggaggagaagagcctgcacggctggggccacggcagcaatggagctggctacaagagccgcagcctggcccggagctgcctgagccacttcaagagcaaccagccctatgccagccggctgggcggccccacctgcaaggtgtcccggggcgtggcctacagcacccacaggaccaatgcccctgggaaggacttccagggcatctctgctgccttcagcacagaaaatggcttccacagcgtgggccacgagctggccgacaaccacatcaccagccgggactgcaatggccacctgctgaactgctatggaagaaatgaaagcatcgccagcaccccacctggagaggacaggaagagcccccgggtgctgatcaagaccctgggcaagctggatggctgcctgcgggtggagttccacaatggaggcaaccccagcaaggtgcctgctgaggactgcagcgagcctgtgcagctgctgcgctacagccccaccctggccagcgagaccagccctgtgcctgaggcccggcggggcagcagcgctgacagcctgcccagccaccggcccagccccacagacagccggctgcggagcagcaagggcagcagcctgagcagcgagagctcctggtatgacagcccctggggcaatgctggggagctgtctgaggccgagggcagcttcctggcccctggcatgccagaccccagcctgcacgccagcttccccccaggagatgccaagaagcccttcaaccagagcagcagcctgagcagcctgcgggagctgtacaaggatgccaacctgggcagcctgagccccagcggcatccggctgagtgatgagtacatgggcacccacgccagcctgagcaacagagtgtcctttgccagtgacattgatgtgcccagccgggtggcccatggagaccccatccagtacagcagcttcaccctgccctgcaggaagcccaaggcctttgtggaggacacagccaagaaggacagcctgaaggccaggatgaggcgcatcagtgactggacaggcagcctgagcaggaagaagaggaagctgcaggagcccaggagcaaggagggcagtgactactttgacagcagaagtgatggcctgaacacagatgtgcagggcagcagccaggccagcgccttcctgtggagcggcggcagcacccagatcctgagccagaggtctgagagcacccacgccatcggcagtgaccccctgcggcagaacatctatgagaacttcatgagggagctggagatgagcaggaccaacacagagaacatcgagaccagcacagaaacagctgagagcagcagcgagagcctgagcagcctggagcagctggacctgctgtttgagaaggagcagggcgtggtgaggaaggccggctggctgttcttcaagcccctggtgacagtgcagaaggagaggaagctggagctggtggcccggaggaagtggaagcagtactgggtgaccctgaagggctgcaccctgctcttctatgagacctacggcaagaacagcatggaccagagcagcgccccccgctgtgccctgtttgctgaagattccatcgtgcagagcgtgcctgagcaccccaagaaggaaaatgtgttctgcctgagcaacagctttggagatgtgtacctgttccaggccaccagccagacagacctggagaactgggtgacagctgtgcacagcgcctgtgccagcctgtttgccaagaagcacggcaaggaggacaccctgcggctgctgaagaaccagaccaagaacctgctgcagaagattgacatggacagcaagatgaagaagatggccgagctgcagctgtctgtggtgtctgaccccaagaacaggaaggccatcgagaaccagatccagcagtgggagcagaacctggagaagttccacatggacctcttcaggatgcgctgctacctggccagcctgcagggcggggagctgcccaaccccaagagcctgctggccgccgccagccggcccagcaagctggccctgggccgcctgggcatcctgtctgtgagcagcttccacgccctggtgtgcagcagagatgattctgccctgaggaagaggaccctgagcctgacccagagaggaagaaacaagaagggcatcttcagcagcctgaagggcctggacaccctggccaggaagggcaaggagaagaggcccagcatcacccaggtggatgagctgctgcacatctacggcagcacagtggatggagtgccccgggacaatgcctgggagatccagacctacgtgcacttccaggacaaccacggcgtgacagtgggcatcaagccagagcaccgggtggaggacatcctgaccctggcctgcaagatgaggcagctggagcccagccactacggcctgcagctgaggaagctggtggatgacaacgtggagtactgcatcccagccccctatgagtacatgcagcagcaggtgtatgatgaaattgaggtgttccccctgaatgtgtatgatgtgcagctgaccaagacaggctctgtgtgtgactttggatttgctgtgacagcccaggtggatgagcggcagcacctgagccgcatcttcatcagtgatgtgctgcctgatggcctggcctatggagagggcctgaggaaaggaaatgagatcatgaccctgaatggagaggccgtgtctgacctggacctgaagcagatggaggccctcttcagcgagaagtctgtgggcctgaccctgattgcccggcccccagacaccaaggccaccctgtgcacctcctggagcgacagcgacctcttcagccgggaccagaagagcctgctgcccccacccaaccagagccagctgctggaggagttcctggacaacttcaagaagaacacagccaatgacttcagcaatgtgcctgacatcaccaccggcctgaagaggagccagacagatggcaccctggaccaggtgagccaccgggagaagatggagcagaccttccgctctgctgagcagatcacagccctgtgccgctccttcaatgacagccaggccaacggcatggagggcccccgggagaaccaggaccccccacccaggagcctggcccggcacctgagtgatgctgaccggctgaggaaggtgatccaggagctggtggacacagagaagagctatgtgaaggacctgagctgcctgtttgagctgtacctggagcccctgcagaatgagaccttcctgacccaggatgagatggagagcctgtttggcagcctgcctgagatgctggagttccagaaggtgttcctggagaccctggaggatggcatcagcgccagcagtgacttcaacaccctggagacccccagccagttcaggaagctgctcttcagcctgggcggcagcttcctgtactatgctgaccacttcaagctgtacagcggcttctgtgccaaccacatcaaggtgcagaaggtgctggagcgggccaagacagacaaggccttcaaggccttcctggatgccaggaaccccaccaagcagcacagcagcaccctggagagctacctgatcaagcctgtgcagagggtgctgaagtaccccctgctgctgaaggagctggtgtccctgacagaccaggagagcgaggagcactaccacctgacagaggccctgaaggccatggagaaggtggccagccacatcaatgagatgcagaagatctatgaggactatggcaccgtgtttgaccagctggtggccgagcagagcggcacagagaaggaggtgacagagctgtccatgggagagctgctgatgcacagcacagtgtcctggctgaaccccttcctgagcctgggcaaggccaggaaggacctggagctgactgtgtttgtgttcaagagagctgtgatcctggtgtacaaggagaactgcaagctgaagaagaagctgcccagcaacagcaggcctgcccacaacagcacagacctggaccccttcaagttccgctggctgatccccatcagcgccctgcaggtgcggctgggcaacccagctggaacagagaacaacagcatctgggagctgatccacaccaagtcagaaattgagggccggcctgagaccatcttccagctgtgctgcagcgacagcgagagcaagaccaacatcgtgaaggtgatccgcagcatcctgcgggagaacttcagaagacacatcaagtgtgagctgcccctggagaagacctgcaaggaccggctggtgcccctgaagaacagagtgcctgtgtctgccaagctggccagcagccgcagcctgaaggtgctgaagaacagcagcagcaatgagtggacaggagagaccgggaagggcaccctgctggacagtgatgagggcagcctgagcagcggcacccagagcagcggctgccccacagctgagggccggcaggacagcaagagcaccagccctgggaagtacccccaccctggcctggccgactttgctgacaacctgatcaaggagagtgacatcctgagtgatgaagatgatgaccaccggcagacagtgaagcagggcagccccaccaaggacatcgagatccagttccagaggctgcgcatcagtgaagatcctgatgtgcaccctgaggccgagcagcagcccggccctgagagcggggagggccagaagggcggggagcagcccaagctggtgcggggccacttctgccccatcaagaggaaggccaacagcaccaagagggaccggggcaccctgctgaaggcccagatccgccaccagagcctggacagccagagtgaaaatgccaccatcgacctgaacagcgtgctggagcgggagttctctgtgcagagcctgacctctgtggtgtctgaggagtgcttctatgaaacagagagccacggcaagagctag

SEQ ID NO: 22151 - DNA, 294 bp, Artificial Sequence
  Description of Artificial Sequence: Synthetic coding sequence
atggaggccgcagatgccagccgcagcaatggcagcagccctgaggccagagatgcccggagccccagcggccccagcggcagcctggagaatggcaccaaggcagatggcaaggatgccaagaccaccaacggccacggcggggaggccgctgagggcaagagcctgggcagcgccctgaagccaggagagggccgcagcgccctgtttgctggaaatgagtggaggcggcccatcatccagtttgtggagagcggagatgacaagaacagcaactacttctccatggactag

SEQ ID NO: 22152 - DNA, 117 bp, Artificial Sequence
  Description of Artificial Sequence: Synthetic coding sequence
atggaggccgcagatgccagccgcagcaatggcagcagccctgaggccagagatgcccggagccccagcggccccagcggcagcctggagaatggcaccaaggcagatggcaagtag

SEQ ID NO: 22153 - DNA, 1455 bp, Artificial Sequence
  Description of Artificial Sequence: Synthetic coding sequence
atggccatcggcaagaggctggccaccctgcccaccaaggagcagaagacccagaggctcatcagcgagctgagcctgctgaaccacaagctgcctgcccgggtgtggctgcccacagctggctttgaccaccacgtggtgcgggtgccccacacccaggccgtggtgctgaacagcaaggacaaggccccctacctgatctacgtggaggtgctggagtgtgaaaattttgacaccacctctgtgcctgcccgcatccctgagaaccgcatccgcagcaccaggtctgtggagaacctgcctgaatgtggcatcacccatgagcagagagctggcagcttcagcacagtgcccaactatgacaatgatgatgaggcctggagcgtggatgacatcggggagctgcaggtggagctgcctgaggtgcacaccaacagctgtgacaacatcagccagttctctgtggacagcatcaccagccaggagagcaaggagcccgtcttcatcgctgctggggacatcagaagaaggctgtctgagcagctggcccacacccccacagccttcaagagggaccctgaggaccccagcgctgtggccctgaaggagccctggcaggagaaggtgcggcgcatccgggagggcagcccctacggccacctgcccaactggaggctgctgagcgtcatcgtgaagtgtggagatgacctgcggcaggagctgctggccttccaggtgctgaagcagctgcagagcatctgggagcaggagcgggtgcccctgtggatcaagccctacaagatcctggtgatctctgctgacagcggcatgattgagcctgtggtgaatgctgtgtccatccaccaggtgaagaagcagagccagctgagcctgctggactacttcctgcaggagcacggcagctacaccacagaggccttcctgagcgcccagaggaactttgtgcagagctgtgccggctactgcctggtgtgctacctgctgcaggtgaaggacagacacaacggcaacatcctgctggatgctgagggccacatcatccacatcgactttggcttcatcctgagcagcagccccaggaacctgggctttgagaccagcgccttcaagctgaccacagaatttgtggatgtgatgggcggcctggatggagacatgttcaactactacaagatgctgatgctgcagggcctgattgctgccaggaagcacatggacaaggtggtgcagatcgtggagatcatgcagcagggcagccagctgccctgcttccacggcagcagcaccatccggaacctgaaggagcgcttccacatgtccatgacagaggagcagctgcagctgctggtggagcagatggtggatggctccatgaggagcatcaccaccaagctgtatgatggcttccagtacctgaccaacggcatcatgtag

SEQ ID NO: 22154 - DNA, 228 bp, Artificial Sequence
  Description of Artificial Sequence: Synthetic coding sequence
atggccatccccatcaccgtgctggactgtgacctgctgctgtatggccggggccacaggaccctggaccgcttcaagctggatgatgtgacagatgagtacctgatgtccatgtatggcttcccccggcagttcatctactacctggtggagctgctgggcgccaacctgagccggcccacccagaggagccgggccatcagccctgagacccaggtgctggcctag

SEQ ID NO: 22155 - DNA, 2754 bp, Artificial Sequence
  Description of Artificial Sequence: Synthetic coding sequence
atggatggagctgctggccctggagatggccctgcccgggaggccctgcagagcctgagccagaggctgcgggtgcaggagcaggagatggagctggtgaaggccgccctggccgaggccctgcggctgctgcggctgcaggtgccccccagcagcctgcagggcagcggcaccccagcccctcctggggacagcctggccgcccctcctggcctgccccccacctgcacccccagcctggtgtcccggggcacccagacagaaacagaggtggagctgaagagcagccctggccccccaggcctgagcaatggccccccagccccccagggcgccagcgaggagcccagcggcacccagagcgagggcggcggcagcagcagcagtggagctggcagccctggccccccaggcatcctgcggcccctgcagcccccccagagagctgacaccccaagaagaaacagcagcagcagcagcagccccagcgagcggccccggcagaagctgagcaggaaggccatcagcagcgccaacctgctggtgcgcagcggcagcacagagagcagaggaggcaaggaccccctgagcagccctgggggccctggcagcagaagaagcaactacaacctggagggcatctctgtgaagatgttcctgcggggccggcccatcaccatgtacatccccagcggcatccgcagcctggaggagctgcccagcggccccccacctgagaccctgagcctggactgggtgtatggctaccggggccgggacagccgcagcaacctgtttgtgctgcggagcggggaggtggtgtacttcatcgcctgtgtggtggtgctgtacagacctgggggcggccctgggggccctgggggcggcggccagaggcactaccggggccacacagactgtgtgcgctgcctggccgtgcacccagatggagtgcgggtggccagcggccagacagctggggtggacaaggatggcaagcccctgcagcctgtggtgcacatctgggacagcgagaccctgctgaagctgcaggagatcggcctgggcgcctttgagcggggcgtgggcgccctggccttctctgctgctgaccagggcgccttcctgtgtgtggtggatgacagcaatgagcacatgctgtctgtgtgggactgcagccggggcatgaagctggccgagatcaagagcaccaatgattctgtgctggccgtgggcttcaacccccgggacagcagctgcatcgtgaccagcggcaagagccacgtgcacttctggaactggagcggaggagtgggcgtgcctggaaatggcaccctgaccaggaagcagggcgtgtttgggaagtacaagaagcccaagttcatcccctgctttgtgttcctgcctgatggagacatcctgactggagacagcgagggcaacatcctgacctggggccgcagccccagcgacagcaagaccccaggccggggcggggccaaggagacctacggcatcgtggcccaggcccacgcccacgagggcagcatctttgccctgtgcctgcggagagatggcaccgtgctgagcggcggcggccgggaccggcggctggtgcagtggggccctggcctggtggccctgcaggaggccgagatccctgagcactttggagctgtgcgggccatcgccgagggcctgggcagcgagctgctggtgggcaccaccaagaatgccctgctgcggggggacctggcccagggcttcagccctgtgatccagggccacacagatgagctgtggggcctgtgcacccaccccagccagaaccgcttcctgacctgtggccatgaccggcagctgtgcctgtgggatggagagagccacgccctggcctggagcattgacctgaaggagaccggcctgtgtgccgacttccaccccagcggggctgtggtggccgtgggcctgaacacaggccgctggctggtgctggacacagagacccgggagatcgtgtctgatgtgattgatggaaatgagcagctgtctgtggtgcgctacagcccagatggcctgtacctggccatcggcagccatgacaacgtcatctacatctacagcgtgtccagtgatggagccaagagcagcagatttggccgctgcatgggccacagcagcttcatcacccacctggactggagcaaggatggcaacttcatcatgagcaacagcggggactatgagatcctgtactgggatgtggccggcggctgcaagcagctgaagaacagatatgagagccgggaccgggagtgggccacctacacctgtgtgctgggcttccacgtgtatgtgcctgtgcgcagctgccagggcgctgagccccacgtgcggggcccccggcagccccgggaccagaggcccatccacgcccggcggctggccccccggctggccggccggcagggccggcagcacctgcctgtggccagcgctggccgctggggccgcggggccggggcccggcatgccctgagcaaccccctgcctgtgccccggctgctgccccggcggctgattgctgcctggagggaccggctggccaggagaagaggccctgccccaccctgccccagcctggcccagagccccaccacccggggccgcctcttccctggcctgaccagccgccacagccgcagccgcatcttcctggagggcgccaacggggccccagcccacacagtgtag

SEQ ID NO: 22156 - DNA, 321 bp, Artificial Sequence
  Description of Artificial Sequence: Synthetic coding sequence
atggtggccatggccgaggccgaggccggcgtggccgtggaggtgcggggcctgcccccagctgtgcctgatgagctgctgaccctgtactttgagaacagaagaagaagtggcggcggccctgtgctgtcctggcagaggctgggctgcggcggcgtgctgaccttccgggagccagcagatgctgagcgggtgctggcccaggccgaccacgagctgcacggggcccagctgagcctgcggcctgccccaccccgggccccagcccggctgctgctgcagggcctgcccccaggcaccaccccccagaggctggagtag

SEQ ID NO: 22157 - DNA, 228 bp, Artificial Sequence
  Description of Artificial Sequence: Synthetic coding sequence
atgttctggaagtttgacctgcacagcagcagccacatcgacaccctgctggagcgggaggatgtgaccctgaaggagctgatggatgaagaagatgtgctgcaggagtgcaaggcccagaacaggaagctgattgagttcctgctgaaggccgagtgcctggaggacctggtgtccttcatcatcgaggagcccccccaggacatggatgagaagatccgctactag

SEQ ID NO: 22158 - DNA, 1275 bp, Artificial Sequence; identical to SEQ ID NO: 20975
  Description of Artificial Sequence: Synthetic coding sequence

SEQ ID NO: 22159 - DNA, 288 bp, Artificial Sequence
  Description of Artificial Sequence: Synthetic coding sequence
atggaggccgcagatgccagccgcagcaatggcagcagccctgaggccagagatgcccggagccccagcggccccagcggcagcctggagaatggcaccaaggcagatggcaaggatgccaagaccaccaacggccacggcggggaggccgctgagggcaagagcctgggcagcgccctgaagccaggagagggccgcagcgccctgtttgctggaaatgagtggaggcggcccatcatccagtttgtggagagcggagatgacaagaacagcaactacttctcctag

SEQ ID NO: 22160 - DNA, 3144 bp, Artificial Sequence
  Description of Artificial Sequence: Synthetic coding sequence
atggccccccggctgcagctggagaaggccgcctggcgctgggccgagaccgtgcggcctgaggaggtgtcccaggagcacatcgagacagcctaccgcatctggctggagccctgcatccggggcgtgtgcagaagaaactgcaagggcaaccccaactgcctggtgggcatcggggagcacatctggctgggggagattgatgaaaattccttccacaacattgatgaccccaactgtgagaggaggaagaagaacagctttgtgggcctgaccaacctgggcgccacctgctacgtgaacaccttcctgcaggtgtggttcctgaacctggagctgcggcaggccctgtacctgtgccccagcacctgcagcgactacatgctgggagatggcatccaggaggagaaggactatgagccccagaccatctgtgagcacctgcagtacctgtttgccctgctgcagaacagcaacagacgctacatcgaccccagcggctttgtgaaggccctgggcctggacaccggccagcagcaggatgcccaggagttcagcaagctgttcatgagcctgctggaggacaccctgagcaagcagaagaacccagatgtgaggaacatcgtgcagcagcagttctgtggggagtatgcctacgtgacagtgtgcaaccagtgtggccgggagagcaagctgctgagcaagttctatgagctggagctgaacatccagggccacaagcagctgacagactgcatcagcgagttcctgaaggaggagaagctggagggggacaaccgctacttctgtgagaactgccagagcaagcagaatgccaccaggaagatccggctgctgagcctgccctgcaccctgaacctgcagctgatgagatttgtgtttgaccggcagacaggccacaagaagaagctgaacacctacatcggcttcagcgagatcctggacatggagccctacgtggagcacaagggcggcagctatgtgtatgagctgtctgctgtgctgatccaccggggcgtgtctgcctacagcggccactacatcgcccacgtgaaggacccccagagcggggagtggtacaagttcaatgatgaggacatcgagaagatggagggcaagaagctgcagctgggcatcgaggaggacctggagcccagcaagagccagaccaggaagcccaagtgtgggaagggcacccactgcagcagaaatgcctacatgctggtgtaccgcctgcagacccaggagaagcccaacaccaccgtgcaggtgcctgccttcctgcaggagctggtggaccgggacaacagcaagtttgaggagtggtgcatcgagatggccgagatgaggaagcagagcgtggacaagggcaaggccaagcatgaggaggtgaaggagctgtaccagaggctgcctgctggagctgagccctatgaatttgtgtccctggagtggctgcagaagtggctggatgagagcacccccaccaagcccatcgacaaccacgcctgcctgtgcagccatgacaagctgcacccagacaagatcagcatcatgaagaggatcagtgaatatgctgctgacatcttctacagccgctatggaggcggcccccggctgactgtgaaggccctgtgcaaggaatgtgtggtggagcgctgccgcatcctgcggctgaagaaccagctgaatgaagactacaagacagtgaacaacctgctgaaggctgctgtgaagggcagtgatggcttctgggtgggcaagagcagcctgcgctcctggaggcagctggccctggagcagctggatgagcaggatggagatgctgagcagagcaatggcaagatgaatggcagcaccctgaacaaggatgagagcaaggaggagaggaaggaggaggaggagctgaacttcaatgaagacatcctgtgcccccatgctgtgttcttcttcagcaagtacatcttcctgaacagcggggagctgtgcatcagtgaaaatgaaagaaggctggtgtccaaggaggcctggagcaagctgcagcagtacttccccaaggcccctgagttccccagctacaaggagtgctgcagccagtgcaagatcctggagcgggagggggaggagaatgaggccctgcacaagatgattgccaatgagcagaagaccagcctgcccaacctcttccaggacaagaaccggccctgcctgagcaactggccagaggacacagatgtgctgtacatcgtgtcccagttctttgtggaggagtggaggaagtttgtgaggaagcccacccgctgcagccctgtgtcctctgtgggcaacagcgccctgctgtgcccccacggcggcctgatgttcacctttgcctccatgaccaaggaggacagcaagctgattgccctgatctggcccagcgagtggcagatgatccagaagctgtttgtggtggaccacgtgatcaagatcacccgcatcgaggtgggagatgtgaaccccagcgagacccagtacatcagcgagcccaagctgtgcccagaatgtcgggagggcctgctgtgccagcagcagagggacctgcgggagtacacccaggccaccatctacgtgcacaaggtggtggacaacaagaaggtgatgaaggacagcgcccctgagctgaatgtgagcagcagcgagacagaggaggacaaggaggaggccaagccagatggagagaaggaccctgacttcaaccagagcaatggaggcaccaagaggcagaagatcagccaccagaactacatcgcctaccagaagcaggtgatcagaagatccatgaggcacaggaaggtgcggggggagaaggccctgctggtgtctgccaaccagaccctgaaggagctgaagatccagatcatgcacgccttctctgtggccccctttgaccagaacctgagcattgatggcaagatcctgagtgatgactgtgccaccctgggcaccctgggcgtcatccctgagagcgtcatcctgctgaaggcagatgagcccatcgctgactatgctgccatggatgatgtgatgcaggtgtgcatgcctgaggagggcttcaagggcaccggcctgctgggccactag

SEQ ID NO: 22161 - DNA, 1443 bp, Artificial Sequence; identical to SEQ ID NO: 21609
  Description of Artificial Sequence: Synthetic coding sequence

SEQ ID NO: 22162 - DNA, 2376 bp, Artificial Sequence
  Description of Artificial Sequence: Synthetic coding sequence
atgttctggaagtttgacctgcacagcagcagccacatcgacaccctgctggagcgggaggatgtgaccctgaaggagctgatggatgaagaagatgtgctgcaggagtgcaaggcccagaacaggaagctgattgagttcctgctgaaggccgagtgcctggaggacctggtgtccttcatcatcgaggagcccccccaggacatggatgagaagatccgctacaagtaccccaacatcagctgtgagctgctgaccagtgatgtgtcccagatgaatgaccggctgggggaggatgagagcctgctgatgaagctgtacagcttcctgctgaatgacagccccctgaaccccctgctggccagcttcttcagcaaggtgctgagcatcctgatcagcaggaagccagagcagatcgtggacttcctgaagaagaagcatgactttgtggacctgatcatcaagcacatcggcaccagcgccatcatggacctgctgctgcggctgctgacctgcatcgagcccccccagccccggcaggatgtgctgaactggctgaatgaggagaagatcatccagaggctggtggagatcgtgcaccccagccaggaggaggacagacacagcaatgccagccagagcctgtgtgagatcgtgcggctgagccgggaccagatgctgcagatccagaacagcacagagccagaccccctgctggccaccctggagaagcaggagatcatcgagcagctgctgagcaacatcttccacaaggagaagaatgaaagtgccatcgtgtctgccatccagatcctgctgaccctgctggagacccggcggcccacctttgagggccacatcgagatctgccccccaggcatgagccacagcgcctgcagcgtgaacaagtctgtgctggaggccatccggggccgcctgggcagcttccacgagctgctgctggagccccccaagaacatgttcttcaagtacacctggaacaacttcctgcacacccaggtggagatctgcatcgccctgatcctggccagcccctttgagaacacagaaaatgccaccatcacagaccaggacagcactggagacaacctgctgctgaagcacctgttccagaagtgccagctgattgagcgcatcctggaggcctgggagatgaatgagaagaagcaggccgagggcggccgccgccacggctacatgggccacctgaccagaattgccaactgcatcgtgcacagcacagacaagggccccaacagcgccctggtgcagcagctgatcaaggacctgcctgatgaggtgcgggagcgctgggagaccttctgcaccagcagcctgggggagaccaacaagaggaacacagtggacctggccttcagtgactaccagatgcagcagatgaccagcaacttcatcgaccagtttggcttcaatgatgagaagtttgctgaccaggatgacattggaaatgtgtcctttgacagagtgtctgacatcaacttcaccctgaacaccaatgaaagtggcaacatcgccctgtttgaggcctgctgcaaggagcgcatccagcagtttgatgatggcggcagtgatgaggaggacatctgggaggagaagcacatcgccttcaccccagagagccagaggaggagcagcagcggcagcacagattctgaggagagcacagattctgaggaggaggatggagccaagcaggacctgtttgagcccagcagcgccaacacagaggacaagatggaggtggacctgtctgagccccccaactggagcgccaactttgatgtgcccatggagaccacccatggagcccccctggacagcgtgggcagtgatgtgtggagcacagaggagcccatgcccaccaaggagaccggctgggccagcttcagcgagttcaccagcagcctgagcaccaaggacagcctgcggagcaacagccctgtggagatggagaccagcacagagcccatggaccccctgaccccatctgctgctgccctggccgtgcagcctgaggccgccggctctgtggccatggaggccagcagtgatggagaagaagatgctgagagcacagacaaggtgacagagaccgtgatgaatggaggcatgaaggagaccctgagcctgactgtggatgccaagacagaaacagctgtgttcaagtctgaggagggcaagctgagcaccagccaggatgctgcctgcaaggatgctgaagaatgtcctgagacagctgaggccaagtgtgccgcccccaggcctcccagcagcagccctgagcagagcggcgtggagatcccagccctgcccggccagtggagccagcagtag

SEQ ID NO: 22163 - DNA, 1500 bp, Artificial Sequence
  Description of Artificial Sequence: Synthetic coding sequence
atgtttggagatgccagcaccagcctggtggtgcctgagaaggtgaagacccccatgaagagcagcaagacagacctgcagggcagcgccagccccagcaaggtggagggcgtgcacaccccccggcagaagaggagcacccccctgaaggagcggcagctgagcaagcccctgtctgagaggaccaacagcagtgacagcgagaggagcccagacctgggccacagcacccagatccccaggaaggtggtgtatgaccagctgaaccagatcctggtgtctgatgctgccctgcctgaaaatgtcatcctggtgaacaccacagactggcagggccagtatgtggccgagctgctgcaggaccagaggaagcctgtggtgtgcacctgcagcacagtggaggtgcaggccgtgctgagcgccctgctgacccgcatccagcgctactgcaactgcaacagctccatgcccaggcctgtgaaggtggccgctgtgggcggccagagctacctgagcagcatcctgcgcttctttgtgaagagcctggccaacaagaccagtgactggctgggctacatgaggttcctgatcatccccctgggcagccaccctgtggccaagtacctgggctctgtggacagcaagtacagcagcagcttcctggacagcggctggagggacctcttcagccgctctgagccccctgtgtctgagcagctggatgtggccggccgggtgatgcagtatgtgaatggagctgccaccacccaccagctgcctgtggccgaggccatgctgacctgccgccacaagttcccagatgaagattcctaccagaagttcatccccttcatcggcgtggtgaaggtgggcctggtggaggacagccccagcacagctggagatggagatgacagccctgtggtgtccctgactgtgcccagcaccagcccccccagcagcagcggcctgagcagagatgccacagccaccccacccagcagccccagcatgagcagcgccctggccatcgtgggcagccccaacagcccctatggagatgtgattggcctgcaggtggactactggctgggccaccctggagagaggagaagagaaggagacaagagagatgccagcagcaagaacaccctgaagtctgtgttccgctctgtgcaggtgtcccggctgccccacagcggggaggcccagctgagcggcaccatggccatgacagtggtgaccaaggagaagaacaagaaggtgcccaccatcttcctgagcaagaagccccgggagaaggaggtggacagcaagagccaggtgattgagggcatcagccgcctcatctgcagcgccaagcagcagcagaccatgctgcgggtgtccattgatggagtggagtggagcgacatcaagttcttccagctggccgcccagtggcccacccacgtgaagcacttccctgtgggcctcttcagcggcagcaaggccacctag

SEQ ID NO: 22164 - DNA, 435 bp, Artificial Sequence
  Description of Artificial Sequence: Synthetic coding sequence
atggtggccatggccgaggccgaggccggcgtggccgtggaggtgcggggcctgcccccagctgtgcctgatgagctgctgaccctgtactttgagaacagaagaagaagtggcggcggccctgtgctgtcctggcagaggctgggctgcggcggcgtgctgaccttccgggagccagcagatgctgagcgggtgctggcccaggccgaccacgagctgcacggggcccagctgagcctgcggcctgccccaccccgggccccagcccggctgctgctgcagggcctgcccccaggcaccaccccccagaggctggagcagcacgtgcaggccctgctgcgggccagcggcctgcctgtgcagccctgctgtgccctggccagccccaggccagaccgggccctggtgcagctgcccaagcccctgtctgagtag

SEQ ID NO: 22165 - DNA, 513 bp, Artificial Sequence; identical to SEQ ID NO: 18990
  Description of Artificial Sequence: Synthetic coding sequence

SEQ ID NO: 22166 - DNA, 270 bp, Artificial Sequence
  Description of Artificial Sequence: Synthetic coding sequence
atggtggccatggccgaggccgaggccggcgtggccgtggaggtgcggggcctgcccccagctgtgcctgatgagctgctgaccctgtactttgagaacagaagaagaagtggcggcggccctgtgctgtcctggcagaggctgggctgcggcggcgtgctgaccttccgggagccagcagatgctgagcgggtgctggcccaggccgaccacgagctgcacggggcccagctgagcctgcggcctgccccaccccgggccccagcctag

SEQ ID NO: 22167 - DNA, 1206 bp, Artificial Sequence
  Description of Artificial Sequence: Synthetic coding sequence
atgtgtgtggagatcagcctgaagaccagcgagggggacagcatggagctggagatctggtgcctggagatgaatgaaaaatgtgacaaggagatcaaggtgtcctacacagtgtacaaccggctgagcctgctgctgaagagcctgctggccatcaccagggtgaccccagcctaccgcctgagcaggaagcagggccatgaatatgtgatcctgtaccgcatctactttggagaggtgcagctgagcggcctgggggagggcttccagacagtgcgggtgggcaccgtgggcacccctgtgggcaccatcaccctgagctgtgcctaccgcatcaacctggccttcatgagcacccggcagtttgagaggaccccacccatcatgggcatcatcatcgaccactttgtggaccggccctaccccagcagcagccccatgcacccctgcaactacagaacagctggagaagatactggagtcatctaccccagcgtggaggacagccaggaggtgtgcaccaccagcttcagcaccagcccccccagccagctgatggtgcctgggaaggagggcggcgtgcccctggcccccaaccagcctgtgcacggcacccaggccgaccaggagcggctggccacctgcacccccagcgacaggacccactgtgccgccacccccagcagcagcgaggacacagaaacagtgagcaacagcagcgagggccgggccagcccccatgatgtgctggagaccatctttgtgaggaaggtgggcgcctttgtgaacaagcccatcaaccaggtgaccctgaccagcctggacatcccctttgccatgtttgcccccaagaacctggagctggaggacacagaccccatggtgaaccccccagacagccctgagacagagagccccctgcagggcagcctgcacagtgatggcagcagcggcggcagcagcggcaacacccatgatgactttgtgatgattgacttcaagccagccttcagcaaggatgacatcctgcccatggacctgggcaccttctaccgggagttccagaaccccccccagctgagcagcctgagcattgatattggagcccagagcatggccgaggacctggacagcctgcctgagaagctggccgtgcatgagaagaatgtgcgggagtttgatgcctttgtggagaccctgcagtag

SEQ ID NO: 22168 - DNA, 2148 bp, Artificial Sequence; identical to SEQ ID NO: 18953
  Description of Artificial Sequence: Synthetic coding sequence

SEQ ID NO: 22169 - DNA, 336 bp, Artificial Sequence
  Description of Artificial Sequence: Synthetic coding sequence
atgacaggcagcaacagccacatcaccatcctgaccctgaaggtgctgccccactttgagagcctgggcaagcaggagaagatccccaacaagatgtctgccttcaggaaccactgcccccacctggacagcgtgggggagatcaccaaggaggacctgatccagaagagcctgggcacctgccaggactgcaaggtgcagggccccaacctgtgggcctgcctggagaaccgctgcagctatgtgggctgtggggagagccaggtggaccacagcaccatccacagccaggagaccaagcactacctgactgtgaacctgaccaccctgaggtag

SEQ ID NO: 22170 - DNA, 228 bp, Artificial Sequence
  Description of Artificial Sequence: Synthetic coding sequence
atggccggccaggaggaccctgtgcagcgggagatccaccaggactgggccaaccgggagtacatcgagatcatcaccagcagcatcaagaagattgctgacttcctgaacagctttgacatgagctgccgcagccggctggccaccctgaatgagaagctgacagccctggagaggagaattgagtacatcgaggcccgggtgaccaagggggagaccctgacctag

SEQ ID NO: 22171 - DNA, 348 bp, Artificial Sequence; identical to SEQ ID NO: 18978
  Description of Artificial Sequence: Synthetic coding sequence

SEQ ID NO: 22172 - DNA, 1077 bp, Artificial Sequence; identical to SEQ ID NO: 20583
  Description of Artificial Sequence: Synthetic coding sequence

SEQ ID NO: 22173 - DNA, 4047 bp, Artificial Sequence
  Description of Artificial Sequence: Synthetic coding sequence
atggctgacacagacctcttcatggagtgtgaggaggaggagctggagccctggcagaagatcagtgatgtgattgaggacagcgtggtggaggactacaacagcgtggacaagaccaccacagctggcaaccccctggtgcagcagggcggccagcccctcatcctgacccagaacccagcccctggcctgggcaccatggtgacccagcctgtgctgcggcctgtgcaggtgatgcagaatgccaaccacgtgaccagcagccctgtggccagccagcccatcttcatcaccacccagggcttccctgtgagaaatgtgcggcctgtgcagaatgccatgaaccaggtgggcatcgtgctgaatgtgcagcagggccagacagtgcggcccatcaccctggtgcctgcccctggcacccagtttgtgaagcccaccgtgggcgtgccccaggtgttcagccagatgacccctgtgcggcccggcagcaccatgcctgtgcggcccaccaccaacaccttcaccaccgtcatcccagccaccctgaccatccgcagcacagtgccccagagccagagccagcagaccaagagcacccccagcaccagcaccacccccacagccacccagcccaccagcctgggccagctggccgtgcagagccctggccagagcaaccagaccaccaaccccaagctggtgtccatcgccagctttgtgacagtgaagaggcctggggtgactggagagaacagcaatgaggtggccaagctggtgaacaccctgaacaccatccccagcctgggccagagccctggccctgtggtggtgagcaacaacagcagcgcccacggcagccagaggaccagcggccctgagagctccatgaaggtgaccagcagcatccctgtgtttgacctgcaggacggcggcaggaagatctgcccccgctgcaatgcccagttccgggtgacagaggccctgcggggccacatgtgctactgctgcccagagatggtggagtaccagaagaagggcaagagcctggacagcgagcccagcgtgcccagcgctgccaagccacccagccctgagaagacagcccctgtggccagcacccccagcagcacccccatcccagccctgagcccccccaccaaggtgcctgagcccaatgaaaatgtgggagatgctgtgcagaccaagctgatcatgctggtggatgacttctactacggcagagatggcggcaaggtggcccagctgaccaacttccccaaggtggccaccagcttccgctgcccccactgcaccaagaggctgaagaacaacatccgcttcatgaaccacatgaagcaccacgtggagctggaccagcagaatggagaggtggatggccacaccatctgccagcactgctaccggcagttcagcacccccttccagctgcagtgccacctggagaatgtgcacagcccctatgagagcaccaccaagtgcaagatctgtgagtgggcctttgaaagtgagcccctcttcctgcagcacatgaaggacacccacaagccaggagagatgccctacgtgtgccaggtgtgccagtaccgcagcagcctgtacagcgaggtggatgtgcacttcaggatgattcatgaggacaccaggcacctgctgtgcccctactgcctgaaggtgttcaagaatggaaatgccttccagcagcactacatgaggcaccagaagagaaatgtgtaccactgcaacaagtgccgcctgcagttcctgtttgccaaggacaagattgagcacaagctgcagcaccacaagaccttcaggaagcccaagcagctggagggcctgaagccaggcaccaaggtgaccatccgggccagccggggccagcccaggacagtgcctgtgagcagcaatgacaccccacccagcgccctgcaggaggccgcccccctgaccagctccatggaccccctgcccgtcttcctgtacccacctgtgcagaggagcatccagaagagagctgtgaggaagatgtctgtgatgggccggcagacctgcctggagtgcagctttgagatcccagacttccccaaccacttccccacctacgtgcactgcagcctgtgccgctacagcacctgctgcagccgggcctatgccaaccacatgatcaacaaccacgtgcccaggaagagccccaagtacctggccctcttcaagaacagcgtgtctggcatcaagctggcctgcaccagctgcacctttgtgacctctgtgggagatgccatggccaagcacctggtgttcaaccccagccacaggagcagcagcatcctgccccggggcctgacctggatcgcccacagccgccacggccagacccgggacagagtgcatgacagaaatgtgaagaacatgtaccccccacccagcttccccaccaacaaggccgccaccgtgaagtctgctggggccaccccagctgagcctgaggagctgctgacccccctggccccagccctgcccagccctgccagcacagccaccccaccacccacccccacccacccccaggccctggccctgccccccctggccacagagggcgctgagtgcctgaatgtggatgaccaggatgagggcagccctgtgacccaggagcctgagctggccagcggcggcggcggcagcggcggcgtgggcaagaaggagcagctgtctgtgaagaagctgcgggtggtgctgtttgccctgtgctgcaacacagagcaggccgctgagcacttcaggaacccccagaggcgcatccgccgctggctgcggcgcttccaggccagccagggcgagaacctggagggcaagtacctgagctttgaagctgaggagaagctggccgagtgggtgctgacccagcgggagcagcagctgcctgtgaatgaggagaccctcttccagaaggccaccaagattggccgcagcctggagggcggcttcaagatctcctatgagtgggccgtgcgcttcatgctgcggcaccacctgaccccccacgcccggcgggctgtggcccacaccctgcccaaggatgtggctgaaaatgccggcctcttcatcgactttgtgcagaggcagatccacaaccaggacctgcccctgtccatgattgtggccattgatgagatcagcctcttcctggacacagaggtgctgagcagtgatgacagaaaagaaaatgccctgcagacagtgggcaccggggagccctggtgtgatgtggtgctggccatcctggctgatggcaccgtgctgcccaccctggtgttctaccggggccagatggaccagcctgccaacatgccagacagcatcctgctggaggccaaggagagcggctacagtgatgatgagatcatggagctgtggagcaccagggtgtggcagaagcacacagcctgccagaggagcaagggcatgctggtgatggactgccacaggacccacctgtctgaggaggtgctggccatgctgagcgccagcagcaccctgcctgctgtggtgcctgctggctgcagcagcaagatccagcccctggatgtgtgcatcaagaggacagtgaagaacttcctgcacaagaagtggaaggagcaggcccgggagatggctgacacagcctgtgacagtgatgtgctgctgcagctggtgctggtgtggctgggggaggtgctgggcgtcatcggggactgcccagagctggtgcagaggagcttcctggtggcctctgtgctgcccggcccagatggcaacatcaacagccccaccagaaatgctgacatgcaggaggagctgattgccagcctggaggagcagctgaagctgagcggggagcacagcgagagcagcaccccccggcccaggagcagccctgaggagaccatcgagcctgagagcctgcaccagctgtttgaaggagagagcgagacagagagcttctacggctttgaggaggccgacctggacctgatggagatctag

SEQ ID NO: 22174 - DNA, 561 bp, Artificial Sequence
  Description of Artificial Sequence: Synthetic coding sequence
atgttctggaagtttgacctgcacagcagcagccacatcgacaccctgctggagcgggaggatgtgaccctgaaggagctgatggatgaagaagatgtgctgcaggagtgcaaggcccagaacaggaagctgattgagttcctgctgaaggccgagtgcctggaggacctggtgtccttcatcatcgaggagcccccccaggacatggatgagaagatccgctacaagtaccccaacatcagctgtgagctgctgaccagtgatgtgtcccagatgaatgaccggctgggggaggatgagagcctgctgatgaagctgtacagcttcctgctgaatgacagccccctgaaccccctgctggccagcttcttcagcaaggtgctgagcatcctgatcagcaggaagccagagcagatcgtggacttcctgaagaagaagcatgactttgtggacctgatcatcaagcacatcggcaccagcgccatcatggacctgctgctgcggctgctgacctgcatcgagcccccccagccccggcaggatgtgctgaactggctgtag

SEQ ID NO: 22175 - DNA, 288 bp, Artificial Sequence
  Description of Artificial Sequence: Synthetic coding sequence
atgagccagagcggggctgtgtcctgctgccctggggccaccaacggcagcctgggccgcagtgatggagtggccaagatgagccccaaggacctgtttgagcagaggaagaagtacagcaacagcaatgtcatcatgcatgagaccagccagtaccacgtgcagcacctggccaccttcatcatggacaagtctgaggccatcacctctgtggatgatgccatcaggaagctggtgcagctgagcagcaaggagaagatctggacccaggagatgctgctgcagtag

SEQ ID NO: 22176 - DNA, 1740 bp, Artificial Sequence
  Description of Artificial Sequence: Synthetic coding sequence
atggatgacagcaagcaggagagcaccaccagcaaggaggaggagaccaacatcatcagcagcatcgtgcccagcacccaggacatctaccagaggcagaacagcagtgatgtgcacaagagcctgctgcctgctgtggatgagaccacctgtggccacacccacttccagcagatgattgacaagtacatcaatgaggccaacctgatccctgagaagacagacctgcaggagctggagcacatcttccccaacctgcaccaccagctgttcaagcccctggagccccacccagactttgacctgagcagcagcagcagcggcatcagcccagacaacagagacttctaccagaggagtgacagcagcagcgagagccactgtgccaccggcctgagcaagagcacagtgtacttcaccgccctgcggaggacctccatgcacagcagcctgaacaccagccccaaccagcagcctgacaccaacctggcccacgtgggcgcccacagctttgccacagagaacatcattggaggcagcgagcagtgctttgagcagctgcagcctgagtacagcagccaggaggagagccagcacgccgacctgcccagcatcttcagcattgaggcccgggacagcagccagggcatgaagaaccagaactaccccagcgaggagcacacagagatcctgcagaacaagaagaagatcgtgcacttccagctgagcatcggcaacctgagctctgtgtacagcagcagtgatgaggccaacgtgtttgaccagctgaatgtgcagcacagcaccccctgtggcagcaacagcagtgaatgttccaccaagcaccagctggagagcaggaaggagagcatgggctttgaggagctgagcaagaggggcgtggtgaccatgctgcagagccagggcctgattgaggacaacaagaatgagacctgccgggtgctggacatcaacccccaggtggaggagacagacagccggctgtgtgtgaggacagtggagatgggcaccagcatccaggccccctacagcctgaccacccagaatgagaagtactttgaaaattctgctgagacagacatccccaagatcaccaagaagctgagccagctgggggagagcgagctgtttgccagcagcggcagcttcagcctgcagagcagcatccctgtgtgggagacagaaacaggccacggcatcatggaggagcctgagctgaccctcatcagcaccacagacaccagcattgctgagatggactttgccaacctgaccctggaggagaagtcagaaaatgaggccaagtgcttcttccaggtgtctgagttcctgcccctggtgtctgccacagaggccagtgactacccagctgtgtctgagctgagcattgagaagcccaggacagccagcacagctgagaccccccggcggctgacccctgtgcccggcagcctgcaggaggccttcatcaagaggaagaagagcttcatggagaggagccaccagaggcagaaggagatccggaacaagatccacgtgtctgagaacagccagatcaagacagtgaaggagaagcccagcatcagcagctctgtgtcccggctgaagggcgtgaacaaggtgcgggccagcttccctgaggacaggaagaccacccaggccctgcggcaccagaggggcctgcggctgtacaaccagctggccgaggtgaagcagtag

SEQ ID NO: 22177 - DNA, 435 bp, Artificial Sequence; identical to SEQ ID NO: 22164
  Description of Artificial Sequence: Synthetic coding sequence

SEQ ID NO: 22178 - DNA, 246 bp, Artificial Sequence
  Description of Artificial Sequence: Synthetic coding sequence
atggtggccatggccgaggccgaggccggcgtggccgtggaggtgcggggcctgcccccagctgtgcctgatgagctgctgaccctgtactttgagaacagaagaagaagtggcggcggccctgtgctgtcctggcagaggctgggctgcggcggcgtgctgaccttccgggagccagcagatgctgagcgggtgctggcccaggccgaccacgagctgcacggggcccagctgagcctgaggtag

SEQ ID NO: 22179 - DNA, 1539 bp, Artificial Sequence
  Description of Artificial Sequence: Synthetic coding sequence
atggccgccttcaagctggacttcctgcctgagatgatggtggaccactgcagcctgaacagcagccctgtgtccaagaagatgaatggcaccctggaccacccagaccagcctgacctggatgccatcaagatgtttgtgggccaggtgcccaggacctggagcgagaaggacctgcgggagctgtttgagcagtacggggctgtgtatgagatcaacgtgctgcgggacaggagccagaaccccccccagagcaagggctgctgctttgtgaccttctacaccaggaaggccgccctggaggcccagaatgccctgcacaacatgaaggtgctgcccggcatgcaccaccccatccagatgaagccagctgacagcgagaagaacaacgtggaggacaggaagctgttcatcggcatgatcagcaagaagtgcacagaaaatgacatccgggtgatgttcagcagctttggccagatcgaggagtgccgcatcctgcggggcccagatggcctgagccggggctgtgcctttgtgaccttcaccacccgggccatggcccagacagccatcaaggccatgcaccaggcccagaccatggagggctgcagcagccccatggtggtgaagtttgctgacacccagaaggacaaggagcagaagaggatggcccagcagctgcagcagcagatgcagcagatctctgctgcctctgtgtggggcaacctggccggcctgaacaccctgggcccccagtacctggccctgtacctgcagctgctgcagcagacagccagcagcggcaacctgaacaccctgagcagcctgcaccccatgggcggcctgaatgccatgcagctgcagaacctggccgccctggccgccgccgccagcgctgcccagaacaccccatctggcaccaatgccctgaccaccagcagcagccccctgtctgtgctgaccagcagcggcagcagccccagcagcagcagcagcaacagcgtgaaccccatcgccagcctgggcgccctgcagaccctggccggggccacagctggcctgaatgtgggcagcctggccggcatggccgccctgaatggaggcctgggcagcagcggcctgagcaatggcaccggcagcaccatggaggccctgacccaggcctacagcggcatccagcagtatgctgctgctgccctgcccaccctgtacaaccagaacctgctgacccagcagagcatcggggctgctggcagccagaaggagggccctgagggcgccaacctcttcatctaccacctgccccaggagtttggagaccaggacctgctgcagatgttcatgccctttggaaatgtggtgtctgccaaggtgttcatcgacaagcagaccaacctgagcaagtgcttcggctttgtgtcctatgacaaccctgtgtctgcccaggccgccatccagagcatgaatggcttccagatcggcatgaagaggctgaaggtgcagctgaagaggagcaagaatgacagcaagccctactag

SEQ ID NO: 22180 - DNA, 1131 bp, Artificial Sequence
  Description of Artificial Sequence: Synthetic coding sequence
atgaaggatgtgcccggcttcctgcagcagagccagaacagcggccctggccagcctgctgtgtggcaccggctggaggagctgtacaccaagaagctgtggcaccagctgaccctgcaggtgctggactttgtgcaggacccctgctttgcccagggagatggcctcatcaagctgtatgagaacttcatcagcgagtttgagcaccgggtgaaccccctgagcctggtggagatcatcctgcacgtggtgcggcagatgacagaccccaacgtggccctgaccttcctggagaagacccgggagaaggtgaagagcagtgatgaggccgtcatcctgtgcaagacagccatcggggccctgaagctgaacattggagacctgcaggtgaccaaggagaccattgaagatgtggaggagatgctgaacaacctgcccggggtgacctctgtgcacagccgcttctatgacctgagcagcaagtactaccagaccatcggcaaccacgccagctactacaaggatgccctgcgcttcctgggctgtgtggacatcaaggacctgcctgtgtctgagcagcaggagcgggccttcaccctgggcctggccggcctgctgggggagggcgtcttcaactttggagagctgctgatgcaccctgtgctggagagcctgaggaacacagaccggcagtggctgattgacaccctgtatgccttcaacagcggaaatgtggagcgcttccagaccctgaagacagcctggggccagcagcctgacctggccgccaatgaggcccagctgctgaggaagatccagctgctgtgcctgatggagatgaccttcaccaggcctgccaaccaccggcagctgacctttgaggagatcgccaagagcgccaagatcaccgtgaatgaggtggagctgctggtgatgaaggccctgtctgtgggcctggtgaagggcagcattgatgaggtggacaagagggtgcacatgacctgggtgcagccccgggtgctggacctgcagcagatcaagggcatgaaggaccggctggagttctggtgcacagatgtgaagtccatggagatgctggtggagcaccaggcccatgacatcctgacctag

SEQ ID NO: 22181 - DNA, 489 bp, Artificial Sequence
  Description of Artificial Sequence: Synthetic coding sequence
atgaccagcaagaagctggtgaacagcgtggccggctgtgctgatgatgccctggccggcctggtggcctgcaaccccaacctgcagctgctgcagggccaccgggtggccctgcggagtgacctggacagcctgaagggccgggtggccctgctgagcggcggcggcagcggccacgagcccgcccacgccggcttcatcggcaagggcatgctgactggagtgattgctggagctgtgttcaccagccctgctgtgggcagcatcctggccgccatccgggctgtggcccaggccggcaccgtgggcaccctgctgattgtgaagaactacaccggggaccggctgaactttggcctggcccgggagcaggcccgggcagagggcatccctgtggagatggtggtgattggagatgattctgccttcaccgtgctgaagaaggccggcagaagaggcctgtgtggcaccgtgctgatccacaagtag

SEQ ID NO: 22182 - DNA, 7854 bp, Artificial Sequence
  Description of Artificial Sequence: Synthetic coding sequence
atgctgacagattctgggggcggcggcaccagctttgaggaggacctggacagcgtggcccccaggtctgccccagctggggccagcgagcccccacctcctgggggcgtgggcctgggcatcagaacagtgcggctgtttggagaggccggccctgccagcggcgtgggcagcagcggcggcggcggcagcggcagcggcaccggcggcggagatgctgccctggacttcaagctggccgctgctgtgctgaggactggaggcggcggcggggccagcggcagtgatgaagatgaggtgtctgaggtggagagcttcatcctggaccaggaggacctggacaaccctgtgctgaagaccaccagcgagatcttcctgagcagcacagctgagggcgctgacctgaggacagtggaccctgagacccaggcccggctggaggccctgctggaggccgccggcatcggcaagctgagcacagcagatggcaaggcctttgctgaccctgaggtgctgcggcggctgaccagctctgtgtcctgtgccctggatgaggccgccgccgccctgaccaggatgaaggccgagaacagccacaatgccggccaggtggacaccaggagcctggccgaggcctgcagtgatggagatgtgaatgctgtgaggaagctgctggatgagggccgctctgtgaatgagcacacagaggagggggagagcctgctgtgcctggcctgcagcgctggctactatgagctggcccaggtgctgctggccatgcacgccaacgtggaggaccggggcaacaagggggacatcacccccctgatggccgccagcagcggcggctacctggacatcgtgaagctgctgctgctgcatgatgctgatgtgaacagccagagcgccaccggcaacacagccctgacctacgcctgtgccggcggctttgtggacatcgtgaaggtgctgctgaatgaaggagccaacatcgaggaccacaatgaaaatggccacacccccctgatggaggccgccagcgctggccacgtggaggtggcccgggtgctgctggaccacggggccggcatcaacacccacagcaatgagttcaaggagagcgccctgaccctggcctgctacaagggccacctggacatggtgcgcttcctgctggaggccggggctgaccaggagcacaagacagatgagatgcacacagccctgatggaggcctgcatggatggccacgtggaggtggcccggctgctgctggacagcggggcccaggtgaacatgcctgctgacagctttgagagccccctgaccctggccgcctgtggcggccacgtggagctggccgccctgctgattgaaagaggagccaacctggaggaggtgaatgatgagggctacacccccctgatggaggccgcccgggagggccacgaggagatggtggccctgctgctggcccagggcgccaacatcaatgcccagacagaggagacccaggagacagccctgaccctggcctgctgcggcggcttcagcgaggtggccgacttcctgatcaaggccggggctgacatcgagctgggctgcagcacccccctgatggaggccagccaggagggccacctggagctggtgaagtacctgctggccagcggggccaacgtgcacgccaccacagccactggagacacagccctgacctacgcctgtgaaaatggccacacagatgtggctgatgtgctgctgcaggccggggctgacctggagcacgagagcgagggcggccgcacccccctgatgaaggccgcccgggccggccacctgtgcaccgtgcagttcctgatcagcaaaggagccaacgtgaacagagccacagccaacaatgaccacacagtggtgtccctggcctgtgccggcggccacctggccgtggtggagctgctgctggcccatggagctgaccccacccaccggctgaaggatggcagcaccatgctgattgaagctgccaagggcggccacaccaacgtggtgtcctacctgctggactaccccaacaacgtgctgtctgtgcccaccacagatgtgtcccagctgcccccacccagccaggaccagagccaggtgccccgggtgcccacccacaccctggccatggtggtgcccccccaggagccagacaggaccagccaggagaacagccctgccctgctgggcgtgcagaagggcaccagcaagcagaagagcagcagcctgcaggtggccgaccaggacctgctgcccagcttccacccctaccagcccctggagtgcatcgtggaggagacagagggcaagctgaatgagctgggccagaggatcagcgccatcgagaaggcccagctgaagagcctggagctgatccagggcgagcccctgaacaaggacaagattgaggagctgaagaagaaccgggaggagcaggtgcagaagaagaagaagatcctgaaggagctgcagaaggtggagcggcagctgcagatgaagacccagcagcagttcaccaaggagtacctggagaccaagggccagaaggacacagtgtccctgcaccagcagtgcagccacagaggagtcttccctgagggggagggagatggcagcctgcctgaggaccacttcagcgagctgccccaggtggacaccatcctcttcaaggacaatgatgtggatgatgagcagcagagcccccccagcgctgagcagattgactttgtgcctgtgcagcccctgagcagcccccagtgcaacttcagcagtgacctgggcagcaatggcaccaacagcctggagctgcagaaggtgtctggcaaccagcagatcgtgggccagccccagatcgccatcactggacatgaccagggcctgctggtgcaggagccagatggcctgatggtggccaccccagcccagaccctgacagacaccctggatgacctgattgctgctgtgtccaccagggtgcccaccggcagcaacagcagcagccagaccacagaatgtctgaccccagagagctgcagccagaccaccagcaatgtggccagccagagcatgcctcctgtgtaccccagcgtggacattgatgcccacacagagagcaaccacgacacagccctgaccctggcctgtgccggcggccacgaggagctggtgtctgtgctgattgccagagatgccaagattgagcaccgggacaagaagggcttcacccccctcatcctggccgccacagctggccacgtgggcgtggtggagatcctgctggacaagggcggggacatcgaggcccagagcgagaggaccaaggacacccccctgagcctggcctgcagcggcggccggcaggaggtggtggacctgctgctggcccggggggccaacaaggagcacagaaatgtgtctgactacacccccctgagcctggccgccagcggcggctacgtgaacatcatcaagatcctgctgaatgctggagctgagatcaacagcaggacaggcagcaagctgggcatcagccccctgatgctggccgccatgaatggccacgtgcctgctgtgaagctgctgctggacatgggcagtgacatcaatgcccagatcgagaccaacagaaacacagccctgaccctggcctgcttccagggccgggcagaggtggtgtccctgctgctggacaggaaggccaacgtggagcaccgggccaagacaggcctgacccccctgatggaggccgccagcggcggctacgccgaggtgggccgggtgctgctggacaagggagcagatgtgaatgcccctcctgtgcccagcagccgggacacagccctgaccatcgctgctgacaagggccactacaagttctgtgagctgctgatccacagaggagcccacattgatgtgaggaacaagaagggcaacacccccctgtggctggccagcaatggaggccactttgatgtggtgcagctgctggtgcaggccggggctgatgtggatgctgctgacaacaggaagatcacccccctgatgtctgccttcaggaagggccacgtgaaggtggtgcagtacctggtgaaggaggtgaaccagttccccagcgacatcgagtgcatgagatacatcgccaccatcacagacaaggagctgctgaagaagtgccaccagtgtgtggagaccatcgtgaaggccaaggaccagcaggccgctgaggccaacaagaatgccagcatcctgctgaaggagctggacctggagaagagccgggaggagagcaggaagcaggccctggccgccaagcgggagaagaggaaggagaagaggaagaagaagaaggaggagcagaagaggaagcaggaggaggatgaggagaacaagcccaaggaaaattctgagctgcctgaagatgaagatgaggaggagaatgatgaagatgtggagcaggaggtgcccatcgagccccccagcgccaccaccaccaccaccatcggcatcagcgccaccagcgccaccttcaccaacgtgtttgggaagaagagggccaacgtggtgaccacccccagcaccaacaggaagaacaagaagaacaagaccaaggagaccccacccacagcccacctgatcctgcctgagcagcacatgagcctggcccagcagaaggctgacaagaacaagatcaatggagagccccggggcggcggggccggcggcaacagcgacagcgacaacctggacagcacagactgcaacagcgagagcagcagcggcggcaagagccaggagctgaactttgtgatggatgtgaacagcagcaagtaccccagcctgctgctgcacagccaggaggagaagaccagcacagccaccagcaagacccagacccggctggagggggaggtgacccccaacagcctgagcaccagctacaagacagtgtccctgcccctgagcagccccaacatcaagctgaacctgaccagccccaagaggggccagaagcgggaggagggctggaaggaggtggtgagaagaagcaagaagctgtctgtgcctgcctctgtggtgagccgcatcatgggccggggcggctgcaacatcacagccatccaggatgtgactggagcccacattgatgtggacaagcagaaggacaagaatggagagaggatgatcaccatccggggcggcacagagagcaccaggtatgctgtgcagctgatcaatgccctgatccaggaccctgccaaggagctggaggacctgatccccaagaaccacatccgcaccccagccagcaccaagagcatccacgccaacttcagcagcggcgtgggcaccacagctgccagcagcaagaatgccttccccctgggcgcccccaccctggtgaccagccaggccaccaccctgagcaccttccagcctgccaacaagctgaacaagaatgtgcccaccaacgtgcgcagcagcttccctgtgtccctgcccctggcctacccccacccccactttgccctgctggccgcccagaccatgcagcagatccgccacccccggctgcccatggcccagtttggaggcaccttcagccccagccccaacacctggggccccttccctgtgcggcctgtgaaccctggcaacaccaacagcagccccaagcacaacaacaccagccggctgcccaaccagaatggaacagtgctgcccagcgagagcgctggcctggccacagccagctgccccatcaccgtgtcctctgtggtggccgccagccagcagctgtgtgtgaccaacaccaggacccccagctctgtgaggaagcagctgtttgcctgtgtgcccaagaccagccccccagccaccgtcatcagctctgtgaccagcacctgcagcagcctgcccagcgtgtcctctgcccccatcaccagcggccaggcccccaccaccttcctgcctgccagcaccagccaggcccagctgagcagccagaagatggagagcttctctgctgtgccccccaccaaggagaaggtgtccacccaggaccagcccatggccaacctgtgcacccccagcagcacagccaacagctgcagcagcagcgccagcaacacccctggggcccctgagacccaccccagcagcagccccacccccaccagcagcaacacccaggaggaggcccagcccagctctgtgtctgacctgagccccatgtccatgccctttgccagcaacagcgagcccgcccccctgaccctgaccagccccaggatggtggccgctgacaaccaggacaccagcaacctgccccagctggccgtgcctgccccccgggtgagccacaggatgcagccccggggcagcttctacagcatggtgcccaatgccaccatccaccaggacccccagagcatctttgtgaccaaccctgtgaccctgaccccaccccagggccccccagctgctgtgcagctgagcagcgctgtgaacatcatgaatggcagccagatgcacatcaacccagccaacaagagcctgccccccaccttcggccctgccaccctcttcaaccacttcagcagcctgtttgacagcagccaggtgcctgccaaccagggctggggagatggccccctgagcagccgggtggccacagatgccagcttcaccgtgcagagcgccttcctgggcaacagcgtgctgggccacctggagaacatgcacccagacaacagcaaggcccctggcttccggccccccagccagagggtgtccaccagccctgtgggcctgcccagcattgaccccagcggcagcagccccagcagcagcagcgcccccctggccagcttcagcggcatccctggcaccagggtcttcctgcagggccctgcccctgtgggcacccccagcttcaaccggcagcacttcagcccccacccctggaccagcgccagcaacagcagcaccagcgccccacccaccctgggccagcccaagggcgtgtctgccagccaggacaggaagatccccccacccatcggcacagagcggctggcccgcatccggcagggcggctctgtggcccaggccccagctggcaccagctttgtggcccctgtgggccacagcggcatctggagctttggagtgaatgctgtgtctgagggcctgagcggctggagccagagcgtgatgggcaaccaccccatgcaccagcagctgagtgaccccagcaccttcagccagcaccagcccatggagagagatgacagcggcatggtggcccccagcaacatcttccaccagcccatggccagcggctttgtggacttcagcaagggcctgcccatctccatgtatggaggcaccatcatccccagccacccccagctggctgatgtgcctgggggccccctcttcaacggcctgcacaacccagaccctgcctggaaccccatgatcaaggtgatccagaacagcacagaatgtacagatgcccagcaggccagcctgctgcccagcgtgcctgccctgaagggggagatccccagcccccagctgacccggcccaagaagagaattggccggcccatggtggccagccccaaccagaggcaccaggaccacctgcggcccaaggtgcctgctggggtgcaggagctgacccactgcccagacacccccctgctgccccccagcgacagccggggccacaacagcagcaacagccccagcctgcaggccggcggcgctgagggcgctggggaccggggccgggacaccaggtag

SEQ ID NO: 22183 - DNA, 753 bp, Artificial Sequence
  Description of Artificial Sequence: Synthetic coding sequence
atgggagacatcccagctgtgggcctgagctcctggaaggccagccctgggaaggtgacagaggccgtgaaggaggccattgatgctggctaccgccactttgactgtgcctacttctaccacaatgaaagagaggtgggcgccggcatccgctgcaagatcaaggagggcgctgtgcggcgggaggacctcttcatcgccaccaagctgtggtgcacctgccacaagaagagcctggtggagacagcctgcaggaagagcctgaaggccctgaagctgaactacctggacctgtacctgatccactggcccatgggcttcaagccaccccaccctgagtggatcatgagctgcagcgagctgtccttctgcctgagccacccccgggtgcaggacctgcccctggatgagagcaacatggtgatccccagcgacacagacttcctggacacctgggaggccatggaggacctggtgatcaccggcctggtgaagaacattggagtgagcaacttcaaccacgagcagctggagcggctgctgaacaagccaggcctgcgcttcaagcccctgaccaaccagatcctgatccgcttccagatccagagaaatgtcatcgtcatccctggcagcatcacccccagccacatcaaggagaacatccaggtgtttgattttgagctgacccagcacgacatggacaacatcctgagcctgaacagaaacctgcggctggccatgttccccatgtag

SEQ ID NO: 22184 - DNA, 525 bp, Artificial Sequence
  Description of Artificial Sequence: Synthetic coding sequence
atgctgacagaaaatggccaggtgctgagctgtggcagcaacagctttggccagctgggcgtgccccacggcccccggcgctgtgtggtgccccaggccatcgagctgcacaaggagaaggtggtgtgcatcgccgccggcctgcggcatgctgtggccgccacagccagcggcatcgtgttccagtggggcaccggcctggccagctgtggccggcggctgtgccccggccagaccctgcccctcttcttcaccgccaaggagcccagccgggtgacaggcctggagaacagcaaggccatgtgtgtgctggccggcagtgaccacagcgccagcctgacagatgctggggaggtgtatgtgtggggcagcaacaagcacggccagctggccaatgaggccgccttcctgcctgtgccccagaagattgaggcccactgcttccagaatgagaaggtgacagccatctggagcggctggacccacctggtggcccagacaggcctgctgtggctgcgggcctag

SEQ ID NO: 22185 - DNA, 228 bp, Artificial Sequence
  Description of Artificial Sequence: Synthetic coding sequence
atgaacagaagaaggaagttcctgctggcctctgtgctggccctgcagaacagcagcttcatctaccccagctgccagaagtgcttcagccgcatcatcctggtgtccaagaggagcaactgccccaagtgtggcagcactggagagagcggaaatgccaactaccgctacaagctgagcctgaaggtggccgagagcaacaagctgtttgtgatcaccgtcttctag

SEQ ID NO: 22186 - DNA, 252 bp, Artificial Sequence
  Description of Artificial Sequence: Synthetic coding sequence
atggtggccatggccgaggccgaggccggcgtggccgtggaggtgcggggcctgcccccagctgtgcctgatgagctgctgaccctgtactttgagaacagaagaagaagtggcggcggccctgtgctgtcctggcagaggctgggctgcggcggcgtgctgaccttccgggagccagcagatgctgagcgggtgctggcccaggccgaccacgagctgcacggggcccagctgagcctgcggcctgcctag

SEQ ID NO: 22187 - DNA, 528 bp, Artificial Sequence
  Description of Artificial Sequence: Synthetic coding sequence
atgctgtctgaggaggagaaggaggagctgaaggccgagctggtgcagctggaggatgagatcaccaccctgcggcaggtgctgagcgccaaggagcggcacctggtggagatcaagcagaagctgggcatgaacctgatgaatgagctgaagcagaacttcagcaagtcctggcatgacatgcagaccaccacagcctacaagaagacccatgagaccctgagccatgctggccagaaggccacagctgccttcagcaatgtgggcacagccatcagcaagaagtttggagacatgagctacagcatccgccacagcatctccatgcctgccatgaggaacagccccaccttcaagagctttgaggagcgggtggagaccaccgtgaccagcctgaagaccaaggtgggcggcaccaaccccaacggcggcagctttgaggaggtgctgagcagcacagcccacgccagcgcccagagcctggccggcggcagcaggaggaccaaggaggaggagctgcagtgctag

SEQ ID NO: 22188 - DNA, 231 bp, Artificial Sequence
  Description of Artificial Sequence: Synthetic coding sequence
atgaacagaagaaggaagttcctgctggcctctgtgctggccctgcagaacagcagcttcatctaccccagctgccagaagtgcttcagccgcatcatcctggtgtccaagaggagcaactgccccaagtgtggcagcactggagagagcggaaatgccaactaccgctacaagctgagcctgaaggtggccgagagcaacaagctgtttgtgatcaccgtgtttggatag

SEQ ID NO: 22189 - DNA, 456 bp, Artificial Sequence
  Description of Artificial Sequence: Synthetic coding sequence
atgagcatccccttcagcaacacccactaccgcatcccccagggcttcggcaacctgctggagggcctgacccgggagatcctgcgggagcagcctgacaacatcccagcctttgctgctgcctactttgagagcctgctggagaagcgggagaagaccaactttgatcctgctgagtggggcagcaaggtggaggaccgcttctacaacaaccacgcctttgaggagcaggagcccccagagaagagtgaccccaagcaggaggagagccagatcagcggcaaggaggaggagacctctgtgaccatcctggacagcagcgaggaggacaaggagaaggaggaggtggccgctgtgaagatccaggccgccttccggggccacatcgcccgggaggaggccaagaagatgaagaccaacagcctgcagaatgaggagaaggaggagaacaagtag

SEQ ID NO: 22190 - DNA, 270 bp, Artificial Sequence
  Description of Artificial Sequence: Synthetic coding sequence
atggaggccgcagatgccagccgcagcaatggcagcagccctgaggccagagatgcccggagccccagcggccccagcggcagcctggagaatggcaccaaggcagatggcaaggatgccaagaccaccaacggccacggcggggaggccgctgagggcaagagcctgggcagcgccctgaagccaggagagggccgcagcgccctgtttgctggaaatgagtggaggcggcccatcatccagtttgtggagagcggagatgacaagtag

SEQ ID NO: 22191 - DNA, 1542 bp, Artificial Sequence
  Description of Artificial Sequence: Synthetic coding sequence
atggaggtgggcatcaccatccagcacgcctatgagaagcagcacccctggattgacctgaccagcatcggcttctcctatgtgattgacttcaacaccatgggccagatcaaccggcagacccagaggcagaggagagtgagaagaaggctggacctgatctaccccatggtgacaggcaccctgcccaaggcccagagctggcctgtgtccccaggccctgccaccagcccccccatgagcccctgcagctgcccccagtgtgtgctggtgatgtctgtgaaggctgctgtggtgaatggcagcacaggccccctgcagctgcctgtgaccaggaagaacatgcctcctcctggggtggtgaagctgccccccctgcccggcagcggggccaagcccctggacagcacaggcaccatccggggccccctgaagacagcccccagccaggtgatccggcggcaggccagctccatgcccaccggcaccaccatgggcagccctgccagccccccaggccccaacagcaagacaggccgggtggccctggccaccctgaacagaaccaacctgcagaggctggccatcgcccagagccgggtgctgattgccagcggcgtgcccaccgtgcctgtgaagaacctgaatggcagcagccctgtgaacccagccctggccggcatcaccggcatcctgatgtctgctgctggcctgcctgtgtgcctgaccaggcctcccaagctggtgctgcaccccccacctgtgtccaagtctgagatcaagagcatccctggggtgagcaacaccagcaggaagaccaccaagaagcaggccaagaagggcaagaccccagaggaggtgctgaagaagtacctgcagaaggtgcgccaccccccagatgaggactgcaccatctgcatggagcggctgacagcccccagcggctacaagggcccccagcccaccgtgaagccagacctggtgggcaagctgagccgctgtggccacgtgtaccacatctactgcctggtggccatgtacaacaatggaaacaaggatggcagcctgcagtgccccacctgcaagaccatctatggagtgaagacaggcacccagcccccaggcaagatggagtaccacctgatcccccacagcctgcccggccacccagactgcaagaccatccgcatcatctacagcatccccccaggcatccagggccctgagcaccccaaccctgggaagagcttcagcgcccggggcttccccaggcactgctacctgcctgattctgagaagggcaggaaggtgctgaagctgctgctggtggcctgggacagaagactcatctttgccatcggcaccagcagcaccactggagagagtgacaccgtcatctggaatgaggtgcaccacaagacagaatttggcagcaacctgactggacatggctacccagatgccaactacctggacaacgtgctggccgagctggccgcccagggcatcagcgaggacagcacagcccaggagaaggactag

SEQ ID NO: 22192 - DNA, 414 bp, Artificial Sequence
  Description of Artificial Sequence: Synthetic coding sequence
atgagctctgtgcagagccagcaggagcagctgagccagagcgaccccagccccagccccaacagctgcagcagctttgagctgattgacatggatgctggcagcctgtatgagcctgtgagcccccactggttctactgcaagatcatcgacagcaaggagacctggatccccttcaacagcgaggacagccagcagctggaggaggcctacagcagcggcaagggctgcaatggccgggtggtgcccacagatggcggccgctatgatgtgcacctgggggagaggatgagatatgctgtgtactgggatgagctggccagcgaggtgcggcgctgcacctggttctacaagggggacaaggacaacaagtatgtgccctacagcgagagcttcagccaggtgctggagtag

SEQ ID NO: 22193 - DNA, 120 bp, Artificial Sequence
  Description of Artificial Sequence: Synthetic coding sequence
atgttctggaagtttgacctgcacagcagcagccacatcgacaccctgctggagcgggaggatgtgaccctgaaggagctgatggatgaagaagatgtgctgcaggagtgcaaggcctag

SEQ ID NO: 22194 - DNA, 2157 bp, Artificial Sequence
  Description of Artificial Sequence: Synthetic coding sequence
atgctgatgaccctggagatgacagagctgacagacccccaccacaccatgggagactacaaggtggcccacccccaggacccccaccaccccagcgagaagcctgtgatccactgccacaagtgtggggagccctgcaagggggaggtgctgcgggtgcagaccaagcacttccacatcaagtgcttcacctgcaaggtgtgtggctgtgacctggcccagggcggcttcttcatcaagaatggagagtacctgtgcaccctggactaccagaggatgtatggcacccgctgccacggctgtggggagtttgtggagggggaggtggtgacagccctgggcaagacctaccaccccaactgctttgcctgcaccatctgcaagaggcccttccccccaggggacagagtgaccttcaacggccgggactgcctgtgccagctgtgtgcccagcccatgagcagcagccccaaggagaccaccttcagcagcaactgtgccggctgcggccgggacatcaagaatggccaggccctgctggccctggacaagcagtggcacctgggctgcttcaagtgcaagagctgtgggaaggtgctgactggagagtacatcagcaaggatggagccccctactgtgagaaggactaccagggcctgtttggagtgaagtgtgaggcctgccaccagttcatcaccgggaaggtgctggaggccggggacaagcactaccaccccagctgtgcccgctgcagccgctgcaaccagatgttcacagaaggagaggagatgtacctgcagggcagcacagtgtggcacccagactgcaagcagagcaccaagacagaggagaagctgcggcccaccaggaccagcagcgagagcatctacagccggcccggcagcagcatccctggcagccctggccacaccatctatgccaaggtggacaatgagatcctggactacaaggacctggccgccatccccaaggtgaaggccatctatgacatcgagaggccagacctgatcacctatgagcccttctacaccagcggctatgatgacaagcaggagcggcagagcctgggggagagccccaggaccctgagccccaccccatctgctgagggctaccaggatgtgcgggacaggatgatccacaggagcaccagccagggcagcatcaacagccctgtgtacagccgccacagctacacccccaccaccagccgcagcccccagcacttccacaggcctggaaatgagcccagcagcggcaggaacagccccctgccctacagaccagacagccggcccctgacccccacctacgcccaggcccccaagcacttccacgtgcctgaccagggcatcaacatctacaggaagccacccatctacaagcagcacgccgccctggccgcccagagcaagagcagcgaggacatcatcaagttcagcaagtttcctgctgcccaggccccagaccccagcgagacccccaagattgaaacagaccactggccaggcccccccagctttgctgtggtgggccctgacatgaagaggaggagcagcggccgggaggaggatgatgaggagctgctgcggcggcggcagctgcaggaggagcagctgatgaagctgaacagcggcctgggccagctgatcctgaaggaggagatggagaaggagagccgggagaggagcagcctgctggccagccgctatgacagccccatcaacagcgccagccacatccccagcagcaagacagccagcctgcccggctatggaagaaatggcctgcacaggcctgtgtccacagactttgcccagtacaacagctatggagatgtgtctgggggcgtgcgggacttccagaccctgcctgatggccacatgcctgccatgaggatggaccggggcgtgtccatgcccaacatgctggagcccaagatcttcccctatgagatgctgatggtgaccaacagaggaagaaacaagatcctgcgggaggtggacaggacccggctggagcggcacctggcccctgaggtgttccgggagatcttcggcatgagcatccaggagtttgaccggctgcccctgtggaggagaaatgacatgaagaagaaggccaagctgttctag

SEQ ID NO: 22195 - DNA, 2148 bp, Artificial Sequence; identical to SEQ ID NO: 18953
  Description of Artificial Sequence: Synthetic coding sequence

SEQ ID NO: 22196 - DNA, 360 bp, Artificial Sequence
  Description of Artificial Sequence: Synthetic coding sequence
atggagacagacctgaacagccaggacaggaaggacctggacaagttcatcaagttctttgccctgaagacagtgcaggtgattgtgcaggcccggctgggggagaagatctgcaccaggagcagcagcagccccaccggcagtgactggttcaacctggccatcaaggacatccctgaggtgacccatgaggccaagaaggccctggccggccagctgcctgctgtgggccgctccatgtgtgtggagatcagcctgaagaccagcgagggggacagcatggagctggagatctggtgcctggagatgaatgagaagtgtgacaaggagatcaaggtgtcctacacagtgtacaactag

SEQ ID NO: 22197 - DNA, 420 bp, Artificial Sequence
  Description of Artificial Sequence: Synthetic coding sequence
atggctgacacagacctcttcatggagtgtgaggaggaggagctggagccctggcagaagatcagtgatgtgattgaggacagcgtggtggaggactacaacagcgtggacaagaccaccaccgtgtctgtgtcccagcagcctgtgtctgcccctgtgcccatcgccgcccacgcctctgtggccggccacctgagcaccagcaccaccgtgagcagcagcggggcccagaacagcgacagcaccaagaagaccctggtgaccctcatcgccaacaacaatgccggcaaccccctggtgcagcagggcggccagcccctcatcctgacccagaacccagcccctggcctgggcaccatggtgacccagcctgtgctgcggcctgtgcaggtgatgcagaatgccaaccacgtgacctag

SEQ ID NO: 22198 - DNA, 492 bp, Artificial Sequence
  Description of Artificial Sequence: Synthetic coding sequence
atgcatgacaagggcatcaccacagctgctgtgtgtgtgtacccagcccgggtgtgtgatgctgtgaaggccctgaaggccgccggctgcaacatccctgtggcctctgtggccgccggcttccctgctggccagacccacctgaagacccggctggaggagatccggctggccgtggaggatggagccacagaaattgatgtggtgatcaacagaagcctggtgctgaccggccagtgggaggccctgtatgatgagatccggcagttcaggaaggcctgtggggaggcccacctgaagaccatcctggccactggagagctgggcaccctgaccaacgtgtacaaggcctccatgattgccatgatggccggcagtgacttcatcaagaccagcacaggcaaggagaccgtgaatgccaccttccctgtggccatcgtgatgctgcgggccatccgggacttcttctggaagacaggcaacaaggtgtag

SEQ ID NO: 22199 - DNA, 456 bp, Artificial Sequence
  Description of Artificial Sequence: Synthetic coding sequence
atggctgacacagacctcttcatggagtgtgaggaggaggagctggagccctggcagaagatcagtgatgtgattgaggacagcgtggtggaggactacaacagcgtggacaagaccaccaccgtgtctgtgtcccagcagcctgtgtctgcccctgtgcccatcgccgcccacgcctctgtggccggccacctgagcaccagcaccaccgtgagcagcagcggggcccagaacagcgacagcaccaagaagaccctggtgaccctcatcgccaacaacaatgccggcaaccccctggtgcagcagggcggccagcccctcatcctgacccagaacccagcccctggcctgggcaccatggtgacccagcctgtgctgcggcctgtgcaggtgatgcagaatgccaaccacgtgaccagcagccctgtggccagccagcccatcttcatcacctag

SEQ ID NO: 22200 - DNA, 252 bp, Artificial Sequence
  Description of Artificial Sequence: Synthetic coding sequence
atgagccagagcggggctgtgtcctgctgccctggggccaccaacggcagcctgggccgcagtgatggagtggccaagatgagccccaaggacctgtttgagcagaggaagaagtacagcaacagcaatgtcatcatgcatgagaccagccagtaccacgtgcagcacctggccaccttcatcatggacaagtctgaggccatcacctctgtggatgatgccatcaggaagctggtgcagctgagcagctag

SEQ ID NO: 22201 - DNA, 366 bp, Artificial Sequence
  Description of Artificial Sequence: Synthetic coding sequence
atggccggccggcccctgcgcatcggggaccagctggtgctggaggaggactatgatgagacctacatccccagcgagcaggagatcctggagtttgcccgggagatcggcatcgaccccatcaaggagcctgagctgatgtggctggcccgggagggcatcgtggcccccctgcctggagagtggaagccctgccaggacatcactggagacatctactacttcaactttgccaacggccagagcatgtgggaccacccctgtgatgagcactaccgcagcctggtgatccaggagcgggccaagctgagcaccagcggggccatcaagaagaagaagaagaagaaggagaagaaggacaagtag

SEQ ID NO: 22202 - DNA, 2997 bp, Artificial Sequence; identical to SEQ ID NO: 21162
  Description of Artificial Sequence: Synthetic coding sequence

SEQ ID NO: 22203 - DNA, 504 bp, Artificial Sequence
  Description of Artificial Sequence: Synthetic coding sequence
atgggcaccacagcccctggccccatccacctgctggagctgtgtgaccagaagctgatggagttcctgtgcaacatggacaacaaggacctggtgtggctggaggagatccaggaggaggccgagaggatgttcacccgggagttcagcaaggagcctgagctgatgcccaagacccccagccagaagaacagaaggaagaagaggcgcatctcctatgtgcaggatgaaaatagagaccccatcagaagaaggctgagcaggaggaagagccgcagcagccagctgagcagccggcggctgcggagcaaggacagcgtggagaagctggccaccgtggtgggggagaatggatctgtgctgcggcgggtgaccagggctgctgctgctgctgctgctgccaccatggccctggccgcccccagcagccccaccccagagagccccaccatgctgaccaagaagccagaggacaaccacacccagtgccagctggtgccctag

SEQ ID NO: 22204 - DNA, 615 bp, Artificial Sequence
  Description of Artificial Sequence: Synthetic coding sequence
atggaggcccaggcccagggcctgctggagacagagcccctgcagggcacagatgaagatgctgtggccagcgctgacttcagctccatgctgtctgaggaggagaaggaggagctgaaggccgagctggtgcagctggaggatgagatcaccaccctgcggcaggtgctgagcgccaaggagcggcacctggtggagatcaagcagaagctgggcatgaacctgatgaatgagctgaagcagaacttcagcaagtcctggcatgacatgcagaccaccacagcctacaagaagacccatgagaccctgagccacgccggccagaaggccacagctgccttcagcaatgtgggcacagccatcagcaagaagtttggagacatgagctacagcatccgccacagcatctccatgcctgccatgaggaacagccccaccttcaagagctttgaggagcgggtggagaccaccgtgaccagcctgaagaccaaggtgggcggcaccaaccccaatggaggcagctttgaggaggtgctgagcagcacagcccacgccagcgcccagagcctggccggcggcagcaggaggaccaaggaggaggagctgcagtgctag

SEQ ID NO: 22205 - DNA, 1023 bp, Artificial Sequence
  Description of Artificial Sequence: Synthetic coding sequence
atggctgctgcccgggaccccccagaggtgtccctgcgggaggccacccagaggaagctgcggcgcttcagcgagctgcggggcaagctggtggcccggggggagttctgggacatcgtggccatcacagctgctgatgagaagcaggagctggcctacaaccagcagctgtctgagaagctgaagaggaaggagctgcccctgggcgtgcagtaccacgtgtttgtggaccctgctggggccaagattggaaatggaggcagcaccctgtgtgccctgcagtgcctggagaagctgtatggagacaagtggaacagcttcaccatcctgctgatccacagcggcggctacagccagaggctgcccaatgccagcgccctgggcaagatcttcaccgccctgcccctggacatccctgagtgcagcggcaagaccagctgcatcatccagagcatcctggacagccgctgcagcgtggcccctggctctgtggtggagtacagccggctgggcccagatgtgtctgtgggggagaactgcatcatcagcggcagctacatcctgaccaaggccgccctgcctgcccacagctttgtgtgcagcctgagcctgaagatgaaccgctgcctgaagtatgccaccatggcctttggagtgcaggacaacctgaagaagtctgtgaagaccctgagtgacatcaagctgctgcagttctttggagtgtgcttcctgagctgcctggatgtgtggaacctgaaggtgacagaggagctgttcagcggcaacaagacctgcctgagcctgtggacagcccgcatcttccctgtgtgcagcagcctgagtgacagcgtcatcaccagcctgaagatgctgaatgctgtgaagaacaagagcgccttcagcctgaacagctacaagctgctgagcattgaggagatgctgatctacaaggatgtggaggacatgatcacctaccgggagcagatcttcctggagatcagcctgaagagcagcctgatgtag

SEQ ID NO: 22206 - DNA, 873 bp, Artificial Sequence
  Description of Artificial Sequence: Synthetic coding sequence
atggccgagctgacagccctggagagcctgattgagatgggcttcccccggggccgggcagagaaggccctggccctgactggaaaccagggcatcgaggccgccatggactggctgatggagcatgaagatgatcctgatgtggatgagcccctggagacccccctgggccacatcctgggccgggagcccaccagcagcgagcagggcggcctggagggcagcggcagcgctgctggggagggcaagccagccctgtctgaggaggagcggcaggagcagaccaagaggatgctggagctggtggcccagaagcagcgggagcgggaggagcgggaggagcgggaggccctggagcgggagcggcagaggcggcggcagggccaggagctgtctgctgcccggcagaggctgcaggaggatgagatgagaagagctgctgaggagaggagaagagagaaggccgaggagctggccgcccggcagagggtgcgggagaagattgaaagagacaaggccgagcgggccaagaagtatggaggctctgtgggcagccagcccccacctgtggcccctgagcccggccctgtgcccagcagccccagccaggagccccccaccaagcgggagtatgaccagtgccgcatccaggtgcggctgcctgatggcaccagcctgacccagaccttccgggcccgggagcagctggccgctgtgcggctgtatgtggagctgcacagaggagaggagctgggcggcggccaggaccctgtgcagctgctgagcggcttcccccggcgggccttcagcgaggccgacatggagcggcccctgcaggagctgggcctggtgcccagcgctgtgctgatctag

SEQ ID NO: 22207 - DNA, 309 bp, Artificial Sequence; identical to SEQ ID NO: 20332
  Description of Artificial Sequence: Synthetic coding sequence

SEQ ID NO: 22208 - DNA, 279 bp, Artificial Sequence
  Description of Artificial Sequence: Synthetic coding sequence
atgctgtctgaggaggagaaggaggagctgaaggccgagctggtgcagctggaggatgagatcaccaccctgcggcaggtgctgagcgccaaggagcggcacctggtggagatcaagcagaagctgggcatgaacctgatgaatgagctgaagcagaacttcagcaagtcctggcatgacatgcagaccaccacagcctacaagaagacccatgagaccctgagccatgctggccagaaggccacagctgccttcagcaatgtgggcacagccatctag

SEQ ID NO: 22209 - DNA, 3735 bp, Artificial Sequence; identical to SEQ ID NO: 19446
  Description of Artificial Sequence: Synthetic coding sequence

SEQ ID NO: 22210 - DNA, 2676 bp, Artificial Sequence
  Description of Artificial Sequence: Synthetic coding sequence
atggaccagcctgaggccccctgcagcagcacaggcccccggctggccgtggcccgggagctgctgctggccgccctggaggagctgagccaggagcagctgaagcgcttccgccacaagctgagagatgtgggcccagatggccgcagcatcccctggggccgcctggagcgggcagatgctgtggacctggccgagcagctggcccagttctacggccctgagcccgccctggaggtggccaggaagaccctgaagagagcagatgccagagatgtggccgcccagctgcaggagcggcggctgcagaggctgggcctgggcagcggcaccctgctgtctgtgtctgagtacaagaagaagtaccgggagcacgtgctgcagctgcacgcccgggtgaaggagagaaatgcccggtctgtgaagatcaccaagcgcttcaccaagctgctgattgcccctgagagcgctgcccctgaggaggccatgggccctgctgaggagcctgagcccggccgggccaggagaagtgacacccacaccttcaacagactcttcagaagagatgaggagggcagaagacccctgactgtggtgctgcagggccctgctggcatcggcaagaccatggccgccaagaagatcctgtatgactgggccgccggcaagctgtaccagggccaggtggactttgccttcttcatgccctgtggggagctgctggagcggcccggcaccaggagcctggccgacctgatcctggaccagtgcccagacagaggagcccctgtgccccagatgctggcccagccccagaggctgctcttcatcctggatggagcagatgagctgcctgccctgggcggccctgaggccgccccctgcacagacccctttgaagctgccagcggggcccgggtgctgggcggcctgctgagcaaggccctgctgcccacagccctgctgctggtgaccaccagggctgctgcccctggccgcctgcagggccgcctgtgcagcccccagtgtgccgaggtgcggggcttcagtgacaaggacaagaagaagtacttctacaagtacttcagagatgagcggcgggcagagcgggcctacagatttgtgaaggaaaatgagaccctgtttgccctgtgctttgtgccctttgtgtgctggatcgtgtgcaccgtgctgcggcagcagctggagctgggccgggacctgagcaggaccagcaagaccaccacctctgtgtacctgctcttcatcacctctgtgctgagcagcgcccctgtggctgatggcccccggctgcagggcgacctgaggaacctgtgccgcctggcccgggagggcgtgctgggccggcgggcccagtttgctgagaaggagctggagcagctggagctgcggggcagcaaggtgcagaccctcttcctgagcaagaaggagctgcccggggtgctggagacagaggtgacctaccagttcatcgaccagagcttccaggagttcctggccgccctgagctacctgctggaggatggaggagtgcccaggacagctgctggaggagtgggcaccctgctgcggggagatgcccagccccacagccacctggtgctgaccacccgcttcctgtttggcctgctgtctgctgagaggatgagggacatcgagcggcacttcggctgcatggtgtctgagcgggtgaagcaggaggccctgcgctgggtgcagggccagggccagggctgccctggggtggcccctgaggtgacagagggcgccaagggcctggaggacacagaggagcctgaggaggaggaggagggggaggagcccaactaccccctggagctgctgtactgcctgtatgagacccaggaggatgcctttgtgcggcaggccctgtgccgcttccctgagctggccctgcagagggtgcgcttctgcaggatggatgtggccgtgctgagctactgtgtgcgctgctgcccagctggccaggccctgcggctcatcagctgccgcctggtggccgcccaggagaagaagaagaagagcctgggcaagaggctgcaggccagcctgggcggcggcagcagccagggcaccaccaagcagctgcctgccagcctgctgcaccccctcttccaggccatgacagaccccctgtgccacctgagcagcctgaccctgagccactgcaagctgcctgatgctgtgtgccgggacctgtctgaggccctgcgggccgccccagccctgacagagctgggcctgctgcacaaccggctgtctgaggccggcctgaggatgctgtctgagggcctggcctggccccagtgccgggtgcagacagtgcgggtgcagctgcctgacccccagaggggcctgcagtacctggtgggcatgctgcggcagagccctgccctgaccaccctggacctgagcggctgccagctgcctgcccccatggtgacctacctgtgtgctgtgctgcagcaccagggctgcggcctgcagaccctgagcctggcctctgtggagctgtctgagcagagcctgcaggagctgcaggccgtgaagagggccaagccagacctggtgatcacccacccagccctggatggccacccccagccccccaaggagctgatcagcaccttctag

SEQ ID NO: 22211 - DNA, 240 bp, Artificial Sequence
  Description of Artificial Sequence: Synthetic coding sequence
atgagccagagcggggctgtgtcctgctgccctggggccaccaacggcagcctgggccgcagtgatggagtggccaagatgagccccaaggacctgtttgagcagaggaagaagtacagcaacagcaatgtcatcatgcatgagaccagccagtaccacgtgcagcacctggccaccttcatcatggacaagtctgaggccatcacctctgtggatgatgccatcaggaagctggtgtag

SEQ ID NO: 22212 - DNA, 543 bp, Artificial Sequence
  Description of Artificial Sequence: Synthetic coding sequence
atgggagacaagaagagccccacccggcccaagaggcagcccaagcccagcagtgatgagggctactgggactgcagcgtgtgcaccttcagaaattctgctgaggccttcaagtgcatgatgtgtgatgtgaggaagggcaccagcaccaggaagcccaggcctgtgtcccagctggtggcccagcaggtgacccagcagtttgtgccccccacccagagcaagaaggagaagaaggacaaggtggagaaggagaagtctgagaaggagaccaccagcaagaagaacagccacaagaagacccggccccggctgaagaatgtggacaggagcagcgcccagcacctggaggtgacagtgggggacctgaccgtcatcatcacagacttcaaggagaagaccaagagccccccagccagcagcgctgccagcgctgaccagcacagccagagcggcagcagcagtgacaacacagagcggggcatgagccgcagcagcagccccagaggagaggccagcagcctgaatggagagagccactag

SEQ ID NO: 22213 - DNA, 2196 bp, Artificial Sequence
  Description of Artificial Sequence: Synthetic coding sequence
atgggcagcggggaggagcccggccagagcggggccagcctgaggacaggccccatggtgcagggccggggcatcatgaccaccggcagcggccaggagcccggccagagcggcaccagcctgaggacaggccccatgggcagcctgggccaggccgagcaggtgtcctccatgcccatgggcagcctggagcacgagggcctggtgtccctgcggcctgtgggcctgcaggagcaggagggccccatgagcctgggccctgtgggcagcgctggccctgtggagaccagcaagggcctgctgggccaggagggcctggtggagatcgccatggacagccctgagcaggagggcctggtgggccccatggagatcaccatgggcagcctggagaaggccggccctgtgtccccaggctgtgtgaagctggccggccaggagggcctggtggagatggtgctgctgatggagcccggggccatgaggttcctgcagctgtaccacgaggacctgctggccggcctgggagatgtggccctgctgcccctggagggccctgacatgacaggcttccggctgtgtggggcccaggccagctgccaggccgctgaggagttcctgcggagcctgctgggcagcatcagctgccacgtgctgtgcctggagcaccctggcagcgcccgcttcctgctgggccctgagggccagcacctgctgcagggcctggaggcccagttccagtgtgtgtttggaacagagcggctggccacagccaccctggacaccggcctggaggaggtggaccccacagaggccctgcctgtgctgcctggaaatgcccacaccctgtggaccccagacagcactggaggagaccaggaggatgtgtccctggaggaggtgcgggagctgctggccaccctggagggcctggacctggatggagaggactggctgccccgggagctggaggaggagggcccccaggagcagcctgaggaggaggtgaccccaggccacgaggaggaggagcctgtggcccccagcacagtggccccccgctggctggaggaggaggccgccctgcagctggccctgcacaggagcctggagccccagggccaggtggccgagcaggaggaggccgccgccctgcggcaggccctgaccctgagcctgctggagcagccccccctggaggccgaggagcccccagatggcggcacagatggcaaggcccagctggtggtgcacagcgcctttgagcaggatgtggaggagctggaccgggccctgcgggccgccctggaggtgcacgtgcaggaggagaccgtgggcccctggaggaggaccctgcctgctgagctgcgggcccggctggagcgctgccacggcgtgtctgtggccctgcggggggactgcaccatcctgcggggctttggagcccacccagcccgggccgcccggcacctggtggccctgctggccggcccctgggaccagagcctggccttccccctggccgccagcggccccaccctggccggccagaccctgaagggcccctggaacaacctggagcggctggctgaaaatactggagagttccaggaggtggtgcgggccttctatgacaccctggatgctgcccggagcagcatccgggtggtgcgggtggagcgggtgagccaccccctgctgcagcagcagtatgagctgtaccgggagcggctgctgcagagatgtgagcggcggcctgtggagcaggtgctgtaccacggcaccacagccccagctgtgcctgacatctgtgcccacggcttcaacagaagcttctgtggcagaaatgccaccgtgtatggcaagggcgtgtactttgcccggcgggccagcctgtctgtgcaggaccgctacagccccccaaatgctgatggccacaaggctgtgtttgtggcccgggtgctgaccggggactatggccagggcagaagaggcctgcgggccccacccctgcggggccctggccacgtgctgctgcgctatgattctgctgtggactgcatctgccagcccagcatcttcgtcatcttccatgacacccaggccctgcccacccacctgatcacctgtgagcacgtgccccgggccagcccagatgaccccagcggcctgcccggccgcagcccagacacctag

SEQ ID NO: 22214 - DNA, 1083 bp, Artificial Sequence
  Description of Artificial Sequence: Synthetic coding sequence
atgcaggtgtatgagggcctggacatcatcaccaacaaggtgtctgcccaggagcagaggatctgccgccaccacatgatcagctttgtggaccccctggtgaccaactacacagtggtggacttcaggaacagagccacagccctgatctacctgcctgagaccaagttcctgctgctgtgggaggagcccatcatcaccctgaacctgtgcagcggcaagttcctgagcatccccaggagcctgcaggtgtttgaggagaccggcatcagccacagcgagttcctgcaccggcagcacacagaggagggcggcggccccctgggcggccccctgaagttcagcaacccctgcatcctgtggctgcacgccgaccaggccgtgctggatgagcggctggacaagagggtggatgacatgctggccgccggcctgctggaggagctgcgggacttccaccggcgctacaaccagaagaatgtgtctgagaacagccaggactaccagcacggcatcttccagagcatcggcttcaaggagttccacgagtacctgatcacagagggcaagtgcaccctggagaccagcaaccagctgctgaagaagggcatcgaggccctgaagcaggtgaccaagagatatgccaggaagcagaaccgctgggtgaagaaccgcttcctgagccggcccggccccatcgtgccccctgtgtatggcctggaggtgtctgatgtgtccaagtgggaggagagcgtgctggagcccgccctggagatcgtgcagagcttcatccagggccacaagcccacagccacccccatcaagatgccctacaatgaagctgagaacaagaggagctaccacctgtgtgacctgtgtgaccgcatcatcatcggggaccgggagtgggccgcccacatcaagagcaagagccacctgaaccagctgaagaagagaagaaggctggacagtgatgctgtgaacaccatcgagagccagagcgtgtccccagaccacaacaaggagcccaaggagaagggcagccctggccagaatgaccaggagctgaagtgcagcgtgtag

SEQ ID NO: 22215 - DNA, 828 bp, Artificial Sequence; identical to SEQ ID NO: 21402
  Description of Artificial Sequence: Synthetic coding sequence

SEQ ID NO: 22216 - DNA, 1692 bp, Artificial Sequence
  Description of Artificial Sequence: Synthetic coding sequence
atggagacagccaagcagaaggccctggaggtggccaacagactctaccagaaggacctgcgggccccagatgtggtgattggagctgacaccatcgtgacagtgggcggcctcatcctggagaagcctgtggacaagcaggatgcctacaggatgctgagccggctgagcggccgggagcacagcgtcttcaccggggtggccatcgtgcactgcagcagcaaggaccaccagctggacaccagggtgtctgagttctatgaggagaccaaggtgaagttcagcgagctgtctgaggagctgctgtgggagtatgtgcacagcggggagcccatggacaaggccggcggctacggcatccaggccctgggcggcatgctggtggagagcgtgcacggggacttcctgaatgtggtgggcttccccctgaaccacttctgcaagcagctggtgaagctgtactacccacccaggcctgaggacctgcggcgctctgtgaagcatgacagcatcccagctgctgacacctttgaggacctgagtgatgtggagggcggcggcagcgagcccacccagagagatgctggcagcagagatgagaaggccgaggccggggaggccggccaggccacagctgaggccgagtgccacaggacccgggagaccctgccccccttccccacccggctgctggagctgattgagggcttcatgctgagcaagggcctgctgacagcctgcaagctgaaggtgtttgacctgctgaaggatgaggccccccagaaggctgctgacatcgccagcaaggtggatgccagcgcctgtggcatggagcggctgctggacatctgtgccgccatgggcctgctggagaagacagagcagggctacagcaacacagaaacagccaacgtgtacctggccagtgatggagagtacagcctgcacggcttcatcatgcacaacaatgacctgacctggaacctcttcacctacctggagtttgccatccgggagggcaccaaccagcaccaccgggccctgggcaagaaggcagaagatctcttccaggatgcctactaccagagccctgagacccggctgcgcttcatgagggccatgcacggcatgaccaagctgacagcctgccaggtggccacagccttcaacctgagccgcttcagcagcgcctgtgatgtgggcggctgcaccggggccctggcccgggagctggcccgggagtaccccaggatgcaggtgacagtgtttgacctgcctgacatcatcgagctggccgcccacttccagcccccaggcccccaggccgtgcagatccactttgctgctggggacttcttccgggaccccctgcccagcgctgagctgtatgtgctgtgccgcatcctgcatgactggccagatgacaaggtgcacaagctgctgagccgggtggccgagagctgcaagccaggggccggcctgctgctggtggagaccctgctggatgaggagaagagggtggcccagagggccctgatgcagagcctgaacatgctggtgcagacagagggcaaggagaggagcctgggggagtaccagtgcctgctggagctgcacggcttccaccaggtgcaggtggtgcacctgggcggcgtgctggatgccatcctggccaccaaggtggccccctag

SEQ ID NO: 22217 - DNA, 828 bp, Artificial Sequence; identical to SEQ ID NO: 21402
  Description of Artificial Sequence: Synthetic coding sequence

SEQ ID NO: 22218 - DNA, 999 bp, Artificial Sequence
  Description of Artificial Sequence: Synthetic coding sequence
atggagtacctgggcggcggcagcgccctggacctgctgaagccaggccccctggaggagacctacatcgccaccatcctgcgggagatcctgaagggcctggactacctgcacagcgagaggaagatccaccgggacatcaaggccgccaacgtgctgctgtctgagcagggagatgtgaagctggccgactttggagtggccggccagctgacagacacccagatcaagaggaacacctttgtgggcacccccttctggatggcccctgaggtgatcaagcagagcgcctatgacttcaaggctgacatctggagcctgggcatcacagccatcgagctggccaagggggagccccccaacagcgacctgcaccccatgagggtgctcttcctgatccccaagaacagcccccccaccctggagggccagcacagcaagcccttcaaggagtttgtggaggcctgcctgaacaaggacccccgcttccggcccacagccaaggagctgctgaagcacaagttcatcacccgctacaccaagaagaccagcttcctgacagagctgattgaccgctacaagcgctggaagtctgagggccatggagaggagagcagcagcgaggacagcgacattgatggagaggctgaagatggagagcagggccccatctggaccttcccccccaccatccggcccagcccccacagcaagctgcacaagggcacagccctgcacagcagccagaagccagctgagcctgtgaagaggcagcccaggagccagtgcctgagcaccctggtgcggcctgtgtttggagagctgaaggagaagcacaagcagagcggcggctctgtgggcgccctggaggagctggagaatgccttcagcctggccgaggagagctgccccggcatcagtgacaagctgatggtgcacctggtggagcgggtgcagcgcttcagccacaacagaaaccacctgaccagcaccaggtag

SEQ ID NO: 22219 - DNA, 279 bp, Artificial Sequence
  Description of Artificial Sequence: Synthetic coding sequence
atgaacttcacccccacccacacccctgtgtgcaggaagaggacagtggtgtccaagaggggcgtggccgtgtctggccccaccaagaggcggggcatggctgacagcctggagagcacccccctgcccagccctgaggaccggctggccaagctgcaccccagcaaggagctgctggagtactaccagaagaagatggccgagtgtgaggccgagaatgaagacctgctgaagaagctggagctgtacaaggaggcctgtgagggccagcacaagtag

SEQ ID NO: 22220 - DNA, 429 bp, Artificial Sequence
  Description of Artificial Sequence: Synthetic coding sequence
atggcccagaaggaaaattcctacccctggccctacggccggcagacagcccccagcggcctgagcaccctgccccagagggtgctgaggaaggagcctgtgaccccatctgccctggtgctgatgagccgcagcaatgtgcagcccacagctgcccctggccagaaggtgatggagaacagcagcggcaccccagacatcctgacccggcggcacttcaccattgatgactttgagatcggccggcccctgggcaagggcaagtttggaaatgtgtacctggcccgggagaagaagagccacttcatcgtggccctgaaggtgctcttcaagagccagatcgagaaggagggcgtggagcaccagctgcggcgggagattgagatccaggcccacctgcagagctggaggtcctggcagatgctgtag

SEQ ID NO: 22221 - DNA, 501 bp, Artificial Sequence
  Description of Artificial Sequence: Synthetic coding sequence
atggaccaggaggacagcgagagcaagacagtgtctgagcacggggagcgggactggatgacagccaagaagttctggaagccaggggacagcctggcccctcctgaggtggactttgaccggctgctggccagcctgcaggacctgtctgagctggtggtggagggggacacccaggtgacccctgtgcctgggggcgcccggctgcggaccctggagcccatccccctgaagctgtacagaaatggcatcatgatgtttgatggccccttccagcccttctatgaccccagcacccagcgctgcctgcgggacatcctggatggcttcttccccagcgagctgcagaggctgtacccaaatggagtgcccttcaaggtgatcagctgcagcagcaaccacaccttcggggactttgagggcagcggggacacccagcccccccagaccccacccatcctgcggggcagccgctgcaccccctggggcacccctgtgtag

SEQ ID NO: 22222 - DNA, 1473 bp, Artificial Sequence
  Description of Artificial Sequence: Synthetic coding sequence
atgcagagcctggatgatgccaccaagcagctggacttcaccaggaagaccctggccgagaagaagcaggagctggacaagctgagaaatgagtgggccagccacacagctgccctgaccaacaagcacagccaggagctgaccaatgagaaggagaaggccctgcaggcccaggtgcagtaccagcagcagcacgagcagcagaagaaggacctggagatcctgcaccagcagaacatccaccagctgcagaaccggctgtctgagctggaggccgccaacaaggacctgacagagaggaagtacaagggggacagcaccatccgggagctgaaggccaagctgagcggcgtggaggaggagctgcagaggaccaagcaggaggtgctgagcctgcggcgggagaacagcaccctggatgtggagtgccacgagaaggagaagcacgtgaaccagctgcagaccaaggtggccgtgctggagcaggagatcaaggacaaggaccagctggtgctgcggaccaaggaggcctttgacaccatccaggagcagaaggtggtgctggaggagaatggagagaagaaccaggtgcagctgggcaagctggaggccaccatcaagagcctgtctgctgagctgctgaaggccaatgagatcatcaagaagctgcagggcgacctgaagaccctgatgggcaagctgaagctgaagaacacagtgaccatccagcaggagaagctgctggccgagaaggaggagaagctgcagaaggagcagaaggagctgcaggatgtgggccagagcctgcgcatcaaggagcaggaggtgtgcaagctgcaggagcagctggaggccaccgtgaagaagctggaggagagcaagcagctgctgaagaacaatgagaagctgatcacctggctgaacaaggagctgaatgaaaaccagctggtgaggaagcaggatgtgctgggccccagcaccaccccaccagcccacagcagcagcaacaccatccgcagcggcatcagccccaacctgaatgtggtggatggccgcctgacctaccccacctgtggcatcggctaccctgtgagcagcgcctttgccttccagaacaccttcccccacagcatcagcgccaagaacaccagccaccctggcagcggcaccaaggtgcagttcaacctgcagttcaccaagcccaatgccagcctgggagatgtgcagagcggggccaccatctccatgccctgcagcacagacaaggaaaatggagaaaatgtgggcctggagagcaagtacctgaagaagagagaagattccatccccctgcggggcctgagccagaacctcttcagcaacagcgaccaccagagagatggcaccctgggcgccctgcacaccagcagcaagcccacagccctgcccagcgccagcagcgcctacttccctggccagctgcccaacagctag

SEQ ID NO: 22223 - DNA, 3015 bp, Artificial Sequence
  Description of Artificial Sequence: Synthetic coding sequence
atgctgaggacagctggaagagatggcctgtgccgcctgagcacctacctggaggagctggaggccgtggagctgaagaagttcaagctgtacctgggcacagccacagagctgggggagggcaagatcccctggggctccatggagaaggccggccccctggagatggcccagctgctgatcacccacttcggccctgaggaggcctggaggctggccctgagcacctttgagcgcatcaacaggaaggacctgtgggagcggggccagcgggaggacctggtgcgggacaccccacctgggggccccagcagcctgggcaaccagagcacctgcctgctggaggtgtccctggtgacccccaggaaggacccccaggagacctacagagattatgtgcggaggaagttccggctgatggaggacagaaatgcccggctgggagaatgtgtgaacctgagccaccgctacacccggctgctgctggtgaaggagcacagcaaccccatgcaggtgcagcagcagctgctggacaccggccggggccacgccaggacagtgggccaccaggccagccccatcaagattgagaccctgtttgagccagatgaggagaggcctgagccccccaggacagtggtgatgcagggcgctgctggcatcggcaagtccatgctggcccacaaggtgatgctggactgggcagatggcaagctgttccagggccgctttgactacctgttctacatcaactgccgggagatgaaccagagcgccacagaatgttccatgcaggacctgatcttcagctgctggccagagcccagcgcccccctgcaggagctgatccgggtgcctgagcggctgctcttcatcattgatggctttgatgagctgaagcccagcttccatgacccccagggcccctggtgcctgtgctgggaggagaagaggcccacagagctgctgctgaacagcctcatcaggaagaagctgctgcctgagctgagcctgctgatcaccacccggcccacagccctggagaagctgcaccggctgctggagcaccccaggcatgtggagatcctgggcttcagcgaggccgagaggaaggagtacttctacaagtacttccacaatgctgagcaggccggccaggtgttcaactacgtgcgggacaatgagcccctcttcaccatgtgctttgtgcccctggtgtgctgggtggtgtgcacctgcctgcagcagcagctggagggcggcggcctgctgcggcagaccagcaggaccaccacagctgtgtacatgctgtacctgctgagcctgatgcagcccaagccaggggccccccggctgcagcccccacccaaccagaggggcctgtgcagcctggccgcagatggcctgtggaaccagaagatcctgtttgaggagcaggacctgaggaagcacggcctggatggagaagatgtgtctgccttcctgaacatgaacatcttccagaaggacatcaactgtgagcgctactacagcttcatccacctgtccttccaggagttctttgctgccatgtactacatcctggatgaaggagagggcggggccggccctgaccaggatgtgacccggctgctgacagaatatgccttcagcgagaggagcttcctggccctgaccagccgcttcctgtttggcctgctgaatgaggagaccaggagccacctggagaagagcctgtgctggaaggtgagcccccacatcaagatggacctgctgcagtggatccagagcaaggcccagagtgatggcagcaccctgcagcagggcagcctggagttcttcagctgcctgtatgagatccaggaggaggagttcatccagcaggccctgagccacttccaggtgattgtggtgagcaacatcgccagcaagatggagcacatggtgtcctccttctgcctgaagcgctgccgcagcgcccaggtgctgcacctgtatggagccacctacagcgcagatggagaagatcgggcccgctgcagcgctggggcccacaccctgctggtgcagctgcctgagaggacagtgctgctggatgcctacagcgagcacctggccgccgccctgtgcaccaaccccaacctgattgagctgagcctgtacagaaatgccctgggcagcagaggagtgaagctgctgtgccagggcctgcggcaccccaactgcaagctgcagaacctgcggctgaagcgctgccgcatcagcagcagcgcctgtgaggacctgtctgctgccctgattgccaacaagaacctgaccaggatggacctgtctggaaatggagtgggcttccctggcatgatgctgctgtgtgagggcctgcggcacccccagtgccgcctgcagatgatccagctgaggaagtgccagctggagagcggggcctgccaggagatggcctctgtgctgggcaccaacccccacctggtggagctggacctgactggaaatgccctggaggacctgggcctgcggctgctgtgccagggcctgcggcaccctgtgtgccgcctgcggaccctgtggctgaagatctgccgcctgacagctgctgcctgtgatgagctggccagcaccctgtctgtgaaccagagcctgcgggagctggacctgagcctgaatgagctgggggacctgggcgtgctgctgctgtgtgagggcctgcggcaccccacctgcaagctgcagaccctgcggctgggcatctgccgcctgggcagcgctgcctgtgagggcctgtctgtggtgctgcaggccaaccacaacctgcgggagctggacctgtccttcaatgacctgggggactggggcctgtggctgctggccgagggcctgcagcacccagcctgccgcctgcagaagctgtggctgtttggcatggacctgaacaagatgacccacagccggctggccgccctgcgggtgaccaagccctacctggacatcggctgctag

SEQ ID NO: 22224 - DNA, 2517 bp, Artificial Sequence; identical to SEQ ID NO: 19107
  Description of Artificial Sequence: Synthetic coding sequence

SEQ ID NO: 22225 - DNA, 165 bp, Artificial Sequence
  Description of Artificial Sequence: Synthetic coding sequence
atgggcaacagcgacagccagtacaccctgcagggcagcaagaaccacagcaacaccatcactggagccaagcagatcccctgcagcctgaagatccggggcatccacgccaaggaggagaagagcctgcacggctggggccacggcagcaatggagctggatag

SEQ ID NO: 22226 - DNA, 1269 bp, Artificial Sequence
  Description of Artificial Sequence: Synthetic coding sequence
atggccagcctgagccgggccctgcgggtggccgccgcccacccccggcagagccccacccggggcatgggcccctgcaacctgagcagcgctgctggccccacagctgagaagtctgtgccctaccagaggaccctgaaggagggccagggcacctctgtggtggcccagggccccagccggcccctgcccagcacagccaacgtggtggtgattggaggcggcagcctgggctgccagaccctgtaccacctggccaagctgggcatgtctggagctgtgctgctggagcgggagcggctgaccagcggcaccacctggcacacagctggcctgctgtggcagctgcggcccagtgatgtggaggtggagctgctggcccacacccggcgggtggtgtcccgggagctggaggaggagaccggcctgcacacaggctggatccagaatggaggcctcttcatcgccagcaaccggcagaggctggatgagtacaagaggctgatgagcctgggcaaggcctatggagtggagagccacgtgctgagccctgctgagaccaagaccctgtaccccctgatgaatgtggatgacctgtatggcaccctgtatgtgccccatgatggcaccatggaccctgctggcacctgcaccaccctggcccgggccgccagcgcccggggggcccaggtgattgagaactgccctgtgacaggcatccgggtgtggacagatgactttggagtgcggcgggtggccggcgtggagacccagcacggcagcatccagaccccctgtgtggtgaactgtgccggcgtgtgggccagcgctgtgggccgcatggccggcgtgaaggtgcccctggtggccatgcaccacgcctacgtggtgacagaaagaattgagggcatccagaacatgcccaacgtgcgggaccatgatgcctctgtgtacctgcggctgcagggagatgccctgtctgtgggcggctatgaggccaaccccatcttctgggaggaggtgtctgacaagtttgccttcggcctgtttgacctggactgggaggtgttcacccagcacattgaaggagccatcaacagagtgcctgtgctggagaagacaggcatcaagagcacagtgtgtggccctgagagcttcaccccagaccacaagcccctgatgggagaggcccctgagctgcggggcttcttcctgggctgcggcttcaacagcgctggggagagcggccaggccctgctggccccctag

SEQ ID NO: 22227 - DNA, 327 bp, Artificial Sequence
  Description of Artificial Sequence: Synthetic coding sequence
atgtccatgctgaagcccagcggcctgaaggcccccaccaagatcctgaagccaggcagcacagccctgaagacccccacagctgtggtggcccctgtggagaagaccatcagcagcgagaaggccagcagcacccccagcagcgagacccaggaggagtttgtggatgacttccgggtgggggagcgggtgtgggtgaatggaaacaagccaggcttcatccagttcctgggggagacccagtttgcccctggccagtgggccggcatcgtgctggatgagcccatcggcaagaatgatggctctgtggccggcgtgcgctactag

SEQ ID NO: 22228 - DNA, 2148 bp, Artificial Sequence
  Description of Artificial Sequence: Synthetic coding sequence
atgaagaggggccgcctgcccagcagcagtgaagattctgatgacaatggcagcctgagcaccacctggagccagaacagccgcagccagcaccggcgcagcagctgcagcagacatgaggacaggaagcccagcgaggtgttcagaacagacctgatcacagccatgaagctgcatgacagctaccagctgaacccagatgagtactacgtgctggccgacccctggaggcaggagtgggagaagggcgtgcaggtgcctgtgtccccaggcaccatcccccagcctgtggcccgggtggtgtctgaggagaagagcctgatgttcatccggcccaagaagtacatcgtgagcagcggcagcgagcccccagagctgggctacgtggacatccgcaccctggccgacagcgtgtgccgctatgacctgaatgacatggatgctgcctggctggagctgaccaatgaggagttcaaggagatgggcatgcctgagctggatgagtacaccatggagcgggtgctggaggagtttgagcagcgctgctatgacaacatgaaccacgccatcgagacagaggagggcctgggcatcgagtatgatgaagatgtggtgtgtgatgtgtgccagagcccagatggagaagatggaaatgagatggtgttctgtgacaagtgcaacatctgtgtgcaccaggcctgctacggcatcctgaaggtgcctgagggctcctggctgtgcaggacctgtgccctgggcgtgcagcccaagtgcctgctgtgccccaagaagggcggggccatgaagcccaccaggagcggcaccaagtgggtgcacgtgtcctgtgccctgtggatccctgaggtgtccatcggcagccctgagaagatggagcccatcaccaaggtgagccacatccccagcagccgctgggccctggtgtgcagcctgtgcaatgagaagtttggagccagcatccagtgcagcgtgaagaactgcaggacagccttccacgtgacctgtgcctttgaccggggcctggagatgaagaccatcctggctgaaaatgatgaggtgaagttcaagagctactgccccaagcacagcagccacaggaagccagaggagagcctgggcaagggggccgcccaggagaatggagcccctgagtgcagccccaggaaccccctggagccctttgccagcctggagcagaaccgggaggaggcccaccgggtgtctgtgaggaagcagaagctgcagcagctggaggatgagttctacacctttgtgaacctgctggatgtggcccgggccctgcggctgcctgaggaggtggtggacttcctgtaccagtactggaagctgaagaggaaggtgaacttcaacaagcccctcatcacccccaagaaggatgaggaggacaacctggccaagcgggagcaggatgtgctcttccggcggctgcagctgttcacccacctgcggcaggacctggagcgggtgaggaacctgacctacatggtgacccggcgggagaagatcaagaggtctgtgtgcaaggtgcaggagcagatcttcaacctgtacaccaagctgctggagcaggagcgggtgtctggagtgcccagcagctgcagcagcagcagcctggagaacatgctgctcttcaacagccccagcgtgggcccagatgcccccaagattgaggacctgaagtggcacagcgccttcttcaggaagcagatgggcaccagcctggtgcacagcctgaagaagccccacaagagggaccccctgcagaacagccctggcagcgagggcaagaccctgctgaagcagcctgacctgtgtggccggcgggagggcatggtggtgcctgagagcttcctgggcctggagaagacctttgctgaggcccggctcatcagcgcccagcagaagaatggagtggtgatgccagaccacggcaagagaagagacaaccgcttccactgtgacctgatcaagggggacctgaaggacaagagcttcaagcagagccacaagcccctgcggagcacagatgtgtcccagaggcacctggacaacaccagggctgctgccatctggaggttccgggtcatctggcagggccctgctgcctag

SEQ ID NO: 22229 - DNA, 162 bp, Artificial Sequence
  Description of Artificial Sequence: Synthetic coding sequence
atgggcagaagaagcaccagcagcaccaagagcggcaagttcatgaaccccacagaccaggccaggaaggaggccaggaagcgggagctgaagaagaacaagaagcagaggatgatggtgcgggctgctgtgctgaagatgaaggaccccaagcagatctag

SEQ ID NO: 22230 - DNA, 1035 bp, Artificial Sequence
  Description of Artificial Sequence: Synthetic coding sequence
atgaccaccaggtctgtgctggatgtggagacctttgtggccgacatcctgaagggggagaacctgagcaagaaggccaaggagaagcgggagagcctcatcaagaagatcaaggatgtgaagagcatctacctgcaggagttccaggacaagggagatgctgaagatggagaggagtatgatgacccctttgctggccccccagacaccatcagcctggccagcgagagatatgacaaggatgatgaggcccccagtgatggagcccagttcccccccatcgccgcccaggacctgccctttgtgctgaaggccggctacctggagaagaggaggaaggaccacagcttcctgggctttgagtggcagaagcgctggtgtgccctgagcaagacagtgttctactactacggcagtgacaaggacaagcagcagaagggggagtttgccattgatggctacagcgtgaggatgaacaacaccctgaggaaggatggcaagaaggactgctgctttgagatcagcgccccagacaagaggatctaccagttcaccgctgccagccccaaggatgctgaggagtgggtgcagcagctgaagtttgtgctgcaggacatggagagtgacatcatcccagaagattatgatgagcggggggagctgtatgatgatgtggaccaccccctgcccatcagcaaccccctgaccagcagccagcccattgatgatgagatctatgaggagctgcctgaggaggaggaggacagcgcccctgtgaaggtggaggagcagaggaagatgagccaggacagcgtgcaccacaccagcggggacaagagcacagattatgccaacttctaccagggcctgtgggactgcaccggggccttcagtgatgagctgtccttcaagagaggagatgtgatctacatcctgagcaaggagtacaacagatatggctggtgggtgggggagatgaagggggccatcggcctggtgcccaaggcctacatcatggagatgtatgacatctag

SEQ ID NO: 22231 - DNA, 2868 bp, Artificial Sequence; identical to SEQ ID NO: 20349
  Description of Artificial Sequence: Synthetic coding sequence

SEQ ID NO: 22232 - DNA, 834 bp, Artificial Sequence
  Description of Artificial Sequence: Synthetic coding sequence
atgctgagccagaaggaggtggccgtggctgatgccaagaagagcctggagctgaaccccaacaacagcacagccatgctgaggaagggcatctgtgagtaccacgagaagaactatgctgctgccctggagaccttcacagagggccagaagctggacagcgcagatgccaacttctctgtgtggatcaagcgctgccaggaggcccagaatggaagtgaaagtgaggtgtggacccaccagagcaagatcaagtatgactggtaccagacagagagccaggtggtgatcaccctgatgatcaagaatgtgcagaagaatgatgtgaatgtggagttcagcgagaaggagctgagcgccctggtgaagctgcccagcggggaggactacaacctgaagctggagctgctgcaccccatcatccctgagcagagcaccttcaaggtgctgagcaccaagattgagatcaagctgaagaagccagaggccgtgcgctgggagaagctggagggccagggagatgtgcccacccccaagcagtttgtggctgatgtgaagaacctgtaccccagcagcagcccctacaccaggaactgggacaagctggtgggggagatcaaggaggaggagaagaatgagaagctggagggagatgctgccctgaacagactcttccagcagatctacagtgatggcagtgatgaggtgaagagggccatgaacaagagcttcatggagagcggcggcaccgtgctgagcaccaactggagcgatgtgggcaagaggaaggtggagatcaaccccccagatgacatggagtggaagaagtactag

SEQ ID NO: 22233 - DNA, 807 bp, Artificial Sequence
  Description of Artificial Sequence: Synthetic coding sequence
atgggcagcgccaagtctgtgcctgtgaccccagcccggcccccaccccacaacaagcacctggcccgggtggccgaccccaggagccccagcgctggcatcctgcggacccccatccaggtggagagcagcccccagcccggcctgcctgctggggagcagctggagggcctgaagcacgcccaggacagcgaccccaggagccccaccctgggcatcgcccggacccccatgaagaccagcagcggggacccccccagccccctggtgaagcagctgtctgaggtgtttgaaacagaggacagcaagagcaacctgcccccagagcctgtgctgcccccagaggcccccctgagcagcgagctggacctgcccctgggcacccagctgtctgtggaggagcagatgccaccctggaaccagacagagttccccagcaagcaggtgttcagcaaggaggaggcccggcagcccacagagacccctgtggccagccagagcagtgacaagcccagccgggaccctgagacccccaggagcagcggctccatgaggaaccgctggaagcccaacagcagcaaggtgctgggccgcagccccctgaccatcctgcaggatgacaacagccctggcaccctgaccctgcggcagggcaagaggcccagccccctgtctgaaaatgtgtctgagctgaaggagggcgccatcctgggcaccggccgcctgctgaagacaggaggccgggcctgggagcagggccaggaccatgacaaggagaaccagcacttccccctggtggagagctag

SEQ ID NO: 22234 - DNA, 1140 bp, Artificial Sequence
  Description of Artificial Sequence: Synthetic coding sequence
atggtgttcaagctgaagaccaaggaggagcagcacagcatgctgggcagcggcttcaaggccgagcggctgcgggtgaacctgcggctggtgatcaaccggctgaagctgctggagaagaagaagacagagctggcccagaaggccaggaaggagattgctgactacctggccgccggcaaggatgagcgggcccgcatccgggtggagcacatcatccgggaggactacctggtggaggccatggagatcctggagctgtactgtgacctgctgctggcccgcttcggcctcatccagagcatgaaggagctggacagcggcctggccgagagcgtgtccaccctcatctgggccgccccccggctgcagagcgaggtggccgagctgaagatcgtggccgaccagctgtgtgccaagtacagcaaggagtatggcaagctgtgcaggaccaaccagatcggcaccgtgaatgaccggctgatgcacaagctgtctgtggaggccccacccaagatcctggtggagcgctacctgattgagatcgccaagaactacaacgtgccctatgagccagacagcgtggtgatggccgaggcccctcctggggtggagacagacctgattgatgtgggcttcacagatgatgtgaagaagggcggccctggccggggcggcagcggcggcttcaccgcccctgtgggcggcccagatggcaccgtgcccatgcccatgcccatgcccatgcccatgcccagcgccaacacccccttctcctaccccctgcccaagggccccagcgacttcaacggcctgcccatgggcacctaccaggccttccccaacatccaccccccccagatcccagccaccccacccagctatgaatctgtggatgacatcaatgctgacaagaacatcagcagcgcccagatcgtgggccctggccccaagccagaggccagcgccaagctgcccagcaggcctgctgacaactatgacaactttgtgctgcctgagctgcccagcgtgcctgacaccctgcccacagccagcgctggggccagcaccagcgcctctgaagatattgactttgatgacctgagccgccgctttgaggagctgaagaagaagacctag

SEQ ID NO: 22235 - DNA, 903 bp, Artificial Sequence
  Description of Artificial Sequence: Synthetic coding sequence
atggcccggcccctgagcacccccagcagcagccagatgcaggccaggaagaagcaccggggcatcatcgagaagagaagaagagaccgcatcaacagcagcctgtctgagctgcggcggctggtgcccacagcctttgagaagcagggcagcagcaagctggagaaggccgaggtgctgcagatgacagtggaccacctgaagatgctgcacgccactggaggcaccggcttctttgatgcccgggccctggccgtggacttccgcagcatcggcttcagagaatgtctgacagaggtgatccgctacctgggcgtgctggagggccccagcagcagagctgaccctgtgcgcatccggctgctgagccacctgaacagctatgctgctgagatggagcccagccccacccccaccggccccctggccttccctgcctggccctggagcttcttccacagctgccccggcctgcctgccctgagcaaccagctggccatcctgggccgggtgcccagccctgtgctgcccggggtgagcagccctgcctaccccatcccagccctgaggacagcccccctgcggcgggccaccggcatcatcctgcctgccaggagaaatgtgctgcccagcagaggagccagcagcacccggcgggcccggcccctggagaggcctgccacccctgtgcctgtggcccccagcagccgggccgcccggagcagccacatcgcccccctgctgcagagcagcagccccaccccacctggccccactggatctgctgcctacgtggccgtgcccacccccaacagcagcagccctggccctgctggccggcctgctggggccatgctgtaccacagctgggtgtctgagatcacagaaattggagccttctag

SEQ ID NO: 22236 - DNA, 318 bp, Artificial Sequence
  Description of Artificial Sequence: Synthetic coding sequence
atgtctgtggtgccccccaacagaagccagacaggctggccccggggcgtgacccagtttggaaacaagtacatccagcagaccaagcccctgaccctggagaggaccatcaacctgtaccccctgaccaactacaccttcggcaccaaggagcccctgtatgagaaggacagctctgtggccgcccgcttccagaggatgagggaggagtttgacaagattggcatgagaagaacagtggagggcgtgctgattgtgcatgagcaccggctgccccacgtgctgctgctgagccgcttcaacttcatctacaactag

SEQ ID NO: 22237 - DNA, 588 bp, Artificial Sequence
  Description of Artificial Sequence: Synthetic coding sequence
atgggcaacagcgacagccagtacaccctgcagggcagcaagaaccacagcaacaccatcactggagccaagcagatcccctgcagcctgaagatccggggcatccacgccaaggaggagaagagcctgcacggctggggccacggcagcaatggagctggctacaagagccgcagcctggcccggagctgcctgagccacttcaagagcaaccagccctatgccagccggctgggcggccccacctgcaaggtgtcccggggcgtggcctacagcacccacaggaccaatgcccctgggaaggacttccagggcatctctgctgccttcagcacagaaaatggcttccacagcgtgggccacgagctggccgacaaccacatcaccagccgggactgcaatggccacctgctgaactgctatggaagaaatgaaagcatcgccagcaccccacctggagaggacaggaagagcccccgggtgctgatcaagaccctgggcaagctggatggctgcctgcgggtggagttccacaatggaggcaaccccagcaaggtgcctgctgaggactgcagcgagcctgtgtag

SEQ ID NO: 22238 - DNA, 1581 bp, Artificial Sequence
  Description of Artificial Sequence: Synthetic coding sequence
atggtgcctggagaggagaaccagctggtgcccaaggaggatgtgttctggcgctgccggcagaacatctttgatgagatgaagaagaagttcctgcagattgaaaatgctgctgaggagccccgggtgctgtgcatcatccaggacaccaccaacagcaagacagtgaatgaaagaatcaccctgaacctgcctgccagcacccctgtgaggaagctgtttgaagatgtggccaacaaggtgggctacatcaatggcacctttgacctggtgtggggcaatggcatcaacacagctgacatggcccccctggaccacaccagtgacaagagcctgctggatgccaactttgagcccgggaagaagaacttcctgcacctgacagacaaggatggagagcagccccagatcctgctggaggacagcagcgctggggaggacagcgtgcatgaccgcttcatcggccccctgccccgggagggcagcggcggcagcaccagtgactatgtgtcccagagctacagctacagcagcatcctgaacaagtcagaaacaggctacgtgggcctggtgaaccaggccatgacctgctacctgaacagcctgctgcagaccctcttcatgaccccagagttcagaaatgccctgtacaagtgggagtttgaggagagcgaggaggaccctgtgaccagcatcccctaccagctgcagaggctgtttgtgctgctgcagaccagcaagaagagggccatcgagaccacagatgtgaccaggagctttggctgggacagcagcgaggcctggcagcagcatgatgtgcaggagctgtgccgggtgatgtttgatgccctggagcagaagtggaagcagacagagcaggccgacctgatcaatgagctgtaccagggcaagctgaaggactatgtgcgctgcctggagtgtggctatgagggctggagaattgacacctacctggacatccccctggtgatccggccctacggcagcagccaggcctttgcctctgtggaggaggccctgcacgccttcatccagcctgagatcctggatggccccaaccagtacttctgtgagcgctgcaagaagaagtgtgatgccaggaagggcctgcgcttcctgcacttcccctacctgctgaccctgcagctgaagagatttgattttgactacaccaccatgcaccgcatcaagctgaatgacaggatgaccttccctgaggagctggacatgagcaccttcattgatgtggaggatgagaagagcccccagacagagagctgcacagattctggagcagaaaatgaaggcagctgccacagcgaccagatgagcaatgacttcagcaatgatgatggagtggatgagggcatctgcctggagaccaacagcggcacagagaagatcagcaagagcggcctggagaagaacagcctcatctatgagctgttctctgtgatggtgcacagcggcagcgctgctgggggccactactatgcctgcatcaagagctctgtgatgagcagcggcacagcctccatgatcaacatgtctgctggatag

SEQ ID NO: 22239 - DNA, 963 bp, Artificial Sequence
  Description of Artificial Sequence: Synthetic coding sequence
atgggcaaggagcaggagctgctggaggccgccaggacaggccacctgcctgctgtggagaagctgctgagcggcaagaggctgagcagcggctttggaggcggcggcggcggcggcagcggcggcggcggcggcggcagcggcggcggcggcggcggcctgggcagcagcagccaccccctgagcagcctgctgtccatgtggaggggccccaacgtgaactgtgtggacagcacaggctacacccccctgcaccacgccgccctgaatggccacaaggatgtggtggaggtgctgctgagaaatgatgccctgaccaacgtggccgacagcaagggctgctaccccctgcacctggccgcctggaagggagatgcccagatcgtgcggctgctgatccaccagggccccagccacaccagggtgaatgagcagaacaatgacaatgaaacagccctgcactgtgccgcccagtatggccacacagaggtggtgaaggtgctgctggaggagctgacagaccccaccatgaggaacaacaagtttgagacccccctggacctggccgccctgtatggccgcctggaggtggtgaagatgctgctgaatgcccaccccaacctgctgagctgcaacaccaagaagcacacccccctgcacctggccgccagaaatggccacaaggctgtggtgcaggtgctgctggatgctggcatggacagcaactaccagacagagatgggcagcgccctgcacgaggccgccctgtttgggaagacagatgtggtgcagatcctgctggccgccggcacagatgtgaacatcaaggacaaccacggcctgacagccctggacacagtgcgggagctgcccagccagaagagccagcagattgctgccctgattgaggacctggacaccctgcagttctacttcatcagctgccccttccagggcctgtag

SEQ ID NO: 22240 - DNA, 660 bp, Artificial Sequence
  Description of Artificial Sequence: Synthetic coding sequence
atggtgatccacaagaaccccccagacacccccacagagagccagttcacccgcttcctgtgcagcagccccctggaggccgagaccccacccaacggccctgactgtggctacggcagcttccaccagcagtactggctggatggcaagatcatcgctgtgggcgtgattgacatcctgcccaactgtgtgtcctctgtgtacctgtactatgaccctgactacagcttcctgagcctgggcgtgtacagcgccctgcgggagatcgccttcacccggcagctgcacgagaagaccagccagctgagctactactacatgggcttctacatccacagctgccccaagatgaagtacaagggccagtaccggcccagcgacctgctgtgcccagagacctacgtgtgggtgcccatcgagcagtgcctgcccagcctggagaacagcaagtactgccgcttcaaccaggaccctgaggccgtggatgaagatagaagcacagagccagaccggctgcaggtgttccacaagagggccatcatgccctatggagtgtacaagaagcagcagaaggaccccagcgaggaggccgctgtgctgcagtatgccagcctggtgggccagaagtgcagcgagaggatgctgctcttcaggaactag

SEQ ID NO: 22241 - DNA, 1791 bp, Artificial Sequence
  Description of Artificial Sequence: Synthetic coding sequence
atgcagcagaaggagctgggcacctttgcccagagcagcatcgccctgcaccaccagtacaaccccaagttccagaccctcttccagccctgcaacctgatgggcgccatgcagctgattgaggacttcagcacccacgtgtccattgactgcagcccccacaagacagtgaagaagacagccaatgagttcccctgcctgcccaagcaggtggcctggatcctggccaccagcaaggtgttcatgtacccagagctgctgcctgtgtgcagcctgaaggccaagaacccccaggacaagatcctcttcaccaaggccgaggacaacaagtacctgctgacctgcaagacagcccggcagctgactgtgcgcatcaagaacctgaacatgaacagagccccagacaacatcatcaagttctacaagaagaccaagcagctgcctgtgctgggcaagtgctgtgaggagatccagccccaccagtggaagccacccatcgagcgggaggagcaccggctgcccttctggctgaaggccagcctgcccagcatccaggaggagctgcggcacatggctgatggagcccgggaggtgggcaacatgacaggcaccacagagatcaacagcgaccagggcctggagaaggacaacagcgagctgggcagcgagacccgctaccccctgctgctgcccaagggcgtggtgctgaagctgaagcctgtggccgaccgcttccccaagaaggcctggaggcagaagaggagctctgtgctgaagcccctgctgatccagcccagccccagcctgcagcccagcttcaaccctgggaagaccccagcccagagcacccacagcgaggccccacccagcaagatggtgctgcgcatcccccaccccatccagcctgccaccgtgctgcagacagtgcctggggtgccccccctgggcgtgtctggaggagagagctttgagagccctgctgccctgcctgccatgcctcctgaggcccggaccagcttccccctgtctgagagccagaccctgctgagcagcgcccctgtgcccaaggtgatgatgcccagccctgccagctccatgttcaggaagccctacgtgagaagaagacccagcaagagaagaggagcccgggccttccgctgcatcaagccagcccctgtgatccacccagccagcgtcatcttcaccgtgcctgccaccaccgtgaagatcgtgtccctgggcggcggctgcaacatgatccagcctgtgaatgctgctgtggcccagagcccccagaccatccccatcgccaccctgctggtgaaccccaccagcttcccctgccccctgaaccagcccctggtggccagctctgtgagccccctgattgtgtctggcaacagcgtgaacctgcccatccccagcaccccagaggacaaggcccacatgaatgtggacatcgcctgtgctgtggctgatggagaaaatgccttccagggcctggagcccaagctggagccccaggagctgagccccctgagcgccaccgtcttccccaaggtggagcacagccctggccccccacctgtggacaagcagtgccaggagggcctgtctgagaacagcgcctaccgctggacagtggtgaagacagaggagggccggcaggccctggagcccctgccccagggcatccaggagagcctgaacaacagcagccctggggacctggaggaggtggtgaagatggagccagaagatgccacagaggagatcagcggcttcctgtag

SEQ ID NO: 22242 - DNA, 912 bp, Artificial Sequence
  Description of Artificial Sequence: Synthetic coding sequence
atggctgacaagagcaagttcatcgagtacattgatgaggccctggagaagagcaaggagacagccctgagccacctgttcttcacctaccagggcatcccctaccccatcaccatgtgcaccagcgagaccttccaggccctggacacctttgaggcccggcatgatgacatcgtgctggccagctaccccaagtgtggcagcaactggatcctgcacatcgtgtctgagctgatctatgctgtgtccaagaagaagtacaagtacccagagttccctgtgctggagtgtggggacagcgagaagtaccagaggatgaagggcttccccagcccccgcatcctggccacccacctgcactatgacaagctgcccggcagcatctttgagaacaaggccaagatcctggtgatcttcaggaaccccaaggacacagctgtgtccttcctgcacttccacaatgatgtgcctgacatccccagctatggctcctgggatgagttcttccggcagttcatgaagggccaggtgtcctggggccgctactttgattttgccatcaactggaacaagcacctggatggagacaacgtgaagttcatcctgtatgaggacctgaaggagaacctggccgccggcatcaagcagattgctgagttcctgggcttcttcctgaccggggagcagatccagaccatctctgtgcagagcaccttccaggccatgagggccaagagccaggacacccacggggctgtgggccccttcctgttcaggaagggggaggtgggggactggaagaacctcttcagcgagatccagaaccaggagatggatgagaagttcaaggagtgcctggccggcaccagcctgggcgccaagctgaagtatgagagctactgccagggctag

SEQ ID NO: 22243 - DNA, 366 bp, Artificial Sequence
  Description of Artificial Sequence: Synthetic coding sequence
atgggcgtgcctgagatccctggagagaagctggtgacagaaagaaacaagaagaggctggagaaggagaagcatgagaagggggcccagaagacagactgccagaagaacctgggcaccgtgggcgctgtggccctggactgcaagggaaatgtggcctatgccaccagcactggaggcatcgtgaacaagatggtgggccgggtgggggacagcccctgcctgggccgcaccaagggctgcctgctgcccctgcccctcttcagccggccccaggccttcctgaccctgtacagcctgcccctgtctgtgtcctgctgcgtgcccttcctgctgctggtgcagctgcaggatgtgtgggagtag

SEQ ID NO: 22244 - DNA, 579 bp, Artificial Sequence
  Description of Artificial Sequence: Synthetic coding sequence
atgaccctgggcagcaagagccagcagcccccagaggacatcaaggccctgtcctggaaccggcaggcccagcacatcctgagcagcgcccaccccagcggcaaggctgtggtgtgggacctgaggaagaatgagcccatcatcaaggtgtctgaccacagcaacaggatgcactgcagcggcctggcctggcacccagacatcgccacccagctggtgctgtgcagtgaagatgaccggctgcccgtcatccagctgtgggacctgcgctttgccagcagccccctgaaggtgctggagagccacagccggggcatcctgtctgtgtcctggagccaggctgatgctgagctgctgctgaccagcgccaaggacagccagatcctgtgcaggaacctgggcagcagcgaggtggtgtacaagctgcccacccagagctcctggtgctttgatgtgcagtggtgcccccgggaccccagcgtcttctctgctgccagcttcaacggctggatcagcctgtacagcgtgatgggccgctcctgggaggtgcagcacatgaggcaggccgacaaggtgtag

SEQ ID NO: 22245 - DNA, 621 bp, Artificial Sequence
  Description of Artificial Sequence: Synthetic coding sequence
atgaaggatgtggacaacctgaagagcatcaaggaggagtgggtgtgtgagaccggcagtgacaaccagcccctgggcaacaaccagcagagcaactgtgagtactttgtggacagcctgtttgaggaggcccagaaggtgagcagcaaatgtgtgtccccagctgagcagaagaagcaggtggatgtgaacatcaagctgtggaagaatggcttcaccgtgaatgatgacttccgcagctacagtgatggagccagccagcagttcctgaacagcatcaagaagggggagctgcccagcgagctgcagggcatctttgacaaggaggaggtggatgtgaaggtggaggacaagaagaatgagatctgcctgagcaccaagcctgtgttccagcccttcagcggccagggccaccggctgggccgggtgagccacatcaaggacttcatcgagaagtaccagggcagccagaggagcccccccttcagcctggccacagccctgcctgtgctgcggctgctggatgagaccctgaccctggaggaggccgacctgcagaatgctgtgatcatccagaggctgcagaagacagccagcttccgggagctgtctgagcactag

SEQ ID NO: 22246 - DNA, 1359 bp, Artificial Sequence
  Description of Artificial Sequence: Synthetic coding sequence
atgaggggctgcagctatggcctgtgccggcggggcctgctcttctgtgtgatcctggatgaccagagcggcaagaagtctgtgaatgacaagaacctgaagaagacagtggaggatgaggaccaggacagcgaggaggagaaggacaatgacagctacatcaaggagaggagtgacatccccagcggcaccagcaagcacctgcagaagaaggccaagaagcaggccaagaagcaggccaagaaccagaggcggcagcagaagatccagggcaaggtgctgcacctgaatgacatctgcaccatcgaccaccctgaggacagtgaatatgaggccgagatgagcctgcagggcgaggtgaacatcaagagcaaccacatcagccaggagggcgtgatgcacaaggagtactgtgtgaaccagaaggacctgaatggccaggccaagatgattgaatctgtgacagacaaccagaagagcacagaggaggtggacatgaagaacatcaacatggacaatgacctggaggtgctgaccagcagccccaccaggaacctgaatggagcctacctgacagagggcagcaatggagaggtggacatcagcaatggcttcaagaacctgaacctgaatgctgccctgcacccagatgagatcaacatcgagatcctgaatgacagccacaccccaggcaccaaggtgtatgaggtggtgaatgaagatcctgagacagccttctgcaccctggccaaccgggaggtgttcaacacagatgaatgttccatccagcactgcctgtaccagttcaccagaaatgagaagctgagagatgccaacaagctgctgtgtgaggtgtgcacccggcggcagtgcaatggccccaaggccaacatcaagggggagaggaagcacgtgtacaccaatgccaagaagcagatgctgatcagcctggcccctcctgtgctgaccctgcacctgaagcgcttccagcaggccggcttcaacctgaggaaggtgaacaagcacatcaagtttcctgagatcctggacctggcccccttctgcaccctgaagtgcaagaatgtggccgaggagaacaccagggtgctgtacagcctgtatggagtggtggagcacagcggcaccatgaggagcggccactacacagcctatgccaaggccaggacagccaacagccacctgagcaacctggtgctgcatggagacatcccccaggactttgagatggagagcaagggccagtggttccacatcagtgacacccacgtgcaggccgtgcccaccaccaaggtgctgaacagccaggcctacctgctcttctatgaaagaatcctgtag

SEQ ID NO: 22247 - DNA, 450 bp, Artificial Sequence
  Description of Artificial Sequence: Synthetic coding sequence
atggagcgcatcgagggcgcctctgtgggccgctgtgccgccagcccctacctgcggcccctgaccctgcactaccggcagaatggagcccagaagtcctgggacttcatgaagacccatgacagcgtgacagtgctgctcttcaacagcagccgccgcagcctggtgctggtgaagcagttccggcctgctgtgtatgctggggaggtggagcggcgcttccctggcagcctggccgctgtggaccaggacggcccccgggagctgcagcctgccctgcccggcagcgctggggtgacagtggagctgtgtgccggcctggtggaccagcccggcctgagcctggaggaggtggcctgcaaggaggcctgggaggagtgtggctaccacctggcccccagcgacctgcggcgggtggccacctactgggatgccaccatgggcagctag

SEQ ID NO: 22248 - DNA, 489 bp, Artificial Sequence
  Description of Artificial Sequence: Synthetic coding sequence
atgaacagcaatgccagcgagcacacaggcatgctgcggacctgctggagccacagccactgggaccccttcagcagcggctctgtgacagccatgtgggccacccacagccccaccagcaaggcctgggccggcatccagggccggggccgctgggccctgggcttcccctggaggggccagggcgtgctgcacgtgattgccagccagaaggctgctgtgacagaagctgtggacctgaggactggagctgccagccaggccatgtctgaggcctttgtgcgcagcggcatgttctacctgcggcctgcctttgtgctgctgtgctacaagtggggcaagctgcggcacagcgaggtgagcaacctgctgggcgtggcctggcctgtgtctgaggaggcctgcatgggcacctggggcagcctggccgtggccgtgaccctgcctgcccagggcctgggcacctggggcagagatgaaggagagtag

SEQ ID NO: 22249 - DNA, 1320 bp, Artificial Sequence; identical to SEQ ID NO: 20037
  Description of Artificial Sequence: Synthetic coding sequence

SEQ ID NO: 22250 - DNA, 867 bp, Artificial Sequence
  Description of Artificial Sequence: Synthetic coding sequence
atggccaagtggggcgagggggacccccgctggatcgtggaggagcgggcagatgccaccaacgtgaacaactggcactggacagaaagagatgccagcaactggagcacagacaagctgaagaccctcttcctggccgtgcaggtgcagaatgaggagggcaaatgtgaggtgacagaggtgtccaagctggatggagaggccagcatcaacaacaggaagggcaagctgatcttcttctatgagtggagcgtgaagctgaactggacaggcaccagcaagtctggagtgcagtacaagggccacgtggagatccccaacctgagtgatgaaaattctgtggatgaggtggagatctctgtgtccctggccaaggatgagccagacaccaacctggtggccctgatgaaggaggagggcgtgaagctgctgcgggaggccatgggcatctacatcagcaccctgaagacagagttcacccagggcatgatcctgcccaccatgaatggagagagcgtggaccctgtgggccagcctgccctgaagacagaggagaggaaggccaagccagcccccagcaagacccaggcccggcctgtgggcgtgaagatccccacctgcaagatcaccctgaaggagaccttcctgaccagccctgaggagctgtacagagtcttcaccacccaggagctggtgcaggccttcacccacgccccagccaccctggaggccgacagaggaggcaagttccacatggtggatggaaatgtgtctggagagttcacagacctggtgcctgagaagcacatcgtgatgaagtggaggttcaagtcctggccagagggcagccactgccacagcggctag

SEQ ID NO: 22251 - DNA, 1053 bp, Artificial Sequence
  Description of Artificial Sequence: Synthetic coding sequence
atgcccagcttcatcagacatggccccaccatccccaggagaacagacatctgcctgcctgacagcagccccaatgccttcagcaccagcggagatgtggtgtccaggaaccagagcttcctgcggacccccatccagaggacccctcatgagatcatgaggcgggagagcaaccggctgagcgcccccagctacctggcccggagcctggctgatgtgccccgggagtatggcagcagccagagctttgtgacagaggtgtcctttgctgtggagaatggagacagcggcagccgctactactacagcgacaacttctttgatggccagaggaagaggcccctgggggaccgggcccacgaggactaccgctactatgagtacaaccacgacctcttccagaggatgccccagaaccagggcagacatgccagcggcatcggccgggtggccgccaccagcctgggcaacctgaccaaccacggcagcgaggacctgcccctgcccccaggctggagcgtggactggaccatgaggggcaggaagtactacatcgaccacaacaccaacaccacccactggagccaccccctggagcgggagggcctgcccccaggctgggagcgggtggagagcagcgagtttggcacctactacgtggaccacaccaacaagaaggcccagtaccgccacccctgtgcccccagcgtgcccaggtatgaccagcccccacctgtgacctaccagccccagcagacagaaagaaaccagagcctgctggtgcctgccaacccctaccacacagctgagatcccagactggctgcaggtgtatgcccgggcccctgtgaagtatgaccacatcctgaagtgggagctgttccagctggccgacctggacacctaccagggcatgctgaagctgctcttcatgaaggagctggagcagatcgtgaagatgtatgaggcctaccggcaggccctgctgacagagctggagaacaggaagcagaggcagcagtggtacgcccagcagcacggcaagaacttctag

SEQ ID NO: 22252 - DNA, 537 bp, Artificial Sequence
  Description of Artificial Sequence: Synthetic coding sequence
atgaccttccgggagggccaccagtgggagaagatccccctgagcggcagcaaccaggagatccggcggcagaaggagcgcatcacagagcagcccctgaaggaggaggaggatgaggacaggaagaacaagggccaccaggccgctgagattgagtggctgggcttcaggaagcccagccaggccgacatgctgcacagcaagcatgatgaggagcagaaggtgtgggatgaggagattgatgatgatgatgatgacaactgcaacaatgatgaagatgaggtgcgggtcatcgagttcaagaagaagcatgaggaggtgtcccagttcaaggaggagggagatgccagcgaggacagccccctgagcagcgccagcagccaggccgtgaccccagatgagcagcccaccctgggcaagaagagtgacatcagcagaaatgcctacagccgctacaacaccatctcctacaggaagatcaggaagggcaacaccaagcagagaattgatgaatttgagagcatgatgcacctgtag

SEQ ID NO: 22253 - DNA, 312 bp, Artificial Sequence
  Description of Artificial Sequence: Synthetic coding sequence
atggccgccttcaagctggacttcctgcctgagatgatggtggaccactgcagcctgaacagcagccctgtgtccaagaagatgaatggcaccctggaccacccagaccagcctgacctggatgccatcaagatgtttgtgggccaggtgcccaggacctggagcgagaaggacctgcgggagctgtttgagcagtacggggctgtgtatgagatcaacgtgctgcgggacaggagccagaaccccccccagagcaagggctgctgctttgtgaccttctacaccaggaaggccgccctggaggcccagtag

SEQ ID NO: 22254 - DNA, 1917 bp, Artificial Sequence
  Description of Artificial Sequence: Synthetic coding sequence
atgccacccatcaacctgcaggagaagcaggtgatctgcctgtctggagatgacagcagcacctgcatcggcatcctggccaaggaggtggagatcgtggccagcagtgacagcagcatcagcagcaaggcccggggcagcaacaaggtgaagatccagcctgtggccaagtatgactgggagcagaagtactactacggcaacctgattgctgtgagcaacagcttcctggcctatgccatccgggccgccaacaacggcagcgccatggtgcgggtcatctctgtgtccaccagcgagaggaccctgctgaagggcttcaccggctctgtggccgacctggcctttgcccacctgaacagcccccagctggcctgcctggatgaggccggcaacctgtttgtgtggaggctggccctggtgaatggcaagatccaggaggagatcctggtgcacatccggcagcctgagggcacccccctgaaccacttccgccgcatcatctggtgccccttcatccctgaggagagcgaggactgctgtgaggagagcagccccaccgtggccctgctgcatgaagatagagctgaggtgtgggacctggacatgctgcggagcagccacagcacctggcctgtggatgtgtcccagatcaagcagggcttcatcgtggtgaagggccacagcacctgcctgtctgagggcgccctgagcccagatggcaccgtgctggccacagccagccatgatggctacgtgaagttctggcagatctacatcgagggccaggatgagccccgctgcctgcacgagtggaagccccatgatggccggcccctgagctgcctgctcttctgtgacaaccacaagaagcaggaccctgatgtgcccttctggaggttcctgatcaccggggctgaccagaaccgggagctgaagatgtggtgcaccgtgtcctggacctgcctgcagaccatccgcttctccccagacatcttcagctctgtgtctgtgccccccagcctgaaggtgtgcctggacctgtctgctgagtacctgatcctgagtgatgtgcagaggaaggtgctgtatgtgatggagctgctgcagaaccaggaggagggccacgcctgcttcagcagcatcagcgagttcctgctgacccaccctgtgctgagctttggcatccaggtggtgagccgctgccgcctgcggcacacagaggtgctgcctgctgaggaggagaatgacagcctgggcgcagatggcacccatggagctggggccatggagagcgctgctggggtgctgatcaagctgttctgtgtgcacaccaaggccctgcaggatgtgcagatccgcttccagccccagctgaacccagatgtggtggcccccctgcccacccacacagcccacgaggacttcaccttcggggagagcaggcctgagctgggcagcgagggcctgggcagcgctgcccacggcagccagcctgacctgcggcgcatcgtggagctgcctgccccagctgacttcctgagcctgagcagcgagaccaagcccaagctgatgaccccagatgccttcatgacccccagcgccagcctgcagcagatcacagccagccccagcagcagcagcagcggcagcagcagcagcagcagcagcagcagcagcagcctgacagctgtgtctgccatgagcagcaccagcgctgtggaccccagcctgaccaggcctcctgaggagctgaccctgagccccaagctgcagctggatggcagcctgaccatgagcagcagcggcagcctgcaggccagcccccggggcctgctgcccggcctgctgcctgccccagctgacaagctgacccccaagggccctggccaggtgtgtgactgggtgtgtgtgtag

SEQ ID NO: 22255 - DNA, 495 bp, Artificial Sequence
  Description of Artificial Sequence: Synthetic coding sequence
atgaggatcctgatcctgggcctggatggagctgggaagaccaccatcctgtaccgcctgcaggtgggggaggtggtgaccaccatccccaccatcggcttcaacgtggagaccgtgacctacaagaacctgaagttccaggtgtgggacctgggcggccagaccagcatccggccctactggcgctgctactacagcaacacagatgctgtgatctacgtggtggacagctgtgaccgggacagaattggcatcagcaagtctgagctggtggccatgctggaggaggaggagctgaggaaggccatcctggtggtgtttgccaacaagcaggacatggagcaggccatgaccagcagcgagatggccaacagcctgggcctgcctgccctgaaggacaggaagtggcagatcttcaagaccagcgccaccaagggcaccggcctggatgaggccatggagtggctggtggagaccctgaagagccggcagtag

SEQ ID NO: 22256 - DNA, 1944 bp, Artificial Sequence
  Description of Artificial Sequence: Synthetic coding sequence
atggcccagggctctgtgtccttcaatgatgtgacagtggacttcacccaggaggagtggcagcacctggaccacgcccagaagaccctgtacatggatgtgatgctggagaactactgccacctgatctctgtgggctgccacatgaccaagccagatgtgatcctgaagctggagcggggggaggagccctggaccagctttgctggccacacctgcctggaggagaactggaaggccgaggacttcctggtgaagttcaaggagcaccaggagaagtacagccgctctgtggtgtccatcaaccacaagaagctggtgaaggagaagagcaagatctatgagaagaccttcaccctgggcaagaaccctgtgaacagcaagaacctgcccccagaatatgacacccacggccgcatcctgaagaatgtgtctgagctgatcatcagcaacctgaacccagccaggaagaggctgtctgagtacaacggctacggcaagagcctgctgagcaccaagcaggagaccacccaccctgaggtgaagagccacaaccagagcgcccgggccttcagccacaatgaggtgctgatgcagtaccagaagacagagaccccagcccagagctttggctacaatgactgtgagaagagcttcctgcagagaggaggcctcatcacccacagccggccctacaagggggagaaccccagcgtgtacaacaagaagaggcgggccaccaacatcgagaagaagcacacctgcaatgaatgtgggaagagcttctgcaggaagtctgtgctgatcctgcaccagggcatccacagcgaggagaagccctaccagtgccaccagtgtggaaatgccttccggaggaagagctacctgattgaccaccagaggacccacactggagagaagccctttgtgtgcaatgaatgtgggaagagcttccggctgaagacagccctgacagaccaccagaggacccacactggagagaagagctatgagtgcctgcagtgcagaaatgccttccggctgaagagccacctgatccgccaccagaggacccacactggagagaagccctatgagtgcaatgactgtgggaagagcttccggcagaagaccaccctgagcctgcaccagaggatccacactggagagaagccctacatctgcaaggaatgtgggaagagcttccaccagaaggccaacctgactgtgcaccagaggacccacactggagagaagccctacatctgcaatgaatgtgggaagagcttcagccagaagaccaccctggccctgcacgagaagacccacaatgaggagaagccctacatctgcagtgaatgtgggaagagcttccggcagaagaccaccctggtggcccaccagaggacccacactggagagaagagctatgagtgcccccactgtgggaaggccttcaggatgaagagctacctgattgaccaccacaggacccacactggagagaagccctatgagtgcaatgaatgtgggaagagcttcagccagaagaccaacctgaacctgcaccagaggatccacactggagagaagccctacgtgtgcaatgaatgtgggaagagcttccggcagaaggccaccctgactgtgcaccagaagatccacacaggccagaagagctatgagtgcccccagtgtgggaaggccttcagcaggaagagctacctgatccaccaccagaggacccacactggagagaagccctacaagtgcagtgaatgtgggaagtgcttccggcagaagaccaacctgattgtgcaccagaggacccacactggagagaagccctacgtgtgcaatgaatgtgggaagagcttctcctacaagaggaacctgattgtgcaccagaggacccacaagggggagaacatcgagatgcagtag

SEQ ID NO: 22257 - DNA, 3570 bp, Artificial Sequence
  Description of Artificial Sequence: Synthetic coding sequence
atgaagctggagtgcatcccagcccccatcacccccagcacagtgcccagcttcccccccaccccacccaccccaccagccagccccccccacacccctgtgattgtgcctgctgctgccaccaccgtgagcagccccagcgctgccatcaccgtgcagagggtgctggaggaggatgagagcatccgcacctgcctgtctgaagatgccaaggagatccagaacaagattgaggtggaggctgatggccagacagaggagatcctggacagccagaacctgaacagcagaagaagccctgtgcctgcccagatcgccatcaccgtgcccaagacctggaagaagcccaaggacaggaccaggaccacagaggagatgctggaggccgagctggagctgaaggccgaggaggagctgagcattgacaaggtgctggagagcgagcaggacaagatgagccagggcttccaccctgagcgggaccccagcgacctgaagaaggtgaaggctgtggaggagaatggagaggaggccgagcctgtgagaaatggagctgagagcgtgtctgagggggagggcattgatgccaacagcggcagcacagacagcagtggagatggagtgaccttccccttcaagccagagagctggaagcccacagacacagagggcaagaagcagtatgaccgggagttcctgctggacttccagttcatgcctgcctgcatccagaagccagagggcctgccccccatcagtgatgtggtgctggacaagatcaaccagcccaagctgcccatgaggaccctggacccccgcatcctgccccggggccctgacttcaccccagcctttgctgactttggccggcagaccccaggcggccggggcgtgcccctgctgaatgtgggcagccgccgcagccagcccggccagaggcgggagcccaggaagatcatcaccgtgtctgtgaaggaggatgtgcacctgaagaaggccgagaatgcctggaagcccagccagaagagggacagccaggctgatgatcctgagaacatcaagacccaggagctgttcaggaaggtgcgcagcatcctgaacaagctgaccccccagatgttcaaccagctgatgaagcaggtgtctggcctgactgtggacacagaggagcggctgaagggcgtcatcgacctggtgtttgagaaggccattgatgagcccagcttctctgtggcctatgccaacatgtgccgctgcctggtgaccctgaaggtgcccatggctgacaagccaggcaacacagtgaacttcaggaagctgctgctgaaccgctgccagaaggagtttgagaaggacaaggcagatgatgatgtgtttgagaagaagcagaaggagctggaggccgccagcgcccctgaggagaggacccggctgcatgatgagctggaggaggccaaggacaaggccaggagaagaagcatcggcaacatcaagttcatcggggagctgttcaagctgaagatgctgacagaggccatcatgcatgactgtgtggtgaagctgctgaagaaccatgatgaggagagcctggagtgcctgtgccgcctgctgaccaccatcggcaaggacctggactttgagaaggccaagcccaggatggaccagtacttcaaccagatggagaagatcgtgaaggagaggaagaccagcagccgcatccgcttcatgctgcaggatgtgattgacctgcggctgtgcaactgggtgtccagaagagctgaccagggccccaagaccatcgagcagatccacaaggaggccaagattgaggagcaggaggagcagaggaaggtgcagcagctgatgaccaaggagaagagaagacctggggtgcagagggtggatgaaggaggctggaacacagtgcagggcgccaagaacagccgggtgctggaccccagcaagttcctgaagatcaccaagcccaccattgatgagaagatccagctggtgcccaaggcccagctgggctcctggggcaagggcagcagcggcggggccaaggccagcgagacagatgccctgcggagcagcgccagcagcctgaaccgcttcagcgccctgcagcccccagcccccagcggcagcacccccagcacccctgtggagtttgacagcaggaggaccctgaccagccggggctccatgggccgggagaagaatgacaagcccctgcccagcgccacagcccggcccaacaccttcatgaggggcggcagcagcaaggacctgctggacaaccagagccaggaggagcagaggcgggagatgctggagaccgtgaagcagctgactggaggagtggatgtggagaggaacagcacagaagctgagaggaacaagacccgggagagcgccaagccagagatcagcgccatgtctgcccatgacaaggccgccctgtctgaggaggagctggagaggaagagcaagagcatcattgatgagttcctgcacatcaatgacttcaaggaggccatgcagtgtgtggaggagctgaatgcccagggcctgctgcacgtgtttgtgcgggtgggcgtggagagcaccctggagaggagccagatcacccgggaccacatgggccagctgctgtaccagctggtgcagagcgagaagctgagcaagcaggacttcttcaagggcttcagcgagaccctggagctggctgatgacatggccatcgacatcccccacatctggctgtacctggccgagctggtgacccccatgctgaaggagggcggcatctccatgagggagctgaccatcgagttcagcaagcccctgctgcctgtgggccgggccggcgtgctgctgtctgagatcctgcacctgctgtgcaagcagatgagccacaagaaggtgggcgccctgtggagggaggccgacctgtcctggaaggacttcctgcctgaaggagaagatgtgcacaacttcctgctggagcagaagctggacttcattgaaagtgacagcccctgcagcagcgaggccctgagcaagaaggagctgtctgctgaggagctgtacaagaggctggagaagctgatcatcgaggacaaggccaatgatgagcagatctttgactgggtggaggccaacctggatgagatccagatgagcagccccaccttcctgcgggccctgatgacagctgtgtgcaaggccgccatcatcgctgacagcagcaccttccgggtggacacagctgtgatcaagcagagggtgcccatcctgctgaagtacctggacagcgacacagagaaggagctgcaggccctgtatgccctgcaggccagcatcgtgaagctggaccagcctgccaacctgctgaggatgttctttgactgcctgtatgatgaggaggtgatcagtgaagatgccttctacaagtgggagagcagcaaggaccctgctgagcagaatggaaaaggagtggccctgaagtctgtgacagccttcttcacctggctgcgggaggccgaggaggagagcgaggacaactag

SEQ ID NO: 22258 - DNA, 591 bp, Artificial Sequence
  Description of Artificial Sequence: Synthetic coding sequence
atgtggagcgtgctgcaggacggccccatcagcagggtcatcgtgttcagcctgtctgctgccaaggagaccaaggaccggcccctgcaggatgagtacagcgtgctggtggcctccatgctggagcctgctgtggtgtacagagacctgctgaacagaggcctggaggaccagctgctgctgcccggcagtgaccagtttgattctgtgctgtgcagcctggtgacagatgtggacctggatggccggcctgaggtgctggtggccacctacggccaggagctgctgtgctacaagtaccggggccctgagagcggcctgcctgaggcccagcacggcttccacctgctgtggcagaggagcttcagcagccccctgctggccatggcccacgtggacctgactggagatggcctgcaggagctggccgtggtgtccctgaagggcgtgcacatcctgcagcacagcctcatccaggccagcgagctggtgctgacccggctgcggcaccaggtggagcagaggagaagaaggctgcagggcctggaggatggagctggggccggccctgcagaaaatgctgccagctag

SEQ ID NO: 22259 - DNA, 1056 bp, Artificial Sequence
  Description of Artificial Sequence: Synthetic coding sequence
atggtgagccacaccttccacatgaggacagaggagagtgatgccagccaggagggagatgacctgcccaagagcagcgccaacaccagccaccccaagcaggatgacagccccaagagcagcgaggagaccatccagcccaaggagggggacatccccaaggcccctgaggagaccatccagagcaagaaggaggacctgcccaagagcagcgagaaggccatccagcccaaggagagcaacatccccaagagcagcgccaagcccatccagcccaagctgggcaacatccccaagacctctgtgaagcccagccagcccaaggagagtgacatccccaagagccctgaggaggccatccagcccaaggagggggacatccccaagagcctggaggaggccatccagcccaaggagggggacatccccaagagccctgaggagaccatccagcccaagaagggggacatccccaagagccctgaggaggccatccagcccaaggagggggacatccccaagagccccaagcaggccatccagcccaaggagggggacatccccaagagcctggaggaggccatcccccccaaggagattgacatccccaagagccctgaggagaccatccagcccaaggaggatgacagccccaagagcctggaggaggccacccccagcaaggagggggacatcctgaagccagaggaggagaccatggagttccctgagggggacaaggtgaaggtgatcctgagcaaagaagattttgaggccagcctgaaggaggccggggagcggctggtggccgtggacttcagcgccacctggtgtggcccctgcaggaccatccggcccttcttccacgccctgtctgtgaagcatgaagatgtggtgttcctggaggtggatgctgacaactgtgaggaggtggtgcgggagtgtgccatcatgtgtgtgcccaccttccagttctacaagaaggaggagaaggtggatgagctgtgtggggccctgaaggagaagctggaggccgtgattgctgagctgaagtag

SEQ ID NO: 22260 - DNA, 1473 bp, Artificial Sequence
  Description of Artificial Sequence: Synthetic coding sequence
atgccagatggcaagatccagaagctgatcatcacagaggagacagccaagatccggccctttgctgtggccgctgtgctgaggaacatcaagttcaccaaggacagatatgacagcttcatcgagctgcaggagaagctgcaccagaacatctgcaggaagagggccctggtggccatcggcacccatgacctggacaccctgagcggccccttcacctacacagccaagaggcccagcgacatcaagttcaagcccctgaacaagaccaaggagtacacagcctgtgagctgatgaacatctacaagacagacaaccacctgaagcactacctgcacatcatcgagaacaagcccctgtaccctgtgatctatgacagcaatggagtggtgctgtccatgccacccatcatcaatggagaccacagccgcatcaccgtgaacaccaggaacatcttcattgaatgtactggaacagacttcaccaaggccaagatcgtgctggacatcatcgtgaccatgttcagcgagtactgtgagaaccagttcaccgtggaggccgctgaggtggtgttccccaacgggaagagccacaccttccctgagctggcctacaggaaggagatggtgcgggctgacctgatcaacaagaaggtgggcatccgggagaccccagagaacctggccaagctgctgaccaggatgtacctgaagtctgaggtgattggagatggcaaccagatcgagattgagatcccccccaccagggctgacatcatccacgcctgtgacatcgtggaggatgctgccatcgcctacggctacaacaacatccagatgaccctgcccaagacctacaccatcgccaaccagttccccctgaacaagctgacagagctgctgcggcatgacatggctgctgctggcttcacagaggccctgacctttgccctgtgcagccaggaggacattgctgacaagctgggcgtggacatcagcgccaccaaggctgtgcacatcagcaaccccaagacagctgagttccaggtggcccggaccaccctgctgcccggcctgctgaagaccatcgccgccaacaggaagatgcccctgcccctgaagctgtttgagatcagtgacatcgtcatcaaggacagcaacacagatgtgggcgccaagaactaccgccacctgtgtgctgtgtactacaacaagaaccctggctttgagatcatccacggcctgctggaccgcatcatgcagctgctggatgtgcccccaggagaagataaaggaggctacgtgatcaaggccagcgagggccctgccttcttccctggccgctgtgccgagatctttgcccggggccagagcgtgggcaagctgggcgtgctgcacccagatgtgatcaccaagtttgagctgaccatgccctgcagcagcctggagatcaacgtgggccccttcctgtag

SEQ ID NO: 22261 - DNA, 1458 bp, Artificial Sequence; identical to SEQ ID NO: 20337
  Description of Artificial Sequence: Synthetic coding sequence

SEQ ID NO: 22262 - DNA, 204 bp, Artificial Sequence
  Description of Artificial Sequence: Synthetic coding sequence
atggccctgctggccgagcacctgctgaagcccctgcctgctgacaagcagatcgagaccggccccttcctggaggccgtgagccacctgccccccttctttgactgcctgggcagccctgtgttcacccccatcaaggctgacatcagcggcaacatcaccatgaggaagctgcggctgcggggcgtggagggcctggcctag

SEQ ID NO: 22263 - DNA, 816 bp, Artificial Sequence
  Description of Artificial Sequence: Synthetic coding sequence
atctgtgagcgcatccgcagcacagtggatgagaaggagcagaagcagctgctgatggacctggatgtggtgatgaggagcagtgactgcccctacatcgtgcagttctatggagccctcttccgggagggggactgctggatctgcatggagctgatgagcaccagctttgacaagttctacaagtatgtgtacagcgtgctggatgatgtgattcctgaggagatcctgggcaagatcaccctggccaccgtgaaggccctgaaccacctgaaggagaacctgaagatcatccaccgggacatcaagcccagcaacatcctgctggacaggagcggcaacatcaagctgtgtgactttggcatcagcggccagctggtggacagcatcgccaagaccagagatgctggctgccggccctacatggcccctgagagaattgaccccagcgccagccggcagggctatgatgtgcggagtgatgtgtggagcctgggcatcaccctgtatgagctggccaccggccgcttcccctaccccaagtggaacagcgtgtttgaccagctgacccaggtggtgaagggggaccccccccagctgagcaacagcgaggagcgggagttcagccccagcttcatcaactttgtgaacctgtgcctgaccaaggatgagagcaagaggcccaagtacaaggagctgctgaagcaccccttcatcctgatgtatgaggagagagctgtggaggtggcctgctacgtgtgcaagatcctggaccagatgcctgccacccccagcagccccatgtatgtggactag

SEQ ID NO: 22264 - DNA, 291 bp, Artificial Sequence
  Description of Artificial Sequence: Synthetic coding sequence
atgtctgagaaggtggactggctgcagagccagaatggagtgtgcaaggtggatgtgtacagccctggggacaaccaggcccaggactggaagatggacaccagcacagatcctgtgcgggtgctgtcctggctgcggcgggacctggagaagagcacagctgagttccaggatgtgcgcttcaagccaggagagagctttggaggagagaccagcaacagcggggacccccacaagggcttctctgtggactactacaacaccaccaccaagggcaccccagagaggtag

SEQ ID NO: 22265 - DNA, 792 bp, Artificial Sequence; identical to SEQ ID NO: 18943
  Description of Artificial Sequence: Synthetic coding sequence

SEQ ID NO: 22266 - DNA, 867 bp, Artificial Sequence; identical to SEQ ID NO: 18941
  Description of Artificial Sequence: Synthetic coding sequence

SEQ ID NO: 22267 - DNA, 549 bp, Artificial Sequence; identical to SEQ ID NO: 20398
  Description of Artificial Sequence: Synthetic coding sequence

SEQ ID NO: 22268 - DNA, 999 bp, Artificial Sequence
  Description of Artificial Sequence: Synthetic coding sequence
atggaccagcctgctggcctgcaggtggactatgtgttccggggcgtggagcacgctgtgcgggtgatggtgtctggccaggtgctggagctggaggtggaggacaggatgacagctgaccagtggagaggagaatttgatgctggcttcatcgaggacctgacccacaagacaggcaacttcaagcagttcaacatcttctgccacatgctggagagcgccctgacccagagcagcgagagcgtgaccctggacctgctgacctacacagacctggagagcctgaggaacaggaagatgggcggccggcccggcagcctggcccccaggtctgcccagctgaacagcaagcgctacctgatcctgatctacagcgtggagtttgaccgcatccactaccccctgcccctgccctaccagggcaagccagaccctgtggtgctgcagggcatcatccgcagcctgaaggaggagctgggccgcctgcagggcctggatggccagaacacccgggacaccagagaaaatgagatctggcacctgcgggagcagcagcagcagaggaaccggctgggcagcggcggcagcggagatggccccagcgtgtcctggagccggcagacccagcccccagctgccctgaccggcagaggagatgcccccaacagaagcaggaacagaagcagctctgtggacagcttccgcagccgctgcagcagcgccagcagctgcagcgacctggaggacttcagcgagagcctgagcagaggaggccacagaagaagaggcaagccacccagccccaccccctggagcggcagcaacatgaagagcccccctgtggagaggagccaccaccagaagagcctggccaacagcggcggctgggtgcccatcaaggagtacagcagcgagcaccaggccgctgacatggccgagattgatgcccggctgaaggccctgcaggagtacatgaaccggctggacatgaggagctag

SEQ ID NO: 22269 - DNA, 516 bp, Artificial Sequence
  Description of Artificial Sequence: Synthetic coding sequence
atgagcagcaagaggaccaagaccaagaccaagaagaggccccagagggccaccagcaatgtgtttgccatgtttgaccagagccagatccaggagttcaaggaggccttcaacatgattgaccagaacagagatggcttcatcgacaaggaggacctgcatgacatgctggccagcctgggcaagaaccccacagatgagtacctggatgccatgatgaatgaggcccctggccccatcaacttcaccatgttcctgaccatgtttggagagaagctgaatggaacagatcctgaagatgtgatcagaaatgcctttgcctgctttgatgaggaggccaccggcaccatccaggaggactacctgcgggagctgctgaccaccatgggagaccgcttcacagatgaggaggtggatgagctgtaccgggaggcccccatcgacaagaagggcaacttcaactacatcgagttcacccgcatcctgaagcacggggccaaggacaaggatgactag

SEQ ID NO: 22270 - DNA, 2391 bp, Artificial Sequence
  Description of Artificial Sequence: Synthetic coding sequence
atgagcctggatgacaacctgagcggcaccagcggcatggaggtggatgacagagtgtctgccctggagcagaggctgcagctgcaggaggatgagctggccgtgctgaaggccgccctggctgatgccctgcggcggctgcgggcctgtgaggagcagggcgccgccctgcgggcccggggcacccccaagggccgggccccaccccggctgggcaccacagcctctgtgtgccagctgctgaagggcctgcccaccaggacccccctgaatggaagtggccccccaagaagagtgggcggctacgccaccagccccagcagccccaagaaggaggccaccagcggccgcagctctgtgcggcgctacctgagccctgagcggctggcctctgtgagaagagaggaccccaggagcaggaccaccagcagcagcagcaactgcagcgccaagaaggagggcaagaccaaggaggtgatcttctctgtggaggatggctctgtgaagatgttcctgcggggccggcctgtgcccatgatgatcccagatgagctggcccccacctacagcctggacaccaggtctgagctgcccagctgccgcctgaagctggagtgggtgtatggctaccggggccgggactgccgggccaacctgtacctgctgcccaccggggagatcgtgtactttgtggcctctgtggccgtgctgtacagcgtggaggagcagaggcagaggcactacctgggccacaatgatgacatcaagtgcctggccatccacccagacatggtgaccatcgccaccggccaggtggccggcaccaccaaggagggcaagcccctgccccctcatgtgcgcatctgggacagcgtgtccctgagcaccctgcacgtgctgggcctgggcgtgtttgacagagctgtgtgctgcgtgggcttcagcaagagcaatggaggcaacctgctgtgtgctgtggatgagagcaatgaccacatgctgtctgtgtgggactgggccaaggagaccaaggtggtggatgtgaagtgcagcaatgaggccgtgctggtggccaccttccaccccacagaccccaccgtgctgatcacctgtgggaagagccacatctacttctggaccctggagggcggcagcctgagcaagaggcagggcctgtttgagaagcatgagaagcccaagtatgtgctgtgtgtgaccttcctggagggcggagatgtggtgactggagacagcggcggcaacctgtatgtgtggggcaaaggaggcaaccgcatcacccaggccgtgctgggcgcccatgatggaggagtgtttggcctgtgtgccctgagagatggcaccctggtgtctgggggcggccgggacagaagagtggtgctgtggggcagtgactacagcaagctgcaggaggtggaggtgcctgaggactttggacctgtgaggacagtggccgagggccacggggacaccctgtatgtgggcaccaccaggaacagcatcctgcagggctctgtgcacacaggcttcagcctgctggtgcagggccacgtggaggagctgtggggcctggccacccaccccagccgggcccagtttgtgacctgtggccaggacaagctggtgcacctgtggagcagtgacagccaccagcccctgtggagccgcatcattgaagatcctgcccggtctgctggcttccaccccagcggctctgtgctggccgtgggcaccgtgacaggccgctggctgctgctggacacagagacccatgacctggtggccatccacacagatggaaatgagcagatctctgtggtgtccttctccccagatggagcctacctggccgtgggcagccatgacaacctggtgtatgtgtacacagtggaccagggcggcaggaaggtgtcccggctgggcaagtgcagcggccacagcagcttcatcacccacctggactgggcccaggacagcagctgctttgtgaccaacagcggggactatgagatcctgtactgggaccctgccacctgcaagcagatcaccagcgcagatgctgtgaggaacatggagtgggccacagccacctgtgtgctgggcttcggcgtgtttggcatctggagcgagggcgcagatggaacagacatcaatgctgtggcccggagccatgatggcaagctgctggccagcgcagatgactttgggaaggtgcacctgttctcctacccctgctgccagccccgggccctgagccacaagtatggaggccacagcagccacgtgaccaacgtggccttcctgtgggatgacagcatggccctgaccactggaggcaaggacacctctgtgctgcagtggagggtggtgtag

SEQ ID NO: 22271 - DNA, 1059 bp, Artificial Sequence
  Description of Artificial Sequence: Synthetic coding sequence
atggccctgctgggccaggccctgaagtggcagcagcaccagggcctgctgcccccaggcatgaccatcgacctcttccggggcaaggctgctgtgaaggatgtggaggaggagaagttccccacccagctgagccgccacatcaagtttggccagaagagccacgtggagtgtgcccgcttctccccagatggccagtacctggtgacaggctctgtggatggcttcatcgaggtgtggaacttcaccaccgggaagatcaggaaggacctgaagtaccaggcccaggacaacttcatgatgatggatgatgctgtgctgtgcatgtgcttcagccgggacacagagatgctggccaccggggcccaggacggcaagatcaaggtgtggaagatccagagcggccagtgcctgcggagatttgagcgggcccacagcaaaggagtgacctgcctgtccttcagcaaggacagcagccagatcctgagcgccagctttgaccagaccatccgcatccacggcctgaagagcggcaagaccctgaaggagttccggggccacagcagctttgtgaatgaggccaccttcacccaggacggccactacatcatcagcgccagcagtgatggcaccgtgaagatctggaacatgaagaccacagaatgtagcaacaccttcaagagcctgggcagcacagctggaacagacatcaccgtgaacagcgtcatcctgctgcccaagaaccctgagcactttgtggtgtgcaacagaagcaacacagtggtgatcatgaacatgcagggccagatcgtgcgctccttcagcagcggcaagcgggagggcggggactttgtgtgctgtgccctgagccccagaggagagtggatctactgtgtgggagaagattttgtgctgtactgcttcagcacagtgacaggcaagctggagaggaccctgactgtgcatgagaaggatgtgattggaattgcccaccacccccaccagaacctgattgccacctacagtgaagatggcctgctgaagctgtggaagccctag

SEQ ID NO: 22272 - DNA, 951 bp, Artificial Sequence
  Description of Artificial Sequence: Synthetic coding sequence
atgcagagctgggtgctgatcagcaaggagctgatcagcctgctgcacctgagcctgctgcacctggaggaggacaagaccaccgtgtcccaggagagccggcgggcagagaccctggtgtgctgctgctttgacctgctgaagaagctgcgggccaagctgcagagcctgaaggccgagcgggaggaggcccggcaccgggaggagatggccctgcggggcaaggatgctgctgagatcgtgctggaggccttctgtgcccacgccagccagaggatcagccagctggagcaggacctggcctccatgagggagttccggggcctgctgaaggatgcccagacccagctggtgggcctgcacgccaagcaggaggagctggtgcagcagacagtgtccctgaccagcaccctgcagcaggactggaggtccatgcagctggactacaccacctggacagccctgctgagccgcagccggcagctgacagagaagctgactgtgaagagccagcaggccctgcaggagagagatgtggccatcgaggagaagcaggaggtgtcccgggtgctggagcaggtgtctgcccagctggaggagtgcaagggccagacagagcagctggagctggagaacagccggctggccacagacctgcgggcccagctgcagatcctggccaacatggacagccagctgaaggagctgcagagccagcacacccactgtgcccaggacctggccatgaaggatgagctgctgtgccagctgacccagagcaatgaggagcaggccgcccagtggcagaaggaggagatggccctgaagcacatgcaggccgagctgcagcagcagcaggccgtgctggccaaggaggtgcgggacctgaaggagaccctggagtttgctgaccaggagaaccaggtggcccacctggagctggcctggtag

SEQ ID NO: 22273 - DNA, 597 bp, Artificial Sequence; identical to SEQ ID NO: 19257
  Description of Artificial Sequence: Synthetic coding sequence

SEQ ID NO: 22274 - DNA, 591 bp, Artificial Sequence
  Description of Artificial Sequence: Synthetic coding sequence
atggtgccccggccctggagcggcagccctggccctggagagtgcctgcacagcctgctgtctgagcggctgtggatctgccgggacatcagcgcccagaggagaagtgcccctggcagcccccggcccagcgactgccagcagctgtccttcctgcccggcaaccagcccaccttcctgtgcctgcaggccctggccgccctggtgcctggggtgacccaggtggacaacaagagcggcttcctgcagaagaggccccaccggcagcaccctggcatcctgaagctgccccacgtgcggctgccccaggccctggccaatggagcccagctgctgctgctgggcagcgctggccccaccatggagaaccaggtgcagaccctgaccagctacctgtggagccgccacctgcctgtggagcctgaggagctgcagaggcgggcccggcacctggagaagaagttcctggagaaccctggccctgacttccagagcctcttcagcccccagacctacctgcggcagaggaggaactttgtggagcagtgctacacccactacgtgaagctgcccaccatcggcaagaactag

SEQ ID NO: 22275 - DNA, 1131 bp, Artificial Sequence
  Description of Artificial Sequence: Synthetic coding sequence
atgccagatgtggtgcagacccggcagcaggcctacagagacaagctggcccagcagcaggccgctgctgctgctgctgctgctgctgctgccagccagcagggcagcgccaagaatggagaaaatacagccaatggagaggagaatggagcccacaccatcgcccgcatctggaacctgtctgagaacagcaccagcggcagcacccagctggtgctgcggcactgcatccgggagggcggccaggatgtgcccagcaacaaggatgtgaccagcctggactggaacagcgagggcaccctgctggccaccggcagctatgatggctttgcccgcatctggaccaaggatggcaacctggccagcaccctgggccagcacaagggccccatctttgccctgaagtggaacaagaagggcaacttcatcctgtctgctggggtggacaagaccaccatcatctgggatgcccacactggagaggccaagcagcagttccccttccacagcgccccagccctggatgtggactggcagagcaacaacacctttgccagctgcagcacagacatgtgcatccacgtgtgcaagctgggccaggaccggcccatcaagaccttccagggccacaccaatgaggtgaatgccatcaagtgggaccccaccggcaacctgctggccagctgcagtgatgacatgaccctgaagatctggagcatgaagcaggacaactgtgtgcatgacctgcaggcccacaacaaggagatctacaccatcaagtggagccccaccggccctggcaccaacaaccccaatgccaacctgatgctggccagcgccagctttgacagcacagtgcggctgtgggatgtggaccggggcatctgcatccacaccctgaccaagcaccaggagcctgtgtacagcgtggccttctccccagatggccgctacctggccagcggcagctttgacaagtgtgtgcacatctggaacacccagacaggagccctggtgcacagctaccggggcactggaggcatctttgaggtgtgctggaatgctgctggggacaaggtgggcgccagcgccagtgatggctctgtgtgtgtgctggacctgaggaagtag

SEQ ID NO: 22276 - DNA, 1116 bp, Artificial Sequence
  Description of Artificial Sequence: Synthetic coding sequence
atgcacatcaagagcatcatcctggagggcttcaagagctatgcccagaggacagaggtgaatggatttgaccccctcttcaatgccatcaccggcctgaatggcagcggcaagagcaacatcctggacagcatctgcttcctgctgggcatcagcaacctgagccaggtgcgggccagcaacctgcaggacctggtgtacaagaatggccaggccggcatcaccaaggcctctgtgtccatcacctttgacaacagcgacaagaagcagagccccctgggctttgaggtgcatgatgagatcaccgtgacccggcaggtggtgattggaggcaggaacaagtacctgatcaacggggtgaatgccaacaacaccagggtgcaggacctcttctgcagcgtgggcctgaatgtgaacaacccccacttcctgatcatgcagggccgcatcaccaaggtgctgaacatgaagcccccagagatcctgtccatgattgaggaggccgccggcaccaggatgtatgagtacaagaagattgctgcccagaagaccatcgagaagaaggaggccaagctgaaggagatcaagaccatcctggaggaggagatcacccccaccatccagaagctgaaggaggagaggagcagctacctggagtaccagaaggtgatgagagaaattgagcacctgagccggctgtacatcgcctaccagttcctgctggccgaggacaccaaggtgcgctctgctgaggagctgaaggagatgcaggacaaggtgatcaagctgcaggaggagctgtctgaaaatgacaagaagatcaaggccctgaaccatgaaattgaggagctggagaagaggaaggacaaggagaccggcggcatcctgcggagcctggaggatgccctggccgaggcccagagggtgaacaccaagagccagagcgcctttgacctgaagaagaagaacctggcctgtgaggagagcaagaggaaggagctggagaagaacatggtggaggacagcaagaccctggccgccaaggagaaggagaagatcaagaggaaggccttctggaagtctgctggcagctgcctggtgatcctggtggactag

SEQ ID NO: 22277 - DNA, 507 bp, Artificial Sequence
  Description of Artificial Sequence: Synthetic coding sequence
cacaagctgcagagcggcatcggccgcctcatcctgaaggaggagatgaaggcccggagcagcagctatgctgacccctggaccccacccaggagcagcaccagcagccgggaggccctgcacacagctggctatgagatgagcctgaatggcagccccaggagccactacctggccgacagcgaccccctcatcagcaagagcgccagcctgcctgcctacagaagaaatggcctgcacaggacccccagcgctgacctcttccactatgacagcatgaatgctgtgaactggggcatgagggagtacaagatctacccctatgagctgctgctggtgaccacccggggcaggaaccggctgcccaaggatgtggacaggacccggctggagcggcacctgagccaggaggagttctaccaggtgtttggcatgaccatcagcgagtttgaccggctggccctgtggaagagaaatgagctgaagaagcaggcccggctcttctag

SEQ ID NO: 22278 - DNA, 1770 bp, Artificial Sequence; identical to SEQ ID NO: 19217
  Description of Artificial Sequence: Synthetic coding sequence

SEQ ID NO: 22279 - DNA, 1287 bp, Artificial Sequence
  Description of Artificial Sequence: Synthetic coding sequence
atgtccatgctgaagcccagcggcctgaaggcccccaccaagatcctgaagccaggcagcacagccctgaagacccccacagctgtggtggcccctgtggagaagaccatcagcagcgagaaggccagcagcacccccagcagcgagacccaggaggagtttgtggatgacttccgggtgggggagcgggtgtgggtgaatggaaacaagccaggcttcatccagttcctgggggagacccagtttgcccctggccagtgggccggcatcgtgctggatgagcccatcggcaagaatgatggctctgtggccggcgtgcgctacttccagtgtgagcccctgaagggcatcttcacccggcccagcaagctgaccaggaaggtgcaggctgaagatgaggccaacggcctgcagaccaccccagccagccgggccaccagccccctgtgcaccagcacagcctccatggtgagcagcagccccagcacccccagcaacatcccccagaagcccagccagcctgctgccaaggagcccagcgccaccccacccatcagcaacctgaccaagacagccagcgagagcatcagcaacctgtctgaggccggcagcatcaagaagggggagcgggagctgaagatcggggacagagtgctggtgggcggcaccaaggccggcgtggtgcgcttcctgggggagacagactttgccaagggggagtggtgtggggtggagctggatgagcccctgggcaagaatgatggagctgtggccggcacccgctacttccagtgccagcccaagtatggcctgtttgcccctgtgcacaaggtgaccaagattggcttccccagcaccaccccagccaaggccaaggccaatgctgtgagaagagtgatggccaccaccagcgccagcctgaagaggagccccagcgccagcagcctgagctccatgagctctgtggccagctctgtgagcagccggcccagcaggacaggcctgcacgtgctggagctggaggccaagatggaccagctgcggaccatggtggaggccgctgaccgggagaaggtggagctgctgaaccagctggaggaggagaagaggaaggtggaggacctgcagttccgggtggaggaggagagcatcaccaagggggacctggagcagaagagccagatcagtgaagatcctgaaaatgtgcggggccacctgactgtgtggatcttccccctgctgaccaagattgaccaccggctgaagtgcctgctgatctacagctag

SEQ ID NO: 22280 - DNA, 3483 bp, Artificial Sequence
  Description of Artificial Sequence: Synthetic coding sequence
atggtggtgaccctgggccctggccctgactgcctgatcctggaggccagccggcagccccagctggtgcccaagccagagaggatggccagtgatggagccagcgccctgcccggccctgacatgtccatgaagcccagcgctgcccccagccccagccctgccctgcccttcctgccccccaccagtgaccccccagaccaccccccccgggagcccccaccccagcccatcatgcccagcgtcttctccccagacaaccccctgatgctgagcgccttccccagcagcctgctggtgactggagatggcggcccctgcctgtctggagctggagctgggaaggtgattgtgaaggtgaagacagagggcggcagcgctgagcccagccagacccagaacttcatcctgacccagacagccctgaacagcacagcccctggcaccccctgtggcggcctggagggccctgcccccccatttgtgacagccagcaatgtgaagaccatcctgcccagcaaggctgtgggcgtgtcccaggagggccccccaggcctgcccccccagcccccacctcctgtggcccagctggtgcccatcgtgcccctggagaaggcctggccaggcccccacggcaccaccggggagggcggccctgtggccaccctgagcaagcccagcctgggggacaggagcaagatcagcaaggatgtgtatgagaacttccggcagtggcagcgctacaaggccctggcccggcggcacctgagccagagcccagacacagaggccctgagctgcttcctgatccctgtgctgcggagcctggcccggctgaagcccaccatgaccctggaggagggcctgcccctggccgtgcaggagtgggagcacaccagcaactttgacaggatgatcttctatgagatggccgagcgcttcatggagtttgaagctgaggagatgcagatccagaacacccagctgatgaatggcagccagggcctgagccctgccacccccctgaagctggaccccctgggccccctggccagcgaggtgtgccagcagcctgtgtacatccccaagaaggccgccagcaagacccgggccccccggcggcggcagaggaaggcccagaggcccccagcccctgaggcccccaaggagatccccccagaggccgtgaaggagtatgtggacatcatggagtggctggtgggcacccacctggccactggagagagtgatggcaagcaggaggaggagggccagcagcaggaggaggagggcatgtacccagaccccggcctgctgagctacatcaatgagctgtgcagccagaaggtgtttgtgtccaaggtggaggccgtcatccacccccagttcctggccgacctgctgagccctgagaagcagagggaccccctggccctgattgaggagctggagcaggaggagggcctgaccctggcccagctggtgcagaagaggctgatggccctggaggaggaggaggatgctgaggcccctccttccttcagcggggcccagctggacagcagccccagcggctctgtggaggatgaagatggagatggccgcctgcggcccagccctggcctgcagggcgccggcggggccgcctgcctgggcaaggtgagcagcagcggcaagagggcccgggaggtgcatggaggccaggagcaggccctggacagcccccggggcatgcacagagatggcaacaccctgcccagccccagctcctgggacctgcagcctgagctggccgccccccagggcaccccaggccccctgggcgtggagcggcggggcagcggcaaggtgatcaaccaggtgtccctgcaccaggacggccacctgggcggggccggccccccaggccactgcctggtggccgacaggaccagcgaggccctgcccctgtgctggcagggcggcttccagcctgagagcacccccagcctggatgctggcctggccgagctggcccccctgcagggccagggcctggagaagcaggtgctgggcctgcagaagggccagcagacaggaggccggggcgtgctgccccagggcaaggagcccctggccgtgccctgggagggcagcagcggggccatgtggggagatgaccggggcacccccatggcccagagctatgaccagaaccccagccccagggctgctggggagagagatgatgtgtgcctgagccctggggtgtggctgagcagcgagatggatgctgtgggcctggagctgcctgtgcagatcgaggaggtgattgagagcttccaggtggagaagtgtgtgacagagtaccaggagggctgccagggcctgggcagccggggcaacatcagcctgggccctggagagaccctggtgcctggggacacagagagcagcgtcatcccctgtggcggcaccgtggccgctgctgccctggagaagaggaactactgcagcctgcccggccccctgcgggccaacagcccccccctgcggagcaaggagaaccaggagcagagctgtgagaccgtgggccaccccagcgacctgtgggccgagggctgcttccccctgctggagagcggggacagcaccctgggcagcagcaaggagaccctgccccccacctgccagggcaacctgctgatcatgggcacagaagatgccagcagcctgcctgaggccagccaggaggccggcagccggggcaacagcttcagccccctgctggagaccatcgagcctgtgaacatcctggatgtgaaggatgactgtggcctgcagctgcgggtgtctgaggacacctgccccctgaatgtgcacagctatgacccccagggcgagggccgggtggaccctgacctgagcaagcccaagaacctggcccccctgcaggagagccaggagagctacaccaccggcacccccaaggccaccagcagccaccagggcctgggcagcaccctgccccggcggggcaccagaaatgccatcgtgccccgggagacctctgtgtccaagacccacaggtctgctgaccgggccaagggcaaggagaagaagaagaaggaggccgaggaggaggatgaggagctgagcaactttgcctacctgctggccagcaagctgagcctgagcccccgggagcaccccctgagcccccaccacgccagcggcggccagggcagccagagggccagccacctgctgcctgctggggccaagggccccagcaagctgccctaccctgtggccaagagcggcaagagggccctggccggcggccctgcccccacagagaagaccccccacagcggggcccagctgggcgtgccccgggagaagcccctggccctgggcgtggtgcggcccagccagcccaggaagagaagatgtgacagctttgtgacaggccgcaggaagaagagaagaagaagccagtag

SEQ ID NO: 22281 - DNA, 1548 bp, Artificial Sequence
  Description of Artificial Sequence: Synthetic coding sequence
ctcaacagccagtgcaggaacaagaacccctttgctgctggccccaggcctccccaccaccagttcttccagaggccccagatccagcccccccgggccaccatccccaacagcagccccagcatccggcctggggcccagacccccacagctgtgtaccaggccaaccagcacatcatgatggtgaaccacctgcccatgccctaccctgtgccccagggcccccagtactgcatcccccagtaccgccacagcggccccccctacgtgggccccccccagcagtaccctgtgcagcccccaggccctggccccttctacccaggccctggccctggggacttccccaatgcctacggcacccccttctaccccagccagcctgtgtaccagagcgcccccatcatcgtgcccacccagcagcagcccccaccagccaagcgggagaagaagaccatccgcatccgggaccccaaccagggcggcaaggacatcacagaggagatcatgtctgggggcggcagcaggaaccccaccccacccatcggccggcccaccagcacccccaccccaccccagcagctgcccagccaggtgcctgagcacagccctgtggtgtatggaacagtggagagcgcccacctggccgccagcacccctgtgacagctgccagtgaccagaagcaggaggagaagcccaagccagaccctgtgctgaagagccccagccctgtgctgcggctggtgctgtctggagagaagaaggagcaggagggccagaccagcgagaccacagccatcgtgtccattgctgagctgcccctgccccccagccccaccaccgtgtcctctgtggcccggagcaccatcgccgcccccaccagcagcgccctgagcagccagcccatcttcaccacagccattgatgacagatgtgagctgagcagcccccgggaggacaccatccccatccccagcctgaccagctgcacagagaccagtgaccccctgcccaccaatgaaaatgatgatgacatctgcaagaagccctgcagcgtggccccaaatgacatccccctggtgagcagcaccaacctgatcaatgagatcaatggagtgtctgagaagctgagcgccacagagagcatcgtggagatcgtgaagcaggaggtgctgcccctgaccctggagctggagatcctggagaaccccccagaggagatgaagctggagtgcatcccagcccccatcacccccagcacagtgcccagcttcccccccaccccacccaccccaccagccagccccccccacacccctgtgattgtgcctgctgctgccaccaccgtgagcagccccagcgctgccatcaccgtgcagagggtgctggaggaggatgagagcatccgcacctgcctgtctgaagatgccaaggagatccagaacaagattgaggtggaggctgatggccagacagaggagatcctggacagccagaacctgaacagccgccgcagccctgtgcctgagaccagcaatgaatgttag

SEQ ID NO: 22282 - DNA, 204 bp, Artificial Sequence; identical to SEQ ID NO: 22262
  Description of Artificial Sequence: Synthetic coding sequence

SEQ ID NO: 22283 - DNA, 2418 bp, Artificial Sequence
  Description of Artificial Sequence: Synthetic coding sequence
atgatgcagaatgtgcacctggcccctgagacagatgaagatgacctgtacagcggctacaatgactacaaccccatctatgacatcgaggagctggagaatgatgctgccttccagcaggccgtgaggaccagccacggccggcggccccccagcaagaccagcctggccagcagcatcggccggcccatgactggagccatccaggatggagtgacccggcccatgacagctgtgcgggccgccggcttcaccaaggccgccctgcggggcagcgcctttgaccccctgagccagagccggggccctgccagccccctggaggccaagaagaaggacagccctgaggagaagatcaagcagctggagaaggaggtgaatgagctggtggaggagagctgcatcgccaacagctgtggggacctgaagctggccctggagaaggccaaggatgctggcaggaaggagcgggtgctggtgcggcagcgggagcaggtgaccaccccagagaacatcaacctggacctgacctacagcgtgctcttcaacctggccagccagtacagcgtgaatgagatgtatgcagaggccctgaacacctaccaggtgattgtgaagaacaagatgttcagcaatgccggcatcctgaagatgaacatgggcaacatctacctgaagcagaggaactacagcaaggccatcaagttctacaggatggccctggaccaggtgcccagcgtgaacaagcagatgaggatcaagatcatgcagaacattggagtgaccttcatccaggccggccagtacagtgatgccatcaacagctatgagcacatcatgtccatggcccccaacctgaaggccggctacaacctgaccatctgctactttgccatcggggaccgggagaagatgaagaaggccttccagaagctgatcaccgtgcccctggagattgatgaggacaagtacatcagccccagtgatgacccccacaccaacctggtgacagaggccatcaagaatgaccacctgcggcagatggagcgggagaggaaggccatggccgagaagtacatcatgaccagcgccaagctgattgcccctgtgattgagaccagctttgctgctggctatgactggtgtgtggaggtggtgaaggccagccagtatgtggagctggccaatgacctggagatcaacaaggctgtgacctacctgcggcagaaggactacaaccaggccgtggagatcctgaaggtgctggagaagaaggacagccgggtgaagtctgctgctgccaccaacctgagcgccctgtactacatgggcaaggactttgcccaggccagcagctatgctgacattgctgtgaacagcgaccgctacaacccagctgccctgaccaacaagggcaacacagtgtttgccaacggggactatgagaaggctgctgagttctacaaggaggccctgagaaatgacagcagctgcacagaggccctgtacaacatcggcctgacctatgagaagctgaaccggctggatgaggccctggactgcttcctgaagctgcacgccatcctgaggaacagcgctgaggtgctgtaccagatcgccaacatctatgagctgatggagaaccccagccaggccatcgagtggctgatgcaggtggtgtctgtcatccccacagacccccaggtgctgagcaagctgggggagctgtatgaccgggagggggacaagagccaggccttccagtactactatgagagctaccgctacttcccctgcaacattgaagtcatcgagtggctgggcgcctactacatcgacacccagttctgggagaaggccatccagtactttgagcgggccagcctcatccagcccacccaggtgaagtggcagctgatggtggccagctgcttccgccgcagcggcaactaccagaaggccctggacacctacaaggacacccacaggaagttcccagaaaatgtggagtgcctgcgcttcctggtgcggctgtgcacagacctgggcctgaaggatgcccaggagtatgccaggaagctgaagaggctggagaagatgaaggagatccgggagcagaggatcaagagcggcagagatggcagcggcggcagccggggcaagcgggagggcagcgccagcggggacagcggccagaactacagcgccagcagcaaaggagagcggctgagcgcccggctgcgggccctgcccggcaccaatgagccctatgagagcagcagcaacaaggagattgatgccagctatgtggaccccctgggcccccagatcgagcggcccaagacagctgccaagaagagaattgatgaagatgactttgctgatgaggagctgggagatgacctgctgcctgagtag

SEQ ID NO: 22284 - DNA, 765 bp, Artificial Sequence
  Description of Artificial Sequence: Synthetic coding sequence
atggcccctggcagctttgctgagtacacagtggtgcctgccagcatcgccacccctgtgcccagcgtgaagccagagtacctgaccctgctggtgtctggcaccacagcctacatcagcctgaaggagctgggcggcctgtctgagggcaagaaggtgctggtgacagctgctgctgggggcaccggccagtttgccatgcagctgagcaagaaggccaagtgccacgtgattggcacctgcagcagtgatgagaagagcgccttcctgaagagcctgggctgtgaccggcccatcaactacaagacagagcctgtgggcaccgtgctgaagcaggagtacccagagggcgtggatgtggtgtatgagagcgtgggcggggccatgtttgacctggccgtggatgccctggccaccaagggccgcctcatcgtcatcggcttcatcagcggctaccagacccccaccggcctgagccctgtgaaggccggcaccctgcctgccaagctgctgaagaagagcgcctctgtgcagggcttcttcctgaaccactacctgagcaagtaccaggccgccatgagccacctgctggagatgtgtgtgtctggggacctggtgtgtgaggtggacctgggggacctgagccctgagggccgcttcaccggcctggagagcatcttccgggctgtgaactacatgtacatgggcaagaacacaggcaagatcgtggtggagctgccccacagcgtgaacagcaagctgtag

SEQ ID NO: 22285 - DNA, 1212 bp, Artificial Sequence
  Description of Artificial Sequence: Synthetic coding sequence
atgcaccaccccatccagatgaagccagctgacagcgagaagagcaatgctgtggaggacaggaagctgttcatcggcatggtgtccaagaagtgcaatgaaaatgacatccgggtgatgttcagccccttcggccagattgaagaatgtcgcatcctgcggggcccagatggcctgagccggggctgtgcctttgtgaccttcagcacccgggccatggcccagaatgccatcaaggccatgcaccagagccagaccatggagggctgcagcagccccatcgtggtgaagtttgctgacacccagaaggacaaggagcagaggcggctgcagcagcagctggcccagcagatgcagcagctgaacacagccacctggggcaacctgaccggcctgggcggcctgaccccccagtacctggccctgctgcagcaggccaccagcagcagcaacctgggcgccttcagcggcatccagcagatggccggcatgaatgccctgcagctgcagaacctggccaccctggccgctgctgctgctgctgcccagaccagcgccaccagcaccaatgccaaccccctgagcaccaccagcagcgccctgggcgccctgaccagccctgtggccgccagcacccccaacagcacagctggagctgccatgaacagcctgaccagcctgggcaccctgcagggcctggccggggccaccgtgggcctgaacaacatcaatgccctggccgtggcccagatgctgagcggcatggccgccctgaatggaggcctgggcgccaccggcctgaccaatggaacagctggcaccatggatgccctgacccaggcctacagcggcatccagcagtatgctgctgctgccctgcccaccctgtacagccagagcctgctgcagcagcagagcgctgctggcagccagaaggagggccctgagggcgccaacctcttcatctaccacctgccccaggagtttggagaccaggacatcctgcagatgttcatgccctttggaaatgtcatcagcgccaaggtgttcatcgacaagcagaccaacctgagcaaatgttttggatttgtgtcctatgacaaccctgtgtctgcccaggccgccatccaggccatgaatggcttccagatcggcatgaagaggctgaaggtgcagctgaagaggagcaagaatgacagcaagccctactag

SEQ ID NO: 22286 - DNA, 1332 bp, Artificial Sequence
  Description of Artificial Sequence: Synthetic coding sequence
atggccgagttcctgaagcaggtgaagccctacgtggaggagggcctgcacccccagatcatcatccgggccttcagaacagccacccagctggccgtgaacaagatcaaggagattgctgtgacagtgaagaaggctgacaaggtggagcagaggaagctgctggagaagtgtgccatgacagccctgagcagcaagctgatcagccagcagaaggccttctttgccaagatggtggtggatgctgtgatgatgctggatgacctgctgcagctgaagatgattggcatcaagaaggtgcagggcggggccctggaggacagccagctggtggccggcgtggccttcaagaagaccttctcctatgccggctttgagatgcagcccaagaagtaccacaaccccaagatcgccctgctgaatgtggagctggagctgaaggccgagaaggacaatgctgagatccgggtgcacacagtggaggactaccaggccatcgtggatgctgagtggaacatcctgtatgacaagctggagaagatccaccacagcggggccaaggtggtgctgagcaagctgcccatcggagatgtggccacccagtactttgctgaccgggacatgttctgtgccggccgggtgcctgaggaggacctgaagaggaccatgatggcctgtggcggcagcatccagacctctgtgaatgccctgtctgcagatgtgctgggccgctgccaggtgtttgaggagacccagattggaggagagcgctacaacttcttcaccggctgccccaaggccaagacctgcaccttcatcctgcggggcggcgctgagcagttcatggaggagacagagaggagcctgcatgatgccatcatgattgtgagaagagccatcaagaatgacagcgtggtggccggcggcggggccatcgagatggagctgagcaagtacctgcgggactacagcaggaccatccctgggaagcagcagctgctgattggagcctatgccaaggccctggagatcatcccccggcagctgtgtgacaatgccggctttgatgccaccaacatcctgaacaagctgcgggcccggcatgcccagggcggcacctggtatggagtggacatcaacaatgaagatattgctgacaactttgaggcctttgtgtgggagcccgccatggtgcgcatcaatgccctgacagctgccagcgaggccgcctgcctgattgtgtctgtggatgagaccatcaagaaccccaggagcacagtggatgcccccacagctgctggccggggccggggccggggccggccccactag

SEQ ID NO: 22287 - DNA, 2193 bp, Artificial Sequence
  Description of Artificial Sequence: Synthetic coding sequence
atgcagctgtttgagcagccctgccctggagaggaccccaggcctgggggccagattggagaggtggagctgagcagctacaccccacctgctggggtgcctgggaagccagctgccccccacttcctgcctgtgctgtgcagcgtgagccccagcggcagccgggtgccccatgacctgctgggcggcagcggcggcttcaccctggaggatgccctgtttggcctgctgtttggagcagatgccaccctgctgcagagccctgtggtgctgtgtggcctgcctgatggccagctgtgctgcgtcatcctgaaggccctggtgaccagccgcagcgcccctggggaccccaatgccctggtgaagatcctgcaccacctggaggagcccgtcatcttcatcggggccctgaagacagagccccaggccgctgaggccgctgagaacttcctgcctgatgaagatgtgcactgtgactgcctggtggccttcggccaccacggccgcatgctggccatcaaggcctcctgggatgagagcggcaagctggtgcctgagctgcgggagtactgcctgcccggccctgtgctgtgtgccgcctgtggcggcggcggccgggtgtaccacagcacccccagcgacctgtgtgtggtggacctgagccggggcagcacccccctgggccctgagcagcctgaggagggccctgggggcctgccccccatgctgtgcccagccagcctgaacatctgcagcgtggtgtccctgagcgccagccccaggacccatgaaggaggcaccaagctgctggccctgagcgccaagggccgcctgatgacctgcagcctggacctggacagcgagatgcctggccctgccaggatgaccacagaatctgctggccagaagatcaaggagctgctgtctggaattggcaacatcagcgagcgggtgtccttcctgaagaaggctgtggaccagaggaacaaggccctgaccagcctgaatgaggccatgaatgtgtcctgtgccctgctgagcagcggcaccggcccccggcccatcagctgcaccaccagcaccacctggagccggctgcagacccaggatgtgctgatggccacctgtgtgctggagaacagcagcagcttcagcctggaccagggctggaccctgtgcatccaggtgctgaccagcagctgtgccctggacctggacagcgcctgcagcgccatcacctacaccatccctgtggaccagctgggccctggggcccggcgggaggtgaccctgcccctgggccctggagaaaatggaggcctggacctgcctgtgacagtgtcctgcaccctcttctacagcctgcgggaggtggtgggcggggccctggcccccagcgacagcgaggaccccttcctggatgaatgtcccagtgatgtgctgcctgagcaggagggcgtgtgcctgcccctgagccgccacacagtggacatgctgcagtgcctgcgcttccctggcctggccccaccccacacccgggcccccagccccctgggccccacccgggaccctgtggccaccttcctggagacctgccgggagcccggcagccagcctgctggccctgccagcctgcgggcagagtacctgcccccatctgtggccagcatcaaggtgtctgctgagctgctgcgggccgccctgaaggatggccacagcggcgtgcccctgtgctgtgccaccctgcagtggctgctggccgagaatgctgctgtggatgtggtgcgggcccgggccctgagcagcatccagggcgtggccccagatggagccaacgtgcacctgattgtgcgggaggtggccatgacagacctgtgcccagctggccccatccaggccgtggagatccaggtggagagcagcagcctggccgacatctgccgggcccaccacgctgtggtgggccgcatgcagaccatggtgacagagcaggccacccagggcagcagcgccccagacctgcgggtgcagtacctgcggcagatccacgccaaccacgagaccctgctgcgggaggtgcagaccctgcgggaccggctgtgcacagaagatgaggccagcagctgtgccacagcccagaggctgctgcaggtgtaccggcagctgcggcaccccagcctcatcctgctgtag

SEQ ID NO: 22288 - DNA, 4179 bp, Artificial Sequence
  Description of Artificial Sequence: Synthetic coding sequence
atgtccatgctgaagcccagcggcctgaaggcccccaccaagatcctgaagccaggcagcacagccctgaagacccccacagctgtggtggcccctgtggagaagaccatcagcagcgagaaggccagcagcacccccagcagcgagacccaggaggagtttgtggatgacttccgggtgggggagcgggtgtgggtgaatggaaacaagccaggcttcatccagttcctgggggagacccagtttgcccctggccagtgggccggcatcgtgctggatgagcccatcggcaagaatgatggctctgtggccggcgtgcgctacttccagtgtgagcccctgaagggcatcttcacccggcccagcaagctgaccaggaaggtgcaggctgaagatgaggccaacggcctgcagaccaccccagccagccgggccaccagccccctgtgcaccagcacagcctccatggtgagcagcagccccagcacccccagcaacatcccccagaagcccagccagcctgctgccaaggagcccagcgccaccccacccatcagcaacctgaccaagacagccagcgagagcatcagcaacctgtctgaggccggcagcatcaagaagggggagcgggagctgaagatcggggacagagtgctggtgggcggcaccaaggccggcgtggtgcgcttcctgggggagacagactttgccaagggggagtggtgtggggtggagctggatgagcccctgggcaagaatgatggagctgtggccggcacccgctacttccagtgccagcccaagtatggcctgtttgcccctgtgcacaaggtgaccaagattggcttccccagcaccaccccagccaaggccaaggccaatgctgtgagaagagtgatggccaccaccagcgccagcctgaagaggagccccagcgccagcagcctgagctccatgagctctgtggccagctctgtgagcagccggcccagcaggacaggcctgctgacagagaccagcagccgctatgccaggaagatcagcggcaccacagccctgcaggaggccctgaaggagaagcagcagcacatcgagcagctgctggccgagcgggacctggagcgggcagaggtggccaaggccaccagccacgtgggggagattgagcaggagctggccctggccagagatggccatgaccagcacgtgctggagctggaggccaagatggaccagctgcggaccatggtggaggccgctgaccgggagaaggtggagctgctgaaccagctggaggaggagaagaggaaggtggaggacctgcagttccgggtggaggaggagagcatcaccaagggggacctggaggtggccaccgtgtctgagaagagccgcatcatggagctggagaaggacctggccctgcgggtgcaggaggtggccgagctgcggcggcggctggagagcaacaagccagctggagatgtggacatgagcctgagcctgctgcaggagatcagcagcctgcaggagaagctggaggtgaccaggacagaccaccagcgggagatcaccagcctgaaggagcactttggagcccgggaggagacccaccagaaggagatcaaggccctgtacacagccacagagaagctgagcaaagaaaatgaaagcctgaagagcaagctggagcacgccaacaaggaaaattctgatgtgattgccctgtggaagagcaagctggagacagccatcgccagccaccagcaggccatggaggagctgaaggtgtccttcagcaagggcctgggcacagaaacagctgagtttgctgagctgaagacccagatcgagaagatgaggctggactaccagcacgagattgagaacctgcagaaccagcaggacagcgagcgggccgcccacgccaaggagatggaggccctgcgggccaagctgatgaaggtgatcaaggagaaggagaacagcctggaggccatccgcagcaagctggacaaggccgaggaccagcacctggtggagatggaggacaccctgaacaagctgcaggaggccgagatcaaggtgaaggagctggaggtgctgcaggccaagtgcaatgagcagaccaaggtgattgacaacttcaccagccagctgaaggccacagaggagaagctgctggacctggatgccctgaggaaggccagcagcgagggcaagtctgagatgaagaagctgcggcagcagctggaggccgctgagaagcagatcaagcacctggagattgagaagaatgctgagagcagcaaggccagcagcatcacccgggagctgcagggccgggagctgaagctgaccaacctgcaggagaacctgtctgaggtgtcccaggtgaaggagaccctggagaaggagctgcagatcctgaaggagaagtttgctgaggccagcgaggaggccgtgtctgtgcagaggtccatgcaggagaccgtgaacaagctgcaccagaaggaggagcagttcaacatgctgagcagtgacctggagaagctgcgggagaacctggccgacatggaggccaagttccgggagaaggatgagcgggaggagcagctgatcaaggccaaggagaagctggagaatgacattgctgagatcatgaagatgtctggggacaacagcagccagctgaccaagatgaatgatgagctgcggctgaaggagagagatgtggaggagctgcagctgaagctgaccaaggccaatgaaaatgccagcttcctgcagaagagcattgaggacatgacagtgaaggccgagcagagccagcaggaggccgccaagaagcatgaggaggagaagaaggagctggagaggaagctgagtgacctggagaagaagatggagaccagccacaaccagtgccaggagctgaaggcccgctatgagcgggccaccagcgagaccaagaccaagcatgaggagatcctgcagaacctgcagaagaccctgctggacacagaggacaagctgaagggggcccgggaggagaacagcggcctgctgcaggagctggaggagctgaggaagcaggccgacaaggccaaggccgcccagacagcagaagatgccatgcagatcatggagcagatgaccaaggagaagacagagaccctggccagcctggaggacaccaagcagaccaatgccaagctgcagaatgagctggacaccctgaaggagaacaacctgaagaatgtggaggagctgaacaagagcaaggagctgctgactgtggagaaccagaagatggaggagttcaggaaggagattgagaccctgaagcaggccgccgcccagaagagccagcagctgagcgccctgcaggaggagaatgtgaagctggccgaggagctgggccgcagcagagatgaggtgaccagccaccagaagctggaggaggagaggtctgtgctgaacaaccagctgctggagatgaagaagcgggagagcaagttcatcaaggatgctgatgaggagaaggccagcctgcagaagagcatcagcatcaccagcgccctgctgacagagaaggatgctgagctggagaagctgagaaatgaggtgacagtgctgcggggggagaatgccagcgccaagagcctgcacagcgtggtgcagaccctggagagtgacaaggtgaagctggagctgaaggtgaagaacctggagctgcagctgaaggagaacaagaggcagctgagcagcagcagcggcaacacagacacccaggctgatgaagatgagcgggcccaggagagccagattgacttcctgaacagcgtcatcgtggacctgcagaggaagaaccaggacctgaagatgaaggtggagatgatgtctgaggccgccctgaatggaaatggagatgacctgaacaactatgacagtgatgaccaggagaagcagagcaagaagaagcccaggctcttctgtgacatctgtgactgctttgacctgcatgacacagaggactgccccacccaggcccagatgtctgaagatcctccccacagcacccaccacggcagcagaggagaggagcggccctactgtgagatctgtgagatgtttggccactgggccaccaactgcaatgatgatgagaccttctag

SEQ ID NO: 22289 - DNA, 492 bp, Artificial Sequence
  Description of Artificial Sequence: Synthetic coding sequence
atgttcaggaagattggaattgaggccctgaagcaggtgaccaagagatatgccaggaagcagaaccgctgggtgaagaaccgcttcctgagcaggcctggccccatcgtgccccctgtgtatggcctggaggtgtctgatgtgtccaagtgggaggagagcgtgctggagcccgccctggagatcgtgcagagcttcatccagggccacaagcccacagccacccccatcaagatgccctacaatgaagctgagaacaagaggagctaccacctgtgtgacctgtgtgaccgcatcatcattggagaccgggagtgggccgcccacatcaagagcaagagccacctgaaccagctgaagaagagaagaaggctggacagtgatgctgtgaacaccatcgagagccagagcgtgtccccagaccacaacaaggagcccaaggagaagggcagccctggccagaatgaccaggagctgaagtgcagcgtgtag

SEQ ID NO: 22290 - DNA, 1602 bp, Artificial Sequence
  Description of Artificial Sequence: Synthetic coding sequence
atggccagccctgggaaggacaactacaggatgaagagctacaagaacaatgccctgaaccctgaggagatgagaagaagaagagaggaggagggcatccagctgaggaagcagaagcgggagcagcagctgttcaagagaagaaatgtggagctgatcaatgaggaggccgccatgtttgacagcctgctgatggacagctatgtgagcagcaccactggagagagcgtcatcacccgggagatggtggagatgctgttcagtgatgacagcgacctgcagctggccaccacccagaagttcaggaagctgctgagcaaggagcccagcccccccattgatgaggtgatcaacaccccccgggtggtggacagatttgtggagttcctgaagagaaatgaaaactgcaccctgcagtttgaggccgcctgggccctgaccaacatcgccagcggcaccagccagcagaccaagatcgtgattgaagctggagctgtgcccatcttcatcgagctgctgaacagcgactttgaagatgtgcaggagcaggccgtgtgggccctgggcaacattgctggggacagctctgtgtgccgggactatgtgctgaactgcagcatcctgaaccccctgctgaccctgctgaccaagagcacccggctgaccatgaccagaaatgctgtgtgggccctgagcaacctgtgccggggcaagaaccccccacctgagtttgccaaggtgagcccctgcctgcctgtgctgagccggctgctcttcagcagtgacagcgacctgctggctgatgcctgctgggccctgagctacctgagtgatggccccaatgagaagatccaggccgtcatcgacagcggcgtgtgccggcggctggtggagctgctgatgcacaatgactacaaggtggccagccctgccctgcgggctgtgggcaacatcgtgactggagatgacatccagacccaggtgatcctgaactgcagcgccctgccctgcctgctgcacctgctgagcagccccaaggagagcatcaggaaggaggcctgctggaccatcagcaacatcacagctggcaacagagcccagatccaggccgtgattgatgccaacatcttccctgtgctgattgagatcctgcagaaggccgagttccgcaccaggaaggaggccgcctgggccatcaccaatgccaccagcggcggcaccccagagcagatccgctacctggtgtccctgggctgcatcaagcccctgtgtgacctgctgactgtgatggacagcaagatcgtgcaggtggccctgaatggcctggagaacatcctgcggctgggggagcaggagggcaagaggagcggcagcggcgtgaacccctactgcggcctgattgaggaggcctacggcctggacaagattgagttcctgcagagccatgagaaccaggagatctaccagaaggcctttgacctgattgagcactactttggagtggaggatgatgacagcagcctggccccccaggtggatgagacccagcagcagttcatcttccagcagcctgaggcccccatggagggcttccagctgtag

SEQ ID NO: 22291 - DNA, 993 bp, Artificial Sequence; identical to SEQ ID NO: 20531
  Description of Artificial Sequence: Synthetic coding sequence

SEQ ID NO: 22292 - DNA, 576 bp, Artificial Sequence
  Description of Artificial Sequence: Synthetic coding sequence
atgagccgggagcggggcagccgctctgaggagcccggggccggcaaccgggagagcggcagccgggagcccggcctggccgctgctgccatgagcacagtggacctggcccgggtgggcgcctgcatcctgaagcatgctgtgactggagaggccgtggagctgcggagcctgtggagggagcacgcctgtgtggtggccggcctgcggcgcttcggctgtgtggtgtgccgctggatcgcccaggacctgagcagcctggccggcctgctggaccagcacggcgtgcggctggtgggcgtgggccctgaggccctgggcctgcaggagttcctggatggagactactttgctggggagctgtacctggatgagagcaagcagctgtacaaggagctgggcttcaagcgctacaacagcctgagcatcctgcctgctgccctgggcaagcctgtgagagatgtggccgccaagagccctggggactatgtgcccaaggagcacatcctgcaggtgctgggcatctctgctgaggtgtgtgccagtgaccccccccagtgtgaccgggaggtgtag

SEQ ID NO: 22293 - DNA, 1050 bp, Artificial Sequence
  Description of Artificial Sequence: Synthetic coding sequence
aacaccatccatgatgtgctggatgtggaggccgctgtggtgaacctggacaacagcgtggtggacctggagaccctgcaggccctgtatgaaaatagagcccagagtgatgagctggagaagattgagaagcacggccgcagcagcaaggacaaggaaaatgccaagagcctggacaagccagagcagttcctgtatgagctgagcctcatccccaacttcagcgagagggtcttctgcatcctcttccagagcaccttcagcgagagcatctgcagcatccggaggaagctggagctgctgcagaagctgtgtgagaccctgaagaatggacctggggtgatgcaggtgctgggcctggtgctggccttcggcaactacatgaatggaggcaacaagacccggggccaggctgatggcttcggcctggacatcctgcccaagctgaaggatgtgaagagcagtgacaacagccgcagcctgctgagctacatcgtgtcctactacctgaggaactttgatgaagatgctgggaaggagcagtgcctcttccccctgcctgagccccaggacctcttccaggccagccagatgaagtttgaggacttccagaaggacctgaggaagctgaagaaggacctgaaggcctgtgaggtggaggccggcaaggtgtaccaggtgagcagcaaggagcacatgcagcccttcaaggagaacatggagcagttcatcatccaggccaagattgaccaggaggccgaggagaacagcctgacagagacccacaagtgcttcctggagaccacagcctacttcttcatgaagcccaagctgggggagaaggaggtgagccccaatgccttcttcagcatctggcatgagttcagcagtgacttcaaggacttctggaagaaggagaacaagctgctgctgcaggagcgggtgaaggaggccgaggaggtgtgccggcagaagaagggcaagagcctgtacaagatcaagcccaggcatgattctggcatcaagaacaacaacagcatgcacacctag

SEQ ID NO: 22294 - DNA, 570 bp, Artificial Sequence
  Description of Artificial Sequence: Synthetic coding sequence
atgacagccagcgccagcagcttcagcagcagccagggcgtgcagcagcccagcatctacagcttcagccagatcaccaggagcctcttcctgagcaatggagtggccgccaatgacaagctgctgctgagcagcaaccgcatcacagccatcgtgaatgcctctgtggagggccagaggatcctgcggggcatccagtacatcaaggtgcctgtgacagatgcccgggacagccggctgtatgacttctttgaccccatcgctgacctgatccacaccatcgacatgaggcagggccgcaccctgctgcactgcatggccggcgtgagccgcagcgccagcctgtgcctggcctacctgatgaagtaccacagcatgagcctgctggatgcccacacctggaccaagagccggcggcccatcatccggcccaacaacggcttctgggagcagctgatcaactatgagttcaagctgttcaacaacaacacagtgaggatgatcaacagccctgtgggcaacatcccagacatctatgagaaggacctgaggatgatgatctccatgtag

SEQ ID NO: 22295 - DNA, 549 bp, Artificial Sequence; identical to SEQ ID NO: 18787
  Description of Artificial Sequence: Synthetic coding sequence

SEQ ID NO: 22296 - DNA, 387 bp, Artificial Sequence
  Description of Artificial Sequence: Synthetic coding sequence
atggtgttccgccgctttgtggaggtgggccgggtggcctacgtgtcctttggcccccatgctgggaagctggtggccatcgtggatgtgattgaccagaacagagccctggtggatggcccctgcacccaggtgcggcggcaggccatgcccttcaagtgcatgcagctgacagacttcatcctgaagttcccccacagcgcccaccagaagtatgtgcggcaggcctggcagaaggctgacatcaacaccaagtgggccgccacccgctgggccaagaagattgaggcccgggagaggaaggccaagatgacagactttgaccgcttcaaggtgatgaaggccaagaagatgaggaaccgcatcatcaagaatgacaccaggtag

SEQ ID NO: 22297 - DNA, 492 bp, Artificial Sequence; identical to SEQ ID NO: 22289
  Description of Artificial Sequence: Synthetic coding sequence

SEQ ID NO: 22298 - DNA, 1224 bp, Artificial Sequence
  Description of Artificial Sequence: Synthetic coding sequence
atggctgctgagctgtatgccccagccagcgctgctgctgctgacctggccaacagcaatgctggagctgctgtgggcaggaaggccggccccaggagcccccccagcgccccagccccagcccctcctcctccagccccagccccacccaccctgggcaacaaccaccaggagagccctggctggcgctgctgccggcccaccctgcgggagagaaatgccctgatgttcaacaatgagctgatggctgatgtgcactttgtggtgggccccccaggggccaccaggacagtgcctgcccacaagtatgtgctggccgtgggcagcagcgtcttctacgccatgttttatggagacctggccgaggtgaagtctgagatccacatcccagatgtggagcctgctgccttcctgatcctgctgaagtacatgtacagtgatgaaattgacctggaggccgacacagtgctggccaccctgtatgctgccaagaagtacatcgtgcctgccctggccaaggcctgtgtgaacttcctggagaccagcctggaggccaagaatgcctgtgtgctgctgagccagagccggctgtttgaggagcctgagctgacccagcgctgctgggaggtgattgatgcccaggccgagatggccctgcggtctgagggcttctgtgaaattgaccggcagaccctggagatcatcgtgacccgggaggccctgaacaccaaggaggccgtggtgtttgaagctgtgctgaactgggccgaggccgagtgcaagaggcagggcctgcccatcacccccaggaacaagagacatgtgctgggccgggccctgtacctggtgcgcatccccaccatgaccctggaggagtttgccaatggagctgcccagagcgacatcctgaccctggaggagacccacagcatcttcctgtggtacacagccaccaacaagccccggctggacttccccctgaccaagaggaagggcctggccccccagcgctgccaccgcttccagagcagcgcctaccgcagcaaccagtggagataccggggccgctgtgacagcatccagtttgctgtggaccggcgggtcttcatcgccggcctgggcctgtatggcagcagcagcggcaaggccgagtacagcgtgaagattgagctgaagaggctgggcgtggtgctggcccagaacctgaccaagttcatgtcctag

SEQ ID NO: 22299 - DNA, 603 bp, Artificial Sequence
  Description of Artificial Sequence: Synthetic coding sequence
atgctggagctggtggcccagaagcagcgggagcgggaggagcgggaggagcgggaggccctggagcgggagcggcagaggcggcggcagggccaggagctgtctgctgcccggcagaggctgcaggaggatgagatgagaagagctgctgaggagcggcggcgggagaaggccgaggagctggccgcccggcagagggtgcgggagaagattgagcgggacaaggccgagcgggccaagaagtatggaggctctgtgggcagccagcccccacctgtggcccctgagcccggccctgtgcccagcagccccagccaggagccccccaccaagcgggagtatgaccagtgccgcatccaggtgcggctgcctgatggcaccagcctgacccagaccttccgggcccgggagcagctggccgctgtgcggctgtatgtggagctgcacagaggagaggagctgggcggcggccaggaccctgtgcagctgctgagcggcttcccccggcgggccttcagcgaggccgacatggagcggcccctgcaggagctgggcctggtgcccagcgctgtgctgattgtggccaagaagtgccccagctag

SEQ ID NO: 22300 - DNA, 885 bp, Artificial Sequence
  Description of Artificial Sequence: Synthetic coding sequence
atgggcctggcctcctggagccagctggccagcaccccccgggcccctggcagcagagatgcccgctgggagcggcgggagcccgccctgcggggggccaaggaccggctgaccatcggcaagcacctggacatgggcagcccccagctgcggacccgggaccggggctggcccagccccaggcctgagcgggagaagaggaccagccagagcgcccggcggcccacctgcacagagagccgctggaagtctgaggaggaggtggagagtgatgatgagtacctggccctgcctgcccggctgacccaggtgagcagcctggtgtcctacctgggcagcatcagcaccctggtgaccctgcccaccggggacatcaagggccagagccccctggaggtgtctgacagtgatggccctgccagcttccccagcagcagcagccagagccagctgcccccaggagctgccctgcagggcagcggggaccctgagggccagaacccctgcttcctgcggagctttgtgcgggcccatgacagcgctggggagggcagcctgggcagcagccaggccctgggcgtgagcagcggcctgctgaagacccggcccagcctgcctgcccggctggaccgctggcccttcagtgaccctgatgtggagggccagctgcccaggaagggcggggagcagggcaaggagagcctggtgcagtgtgtgaaggtgatgaccctgaatgtgaggaagctgtgtgtgcaggtgtcctgcctcttcccccagagcaccaacatcatcatcaagcacgtgcacgtggaccaggccctcttcatgtgccaggccctgtgctgcaccctgagctacagcgtgctgaccaccttcaccaggtag

SEQ ID NO: 22301 - DNA, 354 bp, Artificial Sequence
  Description of Artificial Sequence: Synthetic coding sequence
atggtgaggaagatcaccctggtgtctgctgcccctgggaaggtgatctgtgagatgaaggtggaggaggagcacaccaatgccatcggcaccctgcatggaggcctgacagccaccctggtggacaacatcagcaccatggccctgctgtgcacagagcggggggcccctggggtgtctgtggacatgaacatcacctacatgagccctgccaagctgggagaagatattgtcatcacagcccacgtgctgaagcagggcaagaccctggccttcacctctgtggacctgaccaacaaggccaccgggaagctgattgcccagggccgccacaccaagcacctgggcaactag

SEQ ID NO: 22302 - DNA, 840 bp, Artificial Sequence
  Description of Artificial Sequence: Synthetic coding sequence
atgaccagcggcaagatcaagaagttcatccaggagaacatcttcggcatctgcccccacatgacagaggacaacaaggacctgatccagggcaaggacctgctgattgcctactatgatgtggactatgagaagaatgccaagggcagcaactactggaggaacagagtgatgatggtggccaagaagttcctggatgctggccacaagctgaactttgctgtggccagcaggaagaccttcagccatgagctgagtgactttggcctggagagcacagctggggagatccctgtggtggccatcagaacagccaagggggagaagtttgtgatgcaggaggagttcagcagagatggcaaggccctggagcgcttcctgcaggactactttgatggcaacctgaagcgctacctgaagtctgagcccatccctgagagcaatgatggccctgtgaaggtggtggtggccgagaactttgatgaaattgtgaacaatgaaaacaaggatgtgctgattgagttctacgccccctggtgtggccactgcaagaacctggagcccaagtacaaggagctgggggagaagctgagcaaggaccccaacatcgtgattgccaagatggatgccacagccaatgatgtgcccagcccctatgaggtgcggggcttccccaccatctacttctccccagccaacaagaagctgaaccccaagaagtatgaaggaggccgggagctgagtgacttcatctcctacctgcagcgggaggccaccaacccccctgtgatccaggaggagaagcccaagaagaagaagaaggcccaggaggacctgtag

SEQ ID NO: 22303 - DNA, 3228 bp, Artificial Sequence
  Description of Artificial Sequence: Synthetic coding sequence
atgagccagggcttccaccctgagcgggaccccagcgacctgaagaaggtgaaggctgtggaggagaatggagaggaggccgagcctgtgagaaatggagctgagagcgtgtctgagggggagggcattgatgccaacagcggcagcacagacagcagtggagatggagtgaccttccccttcaagccagagagctggaagcccacagacacagagggcaagaagcagtatgaccgggagttcctgctggacttccagttcatgcctgcctgcatccagaagccagagggcctgccccccatcagtgatgtggtgctggacaagatcaaccagcccaagctgcccatgaggaccctggacccccgcatcctgccccggggccctgacttcaccccagcctttgctgactttggccggcagacccctgggggccggggcgtgcccatctgcaaggtgcagagccgccacggcctgcccatcctggagcagagcaaggcccccacctgcccccccctggtgatgagccacccccccatgaagagcctgcccctgggcctgctgaatgtgggcagccgccgcagccagcccggccagaggcgggagcccaggaagatcatcaccgtgtctgtgaaggaggatgtgcacctgaagaaggccgagaatgcctggaagcccagccagaagagggacagccaggctgatgatcctgagaacatcaagacccaggagctgttcaggaaggtgcgcagcatcctgaacaagctgaccccccagatgttcaaccagctgatgaagcaggtgtctggcctgactgtggacacagaggagcggctgaagggcgtcatcgacctggtgtttgagaaggccattgatgagcccagcttctctgtggcctatgccaacatgtgccgctgcctggtgaccctgaaggtgcccatggctgacaagccaggcaacacagtgaacttcaggaagctgctgctgaaccgctgccagaaggagtttgagaaggacaaggcagatgatgatgtgtttgagaagaagcagaaggagctggaggccgccagcgcccctgaggagaggacccggctgcatgatgagctggaggaggccaaggacaaggccaggagaagaagcatcggcaacatcaagttcatcggggagctgttcaagctgaagatgctgacagaggccatcatgcatgactgtgtggtgaagctgctgaagaaccatgatgaggagagcctggagtgcctgtgccgcctgctgaccaccatcggcaaggacctggactttgagaaggccaagcccaggatggaccagtacttcaaccagatggagaagatcgtgaaggagaggaagaccagcagccgcatccgcttcatgctgcaggatgtgattgacctgcggctgtgcaactgggtgtccagaagagctgaccagggccccaagaccatcgagcagatccacaaggaggccaagattgaggagcaggaggagcagaggaaggtgcagcagctgatgaccaaggagaagagaagacctggggtgcagagggtggatgaaggaggctggaacacagtgcagggcgccaagaacagccgggtgctggaccccagcaagttcctgaagatcaccaagcccaccattgatgagaagatccagctggtgcccaaggcccagctgggctcctggggcaagggcagcagcggcggggccaaggccagcgagacagatgccctgcggagcagcgccagcagcctgaaccgcttcagcgccctgcagcccccagcccccagcggcagcacccccagcacccctgtggagtttgacagcaggaggaccctgaccagccggggctccatgggccgggagaagaatgacaagcccctgcccagcgccacagcccggcccaacaccttcatgaggggcggcagcagcaaggacctgctggacaaccagagccaggaggagcagaggcgggagatgctggagaccgtgaagcagctgactggaggagtggatgtggagaggaacagcacagaagctgagaggaacaagacccgggagagcgccaagccagagatcagcgccatgtctgcccatgacaaggccgccctgtctgaggaggagctggagaggaagagcaagagcatcattgatgagttcctgcacatcaatgacttcaaggaggccatgcagtgtgtggaggagctgaatgcccagggcctgctgcacgtgtttgtgcgggtgggcgtggagagcaccctggagaggagccagatcacccgggaccacatgggccagctgctgtaccagctggtgcagagcgagaagctgagcaagcaggacttcttcaagggcttcagcgagaccctggagctggctgatgacatggccatcgacatcccccacatctggctgtacctggccgagctggtgacccccatgctgaaggagggcggcatctccatgagggagctgaccatcgagttcagcaagcccctgctgcctgtgggccgggccggcgtgctgctgtctgagatcctgcacctgctgtgcaagcagatgagccacaagaaggtgggcgccctgtggagggaggccgacctgtcctggaaggacttcctgcctgaaggagaagatgtgcacaacttcctgctggagcagaagctggacttcattgaaagtgacagcccctgcagcagcgaggccctgagcaagaaggagctgtctgctgaggagctgtacaagaggctggagaagctgatcatcgaggacaaggccaatgatgagcagatctttgactgggtggaggccaacctggatgagatccagatgagcagccccaccttcctgcgggccctgatgacagctgtgtgcaaggccgccatcatcgctgacagcagcaccttccgggtggacacagctgtgatcaagcagagggtgcccatcctgctgaagtacctggacagcgacacagagaaggagctgcaggccctgtatgccctgcaggccagcatcgtgaagctggaccagcctgccaacctgctgaggatgttctttgactgcctgtatgatgaggaggtgatcagtgaagatgccttctacaagtgggagagcagcaaggaccctgctgagcagaatggaaaaggagtggccctgaagtctgtgacagccttcttcacctggctgcgggaggccgaggaggagagcgaggacaactag

SEQ ID NO: 22304 - DNA, 474 bp, Artificial Sequence
  Description of Artificial Sequence: Synthetic coding sequence
atgaagtgcatcccctacagcgtgctgctgaaggacctggagatgaggaacctgcgggagctggaggacctgatcatcgaggccgtgtacacagacatcatccagggcaagctggaccagaggaaccagctgctggaggtggacttctgcatcggccgggacatcaggaagaaggacatcaacaacatcgtgaagaccctgcacgagtggtgtgatggctgtgaggccgtgctgctgggcatcgagcagcaggtgctgcgggccaaccagtacaaggagaaccacaacagaacccagcagcaggtggaggccgaggtgaccaacatcaagaagaccctgaaggccacagccagcagcagcgcccaggagatggagcagcagctggccgagcgggagtgcccccctcatgctgagcagaggcagcccaccaagaagatgagcaaggtgaagggcctggtgagcagccgccactag

SEQ ID NO: 22305 - DNA, 837 bp, Artificial Sequence
  Description of Artificial Sequence: Synthetic coding sequence
atggactgccgggagatggacctgtatgaggactaccagagcccctttgattttgatgctggggtgaacaagagctacctgtacctgagccccagcggcaacagcagccccccaggcagccccaccctgcagaagtttggcctgctgaggacagatcctgtgcctgaggagggagaagatgtggccgccaccatcagcgccacagagaccctgtctgaggaggagcaggaggagctgcggcgggagctggccaaggtggaggaggagatccagaccctgagccaggtgctggccgccaaggagaagcacctggccgagatcaagaggaagctgggcatcaacagcctgcaggagctgaagcagaacatcgccaagggctggcaggatgtgacagccaccagcgcctacaagaagaccagcgagaccctgagccaggccggccagaaggccagcgctgccttcagctctgtgggcagcgtcatcaccaagaagctggaggatgtgaagaacagccccaccttcaagagctttgaggagaaggtggagaacctgaagggcagccccaagaatgtggagagctttgcctccatgctgcggcacagccccctgacccagatgggccctgccaaggacaagctggtgattggccgcatcttccacatcgtggagaatgacctgtacatcgactttggaggcaagttccactgtgtgtgcagaagacctgaggtggatggagagagccccatctcctggtatgctgtgtggaggcgcttcagccaggtgatgatcacctgcttcagcagcaacagcgactttgggaagcacaggaagaggtag

SEQ ID NO: 22306 - DNA, 3123 bp, Artificial Sequence; identical to SEQ ID NO: 19245
  Description of Artificial Sequence: Synthetic coding sequence

SEQ ID NO: 22307 - DNA, 1809 bp, Artificial Sequence
  Description of Artificial Sequence: Synthetic coding sequence
atgtctgacaagagtgacctgaaggccgagctggagaggaagaagcagaggctggcccagatccgggaggagaagaagaggaaggaggaggagaggaagaagaaggaggccgacatgcagcagaagaaggagcctgtgcaggatgacagcgacctggacaggaagaggcgggagacagaggccctgctgcagagcatcggcatcagccctgagccccccctggtgcccacccccatgagccccagcagcaagtctgtgtccacccccagcgaggccggcagccaggacagcggggacctgggccccctgacccggcggcggctgcacaagctgggcgtgtccaaggtgacccaggtggacttcctgccccgggaggtggtgtcctacagcaaggagacccagacccccctggccacccaccagagcgaggaggatgaagaagatgaggagatggtggagagcaaggtgggccaggacagcgagctggagaaccaggacaagaagcaggaggtgaaggaggccccaccccgggagctgacagaggaggagaagcagcagatcctgcacagcgaggagttcctgatcttctttgacaggaccatccgggtcatcgagcgggccctggccgaggacagcgacatcttctttgactacagcggccgggagctggaggagaaggatggagatgtgcaggccggggccaacctgtccttcaaccggcagttctatgatgagcactggagcaagcaccgggtggtgacctgcatggactggagcctgcagtacccagagctgatggtggccagctacaacaacaatgaagatgcccctcatgagccagatggagtggccctggtgtggaacatgaagttcaagaagaccaccccagaatatgtgttccactgccagagctctgtgatgtctgtgtgctttgcccgcttccaccccaacctggtggtgggcggcacctacagcggccagatcgtgctgtgggacaacagaagccacaggaggacccctgtgcagaggacccccctgtctgctgctgcccacacccaccctgtgtactgtgtgaatgtggtgggcacccagaatgcccacaacctgatcaccgtgtccacagatggcaagatgtgctcctggagcctggacatgctgagcaccccccaggagagcatggagctggtgtacaacaagagcaagcctgtggccgtgacaggcatggccttccccactggagatgtgaacaactttgtggtgggcagcgaggagggcaccgtgtacacagcctgcagacatggcagcaaggccggcattggagaggtgtttgagggccaccagggccctgtgacaggcatcaactgccacatggctgtgggccccatcgacttcagccacctgtttgtgaccagcagctttgactggacagtgaagctgtggaccaccaagcacaacaagcccctgtacagctttgaggacaatgctgactatgtgtatgatgtgatgtggagccctgtgcacccagccctgtttgcctgtgtggatggcatgggccgcctggacctgtggaacctgaacaatgacacagaggtgcccacagcctctgtggccatcgagggcgccagcgccctgaacagagtgcgctgggcccaggccggcaaggaggtggccgtgggggacagcgagggccgcatctgggtgtatgatgtgggggagggcctggccatgctgcccggctggagccagaacagctggacccaggccatcctgctgtgctggccacccaaggtgctgggcctgcagacctag

SEQ ID NO: 22308 - DNA, 2847 bp, Artificial Sequence
  Description of Artificial Sequence: Synthetic coding sequence
atgtatggcagcgcccggtctgtgggcaaggtggagcccagcagccagagccctggccgcagcccccggctgcccaggagcccccggctgggccacaggaggaccaacagcactggaggcagcagcggcagctctgtgggcggcggcagcggcaagaccctgtccatggagaacatccagagcctgaatgctgcctatgccaccagcggccccatgtacctgagtgaccatgaaaatgtgggcagcgagacccccaagagcaccatgaccctgggccgcagcggcggccgcctgccctacggcgtgaggatgacagccatgggcagcagccccaacatcgccagcagcggcgtggccagtgacaccatcgcctttggagagcaccacctgccccctgtgtccatggccagcacagtgccccacagcctgcggcaggcccgggacaacaccatcatggacctgcagacccagctgaaggaggtgctgcgggagaatgacctgctgaggaaggatgtggaggtgaaggagagcaagctgagcagctccatgaacagcatcaagaccttctggagccctgagctgaagaaggagcgggccctgaggaaggatgaggccagcaagatcaccatctggaaggagcagtacagagtggtgcaggaggagaaccagcacatgcagatgaccatccaggccctgcaggatgagctgcgcatccagagggacctgaaccagctgttccagcaggacagcagcagcaggactggagagccctgtgtggccgagctgacagaggagaacttccagaggctgcacgccgagcacgagcggcaggccaaggagctgttcctgctgaggaagaccctggaggagatggagctgagaattgagacccagaagcagaccctgaatgccagagatgagagcatcaagaagctgctggagatgctgcagagcaagggcctgagcgccaaggccacagaggaggaccacgagaggacccggcggctggccgaggccgagatgcacgtgcaccacctggagagcctgctggagcagaaggagaaggagaacagcatgctgcgggaggagatgcacagaagatttgaaaatgccccagacagcgccaagaccaaggccctgcagaccgtcatcgagatgaaggacagcaagatcagctccatggagcggggcctgcgggacctggaggaggagatccagatgctgaagagcaatggagccctgagcacagaggagcgggaggaggagatgaagcagatggaggtgtaccgcagccacagcaagttcatgaagaacaagattggccaggtgaagcaggagctgagcaggaaggacacagagctgctggccctgcagaccaagctggagaccctgaccaaccagttcagtgacagcaagcagcacatcgaggtgctgaaggagagcctgacagccaaggagcagagagctgccatcctgcagacagaggtggatgccctgcggctgcggctggaggagaaggagaccatgctgaacaagaagaccaagcagatccaggacatggccgaggagaagggcacccaggccggggagatccatgacctgaaggacatgctggatgtgaaggagaggaaggtgaatgtgctgcagaagaagattgagaacctgcaggagcagctgcgggacaaggagaagcagatgagcagcctgaaggagcgggtgaagagcctgcaggccgacaccaccaacacagacacagccctgaccaccctggaggaggccctggccgagaaggagaggaccatcgagcggctgaaggagcagagggacagagatgagcgggagaagcaggaggagattgacaactacaagaaggacctgaaggacctgaaggagaaggtgtccctgctgcagggcgacctgtctgagaaggaggccagcctgctggacctgaaggagcacgccagcagcctggccagcagcggcctgaagaaggacagccggctgaagaccctggagatcgccctggagcagaagaaggaggagtgcctgaagatggagagccagctgaagaaggcccatgaagctgccctggaggcccgggccagccctgagatgtctgaccgcatccagcacctggagcgggagatcacccgctacaaggatgagagcagcaaggcccaggccgaggtggaccggctgctggagatcctgaaggaggtggagaatgagaagaatgacaaggacaagaagattgctgagctggagagcctcttcagccggcaggtgaaggaccagaacaagaaggtggccaacctgaagcacaaggagcaggtggagaagaagaagagcgcccagatgctggaggaggcccggcggcgggaggacaacctgaatgacagcagccagcagctgcaggtggaggagctgctgatggccatggagaaggtgaagcaggagctggagagcatgaaggccaagctgagcagcacccagcagagcctggccgagaaggagacccacctgaccaacctgcgggcagagaggaggaagcacctggaggaggtgctggagatgaagcaggaggccctgctggccgccatcagcgagaaggatgccaacatcgccctgctggagctgagcagcagcaagaagaagacccaggaggaggtggccgccctgaagcgggagaaggaccggctggtgcagcagctgaagcagcagacccagaacaggatgaagctgatggctgacaactatgaagatgaccacttcaagagcagccacagcaaccagaccaaccacaagcccagcccagaccaggatgaggaggagggcatctgggcctag

SEQ ID NO: 22309 - DNA, 2742 bp, Artificial Sequence
  Description of Artificial Sequence: Synthetic coding sequence
atggaggtgggcagcgaggaggagaagtgggagaagctggatgctgagtttgaccactttgtggtggacatgaagccctttgtgctgaagctgccccacaggacagagcggcagagatgtgccctgtggatcaggaagctgtgtgagcccagcggcactggagctggcatcatgggcaggaagaacagaaacctgtatgccaagctgctgctgcacatgctgaagagaggagccctggagggccccttcacccacaggcctgagcccggcaccctgaagatcctgcccagctacatgagcatctactttgatgagcccaacccagcccgggccaagggcagcagccctgagggcctgcctgcctgggtgctgggggagctggagaccagcgagcacaagctgaatgaatcctggaagctgagcagcggggaggacaacaccctggtgcagagccccacagatgtgtacagccgggagcagtacaccgggaagctgcgggtgcgcagccacagcctgagccccacccaccgggaggatggccagaacatcacccccaagatctgtgaggtgtacagcaagaagagccctgtgtccctggatgacagcgacatcgaggcccggctgaacagctggaacctgggcctggacatgaagaccaagatgatggaggccaagttccacgaggagaagctgaagctgcagcagaagcatgatgctgatgtgcagaagatcctggagaggaagaacaatgaaattgaggagctgaagaccctgtaccgcagcaagcagcacgagacagaggagaccatcaggaagctggagaagaaggtgcagaccctcatccgggactgccaggtgatccgggagaccaaggaggaccagattgctgagctgaagaagatctgtgagcagagcacagagagcctgaacaatgactgggagaagaagctgcacaatgctgtggccgagatggagcaggagaagtttgacctgcagaagcagcacacagagaacatccaggagctgctggaggacaccaacgtgcggctgaacaagatggagagcgagtacatggcccagacccagagcaccaaccacatgatcaaggagctggaggcccgggtgcagcagctgactggagaggccgagaacagcaacctgcagaggcagaagctgatccaggagaaggccgagctggagcgctgctaccagatcacctgcagcgagctgcaggaggtgaaggcccggaggaacaccctgcacaaggagaaggaccacctggtgaatgactatgagcagaacatgaagctgctgcagaccaagtatgatgctgacatcaacctgctgaagcaggagcacgccctgagcgccagcaaggccagctccatgattgaggagctggagcagaatgtgtgccagctgaagcagcagctgcaggagagcgagctgcagaggaagcagcagctgcgggaccaggagaacaagttccagatggagaagagccacctgaagcacatctatgagaagaaggcccatgacctgcagagcgagctggacaagggcaaggaggacacccagaagaagatccacaagtttgaggaggccctgaaggagaaggaggagcagctgaccagggtgacagaggtgcagaggctgcaggcccagcaggctgatgctgccctggaggagttcaagaggcaggtggagctgaacagcgagaaggtgtatgcagagatgaaggagcagatggagaaggtggaggccgacctgaccaggagcaagagcctgcgggagaagcagagcaaggagttcctgtggcagctggaggacatccggcagagatatgagcagcagatcgtggagctgaagctggagcacgagcaggagaagacccacctgctgcagcagcacaatgctgagaaggacagcctggtgcgggaccacgagcgggagattgagaacctggagaagcagctgcgggccgccaacatggagcacgagaaccagatccaggagttcaagaagagagatgcccaggtgattgctgacatggaggcccaggtgcacaagctgcgggaggagctgatcaacgtgaacagccagaggaagcagcagctggtggagctgggcctgctgcgggaggaggagaagcagagggccacccgggagcacgagatcgtggtgaacaagctgaaggccgagagcgagaagatgaagattgagctgaagaagacccatgctgctgagacagagatgaccctggagaaggccaacagcaagctgaagcagatcgagaaggagtacacccagaagctggccaagagcagccagatcatcgccgagctgcagaccaccatcagcagcctgaaggaggagaacagccagcagcagctggccgctgagcggcggctgcaggatgtgcggcagaagtttgaagatgagaagaagcagctgatccgggacaatgaccaggccatcaaggtgctgcaggatgagctggagaacagaagcaaccaggtgcgctgtgccgagaagaagctgcagcacaaggagctggagagccaggagcagatcacctacatccggcaggagtatgagaccaagctgaagggcctgatgcctgccagcctgcggcaggagctggaggacaccatcagcagcctgaagagccaggtgaacttcctgcagaagagggccagcatcctgcaggaggagctgaccacctaccagggcagaagatag

SEQ ID NO: 22310 - DNA, 825 bp, Artificial Sequence
  Description of Artificial Sequence: Synthetic coding sequence
atgcaggatgagaagctgagagatgaaacagagcagcctgtgtccaaggtgattgaaagaaaccggctgaggacagtgctgaagaacctgagcctgctgaagctgctgaagagcagcaacagacgcatccaggagctgcacaagctggccaagcgctgctggcacagcctgctgtctgtgcccaagatcctgcgcatcagcagcggggagaacagcgcctgcaacaagaccaagcagaacaatgaggagttccaggagatcggctgcagcgagaaggagctgaagagcaagaagctggagagcactggagaccccaagaagaaggagtacaaggagtggaagagccaggtgcagagcggcatgaggaacaaggagaagaccagcctggccgccatgcccaggaaggagaagcacatcgagcctgaggtgcccaggaccagcagagatgacagcctgaaccctggggtgcagggccggcagcccctgacagagggccccagggtcatcttcatcaagccctacagaaacagaacacccatgggccacatgaagcagctggatgtggccgaccagtggatctggtttgagggcctgcccacccgcatccacctgcctgccccccgggtgatgtgccgcagcagcaccctgcgctgggtgaagaggcgctgcacccgcttctgcagcgccagcctggagatgcccatgtggcacccctacaaggtggatgtgacctggacccgggcccggggggccagccggggctggaggagccgccaccagctgaagggcagaaatggctggaggaacagccgggtgtacaagtag

SEQ ID NO: 22311 - DNA, 156 bp, Artificial Sequence
  Description of Artificial Sequence: Synthetic coding sequence
atgcagctgcggcacatcggggacaacatcgaccacaggatggtgcgggaggacctgcagcaggacggcagagatgccctggaccactttgtgttcttcttcttccggcgggtgcaggtgctgctgcacttcttctggaacaaccacctgctgtag

SEQ ID NO: 22312 - DNA, 444 bp, Artificial Sequence
  Description of Artificial Sequence: Synthetic coding sequence
atggccggcggggcccgggaggtgctgaccctgcagctgggccactttgctggctttgtgggcgcccactggtggaaccagcaggatgctgccctgggccgggccacagacagcaaggagcccccaggagagctgtgcccagatgtgctgtacagaactggaagaaccctgcacggccaggagacctacacccccaggctcatcctgatggacctgaagggcagcctgagcagcctgaaggaggagggcggcctgtacagagacaagcagctggatgctgccatcgcctggcagggcaagctgaccacccacaaggaggagctgtaccccaagaacccctacctgcaggacttcctgtctgctgaggtgcgggcctctgtgctgaacttcctgacccgctgccacaacctgcgggtgtccattggagctggcagcgctgagtag

SEQ ID NO: 22313 - DNA, 1677 bp, Artificial Sequence
  Description of Artificial Sequence: Synthetic coding sequence
atgtctgtgtctgtgcatgagaccaggaagagccgcagcagcacaggctccatgaatgtgaccctcttccacaaggccagccacccagactgtgtgctggccgccagcagccgctactttgaggccatgttcagccacggcctgcgggagagcagagatgacacagtgaacttccaggacaacctgcaccctgaggtgctggagctgctgctggactttgcctacagcagcagaattgccatcaatgaggagaatgctgagagcctgctggaggccggggacatgctgcagttccatgatgtgagagatgctgctgctgagttcctggagaagaacctcttccccagcaactgcctgggcatgatgctgctgagtgatgcccaccagtgccggcggctgtatgagttctcctggaggatgtgcctggtgcactttgaaacagtgcggcagagcgaggacttcaacagcctgagcaaggacaccctgctggacctgatcagcagtgatgagctggagacagaagatgagcgggtggtgtttgaggccatcctgcagtgggtgaagcatgacctggagcccaggaaggtgcacctgcctgagctgctgcggtctgtgcggctggccctgctgcccagcgactgcctgcaggaggccgtgtcctctgaggccctgctgatggctgatgagaggaccaagctgatcatggatgaggccctgcgctgcaagacccgcatcctgcagaatgatggagtggtgaccagcccctgtgcccggcccaggaaggccggccacaccctgctgatcctgggcggccagaccttcatgtgtgacaagatctaccaggtggaccacaaggccaaggagatcatccccaaggctgacctgcccagccccaggaaggagttcagcgccagcgccatcggctgcaaggtgtatgtgactggaggccggggctctgaaaatggagtgtccaaggatgtgtgggtgtatgacacagtgcatgaggagtggagcaaggccgcccccatgctgattgcccgcttcggccacggcagcgctgagctggagaactgcctgtatgtggtgggcggccacaccagcctggccggggtcttccctgccagccccagcgtgtccctgaagcaggtggagaagtatgaccccggggccaacaagtggatgatggtggcccccctgagagatggagtgtccaatgctgctgtggtgtctgccaagctgaagctgtttgtgtttggaggcaccagcatccaccgggacatggtgtccaaggtgcagtgctatgaccccagcgagaaccgctggaccatcaaggccgagtgcccccagccctggagatacacagctgctgctgtgctgggcagccagatcttcatcatgggcggggacacagagttcaccgctgccagcgcctacagatttgactgtgagaccaaccagtggacccgcatcggggacatgacagccaagaggatgagctgccacgccctggccagcggcaacaagctgtatgtggtgggcggctacttcggcacccagcgctgcaagaccctggactgctatgaccccaccagtgacacctggaactgcatcaccaccgtgccctacagcctcatccccacagcctttgtgtccacctggaagcacctgcctgcctag

SEQ ID NO: 22314 - DNA, 2916 bp, Artificial Sequence
  Description of Artificial Sequence: Synthetic coding sequence
atgaacttcctgcggggcgtgatgggcggccagagcgctggcccccagcacacagaggccgagaccgtgagaggagctgctggcctgggcctgggcaaaggaagtggccagggccggggccgcagcacccggcggcctgaggagtgtggcctgaagttccgccacagcttccggctggtgaagcacatcctgtaccacgtgaccatcaacgtgtctgacagcgagatcatcggctacgccctggacaccctgtacaacatcatcagcaatgaggaggaggaggaggtgggcggcagccaggaggagaacagcacccggcagagcgaggacctgggcagccagttcacagagatcttcatcaagcagcaggagaatgtgaccctgctgctgagcctgctggaggagtttgacttccacgtgcgctggccaggagtgaagctgctgaccagcctgctgaagcagctgggcccccaggtgcagcagatcatcctggtgagccccatgggcgtgtcccggctgatggacctgctggccgacagccgggaggtgatcagaaatgatggagtgctgctgctgcaggccctgaccaggagcaatggagccatccagaagatcgtggcctttgaaaatgcctttgagcggctgctggacatcatcagcgaggagggcaacagtgatggcggcatcgtggtggaggactgcctgatcctgctgcagaacctgctgaagaacaacaacagcaaccagaacttcttcaaggagggcagctacatccagaggatgaagccctggtttgaggtgggagatgagaacagcggctggagcgcccagaaggtgaccaacctgcacctgatgctgcagctggtgcgggtgctggtgagccccaccaaccccccaggggccaccagcagctgccagaaggccatgttccagtgtggcctgctgcagcagctgtgcaccatcctgatggccactggagtgcctgctgacatcctgacagagaccatcaacacagtgtctgaggtgatccggggctgccaggtgaaccaggactactttgcctctgtgaatgcccccagcaacccccccaggcctgccatcgtggtgctgctgatgtccatggtgaatgaaaggcagccctttgtgctgcgctgtgctgtgctgtactgcttccagtgcttcctgtacaagaaccagaagggccagggcgagatcgtgtccaccctgctgcccagcaccattgatgccactggaaacagcgtgtctgctggccagctgctgtgtggcggcctcttcagcacagacagcctgagcaactggtgtgccgctgtggccctggcccacgccctgcaggagaatgccacccagaaggagcagctgctgcgggtgcagctggccaccagcatcggcaacccccctgtgtccctgctgcagcagtgcaccaacatcctgagccagggcgacaagattgaccggcggggcagcaagatccagaccagggtgggcctgctgatgctgctgtgcacctggctgagcaactgccccatcgctgtgacccacttcctgcacaacagcgccaacgtgcccttcctgaccggccagattgctgagaacctgggggaggaggagcagctggtgcagggcctgtgtgccctgctgctgggcatcagcatctacttcaatgacaacagcctggagagctacatgaaggagaagctgaagcagctgattgagaagagaattggcaaggagaacttcatcgagaagctgggcttcatcagcaagcatgagctgtacagccgggccagccagaagccccagcccaacttccccagccctgagtacatgatctttgaccacgagttcaccaagctggtgaaggagctggagggcgtcatcaccaaggccatctacaagagcagcgaggaggacaagaaggaggaggaggtgaagaagaccctggagcagcacgacaacatcgtgacccactacaagaacatgatccgggagcaggacctgcagctggaggagctgcggcagcaggtgtccaccctgaagtgccagaatgagcagctgcagacagctgtgacccagcaggtgtcccagatccagcagcacaaggaccagtacaacctgctgaagatccagctgggcaaggacaaccagcaccagggcagctacagcgagggcgcccagatgaatggcatccagcctgaggagatcggccgcctgcgggaggagattgaggagctgaagaggaaccaggagctgctgcagagccagctgacagagaaggacagcatgattgagaacatgaagagcagccagaccagcggcaccaatgagcagagcagcgccatcgtgtctgcccgggacagcgagcaggtggccgagctgaagcaggagctggccaccctgaagagccagctgaacagccagagcgtggagatcaccaagctgcagacagagaagcaggagctgctgcagaagacagaggcctttgccaagtctgtggaggtgcagggcgagacagagaccatcatcgccaccaagaccacagatgtggagggccgcctgagcgccctgctgcaggagaccaaggagctgaagaatgagatcaaggccctgtctgaggagaggacagccatcaaggagcagctggacagcagcaacagcaccatcgccatcctgcagacagagaaggacaagctggagctggagatcacagacagcaagaaggagcaggatgacctgctggtgctgctggccgaccaggaccagaagatcctgagcctgaagaacaagctgaaggacctgggccaccctgtggaggaggaggatgagctggagagcggggaccaggaggatgaagatgatgaaagtgaggaccccgggaaggacctggaccacatctag

SEQ ID NO: 22315 - DNA, 258 bp, Artificial Sequence
  Description of Artificial Sequence: Synthetic coding sequence
atgggcaacagcgacagccagtacaccctgcagggcagcaagaaccacagcaacaccatcactggagccaagcagatcccctgcagcctgaagatccggggcatccacgccaaggaggagaagagcctgcacggctggggccacggcagcaatggagctggctacaagagccgcagcctggcccggagctgcctgagccacttcaagagcaaccagccctatgccagccggctgggcggccccacctgcaaggtgtag

SEQ ID NO: 22316 - DNA, 174 bp, Artificial Sequence
  Description of Artificial Sequence: Synthetic coding sequence
tgaggaagagcccctggccctgccatcggcggccggcgggccggggacagctgccccggctggaggagaagaagccgcagccggggccggggccagaggctgagccacggcccccggcggcggccccagctgctgacagagaccaggaggcctgtgctggtgcagtggctgtag

SEQ ID NO: 22317 - DNA, 936 bp, Artificial Sequence
  Description of Artificial Sequence: Synthetic coding sequence
atggtgtccctgcgggtgaaccccctgagcctggtggagatcatcctgcacgtggtgcggcagatgacagaccccaacgtggccctgaccttcctggagaagacccgggagaaggtgaagagcagtgatgaagctgtgatcctgtgcaagacagccatcggggccctgaagctgaacatcggggacctgcaggtgaccaaggagaccattgaagatgtggaggagatgctgaacaacctgcccggggtgacctctgtgcacagccgcttctatgacctgagcagcaagtactaccagaccatcggcaaccacgccagctactacaaggatgccctgcgcttcctgggctgtgtggacatcaaggacctgcctgtgtctgagcagcaggagcgggccttcaccctgggcctggccggcctgctgggggagggcgtcttcaactttggagagctgctgatgcaccctgtgctggagagcctgaggaacacagaccggcagtggctgattgacaccctgtatgccttcaacagcggaaatgtggagcgcttccagaccctgaagacagcctggggccagcagcctgacctggccgccaatgaggcccagctgctgaggaagatccagctgctgtgcctgatggagatgaccttcaccaggcctgccaaccaccggcagctgacctttgaggagatcgccaagagcgccaagatcaccgtgaatgaggtggagctgctggtgatgaaggccctgtctgtgggcctggtgaagggcagcattgatgaggtggacaagagggtgcacatgacctgggtgcagccccgggtgctggacctgcagcagatcaagggcatgaaggaccggctggagttctggtgcacagatgtgaagtccatggagatgctggtggagcaccaggcccatgacatcctgacctag

SEQ ID NO: 22318 - DNA, 1161 bp, Artificial Sequence
  Description of Artificial Sequence: Synthetic coding sequence
atgaagagcctgaaggcctgcaagcgggagatcaagtctgtgatgaacacagctggcaacagcgcccccagcctcttcctgaagagcaactttgagtacctgcggggcaactacaggaaggctgtgaagctgctgaacagcagcaacattgctgagcaccctggcttcatgaagacaggagaatgtctgcgctgcatgttctggaacaacctgggctgcatccactttgccatgagcaagcacaacctgggcatcttctacttcaagaaggccctgcaggagaatgacaacgtgtgtgcccagctgtctgctggcagcacagatcctgggaagaagttcagcggccggcccatgtgcaccctgctgaccaacaagagatatgagctgctgtacaactgtggcatccagctgctgcacatcggccggcccctggccgcctttgagtgcctgattgaagctgtgcaggtgtaccacgccaacccccggctgtggctgcggctggccgagtgctgcatcgccgccaacaagggcaccagcgagcaggagaccaagggcctgcccagcaagaagggcatcgtgcagagcatcgtgggccagggctaccacaggaagatcgtgctggccagccagagcatccagaacacagtgtacaatgatggccagagcagcgccatccctgtggcctccatggagtttgctgccatctgcctgagaaatgccctgctgctgctgcctgaggagcagcaggaccccaagcaggagaatggagccaagaacagcaaccagctgggcggcaacacagagagcagcgagagcagcgagacctgcagcagcaagagccatgatggagacaagttcatcccagccccacccagcagccccctgaggaagcaggagctggagaacctgaagtgcagcatcctggcctgcagcgcctacgtggccctggccctgggggacaacctgatggccctgaaccacgccgacaagctgctgcagcagcccaagctgagcggcagcctgaagttcctgggccacctgtatgctgctgaggccctgatcagcctggaccgcatcagtgatgccatcacccacctgaacccagaaaatgtgacagatgtgtccctgggcatcagcagcaatgagcaggaccagggctag

SEQ ID NO: 22319 - DNA, 1596 bp, Artificial Sequence
  Description of Artificial Sequence: Synthetic coding sequence
atgctgcaggagctgaactttggagcctacctgggcctgcctgccttcctgctgcccctgaaccaggaggacaacaccaacctggcccgggtgctgaccaaccacatccacacaggccaccacagctccatgttctggatgagggtgcccctggtggcccctgaggacctgagagatgacatcattgaaaatgcccccaccacccacacagaggagtacagcggggaggagaagacctggatgtggtggcacaacttccgcaccctgtgtgactacagcaagagaattgctgtggccctggagatcggggctgacctgcccagcaaccacgtgattgaccgctggctgggggagcccatcaaggccgccatcctgcccaccagcatcttcctgaccaacaagaagggcttccctgtgctgagcaagatgcaccagaggctcatcttccggctgctgaagctggaggtgcagttcatcatcaccggcaccaaccaccacagcgagaaggagttctgcagctacctgcagtacctggagtacctgagccagaaccggcccccaccaaatgcctatgagctgtttgccaagggctatgaggactacctgcagagccccctgcagcccctgatggacaacctggagagccagacctatgaggtgtttgagaaggaccccatcaagtacagccagtaccagcaggccatctacaagtgcctgctggacagagtgcctgaggaggagaaggacaccaacgtgcaggtgctgatggtgctgggcgccggccggggccccctggtgaatgccagcctgcgggccgccaagcaggccgaccggcgcatcaagctgtatgctgtggagaagaaccccaatgctgtggtgaccctggagaactggcagtttgaggagtggggcagccaggtgacagtggtgtccagtgacatgagggagtgggtggcccctgagaaggctgacatcatcgtgtctgagctgctgggcagctttgctgacaatgagctgagccctgagtgcctggatggagcccagcacttcctgaaggatgatggagtgtccatccctggagagtacaccagcttcctggcccccatcagcagcagcaagctgtacaatgaggtgcgggcctgccgggagaaggaccgggaccctgaggcccagtttgagatgccctacgtggtgcggctgcacaacttccaccagctgagcgccccccagccctgcttcaccttcagccaccccaacagagaccccatgattgacaacaaccgctactgcaccctggagttccctgtggaggtgaacacagtgctgcacggctttgctggctactttgaaacagtgctgtaccaggacatcaccctgagcatccggcctgagacccacagccctggcatgttctcctggttccccatcctcttccccatcaagcagcccatcaccgtgcgggagggccagaccatctgtgtgcgcttctggcgctgcagcaacagcaagaaggtgtggtatgagtgggccgtgacagcccctgtgtgcagcgccatccacaaccccaccggccgcagctacaccatcggcctgtag

SEQ ID NO: 22320 - DNA, 789 bp, Artificial Sequence; identical to SEQ ID NO: 19488
  Description of Artificial Sequence: Synthetic coding sequence

SEQ ID NO: 22321 - DNA, 1131 bp, Artificial Sequence
  Description of Artificial Sequence: Synthetic coding sequence
atggccgcccccagccccagcggcacccctgtgtcctccatgcagggcaagaggaaggccctgaagctgaactttgccaacccccccttcaagagcacagcccgcttcaccctgaaccccaaccccactggagtgcagaacccccacatcgagcggctgcggacccacagcattgagagcagcggcaagctgaagatcagccctgagcagcactgggacttcaccgctgaggacctgaaggacctgggggagatcggccgcggggcctacggctctgtgaacaagatggtgcacaagcccagcggccagatcatggctgtgaagaggatccgcagcacagtggatgagaaggagcagaagcagctgctgatggacctggatgtggtgatgaggagcagtgactgcccctacatcgtgcagttctacggggccctcttccgggagggggactgctggatctgcatggagctgatgagcaccagctttgacaagttctacaagtatgtgtacagcgtgctggatgatgtgattcctgaggagatcctgggcaagatcaccctggccaccgtgaaggccctgaaccacctgaaggagaacctgaagatcatccaccgggacatcaagcccagcaacatcctgctggacagaagtggcaacatcaagctgtgtgactttggcatcagcggccagctggtggacagcatcgccaagaccagagatgctggctgccggccctacatggcccctgagagaattgaccccagcgccagccggcagggctatgatgtgcggagtgatgtgtggagcctgggcatcaccctgtatgagctggccaccggccgcttcccctaccccaagtggaacagcgtgtttgaccagctgacccaggtggtgaagggggaccccccccagctgagcaacagcgaggagcgggagttcagccccagcttcatcaactttgtgaacctgtgcctgaccaaggatgagagcaagaggcccaagtacaaggagctgctgaagcaccccttcatcctgatgtatgaggagagagctgtggaggtggcctgctacgtgtgcaagatcctggaccagatgcctgccacccccagcagccccatgtatgtggactag

SEQ ID NO: 22322 - DNA, 1035 bp, Artificial Sequence
  Description of Artificial Sequence: Synthetic coding sequence
atggccggcagcggctgtgcctggggcgctgagcccccacgcttcctggaggccttcggccgcctgtggcaggtgcagagccggctgggcagcggcagcagcgcctctgtgtacagagtgcgctgctgcggcaaccctggcagccccccaggggccctgaagcagttcctgcccccaggcaccaccggggctgctgccagcgctgctgaatatggcttcaggaaggagcgggccgccctggagcagctgcagggccacagaaatattgtgaccctgtatggagtcttcaccatccacttcagccccaacgtgcccagccgctgcctgctgctggagctgctggatgtgtctgtgtctgagctgctgctgtacagcagccaccagggctgcagcatgtggatgatccagcactgtgccagagatgtgctggaggccctggccttcctgcaccacgagggctacgtgcatgctgacctgaagcccaggaacatcctgtggagcgcagaaaatgaatgcttcaagctgattgactttggcctgtccttcaaggagggcaaccaggatgtgaagtacatccagacagatggctaccgggcccctgaggccgagctgcagaactgcctggcccaggccggcctgcagagcgacacagagtgcaccagcgctgtggacctgtggagcctgggcatcatcctgctggagatgttttctggcatgaagctgaagcacacagtgcgcagccaggagtggaaggccaacagcagcgccatcatcgaccacatctttgccagcaaggctgtggtgaatgctgccatcccagcctaccacctgcgggacctgatcaagtccatgctgcatgatgaccccagccgccgcatcccagctgagatggccctgtgcagccccttcttcagcatcccctttgccccccacatcgaggacctggtgatgctgcccacccctgtgctgcggctgctgaatgtgctggatgatgactacctggagaatgaggaggagtatgagggcctgtgctag

SEQ ID NO: 22323 - DNA, 1467 bp, Artificial Sequence
  Description of Artificial Sequence: Synthetic coding sequence
atggccctgaagatgaacaccctgagcagcaacagagccaacatgctgaaggaggtgcagctgatgaaccggctgagccaccccaacatcctgcgcttcatgggcgtgtgtgtgcaccagggccagctgcacgccctgacagagtacatcaacagcggcaacctggagcagctgctggacagcaacctgcacctgccctggacagtgcgggtgaagctggcctatgacattgctgtgggcctgagctacctgcacttcaagggcatcttccaccgggacctgaccagcaagaactgcctgatcaagagagatgaaaatggctacagcgctgtggtggccgactttggcctggccgagaagatcccagatgtgtccatgggcagcgagaagctggccgtggtgggcagccccttctggatggcccctgaggtgctgagagatgagccctacaatgagaaggcagatgtgttctcctatggcatcatcctgtgtgagatcatcgcccgcatccaggccgaccctgactacctgcccaggacagaaaattttggcctggactatgatgccttccagcacatggtgggggactgccccccagacttcctgcagctgaccttcaactgctgcaacatggaccccaagctgcggcccagctttgtggagatcggcaagaccctggaggagatcctgagccggctgcaggaggaggagcaggagcgggacaggaagctgcagcccacagcccggggcctgctggagaaggcccctggggtgaagaggctgagcagcctggatgacaagatcccccacaagagcccctgccccaggaggaccatctggctgagccgcagccagagcgacatcttcagcaggaagccacccaggacagtgtctgtgctggacccctactaccggcccagagatggagctgcccggacccccaaggtgaaccccttcagcgcccggcaggacctgatgggcggcaagatcaagttctttgacctgcccagcaagagcgtcatcagcctggtgtttgacctggatgcccctggccctggcaccatgcccctggccgactggcaggagcccctggccccacccatccgccgctggaggagcctgcccggcagccctgagttcctgcaccaggaggcctgcccctttgtgggccgggaggagagcctgagtgatggccccccaccccggctgagcagcctgaagtacagagtgaaggagatcccccccttccgggccagcgccctgcctgctgcccaggcccacgaggccatggactgcagcatcctgcaggaggagaatggatttggcagccggccccagggcaccagcccctgcccagctggggccagcgaggagatggaggtggaggagaggcctgctggcagcaccccagccaccttcagcaccagcggcatcggcctgcagacccagggcaagcaggatggatag

SEQ ID NO: 22324 - DNA, 1458 bp, Artificial Sequence
  Description of Artificial Sequence: Synthetic coding sequence
atgaccctgtggatcctgcccaagttcaaggctgtggacttcagccccagcctggccgcctacacccacacctggctgctgccccgcttcctggagatcctgatccagtgtggccactgcaagaggctggccccagaatatgaagctgctgccacccggctgaagggcatcgtgcccctggccaaggtggactgcacagccaacaccaacacctgcaacaagtatggagtgtctggctaccccaccctgaagatcttcagagatggagaggaggccggggcctatgatggccccaggacagcagatggcatcgtgagccacctgaagaagcaggccggccctgcctctgtgcccctgaggacagaggaggagttcaagaagttcatcagtgacaaggatgccagcatcgtgggcttctttgatgacagcttcagcgaggcccacagcgagttcctgaaggccgccagcaacctgcgggacaactacagatttgcccacaccaacgtggagagcctggtgaatgaatatgatgacaatggagagggcatcatcctcttccggcccagccacctgaccaacaagtttgaggacaagacagtggcctacacagagcagaagatgaccagcggcaagatcaagaagttcatccaggagaacatcttcggcatctgcccccacatgacagaggacaacaaggacctgatccagggcaaggacctgctgattgcctactatgatgtggactatgagaagaatgccaagggcagcaactactggaggaacagagtgatgatggtggccaagaagttcctggatgctggccacaagctgaactttgctgtggccagcaggaagaccttcagccatgagctgagtgactttggcctggagagcacagctggggagatccctgtggtggccatcagaacagccaagggggagaagtttgtgatgcaggaggagttcagcagagatggcaaggccctggagcgcttcctgcaggactactttgatggcaacctgaagcgctacctgaagtctgagcccatccctgagagcaatgatggccctgtgaaggtggtggtggccgagaactttgatgaaattgtgaacaatgaaaacaaggatgtgctgattgagttctacgccccctggtgtggccactgcaagaacctggagcccaagtacaaggagctgggggagaagctgagcaaggaccccaacatcgtgattgccaagatggatgccacagccaatgatgtgcccagcccctatgaggtgcggggcttccccaccatctacttctccccagccaacaagaagctgaaccccaagaagtatgaaggaggccgggagctgagtgacttcatctcctacctgcagcgggaggccaccaacccccctgtgatccaggaggagaagcccaagaagaagaagaaggcccaggaggacctgtag

SEQ ID NO: 22325 - DNA, 885 bp, Artificial Sequence
  Description of Artificial Sequence: Synthetic coding sequence
atgtctgcccagcactttgtgtccacagagcaggtggagctgcccggccctggccagtgggtggtggccgagtgcccagcccgggtggacttcagcggcggctggagcgacaccccacccctggcctatgagctgggcggcgctgtgctgggcctggccgtgcgggtggatggaagaagacccatcggggcccgggcccggcgcatccctgagcctgagctgtggctggccgtgggcccccggcaggatgagatgacagtgaagatcgtgtgccgctgcctggccgacctgcgggactactgccagccccacgcccctggggccctgctgaaggccgccttcatctgtgccggcatcgtgcacgtgcacagcgagctgcagctgtctgagcagctgctgcggaccttcggcggcggctttgagctgcacacctggagcgagctgccccacggcagcggcctgggcaccagcagcatcctggccggcacagccctggccgccctgcagagagctgctggccgggtggtgggcacagaggccctgattcatgctgtgctgcacctggagcaggtgctgaccaccggcggcggctggcaggaccaggtgggcggcctgatgcctggcatcaaggtgggccgcagccgggcccagctgcccctgaaggtggaggtggaggaggtgacagtgcctgagggctttgtgcagaagctgaatgaccacctgctgctggtgtacaccgggaagacccggctggccaggaacctgctgcaggatgtgctgcgctcctggtacgcccggctgcctgctgtggtgcagaatgcccacagcctggtgcggcagacagaagaatgtgccgagggcttccggcagggcagccacatctag

SEQ ID NO: 22326 - DNA, 945 bp, Artificial Sequence
  Description of Artificial Sequence: Synthetic coding sequence
gtgggccgcatggagggctgcagcagccccatcgtggtgaagtttgctgacacccagaaggacaaggagcagaggcggctgcagcagcagctggcccagcagatgcagcagctgaacacagccacctggggcaacctgaccggcctgggcggcctgaccccccagtacctggccctgctgcagcaggccaccagcagcagcaacctgggcgccttcagcggcatccagcagatggccggcatgaatgccctgcagctgcagaacctggccaccctggccgctgctgctgctgctgcccagaccagcgccaccagcaccaatgccaaccccctgagcaccaccagcagcgccctgggcgccctgaccagccctgtggccgccagcacccccaacagcacagctggggccgccatgaacagcctgaccagcctgggcaccctgcagggcctggccggggccaccgtgggcctgaacaacatcaatgccctggccggcatggccgccctgaatggaggcctgggcgccaccggcctgaccaacggcacagctggcaccatggatgccctgacccaggcctacagcggcatccagcagtatgctgctgctgccctgcccaccctgtacagccagagcctgctgcagcagcagagcgctgctggcagccagaaggagggccctgagggcgccaacctcttcatctaccacctgccccaggagtttggagaccaggacatcctgcagatgttcatgccctttggaaatgtcatcagcgccaaggtgttcatcgacaagcagaccaacctgagcaagtgcttcggctttgtgtcctatgacaaccctgtgtctgcccaggccgccatccaggccatgaatggcttccagatcggcatgaagaggctgaaggtgcagctgaagaggagcaagaatgacagcaagccctactag

SEQ ID NO: 22327 - DNA, 1083 bp, Artificial Sequence
  Description of Artificial Sequence: Synthetic coding sequence
tccatggagaagacctacaccagcaccagcaacaacagcatcagcggcagcctgaagaggctggaggacaccacagcccgcttcaccaatgccaacttccaggaggtgtctgcccacaccagcagcggcaaggatgtgtctgagacccggggcagcgagggcaagggcaagaagagcagcgcccacagcagcggccagaggggcaggaagccaggcggcggcagaaatcctggcaccaccgtgtctgctgccagccccttcccccaggccggctacaagagggcccagaccagcggcatcgaggaggagaccgtgaaggagaagaagaggaaaggaaacaagcagagcaagcacggccctggccggcccaagggcaacaagaaccaggagaatgtgagccacctgtctgtgtcctctgccagccccaccagctctgtggccagcgctgctggcagcatcaccagcagcagcctgcagaagagccccaccctgctgagaaatggcagcctgcagagcctgtctgtgggcagcagccctgtgggcagcgagatctccatgcagtacagacatgatggagcctgccccaccaccaccttcagcgagctgctgaatgccatccacaatgacagaggagacagcagcaccctgaccaagcaggagctgaagttcatcggcatctacaacagcaatgatgtggccgtgtccttccccaacgtggtgtctggcagcggcagcagcacccctgtgagcagcagccacctgccccagcagagcagcggccacctgcagcaggtgggcgccctgagccccagcgctgtgtcctctgctgccccagctgtggccaccacccaggccaacaccctgagcggcagcagcctgagccaggcccccagccacatgtatggcaacagaagcaacagctccatggccgccctgattgcccagagcgagaacaaccagacagaccaggacctgggggacaacagcaggaacctggtgggccggggcagcagcccccggggcagcctgagccccaggagccctgtgagcagcctgcagatccgctatgaccagcctggatag

SEQ ID NO: 22328 - DNA, 924 bp, Artificial Sequence
  Description of Artificial Sequence: Synthetic coding sequence
atgcagagcctgaccctggacctgctgggccccagcgagctgctgctggccctgaacatgggcaacaccagcttcaatgaggtgatggaggcccagctgcccagccacggcggccccaagcccagcgctgagagtgacatgggcacccggcgggactacatcatggccaagtatgtggagcacagatttgcccggcgctgcaccccagagccccagaggctgtggacagccatctgcaacagagacctgctgtctgtgctggaggcctttgccaacggccaggactttggccagcccctgcccggcccagatgcccaggcccctgaggagctggtgctgcacctggccgtgaaggtggccaaccaggccagcctgcccctggtggacttcatcatccagaatggaggccacctggatgccaaggctgctgatggcaacacagccctgcactacgccgccctgtacaaccagcctgactgcctgaagctgctgctgaagggccgggccctggtgggcaccgtgaatgaagctggggagacagccctggacatcgccaggaagaagcaccacaaggaatgtgaggagctgctggagcaggcccaggccggcacctttgccttccccctgcacgtggactacagctgggtgatcagcacagagcccggcagtgacagtgaagaagatgaggaggagaagcgctgcctgctgaagctgcctgcccaggcccactgggccagcggccgcctggacatcagcaacaagacctatgagaccgtggccagcctgggcgccgccaccccccagggcgagagcgaggactgccccccacccctgcctgtgaagaacagcagcaggaccctggtgcagggctgtgcccggcatgccagcggcggcagaagagaggagcgggcccggcgggagtag

SEQ ID NO: 22329 - DNA, 1497 bp, Artificial Sequence
  Description of Artificial Sequence: Synthetic coding sequence
atgagcagctgtgtgagcagccagcccagcagcaacagagctgccccccaggatgagctgggcggccggggcagcagcagcagcgagagccagaagccctgtgaggccctgcggggcctgagcagcctgagcatccacctgggcatggagagcttcatcgtggtgacagaatgtgagcccggctgtgctgtggacctgggcctggcccgggaccggcccctggaggctgatggccaggaggtgcccctggacaccagcggcagccaggcccggccccacctgagcggcaggaagctgagcctgcaggagaggagccagggcggcctggccgccggcggcagcctggacatgaatggccgctgcatctgccccagcctgccctacagccctgtgagcagcccccagagcagcccccggctgccccggcggcccaccgtggagagccaccacgtgtccatcaccggcatgcaggactgtgtgcagctgaaccagtacaccctgaaggatgaaattggcaagggcagctatggagtggtgaagctggcctacaatgaaaatgacaacacctactatgccatgaaggtgctgagcaagaagaagctgatccggcaggccggcttcccccggcggcccccaccccggggcaccaggcctgcccctgggggctgcatccagccccggggccccatcgagcaggtgtaccaggagatcgccatcctgaagaagctggaccaccccaacgtggtgaagctggtggaggtgctggatgaccccaatgaagaccacctgtacatggtgtttgagctggtgaaccagggccctgtgatggaggtgcccaccctgaagcccctgtctgaggaccaggcccgcttctacttccaggacctgatcaagggcatcgagtacctgcactaccagaagatcatccaccgggacatcaagcccagcaacctgctggtgggggaggatggccacatcaagattgctgactttggagtgtccaatgagttcaagggcagtgatgccctgctgagcaacacagtgggcaccccagccttcatggcccctgagagcctgtctgagaccaggaagatcttcagcggcaaggccctggatgtgtgggccatgggcgtgaccctgtactgctttgtgtttggccagtgccccttcatggatgagcgcatcatgtgcctgcacagcaagatcaagagccaggccctggagttcccagaccagcctgacattgctgaggacctgaaggacctgatcaccaggatgctggacaagaaccctgagagcagaattgtggtgcctgagatcaagatcctggtgaagaccatgatcaggaagaggagctttggaaacccctttgagggcagcagaagagaggagaggagcctgagcgcccctggcaacctgctgaccaagcagggcagcgaggacaacctgcagggcacagaccccccacctgtgggggaggaggaggtgctgctgtag

SEQ ID NO: 22330 - DNA, 600 bp, Artificial Sequence; identical to SEQ ID NO: 19295
  Description of Artificial Sequence: Synthetic coding sequence

SEQ ID NO: 22331 - DNA, 1248 bp, Artificial Sequence
  Description of Artificial Sequence: Synthetic coding sequence
atgtggaggaaggtgtacacccccaggagcagctttgagctgagcgcccagccccccagctgggagcagaggaagctgctggagaagtgtgccatgacagccctgagcagcaagctgatcagccagcagaaggccttctttgccaagatggtggtggatgctgtgatgatgctggatgacctgctgcagctgaagatgattggcatcaagaaggtgcagggcggggccctggaggacagccagctggtggccggcgtggccttcaagaagaccttctcctatgccggctttgagatgcagcccaagaagtaccacaaccccaagatcgccctgctgaatgtggagctggagctgaaggccgagaaggacaatgctgagatccgggtgcacacagtggaggactaccaggccatcgtggatgctgagtggaacatcctgtatgacaagctggagaagatccaccacagcggggccaaggtggtgctgagcaagctgcccatcggagatgtggccacccagtactttgctgaccgggacatgttctgtgccggccgggtgcctgaggaggacctgaagaggaccatgatggcctgtggcggcagcatccagacctctgtgaatgccctgtctgcagatgtgctgggccgctgccaggtgtttgaggagacccagattggaggagagcgctacaacttcttcaccggctgccccaaggccaagacctgcaccttcatcctgcggggcggcgctgagcagttcatggaggagacagagaggagcctgcatgatgccatcatgattgtgagaagagccatcaagaatgacagcgtggtggccggcggcggggccatcgagatggagctgagcaagtacctgcgggactacagcaggaccatccctgggaagcagcagctgctgattggagcctatgccaaggccctggagatcatcccccggcagctgtgtgacaatgccggctttgatgccaccaacatcctgaacaagctgcgggcccggcatgcccagggcggcacctggtatggagtggacatcaacaatgaagatattgctgacaactttgaggcctttgtgtgggagcccgccatggtgcgcatcaatgccctgacagctgccagcgaggccgcctgcctgattgtgtctgtggatgagaccatcaagaaccccaggagcacagtggatgcccccacagctgctggccggggccggggccggggccggccccactag

SEQ ID NO: 22332 - DNA, 3117 bp, Artificial Sequence; identical to SEQ ID NO: 20300
  Description of Artificial Sequence: Synthetic coding sequence

SEQ ID NO: 22333 - DNA, 1443 bp, Artificial Sequence
  Description of Artificial Sequence: Synthetic coding sequence
atgaggctgcggcggctggccctcttccctggggtggccctgctgctggccgccgcccggctggccgccgccagcgagttctttgccccctggtgtggccactgcaagaggctggccccagaatatgaggccgccgccacccggctgaagggcatcgtgcccctggccaaggtggactgcacagccaacaccaacacctgcaacaagtatggagtgtctggctaccccaccctgaagatcttcagagatggagaggaggccggggcctatgatggccccaggacagcagatggcatcgtgagccacctgaagaagcaggccggccctgcctctgtgcccctgaggacagaggaggagttcaagaagttcatcagtgacaaggatgccagcatcgtgggcttctttgatgacagcttcagcgaggcccacagcgagttcctgaaggccgccagcaacctgcgggacaactacagatttgcccacaccaacgtggagagcctggtgaatgaatatgatgacaacggggagggcatcatcctcttccggcccagccacctgaccaacaagtttgaggacaagacagtggcctacacagagcagaagatgaccagcggcaagatcaagaagttcatccaggagaacatcttcggcatctgcccccacatgacagaggacaacaaggacctgatccagggcaaggacctgctgattgcctactatgatgtggactatgagaagaatgccaagggcagcaactactggaggaacagagtgatgatggtggccaagaagttcctggatgctggccacaagctgaactttgctgtggccagcaggaagaccttcagccatgagctgagtgactttggcctggagagcacagctggggagatccctgtggtggccatcagaacagccaagggggagaagtttgtgatgcaggaggagttcagcagagatggcaaggccctggagcgcttcctgcaggactactttgatggcaacctgaagcgctacctgaagtctgagcccatccctgagagcaatgatggccctgtgaaggtggtggtggctgaaaattttgatgagatcgtgaacaatgaaaacaaggatgtgctgattgagttctacgccccctggtgtggccactgcaagaacctggagcccaagtacaaggagctgggggagaagctgagcaaggaccccaacatcgtcatcgccaagatggatgccacagccaatgatgtgcccagcccctatgaggtgcggggcttccccaccatctacttcagccctgccaacaagaagctgaaccccaagaagtatgagggcggccgggagctgagtgacttcatctcctacctgcagcgggaggccaccaacccccctgtgatccaggaggagaagcccaagaagaagaagaaggcccaggaggacctgtag

SEQ ID NO: 22334 - DNA, 228 bp, Artificial Sequence
  Description of Artificial Sequence: Synthetic coding sequence
atgggcgtgaagctggagatcttcaggatgatcatctacctgaccttccctgtggccatgttctgggtgagcaaccaggccgagtggtttgaagatgatgtgatccagaggaagcgggagctgtggcccccagagaagctgcaggagctggaggagttcaaggagcggctgaggaagaggaagaggcgggaggagaagctgctgagagatgcccagcagaacagctag

SEQ ID NO: 22335 - DNA, 807 bp, Artificial Sequence; identical to SEQ ID NO: 22233
  Description of Artificial Sequence: Synthetic coding sequence

SEQ ID NO: 22336 - DNA, 351 bp, Artificial Sequence
  Description of Artificial Sequence: Synthetic coding sequence
atgctgctggagtgtggcatgcaggaggagggcctcttccgggtggcccccagcgccagcaagctgaagaagctgaaggccgccctggactgctgcgtggtggatgtgcaggagtacagcgctgacccccacgccatcgccggggccctgaagagctacctgcgggagctgcctgagcccctgatgacctttgagctgtatgatgagtggatccaggccagcaatgtgcaggagcaggacaagaagctgcaggccctgtggaatgcctgtgagaagctgcccaaggccaaccacaacaacatccgctacctgatcaagttctaccccagctgccagaacatcaagatgtag

SEQ ID NO: 22337 - DNA, 906 bp, Artificial Sequence
  Description of Artificial Sequence: Synthetic coding sequence
atggtgaggaccaagacctggaccctgaagaagcactttgtgggctaccccaccaacagcgactttgagctgaagacagctgagctgccccccctgaagaatggagaggtgctgctggaggccctcttcctgactgtggacccctacatgagggtggccgccaagaggctgaaggagggggacaccatgatgggccagcaggtggccaaggtggtggagagcaagaatgtggccctgcccaagggcaccatcgtgctggccagccctggctggaccacccacagcatcagtgatggcaaggacctggagaagctgctgacagagtggccagacaccatccccctgagcctggccctgggcaccgtgggcatgcctggcctgacagcctacttcggcctgctggagatctgtggggtgaagggcggggagaccgtgatggtgaatgctgctgctggagctgtgggctctgtggtgggccagatcgccaagctgaagggctgcaaggtggtgggcgctgtgggcagtgatgagaaggtggcctacctgcagaagctgggctttgatgtggtgttcaactacaagacagtggagagcctggaggagaccctgaagaaggccagcccagatggctatgactgctactttgacaacgtgggcggggagttcagcaacacagtgattggccagatgaagaagtttggccgcatcgccatctgtggggccatcagcacctacaacagaacaggccccctgcccccaggccccccacctgagatcgtcatctaccaggagctgaggatggaggcctttgtggtgtaccgctggcagggagatgcccggcagaaggccctgaaggacctgctgaagtgggtgctggagatcaagagagaaaatgaggaggactag

SEQ ID NO: 22338 - DNA, 1068 bp, Artificial Sequence
  Description of Artificial Sequence: Synthetic coding sequence
atgctgggcagcggcttcaaggccgagcggctgcgggtgaacctgcggctggtgatcaaccggctgaagctgctggagaagaagaagacagagctggcccagaaggccaggaaggagattgctgactacctggccgccggcaaggatgagcgggcccgcatccgggtggagcacatcatccgggaggactacctggtggaggccatggagatcctggagctgtactgtgacctgctgctggccaggtttggcctcatccagagcatgaaggagctggacagcggcctggccgagagcgtgtccaccctggccgagctgaagatcgtggccgaccagctgtgtgccaagtacagcaaggagtatggcaagctgtgcaggaccaaccagatcggcaccgtgaatgaccggctgatgcacaagctgtctgtggaggccccacccaagatcctggtggagcgctacctgattgagatcgccaagaactacaacgtgccctatgagccagacagcgtggtgatggccgaggcccctcctggggtggagacagacctgattgatgtgggcttcacagatgatgtgaagaagggcggccctggccggggcggcagcggcggcttcaccgcccctgtgggcggcccagatggcaccgtgcccatgcccatgcccatgcccatgcccatgcccagcgccaacacccccttctcctaccccctgcccaagggccccagcgacttcaacggcctgcccatgggcacctaccaggccttccccaacatccaccccccccagatcccagccaccccacccagctatgaatctgtggatgacatcaatgctgacaagaacatcagcagcgcccagatcgtgggccctggccccaagccagaggccagcgccaagctgcccagcaggcctgctgacaactatgacaactttgtgctgcctgagctgcccagcgtgcctgacaccctgcccacagccagcgctggggccagcaccagcgcctctgaagatattgactttgatgacctgagccgccgctttgaggagctgaagaagaagacctag

SEQ ID NO: 22339 - DNA, 2175 bp, Artificial Sequence
  Description of Artificial Sequence: Synthetic coding sequence
atgcagatgaccatccaggccctgcaggatgagctgcgcatccagagggacctgaaccagctgttccagcaggacagcagcagcaggactggagagccctgtgtggccgagctgacagaggagaacttccagaggctgcacgccgagcacgagcggcaggccaaggagctgttcctgctgaggaagaccctggaggagatggagctgagaattgagacccagaagcagaccctgaatgccagagatgagagcatcaagaagctgctggagatgctgcagagcaagggcctgagcgccaaggccacagaggaggaccacgagaggacccggcggctggccgaggccgagatgcacgtgcaccacctggagagcctgctggagcagaaggagaaggagaacagcatgctgcgggaggagatgcacagaagatttgaaaatgccccagacagcgccaagaccaaggccctgcagaccgtcatcgagatgaaggacagcaagatcagctccatggagcggggcctgcgggacctggaggaggagatccagatgctgaagagcaatggagccctgagcacagaggagcgggaggaggagatgaagcagatggaggtgtaccgcagccacagcaagttcatgaagaacaagattggccaggtgaagcaggagctgagcaggaaggacacagagctgctggccctgcagaccaagctggagaccctgaccaaccagttcagtgacagcaagcagcacatcgaggtgctgaaggagagcctgacagccaaggagcagagagctgccatcctgcagacagaggtggatgccctgcggctgcggctggaggagaaggagaccatgctgaacaagaagaccaagcagatccaggacatggccgaggagaagggcacccaggccggggagatccatgacctgaaggacatgctggatgtgaaggagaggaaggtgaatgtgctgcagaagaagattgagaacctgcaggagcagctgcgggacaaggagaagcagatgagcagcctgaaggagcgggtgaagagcctgcaggccgacaccaccaacacagacacagccctgaccaccctggaggaggccctggccgagaaggagaggaccatcgagcggctgaaggagcagagggacagagatgagcgggagaagcaggaggagattgacaactacaagaaggacctgaaggacctgaaggagaaggtgtccctgctgcagggcgacctgtctgagaaggaggccagcctgctggacctgaaggagcacgccagcagcctggccagcagcggcctgaagaaggacagccggctgaagaccctggagatcgccctggagcagaagaaggaggagtgcctgaagatggagagccagctgaagaaggcccatgaagctgccctggaggcccgggccagccctgagatgtctgaccgcatccagcacctggagcgggagatcacccgctacaaggatgagagcagcaaggcccaggccgaggtggaccggctgctggagatcctgaaggaggtggagaatgagaagaatgacaaggacaagaagattgctgagctggagagcctgaccagccggcaggtgaaggaccagaacaagaaggtggccaacctgaagcacaaggagcaggtggagaagaagaagagcgcccagatgctggaggaggcccggcggcgggaggacaacctgaatgacagcagccagcagctgcaggtggaggagctgctgatggccatggagaaggtgaagcaggagctggagagcatgaaggccaagctgagcagcacccagcagagcctggccgagaaggagacccacctgaccaacctgcgggcagagaggaggaagcacctggaggaggtgctggagatgaagcaggaggccctgctggccgccatcagcgagaaggatgccaacatcgccctgctggagctgagcagcagcaagaagaagacccaggaggaggtggccgccctgaagcgggagaaggaccggctggtgcagcagctgaagcagcagacccagaacaggatgaagctgatggctgacaactatgaagatgaccacttcaagagcagccacagcaaccagaccaaccacaagcccagcccagaccaggatgaggaggagggcatctgggcctag

SEQ ID NO: 22340 - DNA, 408 bp, Artificial Sequence
  Description of Artificial Sequence: Synthetic coding sequence
atggccatcggcttcaacgtggagaccgtgacctacaagaacctgaagttccaggtgtgggacctgggcggccagaccagcatccggccctactggcgctgctactacagcaacacagatgctgtgatctacgtggtggacagctgtgaccgggaccgcatcggcatcagcaagtctgagctggtggccatgctggaggaggaggagctgaggaaggccatcctggtggtgtttgccaacaagcaggacatggagcaggccatgaccagcagcgagatggccaacagcctgggcctgcctgccctgaaggacaggaagtggcagatcttcaagaccagcgccaccaagggcaccggcctggatgaggccatggagtggctggtggagaccctgaagagccggcagtag

SEQ ID NO: 22341 - DNA, 684 bp, Artificial Sequence
  Description of Artificial Sequence: Synthetic coding sequence
agacggcagatcctgaaggagctggccctgtgcctgcggcggcaggagatgtatggcccccgggccgccagcaggaacaaggagaccagcgctggccctgtggccgtgatgggcaaggactactacaagatcctgggcatccccagcggggccaatgaagatgagatcaagaaggcctacaggaagatggccctgaagtaccacccagacaagaacaaggagcccaatgctgaggagaagttcaaggagattgctgaggcctatgatgtgctgagtgaccccaagaagaggggcctgtatgaccagtatggagaggagggcctgaagacaggaggcggcaccagcggcggcagcagcggcagcttccactacaccttccatggagacccccacgccacctttgccagcttcttcggcggcagcaacccctttgacatcttctttgccagcagccgcagcacccggcccttcagcggctttgatcctgatgacatggatgtggatgaagatgaggacccctttggagccttcggccgcttcggcttcaacggcctgagccggggcccccggcgggcccctgagcccctgtaccccaggaggaaggtgcaggacccccctgtggtgcatgagctgcgggtgtccctggaggagatctaccacggcagcaccaagaggatgaagtag

SEQ ID NO: 22342 - DNA, 252 bp, Artificial Sequence
  Description of Artificial Sequence: Synthetic coding sequence
atgtccatgctgaagcccagcggcctgaaggcccccaccaagatcctgaagccaggcagcacagccctgaagacccccacagctgtggtggcccctgtggagaagaccatcagcagcgagaaggccagcagcacccccagcagcgagacccaggaggagtttgtggatgacttccgggtgggggagcgggtgtgggtgaatggaaacaagccaggcttcatccagttcctgggggagacccagtttgcctag

SEQ ID NO: 22343 - DNA, 642 bp, Artificial Sequence
  Description of Artificial Sequence: Synthetic coding sequence
atggacatgctgggcggccctggcatcgagagccagtgcaggaaggtggacatcatcgcagatgctgcctacagcatcttccagaagcccaagagcttcaccggcaactttgtgattgatgagaacatcctgaaggaggagggcatcgagaactttgatgtgtatgccatcaagccaggccaccccctgcagcctgacttcttcctggatgagtacccagaggccgtgtccaagaaggtggagagcactggagctgtgcctgagttcaaggaggagaagctgcagctgcagcccaagcccaggtctggagctgtggaggagaccttcagaattgtgaaggacagcctgagtgatgatgtggtgaaggccacccaggccatctacctgtttgagctgtctggagaagatggcggcacctggttcctggacctgaagagcaaaggaggaaatgtgggctatggagagcccagcgaccaggctgatgtggtgatgtccatgaccacagatgactttgtgaagatgttcagcggcaagctgaagcccaccatggccttcatgtctgggaagctgaagatcaagggcaacatggccctggccatcaagctggagaagctgatgaaccagatgaatgcccggctgtag

SEQ ID NO: 22344 - DNA, 1230 bp, Artificial Sequence
  Description of Artificial Sequence: Synthetic coding sequence
atgaacagaacctggccccggcgcatctggggcagcagccaggatgagcctgagtttgccagctctgtgcggcggccccacctgaccagtgatgctgtggccctgctgcgggacaacgtgaccccccgggagaatgagctgtggaccagcctgggggacagctggacccggcccggcctggagctgagccctgaggagggccccccctacagacctgagttcttcagcggctgggagccccctgtgacagacccccagagccgggcctgggaggaccctgtggagaagcagctgcagcacgagaggagaagacggcaggtgacccaggccacccagcagggccggggctgggaggtgcggggccggggccgcagcgcctggccccggctgacccggctgagctacttcctgcagcagagcgccccccaggtggccgtgaatggccaccgggacctggagcctgagagcgagccccagctggagagcgagacagctgggaagtgggtgctgtgcaactatgacttccaggccaggaacagcagcgagctgtctgtgaagcagagagatgtgctggaggtgctggatgacagcaggaagtggtggaaggtgcgggaccctgctggccaggagggctacgtgccctacaacatcctgaccccctacccaggcccccggctgcaccacagccagagccctgcccggagcctgaacagcaccccacctcctcctccagccccagccccagcccctcctccagccctggcccggccccgctgggaccggccccgctgggacagctgtgacagcctgaatggcctggaccccagcgagaaggagaagttcagccagatgctgattgtgaatgaggagctgcaggcccggctggcccagggccgcagcggccccagcagagctgtgcccggcccccgggcccctgagccccagctgagccctggcagtgatgccagcgaggtgcgggcctggctgcaggccaagggcttcagcagcggcaccgtggatgccctgggcgtgctgaccggggcccagctgttcagcctgcagaaggaggagctgcgggctgtgtccccagaggagggcgcccgggtgtacagccaggtgacagtgcagaggagcctgctggaggacaaggagaaggtgtctgagctggaggccgtgatggagaagcagaagaagaaggtggagggggaggtggagatggaggtgatctag

SEQ ID NO: 22345 - DNA, 1425 bp, Artificial Sequence
  Description of Artificial Sequence: Synthetic coding sequence
atggccagcctgagccgggccctgcgggtggccgccgcccacccccggcagagccccacccggggcatgggcccctgcaacctgagcagcgctgctggccccacagctgagaagtctgtgccctaccagaggaccctgaaggagggccagggcacctctgtggtggcccagggccccagccggcccctgcccagcacagccaacgtggtggtgattggaggcggcagcctgggctgccagaccctgtaccacctggccaagctgggcatgtctggagctgtgctgctggagcgggagcggctgaccagcggcaccacctggcacacagctggcctgctgtggcagctgcggcccagtgatgtggaggtggagctgctggcccacacccggcgggtggtgtcccgggagctggaggaggagaccggcctgcacacaggctggatccagaatggaggcctcttcatcgccagcaaccggcagaggctggatgagtacaagaggctgatgagcctgggcaaggcctatggagtggagagccacgtgctgagccctgctgagaccaagaccctgtaccccctgatgaatgtggatgacctgtatggcaccctgtatgtgccccatgatggcaccatggaccctgctggcacctgcaccaccctggcccgggccgccagcgcccggggggcccaggtgattgagaactgccctgtgacaggcatccgggtgtggacagatgactttggagtgcggcgggtggccggcgtggagacccagcacggcagcatccagaccccctgtgtggtgaactgtgccggcgtgtgggccagcgctgtgggccgcatggccggcgtgaaggtgcccctggtggccatgcaccacgcctacgtggtgacagaaagaattgagggcatccagaacatgcccaacgtgcgggaccatgatgcctctgtgtacctgcggctgcagggagatgccctgtctgtgggcggctatgaggccaaccccatcttctgggaggaggtgtctgacaagtttgccttcggcctgtttgacctggactgggaggtgttcacccagcacattgaaggagccatcaacagagtgcctgtgctggagaagacaggcatcaagagcacagtgtgtggccctgagagcttcaccccagaccacaagcccctgatgggagaggcccctgagctgcggggcttcttcctgggctgcggcttcaacagcgctggcatgatgctgggcggcggctgcggccaggagctggcccactggatcatccacggccggcctgagaaggacatgcacggctatgacatccgccgcttccaccacagcctgacagaccacccccgctggatccgggagaggagccatgagagctaccaggagctgctgcggcggctgccccccaggtag

SEQ ID NO: 22346 - DNA, 1893 bp, Artificial Sequence
  Description of Artificial Sequence: Synthetic coding sequence
atgagcattgagctgcagagcgtgagcaaccctgtgcacaggaaggacctggtgatccggctgacagatgacacagaccccttcttcctgtacaacctggtgatcagcgaggaggacttccagagcctgaagttccagcagggcctgctggtggacttcctggccttcccccagaagttcatcgacctgctgcagcagtgcacccaggagcacgccaaggagatcccccgcttcctgctgcagctggtgtccccagctgccatcctggacaacagccctgccttcctgaatgtggtggagaccaaccccttcaagcacctgacccacctgagcctgaagctgctgcctggaaatgatgtggagatcaagaagttcctggccggctgcctgaagtgcagcaaggaggagaagctgagcctgatgcagagcctggatgatgccaccaagcagctggacttcaccaggaagaccctggccgagaagaagcaggagctggacaagctgagaaatgagtgggccagccacacagctgccctgaccaacaagcacagccaggagctgaccaatgagaaggagaaggccctgcaggcccaggtgcagtaccagcagcagcacgagcagcagaagaaggacctggagatcctgcaccagcagaacatccaccagctgcagaaccggctgtctgagctggaggccgccaacaaggacctgacagagaggaagtacaagggggacagcaccatccgggagctgaaggccaagctgagcggcgtggaggaggagctgcagaggaccaagcaggaggtgctgagcctgcggcgggagaacagcaccctggatgtggagtgccacgagaaggagaagcacgtgaaccagctgcagaccaaggtggccgtgctggagcaggagatcaaggacaaggaccagctggtgctgcggaccaaggaggcctttgacaccatccaggagcagaaggtggtgctggaggagaatggagagaagaaccaggtgcagctgggcaagctggaggccaccatcaagagcctgtctgctgagctgctgaaggccaatgagatcatcaagaagctgcagggcgacctgaagaccctgatgggcaagctgaagctgaagaacacagtgaccatccagcaggagaagctgctggccgagaaggaggagaagctgcagaaggagcagaaggagctgcaggatgtgggccagagcctgcgcatcaaggagcaggaggtgtgcaagctgcaggagcagctggaggccaccgtgaagaagctggaggagagcaagcagctgctgaagaacaatgagaagctgatcacctggctgaacaaggagctgaatgaaaaccagctggtgaggaagcaggatgtgctgggccccagcaccaccccaccagcccacagcagcagcaacaccatccgcagcggcatcagccccaacctgaatgtggtggatggccgcctgacctaccccacctgtggcatcggctaccctgtgagcagcgcctttgccttccagaacaccttcccccacagcatcagcgccaagaacaccagccaccctggcagcggcaccaaggtgcagttcaacctgcagttcaccaagcccaatgccagcctgggagatgtgcagagcggggccaccatctccatgccctgcagcacagacaaggaaaatggagaaaatgtgggcctggagagcaagtacctgaagaagagagaagattccatccccctgcggggcctgagccagaacctcttcagcaacagcgaccaccagagagatggcaccctgggcgccctgcacaccagcagcaagcccacagccctgcccagcgccagcagcgcctacttccctggccagctgcccaacagctag

SEQ ID NO: 22347 - DNA, 1170 bp, Artificial Sequence
  Description of Artificial Sequence: Synthetic coding sequence
atggaccgggagaccctgattgatgtggcccggaccagcctgcggaccaaggtgcacgccgagctggctgatgtgctgacagaagctgtggtggacagcatcctggccatcaagaagcaggatgagcccatcgacctcttcatgattgagatcatggagatgaagcacaagtcagaaacagacaccagcctcatccggggcctggtgctggaccacggggcccggcacccagacatgaagaagagggtggaggatgcctacatcctgacctgcaatgtgtccctggagtatgagaagacagaggtgaacagcggcttcttctacaagtctgctgaggagcgggagaagctggtgaaggccgagaggaagttcatcgaggacagagtgaagaagatcatcgagctgaagaggaaggtgtgtggggacagcgacaagggctttgtggtgatcaaccagaagggcatcgaccccttcagcctggatgccctgagcaaggagggcatcgtggccctgcggcgggccaagagaagaaacatggagcggctgaccctggcctgtggcggcgtggccctgaacagctttgatgacctgagcccagactgcctgggccatgctggcctggtgtatgagtacaccctgggggaggagaagttcaccttcatcgagaagtgcaacaaccccaggtctgtgaccctgctgatcaagggccccaacaagcacaccctgacccagatcaaggatgctgtgagagatggcctgcgggctgtgaagaatgccattgatgatggctgtgtggtgcctggagctggagctgtggaggtggccatggccgaggccctgatcaagcacaagcccagcgtgaagggccgggcccagctgggcgtgcaggcctttgctgatgccctgctgatcatccccaaggtgctggcccagaacagcggctttgacctgcaggagaccctggtgaagatccaggccgagcacagcgagagcggccagctggtgggcgtggacctgaacacaggagagcccatggtggccgctgaggtgggcgtgtgggacaactactgtgtgaagaagcagctgctgcacagctgcaccgtgattgccaccaacatcctgctggtggatgagatcatgagagctggcatgagcagcctgaagggctag

SEQ ID NO: 22348 - DNA, 441 bp, Artificial Sequence
  Description of Artificial Sequence: Synthetic coding sequence
atgacagtgaatgaggccaaggagaagctgaaggaggcccctgagggcaccttcctgatccgggacagcagccacagcgactacctgctgaccatctctgtgaagaccagcgctggccccaccaacctgagaattgagtaccaggacggcaagttccggctggacagcatcatctgtgtgaagagcaagctgaagcagtttgattctgtggtgcacctgattgactactacgtgcagatgtgcaaggacaagaggacaggccctgaggcccccagaaatggaacagtgcacctgtacctgaccaagcccctgtacaccagcgcccccagcctgcagcacctgtgccgcctgaccatcaacaagtgcacaggagccatctggggcctgcccctgcccacccggctgaaggactacctggaggagtacaagttccaggtgtag

SEQ ID NO: 22349 - DNA, 1905 bp, Artificial Sequence
  Description of Artificial Sequence: Synthetic coding sequence
atgctggagtatgccctgaagcaggagcgggccaagtaccacaagctgaagtttggaacagacctgaaccagggcgagaagaaggcagatgtgtctgagcaggtgtccaatggacctgtggagagcgtgaccctggagaacagccccctggtgtggaaggagggccggcagctgctgcggcagtacctggaggaggtgggctacacagacaccatcctggacatgaggagcaagagggtgcgcagcctgctgggccgcagcctggagctgaatggagctgtggagcccagcgagggcgccccccgggcccctcctggccctgctggcctgtctggaggagagagcctgctggtgaagcagatcgaggagcagatcaagagaaatgctgctgggaaggatggcaaggagcggctgggcggctctgtgctgggccagatccccttcctgcagaactgtgaagatgaagattctgatgaagatgatgagctggacagcgtgcagcacaagaagcagagggtgaagctgcccagcaaggccctggtgcctgagatggaggatgaagatgaggaggatgattctgaagatgccatcaatgaatttgacttcctgggcagcggagaagatggagagggcgccccagacccccggcgctgcaccgtggatggcagcccccatgagctggagagccggcgggtgaagctgcagggcatcctggccgacctgagagatgtggatggcctgccccccaaggtgacaggccccccacctggcaccccccagccccggccccatgaagatgtgttcatcatggacaccatcggcggcggggaggtgtccctgggggacctggccgacctgactgtgaccaatgacaatgacctgagctgtgacctgagtgacagcaaggatgccttcaagaagacctggaaccccaagttcaccctgcggagccactatgatggcatccgcagcctggccttccaccacagccagagcgccctgctgacagcctctgaagatggcaccctgaagctgtggaacctgcagaaggctgtgacagccaagaagaatgctgccctggatgtggagcccatccacgccttccgggcccaccggggccctgtgctggccgtggccatgggcagcaacagcgagtactgctacagcggcggcgcagatgcctgcatccacagctggaagatcccagacctgtccatggacccctatgatggctatgaccccagcgtgctgagccacgtgctggagggccatggagatgctgtgtggggcctggccttcagccccaccagccagaggctggccagctgcagcgcagatggcaccgtgcgcatctgggaccccagcagcagcagccctgcctgcctgtgcaccttccccacagccagcgagcacggcgtgcccacctctgtggccttcaccagcacagagcccgcccacatcgtggccagcttccgcagcggggacacagtgctgtatgacatggaggtgggcagcgccctgctgaccctggagagccggggcagcagcggccccacccagatcaaccaggtggtgagccaccccaaccagcccctgaccatcacagcccatgatgaccggggcatccgcttcctggacaacagaacaggcaagcctgtgcacagcatggtggcccacctggatgctgtgacctgcctggccgtggaccccaatggagccttcctgatgagcggcagccatgactgcagcctgcggctgtggagcctggacaacaagacctgtgtgcaggagatcacagcccacaggaagaagcatgaggaggccatccatgctgtggcctgccaccccagcaaggccctgattgccagcgctggagcagatgccctggccaaggtgtttgtgtag

SEQ ID NO: 22350 - DNA, 1368 bp, Artificial Sequence; identical to SEQ ID NO: 19227
  Description of Artificial Sequence: Synthetic coding sequence

SEQ ID NO: 22351 - DNA, 474 bp, Artificial Sequence
  Description of Artificial Sequence: Synthetic coding sequence
atgaagtccatgagccagctggccgtgctgagccgccgctggaagcccagcgagatgaagctggaccccttccaggaggtggtgctggagagcagctctgtggatgagctgcgggagaagctgtctgagatcagcggcatccccctggatgacatcgagtttgccaagggccggggcaccttcccctgtgacatctctgtgctggacatccaccaggacctggactggaaccccaaggtgtccaccctgaatgtgtggcccctgtacatctgtgatgatggagctgtgatcttctacagagacaagacagaggagctgatggagctgacagatgagcagagaaatgagctgatgaagaaggagagcagccggctgcagaagacaggccaccgggtgacctacagccccaggaaggagaaggccctgaagatctacctggatggagcccccaacaaggacctgacccaggactag

SEQ ID NO: 22352 - DNA, 1083 bp, Artificial Sequence
  Description of Artificial Sequence: Synthetic coding sequence
atgaaggccacagccatgaccagcgcctggctggcccagggcactggagagggcgtgaatgatgtgaggaagggggcctgtgccagccacgtgtccaccatggccagcttcctgaagggggcccacgtgaccatcaatgcccgggcagaagaagatgtggagcctgagtgcatcatggagaaggtggccaaggccagcggggccaactacagcttccacaaggagagcggccgcttccaggatgtgggcccccaggcccctgtgggctctgtgtaccagaagaccaatgctgtgtctgagatcaagagggtgggcaaggacagcttctgggccaaggccgagaaggaggaggagaacagaaggctggaggagaagagaagagctgaggaggcccagaggcagctggagcaggagcggcgggagcgggagctgcgggaggccgcccggcgggagcagcgctaccaggagcagggcggggaggccagcccccagaggacctgggagcagcagcaggaggtggtgtccaggaacagaaatgagcaggagagcgctgtgcacccccgggagatcttcaagcagaaggagcgggccatgagcaccaccagcatcagcagcccccagcccgggaagctgcggagccccttcctgcagaagcagctgacccagcctgagacccacttcggccgggagcctgctgctgccatcagccggcccagggctgacctgcctgctgaggagcccgcccccagcaccccaccctgcctggtgcaggccgaggaggaggccgtgtatgaggagcccccagagcaggagaccttctatgagcagccccccctggtgcagcagcagggcgccggcagcgagcacatcgaccaccacatccagggccagggcctgagcggccagggcctgtgtgcccgggccctgtatgactaccaggccgcagatgacacagagatcagctttgatcctgaaaatctcatcactggaattgaggtgattgatgagggctggtggaggggctacggcccagatggccacttcggcatgtttcctgccaactacgtggagctgattgaatag

SEQ ID NO: 22353 - DNA, 291 bp, Artificial Sequence
  Description of Artificial Sequence: Synthetic coding sequence
atgtgccacaccagctgcagcagcggctgccagcctgcctgctgtgcccccagcccctgccagcctgcctgctgcgtgcctgtgtcctgccagagctctgtgtgtgtgcctgtgtcctgccggcccatcgtgtgtgccgcccccagctgccagagcagcctgtgtgtgcctgtgtcctgcaggcctgtggtgtatgctgcccccagctgccagagcagcggctgctgccagcccagctgcacctctgtgctgtgccggcccatctcctacagcatcagcagctgctgctag

SEQ ID NO: 22354 - DNA, 27 bp, Artificial Sequence
  Description of Artificial Sequence: Synthetic coding sequence
atgcccctgagcagccccaatgcctag

SEQ ID NO: 22355 - DNA, 384 bp, Artificial Sequence
  Description of Artificial Sequence: Synthetic coding sequence
atgagcagctccatgtggtacatcatgcagagcatccagagcaagtacagcctgtctgagcggctcatccgcaccatcgccgccatccgctccttcccccatgacaacgtggaggacctgatccggggcggcgcagatgtgaactgcacccacggcaccctgaagcccctgcactgtgcctgcatggtgtctgatgctgactgtgtggagctgctgctggagaagggagctgaggtgaatgccctggatggctacaacagaacagccctgcactatgctgctgagaaggatgaggcctgtgtggaggtgctgctggagtatggagccaaccccaatgccctggatggcaacagagacacccccctgcactgggccgccttctag

SEQ ID NO: 22356 - DNA, 318 bp, Artificial Sequence
  Description of Artificial Sequence: Synthetic coding sequence
cagtggacagccagcacagccaccatcaccaaggagaagcaggaccagcccaagaaggacatcagcaactaccaggtggagcaggcccaggtgctgctgaagcgggagaaggagatcccccccaccgtcttccccaacagaagcccctggtgccagaacccctacgtgtctgcccacccctactgccccctgattgagccccacaacaccagcacagctgggggccgcctggaccggcagcccaggaccaggagcacccggcccaacagagccagcggcagcaagaagaagaagaccagcgagagccagaagcagtag

SEQ ID NO: 22357 - DNA, 1116 bp, Artificial Sequence
  Description of Artificial Sequence: Synthetic coding sequence
atggaggaggagggcctggctgatgaggaggtgcggctggtgcagaagaaggacaccggccacatctatgccatgaagatcctgaggaagagtgacatgctggagaaggagcaggtggcccacatccgggcagagcgggacatcctggtggaggctgatggagcctgggtggtgaagatgttctacagcttccaggacaagaggaacctgtacctgatcatggagttcctgcccggcggggacatgatgaccctgctgatgaagaaggacaccctgacagaggaggagacccagttctacatcagcgagaccgtgctggccattgatgccatccaccagctgggcttcatccaccgggacatcaagccagacaacctgctgctggatgccaagggccacgtgaagctgagtgactttggcctgtgcaccggcctgaagaaggcccacaggacagagttctacagaaacctgacccacaaccccccaagtgacttctccttccagaacatgaacagcaagaggaaggccgagacctggaagaagaacagacggcagctggcctacagcacagtgggcaccccagactacatcgcccctgaggtgttcatgcagacaggctacaacaagctgtgtgactggtggagcctgggcgtcatcatgtatgagatgctgattggctacccacccttctgcagcgagaccccccaggagacctacaggaaggtgatgaactggaaggagaccctggtgttccccccagaggtgcccatcagcgagaaggccaaggacctgatcctgcgcttctgcatcgacagtgaaaatcgcatcggcaacagcggcgtggaggagatcaagggccaccccttctttgagggcgtggactgggagcacatccgggagaggcctgctgccatccccatcgagatcaagagcattgatgacaccagcaactttgatgacttccctgagagtgacatcctgcagcctgtgcccaacaccacagagccagactacaagagcaaggactgggtgttcctgaactacacctacaagagatttgagggcctgacccagaggggcagcatccccacctacatgaaggccggcaagctgtag

SEQ ID NO: 22358 - DNA, 564 bp, Artificial Sequence
  Description of Artificial Sequence: Synthetic coding sequence
atgaacaacaccctgaggaaggatggcaagaaggactgctgctttgagatcagcgccccagacaagaggatctaccagttcaccgctgccagccccaaggatgctgaggagtgggtgcagcagctgaagtttgtgctgcaggacatggagagtgacatcatccctgaggactatgatgagcggggggagctgtatgatgatgtggaccaccccctgcccatcagcaaccccctgaccagcagccagcccattgatgatgagatctatgaggagctgcctgaggaggaggaggacagcgcccctgtgaaggtggaggagcagaggaagatgagccaggacagcgtgcaccacaccagcggggacaagagcacagattatgccaacttctaccagggcctgtgggactgcacaggagccttcagtgatgagctgtccttcaagagaggagatgtgatctacatcctgagcaaggagtacaacagatatggctggtgggtgggggagatgaagggggccatcggcctggtgcccaaggcctacatcatggagatgtatgacatctag

SEQ ID NO: 22359 - DNA, 219 bp, Artificial Sequence
  Description of Artificial Sequence: Synthetic coding sequence
atggccctgagcctgggctggaaggcccacaggaaccactgcggcctgctgctgcaggccctgcggagcagcggcctgctgctcttcccctgtggccagtgcccctggagaggagctggcagcttcctggaccctgagatcaaggccttcctggaggagaacacagaggtgaccagcagcggcagcctgaccccagagatccagctgcggctgctgtag

SEQ ID NO: 22360 - DNA, 2919 bp, Artificial Sequence
  Description of Artificial Sequence: Synthetic coding sequence
atggctgctgctgctgctgagcagcagcagttctacctgctgctgggcaacctgctgagcccagacaacgtggtgaggaagcaggccgaggagacctatgagaacatccctggccagagcaagatcaccttcctgctgcaggccatccggaacaccacagctgctgaggaggcccggcagatggctgctgtgctgctgcggcggctgctgagcagcgcctttgatgaggtgtacccagccctgcccagtgatgtgcagacagccatcaagaacctgctgcccggcttcctgcaggccgtgaatgacagctgctaccagaatgatgacagcgtgctgaagagcctggtggagattgctgacacagtgcccaagtacctgcggccccacctggaggccaccctgcagctgagcctgaagctgtgtggggacaccagcctgaacaacatgcagaggcagctggccctggaggtgattgtgaccctgtctgaaacagctgctgccatgctgaggaagcacaccaacatcgtggcccagaccatcccccagatgctggccatgatggtggacctggaggaggatgaggactgggccaatgctgatgagctggaggatgatgactttgacagcaatgctgtggccggggagagcgccctggacaggatggcctgtggcctgggcggcaagctggtgctgcccatgatcaaggagcacatcatgcagatgctgcagaacccagactggaagtacagacatgctggcctgatggccctgagcgccatcggggagggctgccaccagcagatggagggcatcctgaatgaaattgtgaactttgtgctgctcttcctgcaggacccccacccccgggtgcgctatgctgcctgcaatgctgtgggccagatggccacagactttgcccctggcttccagaagaagttccacgagaaggtgattgctgccctgctgcagaccatggaggaccagggcaaccagagggtgcaggcccatgctgctgctgccctgatcaacttcacagaggactgccccaagagcctgctgatcccctacctggacaacctggtgaagcacctgcacagcatcatggtgctgaagctgcaggagctgatccagaagggcaccaagctggtgctggagcaggtggtgaccagcatcgcctctgtggccgacacagctgaggagaagtttgtgccctactatgacctcttcatgcccagcctgaagcacatcgtggagaatgctgtgcagaaggagctgcggctgctgcggggcaagaccatcgagtgcatcagcctgattggcctggccgtgggcaaggagaagttcatgcaggatgccagtgatgtgatgcagctgctgctgaagacccagacagacttcaatgacatggaggatgatgacccccagatctcctacatgatcagcgcctgggccaggatgtgcaagatcctgggcaaggagttccagcagtacctgcctgtggtgatgggccccctgatgaagacagccagcatcaagccagaggtggccctgctggacacccaggacatggagaacatgtctgatgatgatggctgggagtttgtgaacctgggggaccagcagagctttggcatcaagacagctggcctggaggagaagagcacagcctgccagatgctggtgtgctacgccaaggagctgaaggagggctttgtggagtacacagagcaggtggtgaagctgatggtgcccctgctgaagttctacttccatgatggagtgcgggtggccgctgctgagagcatgcccctgctgctggagtgtgcccgggtgcggggccctgagtacctgacccagatgtggcacttcatgtgtgatgccctgatcaaggccatcggcacagagccagacagtgatgtgctgtctgagatcatgcacagctttgccaagtgcatcgaggtgatgggagatggctgcctgaacaatgagcactttgaggagctgggcggcatcctgaaggccaagctggaggagcacttcaagaaccaggagctgcggcaggtgaagaggcaggatgaagattatgatgagcaggtggaggagagcctgcaggatgaagatgacaatgatgtgtacatcctgaccaaggtgtctgacatcctgcacagcatcttcagcagctacaaggagaaggtgctgccctggtttgagcagctgctgcccctgattgtgaacctgatctgcccccaccggccctggccagaccggcagtggggcctgtgcatctttgatgatgtgattgagcactgcagccctgccagcttcaagtatgcagagtacttcctgcggcccatgctgcagtatgtgtgtgacaacagccctgaggtgcggcaggccgccgcctacggcctgggcgtgatggcccagtatggaggagacaactaccggcccttctgcacagaggccctgcccctgctggtgcgggtcatccagagcgctgacagcaagaccaaggaaaatgtgaatgccacagagaactgcatctctgctgtgggcaagatcatgaagttcaagccagactgtgtgaatgtggaggaggtgctgccccactggctgtcctggctgcccctgcacgaggacaaggaggaggccgtgcagaccttcaactacctgtgtgacctgattgagagcaaccaccccatcgtgctgggccccaacaacaccaacctgcccaagatcttcagcatcatcgccgagggggagatgcatgaggccatcaagcatgaggacccctgtgccaagaggctggccaacgtggtgcggcaggtgcagaccagcggcggcctgtggacagagtgcatcgcccagctgagccctgagcagcaggccgccatccaggagctgctgaacagcgcctag

SEQ ID NO: 22361 - DNA, 1428 bp, Artificial Sequence
  Description of Artificial Sequence: Synthetic coding sequence
atgcaggtgaccttcatctacgtgtgcctgaagggcctgatgctgcaggacctggtgtctgccaagctgatcagtgactacacagtgacagagatcccagacaccatcaatgacctgcagggcagcaccaaggtgctgcaggccgtgcagtggctggtgagccactgcccccacagcctggacctgtgctgccagaccctcatccagtatgtggaggatggcattggacatgagttcagcggccgcttcttccatgacagaagagagcggcggctgggcggcctggccagccaggagcccggggccatcatcgagctgttcaacagcgtgctgcagttcctggcctctgtggtgagcagcgagcagctgtgtgacctgtcctggcctgtgacagaatttgctgaggccggcggcagccggctgctgccccacctgcactggaatgcccctgagcacctggcctggctgaagcaggccgtgctgggcttccagctgccccagatggacctgccccccctgggcgccccctggctgcctgtgtgcagcatggtggtgcagtatgccagccagatccccagcagccggcagacccagcctgtgctgcagagccaggtggagaacctgctgcacaggacctactgccgctggaagagcaagagccccagccctgtgcatggagctggccccagcgtgatggagatcccctgggatgacctgattgccctgtgcatcaaccacaagctgcgggactggaccccaccccggctgcctgtgaccagcgaggccctgtctgaagatggccagatctgtgtgtacttcttcaagaatgacctgaagaagtatgatgtgcccctgtcctgggagcaggcccggctgcagacccagaaggagctgcagctgcgggagggccgcctggccatcaagcccttccaccccagcgccaacaacttccccatccccctgctgcacatgcacaggaactggaagaggagcacagaatgtgcccaggagggccgcatccccagcacagaggacctgatgagaggagccagcgctgaggagctgctggcccagtgcctgagcagcagcctgctgctggagaaggaggagaacaagagatttgaggaccagctgcagcagtggctgtctgaggacagcggggccttcacagacctgaccagcctgcccctgtacctgccccagaccctggtgtccctgagccacaccatcgagcctgtgatgaagacctctgtgaccaccagcccccagagcgacatgatgagggagcagctgcagctgtctgaggccaccggcacctgcctgggggagcggctgaagcacctggagcggctcatccgcagcagccgggaggaggaggtggccagcgagctgcacctgagcgccctgctggacatggtggacatctag

SEQ ID NO: 22362 - DNA, 333 bp, Artificial Sequence
  Description of Artificial Sequence: Synthetic coding sequence
atgagcacagccctgacccacaccaccgtggccatgcgctgccccatgggcggcggcggcggccccacctacggccccccccagccctggggccacccagatgtgcacatcatgcagcaccacgtgctgcccatccaggcccggctgggcagcattgctgagattgacctgggcgtgcccccacctgtgatgaagaccttcaaggagttcctgctgagcctggatgattctgtggatgaaacagaagctgtgaagcgctacaatgactacaagctggacttccggcggcagcagatgcaggacttcttcctggcccacaaggatgaggagtag

SEQ ID NO: 22363 - DNA, 828 bp, Artificial Sequence; identical to SEQ ID NO: 21402
  Description of Artificial Sequence: Synthetic coding sequence

SEQ ID NO: 22364 - DNA, 876 bp, Artificial Sequence
  Description of Artificial Sequence: Synthetic coding sequence
atgattggagatggagaggactacttcctgagcctgtttggagacagcaagaagctgacagcccacagcaactacacccagaagaccctgaagtacttctccatgatcctggaggaggtgggccagttcaccagcagcagcctgggagatgtggagattgctgaggtgaatgtgaagggcctgtttgtgaagctgatcaacagcagcctggacaaggagatggccatcggggaccacatcctgcagcagaatgtgaatggccagaccatcagcctgtaccgcttcctgcccaacatcgtgatgcaggccaacagcacagtgacagtgtgggccgccgccagcgaggccaagcaccagccccccagcgacttcctgtggaaggagcaggacaagttccgggccagcccagactgcatcaccatcctgtgcaagcccaacggccaggccatcgcctggtacacccccatccactggaagcaggcctgggagaagctggatgctgatgtggagttcaaccgctgcagcgtggtgagccccaccttcaggaagagggtcttccagtggacagccagcacagccaccatcaccaaggagaagcaggaccagcccaagaaggacatcagcaactaccaggtggagcaggcccaggtgctgctgaagcgggagaaggagatcccccccaccgtcttccccaacagaagcccctggtgccagaacccctacgtgtctgcccacccctactgccccctgattgagccccacaacaccagcacagctgggggccgcctggaccggcagcccaggaccaggagcacccggcccaacagagccagcggcagcaagaagaagaagaccagcgagagccagaagcagtag

SEQ ID NO: 22365 - DNA, 1185 bp, Artificial Sequence
  Description of Artificial Sequence: Synthetic coding sequence
atggtgcccagccaggccccctacctggtgcctgccttccccctgcctgctgccaccagccctggccgggagtatgctgcccctggaacagcccctgagggcctgcacggcctgcccctgtctgagggcctgcagccctacccagccttccccttcccctacctggacaccttcatgaccgtcttcctgcctgacccccctgtgtgccccctgctgagccccagcttcctgccctgccccttcctgggcgccacagccagcagcgccatcagccccagcatgagcagcgccatgagccccaccctggaccccccaccttctgtgaccagccagaggcgggaggaggagaagtgggaggcccagagcgagggccaccccttcatcaccagccgcagcagcagccccctgcagctgaacctgctgcaggaggagatgccccggcccagcgagagcccagaccagatgagaagaaacacctgcccccagacagagtactgtgtgacaggcaacaatggaagtgagagcagccctgccaccaccggggccctgagcacaggcagccccccccgggagaaccccagccaccccacagccagcgccctgagcacaggcagcccccccatgaagaaccccagccaccccacagccagcaccctgtccatgggcctgccccccagcaggacccccagccaccccacagccaccgtgctgagcacaggcagcccccccagcgagagccccagcaggacaggcagcgctgccagcggcagcagtgacagcagcatctacctgaccagctctgtgtacagcagcaagatcagccagaatggccagcagagccaggatgtgcagaagaaggagaccttccccaacgtggccgaggagcccatctggaggatgatccggcagaccccagagcgcatcctgatgacctaccaggtgcctgagcgggtgaaggaggtggtgctgaaggaggacctggagaagctggagagcatgaggcagcagcagccccagttcagccacggccagaaggaggagctggccaaggtgtacaactggatccagagccagacagtgacccaggagattgacatccaggcctgtgtgacctgtgaaaatgaagattctgcagatggagctgccaccagctgtggccaggtgctggtggaggacagctgctag

SEQ ID NO: 22366 - DNA, 2424 bp, Artificial Sequence
  Description of Artificial Sequence: Synthetic coding sequence
cagggcgccagctttgccctggccgctgctgctgccctgctgtttggaagtgacatggaggatggccccagcaacaatgccagctgcttccggcggctgacagagtgcttcctgagccccagcctgacagatgagaaggtgaaggcctacctgagcctgcacccccaggtgctggatgaatttgtgtctgagagcgtgtctgctgagaccgtggagaagtggctgaagaggaagaacaacaagtcagaagatgagagcgcccccaaggaggtgagccgctaccaggacaccaacatgcagggcgtggtgtatgagctgaacagctacatcgagcagaggctggacaccggcggggacaaccagctgctgctgtatgagctgagcagcatcatcaagatcgccaccaaggcagatggctttgccctgtacttcctgggggagtgcaacaacagcctgtgcatcttcaccccacctggcatcaaggagggcaagcccaggctcatcccagctggccccatcacccagggcaccaccgtgtctgcctacgtggccaagagcaggaagaccctgctggtggaggacatcctgggagatgagcgcttcccccggggcaccggcctggagagcggcacccgcatccagagcgtgctgtgcctgcccatcgtgacagccatcggggacctgattggcatcctggagctgtaccgccactggggcaaggaggccttctgcctgagccaccaggaggtggccacagccaacctggcctgggcctctgtggccatccaccaggtgcaggtgtgccggggcctggccaagcagacagagctgaatgacttcctgctggatgtgtccaagacctactttgacaacatcgtggccatcgacagcctgctggagcacatcatgatctatgccaagaacctggtgaatgctgacagatgtgccctcttccaggtggaccacaagaacaaggagctgtacagcgacctgtttgacatcggggaggagaaggagggcaagcctgtgttcaagaagaccaaggagatccgcttcagcattgagaagggcattgctggccaggtggccaggactggagaggtgctgaacatcccagatgcctatgctgacccccgcttcaaccgggaggtggacctgtacacaggctacaccaccaggaacatcctgtgcatgcccatcgtgtcccggggctctgtgattggagtggtgcagatggtgaacaagatcagcggcagcgccttcagcaagacagatgagaacaacttcaagatgtttgctgtgttctgtgccctggccctgcactgtgccaacatgtaccaccgcatccgccacagcgagtgcatctacagagtgaccatggagaagctgagctaccacagcatctgcaccagcgaggagtggcagggcctgatgcagttcaccctgcctgtgcggctgtgcaaggagattgagctgttccactttgatattggcccctttgagaacatgtggccaggcatctttgtgtacatggtgcacaggagctgtggcaccagctgctttgagctggagaagctgtgccgcttcatcatgtctgtgaagaagaactaccgccgggtgccctaccacaactggaagcatgctgtgacagtggcccactgcatgtatgccatcctgcagaacaaccacaccctcttcacagacctggagaggaagggcctgctgattgcctgcctgtgccacgacctggaccaccggggcttcagcaacagctacctgcagaagtttgaccaccccctggccgccctgtacagcaccagcaccatggagcagcaccacttcagccagacagtgtccatcctgcagctggagggccacaacatcttcagcaccctgagcagcagtgaatatgagcaggtgctggagatcatcaggaaggccatcatcgccacagacctggccctgtactttggaaacaggaagcagctggaggagatgtaccagacaggcagcctgaacctgaacaaccagagccaccgggacagagtcatcggcctgatgatgacagcctgtgacctgtgcagcgtgaccaagctgtggcctgtgaccaagctgacagccaatgacatctatgcagagttctgggccgagggagatgagatgaagaagctgggcatccagcccatccccatgatggaccgggacaagaaggatgaggtgccccagggccagctgggcttctacaatgctgtggccatcccctgctacaccaccctgacccagatcctgcccccaacagagcccctgctgaaggcctgccgggacaacctgagccagtgggagaaggtgatccggggggaggagacagccacctggatcagcagccccagcgtggcccagaaggctgctgccagcgaggactag

SEQ ID NO: 22367 - DNA, 1677 bp, Artificial Sequence
  Description of Artificial Sequence: Synthetic coding sequence
atggccagctgcccagacagcgacaacagctgggtgctggccggcggggagctgggcatcagcctgaacatgtgcctgctgggcgccctggtgctgctgggcctgggcgtgctgctcttcagcggcggcctgtctgagagcgagaccggccccatggaggaggtggagcggcaggtgctgcctgaccctgaggtgctggaggccgtgggggaccggcaggacggcctgcgggagcagctgcaggcccctgtgcccccagacagcgtgcccagcctgcagaacatgggcctgctgctggacaagctggccaaggagaaccaggacatccggctgctgcaggcccagctgcaggcccagaaggaggagctgcagagcctgatgcaccagcccaagggcctggaggaggagaatgcccagctgcggggggccctgcagcagggcgaggccttccagagggccctggagagcgagctgcagcagctgcgggcccggctgcagggcctggaggccgactgtgtgcggggcccagatggagtgtgcctgagcggcggccggggcccccagggcgacaaggccatccgggagcagggcccccgggagcaggagcctgagctgtccttcctgaagcagaaggagcagctggaggccgaggcccaggccctgcggcaggagctggagcggcagaggcggctgctgggctctgtgcagcaggacctggagaggagcctgcaggatgccagcagaggagaccctgcccacgccggcctggccgagctgggccaccggctggcccagaagctgcagggcctggagaactggggccaggaccccggggtgtctgccaatgccagcaaggcctggcaccagaagagccacttccagaacagccgggagtggagcggcaaggagaagtggtgggatggccagagggacaggaaggccgagcactggaagcacaagaaggaggagagcggccgggagaggaagaagaactggggcggccaggaggaccgggagcctgctggccgctggaaggagggccggccccgggtggaggagagcggcagcaagaaggagggcaagaggcagggccccaaggagccccccaggaagagcggcagcttccacagcagcggggagaagcagaagcagccccgctggagggagggcaccaaggacagccatgaccccctgcccagctgggccgagctgctgcggcccaagtaccgggccccccagggctgcagcggcgtggatgaatgtgcccggcaggagggcctgaccttcttcggcacagagctggcccctgtgcggcagcaggagctggccagcctgctgcggacctacctggcccggctgccctgggccggccagctgaccaaggagctgcccctgagccctgccttcttcggggaggatggcatcttcagacatgaccggctgcgcttccgggactttgtggatgccctggaggacagcctggaggaggtggccgtgcagcagacaggagatgatgatgaggtggatgactttgaggacttcatcttcagccacttcttcggggacaaggccctgaagaagaggtctgggaagaaggacaagcacagccagagccccagggctgctggcccccgggagggccacagccacagccaccaccaccaccaccggggctag

SEQ ID NO: 22368 - DNA, 1881 bp, Artificial Sequence
  Description of Artificial Sequence: Synthetic coding sequence
atgggaaatgctgctggcagcgctgagcagcctgctggccctgctgcccccccacccaagcagcacagatttgagaagctgatggagtacttcagaaatgaagacagcaacatcgacttcatggtggcctgcatgcagttcatcaacatcgtggtgcacagcgtggagaacatgaacttccgggtcttcctgcagtatgagttcacccacctgggcctggacctgtacctggagcggctgcggctgacagaaagtgacaagctgcaggtgcagatccaggcctacctggacaacatctttgatgtgggcgccctgctggaggacacagagaccaagaatgctgtgctggagcacatggaggagctgcaggagcaggtggccctgctgacagagcggctgagagatgctgaaaatgaatccatggccaagattgctgagctggagaagcagctgagccaggccaggaaggagctggagaccctgcgggagcgcttcagcgagagcacagccatgggccccagcagaagacctcctgagcctgagaaggcccccccagctgcccccacccggcccagcgccctggagctgaaggtggaggagctggaggagaagggcctcatccgcatcctgcggggccctggagatgctgtgtccattgagatcctgcctgtggccgtggccacccccagcggaggagatgcccccaccccaggagtgcccaccggcagccccagcccagacctggccccagctgctgagcccgcccctggggccgcccctcctcctcctcctcctcctcctgggggccccccagatgccctgggccggcgggacagcgagctgggccctggggtgaaggccaagaagcccatccagaccaagttcaggatgcccctgctgaactgggtggccctgaagcccagccagatcactggaacagtgttcacagagctgaatgatgagaaggtgctgcaggagctggacatgtctgactttgaggagcagttcaagaccaagagccagggccccagcctggacctgagcgccctgaagagcaaggccgcccagaaggcccccagcaaggccaccctgattgaggccaacagagccaagaacctggccatcaccctgaggaaaggaaacctgggcgctgagcgcatctgccaggccatcgaggcctatgacctgcaggccctgggcctggacttcctggagctgctgatgaggttcctgcccacagaatatgaaagaagcctcatcaccaggtttgagcgggagcagaggcccatggaggagctgtctgaggaggaccgcttcatgctgtgcttcagccgcatcccccggctgcctgagaggatgaccaccctgaccttcctgggcaacttcccagacacagcccagctgctgatgccccagctgaatgccatcatcgccgcctccatgagcatcaagagcagtgacaagctgcggcagatcctggagatcgtgctggcctttggaaactacatgaacagcagcaagagaggagctgcctacggcttccggctgcagagcctggatgccctgctggagatgaagagcacagacaggaagcagaccctgctgcactacctggtgaaggtgattgctgagaagtacccccagctgaccggcttccacagcgacctgcacttcctggacaaggccggctctgtgtccctggacagcgtgctggctgatgtgcgcagcctgcagaggggcctggagctgacccagcgggagtttgtgcggcaggatgactgcatggtgctgaaggagttcctgcgggccaacagccccaccatggacaagctgctggccgacagcaagacagcccaggccgtgcccactggaggcctgtag

SEQ ID NO: 22369 - DNA, 1500 bp, Artificial Sequence
  Description of Artificial Sequence: Synthetic coding sequence
atggacaagctgattgtggatggccggggcaaggccaccatcagcaatgatggagccaccatcctgaagctgctggatgtggtgcaccctgctgccaagaccctggtggacatcgccaagagccaggatgctgaggtgggagatggcaccacctctgtgaccctgctggccgctgagttcctgaagcaggtgaagccctacgtggaggagggcctgcacccccagatcatcatccgggccttcagaacagccacccagctggccgtgaacaagatcaaggagattgctgtgacagtgaagaaggctgacaaggtggagcagaggaagctgctggagaagtgtgccatgacagccctgagcagcaagctgatcagccagcagaaggccttctttgccaagatggtggtggatgctgtgatgatgctggatgacctgctgcagctgaagatgattggcatcaagaaggtgcagggcggggccctggaggacagccagctggtggccggcgtggccttcaagaagaccttctcctatgccggctttgagatgcagcccaagaagtaccacaaccccaagatcgccctgctgaatgtggagctggagctgaaggccgagaaggacaatgctgagatccgggtgcacacagtggaggactaccaggccatcgtggatgctgagtggaacatcctgtatgacaagctggagaagatccaccacagcggggccaaggtggtgctgagcaagctgcccatcggagatgtggccacccagtactttgctgaccgggacatgttctgtgccggccgggtgcctgaggaggacctgaagaggaccatgatggcctgtggcggcagcatccagacctctgtgaatgccctgtctgcagatgtgctgggccgctgccaggtgtttgaggagacccagattggaggagagcgctacaacttcttcaccggctgccccaaggccaagacctgcaccttcatcctgcggggcggcgctgagcagttcatggaggagacagagaggagcctgcatgatgccatcatgattgtgagaagagccatcaagaatgacagcgtggtggccggcggcggggccatcgagatggagctgagcaagtacctgcgggactacagcaggaccatccctgggaagcagcagctgctgattggagcctatgccaaggccctggagatcatcccccggcagctgtgtgacaatgccggctttgatgccaccaacatcctgaacaagctgcgggcccggcatgcccagggcggcacctggtatggagtggacatcaacaatgaagatattgctgacaactttgaggcctttgtgtgggagcccgccatggtgcgcatcaatgccctgacagctgccagcgaggccgcctgcctgattgtgtctgtggatgagaccatcaagaaccccaggagcacagtggatgcccccacagctgctggccggggccggggccggggccggccccactag

SEQ ID NO: 22370 - DNA, 78 bp, Artificial Sequence
  Description of Artificial Sequence: Synthetic coding sequence
atggcccacgagatgattggcacccagatcgtgacagagcggctggtggccctgctggagagcggcacagagaagtag

SEQ ID NO: 22371 - DNA, 633 bp, Artificial Sequence
  Description of Artificial Sequence: Synthetic coding sequence
atggagaagacagagctgatccagaaggctgtggcctacaagaatgtggtgggcggccgccgcagcgcctggagggtcatcagcagcattgagcagaagacagacaccagtgacaagaagctgcagctgatcaaggactaccgggagaaggtggagagcgagctgcggagcatctgcaccaccgtgctggagctgctggacaagtacctgattgccaatgccaccaaccctgagagcaaggtgttctacctgaagatgaagggggactacttccgctacctggccgaggtggcctgtggagatgacaggaagcagaccatcgacaacagccagggcgcctaccaggaggcctttgacatcagcaagaaggagatgcagcccacccaccccatccggctgggcctggccctgaacttcagcgtcttctactatgagatcctgaacaaccctgagctggcctgcaccctggccaagacagcctttgatgaggccatcgccgagctggacaccctgaatgaagattcctacaaggacagcaccctcatcatgcagctgctgcgggacaacctgaccctgtggaccagtgacagcgctggggaggagtgtgatgctgctgagggcgcagaaaattag

SEQ ID NO: 22372 - DNA, 501 bp, Artificial Sequence
  Description of Artificial Sequence: Synthetic coding sequence
atggacctgatgcccttcatcaacaaggccggctgtgaatgtctgaatgaaagtgatgaacatggctttgacaactgcctgaggaaggacaccaccttcctggagagtgactgtgatgagcagctgctgatcaccgtggccttcaaccagcctgtgaagctgtacagcatgaagttccagggccctgacaatggccagggccccaagtatgtgaagatcttcatcaacctgcccaggtccatggactttgaggaggccgagaggtctgagcccacccaggccctggagctgacagaagatgacatcaaggaggatggcatcgtgcccctgcgctacgtgaagttccagaatgtgaacagcgtgaccatctttgtgcagagcaaccagggcgaggaggagaccacccgcatctcctacttcaccttcatcggcacccctgtgcaggccaccaacatgaatgacttcaagagggtggtgggcaagaagggggagagccactag

SEQ ID NO: 22373 - DNA, 639 bp, Artificial Sequence
  Description of Artificial Sequence: Synthetic coding sequence
atggccgcccctgaggagcgggacctgacccaggagcagacagagaagctgctgcagttccaggacctgaccggcatcgagagcatggaccagtgccgccacaccctggagcagcacaactggaacattgaagctgctgtgcaggaccggctgaatgagcaggagggcgtgcccagcgtcttcaaccccccacccagccggcccctgcaggtgaacacagctgaccaccgcatctacagctatgtggtgtcccggccccagccccggggcctgctgggctggggctactacctgatcatgctgcccttccgcttcacctactacaccatcctggacatcttccgctttgccctgcgcttcatccggccagaccccaggagccgggtgacagatcctgtgggggacatcgtgtccttcatgcacagctttgaggagaagtatggccgggcccaccctgtgttctaccagggcacctacagccaggccctgaatgatgccaagcgggagctgcgcttcctgctggtgtacctgcatggagatgaccaccaggacagtgatgagttctgcaggaacaccctgtgtgcccctgaggtgatcagcctcatcaacaccagcagccacagcttcctgctgctgtag

SEQ ID NO: 22374 - DNA, 1371 bp, Artificial Sequence; identical to SEQ ID NO: 20778
  Description of Artificial Sequence: Synthetic coding sequence

SEQ ID NO: 22375 - DNA, 183 bp, Artificial Sequence
  Description of Artificial Sequence: Synthetic coding sequence
atggatgagcaggccctgctgggcctgaaccccaatgctgacagcgacttccggcagagggccctggcctactttgagcagctgaagatcagcccagatgcctggcaggtgtgtgccgaggccctggcccagaggacctacagtgatgaccacgtgaagttcttctgcttccaggtgctgtag

SEQ ID NO: 22376 - DNA, 339 bp, Artificial Sequence
  Description of Artificial Sequence: Synthetic coding sequence
atgagcagctccatgtggtacatcatgcagagcatccagagcaagtacagcctgtctgagcggctcatccgcaccatcgccgccatccgctccttcccccatgacaacgtggaggacctgatccggggcggcgcagatgtgaactgcacccacggcaccctgaagcccctgcactgtgcctgcatggtgtctgatgctgactgtgtggagctgctgctggagaagggagctgaggtgaatgccctggatggctacaacagaacagccctgcactatgctgctgagaaggatgaggcctgtgtggaggtgctgctggagtatggagccaaccccaactag

SEQ ID NO: 22377 - DNA, 1173 bp, Artificial Sequence; identical to SEQ ID NO: 21560
  Description of Artificial Sequence: Synthetic coding sequence

SEQ ID NO: 22378 - DNA, 1335 bp, Artificial Sequence; identical to SEQ ID NO: 18494
  Description of Artificial Sequence: Synthetic coding sequence

SEQ ID NO: 22379 - DNA, 495 bp, Artificial Sequence; identical to SEQ ID NO: 19754
  Description of Artificial Sequence: Synthetic coding sequence

SEQ ID NO: 22380 - DNA, 3252 bp, Artificial Sequence; identical to SEQ ID NO: 18590
  Description of Artificial Sequence: Synthetic coding sequence

SEQ ID NO: 22381 - DNA, 1503 bp, Artificial Sequence
  Description of Artificial Sequence: Synthetic coding sequence
atggctgctgtgaagaccctgaaccccaagggcaccatgaagatgctggtgtctggggccggggacatcaagctgaccaaggatggaaatgtgctgctgcacgagatgcagatccagcaccccacagccagcctcatcgccaaggtggccacagcccaggatgacatcactggagatggcaccaccagcaatgtgctgatcatcggggagctgctgaagcaggccgacctgtacatcagcgagggcctgcacccccgcatcatcacagagggctttgaggccgccaaggagaaggccctgcagttcctggaggaggtgaaggtgtcccgggagatggaccgggagaccctgattgatgtggcccggaccagcctgcggaccaaggtgcatgctgagctggctgatgtgctgacagaggccgtggtggacagcatcctggccatcaagaagcaggatgagcccatcgacctcttcatgattgagatcatggagatgaagcacaagtcagaaacagacaccagcctcatccggggcctggtgctggaccatggagcccggcacccagacatgaagaagagggtggaggatgcctacatcctgacctgcaatgtgtccctggagtatgagaagacagaggtgaacagcggcttcttctacaagtctgctgaggagcgggagaagctggtgaaggccgagaggaagttcattgaagatagagtgaagaagatcatcgagctgaagaggaaggtgtgtggggacagcgacaagggctttgtggtgatcaaccagaagggcatcgaccccttcagcctggatgccctgagcaaggagggcatcgtggccctgcggcgggccaagagaagaaacatggagcggctgaccctggcctgtggcggcgtggccctgaacagctttgatgacctgagcccagactgcctgggccacgccggcctggtgtatgagtacaccctgggggaggagaagttcaccttcatcgagaagtgcaacaaccccaggtctgtgaccctgctgatcaagggccccaacaagcacaccctgacccagatcaaggatgctgtgagagatggcctgcgggctgtgaagaatgccattgatgatggctgtgtggtgcctggggccggggctgtggaggtggccatggccgaggccctgatcaagcacaagcccagcgtgaagggccgggcccagctgggcgtgcaggcctttgctgatgccctgctgatcatccccaaggtgctggcccagaacagcggctttgacctgcaggagaccctggtgaagatccaggccgagcacagcgagagcggccagctggtgggcgtggacctgaacacaggagagcccatggtggccgctgaggtgggcgtgtgggacaactactgtgtgaagaagcagctgctgcacagctgcaccgtcatcgccaccaacatcctgctggtggatgagatcatgagagctggcatgagcagcctgaagggctag

SEQ ID NO: 22382 - DNA, 1542 bp, Artificial Sequence
  Description of Artificial Sequence: Synthetic coding sequence
atgtgggatgtgtgcatggagcggggccaccgggacctggagcagtttgagcgggtgcaccgctacatcagtgaccagctgttcaccaacttcaaggagaggacagagcggctggtgatcagccccctgaaccagctgctgtccatgttcaccggcccccacaagctggtgcagaagagatttgacaagctgctggacttctacaactgcacagagcgggcagagaagctgaaggacaagaagaccctggaggagctgcagagcgccaggaacaactatgaggccctgaatgcccagctgctggatgagctgcccaagttccaccagtatgcccagggcctcttcaccaactgtgtgcacggctatgcagaggcccactgtgactttgtgcaccaggccctggagcagctgaagcccctgctgagcctgctgaaggtggccggccgggagggcaacctgattgccatcttccacgaggagcacagccgggtgctgcagcagctgcaggtgttcaccttcttccctgagagcctgcctgccaccaagaagccctttgagaggaagaccatcgaccggcagagcgccaggaagcccctgctgggcctgcccagctacatgctgcagagcgaggagctgcgggccagcctgctggcccgctacccacctgagaagctgttccaggccgagaggaacttcaatgctgcccaggacctggatgtgtccctgctggagggggacctggtgggcgtcatcaagaagaaggaccccatgggcagccagaaccgctggctgattgacaatggagtgaccaagggctttgtgtacagcagcttcctgaagccctacaaccccaggaggagccacagtgatgcctctgtgggcagccacagcagcacagaaagtgaacatggcagcagcagcccccgcttcccccggcagaacagcggcagcaccctgaccttcaaccccagctccatggctgtgtccttcaccagcggcagctgccagaagcagccccaggatgccagccccccacccaaggaatgtgaccagggcaccctgagcgccagcctgaaccccagcaacagcgagagcagccccagccgctgccccagcgaccctgacagcaccagccagcccaggtctggggacagcgcagatgtggccagagatgtgaagcagcccacagccacccccaggagctacagaaacttccgccaccctgagatcgtgggctacagcgtgcccggcagaaatggccagagccaggacctggtgaagggctgtgccaggacagcccaggccccagaagatagaagcacagagccagatggcagcgaggccgagggcaaccaggtgtactttgctgtgtacaccttcaaggccaggaaccccaatgagctgtctgtgtctgccaaccagaagctgaagatcctggagttcaaggatgtgactggaaacacagagtggtggctggccgaggtgaatggcaagaagggctacgtgcccagcaactacatcaggaagacagagtacacctag

SEQ ID NO: 22383 - DNA, 153 bp, Artificial Sequence; identical to SEQ ID NO: 20270
  Description of Artificial Sequence: Synthetic coding sequence

SEQ ID NO: 22384 - DNA, 4317 bp, Artificial Sequence
  Description of Artificial Sequence: Synthetic coding sequence
atgtccatgctgaagcccagcggcctgaaggcccccaccaagatcctgaagccaggcagcacagccctgaagacccccacagctgtggtggcccctgtggagaagaccatcagcagcgagaaggccagcagcacccccagcagcgagacccaggaggagtttgtggatgacttccgggtgggggagcgggtgtgggtgaatggaaacaagccaggcttcatccagttcctgggggagacccagtttgcccctggccagtgggccggcatcgtgctggatgagcccatcggcaagaatgatggctctgtggccggcgtgcgctacttccagtgtgagcccctgaagggcatcttcacccggcccagcaagctgaccaggaaggtgcaggctgaagatgaggccaacggcctgcagaccaccccagccagccgggccaccagccccctgtgcaccagcacagcctccatggtgagcagcagccccagcacccccagcaacatcccccagaagcccagccagcctgctgccaaggagcccagcgccaccccacccatcagcaacctgaccaagacagccagcgagagcatcagcaacctgtctgaggccggcagcatcaagaagggggagcgggagctgaagatcggggacagagtgctggtgggcggcaccaaggccggcgtggtgcgcttcctgggggagacagactttgccaagggggagtggtgtggggtggagctggatgagcccctgggcaagaatgatggagctgtggccggcacccgctacttccagtgccagcccaagtatggcctgtttgcccctgtgcacaaggtgaccaagattggcttccccagcaccaccccagccaaggccaaggccaatgctgtgagaagagtgatggccaccaccagcgccagcctgaagaggagccccagcgccagcagcctgagctccatgagctctgtggccagctctgtgagcagccggcccagcaggacaggcctgctgacagagaccagcagccgctatgccaggaagatcagcggcaccacagccctgcaggaggccctgaaggagaagcagcagcacatcgagcagctgctggccgagcgggacctggagcgggcagaggtggccaaggccaccagccacgtgggggagattgagcaggagctggccctggccagagatggccatgaccagcacgtgctggagctggaggccaagatggaccagctgcggaccatggtggaggccgctgaccgggagaaggtggagctgctgaaccagctggaggaggagaagaggaaggtggaggacctgcagttccgggtggaggaggagagcatcaccaagggggacctggagcagaagagccagatcagtgaagatcctgagaacacccagaccaagctggagcacgcccgcatcaaggagctggagcagagcctgctgtttgagaagaccaaggctgacaagctgcagcgggagctggaggacaccagggtggccaccgtgtctgagaagagccgcatcatggagctggagaaggacctggccctgcgggtgcaggaggtggccgagctgcggcggcggctggagagcaacaagccagctggagatgtggacatgagcctgagcctgctgcaggagatcagcagcctgcaggagaagctggaggtgaccaggacagaccaccagcgggagatcaccagcctgaaggagcactttggagcccgggaggagacccaccagaaggagatcaaggccctgtacacagccacagagaagctgagcaaagaaaatgaaagcctgaagagcaagctggagcacgccaacaaggaaaattctgatgtgattgccctgtggaagagcaagctggagacagccatcgccagccaccagcaggccatggaggagctgaaggtgtccttcagcaagggcctgggcacagaaacagctgagtttgctgagctgaagacccagatcgagaagatgaggctggactaccagcacgagattgagaacctgcagaaccagcaggacagcgagcgggccgcccacgccaaggagatggaggccctgcgggccaagctgatgaaggtgatcaaggagaaggagaacagcctggaggccatccgcagcaagctggacaaggccgaggaccagcacctggtggagatggaggacaccctgaacaagctgcaggaggccgagatcaaggtgaaggagctggaggtgctgcaggccaagtgcaatgagcagaccaaggtgattgacaacttcaccagccagctgaaggccacagaggagaagctgctggacctggatgccctgaggaaggccagcagcgagggcaagtctgagatgaagaagctgcggcagcagctggaggccgctgagaagcagatcaagcacctggagattgagaagaatgctgagagcagcaaggccagcagcatcacccgggagctgcagggccgggagctgaagctgaccaacctgcaggagaacctgtctgaggtgtcccaggtgaaggagaccctggagaaggagctgcagatcctgaaggagaagtttgctgaggccagcgaggaggccgtgtctgtgcagaggtccatgcaggagaccgtgaacaagctgcaccagaaggaggagcagttcaacatgctgagcagtgacctggagaagctgcgggagaacctggccgacatggaggccaagttccgggagaaggatgagcgggaggagcagctgatcaaggccaaggagaagctggagaatgacattgctgagatcatgaagatgtctggggacaacagcagccagctgaccaagatgaatgatgagctgcggctgaaggagagagatgtggaggagctgcagctgaagctgaccaaggccaatgaaaatgccagcttcctgcagaagagcattgaggacatgacagtgaaggccgagcagagccagcaggaggccgccaagaagcatgaggaggagaagaaggagctggagaggaagctgagtgacctggagaagaagatggagaccagccacaaccagtgccaggagctgaaggcccgctatgagcgggccaccagcgagaccaagaccaagcatgaggagatcctgcagaacctgcagaagaccctgctggacacagaggacaagctgaagggggcccgggaggagaacagcggcctgctgcaggagctggaggagctgaggaagcaggccgacaaggccaaggccgcccagacagcagaagatgccatgcagatcatggagcagatgaccaaggagaagacagagaccctggccagcctggaggacaccaagcagaccaatgccaagctgcagaatgagctggacaccctgaaggagaacaacctgaagaatgtggaggagctgaacaagagcaaggagctgctgactgtggagaaccagaagatggaggagttcaggaaggagattgagaccctgaagcaggccgccgcccagaagagccagcagctgagcgccctgcaggaggagaatgtgaagctggccgaggagctgggccgcagcagagatgaggtgaccagccaccagaagctggaggaggagaggtctgtgctgaacaaccagctgctggagatgaagaagcgggagagcaagttcatcaaggatgctgatgaggagaaggccagcctgcagaagagcatcagcatcaccagcgccctgctgacagagaaggatgctgagctggagaagctgagaaatgaggtgacagtgctgcggggggagaatgccagcgccaagagcctgcacagcgtggtgcagaccctggagagtgacaaggtgaagctggagctgaaggtgaagaacctggagctgcagctgaaggagaacaagaggcagctgagcagcagcagcggcaacacagacacccaggctgatgaagatgagcgggcccaggagagccagattgacttcctgaacagcgtcatcgtggacctgcagaggaagaaccaggacctgaagatgaaggtggagatgatgtctgaggccgccctgaatggaaatggagatgacctgaacaactatgacagtgatgaccaggagaagcagagcaagaagaagcccaggctcttctgtgacatctgtgactgctttgacctgcatgacacagaggactgccccacccaggcccagatgtctgaagatcctccccacagcacccaccacggcagcagaggagaggagcggccctactgtgagatctgtgagatgtttggccactgggccaccaactgcaatgatgatgagaccttctag

SEQ ID NO: 22385 - DNA, 636 bp, Artificial Sequence
  Description of Artificial Sequence: Synthetic coding sequence
atggcctttgctgacagccacctgtggaagctgctggacagacatgccaacaccatccggctgtttgtgctgctgcctgagcagagccctgtgtcctacagcaagaggacagcctaccagaaggccggcggggacagcggaaatgtggatgatgactgtgagcgggtgaagggccctgtgggcagcctgaagtctgtggaggccatcctggaggagagcacagagaagctgaagagcctgagcctgcagcagcagcaggatggagacaacggggacagcagcaagagcacagagaccagtgactttgaaaatattgagagccccctgaatgaaagagacagcagcgcctctgtggacaaccgggagctggagcagcacatccagaccagtgaccctgagaacttccagagcgaggagaggagtgacagtgatgtgaacaatgacaggagcaccagctctgtggacagcgacatcctgagcagcagccacagcagtgacaccctgtgcaatgctgacaatgcccagatccccctggccaacggcctggacagccacagcatcaccagcagcaggaggaccaaggccaaccgggagaagaggaacatgggctacagcagaagaaggctgtggaactag

SEQ ID NO: 22386 - DNA, 2136 bp, Artificial Sequence
  Description of Artificial Sequence: Synthetic coding sequence
atgctggccagcctgaaggtgaagaagcaggagctggccaacagcagtgatgccaccctgcctgaccggcccctgagcccccccctgacagccccacccaccatgaagagcagcgagttctttgagatgctggagaagatgcagggcatcaagctggaggagcagaagccaggcccccagaagaacaaggatgactacatcccctaccccagcattgatgaggtggtggagaagggcggcccctacccccaggtgatcctgccccagtttggaggctactggattgaggaccctgaaaatgtgggcacccccaccagcctgggcagcagcatctgtgaggaggaggaggaggacaacctgagccccaacaccttcggctacaagctggagtgcaagggggaggcccgggcctacagaagacacttcctgggcaaggaccacctgaacttctactgcaccggcagcagcctgggcaacctgatcctgtctgtgaagtgtgaggaggccgagggcatcgagtacctgcgggtcatcctgcggagcaagctgaagacagtgcatgagcgcatccccctggccggcctgagcaagctgcccagcgtgccccagatcgccaaggccttctgtgatgatgctgtgggcctgcgcttcaaccctgtgctgtaccccaaggccagccagatgattgtgtcctatgatgaacatgaggtgaacaacaccttcaagtttggagtcatctaccagaaggcccggcagaccctggaggaggagctgtttggaaataatgaggagagccctgccttcaaggagttcctggacctgctgggggacaccatcaccctgcaggacttcaagggcttccggggcggcctggatgtgacccacggccagacaggagtggagagcgtgtacaccaccttccgggaccgggagatcatgtttcatgtgtccaccaagctgcccttcacagatggagatgcccagcagctgcagaggaagaggcacatcggaaatgacatcgtggccatcatcttccaggaggagaacaccccatttgtgcctgacatgattgccagcaacttcctgcacgcctacatcgtggtgcaggtggagaccccaggcacagagacccccagctacaaggtgtctgtgacagcccgggaggatgtgcccacctttggaccacccctgcccagcccccctgtgttccagaagggccctgagttccgggagttcctgctgaccaagctgaccaatgcagaaaatgcctgctgcaagagtgacaagtttgccaagctggaggacaggaccagggctgccctgctggacaacctgcatgatgagctgcacgcccacacccaggccatgctgggcctgggccctgaggaggacaagtttgaaaatggaggccatggaggcttcctggagagcttcaagagggccatccgggtgcgcagccacagcatggagaccatggtgggcggccagaagaagagccacagcggcggcatccctggcagcctgagcggcggcatcagccacaacagcatggaggtgaccaagaccaccttcagcccccctgtggtggccgccaccgtgaagaaccagagccgcagccccatcaagagaagaagtggcctcttcccccggctgcacactggaagtgagggccagggcgacagccgggcccgctgtgacagcaccagcagcacccccaagaccccagatggcggccacagcagccaggagatcaagtctgagaccagcagcaaccccagcagccctgagatctgccccaacaaggagaagcccttcatgaagctgaaggaaaatggccgggccatcagccgcagcagcagcagcaccagctctgtgagcagcacagctggggagggggaggccatggaggagggggacagcggcggcagccagcccagcaccaccagccccttcaagcaggaggtgtttgtgtacagccccagccccagcagcgagagccccagcctgggcgccgccgccacccccatcatcatgagccgcagccccacagatgccaagagcaggaacagccccaggagcaacctgaagttccgctttgacaagctgagccacgccagcagtggagctggccactag

SEQ ID NO: 22387 - DNA, 1089 bp, Artificial Sequence
  Description of Artificial Sequence: Synthetic coding sequence
atggatggcctggatgatgtggagaacagcatgctgtactacaaccaggccgtcatcctgtaccacctgcggcagtacacagaggccatctctgtgggggagaagctgtaccagttcatcgagccctttgaggagaagtttgcccaggccgtgtgcttcctgctggtggacctgtacatcctgacctaccaggccgagaaggccctgcacctgctggccgtgctggagaagatgatcagccagggcaacaacaacaagaatggcaagaatgagaccggcaacaacaacaacaaggatggcagcaaccacaaggccgagagcggggccctgattgaagctgccaagagcaagatccaccagtacaaggtgcgggcctacatccagatgaagagcctgaaggcctgcaagcgggagatcaagtctgtgatgaacacagctggcaacagcgcccccagcctcttcctgaagagcaactttgagtacctgcggggcaactacaggaaggctgtgaagctgctgaacagcagcaacattgctgagcaccctggcttcatgaagacaggagaatgtctgcgctgcatgttctggaacaacctgggctgcatccactttgccatgagcaagcacaacctgggcatcttctacttcaagaaggccctgcaggagaatgacaacgtgtgtgcccagctgtctgctggcagcacagatcctgggaagaagttcagcggccggcccatgtgcaccctgctgaccaacaagagatatgagctgctgtacaactgtggcatccagctgctgcacatcggccggcccctggccgcctttgagtgcctgattgaagctgtgcaggtgtaccacgccaacccccggctgtggctgcggctggccgagtgctgcatcgccgccaacaagggcaccagcgagcaggagaccaagggcctgcccagcaagaagggcatcgtgcagagcatcgtgggccagggctaccacaggaagatcgtgctggccagccagagcatccagaacacagtgtacaatgatggccagagcagcgccatccctgtggccaaggccggcaagtggggctag

SEQ ID NO: 22388 - DNA, 1821 bp, Artificial Sequence
  Description of Artificial Sequence: Synthetic coding sequence
atgtgtggggccggcttcggccactttgagtggctggccggcggcggggccggccaggatgtgggccgcagctgcatcctggtgtccattgctgggaagaatgtgatgctggactgtggcatgcacatgggcttcaatgatgaccggcgcttcccagacttctcctacatcacccagaatggccgcctgacagacttcctggactgtgtgatcatcagccacttccacctggaccactgtggggccctgccctacttcagcgagatggtgggctatgatggccccatctacatgacccaccccacccaggccatctgccccatcctgctggaggactacaggaagattgctgtggacaagaagggggaggccaacttcttcaccagccagatgatcaaggactgcatgaagaaggtggtggccgtgcacctgcaccagacagtgcaggtggatgatgagctggagatcaaggcctactatgccggccacgtgctgggcgccgccatgttccagatcaaggtgggcagcgagagcgtggtgtacaccggggactacaacatgaccccagacagacacctgggcgccgcctggattgacaagtgccggcccaacctgctgatcacagagagcacctacgccaccaccatccgggacagcaagcgctgccgggagcgggacttcctgaagaaggtgcatgagaccgtggagcggggcggcaaggtgctgatccctgtgtttgccctgggccgggcccaggagctgtgcatcctgctggagaccttctgggagaggatgaacctgaaggtgcccatctacttcagcacaggcctgacagagaaggccaaccactactacaagctgttcatcccctggaccaaccagaagatcaggaagacctttgtgcagaggaacatgtttgagttcaagcacatcaaggcctttgaccgggcctttgctgacaaccctggccccatggtggtgtttgccaccccaggcatgctgcacgccggccagagcctgcagatcttcaggaagtgggccggaaatgagaagaacatggtgatcatgcctggctactgtgtgcagggcaccgtgggccacaagatcctgagcggccagaggaagctggagatggagggccggcaggtgctggaggtgaagatgcaggtggagtacatgtccttcagcgcccatgctgatgccaagggcatcatgcagctggtgggccaggccgagcctgagagcgtgctgctggtgcacggggaggccaagaagatggagttcctgaagcagaagattgagcaggagctgcgggtgaactgctacatgcctgccaacggggagaccgtgaccctgcccaccagccccagcatccctgtgggcatcagcctgggcctgctgaagcgggagatggcccagggcctgctgcctgaggccaagaagccccggctgctgcacggcaccctcatcatgaaggacagcaacttccggctggtgtcctctgagcaggccctgaaggagctgggcctggccgagcaccagctgcgcttcacctgccgggtgcacctgcatgacaccaggaaggagcaggagacagccctgcgggtgtacagccacctgaagtctgtgctgaaggaccactgtgtgcagcacctgcctgatggctctgtgacagtggagagcgtgctgctgcaggccgccgcccccagtgaagatcctggcaccaaggtgctgctggtgtcctggacctaccaggatgaggagctgggcagcttcctgaccagcctgctgaagaagggcctgccccaggcccccagctag

SEQ ID NO: 22389 - DNA, 399 bp, Artificial Sequence
  Description of Artificial Sequence: Synthetic coding sequence
atgaagaaggtgcggctgaaggagctggagagccggctgcagcaggtggatggctttgagaagcccaagctgctgctggagcagtaccccacccggccccacatcgccgcctgcatgctgtacaccatccacaacacctatgatgacatcgagaacaaggtggtggccgacctgggctgcggctgcggcgtgctgagcattggaacagccatgctgggcgccggcctgtgtgtgggctttgatattgatgaagatgccctggagatcttcaacagaaatgctgaggagtttgagctgcagatcctgacctggttcaacgtgatgtgtgcctactacctgacagaatgtcccagccacagcatccagaactatgagagcagcctgtgggaccagaagtag

SEQ ID NO: 22390 - DNA, 1371 bp, Artificial Sequence
  Description of Artificial Sequence: Synthetic coding sequence
atgatggtgggagatggcaccacctctgtgaccctgctggccgctgagttcctgaagcaggtgaagccctacgtggaggagggcctgcacccccagatcatcatccgggccttcagaacagccacccagctggccgtgaacaagatcaaggagattgctgtgacagtgaagaaggctgacaaggtggagcagaggaagctgctggagaagtgtgccatgacagccctgagcagcaagctgatcagccagcagaaggccttctttgccaagatggtggtggatgctgtgatgatgctggatgacctgctgcagctgaagatgattggcatcaagaaggtgcagggcggggccctggaggacagccagctggtggccggcgtggccttcaagaagaccttctcctatgccggctttgagatgcagcccaagaagtaccacaaccccaagatcgccctgctgaatgtggagctggagctgaaggccgagaaggacaatgctgagatccgggtgcacacagtggaggactaccaggccatcgtggatgctgagtggaacatcctgtatgacaagctggagaagatccaccacagcggggccaaggtggtgctgagcaagctgcccatcggagatgtggccacccagtactttgctgaccgggacatgttctgtgccggccgggtgcctgaggaggacctgaagaggaccatgatggcctgtggcggcagcatccagacctctgtgaatgccctgtctgcagatgtgctgggccgctgccaggtgtttgaggagacccagatcggcggggagcgctacaacttcttcaccggctgccccaaggccaagacctgcaccttcatcctgcggggcggcgctgagcagttcatggaggagacagagaggagcctgcatgatgccatcatgattgtgcggcgggccatcaagaatgattctgtggtggccggcggcggggccatcgagatggagctgagcaagtacctgcgggactacagcaggaccatccctgggaagcagcagctgctgattggagcctatgccaaggccctggagatcatcccccggcagctgtgtgacaatgccggctttgatgccaccaacatcctgaacaagctgcgggcccggcatgcccagggcggcacctggtacggcgtggacatcaacaatgaagatattgctgacaactttgaggcctttgtgtgggagcccgccatggtgcgcatcaatgccctgacagctgccagcgaggccgcctgcctgattgtgtctgtggatgagaccatcaagaaccccaggagcacagtggatgcccccacagctgctggccggggccggggccggggccggccccactag

SEQ ID NO: 22391 - DNA, 2520 bp, Artificial Sequence
  Description of Artificial Sequence: Synthetic coding sequence
atggatggcaaggcagatgtgaagagcctgatggccaagtacaacacaggaggcaaccccacagaagatgtgtctgtgaacagccggcccttccgggtgacaggccccaacagcagcagcggcatccaggccaggaagaacctcttcaacaaccagggcaatgccagccccccagctggccccagcaatgtgcccaagtttggcagccccaagccccctgtggccgtgaagcccagcagcgaggagaagccagacaaggagcccaagccacccttcctgaagcccaccggggccggccagcgcttcggcaccccagccagcctgaccacccgggaccctgaggccaaggtgggcttcctgaagcctgtgggccccaagcccatcaacctgcccaaggaggacagcaagcccaccttcccctggcccccaggcaacaagcccagcctgcacagcgtgaaccaggaccatgacctgaagcccctgggccccaagagcggccccaccccacccaccagtgaaaatgagcagaagcaggccttccccaagctgactggagtgaagggcaagttcatgtctgccagccaggacctggagcccaagcccctcttccccaagccagccttcggccagaagccacccctgagcacagagaacagccatgaagatgagagccccatgaagaatgtgagcagcagcaagggcagccctgcccccctgggcgtgcgcagcaagagcggccccctgaagccagccagagaagattctgagaacaaggaccatgctggggagatcagcagcctgcccttccctggggtggtgctgaagccagctgccagcagaggaggccctggcctgagcaagaatggagaggagaagaaggaggacaggaagattgatgctgccaagaacaccttccagagcaagatcaaccaggaggagctggccagcggcaccccaccagcccgcttccccaaggcccccagcaagctgactgtgggcggcccctggggccagagccaggagaaggagaagggggacaagaacagcgccacccccaagcagaagcccctgcccccactcttcaccctgggccccccaccacccaagcccaacagacctccaaatgtggacctgaccaagttccacaagaccagcagcggcaacagcaccagcaagggccagaccagctacagcaccaccagcctgcccccacctccacccagccacccagccagccagccccccctgcctgccagccaccccagccagccccctgtgcccagcctgccccccaggaacatcaagcccccatttgacctgaagagccctgtgaatgaagacaaccaggatggagtgacccacagtgatggagctggcaacctggatgaggagcaggacagcgagggggagacctatgaagatattgaggccagcaaggagcgggagaagaagcgggagaaggaggagaagaagaggctggagctggagaagaaggagcagaaggagaaggagaagaaggagcaggagatcaagaagaagttcaagctgaccggccccatccaggtgatccacctggccaaggcctgctgtgatgtgaagggcggcaagaatgagctgtccttcaagcagggcgagcagatcgagatcatccgcatcacagacaaccctgagggcaagtggctgggccgcacagcccggggcagctatggctacatcaagaccacagctgtggagattgattatgacagcctgaagctgaagaaggacagcctgggcgcccccagccggcccattgaagatgaccaggaggtgtatgatgatgtggccgagcaggatgacatcagcagccacagccagagcggcagcggcggcatcttccccccacctccagatgatgacatctatgatggcatcgaggaggaggatgctgatgatggcagcaccctgcaggtgcaggagaagagcaacacctggagctggggcatcctgaagatgctgaagggcaaggatgacaggaagaagagcatccgggagaagcccaaggtgtctgacagcgacaacaatgaaggcagcagcttccctgccccacccaagcagctggacatgggagatgaggtgtatgatgatgtggacaccagtgacttccctgtgtcctctgctgagatgagccagggcaccaacgtgggcaaggccaagacagaggagaaggacctgaagaagctgaagaagcaggagaaggaggagaaggacttcaggaagaagttcaagtatgatggagagatccgggtgctgtacagcaccaaggtgaccaccagcatcaccagcaagaagtggggcacccgggacctgcaggtgaagccaggagagagcctggaggtgatccagaccacagatgacaccaaggtgctgtgcagaaatgaggagggcaagtatggctacgtgctgcggagctacctggccgacaatgatggagagatctatgatgacattgctgatggctgcatctatgacaatgactag

SEQ ID NO: 22392 - DNA, 1017 bp, Artificial Sequence
  Description of Artificial Sequence: Synthetic coding sequence
atgggccaccgctacatcgaggtgttcaagagccacaggacagagatggactgggtgctgaagcacagcggccccaacagcgctgacagcgccaatgatggctttgtgcggctgcggggcctgcccttcggctgcaccaaggaggagatcgtgcagttcttcagcggcctggagatcgtgcccaacggcatcaccctgcctgtggaccctgagggcaagatcactggagaggcctttgtgcagtttgccagccaggagctggccgagaaggccctgggcaagcacaaggagagaattggccaccgctacatcgaggtgttcaagagcagccaggaggaggtgcgcagctacagcgacccccccctgaagttcatgtctgtgcagaggcctggcccctatgaccggcccggcacagcccggcgctacatcggcatcgtgaagcaggccggcctggagaggatgaggcctggggcctacagcacaggctatggaggctatgaggagtacagcggcctgagtgatggctacggcttcaccacagacctgtttggccgggacctgagctactgcctgagcggcatgtatgaccacagatatggagacagcgagttcaccgtgcagagcaccaccggccactgtgtgcacatgaggggcctgccctacaaggccacagaaaatgacatctacaacttcttcagccccctgaaccctgtgcgggtgcacatcgagatcggcccagatggccgggtgactggagaggctgatgtggagtttgccacccatgaggaggccgtggccgccatgagcaaggaccgggccaacatgcagcaccgctacatcgagctgttcctgaacagcaccaccggggccagcaatggagcctacagcagccaggtgatgcagggcatgggcgtgtctgctgcccaggccacctacagcggcctggagagccagagcgtgtctggctgctacggggccggctacagcggccagaacagcatgggcggctatgactag

SEQ ID NO: 22393 - DNA, 1536 bp, Artificial Sequence
  Description of Artificial Sequence: Synthetic coding sequence
atggcctctgtggtggagtacaagggcctgcgggccggctaccactgcggctactgtgacagcaaggagggcaaggccagctgtggcatgtgggcccacagcatgacagtgcaggactaccaggacctgattgaccggggctggaggagaagtggcaagtatgtgtacaagcctgtgatgaaccagacctgctgcccccagtacaccatccgctgccggcccctgcagttccagcccagcaagagccacaagaaggtgctgaagaagatgctgaagttcctggccaagggggaggtgcccaagggcagctgtgaagatgagcccatggacagcaccatggatgatgctgtggccggggactttgccctgatcaacaagctggacatccagtgtgacctgaagaccctgagtgatgacatcaaggagagcctggagagcgagggcaagaacagcaagaaggaggagccccaggagctgctgcagagccaggactttgtgggggagaagctgggcagcggggagcccagccacagcgtgaaggtgcacacagtgcccaagccaggaaaaggagctgacctgagcaagccaccctgcaggaaggccaaggagatcaggaaggagaggaagaggctgaagctgatgcagcagaacccagctggggagctggagggcttccaggcccagggccacccccccagcctcttcccccccaaggccaagagcaaccagcccaagagcctggaggacctgatctttgagagcctgcctgaaaatgccagccacaagctggaggtgcggctggtgcctgtgtcctttgaagatcctgagttcaagagcagcttcagccagagcttcagcctgtatgtgaagtaccaggtggccatccaccaggaccccccagatgaatgtgggaagacagagttcacccgcttcctgtgcagcagccccctggaggccgagaccccacccaacggccctgactgtggctacggcagcttccaccagcagtactggctggatggcaagatcatcgctgtgggcgtgattgacatcctgcccaactgtgtgtcctctgtgtacctgtactatgaccctgactacagcttcctgagcctgggcgtgtacagcgccctgcgggagatcgccttcacccggcagctgcacgagaagaccagccagctgagctactactacatgggcttctacatccacagctgccccaagatgaagtacaagggccagtaccggcccagcgacctgctgtgcccagagacctacgtgtgggtgcccatcgagcagtgcctgcccagcctggagaacagcaagtactgccgcttcaaccaggaccctgaggccgtggatgaagatagaagcacagagccagaccggctgcaggtgttccacaagagggccatcatgccctatggagtgtacaagaagcagcagaaggaccccagcgaggaggccgctgtgctgcagtatgccagcctggtgggccagaagtgcagcgagaggatgctgctcttcaggaactag

SEQ ID NO: 22394 - DNA, 3963 bp, Artificial Sequence
  Description of Artificial Sequence: Synthetic coding sequence
atgcaggatgacagcattgaggccagcaccagcatcagccagctgctgcgggagagctacctggccgagaccaggcaccggggcaacaatgaaagaagcagagctgagcccagcagcaacccctgccacttcggcagccccagcggggctgctgagggcggcggcggccaggatgacctgcctgacctgagcgccttcctgagccaggaggagctggatgaatctgtgaacctggcccggctggccatcaactatgaccccctggagaaggcagatgagacccaggccaggaagaggctgagcccagaccagatgaagcacagccccaacctgagctttgagcccaacttctgccaggacaaccccaggagccccaccagcagcaaggagagcccccaggaggccaagaggccccagtactgcagcgagacccagagcaagaaggtgttcctgaacaaggctgctgacttcatcgaggagctgagcagcctcttcaagagccacagcagcaagaggatccggccccgggcctgcaagaaccacaagagcaagctggagagccagaacaaggtgatgcaggagaacagcagcagcttcagtgacctgtctgaaagaagagagaggagctctgtgcccatccccatcccagctgacacccgggacaatgaggtgaaccacgccctggagcagcaggaggccaagagaagagaggccgagcaggccgccagcgaggccgccggcggggacaccaccccaggcagcagccccagcagcctgtactatgaggagcccctgggccagcccccacgcttcacccagaagctgcggagccgggaggtgcctgagggcaccagggtgcagctggactgcatcgtggtgggcatccccccaccccaggtgcgctggtactgtgagggcaaggagctggagaacagcccagacatccacatcgtgcaggccggcaacctgcacagcctgaccatcgccgaggcctttgaggaggacaccggccgctacagctgctttgccagcaacatctatggaacagacagcaccagcgctgagatctacatcgagggcgtgagcagcagtgacagcgagggggaccccaacaaggaggagatgaaccgcatccagaagcccaatgaggtgagcagcccccccaccaccagcgctgtgattcctcctgctgtgccccaggcccagcacctggtggcccagccccgggtggccaccatccagcagtgccagagccccaccaactacctgcagggcctggatggcaagcccatcatcgccgcccctgtgttcaccaagatgctgcagaacctgagcgccagcgagggccagctggtggtgtttgaatgtcgggtgaagggggcccccagccccaaggtggagtggtaccgggagggcaccctgattgaggacagcccagacttccgcatcctgcagaagaggcctgtgtgcatggagcacatcgaggagatctgcaccctggtgattgctgaggtgtttgctgaggacagcggctgcttcacctgcacagccagcaacaagtatggaacagtgagcagcatcgcccagctgcacgtgagaggaaatgaagacctgagcaacaacggcagcctgcacagcgccaacagcaccaccaacctggccgccatcgagccccagcccagccccccccacagcgagcccccatctgtggagcagccccccaagcccaagctggagggcgtgctggtgaaccacaatgagcccaggagcagcagccgcatcggcctgcgggtgcacttcaacctgcctgaagatgacaagggcagcgaggccagcagcgaggccggcgtggtgaccacccggcagaccaggccagacagcttccaggagcgcttcaacggccaggccaccaagaccccagagcccagcagccctgtgaaggagcccccacctgtgctggccaagcccaagctggacagcacccagctgcagcagctgcacaaccaggtgctgctggagcagcaccagctgcagaaccccccacccagcagccccaaggagttccccttctccatgacagtgctgaacagcaatgcccccccagctgtgaccaccagcagcaagcaggtgaaggcccccagcagccagaccttcagcctggcccggcccaagtacttcttccccagcaccaacaccacagctgccaccgtggcccccagcagcagccctgtgttcaccctgagcagcaccccccagaccatccagaggacagtgtccaaggagagcctgctggtgagccaccccagcgtgcagaccaagagccctgggggcctgagcatccagaatgagcccctgcccccaggccccacagagcccaccccaccacccttcaccttcagcatccccagcggcaaccagttccagccccgctgtgtgagccccatccctgtgagccccaccagccgcatccagaaccctgtggccttcctgagctctgtgctgcccagcctgcctgccatcccccccaccaatgccatgggcctgcccaggtctgcccccagcatgcccagccagggcctggccaagaagaacaccaagagcccccagcctgtgaatgatgacaacatccgggagaccaagaatgctgtgatccgggacctgggcaagaagatcaccttcagtgatgtgcggcccaaccagcaggagtacaagatcagcagctttgagcagaggctgatgaatgaaattgagttccggctggagaggacccctgtggatgaaagtgatgatgagatccagcatgatgagatccccactggaaaatgtattgcccccatctttgacaagaggctgaagcacttccgggtgacagagggcagccctgtgaccttcacctgcaagatcgtgggcatccctgtgcccaaggtgtactggttcaaggatggcaagcagatcagcaagagaaatgagcactgcaagatgagaagagaaggagatggcacctgcagcctgcacatcgagagcaccaccagtgatgatgatggcaactacaccatcatggccgccaacccccagggccgcatcagctgcagcggccacctgatggtgcagagcctgcccatccgcagccggctgaccagcgctggccagagccaccggggccgcagccgggtgcaggagcgggacaaggagcccctgcaggagcgcttcttccggccccacttcctgcaggcccctggggacatggtggcccacgagggccgcctgtgccgcctggactgcaaggtgtctggcctgcccccacctgagctgacctggctgctgaatggccagcctgtgctgcctgatgccagccacaagatgctggtgcgggagaccggggtgcacagcctgctgattgaccccctgacccagagagatgctggcacctacaagtgcatcgccaccaacaagacaggccagaacagcttcagcctggagctgtctgtggtggccaaggaggtgaagaaggcccctgtgatcctggagaagctgcagaactgtggggtgcctgagggccaccctgtgcggctggagtgcagggtcatcggcatgcctcctcctgtgttctactggaagaaggacaatgagaccatcccctgcacccgggagcgcatctccatgcaccaggacaccaccggctacgcctgcctgctgatccagcctgccaagaagagtgatgctggctggtacaccctgagcgccaagaatgaggccggcatcgtgtcctgcacagcccggctggacatctatgcccagtggcaccaccagatccccccacccatgtctgtgcggcccagcggcagccgctatggcagcctgaccagcaagggcctggacatcttcagcgccttcagctccatggagagcaccatggtgtacagctgcagcagccgctctgtggtggagagtgatgagctgtag

SEQ ID NO: 22395 - DNA, 2292 bp, Artificial Sequence
  Description of Artificial Sequence: Synthetic coding sequence
atgcaggacctgggggacaagctgaggatgattgtgatgggccaccggcgggtgcacatcagccggcagctggaggtggagcctgaggagcctgaggccgagaacaagcacaagcccaggaggaagagcaagaggggcaagaaggaggctgaagatgagctgagcgcccggcaccctgctgagctggccatggagcccaccccagagctgcctgctgaggtgctgatggtggaggtggagaatgtggtgcatgaggacttccaggtgacagaggaggtgaaggccctgacagctgagatcgtgaagaccatccgggacatcatcgccctgaaccccctgtaccgggagagcgtgctgcagatgatgcaggccggccagagggtggtggacaaccccatctacctgagtgacatgggcgccgccctgactggagctgagagccatgagctgcaggatgtgctggaggagaccaacatccccaagaggctgtacaaggccctgagcctgctgaagaaggagtttgagctgagcaagctgcagcagaggctgggccgggaggtggaggagaagatcaagcagacccacaggaagtacctgctgcaggagcagctgaagatcatcaagaaggagctgggcctggagaaggatgacaaggatgccatcgaggagaagttccgggagcggctgaaggagctggtggtgcccaagcacgtgatggatgtggtggatgaggagctgagcaagctgggcctgctggacaaccacagcagcgagttcaacgtgaccaggaactacctggactggctgaccagcatcccctggggcaagtacagcaatgaaaacctggacctggcccgggcccaggccgtgctggaggaggaccactacggcatggaggatgtgaagaagaggatcctggagttcatcgctgtgtcccagctgcggggcagcacccagggcaagatcctgtgcttctacggccccccaggagtgggcaagaccagcatcgcccggagcatcgcccgggccctgaaccgggagtacttccgcttctctgtgggcggcatgacagatgtggccgagatcaagggccacaggaggacctacgtgggcgccatgcctgggaagatcatccagtgcctgaagaagaccaagacagagaaccccctcatcctgattgatgaggtggacaagattggccggggctaccagggcgaccccagcagcgccctgctggagctgctggaccctgagcagaatgccaacttcctggaccactacctggatgtgcctgtggacctgagcaaggtgctcttcatctgcacagccaacgtgacagacaccatccctgagcccctgcgggacaggatggagatgatcaacgtgtctggctacgtggcccaggagaagctggccatcgccgagcgctacctggtgccccaggcccgggccctgtgtggcctggatgagagcaaggccaagctgagcagtgatgtgctgaccctgctgatcaagcagtactgccgggagagcggcgtgaggaacctgcagaagcaggtggagaaggtgctgaggaagagcgcctacaagatcgtgtctggagaggccgagagcgtggaggtgaccccagagaacctgcaggactttgtgggcaagcctgtgttcaccgtggagaggatgtatgatgtgaccccacctggggtggtgatgggcctggcctggacagccatgggcggcagcaccctgtttgtggagaccagcctgcggcggccccaggacaaggatgccaagggggacaaggatggcagcctggaggtgacaggccagctgggggaggtgatgaaggagagcgcccgcatcgcctacacctttgcccgggccttcctgatgcagcacgccccagccaatgactacctggtgaccagccacatccacctgcacgtgcctgagggcgccacccccaaggatggccccagcgctggctgcaccatcgtgacagccctgctgagcctggccatgggccggcctgtgcggcagaacctggccatgaccggggaggtgtccctgaccgggaagatcctgcctgtgggcggcatcaaggagaagaccatcgccgccaagagagctggggtgacctgcatcgtgctgcctgctgagaacaagaaggacttctatgacctggccgccttcatcacagagggcctggaggtgcactttgtggagcactaccgggagatctttgatattgccttcccagatgagcaggccgaggccctggccgtggagaggtag

SEQ ID NO: 22396 - DNA, 558 bp, Artificial Sequence
  Description of Artificial Sequence: Synthetic coding sequence
atgaacaacaaccagatcgtggccaaggacctgcaggatgagaagatcctgtacccagagttcaacaagctgaaggagaggaaccgggagctgaagaccctgctgagcattggaggctggaactttggcaccagccgcttcaccaccatgctgagcacctttgccaaccgggagaagttcatcgccagcgtcatcagcctgctgcggacccatgactttgatggcctggacctcttcttcctgtacccaggcctgcggggcagccccatgcatgaccgctggaccttcctgttcctgattgaggagctgctgtttgccttcaggaaggaggccctgctgaccatgaggccccggctgctgctgtctgctgctgtgtctggagtgccccacatcgtgcagaccagctatgatgtgcgcttcctgggccgctttgtgcccctgagcggggagaggaggagcacaggcctcatcacctccatgagcaggatgcccacccggggcaagagcggcctggccatgaccatgcccagcgcctctgtgaccaggcatggcctgtag

SEQ ID NO: 22397 - DNA, 1269 bp, Artificial Sequence
  Description of Artificial Sequence: Synthetic coding sequence
atgtctgggggcaccccctacatcggcagcaagatcagcctcatcagcaaggccgagatccgctatgagggcatcctgtacaccatcgacacagagaacagcacagtggccctggccaaggtgcgcagctttggaacagaagatcggcccacagaccggcccatccccccaagagatgaggtgtttgagtacatcatcttccggggcagtgacatcaaggacctgactgtgtgtgagccccccaagccccagtgcagcctgccccaggaccctgccatcgtgcagagcagcctgggcagcagcaccagcagcttccagagcatgggcagctatggccccttcggccgcatgcccacctacagccagttcagccccagcagcctggtgggccagcagtttggagctgtgggcgtgggccgcagcagcccccagctggaccccctgaggaagagccccaccatggagcaggccgtgcagacagccagcgcccacctgcctgccccagctgctgtgggcagaagaagccctgtgtccacccggcccctgcccagcgccagccagaaggccggggagaaccaggagcaccggcgggcagaggtgcacaaggtgtccaggccagaaaatgagcagctgagaaatgacaacaagaggcaggtggcccctggggcccccagcgccccccggcggggccggggcggccaccggggcggccggggccgcttcggcatcagaagagatggccccatgaagtttgagaaggactttgattttgaaagtgccaatgcccagttcaacaaggaggagattgaccgggagttccacaacaagctgaagctgaaggaggacaagctggagaagcaggagaagcctgtgaatggagaggacaagggggacagcggcgtggacacccagaacagcgagggcaatgctgatgaggaggaccccctgggccccaactgctactatgacaagaccaagagcttctttgacaacatcagctgtgatgacaaccgggagcggcggcccacctgggccgaggagcggcggctgaatgctgagaccttcggcatccccctgcggcccaacagaggccggggcggctaccggggccggggcggcctgggcttccggggcggccggggccggggcggcggccggggcggcaccttcaccgccccccggggcttccggggcggcttccggggcggccggggcggccgggagtttgctgactttgagtacaggaagaccacagccttcggcccctag

SEQ ID NO: 22398 - DNA, 1266 bp, Artificial Sequence; identical to SEQ ID NO: 19415
  Description of Artificial Sequence: Synthetic coding sequence

SEQ ID NO: 22399 - DNA, 756 bp, Artificial Sequence
  Description of Artificial Sequence: Synthetic coding sequence
atggattctgagctgatgcacagcatcgtgggcagctaccacaagcccccagagcgggtgtttgtgcccagcttcacccagaatgagcccagccagaactgccacccagccaacctggaggtgaccagccccaagatcctgcacagccccaacagccaggccctgatcctggccctgaagaccctgcaggagaagatccaccggctggagctggagaggacccaggccgaggacaacctgaacatcctgagccgggaggccgcccagtacaagaaggccctggagaatgagaccaatgaaagaaacctggcccaccaggagctgatcaagcagaagaaggacatcagcatccagctgagcagcgcccagagccgctgcaccctgctggagaagcagctggagtacaccaagaggatggtgctgaatgtggagcgggagaagaacatgatcctggagcagcaggcccagctgcagcgggagaaggagcaggaccagatgaagctgtatgccaagctggagaagctggatgtgctggagaaggagtgcttccggctgaccaccacccagaagacagctgaggacaagatcaagcacctggaggagaagctgaaggaggaggagcaccagaggaagctgttccaggacaaggccagcgagctgcagacaggcctggagatcagcaagatcatcatgagctctgtgagcaacctgaagcacagcaaggagaagaagaagagcagcaaggtgtgcatctag

SEQ ID NO: 22400 - DNA, 1980 bp, Artificial Sequence
  Description of Artificial Sequence: Synthetic coding sequence
atggacagccagggccgggtgtgggcccaggagatgctgctgcgggtgtccccagaccacgtgaccctgctggaccctgccagcaaggaggagctggagagctaccccctgggcgccatcgtgcgctgtgatgctgtgatgcctcctggccgcagccgcagcctgctgctgctggtgtgccaggagcctgagcgggcccagccagatgtgcacttcttccagggcctgcggctgggcgctgagctgatccgggaggacatccagggcgccctgcacaactaccgcagcggccgcggggagaggagagctgctgccctgcgggccacccaggaggagctgcagagggacaggagccctgctgctgagaccccacccctgcagaggcggcccagcgtgcgggccgtcatcagcacagtggagagaggagctggccggggccggccccaggccaagcccatccctgaggccgaggaggcccagaggcctgagcctgtgggcaccagcagcaatgctgacagcgccagcccagacctgggcccccggggccctgacctggccgtgctgcaggccgagcgggaggtggacatcctgaaccacgtgtttgatgatgtggagagctttgtgtcccggctgcagaagtctgctgaggccgcccgggtgctggagcaccgggagcggggccgccgcagcagaagaagagctgctggggagggcctgctgaccctgcgggccaagccacccagcgaggccgagtacacagatgtgctgcagaagatcaagtatgccttcagcctgctggcccggctgcggggcaacattgctgaccccagcagccctgagctgctgcacttcctgtttggccccctgcagatgattgtgaacaccagcggcggccctgagtttgccagctctgtgcggcggccccacctgaccagtgatgctgtggccctgctgcgggacaacgtgaccccccgggagaatgagctgtggaccagcctgggggacagctggacccggcccggcctggagctgagccctgaggagggccccccctacagacctgagttcttcagcggctgggagccccctgtgacagacccccagagccgggcctgggaggaccctgtggagaagcagctgcagcacgagaggagaagacggcagcagagcgccccccaggtggccgtgaatggccaccgggacctggagcctgagagcgagccccagctggagagcgagacagctgggaagtgggtgctgtgcaactatgacttccaggccaggaacagcagcgagctgtctgtgaagcagagagatgtgctggaggtgctggatgacagcaggaagtggtggaaggtgcgggaccctgctggccaggagggctacgtgccctacaacatcctgaccccctacccaggcccccggctgcaccacagccagagccctgcccggagcctgaacagcaccccacctcctcctccagccccagccccagcccctcctccagccctggcccggccccgctgggaccggccccgctgggacagctgtgacagcctgaatggcctggaccccagcgagaaggagaagttcagccagatgctgattgtgaatgaggagctgcaggcccggctggcccagggccgcagcggccccagcagagctgtgcccggcccccgggcccctgagccccagctgagccctggcagtgatgccagcgaggtgcgggcctggctgcaggccaagggcttcagcagcggcaccgtggatgccctgggcgtgctgaccggggcccagctgttcagcctgcagaaggaggagctgcgggctgtgtccccagaggagggcgcccgggtgtacagccaggtgacagtgcagaggagcctgctggaggacaaggagaaggtgtctgagctggaggccgtgatggagaagcagaagaagaaggtggagggggaggtggagatggaggtgatctag

SEQ ID NO: 22401 - DNA, 3702 bp, Artificial Sequence
  Description of Artificial Sequence: Synthetic coding sequence
atgaacaccaagaagaggggcagccctgcccggacccacagcatgatgagcctgtctgtgcggccccagaggcggctgctgagcgcccgggtgaacagaagccagagctttgctggggtgctgggcagccatgagcggggccccaggagcttccctgtgttcagccccccaggcccccccaggaagcccccagccctgagccgggtgtccaggatgttttctgtggcccaccctgctgccaaggtgccccagcctgagcggctggacctggtgtacacagccctgaagaggggcctgacagcctacctggaggtgcaccagcaggagcaggagaagctgcagggccagatccgggagagcaagaggaacagccggctgggcttcctgtatgacctggacaagcaggtgaagagcattgagcgcttcctgcggcggctggagttccacgccagcaagattgatgagctgtatgaggcctactgtgtgcagaggcggctgagagatggagcctacaacatggtgcgggcctacaccaccggcagccctggcagccgggaggcccgggacagcctggccgaggccacccggggccaccgggagtacacagagagcatgtgcctgctggagagcgagctggaggcccagctgggggagttccacctgaggatgaagggcctggccggctttgcccggctgtgtgtgggggaccagtatgagatctgcatgaagtatggccggcagcgctggaagctgcggggcagaattgagggcagcggcaagcaggtgtgggacagcgaggagaccatcttcctgcccctgctgacagagttcctgagcatcaaggtgacagagctgaagggcctggccaaccacgtggtggtgggctctgtgtcctgtgagaccaaggacctgtttgctgccctgccccaggtggtggccgtggacatcaatgacctgggcaccatcaagctgagcctggaggtgacctggagcccctttgacaaggatgaccagcccagcgctgccagctctgtgaacaaggccagcacagtgaccaagcgcttcagcacctacagccagagccccccagacacccccagcctgcgggagcaggccttctacaacatgctgcggcggcaggaggagctggagaatggaacagcctggagcctgagcagcgagagcagtgatgacagcagcagcccccagctgtctggaacagcccggcacagccctgccccccggcccctggtgcagcagcctgagcccctgcccatccaggtggccttcagaagacctgagacccccagcagcggccccctggatgaggagggcgctgtggcccctgtgctggccaatggacatgccccctacagcaggaccctgagccacatcagcgaggcctctgtggatgctgccctggccgaggcctctgtggaggccgtgggccctgagagcctggcctggggccccagcccccccacccacccagcccccacccatggagagcaccccagccctgtgcccccagccctggaccccggccacagcgccaccagcagcaccctgggcaccaccggctctgtgcccaccagcacagatcctgcccccagcgcccacctggacagcgtgcacaagagcacagacagcggccccagcgagctgcccggccccacccacaccaccaccggcagcacctacagcgccatcaccaccacccacagcgcccccagccccctgacccacaccaccaccggcagcacccacaagcccatcatcagcaccctgaccaccaccggccccaccctgaacatcatcggccctgtgcagaccaccaccagccccacccacaccatgcccagccccacccacaccacagccagccccacccacaccagcaccagccccacccacacccccaccagccccacccacaagacctccatgagcccccccaccaccaccagccccacccccagcggcatgggcctggtgcagacagccaccagccccacccaccccaccaccagccccacccaccccaccaccagccccatcctgatcaacgtgagccccagcaccagcctggagctggccaccctgagcagccccagcaagcacagcgaccccaccctgcctggaacagacagcctgccctgcagcccccctgtgagcaacagctacacccaggccgaccccatggcccccaggaccccccaccccagccctgcccacagcagcaggaagcccctgaccagccctgccccagaccccagcgagagcacagtgcagagcctgagccccacccccagcccccccaccccagccccccagcacagcgacctgtgcctggccatggctgtgcagacccctgtgcccacagctgctgggggcagcggggacaggagcctggaggaggccctgggcgccctgatggccgccctggatgactaccggggccagtttcctgagctgcagggcctggagcaggaggtgacccggctggagagcctgctgatgcagaggcagggcctgaccaggagccgggccagcagcctgagcatcaccgtggagcacgccctggagagcttctccttcctgaatgaagatgaagatgaagataatgatgtgcctggggaccggccccccagcagccctgaggccggggctgaagattccattgacagccccagcgcccggcccctgagcacaggctgcccagccctggatgctgccctggtgcgccacctgtaccactgcagccggctgctgctgaagctgggcaccttcggccccctgcgctgccaggaggcctgggccctggagcggctgctgcgggaggcccgggtgctggaggccgtgtgtgagttcagccgccgctgggagatcccagccagcagcgcccaggaggtggtgcagttcagcgccagcaggcctggcttcctgaccttctgggaccagtgcacagagcggctgagctgcttcctgtgccctgtggagcgggtgctgctgaccttctgcaaccagtacggggcccggctgagcctgcggcagcccggcctggccgaggccgtgtgtgtgaagttcctggaggatgccctgggccagaagctgccccggcggccccagcccggccctggagagcagctgactgtgttccagttctggagctttgtggagaccctggacagccccaccatggaggcctacgtgacagaaacagctgaggaggtgctgctggtgaggaacctgaacagtgatgaccaggccgtggtgctgaaggccctgcggctggcccctgagggccgcctgcggagagatggcctgcgggccctgagcagcctgctggtgcacggcaacaacaaggtgatggctgctgtgtccacccagctgcggagcctgagcctgggccccaccttccgggagcgggccctgctgtgcttcctggaccagctggaggatgaagatgtgcagaccagggtggccggctgcctggccctgggctgcatcaaggcccctgagggcatcgagcccctggtgtacctgtgccagacagacacagaagctgtgcgggaggccgcccggcagagcctgcagcagtgtggggaggagggccagagcgcccaccggcggctggaggagagcctggatgccctgccccgcatctttggacctggctccatggccagcacagccttctag

SEQ ID NO: 22402 - DNA, 1428 bp, Artificial Sequence
  Description of Artificial Sequence: Synthetic coding sequence
atggaccagatggtgcagcaccctgctgccaagatgattgtgatggccagccacatgcaggagcaggaggtgggagatggcaccaactttgtgctggtgtttgctggggccctgctggagctggccgaggagctgctgcgcatcggcctgtctgtgtctgaggtgattgagggctatgaaattgcctgcaggaaggcccacgagatcctgcccaacctggtgtgctgcagcgccaagaacctgcgggacattgatgaggtgagcagcctgctgcggaccagcatcatgagcaagcagtatggaaatgaggtgttcctggccaagctgattgcccaggcctgtgtgtccatcttcccagattctggccacttcaacgtggacaacatccgggtgtgcaagatcctgggcagcggcatcagcagcagctctgtgctgcacggcatggtgttcaagaaggagacagaaggagatgtgacctctgtgaaggatgccaagattgctgtgtacagctgcccctttgatggcatgatcacagagaccaagggcaccgtgctgatcaagacagctgaggagctgatgaacttcagcaaaggagaggagaacctgatggatgcccaggtgaaggccatcgctgacacaggagccaacgtggtggtgactggaggcaaggtggccgacatggccctgcactacgccaacaagtacaacatcatgctggtgcggctgaacagcaagtgggacctgcggcggctgtgcaagacagtgggcgccacagccctgccccggctgaccccacctgtgctggaggagatgggccactgtgacagcgtgtacctgtctgaggtgggggacacccaggtggtggtgttcaagcatgagaaggaggatggagccatcagcaccatcgtgctgcggggcagcacagacaacctgatggatgacatcgagagagctgtggatgatggagtgaacaccttcaaggtgctgacccgggacaagaggctggtgcctgggggcggggccacagaaattgagctggccaagcagatcaccagctatggagagacctgccccggcctggagcagtatgccatcaagaagtttgctgaggcctttgaggccatcccccgggccctggctgaaaattctggagtgaaggccaatgaggtgatcagcaagctgtatgctgtgcaccaggagggcaacaagaatgtgggcctggacattgaagctgaggtgcctgctgtgaaggacatgctggaggccggcatcctggacacctacctgggcaagtactgggccatcaagctggccaccaatgctgctgtgacagtgctgcgggtggaccagatcatcatggccaagccagctgggggccccaagccacccagcggcaagaaggactgggatgatgaccagaatgactag

SEQ ID NO: 22403 - DNA, 1626 bp, Artificial Sequence
  Description of Artificial Sequence: Synthetic coding sequence
atgagggccctgctgcacaagccagagatgatcaagcagatcctgcctgagcacagcgtgctgcagaacatcaactttgtggaggccttccaggatgagctgctggtgacagaggtgtatgacctgccccagaggcccaatgatgtgcagctgttctacggctccatgtgcaagatcatcctgagcgtcatcggggagttccgggactgcatcagcagccgggagttcctgcagcccagcagcaaggccagcctggagagcaccagtgacctgggcgccagcggcaagcatggaggaaatgtgtccctggatgtgctgcctgtgaagggcccccagggcagccccctgctgagccgggccgcccggccccccctggaccagctggccagcgaggagccctggacagtgctgcctgagcacctgatcctggtggcccccagcccctgtgacatggccaagacaggccgcttccagatcgtgaacaacagcgtgcggctgctgcgctttgagctgtgctggccagcccactgcctgactgtgaccccccagcacggctgtgtggcccctgagagcaagctgcagatcctggtgagccccaacagcagcctgagcaccaagcagagcatgttcccctggagcggcctcatctacatccactgtgatgatggccagaagaagatcgtgaaggtgcagatccgggaggacctgacccaggtggagctgctgacccggctgaccagcaagcccttcggcatcctgagccctgtgtctgagcccagcgtgagccacctggtgaagcccatgaccaagccacccagcaccaaggtggagatccggaacaagagcatcaccttccccaccacagagcccggggagaccagcgagagctgcctggagctggagaaccacggcaccacagatgtgaagtggcacctgagcagcctggccccaccctacgtgaagggcgtggatgagagcggagatgtgttccgggccacctatgctgccttccgctgcagccccatcagcggcctgctggagagccacggcatccagaaggtgtccatcaccttcctgccccggggccgcggggactatgcccagttctgggatgtggagtgccaccccctgaaggagccccacatgaagcacaccctgcgcttccagctgagcggccagagcattgaagcagaaaatgaaccagaaaatgcctgcctgagcacagacagcctcatcaagattgaccacctggtgaagccccggcggcaggccgtgtctgaggccagcgcccgcatccctgagcagctggatgtgacagcccggggcgtgtatgccccagaagatgtgtaccgcttccggcccacctctgtgggggagagcaggaccctgaaggtgaacctgaggaacaacagcttcatcacccacagcctgaagttcctgagcccccgggagcccttctacgtgaagcacagcaagtacagcctgcgggcccagcactacatcaacatgcctgtgcagttcaagcccaagtctgctgggaagtttgaggccctgctggtgatccagacagatgagggcaagagcatcgccatccgcctcatcggggaggccctgggcaagaactag

SEQ ID NO: 22404 - DNA, 1737 bp, Artificial Sequence
  Description of Artificial Sequence: Synthetic coding sequence
atgagcagcaagggcagcagcacagatggccgcacagacctggccaacggcagcctgagcagcagccctgaggagatgtctggagctgaggagggccgggagaccagcagcggcatcgaggtggaggccagtgacctgagcctgagcctgactggagatgatggcggccccaacagaacctccatggaggacaccggccactacagcatcaatgatgaaaatagagtgcatgacagaagtgaggaggaggaggaggaggaggaggaggaggaggaggagcagcccaggagaagagtgcagaggaagagggccaacagagaccaggacagcagtgatgatgagcgggccctggaggactgggtgtcctctgagaccagcgccctgccccggccccgctggcaggccctgcctgccctgcgggagcgggagctgggcagcagcgccaggtttgtgtatgaggcctgtggggcccgggtgtttgtgcagcgcttccggctgcagcacggcctggagggccacacaggctgtgtgaacaccctgcacttcaaccagaggggcacctggctggccagcggcagtgatgacctgaaggtggtggtgtgggactgggtgcggcggcagcctgtgctggactttgagagcggccacaagagcaatgtgttccaggccaagttcctgcccaacagcggggacagcaccctggccatgtgtgccagagatggccaggtgcgggtggccgagctgagcgccacccagtgctgcaagaacaccaagagggtggcccagcacaagggggccagccacaagctggccctggagccagacagcccctgcaccttcctgtctgctggagaagatgctgtggtgttcaccatcgacctgcggcaggacaggcctgccagcaagctggtggtgaccaaggagaaggagaagaaggtgggcctgtacaccatctacgtgaacccagccaacacccaccagtttgctgtgggcggccgggaccagtttgtgcgcatctatgaccagaggaagattgatgaaaatgaaaataatggagtgctgaagaagttctgcccccaccacctggtgaacagcgagagcaaggccaacatcacctgcctggtgtacagccatgatggaacagagctgctggccagctacaatgatgaggacatctacctgttcaacagcagccacagtgatggagcccagtatgtgaagcgctacaagggccacagaaataatgccaccgtgaagggcgtgaacttctacggccccaagtcagaatttgtggtgtctggcagtgactgtggccacatcttcctgtgggagaagagcagctgccagatcatccagttcatggagggggacaagggcggcgtggtgaactgcctggagccccacccccacctgcctgtgctggccaccagcggcctggaccatgatgtgaagatctgggcccccacagctgaggccagcacagagctgaccggcctgaaggatgtgatcaagaagaacaagcgggagagagatgaggacagcctgcaccagacagacctgtttgacagccacatgctgtggttcctgatgcaccacctgcggcagaggaggcaccaccggcgctggagggagcccggggtgggcgccacagatgctgacagtgatgagagccccagcagcagtgacaccagtgatgaggaggagggccctgacagagtgcagtgcatgcccagctag

SEQ ID NO: 22405 - DNA, 426 bp, Artificial Sequence
  Description of Artificial Sequence: Synthetic coding sequence
atgggcggcaagcccaggcacagcctgtacttcatcggctaccaggatgacttcctgctgtacctggacccccactactgccagcccaccgtggatgtgtcccaggccgacttccccctggagagcttccactgcaccagccccaggaagatggcctttgccaagatggaccccagctgcaccgtgggcttctacgccggggacaggaaggagtttgagaccctgtgcagcgagctgaccagggtgctgagcagcagcagcgccacagagcgctaccccatgttcaccctggccgagggccacgcccaggaccacagcctggatgacctgtgcagccagctggcccagcccaccctgcggctgcccaggacaggccgcctgctgcgggccaagaggcccagcagcgaggactttgtgttcctgtag

SEQ ID NO: 22406 - DNA, 570 bp, Artificial Sequence
  Description of Artificial Sequence: Synthetic coding sequence
atggtgctgctgcacgtgaagagaggagatgagagccagttcctgctgcaggcccctggcagcacagagctggaggagctgactgtgcaggtggcccgggtgtacaacggccgcctgaaggtgcagaggctgtgcagcgccccaaatgagaagatgaagcaggtgctgaagaagaccatcgaggaggccaaggccatcatcagcaagaagcaggtggaggccggcgtgtgtgtgaccatggagatggtgaaggatgccctggaccagctgcggggagctgtgatgattgtgtaccccatgggcctgcccccctatgaccccatccgcatggagtttgagaacaaggaggacctgagcggcacccaggccggcctgaatgtcatcaaggaggccgaggcccagctgtggtgggccgccaaggagctgcggaggaccaagaagctgagtgactatgtgggcaagaatgagaagaccaagatcatcgccaagatccagcaggtgtccaccttctgcttcaacgtgtctgtggtgtttgtgatcagcctgcagacagacaagaatgtgcagtag

SEQ ID NO: 22407 - DNA, 2031 bp, Artificial Sequence
  Description of Artificial Sequence: Synthetic coding sequence
atggccgccatccagcacggccacgaggccgtggtgcggctgctgatggagtggggcgctgaccccaaccacgccgccaggacagtgggctggagccccctgatgctggccgccctgaccggccgcctgggcgtggcccagcagctggtggagaagggggccaacccagaccacctgtctgtgctggagaagacagcctttgaggtggccctggactgcaagcaccgggacctggtggactacctggaccccctgaccaccgtgcggcccaagacagatgaggagaagagaagaccagacatcttccacgccctgaagatgggcaacttccagctggtgaaggagattgctgatgaggaccccagccacgtgaacctggtgaatggagatggagccacccccctgatgctggccgctgtgacaggccagctggccctggtgcagctgctggtggagagacatgctgatgtggacaagcaggacagcgtgcacggctggacagccctgatgcaggccacctaccacggcaacaaggagatcgtgaagtacctgctgaaccagggcgcagatgtgaccctgcgggccaagaatggctacacagcctttgacctggtgatgctgctgaatgaccctgacacagagctggtgcggctgctggcctctgtgtgcatgcaggtgaacaaggacaagggccggcccagccaccagccccccctgccccacagcaaggtgcggcagccctggagcatccctgtgctgcctgatgacaagggcggcctgaagtcctggtggaacaggatgagcaaccgcttcaggaagctgaagctgatgcagaccctgccccggggcctgagcagcaaccagcccctgcccttcagtgatgagcctgagcccgccctggacagcaccatgagagctgccccccaggacaagaccagccgcagcgccctgcctgatgctgcccctgtgaccaaggacaatggacctggcagcaccagaggagagaaggaggacaccctgctgaccaccatgctgagaaatggagcccccctgacccggctgcccagcgacaagctgaaggctgtgatcccccccttcctgccccccagcagctttgagctgtggagcagtgacaggagcaggaccaggcacaacgggaaggctgaccccatgaagacagccctgccccagagggccagccggggccaccctgtgggcggcggcggcacagacaccacccctgtgcggcctgtgaagttccccagcctgcccaggagccctgccagcagcgccaacagcggcaacttcaaccacagcccccacagcagcggcggcagcagtggagtgggcgtgagccgccacggcggggagctgctgaacagaagtggcggcagcattgacaacgtgctgagccagattgctgcccagaggaagaaggctgctggcctgctggagcagaagcccagccacaggagcagccctgtgggccctgcccctggcagcagccccagcgagctgcctgccagccctgctgggggcagcgcccctgtgggcaagaagctggagaccagcaagaggcctccttctggcaccagcaccaccagcaagagcaccagccccaccctgacccccagccccagccccaagggccacacagctgagagctctgtgagcagcagcagcagccaccggcagagcaagagcagcggcggcagcagcagcggcaccatcacagatgaagatgagctgaccggcatcctgaagaagctgagcctggagaagtaccagcccatctttgaggagcaggaggtggacatggaggccttcctgaccctgacagatggagacctgaaggagctgggcatcaagacagatggcagccggcagcagatcctggccgccatcagcgagctgaatgctgggaagggccgggagcggcagatcctgcaggagaccatccacaacttccacagcagctttgagagcagcgccagcaacacccgggcccctggcaacagcccctgtgcctag

SEQ ID NO: 22408 - DNA, 2319 bp, Artificial Sequence
  Description of Artificial Sequence: Synthetic coding sequence
atgaggcaccagaagagaaatgtgtaccactgcaacaagtgccgcctgcagttcctgtttgccaaggacaagattgagcacaagctgcagcaccacaagaccttcaggaagcccaagcagctggagggcctgaagccaggcaccaaggtgaccatccgggccagccggggccagcccaggacagtgcctgtgagcagcaatgacaccccacccagcgccctgcaggaggccgcccccctgaccagctccatggaccccctgcccgtcttcctgtacccacctgtgcagaggagcatccagaagagagctgtgaggaagatgtctgtgatgggccggcagacctgcctggagtgcagctttgagatcccagacttccccaaccacttccccacctacgtgcactgcagcctgtgccgctacagcacctgctgcagccgggcctatgccaaccacatgatcaacaaccacgtgcccaggaagagccccaagtacctggccctcttcaagaacagcgtgtctggcatcaagctggcctgcaccagctgcacctttgtgacctctgtgggagatgccatggccaagcacctggtgttcaaccccagccacaggagcagcagcatcctgccccggggcctgacctggatcgcccacagccgccacggccagacccgggacagagtgcatgacagaaatgtgaagaacatgtaccccccacccagcttccccaccaacaaggccgccaccgtgaagtctgctggggccaccccagctgagcctgaggagctgctgacccccctggccccagccctgcccagccctgccagcacagccaccccaccacccacccccacccacccccaggccctggccctgccccccctggccacagagggcgctgagtgcctgaatgtggatgaccaggatgagggcagccctgtgacccaggagcctgagctggccagcggcggcggcggcagcggcggcgtgggcaagaaggagcagctgtctgtgaagaagctgcgggtggtgctgtttgccctgtgctgcaacacagagcaggccgctgagcacttcaggaacccccagaggcgcatccgccgctggctgcggcgcttccaggccagccagggcgagaacctggagggcaagtacctgagctttgaagctgaggagaagctggccgagtgggtgctgacccagcgggagcagcagctgcctgtgaatgaggagaccctcttccagaaggccaccaagattggccgcagcctggagggcggcttcaagatctcctatgagtgggccgtgcgcttcatgctgcggcaccacctgaccccccacgcccggcgggctgtggcccacaccctgcccaaggatgtggctgaaaatgccggcctcttcatcgactttgtgcagaggcagatccacaaccaggacctgcccctgtccatgattgtggccattgatgagatcagcctcttcctggacacagaggtgctgagcagtgatgacagaaaagaaaatgccctgcagacagtgggcaccggggagccctggtgtgatgtggtgctggccatcctggctgatggcaccgtgctgcccaccctggtgttctaccggggccagatggaccagcctgccaacatgccagacagcatcctgctggaggccaaggagagcggctacagtgatgatgagatcatggagctgtggagcaccagggtgtggcagaagcacacagcctgccagaggagcaagggcatgctggtgatggactgccacaggacccacctgtctgaggaggtgctggccatgctgagcgccagcagcaccctgcctgctgtggtgcctgctggctgcagcagcaagatccagcccctggatgtgtgcatcaagaggacagtgaagaacttcctgcacaagaagtggaaggagcaggcccgggagatggctgacacagcctgtgacagtgatgtgctgctgcagctggtgctggtgtggctgggggaggtgctgggcgtcatcggggactgcccagagctggtgcagaggagcttcctggtggcctctgtgctgcccggcccagatggcaacatcaacagccccaccagaaatgctgacatgcaggaggagctgattgccagcctggaggagcagctgaagctgagcggggagcacagcgagagcagcaccccccggcccaggagcagccctgaggagaccatcgagcctgagagcctgcaccagctgtttgaaggagagagcgagacagagagcttctacggctttgaggaggccgacctggacctgatggagatctag

SEQ ID NO: 22409 - DNA, 285 bp, Artificial Sequence
  Description of Artificial Sequence: Synthetic coding sequence
atggccatgacagctggcaccaccaccaccttccccatgagcaaccacacccgggagcgggtgacagtggccaagctgaccctggagaacttctacagcaacctgatcctgcagcacgaggagcgggagacccggcagaagaagctggaggtggccatggaggaggagggcctggctgatgaggagaagaagctgcggcgcagccagcacgccaggaaggagacagagttcctgcggctgaagaggacccggctgggcctggatgactttgagagcctgaagtag

SEQ ID NO: 22410 - DNA, 1047 bp, Artificial Sequence; identical to SEQ ID NO: 18886
  Description of Artificial Sequence: Synthetic coding sequence

SEQ ID NO: 22411 - DNA, 888 bp, Artificial Sequence; identical to SEQ ID NO: 18344
  Description of Artificial Sequence: Synthetic coding sequence

SEQ ID NO: 22412 - DNA, 258 bp, Artificial Sequence
  Description of Artificial Sequence: Synthetic coding sequence
atgccctacaatgaagctgagaacaagaggagctaccacctgtgtgacctgtgtgaccgcatcatcattggagaccgggagtgggccgcccacatcaagagcaagagccacctgaaccagctgaagaagagaagaaggctggacagtgatgctgtgaacaccatcgagagccagagcgtgtccccagaccacaacaaggagcccaaggagaagggcagccctggccagaatgaccaggagctgaagtgcagcgtgtag

SEQ ID NO: 22413 - DNA, 396 bp, Artificial Sequence
  Description of Artificial Sequence: Synthetic coding sequence
atggccatgacagctggcaccaccaccaccttccccatgagcaaccacacccgggagcgggtgacagtggccaagctgaccctggagaacttctacagcaacctgatcctgcagcacgaggagcgggagacccggcagaagaagctggaggtggccatggaggaggagggcctggctgatgaggagaagaagctgcggcgcagccagcacgccaggaaggagacagagttcctgcggctgaagaggacccggctgggcctggatgactttgagagcctgaaggtgattggccgcggggcctttggagaggtgcggctggtgcagaagaaggacaccggccacatctatgccatgaagatcctgaggaagagtgacatgctggagaaggagcagtag

SEQ ID NO: 22414 - DNA, 21 bp, Artificial Sequence
  Description of Artificial Sequence: Synthetic coding sequence
atggcccacgagatgatctag

SEQ ID NO: 22415 - DNA, 2199 bp, Artificial Sequence
  Description of Artificial Sequence: Synthetic coding sequence
atgggcttcagagatgaagctgctggctacttccacaaggctgtgaagctgaacccagacttcagtgatgccaaggagaacttctacagagtggccaactggctggtggagcgctggcacttcatcatgctgaatgacaccaagaggaacaccatctacaatgctgccatccagaaggctgtgtgcctgggcagcaagtctgtgctggacattggagctggcaccggcatcctgtccatgtttgccaagaaggccggggcccacagcgtgtatgcctgtgagctgagcaagaccatgtatgagctggcctgtgatgtggtggccgccaacaagatggaggccggcatcaagctgctgcacaccaagagcctggacatcgagatccccaagcacatccctgagcgggtgtccctggtggtgacagaaacagtggatgctggcctgtttggagagggcatcgtggagagcctcatccacgcctgggagcacctgctgctgcagcccaagaccaagggggagagcgccaactgtgagaagtatggcaaggtgatcccagccagcgctgtgatcttcggcatggctgtggagtgtgccgagatcagaagacaccaccgggtgggcatcaaggacattgctggcatccacctgcccaccaacgtgaagttccagagccctgcctacagctctgtggacacagaggagaccatcgagccctacaccacagagaagatgagccgggtgcctgggggctacctggccctgacagagtgctttgagatcatgacagtggacttcaacaacctgcaggagctgaagagcctggccaccaagaagccagacaagattggcatccctgtgatcaaggagggcatcctggatgccatcatggtgtggtttgtgctgcagctggatgatgagcacagcctgagcaccagccccagcgaggagacctgctgggagcaggccgtgtaccctgtgcaggacctggccgactactggatcaagccaggggaccacgtgatgatggaggtgtcctgccaggactgctacctgcgcatccagagcatctctgtgctgggcctggagtgtgagatggatgtggccaagagcttcacccagaacaaggacctgctgagcctgggcaatgaggccgagctgtgcagcgccctggccaacctgcagaccagcaagccagatgctgtggagcagacctgcatcctggagagcacagagatcgccctgctgaacaacatcccctaccacgagggcttcaagatggccatgagcaaggtgctgagcagcctgaccccagagaagctgtaccagaccatggacacccactgccagaatgagatgagcagcggcaccggccagagcaacacagtgcagaacatcctggagcccttctacgtgctggatgtgtctgagggcttctctgtgctgcctgtgattgctggcaccctgggccaggtgaagccctacagctctgtggagaaggaccagcaccgcatcgccctggacctgatcagcgaggccaaccacttccccaaggagaccctggagttctggctgcggcacgtggaggatgaaagtgccatgctgcagaggcccaagagtgacaagctgtggagcatcatcatcctggatgtgattgagcccagcggcctcatccagcaggagatcatggagaaggccgccatcagccgctgcctgctgcagagcggcggcaagatcttcccccagtatgtgctgatgtttggcctgctggtggagagccagaccctgctggaggagaatgctgtgcagggcacagagaggaccctgggcctgaacatcgcccccttcatcaaccagttccaggtgcccatccgggtcttcctggacctgagcagcctgccctgcatccccctgagcaagcctgtggagctgctgcggctggacctgatgaccccctacctgaacaccagcaaccgggaggtgaaggtgtatgtgtgcaagagcggccgcctgacagccatccccttctggtaccacatgtacctggatgaggagatccggctggacaccagcagcgaggccagccactggaagcaggccgctgtggtgctggacaaccccatccaggtggagatgggagaggagctggtgctgagcatccagcaccacaagagcaatgtgtccatcaccgtgaagcagtag

SEQ ID NO: 22416 - DNA, 1554 bp, Artificial Sequence
  Description of Artificial Sequence: Synthetic coding sequence
atgtgcagcctggccagcggggccactggaggccgcggggctgtggagaatgaggaggacctgcctgagctgagtgacagcggagatgaagctgcctgggaggatgaagatgatgctgacctgccccacggcaagcagcagaccccctgcctcttctgcaacagactcttcaccagcgctgaggagaccttcagccactgcaagtctgagcaccagttcaacatcgacagcatggtgcacaagcacggcctggagttctacggctacatcaagctgatcaacttcatccggctgaagaaccccaccgtggagtacatgaacagcatctacaaccctgtgccctgggagaaggaggagtacctgaagcctgtgctggaggatgacctgctgctgcagtttgatgtggaggacctgtatgagcctgtgtctgtgcccttctcctaccccaacggcctgtctgagaacacctctgtggtggagaagctgaagcacatggaggcccgggccctgtctgctgaggccgccctggcccgggcccgggaggacctgcagaagatgaagcagtttgcccaggactttgtgatgcacacagatgtgaggacctgcagcagcagcacctctgtgattgctgacctgcaggaggatgaagatggagtgtacttcagcagctatggccactacggcatccacgaggagatgctgaaggacaagatcagaacagagagctacagagacttcatctaccagaacccccacatcttcaaggacaaggtggtgctggatgtgggctgcggcaccggcatcctgtccatgtttgctgccaaggccggggccaagaaggtgctgggcgtggaccagagcgagatcctgtaccaggccatggacatcatccggctgaacaagctggaggacaccatcaccctcatcaagggcaagattgaggaggtgcacctgcctgtggagaaggtggatgtgatcatcagcgagtggatgggctacttcctgctgtttgagagcatgctggacagcgtgctgtatgccaagaacaagtacctggccaagggcggctctgtgtacccagacatctgcaccatcagcctggtggccgtgtctgatgtgaacaagcatgctgaccgcatcgccttctgggatgatgtgtatggcttcaagatgagctgcatgaagaaggctgtgattcctgaggccgtggtggaggtgctggaccccaagaccctcatcagcgagccctgtggcatcaagcacatcgactgccacaccaccagcatcagtgacctggagttcagcagtgacttcaccctgaagatcaccaggacctccatgtgcacagccatcgccggctactttgacatctactttgagaagaactgccacaacagagtggtgttcagcacaggcccccagagcaccaagacccactggaagcagacagtgttcctgctggagaagcccttctctgtgaaggccggggaggccctgaagggcaaggtgacagtgcacaagaacaagcgggaggtgctgattgtgggcatctag

SEQ ID NO: 22417 - DNA, 1560 bp, Artificial Sequence
  Description of Artificial Sequence: Synthetic coding sequence
atggagcaggagaagtttgacctgcagaagcagcacacagagaacatccaggagctgctggaggacaccaacgtgcggctgaacaagatggagagcgagtacatggcccagacccagagcaccaaccacatgatcaaggagctggaggcccgggtgcagcagctgaccggggaggccgagaacagcaacctgcagaggcagaagctgatccaggagaaggccgagctggagcgctgctaccagatcacctgcagcgagctgcaggaggtgaaggcccggaggaacaccctgcacaaggagaaggaccacctggtgaatgactatgagcagaacatgaagctgctgcagaccaagtatgatgctgacatcaacctgctgaagcaggagcacgccctgagcgccagcaaggccagctccatgattgaggagctggagcagaatgtgtgccagctgaagcagcagctgcaggagagcgagctgcagaggaagcagcagctgcgggaccaggagaacaagttccagatggagaagagccacctgaagcacatctatgagaagaaggcccatgacctgcagagcgagctggacaagggcaaggaggacacccagaagaagatccacaagtttgaggaggccctgaaggagaaggaggagcagctgaccagggtgacagaggtgcagaggctgcaggcccagcaggctgatgctgccctggaggagttcaagaggcaggtggagctgaacagcgagaaggtgtatgcagagatgaaggagcagatggagaaggtggaggccgacctgaccaggagcaagagcctgcgggagaagcagagcaaggagttcctgtggcagctggaggacatccggcagagatatgagcagcagatcgtggagctgaagctggagcacgagcaggagaagacccacctgctgcagcagcacaatgctgagaaggacagcctggtgcgggaccacgagcgggagattgagaacctggagaagcagctgcgggccgccaacatggagcacgagaaccagatccaggagttcaagaagagagatgcccaggtgattgctgacatggaggcccaggtgcacaagctgcgggaggagctgatcaacgtgaacagccagaggaagcagcagctggtggagctgggcctgctgcgggaggaggagaagcagagggccacccgggagcatgaaattgtggtgaacaagctgaaggccgagagcgagaagatgaagattgagctgaagaagacccacgccgctgagacagagatgaccctggagaaggtgctgcaggatgagctggagaacagaagcaaccaggtgcgctgtgccgagaagaagctgcagcacaaggagctggagagccaggagcagatcacctacatccggcaggagtatgagaccaagctgaagggcctgatgcctgccagcctgcggcaggagctggaggacaccatcagcagcctgaagagccaggtgaacttcctgcagaagagggccagcatcctgcaggaggagctgaccacctaccagggcagaagatag

SEQ ID NO: 22418 - DNA, 1743 bp, Artificial Sequence
  Description of Artificial Sequence: Synthetic coding sequence
atgaacaacatccacgtggagaatgaaagcctggacaacttcctgaaggagaccaacaaggagaacctgctggacatcctgacagagcctgagaggaagccagaccccaagctgtacaccaggagcaagcccaagacagacagctacaaccagaccaagaacagcctggtgcccaagcaggccctgggcaagagctctgtgaacagcgctgtgctgaaggacagagtgaacaagcagtttgtgggggagacccagagcaggaccttccctgtgaagagccagcagctgagcagaggagctgacctggcccggcctggggtgaagcccagcaggacagtgcccagccacttcatccgcaccctgagcaaggtgcagagcagcaagaagcctgtggtgaagaacatcaaggacatcaaggtgaacagaagccagtatgagcggcccaatgagaccaagatccgcagctaccctgtgacagagcagagggtgaagcacaccaagcccaggacctaccccagcctgctgcagggcgagtacaacaacagacaccccaacatcaagcaggaccagaagagcagccaggtgtgcatcccccagaccagctgtgtgctgcagaagagcaaggccatcagccagaggcccaacctgactgtgggccgcttcaacagcgccatccccagcacccccagcatccggcccaacggcaccagcggcaacaagcacaacaacaacggcttccagcagaaggcccagaccctggacagcaagctgaagaaggctgtgccccagaaccacttcctgaacaagacagcccccaagacccaggctgatgtgaccaccgtgaatggcacccagaccaaccccaacatcaagaagaaggccacagcagaagatagaaggaagcagctggaggagtggcagaagagcaagggcaagacctacaagaggcctcccatggagctgaagaccaagaggaaggtgatcaaggagatgaacatctccttctggaagagcattgagaaggaggaggaggagaagaaggcccagctggagctgagcagcaagatcaacaacaccctgacagagtgcctgaacctgattgaaggaggagtgcccagcaatgagatcctgaacatcctgagcagcatccctgaggccgagaagtttgccaagttctggatctgcaaggccaagctgctggccagcaagggcacctttgatgtgattggcctgtatgaggaggccatcaagaatggagccacccccatccaggagctgaggaaggtggtgctgaacatcctgcaggacagcaacagaaccacagagggcatcaccagtgacagcctggtggccgagaccagcatcacctctgtggaggagctggccaagaagatggagagcgtgaagagctgcctgagccccaaggagcgggagcaggtgacagccaccccccgcatcgccaaggccgagcagcacaactacccaggcatcaagctgcagatcggccccatcccccgcatcaatggcatgcctgaggtgcaggacatgaagttcatcacccctgtgagaagaagcagccgcatcgagagagctgtgagccgctacccagagatgctgcaggagcatgacctggtggtggccagcctggatgagctgctggaggtggaggagaccaagtgcttcatcttcagaagaaatgaggccctgcctgtgaccctgggcttccagaccccagagagctag

SEQ ID NO: 22419 - DNA, 705 bp, Artificial Sequence
  Description of Artificial Sequence: Synthetic coding sequence
atgtacatggacctggtggatggcatcttcctgaaccagatcatgctgcagattgacccccggcccaccaaccagaggatcaacaagcacgtgaacaatgatgtgaacctgcgcatccagaacctgaccatcctggtgaggaacatcaagacctactaccaggaggtgctgcagcagctgattgtgatgaacctgcccaacgtgctgatgattggccgggaccccctgagcggcaagtccatggaggagatcaagaaggtgctgctgctggtgctgggctgtgctgtgcagtgtgagaggaaggaggagttcatcgagcgcatcaagcagctggacatcgagacccaggccggcatcgtggcccacatccaggaggtgacccacaaccaggagaatgtgtttgacctgcagtggctggagctgcctgatgtggcccctgaggagctggaggccctgagccgctccatggtgctgcacctgcggcggctgattgaccagagagatgaatgtacagagctgattgtggacctgacccaggagcgggactacctgcaggcccagcacccccccagccccatcaagagcagcagcgctgacagcacccccagccccaccagcagcctgagcagcgaggacaagcagcacctggccgtggagctggccgacaccaaggcccggctgcggcgggtgcggcaggagctgtag

SEQ ID NO: 22420 - DNA, 1161 bp, Artificial Sequence
  Description of Artificial Sequence: Synthetic coding sequence
atgacagacatcaggaagatccggctgggggagcggctggtggaggtgttttctgctgagaaggtgtacatggtgcggctgaggaaccccctgggccggcaggagtggagcggcccctggagcgagatcagcgaggagtggcagcagctgacagccagtgacaggaagaacctgggcctggtgatgtctgatgatggagagttctggatgagcctggaggacttctgcaggaacttccacaagctgaatgtgtgcagaaatgtgaacaaccccatctttggaaggaaggagctggagagcgtgctgggctgctggacagtggatgatgaccccctgatgaacagaagtggcggctgctacaacaacagagacaccttcctgcagaacccccagtacatcttcaccgtgcctgaagatggccacaaggtgatcatgagcctgcagcagaaggacctgcggacctacagaaggatgggccgcccagacaactacatcatcggctttgagctgttcaaggtggagatgaacaggaagttccggctgcaccacctgtacatccaggagcgggccggcaccagcacctacatcgacaccaggacagtgttcctgagcaagtacctgaagaagggcaactacgtgctggtgcccaccatgttccagcacggccgcaccagcgagttcctgctgcgcatcttcagcgaggtgcctgtgcagctgcgggagctgaccctggacatgcccaagatgagctgctggaacctggcccggggctaccccaaggtggtgacccagatcaccgtgcacagcgctgaggacctggagaagaagtatgccaatgaaacagtgaacccctacctggtgatcaagtgtgggaaggaggaggtgcgcagccctgtgcagaagaacacagtgcacgccatctttgacacccaggccatcttctacagaaggaccacagacatccccatcatcgtgcaggtgtggaacagcaggaagttctgtgaccagttcctgggccaggtgaccctggatgctgaccccagcgactgccgggacctgaagagcctgtacctgaggaagaagggcggccccacagccaaggtgaagcagggccacatctccttcaaggtgatcagcagtgatgacctgacagagctgtag

SEQ ID NO: 22421 - DNA, 966 bp, Artificial Sequence
  Description of Artificial Sequence: Synthetic coding sequence
atgacagagctgagcctgcagaaggagcagctgcagctgaagatcatcgagattgaagatgaggccgagaagtggcagaaggagaaggaccgcatcaagagcttcaccaccaatgagaaggccatcctggagcagaacttccgggacctggtgcgggacctggagaagcagaaggaggaggtgcgggccgccctggagcagcgggagcaggatgctgtggaccaggtgaaggtgatcatggatgccctggatgagcgggccaaggtgctgcacgaggacaagcagacccgggagcagctgcacagcatcagtgacagcgtgctcttcctgcaggagtttggagccctgatgagcaactacagcctgcccccacccctgcccacctaccacgtgctgctggagggggagggcctgggccagagcctgggcaacttcaaggatgacctgctgaatgtgtgcatgagacatgtggagaagatgtgcaaggctgacctgagcaggaacttcatcgagaggaaccacatggagaatggaggagaccacagatatgtgaacaactacaccaacagctttggaggagagtggagcgccccagacaccatgaagcgctacagcatgtacctgacccccaagggcggcgtgaggaccagctaccagcccagcagccctggccgcttcaccaaggagaccacccagaagaacttcaacaacctgtatggcaccaagggcaactacaccagccgggtgtgggagtacagcagcagcatccagaacagcgacaatgacctgcctgtggtgcagggcagcagcagcttcagcctgaagggctaccccagcctgatgaggagccagagccccaaggcccagccccagacctggaagagcggcaagcagaccatgctgagccactaccggcccttctacgtgaacaagggaaatggaattggcagcaatgaggccccctag

SEQ ID NO: 22422 - DNA, 687 bp, Artificial Sequence
  Description of Artificial Sequence: Synthetic coding sequence
atgtaccggcagcgcttcctgtacagcctgtaccgccacacccactgggtgcgctgtgccaagttctccccagatggccgcctgattgtgtcctgcagcgaggacaagaccatcaagatctgggacaccaccaacaagcagtgtgtgaacaacttcagtgacagcgtgggctttgccaactttgtggacttcaaccccagcggcacctgcatcgccagcgctggcagtgaccagacagtgaaggtgtgggatgtgcgggtgaacaagctgctgcagcactaccaggtgcacagcggcggcgtgaactgcatctccttccaccccagcggcaactacctgatcacagccagcagtgatggcaccctgaagatcctggacctgctggagggccgcctcatctacaccctgcagggccacacaggccctgtgttcaccgtgtccttcagcaagggcggggagctgtttgccagcggcggcgctgacacccaggtgctgctgtggaggaccaactttgatgagctgcactgcaagggcctgaccaagaggaacctgaagaggctgcactttgacagccccccccacctgctggacatctaccccaggaccccccacccccatgaggagaaggtggagaccgtggaggacttcttcctgcacctgctgcggctcatccagagcctgaggtag

SEQ ID NO: 22423 - DNA, 1686 bp, Artificial Sequence
  Description of Artificial Sequence: Synthetic coding sequence
atgagagctgtgagaagacacctgttcccccagcacagcgcccctggccggggcgtggtgtgggagtggctgagtgatgatggctcctggacagcctatgaggcctctgtgtgtgactacctggagcagcaggtggcccggggcaaccagctggtggacctggcccccctgggctacaactacacagtgaactacaccacccacacccagaccaacaagaccagcagcttctgccgctctgtgcggcggcaggccggccccccctaccctgtgaccaccatcatcgcccctcctggccacactggagtggcctgcagctgccaccagtgcctgagcggcagcaggacaggccctgtgtctggccgctaccgccacagcatgaccaacctgcctgcctaccctgtgccccagcaccccccccacaggacagcctctgtgtttggcacccaccaggcctttgccccctacaacaagcccagcctgagcggggcccggagcgccccccggctgaacaccaccaatgcctggggcgccgccccacccagcctgggcagccagcccctgtaccgcagcagcctgagccacctgggcccccagcacctgcccccaggcagcagcaccagcggggctgtgtctgccagcctgcccagcggccccagcagcagccctggctctgtgcctgccaccgtgcccatgcagatgcccaagcccagccgggtgcagcaggccctggccggcatgacctctgtgctgatgtctgccatcggcctgcctgtgtgcctgagccgggccccccagcccaccagccccccagccagccggctggccagcaagagccacggctctgtgaagaggctgaggaagatgtctgtgaagggggccacccccaagccagagcctgagcctgagcaggtgatcaagaactacacagaggagctgaaggtgcccccagatgaggactgcatcatctgcatggagaagctgagcacagccagcggctacagtgatgtgacagacagcaaggccatcggcagcctggccgtgggccacctgaccaagtgcagccacgccttccacctgctgtgcctgctggccatgtactgcaatggaaacaaggatggcagcctgcagtgccccagctgcaagaccatctatggagagaagacaggcacccagccccagggcaagatggaggtgctgcgcttccagatgagcctgcccggccacgaggactgtggcaccatcctgattgtgtacagcatcccccacggcatccagggccctgagcaccccaaccctgggaagcccttcaccgcccggggcttcccccggcagtgctacctgcctgacaatgcccagggcaggaaggtgctggagctgctgaaggtggcctggaagagaagactcatcttcaccgtgggcaccagcagcaccactggagaaacagacacagtggtgtggaatgagatccaccacaagacagagatggacaggaacatcactggacatggctacccagaccccaactacctgcagaatgtgctggccgagctggccgcccagggcgtgacagaggactgcctggagcagcagcacgcccggctgtggtggccaccccgctgccccatggccggctgggtggcccggcaggaggtgcccagcccccggggctgggaggtgtgctag

SEQ ID NO: 22424 - DNA, 2565 bp, Artificial Sequence
  Description of Artificial Sequence: Synthetic coding sequence
atgaaggtggaggcctgcacctgggccggctacagcggcctgtatgaggccatcgagagctgggacttcaagaagattgagaagctggaggagtaccgcctgctgctgaagaggctgcagcctgagttcaagacccgcatcatccccacagacatcatcagtgacctgtctgagtgcctgatcaaccaggagtgtgaggagatcctgcagatctgcagcaccaagggcatgatggccggggctgagaagctggtggagtgcctgctgcggagtgacaaggagaactggcccaagaccctgaagctggccctggagaaggagaggaacaagttcagcgagctgtggatcgtggagaagggcatcaaggatgtggagacagaggacctggaggacaagatggagaccagtgacatccagatcttctaccaggaggaccctgagtgccagaacctgtctgagaacagctgccccccatctgaggtgtctgacaccaacctgtacagccccttcaagcccaggaactaccagctggagctggccctgcctgccatgaagggcaagaacaccatcatctgtgcccccaccggctgcggcaagacctttgtgtccctgctgatctgtgagcaccacctgaagaagttcccccagggccagaagggcaaggtggtgttctttgccaaccagatccctgtgtatgagcagcagaagtctgtgttcagcaagtactttgagcggcacggctacagagtgacaggcatcagcggggccacagcagaaaatgtgcctgtggagcagatcgtggagaacaatgacatcatcatcctgaccccccagatcctggtgaacaacctgaagaagggcaccatccccagcctgagcatcttcaccctgatgatctttgatgagtgccacaacaccagcaagcagcacccctacaacatgatcatgttcaactacctggaccagaagctgggcggcagcagcggccccctgccccaggtgattggcctgacagcctctgtgggcgtgggagatgccaagaacacagatgaggccctggactacatctgcaagctgtgtgccagcctggatgccagcgtcatcgccaccgtgaagcacaacctggaggagctggagcaggtggtgtacaagccccagaagttcttcaggaaggtggagagccgcatcagtgacaagttcaagtacatcatcgcccagctgatgagggacacagagagcctggccaagaggatctgcaaggacctggagaacctgagccagatccagaaccgggagtttggcacccagaagtatgagcagtggatcgtgacagtgcagaaggcctgcatggtgttccagatgccagacaaggatgaggagagccgcatctgcaaggccctcttcctgtacaccagccacctgaggaagtacaatgatgccctgatcatcagcgagcacgccaggatgaaggatgccctggactacctgaaggacttcttcagcaatgtgcgggccgccggctttgatgaaattgagcaggacctgacccagagatttgaggagaagctgcaggagctggagagcgtgtcccgggaccccagcaatgaaaaccccaagctggaggacctgtgcttcatcctgcaggaggagtaccacctgaaccctgagaccatcaccatcctgtttgtgaagacccgggccctggtggatgccctgaagaactggattgagggcaaccccaagctgtccttcctgaagccaggcatcctgaccggccggggcaagaccaaccagaacacaggcatgaccctgcctgcccagaagtgcatcctggatgccttcaaggccagcggggaccacaacatcctgattgccacctctgtggctgatgagggcattgatattgcccagtgcaacctggtgatcctgtatgaatatgtgggcaatgtcatcaagatgatccagacccggggccggggccgggcccggggcagcaagtgcttcctgctgaccagcaatgctggggtgattgagaaggagcagatcaacatgtacaaggagaagatgatgaatgacagcatcctgcggctgcagacctgggatgaagctgtgttccgggagaagatcctgcacatccagacccatgagaagttcatccgggacagccaggagaagcccaagcctgtgcctgacaaggagaacaagaagctgctgtgcaggaagtgcaaggccctggcctgctacacagcagatgtgcgggtgattgaggagtgccactacacagtgctgggagatgccttcaaggaatgttttgtgtcccggccccaccccaagcccaagcagttcagcagctttgagaagagggccaagatcttctgtgcccggcagaactgcagccatgactggggcatccacgtgaagtacaagacctttgagatccctgtgatcaagattgagagctttgtggtggaggacatcgccaccggggtgcagaccctgtacagcaagtggaaggacttccactttgagaagatcccctttgatcctgctgagatgagcaagtag

SEQ ID NO: 22425 - DNA, 813 bp, Artificial Sequence
  Description of Artificial Sequence: Synthetic coding sequence
atgcagatcgagcacatcatcgagaacatcgtggccgtgaccaagggcctgtctgagaagctgcctgagaagtgggagagcgtgaagctgctgtttgtgaagacagagaagtctgctgccctgcccatcttcagcagctttgtgagcaactgggatgaggccaccaagaggagcctgctgaacaagaagaagaaggaggcccggaggaagagaagagagaggaactttgagaagcagaaggagaggaagaagaagaggcagcaggccaggaagacagcctctgtgctgagcaaggatgatgtggcccctgagagcggggacaccaccgtgaagaagccagagagcaagaaggagcagaccccagagcacggcaagaagaagaggggccggggcaaggcccaggtgaaggccaccaatgaaagtgaagatgagatcccccagctggtgcccatcggcaagaagaccccagccaatgagaaggtggagatccagaagcacgccaccgggaagaagagccctgccaagagccccaaccccagcaccccccggggcaagaagaggaaggccctgcctgccagcgagacccccaaggctgctgagagcgagacccctgggaagagccctgagaagaagcccaagatcaaggaggaggccgtgaaggagaagagccccagcctgggcaagaaggatgcccggcagacccccaagaagccagaggccaagttcttcaccacccccagcaagtctgtgaggaaggccagccacacccccaagaagtggcccaagaagcccaaggtgccccagagcacctag

SEQ ID NO: 22426 - DNA, 1059 bp, Artificial Sequence
  Description of Artificial Sequence: Synthetic coding sequence
atgagcagcaggaagctgagcggccccaagggccggcggctgagcatccacgtggtgacctggaatgtggccagcgctgccccacccctggacctgagtgacctgctgcagctgaacaacagaaacctgaacctggacatctacgtgattggcctgcaggagctgaacagcggcatcatcagcctgctgagtgatgctgccttcaatgacagctggagcagcttcctgatggatgtgctgagccccctgtccttcatcaaggtgagccacgtgaggatgcagggcatcctgctgctggtgtttgccaagtaccagcacctgccctacatccagatcctgagcaccaagagcacccccaccggcctgtttggctactggctgagcatcgccaagaagcatgaccccctgctgcgggagttccaggagggccgcctgctcttcccccccacctacaagtttgacaggaacagcaatgactatgacaccagcgagaagaagaggaagccagcctggacagaccgcatcctgtggaggctgaagaggcagccctgtgccggccctgacacccccatccccccagccagccacttcagcctgagcctgcggggctacagcagccacatgacctacggcatcagtgaccacaagcctgtgtctggcacctttgacctggagctgaagcccctggtgtctgcccccctgattgtgctgatgcctgaggacctgtggacagtggagaatgacatgatggtgtcctacagcagcaccagtgacttccccagcagcccctgggactggattggcctgtacaaggtgggcctgagagatgtgaatgactatgtgtcctatgcctgggtgggggacagcaaggtgtcctgcagcgacaacctgaaccaggtgtacatcgacatcagcaacatccccaccacagaagatgagttcctgctgtgctactacagcaacagcctgcggtctgtggtgggcatcagccggcccttccagatccccccaggcagcctgcgggaggaccccctgggggaggcccagccccagatctag

SEQ ID NO: 22427 - DNA, 375 bp, Artificial Sequence
  Description of Artificial Sequence: Synthetic coding sequence
atgacaggcagctgctgcggcagcaccttcagcagcctgtcctatggaggcggctgctgccagccctgctgctgccgggacccctgctgctgcaggcctgtgacctgccagaccaccgtgtgcaggcctgtgacctgtgtgccccgctgcacccggcccatctgtgagccctgcagaagacctgtgtgctgtgacccctgcagcctgcaggagggctgctgccggcccatcacctgctgccccagcagctgcacagctgtggtgtgccggccctgctgctgggccaccacctgctgccagccccctgtgtctgtgcagagcccctgtggccagcccaccccctgcagcaccacctgcaggaccagcagctgctag

SEQ ID NO: 22428 - DNA, 927 bp, Artificial Sequence; identical to SEQ ID NO: 19214
  Description of Artificial Sequence: Synthetic coding sequence

SEQ ID NO: 22429 - DNA, 2943 bp, Artificial Sequence
  Description of Artificial Sequence: Synthetic coding sequence
atgacagagggccgccactgccaggtgcacctgctggatgaccggcggctggagctgctggtgcagcccaagctgctggcccgggagctgctggacctggtggccagccacttcaacctgaaggagaaggagtacttcggcatcaccttcattgatgacaccggccagcagaactggctgcagctggaccaccgggtgctggaccatgacctgcccaagaagccaggccccaccatcctgcactttgctgtgcgcttctacatcgagagcatctccttcctgaaggacaagaccaccgtggagctgttcttcctgaatgccaaggcctgtgtgcacaagggccagatcgaggtggagagcgagaccatcttcaagctggccgccttcatcctgcagagccccaaggtgtccctgacccatgatgaaaatgccaggaaggacctgaagaccctgcctgccttccccaccaagaccctgcaggagcaccccagcctggcctactgtgaagatagagtgattgagcactacctgaagatcaagggcctgacccggggccaggccgtggtgcagtacatgaagatcgtggaggccctgcccacctatggagtgcactactatgctgtgaaggacaagcagggcctgccctggtggctgggcatctcctacaagggcatcggccagtatgacatccaggacaaggtgaagcccaggaagctgttccagtggaagcagctggagaacctgtacttccgggagaagaagtttgctgtggaggtgcatgacccccggcgcatctctgtgtccaggaggaccttcggccagagcggcctgtttgtgcagacctggtacgccaacagcagcctcatcaagagcatctgggtgatggccatcagccagcaccagttctacctggacaggaagcagagcaaggccaagatccccagcgcccggagcctggatgagatcgccatggacctgacagaaacaggcacccagagggccagcaagctggtgaccctggagaccaagagccagttcatcatggccagcaatggcagcctcatcagcagcggcagccaggacagcgaggtgtctgaggagcagaagcgggagaagatcctggagctgaagaagaaggagaagctgctgcaggagaagctgctgaagaaggtggaggagctgaagaagatctgcctgcgggaggccgagctgaccgggaagatgcccaaggagtaccccctgaacatcggggagaagccaccccaggtgagaagaagagtgggcacagccttcaagctggatgacaacctgctgcccagcgaggaggaccctgccctgcaggagctggagagcaacttcctgatccagcagaagctggtggaggccgccaagaagctggccaatgaaccagacctgtgcaagacagtgaagaagaagaggaagcaggactacacagatgccatgaagaagctgcaggagattgaaaatgccatcaatgagtaccgcatccgctgtgggaagaagcccagccagaaggccaccgtgctgcctgaggacatcatccccagcgagagcagcagcctgagtgacaccaccacctatgatgaccccagtgatgccttcaccttccctggccagaggagcagctctgtgccccacagcccccgcatcctgccccccaagagcctgggcatcgagcgcatccacttcaggaagagcagcatcaatgagcagtttgtggacacccggcagagccgggagatgctgagcacccacagcagcccctacaagaccctggagcggcggccccagggcggccgctccatgcccaccacccctgtgctgaccagaaatgcctacagcagcagccacctggagcctgagagcagcagccagcactgccggcagaggagcggcagcctggagagccagagccacctgctgtctgagatggacagcgacaagcccttcttcagcctgagcaagagccagaggagcagcagcacagagatcctggatgatggcagcagctacaccagccagagcagcacagagtactactgtgtgacccctgtgacaggcccctactacaccacccagaccctggacaccaggacccggggcagaagaagaagcaagaagcagaatgtgtccaccagcaacagcggctccatgcccaacctggcccagaaggacagcctgagaaatggagtgtacagcaagagccaggagccccccagcagcagctactacatcgccggctacaccccctatgcagaatgtgacttctactacagcggcggctacgtgtatgaaaatgacacagagggccagtacagcgtgaaccccagctaccgcagcagcgcccactacggctatgagcggcagagggactacagccgctccttccatgaagatgaggtggacagagtgccccacaacccctatgccaccctgcggctgcccaggaaggccgccgccaagtctgagcacatcaccaagaacatccacaaggccctggtggccgagcacctgcggggctggtaccagagggccagcggccagaaggaccagggccacagcccccagaccagctttgacagcgaccggggcagccagcgctgcctgggctttgctggcctgcaggtgccctgcagccccagcagccgggccagcagctacagctctgtgagcagcaccaatgccagcggcaactggaggacccagctgaccatcggcctgagtgactatgagaccccagcccacagcagctacaccagctgctatggaaatgtgtacaaccccctgcccagccccagccggcagtacacagagatcagccagctggatggaacagatggcaaccagctggaggacaacctggagagcagcgagcagaggctcttctggcatgaggacagcaagccaggcaccctggtgtag

SEQ ID NO: 22430 - DNA, 2979 bp, Artificial Sequence
  Description of Artificial Sequence: Synthetic coding sequence
atgtatggcagcgcccggtctgtgggcaaggtggagcccagcagccagagccctggccgcagcccccggctgcccaggagcccccggctgggccacaggaggaccaacagcactggaggcagcagcggcagctctgtgggcggcggcagcggcaagaccctgtccatggagaacatccagagcctgaatgctgcctatgccaccagcggccccatgtacctgagtgaccatgaaaatgtgggcagcgagacccccaagagcaccatgaccctgggccgcagcggcggccgcctgccctacggcgtgaggatgacagccatgggcagcagccccaacatcgccagcagcggcgtggccagtgacaccatcgcctttggagagcaccacctgccccctgtgtccatggccagcacagtgccccacagcctgcggcaggcccgggacaacaccatcatggacctgcagacccagctgaaggaggtgctgcgggagaatgacctgctgaggaaggatgtggaggtgaaggagagcaagctgagcagctccatgaacagcatcaagaccttctggagccctgagctgaagaaggagcgggccctgaggaaggatgaggccagcaagatcaccatctggaaggagcagtacagagtggtgcaggaggagaaccagcacatgcagatgaccatccaggccctgcaggatgagctgcgcatccagagggacctgaaccagctgttccagcaggacagcagcagcaggactggagagccctgtgtggccgagctgacagaggagaacttccagaggctgcacgccgagcacgagcggcaggccaaggagctgttcctgctgaggaagaccctggaggagatggagctgagaattgagacccagaagcagaccctgaatgccagagatgagagcatcaagaagctgctggagatgctgcagagcaagggcctgagcgccaaggccacagaggaggaccacgagaggacccggcggctggccgaggccgagatgcacgtgcaccacctggagagcctgctggagcagaaggagaaggagaacagcatgctgcgggaggagatgcacagaagatttgaaaatgccccagacagcgccaagaccaaggccctgcagaccgtcatcgagatgaaggacagcaagatcagctccatggagcggggcctgcgggacctggaggaggagatccagatgctgaagagcaatggagccctgagcacagaggagcgggaggaggagatgaagcagatggaggtgtaccgcagccacagcaagttcatgaagaacaagattggccaggtgaagcaggagctgagcaggaaggacacagagctgctggccctgcagaccaagctggagaccctgaccaaccagttcagtgacagcaagcagcacatcgaggtgctgaaggagagcctgacagccaaggagcagagagctgccatcctgcagacagaggtggatgccctgcggctgcggctggaggagaaggagaccatgctgaacaagaagaccaagcagatccaggacatggccgaggagaagggcacccaggccggggagatccatgacctgaaggacatgctggatgtgaaggagaggaaggtgaatgtgctgcagaagaagattgagaacctgcaggagcagctgcgggacaaggagaagcagatgagcagcctgaaggagcgggtgaagagcctgcaggccgacaccaccaacacagacacagccctgaccaccctggaggaggccctggccgagaaggagaggaccatcgagcggctgaaggagcagagggacagagatgagcgggagaagcaggaggagattgacaactacaagaaggacctgaaggacctgaaggagaaggtgtccctgctgcagggcgacctgtctgagaaggaggccagcctgctggacctgaaggagcacgccagcagcctggccagcagcggcctgaagaaggacagccggctgaagaccctggagatcgccctggagcagaagaaggaggagtgcctgaagatggagagccagctgaagaaggcccatgaagctgccctggaggcccgggccagccctgagatgtctgaccgcatccagcacctggagcgggagatcacccgctacaaggatgagagcagcaaggcccaggccgaggtggaccggctgctggagatcctgaaggaggtggagaatgagaagaatgacaaggacaagaagattgctgagctggagagcctgaccagccggcaggtgaaggaccagaacaagaaggtggccaacctgaagcacaaggagcaggtggagaagaagaagagcgcccagatgctggaggaggcccggcggcgggaggacaacctgaatgacagcagccagcagctgcaggacagcctgaggaagaaggatgacagaattgaggagctggaggaggccctgcgggagagcgtgcagatcacagctgagcgggagatggtgctggcccaggaggagagcgcccggaccaatgctgagaagcaggtggaggagctgctgatggccatggagaaggtgaagcaggagctggagagcatgaaggccaagctgagcagcacccagcagagcctggccgagaaggagacccacctgaccaacctgcgggcagagaggaggaagcacctggaggaggtgctggagatgaagcaggaggccctgctggccgccatcagcgagaaggatgccaacatcgccctgctggagctgagcagcagcaagaagaagacccaggaggaggtggccgccctgaagcgggagaaggaccggctggtgcagcagctgaagcagcagacccagaacaggatgaagctgatggctgacaactatgaagatgaccacttcaagagcagccacagcaaccagaccaaccacaagcccagcccagaccaggatgaggaggagggcatctgggcctag

SEQ ID NO: 22431 - DNA, 3138 bp, Artificial Sequence
  Description of Artificial Sequence: Synthetic coding sequence
atgctgactgtgcaggtgaagaccagcagcgccatcgagctgcctgacagcctggccttcctgtggatcatccccatgtggtactgtgagggcaaggagctggagaacagcccagacatccacatcgtgcaggccggcaacctgcacagcctgaccatcgccgaggcctttgaggaggacaccggccgctacagctgctttgccagcaacatctacggcacagacagcaccagcgctgagatctacattgaaggagtgagcagcagtgacagcgagggggaccccaacaaggaggagatgaaccgcatccagaagcccaatgaggtgagcagcccccccaccaccagcgctgtgatccccccagctgtgccccaggcccagcacctggtggcccagccccgggtggccaccatccagcagtgccagagccccaccaactacctgcagggcctggatggcaagcccatcatcgccgcccctgtgttcaccaagatgctgcagaacctgagcgccagcgagggccagctggtggtgtttgagtgccgggtgaagggggcccccagccccaaggtggagtggtaccgggagggcaccctgattgaggacagcccagacttccgcatcctgcagaagaggcctgtgtgcatggagcacatcgaggagatctgcaccctggtgattgctgaggtgtttgctgaagattctggctgcttcacctgcacagccagcaacaagtatggcaccgtgagcagcatcgcccagctgcacgtgagaggaaatgaagacctgagcaacaacggcagcctgcacagcgccaacagcaccaccaacctggccgccatcgagccccagcccagccccccccacagcgagccccccagcgtggagcagccccccaagcccaagctggagggcgtgctggtgaaccacaatgagcccaggagcagcagcagaattggcctgcgggtgcacttcaacctgcctgaagatgacaagggcagcgaggccagcagcgaggccggcgtggtgaccacccggcagaccaggccagacagcttccaggagcgcttcaacggccaggccaccaagaccccagagcccagcagccctgtgaaggagcccccacctgtgctggccaagcccaagctggacagcacccagctgcagcagctgcacaaccaggtgctgctggagcagcaccagctgcagaaccccccacccagcagccccaaggagttccccttctccatgacagtgctgaacagcaatgcccctcctgctgtgaccaccagcagcaagcaggtgaaggcccccagcagccagaccttcagcctggcccggcccaagtacttcttccccagcaccaacaccacagctgccaccgtggcccccagcagcagccctgtgttcaccctgagcagcaccccccagaccatccagaggacagtgtccaaggagagcctgctggtgagccaccccagcgtgcagaccaagagccctgggggcctgagcatccagaatgagcccctgcccccaggccccacagagcccaccccaccacccttcaccttcagcatccccagcggcaaccagttccagccccgctgtgtgagccccatccctgtgagccccaccagccgcatccagaaccctgtggccttcctgagctctgtgctgcccagcctgcctgccatcccccccaccaatgccatgggcctgcccaggtctgcccccagcatgcccagccagggcctggccaagaagaacaccaagagcccccagcctgtgaatgatgacaacatccgggagaccaagaatgctgtgatccgggacctgggcaagaagatcaccttcagtgatgtgcggcccaaccagcaggagtacaagatcagcagctttgagcagaggctgatgaatgaaattgagttccggctggagaggacccctgtggatgaaagtgatgatgagatccagcatgatgagatccccaccgggaagtgcatcgcccccatctttgacaagaggctgaagcacttccgggtgacagagggcagccctgtgaccttcacctgcaagatcgtgggcatccctgtgcccaaggtgtactggttcaaggatggcaagcagatcagcaagagaaatgagcactgcaagatgaggcgggagggagatggcacctgcagcctgcacatcgagagcaccaccagtgatgatgatggcaactacaccatcatggccgccaacccccagggccgcatcagctgcagcggccacctgatggtgcagagcctgcccatccgcagccggctgaccagcgctggccagagccaccggggccgcagccgggtgcaggagcgggacaaggagcccctgcaggagcgcttcttccggccccacttcctgcaggcccctggggacatggtggcccacgagggccgcctgtgccgcctggactgcaaggtgtctggcctgcccccacctgagctgacctggctgctgaatggccagcctgtgctgcctgatgccagccacaagatgctggtgcgggagactggagtgcacagcctgctgattgaccccctgacccagagagatgctggcacctacaagtgcatcgccaccaacaagacaggccagaacagcttcagcctggagctgtctgtggtggccaaggaggtgaagaaggcccctgtgatcctggagaagctgcagaactgtggggtgcctgagggccaccctgtgcggctggagtgccgggtgattggcatgcctcctcctgtgttctactggaagaaggacaatgagaccatcccctgcacccgggagcgcatctccatgcaccaggacaccaccggctacgcctgcctgctgatccagcctgccaagaagagtgatgctggctggtacaccctgagcgccaagaatgaagctggcatcgtgtcctgcacagcccggctggacatctatgcccagtggcaccaccagatccccccacccatgtctgtgcggcccagcggcagccgctatggcagcctgaccagcaagggcctggacatcttcagcgccttcagctccatggagagcaccatggtgtacagctgcagcagccgctctgtggtggagagtgatgagctgtag

SEQ ID NO: 22432 - DNA, 72 bp, Artificial Sequence
  Description of Artificial Sequence: Synthetic coding sequence
gtgcggctggcctggggctttgtgtctgccctgggcagcttccacacagctgaccctgagggcgccgcctag

SEQ ID NO: 22433 - DNA, 1608 bp, Artificial Sequence
  Description of Artificial Sequence: Synthetic coding sequence
atggaggcccccaccgtggagaccccaccagaccccagcccccccagcgccccagccccagccctggtgcccctgcgggccccagatgtggcccggctgcgggaggagcaggagaaggtggtgaccaactgccaggagcgcatccagcactggaagaaggtggacaatgactacaatgccctgcgggagcggctgagcaccctgcctgacaagctgagctacaacatcatggtgcccttcggcccctttgccttcatgcctgggaagctggtgcacaccaatgaggtgacagtgctgctgggggacaactggtttgccaagtgcagcgccaagcaggccgtgggcctggtggagcacaggaaggagcacgtgaggaagaccattgatgacctgaagaaggtgatgaagaactttgagagccgggtggagttcacagaggacctgcagaagatgtctgatgctgctggggacatcgtggacatccgggaggagatcaagtgtgactttgagttcaaggccaagcacagaattgcccacaagccccacagcaagcccaagaccagtgacatctttgaagctgacatcgccaatgatgtgaagagcaaggacctgctggccgacaaggagctgtgggcccggctggaggagctggagcggcaggaggagctgctgggggagctggacagcaagccagacacagtgattgccaatggagaggacaccaccagcagcgaggaggagaaggaggacaggaacaccaacgtgaatgccatgcaccaggtgacagacagccacaccccctgccacaaggatgtggccagcagcgagcccttcagcggccaggtgaacagccagctgaactgcagcgtgaatggcagcagcagctaccacagtgatgatgatgatgatgatgatgatgatgatgatgatgacaacattgatgatgatgatggagacaatgaccacgaggccctgggcgtgggggacaacagcatccccaccatctacttcagccacacagtggagcccaagagggtgcgcatcaacacaggcaagaacaccaccctgaagttcagcgagaagaaggaggaggccaagaggaagaggaagaacagcactggaagtggccacagcgcccaggagctgcccaccatccgcaccccagctgacatctaccgggcctttgtggatgtggtgaatggagaatatgtgcccaggaagagcatcctgaagagccgcagccgggagaacagcgtgtgcagcgacaccagcgagagcagcgctgctgagtttgatgaccggcggggcgtgctgcggagcatcagctgtgaggaggccacctgcagcgacaccagcgagagcatcctggaggaggagccccaggagaaccagaagaagctgctgcccctgtctgtgaccccagaggccttcagcggcaccgtcatcgagaaggagtttgtgagccccagcctgaccccacctccagccatcgcccacccagccctgcccaccatccctgagaggaaggaggtgctgctggaggccagcgaggagaccgggaagagggtgtccaagttcaaggccgcccggctgcagcagaaggactag

SEQ ID NO: 22434 - DNA, 1731 bp, Artificial Sequence
  Description of Artificial Sequence: Synthetic coding sequence
atggagggcctgcggaggagaagaggccgggaggccggccccccccagcccatggtgcccctggccgtggagaaccaggccggcggggagggcgctggaggagagctgggcatcagcctgaacatgtgcctgctgggcgccctggtgctgctgggcctgggcgtgctgctcttcagcggcggcctgtctgagagcgagaccggccccatggaggaggtggagcggcaggtgctgcctgaccctgaggtgctggaggccgtgggggaccggcaggacggcctgcgggagcagctgcaggcccctgtgcccccagacagcgtgcccagcctgcagaacatgggcctgctgctggacaagctggccaaggagaaccaggacatccggctgctgcaggcccagctgcaggcccagaaggaggagctgcagagcctgatgcaccagcccaagggcctggaggaggagaatgcccagctgcggggggccctgcagcagggcgaggccttccagagggccctggagagcgagctgcagcagctgcgggcccggctgcagggcctggaggccgactgtgtgcggggcccagatggagtgtgcctgagcggcggccggggcccccagggcgacaaggccatccgggagcagggcccccgggagcaggagcctgagctgtccttcctgaagcagaaggagcagctggaggccgaggcccaggccctgcggcaggagctggagcggcagaggcggctgctgggctctgtgcagcaggacctggagaggagcctgcaggatgccagcagaggagaccctgcccacgccggcctggccgagctgggccaccggctggcccagaagctgcagggcctggagaactggggccaggaccccggggtgtctgccaatgccagcaaggcctggcaccagaagagccacttccagaacagccgggagtggagcggcaaggagaagtggtgggatggccagagggacaggaaggccgagcactggaagcacaagaaggaggagagcggccgggagaggaagaagaactggggcggccaggaggaccgggagcctgctggccgctggaaggagggccggccccgggtggaggagagcggcagcaagaaggagggcaagaggcagggccccaaggagccccccaggaagagcggcagcttccacagcagcggggagaagcagaagcagccccgctggagggagggcaccaaggacagccatgaccccctgcccagctgggccgagctgctgcggcccaagtaccgggccccccagggctgcagcggcgtggatgaatgtgcccggcaggagggcctgaccttcttcggcacagagctggcccctgtgcggcagcaggagctggccagcctgctgcggacctacctggcccggctgccctgggccggccagctgaccaaggagctgcccctgagccctgccttcttcggggaggatggcatcttcagacatgaccggctgcgcttccgggactttgtggatgccctggaggacagcctggaggaggtggccgtgcagcagacaggagatgatgatgaggtggatgactttgaggacttcatcttcagccacttcttcggggacaaggccctgaagaagaggtctgggaagaaggacaagcacagccagagccccagggctgctggcccccgggagggccacagccacagccaccaccaccaccaccggggctag

SEQ ID NO: 22435 - DNA, 2244 bp, Artificial Sequence
  Description of Artificial Sequence: Synthetic coding sequence
atggccaagtacaacacaggaggcaaccccacagaagatgtgtctgtgaacagccggcccttccgggtgacaggccccaacagcagcagcggcatccaggccaggaagaacctcttcaacaaccagggcaatgccagccccccagctggccccagcaatgtgcccaagtttggcagccccaagccccctgtggccgtgaagcccagcagcgaggagaagccagacaaggagcccaagccacccttcctgaagcccaccggggccggccagcgcttcggcaccccagccagcctgaccacccgggaccctgaggccaaggtgggcttcctgaagcctgtgggccccaagcccatcaacctgcccaaggaggacagcaagcccaccttcccctggcccccaggcaacaagcccagcctgcacagcgtgaaccaggaccatgacctgaagcccctgggccccaagagcggccccaccccacccaccagtgaaaatgagcagaagcaggccttccccaagctgactggagtgaagggcaagttcatgtctgccagccaggacctggagcccaagcccctcttccccaagccagccttcggccagaagccacccctgagcacagagaacagccatgaagatgagagccccatgaagaatgtgagcagcagcaagggcagccctgcccccctgggcgtgcgcagcaagagcggccccctgaagccagccagagaagattctgagaacaaggaccatgctggggagatcagcagcctgcccttccctggggtggtgctgaagccagctgccagcagaggaggccctggcctgagcaagaatggagaggagaagaaggaggacaggaagattgatgctgccaagaacaccttccagagcaagatcaaccaggaggagctggccagcggcaccccaccagcccgcttccccaaggcccccagcaagctgactgtgggcggcccctggggccagagccaggagaaggagaagggggacaagaacagcgccacccccaagcagaagcccctgcccccactcttcaccctgggccccccaccacccaagcccaacagacctccaaatgtggacctgaccaagttccacaagaccagcagcggcaacagcaccagcaagggccagaccagctacagcaccaccagcctgcccccacctccacccagccacccagccagccagccccccctgcctgccagccaccccagccagccccctgtgcccagcctgccccccaggaacatcaagcccccatttgacctgaagagccctgtgaatgaagacaaccaggatggagtgacccacagtgatgtggtgatccccctggaccacgagcaggacagcgagggggagacctatgaagatattgaggccagcaaggagcgggagaagaagcgggagaaggaggagaagaagaggctggagctggagaagaaggagcagaaggagaaggagaagaaggagcaggagatcaagaagaagttcaagctgaccggccccatccaggtgatccacctggccaaggcctgctgtgatgtgaagggcggcaagaatgagctgtccttcaagcagggcgagcagatcgagatcatccgcatcacagacaaccctgagggcaagtggctgggccgcacagcccggggcagctatggctacatcaagaccacagctgtggagattgattatgacagcctgaagctgaagaaggacagcctgggcgcccccagccggcccattgaagatgaccaggaggtgtatgatgatgtggccgagcaggatgacatcagcagccacagccagagcggcagcggcggcatcttccccccacctccagatgatgacatctatgatggcatcgaggaggaggatgctgatgatggcagcaccctgcaggtgcaggagaagagcaacacctggagctggggcatcctgaagatgctgaagggcaaggatgacaggaagaagagcatccgggagaagcccaaggtgtctgacagcgacaacaatgaaggcagcagcttccctgccccacccaagcagctggacatgggagatgaggtgtatgatgatgtggacaccagtgacttccctgtgtcctctgctgagatgagccagggcaccaacgtgggcaaggccaagacagaggagaaggacctgaagaagctgaagaagcaggagaaggaggagaaggacttcaggaagaagttcaagaagtag

SEQ ID NO: 22436 - DNA, 1566 bp, Artificial Sequence; identical to SEQ ID NO: 21571
  Description of Artificial Sequence: Synthetic coding sequence

SEQ ID NO: 22437 - DNA, 1710 bp, Artificial Sequence
  Description of Artificial Sequence: Synthetic coding sequence
atgctgcgggacatgacaggcctgccccacaacagaaaatgttttgactgtgaccagaggggccccacctacgtgaacatgacagtgggcagctttgtgtgcaccagctgcagcggcagcctgcggggcctgaaccccccccaccgggtgaagagcatctccatgaccaccttcacccagcaggagattgagttcctgcagaagcatggaaatgaggtgtgcaagcagatctggctgggcctgtttgatgacaggagcagcgccatcccagacttccgggacccccagaaggtgaaggagttcctgcaggagaagtatgagaagaagcgctggtacgtgcccccagagcaggccaaggtggtggcctctgtgcacgccagcatcagcggcagcagcgccagcagcaccagcagcaccccagaggtgaagcccctgaagagcctgctgggggacagcgcccccaccctgcacctgaacaagggcacccccagccagagccctgtggtgggccgcagccagggccagcagcaggagaagaagcagtttgacctgctgagtgacctgggcagtgacatctttgctgccccagccccccagagcacagccacagccaactttgccaactttgcccacttcaacagccacgccgcccagaacagcgccaatgctgactttgccaactttgatgccttcggccagagcagcggcagcagcaactttggaggcttccccacagccagccacagccccttccagccccagaccacagccttcaggatgctgagcagcagctgcagctttggagagttcaccagcgccttccccctgcaggccacccacagcggcagcgctgcctctgtgaatgccaactttgcccactttgacaacttccccaagagcagcagcgctgactttggcaccttcaacaccagccagagccaccagacagccagcgctgtgtccaaggtgtccaccaacaaggccggcctgcagacagctgacaagtatgctgccctggccaacctggacaacatcttctctgctggccagggcggggaccagggcagcggcttcggcaccaccgggaaggcccctgtgggctctgtggtgtctgtgcccagccagagcagcgccagcagtgacaagtatgctgccctggccgagctggacagcgtcttcagcagcgctgccaccagcagcaatgcctacaccagcaccagcaatgccagcagcaatgtgtttggcaccgtgcctgtggtggccagcgcccagacccagcctgccagcagctctgtgcctgccccctttggagccacccccagcaccaacccctttgtggccgctgctggccccagcgtggccagcagcaccaaccccttccagaccaatgcccggggggccacagctgccaccttcggcacagcctccatgtccatgcccactggatttggcaccccagccccctacagcctgcccaccagcttcagcggcagcttccagcagcctgccttccctgcccaggccgccttcccccagcagacagccttcagccagcagcccaatggatttgctgccttcggccagaccaagcctgtggtgacccccttcggccaggtggccgccgccggcgtgagcagcaaccccttcatgactggagcccccaccggccagttccccaccggcagcagcagcaccaaccccttcctgtag

SEQ ID NO: 22438 - DNA, 2007 bp, Artificial Sequence
  Description of Artificial Sequence: Synthetic coding sequence
atgagcaagctggccgccgcccacagaggagccatccgggccctgcagatgtttgtgacccagttcacagacagaggagagcaccccctgcctgcccgctgcaaggagctgggcagcctcatccggcagctgagcctgtgcagcgtgaagctggatgctgaccccagcgtgcctgatgtggtgattgacatcctgcagcagatcgaggccctggagagcctgctggagaagaagctgagccccaagaaggtgaagaagtgcttcagcgagatccgcagccgcttccccatcggcagccagaaggccctggagcgctggcccagcaccagccccaagggggagcggcggcccctgacagccaaggacaccttcccccaggagaccagccggcccagcgtggccaagcagctgctggccgacaagtaccagcctgacacagagctgcctgagacccagaggctgcagagcgagctggatgtgctggatgctgacatcgtgctggaggagggccccttcatcctggaccagagcgccagcttcaaggatgaggtgctggccgtggccaagaccaaggccggcaagaagaagcctgtgacagaaaatgtgcccttcaggaagaaggacaccctggccccagcccggcagcagggcctgaggaaggccgagcggggccggcagagccagccccacagcaagagccgggtgcagcagaccaccgtgagcagccggctgaagatgaaccggcagcctgtgaaggacaggaaggccccctggatcccccccaaccccaccagccccccagccagccccaagtgtgccgcctggctgaaggtgaagaccagccccagagatgccaccaaggagcccctgcagcaggaggacccccaggaggagagccacctgaccggggctgtggagcatgaagctgcccggctggcctggctggatgctgagaccagcaagaggctgaaggagctggaggagctgaaggccaaggagattgacagcatgcagaagcagaggctggactggctggatgctgagaccagcaggaggaccaaggagctgaatgagctgaaggccgaggagatgtaccgcctgcagcagctgtctgtgtctgccacccacctggccgacaaggtggaggaggccgtgctggaccggctgaagcccctgctggtgaaggcccagagggtgaacagcaccacagaggccaacatccacctgaaggatggcagctctgtgaacacagccaaggcccagcctgcccaggaggtggccgctgtggactttgagagcaacaacatccggcagctggatgacttcctggaggactgtgccagcgagctgtgggccgtgacccacgccaagatcctgggcagcgagaccctggccaccgtggaggacagcaaggacagcccagacctggagatcatgatgaggaggatggaggagatggagaagtaccaggagagcgtgcggcagcgctacaacaagatcgcctatgctgacccccggctgtggatgcaggaggagaacaatgaccagaagatcagcgccatcagcgagaagcccctgagcccccaccccatccgcatcaccaagacagtggacaggaaggaccctgctgtgaacatcatgctggagcggccctgcaatggaaacagcctggatgagagcgtgggcacagaggagggcagcgagaagcgggaggcccccctgctgagcctggccgaggacagccagcagaaggagggccgggcccccctgtttgtgcccccaggcatgcagcacagcatcggggactactgcagcagatttgagcagtacctgcgcatcatcagccatgaggccgtgggcagcttcaacccctggctgattgctgagagcttcagcgaggagctggtggatgaggccctgggcgctgtggccgctgagctgcaggacatgtgtgaggactatgcagaggccgtgttcaccagcgagttcctggaggccgccacctag

SEQ ID NO: 22439 - DNA, 3612 bp, Artificial Sequence
  Description of Artificial Sequence: Synthetic coding sequence
atgcctgccagaattggctactatgaaattgacaggaccatcggcaagggcaactttgctgtggtgaagagggccacccacctggtgaccaaggccaaggtggccatcaagatcatcgacaagacccagctggatgaggagaacctgaagaagatcttccgggaggtgcagatcatgaagatgctgtgccacccccacatcatccggctgtaccaggtgatggagacagagaggatgatctacctggtgacagaatatgccagcggcggggagatctttgaccacctggtggcccacggccgcatggccgagaaggaggcccggaggaagttcaagcagatcgtgacagctgtgtacttctgccactgcaggaacatcgtgcaccgggacctgaaggccgagaacctgctgctggatgccaacctgaacatcaagattgctgactttggcttcagcaacctcttcaccccaggccagctgctgaagacctggtgtggcagccccccctatgctgcccctgagctgtttgagggcaaggagtatgatggccccaaggtggacatctggagcctgggcgtggtgctgtatgtgctggtgtgtggggccctgccctttgatggcagcaccctgcagaacctgcgggcccgggtgctgagcggcaagttccgcatccccttcttcatgagcacagaatgtgagcacctgatccgccacatgctggtgctggaccccaacaagaggctgtccatggagcagatctgcaagcacaagtggatgaagctgggagatgctgaccccaactttgaccggctgattgctgagtgccagcagctgaaggaggagcggcaggtggaccccctgaatgaagatgtgctgctggccatggaggacatgggcctggacaaggagcagaccctgcaggccgagcaggccggcacagccatgaacatctctgtgccccaggtgcagctgatcaaccctgagaaccagatcgtggagccagatggcaccctgaacctggacagtgatgaaggagaggagcccagccctgaggccctggtgcgctacctgtccatgaggaggcacacagtgggcgtggccgaccccaggacagaggtgatggaggacctgcagaagctgctgcccggcttccctggggtgaacccccaggcccccttcctgcaggtggccccaaatgtgaacttcatgcacaacctgctgcccatgcagaacctgcagcccaccggccagctggagtacaaggagcagagcctgctgcagccccccaccctgcagctgctgaatggcatgggccccctgggccggcgggccagtgatggaggagccaacatccagctgcacgcccagcagctgctgaagaggccccggggccccagccccctggtgaccatgaccccagctgtgcctgctgtgacccctgtggatgaggagagcagtgatggagagccagaccaggaggccgtgcagcgctacctggccaacagaagcaagaggcacaccctggccatgaccaaccccacagctgagatccccccagacctgcagaggcagctgggccagcagcccttccgcagccgggtgtggccaccccacctggtgcctgaccagcacaggagcacctacaaggacagcaacaccctgcacctgcccacagagcgcttcagccctgtgcggcgcttcagtgatggagctgccagcatccaggccttcaaggcccacctggagaagatgggcaacaacagcagcatcaagcagctgcagcaggagtgtgagcagctgcagaagatgtatggaggccagattgatgagaggaccctggagaagacccagcagcagcacatgctgtaccagcaggagcagcaccaccagatcctgcagcagcagatccaggacagcatctgccccccccagcccagcccccccctgcaggccgcctgtgagaaccagcctgccctgctgacccaccagctgcagaggctgcgcatccagcccagcagccccccacccaaccaccccaacaaccacctgttccggcagcccagcaacagccccccacccatgagcagcgccatgatccagccccacggggccgccagcagcagccagttccagggcctgcccagccgcagcgccatcttccagcagcagcctgagaactgcagcagcccccccaacgtggccctgacctgcctgggcatgcagcagcctgcccagagccagcaggtgaccatccaggtgcaggagcctgtggacatgctgagcaacatgcctggaacagctgctggcagcagcggccggggcatcagcatcagccccagcgctggccagatgcagatgcagcacaggaccaacctgatggccaccctgtcctatggccaccggcccctgagcaagcagctgtctgctgacagcgctgaggcccacagcgcccaccagcagcccccccactacaccaccagcgccctgcagcaggccctgctgagccccaccccaccagactacaccaggcaccagcaggtgccccacatcctgcagggcctgctgagccccaggcacagcctgaccggccacagcgacatccggctgcccccaacagaatttgcccagctgatcaagaggcagcagcagcagaggcagcagcagcagcagcagcagcagcagcaggagtaccaggagctgttccgccacatgaaccagggagatgctggcagcctggcccccagcctgggcggccagagcatgacagagcggcaggccctgagctaccagaatgctgacagctaccaccaccacaccagcccccagcacctgctgcagatccgggcccaggagtgtgtgtcccaggccagcagccccaccccacctcatggctacgcccaccagcctgccctgatgcacagcgagagcatggaggaggactgcagctgtgagggcgccaaggatggcttccaggacagcaagagcagcagcaccctgaccaagggctgccacgacagccccctgctgctgagcactggaggccctggggaccctgagagcctgctgggcaccgtgtcccatgcccaggagctgggcatccacccctacggccaccagcccacagctgccttcagcaagaacaaggtgcccagccgggagcccgtcatcggcaactgcatggacaggagcagccctggccaggccgtggagctgcctgaccacaacggcctgggctacccagcccggcccagcgtgcatgagcaccaccggccccgggccctgcagaggcaccacaccatccagaacagtgatgatgcctacgtgcagctggacaacctgcccggcatgagcctggtggccggcaaggccctgagcagcgccaggatgtctgatgctgtgctgagccagagcagcctgatgggcagccagcagttccaggatggagaaaatgaggagtgtggggccagcctgggcggccacgagcacccagacctgagtgatggcagccagcacctgaacagcagctgctaccccagcacctgcatcacagacatcctgctgagctacaagcaccctgaggtgtccttctccatggagcaggccggcgtgtag

SEQ ID NO: 22440 - DNA, 2046 bp, Artificial Sequence
  Description of Artificial Sequence: Synthetic coding sequence
atgattgagaagatgcagggcagcaggatggatgagcagcgctgcagcttccccccacccctgaagacagaggaggactacatcccctaccccagcgtgcatgaggtgctgggccgggagggccccttccccctcatcctgctgccccagtttggaggctactggattgagggcaccaaccacgagatcaccagcatccctgagacagagcccctgcagagccccaccaccaaggtgaagctggagtgcaaccccacagcccgcatctacaggaagcacttcctgggcaaggagcacttcaactactacagcctggatgctgccctgggccacctggtgttcagcctgaagtatgatgtgattggagaccaggagcacctgcggctgctgctgcggaccaagtgcaggacctaccatgatgtgatccccatcagctgcctgacagagttccccaacgtggtgcagatggccaagctggtgtgtgaagatgtgaatgtggaccgcttctaccctgtgctgtaccccaaggccagccggctgattgtgacctttgatgaacatgtgatcagcaacaacttcaagtttggagtcatctaccagaagctgggccagaccagcgaggaggagctgttcagcaccaatgaggagagccctgcctttgtggagttcctggagttcctgggccagaaggtgaagctgcaggacttcaagggcttccggggcggcctggatgtgacccacggccagacaggaacagagagcgtgtactgcaacttcaggaacaaggagatcatgtttcatgtgtccaccaagctgccctacacagaaggagatgcccagcagctgcagaggaagaggcacatcggaaatgacatcgtggccgtggtgttccaggatgagaacaccccatttgtgcctgacatgattgccagcaacttcctgcacgcctacgtggtggtgcaggccgagggcggcggcccagatggccccctgtacaaggtgtctgtgacagccagagatgatgtgcccttctttggaccacccctgcctgaccctgctgtgttcagaaaaggacctgagttccaggagttcctgctgaccaagctgatcaatgcagaatatgcctgctacaaggccgagaagtttgccaagctggaggagaggaccagggctgccctgctggagaccctgtatgaggagctgcacatccacagccagagcatgatgggcctgggcggagatgaggacaagatggagaatggcagcggcggcggcggcttctttgagagcttcaagagggtcatccgcagccgcagccagagcatggatgccatgggcctgagcaacaagaagcccaacacagtgtccaccagccacagcggcagctttgcccccaacaacccagacctggccaaggccgccggcatcagcctgctgatccctgggaagagcgccagccgcttcggccggcggggcagcgccatcggcattggaacagtggaggagagcctgattgtgcctgggaagagccccaccaggaagaagagcggccccttcggcagccgccgcagcagcgccatcggcatcgagaacatccaggaggtgcaggagaagcgggagagccccccagctggccagaagaccccagattctggccacgtgtcccaggagcccaagtctgagaacagcagcacccagagcagccctgagatgcccaccaccaagaacagagctgagacagctgcccagagagctgaggccctgaaggacttcagccgcagcagcagcagcgccagcagctttgcctctgtggtggaggagacagagggcgtggatggagaggacaccggcctggagagcgtgagcagcagcggcaccccccacaagagggacagcttcatctacagcacctggctggaggacagcgtgtccaccaccagcggcggcagcagcccagatgctgggaagctgggggaccctgcctgcccagagatcaagatccagctggaggccagcgagcagcacatgccccagctgggctgctag

SEQ ID NO: 22441 - DNA, 675 bp, Artificial Sequence
  Description of Artificial Sequence: Synthetic coding sequence
atgtctgtgggctacgccaacggcatccgggtgatgtccatgacccacactggagagcccggcttcatgctgtacatccccatcgagtatgccctgcacgtgtacaatgaggtgatgtctgtgggccagaagtatggcatcagaaatgccggctactatgccctgcggagcctgcgcatcgagaagttctttgccttctggggccaggacatcaacaacctgaccacccccctggagtgtggccgggagagccgggtgaagctggagaagggcatggacttcatcggcagagatgccctgctgcagcagaagcagaatggagtgtacaagaggctgaccatgttcatcctggatgaccatgacagcgacctggacctgtggccctggtggggcgagcccatctacagaaatggccagtatgtgggcaagaccaccagcagcgcctacagctacagcctggagcggcacgtgtgcctgggctttgtgcacaacttctctgaagatactggagaggagcaggtggtgacagctgacttcatcaacagaggagaatatgaaattgatattgctggctaccgcttccaggccaaggccaagctgtaccctgtggccagcctcttcacccagaagaggaggaaggatgacatggagctgagtgacctgcacggcaagtag

SEQ ID NO: 22442 - DNA, 1590 bp, Artificial Sequence
  Description of Artificial Sequence: Synthetic coding sequence
atgcacttcagcggcctggaggaggccgtgtacagaaacatccaggcctgcaaggagctggcccagaccaccaggacagcctacggccccaacggcatgaacaagatggtgatcaaccacctggagaagctgtttgtgaccaatgatgctgccaccatcctgcgggagctggaggtgcagcaccctgctgccaagatgattgtgatggccagccacatgcaggagcaggaggtgggagatggcaccaactttgtgctggtgtttgctggggccctgctggagctggccgaggagctgctgcgcatcggcctgtctgtgtctgaggtgattgagggctatgaaattgcctgcaggaaggcccacgagatcctgcccaacctggtgtgctgcagcgccaagaacctgcgggacattgatgaggtgagcagcctgctgcggaccagcatcatgagcaagcagtatggaaatgaggtgttcctggccaagctgattgcccaggcctgtgtgtccatcttcccagattctggccacttcaacgtggacaacatccgggtgtgcaagatcctgggcagcggcatcagcagcagctctgtgctgcacggcatggtgttcaagaaggagacagaaggagatgtgacctctgtgaaggatgccaagattgctgtgtacagctgcccctttgatggcatgatcacagagaccaagggcaccgtgctgatcaagacagctgaggagctgatgaacttcagcaaaggagaggagaacctgatggatgcccaggtgaaggccatcgctgacacaggagccaacgtggtggtgactggaggcaaggtggccgacatggccctgcactacgccaacaagtacaacatcatgctggtgcggctgaacagcaagtgggacctgcggcggctgtgcaagacagtgggcgccacagccctgccccggctgaccccacctgtgctggaggagatgggccactgtgacagcgtgtacctgtctgaggtgggggacacccaggtggtggtgttcaagcatgagaaggaggatggagccatcagcaccatcgtgctgcggggcagcacagacaacctgatggatgacatcgagagagctgtggatgatggagtgaacaccttcaaggtgctgacccgggacaagaggctggtgcctgggggcggggccacagaaattgagctggccaagcagatcaccagctatggagagacctgccccggcctggagcagtatgccatcaagaagtttgctgaggcctttgaggccatcccccgggccctggctgaaaattctggagtgaaggccaatgaggtgatcagcaagctgtatgctgtgcaccaggagggcaacaagaatgtgggcctggacattgaagctgaggtgcctgctgtgaaggacatgctggaggccggcatcctggacacctacctgggcaagtactgggccatcaagctggccaccaatgctgctgtgacagtgctgcgggtggaccagatcatcatggccaagccagctgggggccccaagccacccagcggcaagaaggactgggatgatgaccagaatgactag

SEQ ID NO: 22443 - DNA, 2193 bp, Artificial Sequence; identical to SEQ ID NO: 18385
  Description of Artificial Sequence: Synthetic coding sequence

SEQ ID NO: 22444 - DNA, 2271 bp, Artificial Sequence
  Description of Artificial Sequence: Synthetic coding sequence
atggtggcccctgtgctggagaccagccacgtgttctgctgccccaacagagtgcggggcgtgctgaactggagcagcggcccccggggcctgctggccttcggcaccagctgcagcgtggtgctgtatgaccccctgaagagggtggtggtgaccaacctgaatggccacacagcccgggtgaactgcatccagtggatctgcaagcaggacggcagccccagcacagagctggtgtctgggggcagtgacaaccaggtgatccactgggagattgaggacaaccagctgctgaaggctgtgcacctgcagggccacgagggccctgtgtatgctgtgcatgctgtgtaccagaggaggaccagtgaccctgccctgtgcaccctcatcgtgtctgctgctgctgacagcgctgtgcggctgtggagcaagaagggccctgaggtgcccatcctggcctgtggaaatgatgactgccgcatccacatctttgcccagcagaatgaccagttccagaaggtgctgagcctgtgtggccacgaggactggatccggggcgtggagtgggccgccttcggccgggacctcttcctggccagctgcagccaggactgcctgatccgcatctggaagctgtacatcaagagcaccagcctggagacccaggatgatgacaacatccggctgaaggagaacaccttcaccattgaaaatgaatctgtgaagatcgcctttgctgtgaccctggagaccgtgctggccggccacgagaactgggtgaatgctgtgcactggcagcctgtgttctacaaggatggagtgctgcagcagcctgtgcggctgctgagcgcctccatggacaagaccatgatcctgtgggccccagatgaggagagcggcgtgtggctggagcagcgggagtggaccccagagatcgtcatcagcggccactttgatggagtgcaggacctggtgtgggaccctgagggggagttcatcatcaccgtgggcacagaccagaccacccggctgtttgccccctggaagaggaaggaccagagccaggtgacctggcatgaaattgcccggccccagatccacggctatgacctgaagtgcctggccatgatcaaccgcttccagtttgtgtctggagcagatgagaaggtgctgcgggtcttcagcgcccccaggaactttgtggagaacttctgtgccatcaccggccagagcctgaaccacgtgctgtgcaaccaggacagcgacctgcctgagggcgccaccgtgcctgccctgggcctgagcaacaaggctgtgttccagggcgacatcgccagccagcccagtgatgaggaggagctgctgaccagcacaggctttgagtaccagcaggtggccttccagcccagcatcctgacagagcccccaacagaggaccacctgctgcagaacaccctgtggccagaggtgcagaagctgtatggccacggctatgagatcttctgtgtgacctgcaacagcagcaagaccctgctggccagcgcctgcaaggccgccaagaaggagcacgccgccatcatcctgtggaacaccacctcctggaagcaggtgcagaacctggtgttccacagcctgactgtgacccagatggccttcagccccaatgagaagttcctgctggccgtgtcccgggacaggacctggagcctgtggaagaagcaggacaccatcagccctgagtttgagcctgtgttcagcctgtttgccttcaccaacaagatcacctctgtgcacagccgcatcatctggagctgtgactggagcccagacagcaagtacttcttcaccggcagccgggacaagaaggtggtggtgtggggagaatgtgacagcacagatgactgcatcgagcacaacatcggcccctgcagctctgtgctggatgtgggcggcgctgtgacagctgtgtctgtgtgccctgtgctgcaccccagccagcgctacgtggtggccgtgggcctggagtgtgggaagatctgcctgtacacctggaagaagacagaccaggtgcctgagatcaatgactggacccactgtgtggagaccagccagagccagagccacaccctggccatcaggaagctgtgctggaagaactgcagcggcaagacagagcagaaggaggccgagggcgctgagtggctgcactttgccagctgtggggaggaccacacagtgaagatccaccgggtgaacaagtgtgccctgtag

SEQ ID NO: 22445 - DNA, 1272 bp, Artificial Sequence
  Description of Artificial Sequence: Synthetic coding sequence
atgaaccggcagcctgtgaaggacaggaaggccccctggatcccccccaaccccaccagccccccagccagccccaagtgtgccgcctggctgaaggtgaagaccagccccagagatgccaccaaggagcccctgcagcaggaggacccccaggaggagagccacctgactggagctgtggagcacgaggccgcccggctggcctggctggatgctgagaccagcaagaggctgaaggagctggaggagctgaaggccaaggagattgacagcatgcagaagcagaggctggactggctggatgctgagaccagcaggaggaccaaggagctgaatgagctgaaggccgaggagatgtaccgcctgcagcagctgtctgtgtctgccacccacctggccgacaaggtggaggaggccgtgctggaccggctgaagcccctgctggtgaaggcccagagggtgaacagcaccacagaggccaacatccacctgaaggatggcagctctgtgaacacagccaaggcccagcctgcccaggaggtggccgctgtggactttgagagcaacaacatccggcagctggatgacttcctggaggactgtgccagcgagctgtgggccgtgacccacgccaagatcctgggcagcgagaccctggccaccgtggaggacagcaaggacagcccagacctggagatcatgatgaggaggatggaggagatggagaagtaccaggagagcgtgcggcagcgctacaacaagatcgcctatgctgacccccggctgtggatgcaggaggagaacaatgaccagaagatcagcgccatcagcgagaagcccctgagcccccaccccatccgcatcaccaagacagtggacaggaaggaccctgctgtgaacatcatgctggagcggccctgcaatggaaacagcctggatgaatctgtgggcacagaggagggcagcgagaagcgggaggcccccctgctgagcctggccgaggacagccagcagaaggagggccgggcccccctgtttgtgcccccaggcatgcagcacagcattggagactactgcagcagatttgagcagtacctgcgcatcatcagccatgaagctgtgggcagcttcaacccctggctgattgctgagagcttcagcgaggagctggtggatgaggccctgggcgctgtggccgctgagctgcaggacatgtgtgaagattatgcagaggccgtgttcaccagcgagttcctggaggccgccacctag

SEQ ID NO: 22446 - DNA, 777 bp, Artificial Sequence
  Description of Artificial Sequence: Synthetic coding sequence
atggcccggctgcaggaggagcacggggaccagctgctgagcatccgctgccagcaccaggagcaggtggaggacctgacagccagccatgatgctgccctgctggagatggagaacaaccacacagtggccatcaccatcctgcaggatgaccatgaccacaaggtgcaggagctgatgagcacccatgagctggagaagaaggagctggaggagaactttgagaagctgcggctgagcctgcaggaccaggtggacaccctgaccttccagagccagagcctgcgggaccgggccaggagatttgaggaggccctgaggaagaacacagaggagcagctggagatcgccctggccccctaccagcacctggaggaggacatgaagagcctgaagcaggtgctggagatgaagaaccagcagatccacgagcaggagaagaagatcctggagctggagaagctggccgagaagaacatcatcctggaggagaagatccaggtgctgcagcagcagaatgaagacctgaaggccagaattgaccagaacacagtggtgacccggcagctgtctgaagaaaatgccaacctgcaggagtatgtggagaaggagacccaggagaagaagaggctgagcaggaccaatgaggagctgctgtggaagctgcagacaggagaccccaccagccccatcaagctgagccccaccagccctgtgtaccggggcagcagcagcggccccagcagccctgcccgggtgtccaccacccccaggtag

SEQ ID NO: 22447 - DNA, 1053 bp, Artificial Sequence
  Description of Artificial Sequence: Synthetic coding sequence
atgtgccccaccaccacctggccccggggccgccgctggagcaggaacctgcgggacacccaggccgtgcgccactacaagatctggaggcgggccggcggccgcctgcacctgaatgaagctgtgtccttcctgagcctgcctgagctggtgaactaccaccgggcccagagcctgagccacggcctgcggctggccgccccctgcaggaagcatgagcctgagcccctgccccactgggatgactgggagcggccccgggaggagttcaccctgtgcaggaagctgggcagcggctactttggagaggtgtttgagggcctgtggaaggacagagtgcaggtggccatcaaggtgatcagccgggacaacctgctgcaccagcagatgctgcagagcgagatccaggccatgaagaagctgcggcacaagcacatcctggccctgtatgctgtggtgtctgtgggggaccctgtgtacatcatcacagagctgatggccaagggcagcctgctggagctgctgcgggacagtgatgagaaggtgctgcctgtgtctgagctgctggacatcgcctggcaggtggccgagggcatgtgctacctggagagccagaactacatccaccgggacctggccgccaggaacatcctggtgggggagaacaccctgtgcaaggtgggggactttggcctggcccggctcatcaaggaggatgtgtacctgagccatgaccacaacatcccctacaagtggacagcccctgaggccctgagccggggccactacagcaccaagagtgatgtgtggagctttggcatcctgctgcacgagatgttcagccggggccaggtgccctacccaggcatgagcaaccacgaggccttcctgcgggtggatgctggctacaggatgccctgccccctggagtgcccccccagcgtgcacaagctgatgctgacctgctggtgccgggaccctgagcagaggccctgcttcaaggccctgcgggagcggctgagcagcttcaccagctatgagaaccccacctag

SEQ ID NO: 22448 - DNA, 3480 bp, Artificial Sequence
  Description of Artificial Sequence: Synthetic coding sequence
atggtgagcagcagccccagcacccccagcaacatcccccagaagcccagccagcctgctgccaaggagcccagcgccaccccacccatcagcaacctgaccaagacagccagcgagagcatcagcaacctgtctgaggccggcagcatcaagaagggggagcgggagctgaagattggagacagagtgctggtgggcggcaccaaggccggcgtggtgcgcttcctgggggagacagactttgccaagggggagtggtgtggggtggagctggatgagcccctgggcaagaatgatggagctgtggccggcacccgctacttccagtgccagcccaagtatggcctgtttgcccctgtgcacaaggtgaccaagattggcttccccagcaccaccccagccaaggccaaggccaatgctgtgcggcgggtgatggccaccaccagcgccagcctgaagaggagccccagcgccagcagcctgagctccatgagctctgtggccagctctgtgagcagccggcccagcaggacaggcctgctgacagagaccagcagccgctatgccaggaagatcagcggcaccacagccctgcaggaggccctgaaggagaagcagcagcacatcgagcagctgctggccgagcgggacctggagagagctgaggtggccaaggccaccagccacgtgggggagattgagcaggagctggccctggccagagatggccatgaccagcacgtgctggagctggaggccaagatggaccagctgcggaccatggtggaggccgctgaccgggagaaggtggagctgctgaaccagctggaggaggagaagaggaaggtggaggacctgcagttccgggtggaggaggagagcatcaccaagggggacctggagacccagaccaagctggagcacgcccgcatcaaggagctggagcagagcctgctgtttgagaagaccaaggctgacaagctgcagcgggagctggaggacaccagggtggccaccgtgtctgagaagagccgcatcatggagctggagaaggacctggccctgcgggtgcaggaggtggccgagctgcggcggcggctggagagcaacaagccagctggagatgtggacatgagcctgagcctgctgcaggagatcagcagcctgcaggagaagctggaggtgaccaggacagaccaccagcgggagatcaccagcctgaaggagcactttggagcccgggaggagacccaccagaaggagatcaaggccctgtacacagccacagagaagctgagcaaagaaaatgaaagcctgaagagcaagctggagcacgccaacaaggaaaattctgatgtgattgccctgtggaagagcaagctggagacagccatcgccagccaccagcaggccatggaggagctgaaggtgtccttcagcaagggcctgggcacagaaacagctgagtttgctgagctgaagacccagatcgagaagatgaggctggactaccagcacgagattgagaacctgcagaaccagcaggacagcgagcgggccgcccacgccaaggagatggaggccctgcgggccaagctgatgaaggtgatcaaggagaaggagaacagcctggaggccatccgcagcaagctggacaaggccgaggaccagcacctggtggagatggaggacaccctgaacaagctgcaggaggccgagatcaagaaggagaagtttgctgaggccagcgaggaggccgtgtctgtgcagaggtccatgcaggagaccgtgaacaagctgcaccagaaggaggagcagttcaacatgctgagcagtgacctggagaagctgcgggagaacctggccgacatggaggccaagttccgggagaaggatgagcgggaggagcagctgatcaaggccaaggagaagctggagaatgacattgctgagatcatgaagatgtctggggacaacagcagccagctgaccaagatgaatgatgagctgcggctgaaggagagagatgtggaggagctgcagctgaagctgaccaaggccaatgaaaatgccagcttcctgcagaagagcattgaggacatgacagtgaaggccgagcagagccagcaggaggccgccaagaagcatgaggaggagaagaaggagctggagaggaagctgagtgacctggagaagaagatggagaccagccacaaccagtgccaggagctgaaggcccgctatgaaagagccaccagcgagaccaagaccaagcatgaggagatcctgcagaacctgcagaagaccctgctggacacagaggacaagctgaagggggcccgggaggagaacagcggcctgctgcaggagctggaggagctgaggaagcaggccgacaaggccaaggccgcccagacagcagaagatgccatgcagatcatggagcagatgaccaaggagaagacagagaccctggccagcctggaggacaccaagcagaccaatgccaagctgcagaatgagctggacaccctgaaggagaacaacctgaagaatgtggaggagctgaacaagagcaaggagctgctgactgtggagaaccagaagatggaggagttcaggaaggagattgagaccctgaagcaggccgccgcccagaagagccagcagctgagcgccctgcaggaggagaatgtgaagctggccgaggagctgggccgcagcagagatgaggtgaccagccaccagaagctggaggaggagaggtctgtgctgaacaaccagctgctggagatgaagaagcgggagagcaagttcatcaaggatgctgatgaggagaaggccagcctgcagaagagcatcagcatcaccagcgccctgctgacagagaaggatgctgagctggagaagctgagaaatgaggtgacagtgctgcggggagaaaatgccagcgccaagagcctgcacagcgtggtgcagaccctggagagtgacaaggtgaagctggagctgaaggtgaagaacctggagctgcagctgaaggagaacaagaggcagctgagcagcagcagcggcaacacagacacccaggctgatgaagatgagcgggcccaggagagccagaaccagattgacttcctgaacagcgtgattgtggacctgcagaggaagaaccaggacctgaagatgaaggtggagatgatgtctgaggccgccctgaatggaaatggagatgacctgaacaactatgacagtgatgaccaggagaagcagagcaagaagaagcccaggctcttctgtgacatctgtgactgctttgacctgcatgacacagaggactgccccacccaggcccagatgtctgaggaccccccccacagcacccaccacggcagcagaggagaggagcggccctactgtgagatctgtgagatgtttggccactgggccaccaactgcaatgatgatgagaccttctag

SEQ ID NO: 22449 - DNA, 756 bp, Artificial Sequence
  Description of Artificial Sequence: Synthetic coding sequence
atgaccacagagcagaggaggagcctgcaggccttccaggactacatcaggaagaccctggaccccacctacatcctgagctacatggccccctggttccgggaggaggaggtgcagtacatccaggccgagaagaacaacaagggccccatggaggccgccaccctcttcctgaagttcctgctggagctgcaggaggagggctggttccggggcttcctggatgccctggaccacgccggctacagcggcctgtatgaggccattgaatcctgggacttcaagaagattgagaagctggaggagtaccgcctgctgctgaagaggctgcagcctgagttcaagacccgcatcatccccacagacatcatcagtgacctgtctgaatgtctcatcaaccaggagtgtgaggagatcctgcagatctgcagcaccaagggcatgatggccggggctgagaagctggtggagtgcctgctgcggagtgacaaggagaactggcccaagaccctgaagctggccctggagaaggagaggaacaagttcagcgagctgtggatcgtggagaagggcatcaaggatgtggagacagaggacctggaggacaagatggagaccagtgacatccagatcttctaccaggaggaccctgagtgccagaacctgtctgagaacagctgcccccccagcgaggtgtctgacaccaacctgtacagccccttcaagcccatcaagaagaagaagaagaagaagtag

SEQ ID NO: 22450 - DNA, 3189 bp, Artificial Sequence; identical to SEQ ID NO: 21531
  Description of Artificial Sequence: Synthetic coding sequence

SEQ ID NO: 22451 - DNA, 363 bp, Artificial Sequence
  Description of Artificial Sequence: Synthetic coding sequence
atgtggagcattgaaaatattgcctttggaagtggcggcggcctgctgcagaagctgacccgggacctgctgaactgcagcttcaagtgcagctatgtggtgaccaacggcctgggcatcaacgtgttcaaggaccctgtggccgaccccaacaagaggagcaagaagggccgcctgagcctgcacaggaccccagctggcaactttgtgaccctggaggagggcaagggggacctggaggagtatggccaggacctgctgcacacagtgttcaagaatggcaaggtgaccaagagctacagctttgatgagatcaggaagaatgcccagctgaacatcgagctggaggccgcccaccactag

SEQ ID NO: 22452 - DNA, 936 bp, Artificial Sequence
  Description of Artificial Sequence: Synthetic coding sequence
atgtaccacctggacaaccaccctgagaagcagttcagcacagatgtgctgaagcaggccatcgagctgagcccagacaaccagtatgtgaaggtgctgctgggcctgaagctgcagaagatgaacaaggaggccgagggggagcagtttgtggaggaggccctggagaagagcccctgccagacagatgtgctgcggtctgctgccaagttctacagaagaaaaggagacctggacaaggccatcgagctgttccagagggtgctggagagcacccccaacaacggctacctgtaccaccagatcggctgctgctacaaggccaaggtgcggcagatgcagaacacaggagagagcgaggccagcggcaacaaggagatgattgaggccctgaagcagtatgccatggactacagcaacaaggccctggagaagggcctgaaccccctgaatgcctacagcgacctggccgagttcctggagacagagtgctaccagacccccttcaacaaggaggtgcctgatgctgagaagcagcagagccaccagcgctactgcaacctgcagaagtacaacgggaagtctgaggacacagctgtgcagcacggcctggagggcctgagcatcagcaagaagagcacagacaaggaggagatcaaggaccagccccagaatgtgtctgagaacctgctgccccagaatgcccccaactactggtacctgcagggcctcatccacaagcagaatggagacctgctgcaggccgccaagtgctatgagaaggagctgggccgcctgctgagagatgcccccagcggcatcggcagcatcttcctgagcgccagcgagctggaggatggcagcgaggagatgggccagggcgctgtgagcagcagcccccgggagctgctgagcaacagcgagcagctgaactag

SEQ ID NO: 22453 - DNA, 3267 bp, Artificial Sequence
  Description of Artificial Sequence: Synthetic coding sequence
atgtatggcagcgcccggtctgtgggcaaggtggagcccagcagccagagccctggccgcagcccccggctgcccaggagcccccggctgggccacaggaggaccaacagcactggaggcagcagcggcagctctgtgggcggcggcagcggcaagaccctgtccatggagaacatccagagcctgaatgctgcctatgccaccagcggccccatgtacctgagtgaccatgaaaatgtgggcagcgagacccccaagagcaccatgaccctgggccgcagcggcggccgcctgccctacggcgtgaggatgacagccatgggcagcagccccaacatcgccagcagcggcgtggccagtgacaccatcgcctttggagagcaccacctgccccctgtgtccatggccagcacagtgccccacagcctgcggcaggcccgggacaacaccatcatggacctgcagacccagctgaaggaggtgctgcgggagaatgacctgctgaggaaggatgtggaggtgaaggagagcaagctgagcagctccatgaacagcatcaagaccttctggagccctgagctgaagaaggagcgggccctgaggaaggatgaggccagcaagatcaccatctggaaggagcagtacagagtggtgcaggaggagaaccagcacatgcagatgaccatccaggccctgcaggatgagctgcgcatccagagggacctgaaccagctgttccagcaggacagcagcagcaggactggagagccctgtgtggccgagctgacagaggagaacttccagaggctgcacgccgagcacgagcggcaggccaaggagctgttcctgctgaggaagaccctggaggagatggagctgagaattgagacccagaagcagaccctgaatgccagagatgagagcatcaagaagctgctggagatgctgcagagcaagggcctgagcgccaaggccacagaggaggaccacgagaggacccggcggctggccgaggccgagatgcacgtgcaccacctggagagcctgctggagcagaaggagaaggagaacagcatgctgcgggaggagatgcacagaagatttgaaaatgccccagacagcgccaagaccaaggccctgcagaccgtcatcgagatgaaggacagcaagatcagctccatggagcggggcctgcgggacctggaggaggagatccagatgctgaagagcaatggagccctgagcacagaggagcgggaggaggagatgaagcagatggaggtgtaccgcagccacagcaagttcatgaagaacaagattggccaggtgaagcaggagctgagcaggaaggacacagagctgctggccctgcagaccaagctggagaccctgaccaaccagttcagtgacagcaagcagcacatcgaggtgctgaaggagagcctgacagccaaggagcagagagctgccatcctgcagacagaggtggatgccctgcggctgcggctggaggagaaggagaccatgctgaacaagaagaccaagcagatccaggacatggccgaggagaagggcacccaggccggggagatccatgacctgaaggacatgctggatgtgaaggagaggaaggtgaatgtgctgcagaagaagattgagaacctgcaggagcagctgcgggacaaggagaagcagatgagcagcctgaaggagcgggtgaagagcctgcaggccgacaccaccaacacagacacagccctgaccaccctggaggaggccctggccgagaaggagaggaccatcgagcggctgaaggagcagagggacagagatgagcgggagaagcaggaggagattgacaactacaagaaggacctgaaggacctgaaggagaaggtgtccctgctgcagggcgacctgtctgagaaggaggccagcctgctggacctgaaggagcacgccagcagcctggccagcagcggcctgaagaaggacagccggctgaagaccctggagatcgccctggagcagaagaaggaggagtgcctgaagatggagagccagctgaagaaggcccatgaagctgccctggaggcccgggccagccctgagatgtctgaccgcatccagcacctggagcgggagatcacccgctacaaggatgagagcagcaaggcccaggccgaggtggaccggctgctggagatcctgaaggaggtggagaatgagaagaatgacaaggacaagaagattgctgagctggagcggcaggtgaaggaccagaacaagaaggtggccaacctgaagcacaaggagcaggtggagaagaagaagagcgcccagatgctggaggaggcccggcggcgggaggacaacctgaatgacagcagccagcagctgcaggacagcctgaggaagaaggatgacagaattgaggagctggaggaggccctgcgggagagcgtgcagatcacagctgagcgggagatggtgctggcccaggaggagagcgcccggaccaatgctgagaagcaggtggaggagctgctgatggccatggagaaggtgaagcaggagctggagagcatgaaggccaagctgagcagcacccagcagagcctggccgagaaggagacccacctgaccaacctgcgggcagagaggaggaagcacctggaggaggtgctggagatgaagcaggaggccctgctggccgccatcagcgagaaggatgccaacatcgccctgctggagctgagcagcagcaagaagaagacccaggaggaggtggccgccctgaagcgggagaaggaccggctggtgcagcagctgaagcagcagacccagaacaggatgaagctgatggctgacaactatgaagatgaccacttcaagagcagccacagcaaccagaccaaccacaagcccagcccagaccagatcatccagcccctgctggagctggaccagaacagaagcaagctgaagctgtacatcggccacctgaccaccctgtgccacgaccgggaccccctcatcctgcggggcctgaccccaccagccagctacaacctggatgatgaccaggccgcctgggagaatgagctgcagaagatgacccggggccagctgcaggatgagctggagaagggggagcgggacaatgctgagctgcaggagtttgccaatgccatcctgcagcagattgctgaccactgcccagacatcctggagcaggtggtgaatgccctggaggagagcagctag

SEQ ID NO: 22454 - DNA, 1485 bp, Artificial Sequence
  Description of Artificial Sequence: Synthetic coding sequence
atgaagctggtgaacctgtacaagggagctgtgctgtacctgctgcggggcaggaagaccttcctgatccctgtgctcttcaacaactacatcacagctgccctgaagctgctggagaagctgtacaaggtgaacctgaaggtgaagcacgtggagtatgacaccttctacatccctgagatcagcaacctggtggacatccaggaggactacctgatgtggttcctgcaccaggccggcatgaaggcccggcccagcatcatccaggacacagtgaccctgtgcagctaccccttcatctttgatgcccaggccaagaccaagatgctgcagacagatgctgagctgcagatgcaggtggccgtgaatggagccaacctgcagaatgtgttcatgctgctgaccctggagcccctgctggcccggagccccttcctggtgctgcacgtgagaagaaacaacctggtgggagatgccctgcgggagctgagcatccacagcgacatcgacctgaagaagcccctgaaggtgatctttgatggagaggaggccgtggatgctggaggagtgaccaaggagttcttcctgctgctgctgaaggagctgctgaaccccatctacggcatgttcacctactaccaggacagcaacctgctgtggttcagtgacacctgctttgtggagcacaactggttccacctgattggcatcacctgtggcctggccatctacaacagcacagtggtggacctgcacttccccctggccctgtacaagaagctgctgaatgtgaagccaggcctggaggacctgaaggagctgagccccacagagggccgcagcctgcaggagctgctggactacccaggagaagatgtggaggagaccttctgcctgaacttcaccatctgccgggagagctatggagtgattgagcagaagaagctgatccctggaggagacaacgtgacagtgtgcaaggacaaccggcaggagtttgtggatgcctacgtgaactacgtgttccagatctctgtgcatgagtggtacacagccttcagcagcggcttcctgaaggtgtgtggcggcaaggtgctggagctgttccagcccagcgagctgcgggccatgatggtgggcaacagcaactacaactgggaggagctggaggagacagccatctacaagggggactacagcgccacccaccccaccgtgaagctgttctgggagaccttccacgagttccccctggagaagaagaagaagttcctgctcttcctgactggaagtgaccgcatccccatctacggcatggccagcctgcagatcgtcatccagagcacagccagcggggaggagtacctgcctgtggcccacacctgctacaacctgctggacctgcccaagtacagcagcaaggagatcctgagcgcccggctgacccaggccctggacaactatgagggcttcagcctggcctag

SEQ ID NO: 22455 - DNA, 2370 bp, Artificial Sequence
  Description of Artificial Sequence: Synthetic coding sequence
atgtgccccagcagccagagcccccggccccccctgctgcggcccccctgcagctaccgggaggtgcccagctctgtgcagagccctgcccagcagcaggtgcctgcccggcctggggcccccagcgtgcaggtgcccagccccttcctgctgcagaaccagtatgagcctgtgcagccccactggttctactgcaaggaggtggagtacaagcagctgtggatgcccttctctgtgtttgacagcctgaacctggaggagatctacaacagcgtgcagcctgaccctgagagcgtggtgctgggcacagatggcggccgctatgatgtgtacctgtatgaccgcatcaggaaggccgcctactgggaggaggagcctgctgaggtgcggcgctgcacctggttctacaagggggacacagacagccgcttcatcccctacacagaggagttcagcgagaagctggaggccgagtacaagaaggctgtgaccaccaaccagtggcaccggcggctggagttccccagcggggagaccatcgtgatgcacaaccccaaggtgattgtgcagttccagcccagctctgtgcctgatgagtggggcaccacccaggacggccagacccggccccgggtggtgaagaggggcattgatgacaacctggatgagatcccagatggagagatgccccaggtggaccacctggtgtttgtggtgcacggcatcggccctgtgtgtgacctgcgcttccgcagcatcattgaatgtgtggatgacttccgggtggtgtccctgaagctgctgcggacccacttcaagaagagcctggatgatggcaaggtgtcccgggtggagttcctgcctgtgcactggcacagcagcctgggcggagatgccaccggggtggacaggaacatcaagaagatcaccctgcccagcatcggccgcttccgccacttcaccaatgagaccctgctggacatcctcttctacaacagccccacctactgccagaccatcgtggagaaggtgggcatggagatcaaccacctgcacgccctcttcatgagcaggaacccagacttcaagggcggcgtgtctgtggccggccacagcctgggcagcctcatcctgtttgacatcctgagcaaccagaaggacctgaacctgagcaagtgccccggccccctggccgtggccaatggagtggtgaagcagctgcacttccaggagaagcagatgcctgaggagcccaagctgaccctggatgagagctatgacctggtggtggagaacaaggaggtgctgaccctgcaggagaccctggaggccctgagcctgtctgagtacttcagcacctttgagaaggagaagattgacatggagagcctgctgatgtgcaccgtggatgacctgaaggagatgggcatccccctgggccccaggaagaagatcgccaactttgtggagcacaaggccgccaagctgaagaaggccgccagcgagaagaaggctgtggccgccaccagcaccaagggccaggagcagagcgcccagaagaccaaggacatggccagcctgcccagcgagagcaatgagcccaagaggaagctgcctgtgggcgcctgtgtgtcctctgtgtgtgtgaactatgagagctttgaggtgggcgccggccaggtgtctgtggcctacaacagcctggactttgagcctgagatcttctttgccctgggcagccccatcgccatgttcctgaccatccggggcgtggacagaattgatgagaactacagcctgcccacctgcaagggcttcttcaacatctaccaccccctggaccctgtggcctaccgcctggagcccatgattgtgcctgacctggacctgaaggctgtgctgatcccccaccacaagggcaggaagaggctgcacctggagctgaaggagagcctgagcaggatgggcagtgacctgaagcagggcttcatcagcagcctgaagagcgcctggcagaccctgaatgaatttgcccgggcccacaccagcagcacccagctgcaggaggagctggagaaggtggccaaccagatcaaggaggaggaggagaagcaggtggtggaggccgagaaggtggtggagagcccagacttcagcaaggatgaggactacctgggcaaggtgggcatgctgaatggaggaagaagaattgattatgtgctgcaggagaagcccatcgagagcttcaatgagtacctgtttgccctgcagagccacctgtgctactgggagagcgaggacacagccctgctgctgctgaaggagatctaccgcaccatgaacatcagccctgagcagccccagcactag

SEQ ID NO: 22456 - DNA, 828 bp, Artificial Sequence; identical to SEQ ID NO: 21402
  Description of Artificial Sequence: Synthetic coding sequence

SEQ ID NO: 22457 - DNA, 240 bp, Artificial Sequence
  Description of Artificial Sequence: Synthetic coding sequence
atgaatggcaccctggaccacccagaccagcctgacctggatgccatcaagatgtttgtgggccaggtgcccaggacctggagcgagaaggacctgcgggagctgtttgagcagtatggagctgtgtatgagatcaacgtgctgcgggacaggagccagaaccccccccagagcaagggctgctgctttgtgaccttctacaccaggaaggccgccctggaggcccagaatgccctgtag

SEQ ID NO: 22458 - DNA, 738 bp, Artificial Sequence
  Description of Artificial Sequence: Synthetic coding sequence
atggtgctgctgcacgtgaagagaggagatgagagccagttcctgctgcaggcccctggcagcacagagctggaggagctgactgtgcaggtggcccgggtgtacaacggccgcctgaaggtgcagaggctgtgcagcgagatggaggagctggccgagcacggcatcttcctgccccccaacatgcagggcctgacagatgaccagatcgaggagctgaagctgaaggatgagtggggcgagaagtgtgtgcccagcggcggcgctgtgttcaagaaggatgacatcggcagaagaaatggccaggccccaaatgagaagatgaagcaggtgctgaagaagaccatcgaggaggccaaggccatcatcagcaagaagcaggtggaggccggcgtgtgtgtgaccatggagatggtgaaggatgccctggaccagctgcggggagctgtgatgattgtgtaccccatgggcctgcccccctatgaccccatccgcatggagtttgagaacaaggaggacctgagcggcacccaggccggcctgaatgtcatcaaggaggccgaggcccagctgtggtgggccgccaaggagctgcggaggaccaagaagctgagtgactatgtgggcaagaatgagaagaccaagatcatcgccaagatccagcaggtgtccaccttctgcttcaacgtgtctgtggtgtttgtgatcagcctgcagacagacaagaatgtgcagtag

SEQ ID NO: 22459 - DNA, 396 bp, Artificial Sequence; identical to SEQ ID NO: 22413
  Description of Artificial Sequence: Synthetic coding sequence

SEQ ID NO: 22460 - DNA, 2517 bp, Artificial Sequence; identical to SEQ ID NO: 19107
  Description of Artificial Sequence: Synthetic coding sequence

SEQ ID NO: 22461 - DNA, 1215 bp, Artificial Sequence
  Description of Artificial Sequence: Synthetic coding sequence
atggacttcaacatgaagaagctggccagtgatgctggcatcttcttcaccagggctgtgcagttcacagaggagaagtttggccaggccgagaagacagagctggatgcccactttgagaacctgctggcccgggctgacagcaccaagaactggacagagaagatcctgcggcagacagaggtgctgctgcagcccaaccccagcgcccgggtggaggagttcctgtatgagaagctggacaggaaggtgcccagccgggtgaccaacggggagctgctggcccagtacatggctgatgctgccagcgagctgggccccaccaccccctacggcaagaccctcatcaaggtggccgaggccgagaagcagctgggcgctgctgagcgggacttcatccacacagccagcatctccttcctgacccccctgaggaacttcctggagggggactggaagaccatcagcaaggagcggcggctgctgcagaacagaaggctggacctggatgcctgcaaggcccggctgaagaaggccaaggctgctgaggccaaggccacagctgagggccccaccgtgcctgacttccaggagacccggcccaggaactacatcctgagcgccagcgccagcgccctgtggaatgatgaggtggacaaggccgagcaggagctgcgggtggcccagacagaatttgaccggcaggccgaggtgacccggctgctgctggagggcatcagcagcacccacgtgaaccacctgcgctgcctgcacgagtttgtgaagagccagaccacctactatgcccagtgctaccgccacatgctggacctgcagaagcagctgggcagcagccagggcgccatcttccctggcacctttgtgggcaccacagagcccgccagcccccccctgagcagcaccagccccaccacagctgctgccaccatgcctgtggtgcccagcgtggccagcctggcccctcctggagaggccagcctgtgcctggaggaggtggcccccccagccagcggcaccaggaaggcccgggtgctgtatgactatgaagctgctgacagcagcgagctggccctgctggctgatgagctgatcaccgtgtacagcctgcccggcatggaccctgactggctgattggagagcggggcaacaagaagggcaaggtgcctgtgacctacctggagctgctgtcctag

SEQ ID NO: 22462 - DNA, 495 bp, Artificial Sequence
  Description of Artificial Sequence: Synthetic coding sequence
atgacctgctgccagaccagcttctgtggctaccccagcttcagcatcagcggcacctgtggcagcagctgctgccagcccagctgctgtgagaccagctgctgccagcccaggagctgccagaccagcttctgtggcttccccagcttcagcaccagcggcacctgcagcagcagctgctgccagcccagctgctgtgagaccagctgctgccagcccagctgctgccagatcagcagctgtggcaccggctgcggcattggaggcggcatctcctatggccaggagggcagcagtggagctgtgtccacccgcatccgctggtgcaggccagacagccgggtggagggcacctacctgcccccctgctgcgtggtgtcctgcaccccacccagctgctgccagctgcaccacgcccaggccagctgctgccggcccagctactgcggccagagctgctgcaggcctgtgtgctgctgtgagcccacctgctag

SEQ ID NO: 22463 - DNA, 846 bp, Artificial Sequence
  Description of Artificial Sequence: Synthetic coding sequence
atgctgaccaagctgcagatcaagcagatgatggaggccgccacccggcagatcgaggagaggaagaagcagctgtccttcatcagcccccccaccccccagcccaagacccccagcagcagccagcctgagcggctgcccatcggcaacaccatccagcccagccaggccgccaccttcatgaatgatgccatcgagaaggccaggaaggctgctgagctgcaggcccgcatccaggcccagctggccctgaagccaggcctgattggaaatgccaacatggtgggcctggccaacctgcacgccatgggcatcgccccacccaaggtggagctgaaggaccagaccaagcccacccccctcatcctggatgagcagggccgcacagtggatgccaccgggaaggagattgagctgacccacaggatgcccaccctgaaggccaacatccgggctgtgaagcgggagcagttcaagcagcagctgaaggagaagcccagcgaggacatggagagcaacaccttctttgacccccgggtgtccatcgcccccagccagaggcagaggaggaccttcaagttccatgacaagggcaagtttgagaagatcgcccagaggctgcggaccaaggcccagctggagaagctgcaggccgagatcagccaggccgccaggaagacaggcatccacaccagcacccggctggccctgattgcccccaagaaggagctgaaggagggggacatccctgagattgagtggtgggacagctacatcatccccaacggctttgacctgggcaagagccaggagcggcggctcttctggaaccacaagagctgctag

SEQ ID NO: 22464 - DNA, 693 bp, Artificial Sequence
  Description of Artificial Sequence: Synthetic coding sequence
atgaggggccacgagagctctgtgttcagcatctctgtgcacgccagcggcaagtatgccatcaccaccagcagtgacacagcccagctgtgggacctggacaccttccagaggaagaggaagctgaacatccggcagagcgtgggcatccagaaggtgttcttcctgcccctgagcaacaccatcctgagctgcttcaaggacaacagcatctttgcctgggagtgtgacaccctcttctgcaagtaccagctgcctgcccctcctgagagcagcagcatcctgtacaaggtgtttgctgtgaccagagatggccgcatcctggccgccggcggcaagagcaaccacctgcacctgtggtgcctggaggcccggcagctgttccgcatcatccagatgcccaccaaggtgcgggccatccgccacctggagttcctgcctgacagctttgatgctggcagcaaccaggtgctgggcgtgctgagccaggacggcatcatgaggttcatcaacatgcagacctgcaagctgctgtttgaaattggcagcctggatgagggcatcagcagcagcgccatcagcccccacggccgctacatcgccagcatcatggagaatggcagcctgaacatctacagcgtgcaggccctgacccaggagatcaacaaggaggaggtgcgggcccagaactag

SEQ ID NO: 22465 - DNA, 1212 bp, Artificial Sequence
  Description of Artificial Sequence: Synthetic coding sequence
atggacagcaccatggatgatgctgtggccggggactttgccctgatcaacaagctggacatccagtgtgacctgaagaccctgagtgatgacatcaaggagagcctggagagcgagggcaagaacagcaagaaggaggagccccaggagctgctgcagagccaggactttgtgggggagaagctgggcagcggggagcccagccacagcgtgaaggtgcacacagtgcccaagccaggaaaaggagctgacctgagcaagccaccctgcaggaaggccaaggagatcaggaaggagaggaagaggctgaagctgatgcagcagaacccagctggggagctggagggcttccaggcccagggccacccccccagcctcttcccccccaaggccaagagcaaccagcccaagagcctggaggacctgatctttgagagcctgcctgaaaatgccagccacaagctggaggtgcgggtggtgcgcagcagcccccccagcagccagttcaaggccaccctgctggagagctaccaggtgtacaagcgctaccagatggtgatccacaagaaccccccagacacccccacagagagccagttcacccgcttcctgtgcagcagccccctggaggccgagaccccacccaacggccctgactgtggctacggcagcttccaccagcagtactggctggatggcaagatcatcgctgtgggcgtgattgacatcctgcccaactgtgtgtcctctgtgtacctgtactatgaccctgactacagcttcctgagcctgggcgtgtacagcgccctgcgggagatcgccttcacccggcagctgcacgagaagaccagccagctgagctactactacatgggcttctacatccacagctgccccaagatgaagtacaagggccagtaccggcccagcgacctgctgtgcccagagacctacgtgtgggtgcccatcgagcagtgcctgcccagcctggagaacagcaagtactgccgcttcaaccaggaccctgaggccgtggatgaagatagaagcacagagccagaccggctgcaggtgttccacaagagggccatcatgccctatggagtgtacaagaagcagcagaaggaccccagcgaggaggccgctgtgctgcagtatgccagcctggtgggccagaagtgcagcgagaggatgctgctcttcaggaactag

SEQ ID NO: 22466 - DNA, 909 bp, Artificial Sequence
  Description of Artificial Sequence: Synthetic coding sequence
atgcccctgtatgagggcctgggcagcggcggggagaagacagctgtggtgattgacctgggggaggccttcaccaagtgtggctttgctggggagaccggcccccgctgcatcatccccagcgtcatcaagagagctggcatgcccaagcctgtgcgggtggtgcagtacaacatcaacacagaggagctgtacagctacctgaaggagttcatccacatcctgtacttccgccacctgctggtgaacccccgggacagaagagtggtgatcatcgagagcgtgctgtgccccagccacttccgggagaccctgaccagggtgctcttcaagtactttgaggtgcccagcgtgctgctggcccccagccacctgatggccctgctgaccctgggcatcaacagcgccatggtgctggactgtggctaccgggagagcctggtgctgcccatctatgagggcatccctgtgctgaactgctggggcgccctgcccctgggcggcaaggccctgcacaaggagctggagacccagctgctggagcagtgcaccgtggacacctctgtggccaaggagcagagcctgcccagcgtgatgggctctgtgcctgagggcgtgctggaggacatcaaggcccggacctgctttgtgtctgacctgaagaggggcctgaagatccaggccgccaagttcaacattgatggcaacaatgaaagacccagccccccaccaaatgtggactaccccctggatggagagaagatcctgcacatcctgggcagcatccgggacagcgtggtggagatcctgtttgagcaggacaatgaggagcagagcgtggccaccctcatcctggacagcctcatccagtgctgcagctgctgccccggctggagcgccatggcctag

SEQ ID NO: 22467 - DNA, 378 bp, Artificial Sequence
  Description of Artificial Sequence: Synthetic coding sequence
atgagcagctgtgtgagcagccagcccagcagcaacagagctgccccccaggatgagctgggcggccggggcagcagcagcagcgagagccagaagccctgtgaggccctgcggggcctgagcagcctgagcatccacctgggcatggagagcttcatcgtggtgacagaatgtgagcccggctgtgctgtggacctgggcctggcccgggaccggcccctggaggctgatggccaggaggtgcccctggacaccagcggcagccaggcccggccccacctgagcggcaggaagctgagcctgcaggagaggagccagggcggcctggccgccggcggcagcctggacatgaatggccgctgcatctgccccagctag

SEQ ID NO: 22468 - DNA, 1161 bp, Artificial Sequence
  Description of Artificial Sequence: Synthetic coding sequence
atggctgacagcctggagagcacccccctgcccagccctgaggaccggctggccaagctgcaccccagcaaggagctgctggagtactaccagaagaagatggccgagtgtgaggccgagaatgaagacctgctgaagaagctggagctgtacaaggaggcctgtgagggccagcacaagctggagtgtgacctgcagcagcgggaggaggagattgctgagctgcagaaggccctgagtgacatgcaggtgtgcctcttccaggagcgggagcacgtgctgcggctgtacagtgaaaatgaccggctgcgcatccgggagctggaggacaagaagaagatccagaacctgctggccctggtgggcacagatgctggggaggtgacctacttctgcaaggagcccccccacaaggtgaccatcctgcagaagaccatccaggccgtgggagaatgtgagcagagcgagagcagcgccttcaaggctgaccccaagatcagcaagagaagacccagccgggagaggaaggagagcagcgagcactaccagagggacatccagaccctcatcctgcaggtggaggccctgcaggcccagctgggggagcagaccaagctgagccgggagcagatcgagggcctgattgaggaccggcgcatccacctggaggagatccaggtgcagcaccagaggaaccagaacaagatcaaggagctgaccaagaacctgcaccacacccaggagctgctgtatgagagcaccaaggacttcctgcagctgcggtctgagaaccagaacaaggagaagtcctggatgctggagaaggacaacctgatgagcaagatcaagcagtacagagtgcagtgcaagaagaaggaggacaagattggcaaggtgctgcctgtgatgcatgagagccaccacgcccagagcgagtacatcaagagcctgaaggacaagctggtgcaggagaagaagctgagcaacatgtaccaggagcagtgcatcagcctggaggaggagctggcccgcatccgggaggaggagggcatgaggcgggagatcttcaaggacaggaccaacaagatgggcaagaggctgcagatcatgaccaagagatatgaggccctggagcggcggcgcatcctggaggtggagtag

SEQ ID NO: 22469 - DNA, 999 bp, Artificial Sequence; identical to SEQ ID NO: 22218
  Description of Artificial Sequence: Synthetic coding sequence

SEQ ID NO: 22470 - DNA, 1524 bp, Artificial Sequence
  Description of Artificial Sequence: Synthetic coding sequence
atggaggaggtggagcggcaggtgctgcctgaccctgaggtgctggaggccgtgggggaccggcaggacggcctgcgggagcagctgcaggcccctgtgcccccagattctgtgcccagcctgcagaacatgggcctgctgctggacaagctggccaaggagaaccaggacatccggctgctgcaggcccagctgcaggcccagaaggaggagctgcagagcctgatgcaccagcccaagggcctggaggaggagaatgcccagctgcggggggccctgcagcagggcgaggccttccagagggccctggagagcgagctgcagcagctgcgggcccggctgcagggcctggaggccgactgtgtgcggggcccagatggagtgtgcctgagcggcggccggggcccccagggcgacaaggccatccgggagcagggcccccgggagcaggagcctgagctgtccttcctgaagcagaaggagcagctggaggccgaggcccaggccctgcggcaggagctggagcggcagaggcggctgctgggctctgtgcagcaggacctggagaggagcctgcaggatgccagcagaggagaccctgcccatgctggcctggccgagctgggccaccggctggcccagaagctgcagggcctggagaactggggccaggaccccggggtgtctgccaatgccagcaaggcctggcaccagaagagccacttccagaacagccgggagtggagcggcaaggagaagtggtgggatggccagagggacaggaaggccgagcactggaagcacaagaaggaggagagcggccgggagaggaagaagaactggggcggccaggaggaccgggagcccgccggccgctggaaggagggccggccccgggtggaggagagcggcagcaagaaggagggcaagaggcagggccccaaggagccccccaggaagagcggcagcttccacagcagtggagagaagcagaagcagccccgctggagggagggcaccaaggacagccatgaccccctgcccagctgggccgagctgctgcggcccaagtaccgggccccccagggctgcagcggcgtggatgaatgtgcccggcaggagggcctgaccttctttggaacagagctggcccctgtgcggcagcaggagctggccagcctgctgcggacctacctggcccggctgccctgggccggccagctgaccaaggagctgcccctgagccctgccttctttggagaagatggcatcttcagacatgaccggctgcgcttccgggactttgtggatgccctggaggacagcctggaggaggtggccgtgcagcagacaggagatgatgatgaggtggatgactttgaggacttcatcttcagccacttctttggagacaaggccctgaagaagaggtctgggaagaaggacaagcacagccagagccccagggctgctggcccccgggagggccacagccacagccaccaccaccaccaccggggctag

SEQ ID NO: 22471 - DNA, 2472 bp, Artificial Sequence
  Description of Artificial Sequence: Synthetic coding sequence
atgaccctgctgagcagccagagcagcagcctggtggcccccagcggctctgtgtctgcagaaaatcctgagcagaggatgctggagaagagggccaaggtgattgaggagctgctgcagacagagcgggactacatccgggacctggagatgtgcatcgagcgcatcatggtgcccatgcagcaggcccaggtgcccaacatcgactttgagggcctgtttggaaacatgcagatggtgatcaaggtgtccaagcagctgctggccgccctggagatcagtgatgctgtgggccctgtgttcctgggccacagagatgagctggagggcacctacaagatctactgccagaaccatgatgaggccatcgccctgctggagatctatgagaaggatgagaagatccagaagcacctgcaggacagcctggccgacctgaagagcctgtacaatgagtggggctgcaccaactacatcaacctgggcagcttcctgatcaagcctgtgcagagggtgatgagataccccctgctgctgatggagctgctgaacagcaccccagagagccacccagacaaggtgcccctgaccaatgctgtgctggccgtgaaggagatcaacgtgaacatcaatgagtacaagaggaggaaggacctggtgctgaagtacagaaaaggagatgaggacagcctgatggagaagatcagcaagctgaacatccacagcatcatcaagaagagcaacagagtgagcagccacctgaagcacctgaccggctttgccccccagatcaaggatgaggtgtttgaggagacagagaagaacttcaggatgcaggagcggctcatcaagagcttcatccgggacctgagcctgtacctgcagcacatccgggagagcgcctgtgtgaaggtggtggccgctgtgtccatgtgggatgtgtgcatggagcggggccaccgggacctggagcagtttgagcgggtgcaccgctacatcagtgaccagctgttcaccaacttcaaggagaggacagagcggctggtgatcagccccctgaaccagctgctgtccatgttcaccggcccccacaagctggtgcagaagagatttgacaagctgctggacttctacaactgcacagagcgggcagagaagctgaaggacaagaagaccctggaggagctgcagagcgccaggaacaactatgaggccctgaatgcccagctgctggatgagctgcccaagttccaccagtatgcccagggcctcttcaccaactgtgtgcacggctatgcagaggcccactgtgactttgtgcaccaggccctggagcagctgaagcccctgctgagcctgctgaaggtggccggccgggagggcaacctgattgccatcttccacgaggagcacagccgggtgctgcagcagctgcaggtgttcaccttcttccctgagagcctgcctgccaccaagaagccctttgagaggaagaccatcgaccggcagagcgccaggaagcccctgctgggcctgcccagctacatgctgcagagcgaggagctgcgggccagcctgctggcccgctacccacctgagaagctgttccaggccgagaggaacttcaatgctgcccaggacctggatgtgtccctgctggagggggacctggtgggcgtcatcaagaagaaggaccccatgggcagccagaaccgctggctgattgacaatggagtgaccaagggctttgtgtacagcagcttcctgaagccctacaaccccaggaggagccacagtgatgcctctgtgggcagccacagcagcacagaaagtgaacatggcagcagcagcccccgcttcccccggcagaacagcggcagcaccctgaccttcaaccccagctccatggctgtgtccttcaccagcggcagctgccagaagcagccccaggatgccagccccccacccaaggaatgtgaccagggcaccctgagcgccagcctgaaccccagcaacagcgagagcagccccagccgctgccccagcgaccctgacagcaccagccagcccaggtctggggacagcgcagatgtggccagagatgtgaagcagcccacagccacccccaggagctacagaaacttccgccaccctgagatcgtgggctacagcgtgcccggcagaaatggccagagccaggacctggtgaagggctgtgccaggacagcccaggccccagaagatagaagcacagagccagatggcagcgaggccgagggcaaccaggtgtactttgctgtgtacaccttcaaggccaggaaccccaatgagctgtctgtgtctgccaaccagaagctgaagatcctggagttcaaggatgtgactggaaacacagagtggtggctggccgaggtgaatggcaagaagggctacgtgcccagcaactacatcaggaagacagagtacacctag

SEQ ID NO: 22472 - DNA, 492 bp, Artificial Sequence
  Description of Artificial Sequence: Synthetic coding sequence
tgagacaagttccgggccagcccagactgcatcaccatcctgtgcaagcccaacggccaggccatcgcctggtacacccccatccactggaagcaggcctgggagaagctggatgctgatgtggagttcaaccgctgcagcgtggtgagccccaccttcaggaagagggtcttccagtggacagccagcacagccaccatcaccaaggagaagcaggaccagcccaagaaggacatcagcaactaccaggtggagcaggcccaggtgctgctgaagcgggagaaggagatcccccccaccgtcttccccaacagaagcccctggtgccagaacccctacgtgtctgcccacccctactgccccctgattgagccccacaacaccagcacagctgggggccgcctggaccggcagcccaggaccaggagcacccggcccaacagagccagcggcagcaagaagaagaagaccagcgagagccagaagcagtag

SEQ ID NO: 22473 - DNA, 771 bp, Artificial Sequence; identical to SEQ ID NO: 19189
  Description of Artificial Sequence: Synthetic coding sequence

SEQ ID NO: 22474 - DNA, 2793 bp, Artificial Sequence
  Description of Artificial Sequence: Synthetic coding sequence
atgtctgagttccgcatccaccatgatgtgaatgagctgctgagcctgctgcgggtgcacggcggagatggagctgaggtgtacatcgacctgctgcagaagaacagaacaccctacgtgaccaccaccgtgtctgcccacagcgccaaggtgaagattgctgagttcagcaggaccccagaggacttcctgaagaagtatgatgagctgaagagcaagaacaccaggaacctggaccccctggtgtacctgctgagcaagctgacagaggacaaggagaccctgcagtacctgcagcagaatgccaaggagcgggcagagctggccgctgctgctgtgggcagcagcaccaccagcatcaacgtgcctgctgctgccagcaagatctccatgcaggagctggaggagctgaggaagcagctgggctctgtggccaccggcagcaccctgcagcagagcctggagctgaagaggaagatgctgcgggacaagcagaacaagaagaacagcggccagcacctgcccatcttccctgcctgggtgtatgaaagacctgccctgattggagacttcctgattggagctggcatcagcacagacacagccctgcccatcgtgctgctgcgctggaacctggccctgagcccccggctgaagtgcagcggggtcatcagcgcccactgcaacctgcacctgcccggcaccctgcccctggccagccaggagagcgctgtggtggaggacctgctgtatgtgctggtgggcgtggatggccgctacgtgtctgcccagcccctggccggccggcagagcaggaccttcctggtggaccccaacctggacctgagcatccgggagctggtgcaccgcatcctgcctgtggccgccagctacagcgctgtgacccgcttcatcgaggagaagagcagctttgaatatggccaggtgaaccacgccctggccgccgccatgaggaccctggtgaaggagcacctgatcctggtgtcccagctggagcagctgcaccggcagggcctgctgagcctgcagaagctgtggttctacatccagcctgccatgaggaccatggacatcctggccagcctggccacctctgtggacaagggagaatgtctgggcggcagcaccctgagcctgctgcatgaccgctccttctcctacacaggagacagccaggcccaggagctgtgcctgtacctgaccaaggccgccagcgccccctactttgaggtgctggagaagtggatctaccggggcatcatccatgacccctacagcgagttcatggtggaggagcacgagctgaggaaggagcgcatccaggaggactacaatgacaagtactgggaccagcgctacaccatcgtgcagcagcagatccccagcttcctgcagaagatggctgacaagatcctgagcacaggcaagtacctgaatgtggtgcgggagtgtggccatgatgtgacctgccctgtggccaaggagatcatctacaccctgaaggagcgggcctacgtggagcagatcgagaaggccttcaactatgccagcaaggtgctgctggacttcctgatggaggagaaggagctggtggcccacctgcggagcatcaagcgctacttcctgatggaccagggcgacttctttgtgcacttcatggacctggccgaggaggagctgaggaagcctgtggaggacatcaccccaccccggctggaggccctgctggagctggccctgaggatgagcacagccaacacagaccccttcaaggatgacctgaagattgacctgatgcctcatgacctgatcacccagctgctgcgggtgctggccatcgagaccaagcaggagaaggccatggcccatgctgaccccacagagctggccctgagcggcctggaggccttctcctttgactacatcgtgaagtggcccctgagcctcatcatcaacaggaaggccctgacccgctaccagatgctgttccgccacatgttctactgcaagcacgtggagcggcagctgtgcagcgtgtggatcagcaacaagacagccaagcagcacagcctgcacagcgcccagtggtttgctggggccttcaccctgcggcagaggatgctgaactttgtgcagaacatccagtactacatgatgtttgaggtgatggagcccacctggcacatcctggagaagaacctgaagagcgccagcaacattgatgatgtgctgggccaccacacaggcttcctggacacctgcctgaaggactgcatgctgaccaaccctgagctgctgaaggtgttcagcaagctgatgtctgtgtgtgtgatgttcaccaactgcatgcagaagttcacccagagcatgaagctggatggagagctgggcggccagaccctggagcacagcacagtgctgggcctgcctgctggagctgaggagcgggccaggaaggagctggccaggaagcacctggccgagcacgccgacacagtgcagctggtgtctggctttgaggccaccatcaacaagtttgacaagaacttcagcgcccacctgctggacctgctggcccggctgagcatctacagcaccagtgactgtgagcacggcatggccagcgtcatcagccggctggacttcaacggcttctacacagagcggctggagcggctgtctgctgagaggagccagaaggccaccccccaggtgcctgtgctgcggggccccccagccccagccccccgggtggccgtgacagcccagtag

SEQ ID NO: 22475 - DNA, 129 bp, Artificial Sequence
  Description of Artificial Sequence: Synthetic coding sequence
atgtgcctgctgcccatccgggtgaaggaggccgaggaggtgtgccggcagaagaagggcaagagcctgtacaagatcaagcccaggcatgacagcggcatcaaggccaagatctccatgaagacctag

SEQ ID NO: 22476 - DNA, 456 bp, Artificial Sequence
  Description of Artificial Sequence: Synthetic coding sequence
atggactgccgggagatggacctgtatgaggactaccagagcccctttgattttgatgctggggtgaacaagagctacctgtacctgagccccagcggcaacagcagccccccaggcagccccaccctgcagaagtttggcctgctgaggacagatcctgtgcctgaggagggagaagatgtggccgccaccatcagcgccacagagaccctgtctgaggaggagcaggaggagctgcggcgggagctggccaaggtggaggaggagatccagaccctgagccaggtgctggccgccaaggagaagcacctggccgagatcaagaggaagctgggcatcaacagcctgcaggagctgaagcagaacatcgccaagggctggcaggatgtgacagccaccagcgcccggagcaagctgctggccgctgagacagagctgctgtgcctgctgtactag

SEQ ID NO: 22477 - DNA, 627 bp, Artificial Sequence; identical to SEQ ID NO: 18638
  Description of Artificial Sequence: Synthetic coding sequence

SEQ ID NO: 22478 - DNA, 1575 bp, Artificial Sequence
  Description of Artificial Sequence: Synthetic coding sequence
atgaagaggagctctgtgagcagcggcggggccggccgcctgtccatgcaggagctgcggagccaggatgtgaacaagcagggcctgtacaccccccagaccaaggagaagcccaccttcggcaagctgagcatcaacaagcccaccagcgagaggaaggtgtccctgtttgggaagaggaccagcggccacggcagcaggaacagccagctgggcatcttcagcagcagcgagaagatcaaggacccccggcccctgaatgacaaggccttcatccagcagtgcatccggcagctgtgtgagttcctgacagaaaatggctacgcccacaacgtgtccatgaagagcctgcaggcccccagcgtgaaggacttcctgaagatcttcaccttcctgtatggcttcctgtgccccagctatgagctgcctgacaccaagtttgaggaggaggtgccccgcatcttcaaggacctgggctacccctttgccctgagcaagagctccatgtacacagtgggcgccccccacacctggccccacatcgtggccgccctggtgtggctgattgactgcatcaagatccacacagccatgaaggagagcagccccctgtttgatgatggccagccctggggcgaggagacagaagatggcatcatgcacaacaagctgttcctggactacaccatcaagtgctatgagagcttcatgtctggagctgacagctttgatgagatgaatgctgagctgcagagcaagctgaaggacctcttcaacgtggatgccttcaagctggagagcctggaggccaagaacagagccctgaatgagcagatcgcccggctggagcaggagcgggagaaggagcccaaccggctggagagcctgaggaagctgaaggccagcctgcagggagatgtgcagaagtaccaggcctacatgagcaacctggagagccacagcgccatcctggaccagaagctgaatggcctgaatgaggagatcgcccgggtggagctggagtgtgagaccatcaagcaggagaacacccggctgcagaacatcatcgacaaccagaagtacagcgtggccgacatcgagcgcatcaaccatgaaagaaatgagctgcagcagaccatcaacaagctgaccaaggacctggaggccgagcagcagaagctgtggaatgaggagctgaagtatgcccggggcaaggaggccatcgagacccagctggccgagtaccacaagctggccaggaagctgaagctgatccccaagggagctgagaacagcaagggctatgactttgagatcaagttcaaccctgaggccggggccaactgcctggtgaagtaccgggcccaggtgtatgtgcccctgaaggagctgctgaatgaaacagaggaggagatcaacaaggccctgaacaagaagatgggcctggaggacaccctggagcagctgaatgccatgatcacagagagcaagaggtctgtgaggaccctgaaggaggaggtgcagaagctggatgacctgtaccagcagaagatcaagaaggagaggaagaagtag

SEQ ID NO: 22479 - DNA, 1248 bp, Artificial Sequence; identical to SEQ ID NO: 19216
  Description of Artificial Sequence: Synthetic coding sequence

SEQ ID NO: 22480 - DNA, 1512 bp, Artificial Sequence
  Description of Artificial Sequence: Synthetic coding sequence
atggccagcaaccacaagagcagcgctgcccggcctgtgtcccggggcggcgtgggcctgaccggccggccccccagcggcatccggcccctgagcggcaacatccgggtggccacagccatgcctcctggaacagcccggcccggcagccggggctgccccatcggcactggaggagtgctgagcagccagatcaaggtggcccacaggcctgtgacccagcagggcctgaccggcatgaagacaggcaccaagggcccccagaggcagatcctggacaagagctactacctgggcctgctgcggagcaagatcagcgagctgaccacagaggtgaacaagctgcagaagggcatcgagatgtacaaccaggagaacagcgtgtacctgtcctatgagaagagagctgagaccctggccgtggagatcaaggagctgcagggccagctggccgactacaacatgctggtggacaagctgaacaccaacacagagatggaggaggtgatgaatgactacaacatgctgaaggcccagaatgaccgggagacccagagcctggatgtgatcttcacagagcggcaggccaaggagaagcagatccgctctgtggaggaggagattgagcaggagaagcaggccacagatgacatcatcaagaacatgagctttgagaaccaggtgaagtacctggagatgaagaccaccaatgagaagctgctgcaggagctggacaccctgcagcagcagctggacagccagaacatgaagaaggagagcctggaggccgagatcgcccacagccaggtgaagcaggaggccgtgctgctgcacgagaagctgtatgagctggagagccaccgggaccagatgattgctgaggacaagagcatcggcagccccatggaggagcgggagaagctgctgaagcagatcaaggatgacaaccaggagatcgcctccatggagcggcagctgacagacaccaaggagaagatcaaccagttcatcgaggagatccggcagctggacatggacctggaggagcaccagggcgagatgaaccagaagtacaaggagctgaagaagcgggaggagcacatggacaccttcatcgagacctttgaggagaccaagaaccaggagctgaagaggaaggcccagatcgaggccaacatcgtggccctgctggagcactgcagcaggaacatcaacagaattgagcagatcagcagcatcaccaaccaggagctgaagatgatgcaggatgacctgaacttcaagagcacagaggtgcagaagagccagagcacagcccagaacctgaccagtgacatccagaggctgcagctggacctgcagaagatggagctgctggagagcaagatgacagaggagcagcacagcctgaagagcaagatcaagcagatgaccacagacctggagatctacaatgacctgcctgccctgaagagcagtggagagaagaagaagaagaagaagaagaagtag

SEQ ID NO: 22481 - DNA, 1461 bp, Artificial Sequence; identical to SEQ ID NO: 18684
  Description of Artificial Sequence: Synthetic coding sequence

SEQ ID NO: 22482 - DNA, 1011 bp, Artificial Sequence
  Description of Artificial Sequence: Synthetic coding sequence
atgtgcaccatgcacaaggatgagaaggccaagcgggaggtgtcctcctggacagtggagggggacatcaacacagacccctgggccggctaccgctacaccgggaagctgcggccccactaccccctgatgcccaccaggcctgtgcccagctacatccagaggccagactatgctgaccaccccctgggcatgtctgagagcgagcaggccctgaagggcaccagccagatcaagctgctgagcagcgaggacatcgagggcatgaggctggtgtgccgcctggcccgggaggtgctggatgtggccgccggcatgatcaagccaggagtgaccacagaggagattgaccatgctgtgcacctggcctgcatcgccaggaactgctaccccagccccctgaactactacaacttccccaagagctgctgcacctctgtgaatgaggtgatctgccacggcatcccagaccggcggcccctgcaggagggggacatcgtgaatgtggacatcaccctgtacagaaatggctaccatggagacctgaatgagaccttctttgtgggggaggtggatgatggagccaggaagctggtgcagaccacctatgagtgcctgatgcaggccattgatgctgtgaagccaggagtgcgctaccgggagctgggcaacatcatccagaagcacgcccaggccaacggcttctctgtggtgcgcagctactgcggccacggcatccacaagctgttccacacagccccaaatgtgccccactacgccaagaacaaggctgtgggcgtgatgaagagcggccacgtgttcaccatcgagcccatgatctgtgagggcggctggcaggatgagacctggccagatggctggacagctgtgaccagagatggcaagaggtctgcccagtttgagcacaccctgctggtgacagacaccggctgtgagatcctgacccggcggctggacagcgcccggccccacttcatgagccagttctag

SEQ ID NO: 22483 - DNA, 3102 bp, Artificial Sequence
  Description of Artificial Sequence: Synthetic coding sequence
atggccggcatgattgaccgcttcagccctgccaacacaggcatccgctcctgggatgtggaccccggggtgtgcaacctggatgagcagctgaaggtgtttgtgagccgccacagcgccaccttcagcagcatcgtgaagggccagaggagcctgcaccacagaggagacaacctggagaccctggtgctgctgaaccccagcgacaagagcctgtatgatgagctgaggaacctgctgctggaccctgccagccacaagctgctggtgctggccggcccctgcctggaggagactggagagctgctgctgcagacaggaggcttcagcccccaccacttcctgcaggtgctgaaggaccgggagatccgggacatcctggccaccaccccacctcctgtgcagccccccatcctgaccatcacctgccccaccttcggggactgggcccagctggccccagctgtgcccggcctgcagggcgccctgcggctgcagctgcggctgaaccccccagcccagctgcccaacagcgagggcctgtgtgagttcctggagtatgtggccgagagcctggagccccccagcccctttgagctgctggagccccccaccagcggcggcttcctgcggctgggccggccctgctgctacatcttccctgggggcctgggagatgctgccttctttgctgtgaatggcttcaccgtgctggtgaatggaggcagcaaccccaagagcagcttctggaagctggtgcgccacctggacagagtggatgctgtgctggtgacccaccctggagctgacagcctgcccggcctgaacagcctgctgcggaggaagctggccgagaggtctgaggtggccgccggcggcggctcctgggatgaccggctgcggcggctcatcagccccaacctgggcgtggtgttcttcaatgcctgtgaggccgccagccggctggcccggggggaggatgaagctgagctggccctgagcctgctggcccagctgggcatcacccccctgcccctgagccggggccctgtgcctgccaagcccaccgtgctgtttgagaagatgggcgtgggccgcctggacatgtatgtgctgcacccccccagcgctggagctgagaggaccctggcctctgtgtgtgccctgctggtgtggcaccctgctggccctggagagaaggtggtgcgggtgctcttccctggctgcaccccaccagcctgcctgctggatggcctggtgcggctgcagcacctgcgcttcctgcgggagcctgtggtgaccccccaggacctggagggccctggccgggcagagagcaaggagagcgtgggcagccgggacagcagcaagcgggagggcctgctggccacccacccccggcccggccaggagaggcctggggtggccaggaaggagcccgcccgggcagaggcccccaggaagacagagaaggaggccaagaccccccgggagctgaagaaggaccccaagcccagcgtgtccaggacccagccccgggaggtgcggcgggccgccagctctgtgcccaacctgaagaagaccaatgcccaggccgcccccaagcccaggaaggcccccagcaccagccacagcggcttcccccctgtggccaacggccccaggagcccccccagcctgcgctgtggggaggccagccccccatctgctgcctgtggcagccctgccagccagctggtggccacccccagcctggagctgggccccatcccagctggggaggagaaggccctggagctgcccctggccgccagcagcatcccccggcccaggacccccagccctgagagccacaggagccctgctgagggcagcgagcggctgagcctgagccccctgcggggcggggaggccggcccagatgccagccccaccgtgaccacccccaccgtgaccacccccagcctgcctgctgaggtgggcagcccccacagcacagaggtggatgagagcctgtctgtgtcctttgagcaggtgctgcccccatctgcccccaccagcgaggccggcctgagcctgcccctgcggggcccccgggccaggagaagtgccagcccccatgatgtggacctgtgcctggtgagcccctgtgaatttgagcacaggaaggctgtgcccatggccccagccccagccagccctggcagcagcaatgacagcagcgcccggagccaggagcgggccggcggcctgggcgctgaggagaccccacccacctctgtgtctgagagcctgcccaccctgagtgacagcgaccctgtgcccctggcccctggagctgctgacagtgatgaggacacagagggcttcggcgtgcccaggcatgaccccctgcctgaccccctgaaggtgcccccacccctgcctgaccccagcagcatctgcatggtggaccctgagatgctgccccccaagacagcccggcagacagaaaatgtgtccaggaccaggaagcccctggcccggcccaacagcagagctgctgcccccaaggccacccctgtggccgccgccaagaccaagggcctggccggcggggaccgggccagccggcccctgagcgcccggtctgagcccagcgagaagggcggccgggcccccctgagcaggaagagcagcacccccaagacagccacccggggccccagcggcagcgccagcagcaggcctggggtgtctgccaccccacccaagagccctgtgtacctggacctggcctacctgcccagcggcagcagcgcccacctggtggatgaggagttcttccagagggtgcgggccctgtgctacgtgatcagcggccaggaccagaggaaggaggagggcatgagagctgtgctggatgccctgctggccagcaagcagcactgggaccgggacctgcaggtgaccctcatccccacctttgattctgtggccatgcacacctggtatgcagagacccacgcccggcaccaggccctgggcatcaccgtgctgggcagcaacagcatggtgtccatgcaggatgatgccttccctgcctgcaaggtggagttctag

SEQ ID NO: 22484 - DNA, 2223 bp, Artificial Sequence
  Description of Artificial Sequence: Synthetic coding sequence
atgagggacctggagggctaccgggagacccgctaccagctgctgcagctgcggcctgcccagagggcctcctggattggctacgccatcgcctaccacctgctggaggactatgagatggccgccaagatcctggaggagttcaggaagacccagcagaccagcccagacaaggtggactatgagtacagcgagctgctgctgtaccagaaccaggtgctgcgggaggccggcctgtaccgggaggccctggagcacctgtgcacctatgagaagcagatctgtgacaagctggccgtggaggagaccaagggggagctgctgctgcagctgtgccgcctggaggatgctgctgatgtgtaccggggcctgcaggagagaaatcctgagaactgggcctactacaagggcctggagaaggccctgaagccagccaacatgctggagcggctgaagatctatgaggaggcctggaccaagtacccccggggcctggtgccccggcggctgcccctgaacttcctgagcggggagaagttcaaggagtgcctggacaagttcctgaggatgaacttcagcaagggctgcccccctgtgttcaacaccctgcggagcctgtacaaggacaaggagaaggtggccatcatcgaggagctggtggtgggctatgagaccagcctgaagagctgccgcctcttcaaccccaatgatgatggcaaggaggagccccccaccaccctgctgtgggtgcagtactacctggcccagcactatgacaagattggccagcccagcatcgccctggagtacatcaacacagccatcgagagcacccccaccctcatcgagctgttcctggtgaaggccaagatctacaagcatgctggcaacatcaaggaggccgcccgctggatggatgaggcccaggccctggacacagctgaccgcttcatcaacagcaaatgtgccaagtacatgctgaaggccaacctgatcaaggaggccgaggagatgtgcagcaagttcacccgggagggcaccagcgctgtggagaacctgaatgagatgcagtgcatgtggttccagacagaatgtgcccaggcctacaaggccatgaacaagtttggagaggccctgaagaagtgccatgaaattgagcggcacttcatcgagatcacagatgaccagtttgacttccacacctactgcatgaggaagatcaccctgcggagctatgtggacctgctgaagctggaggatgtgctgcggcagcaccccttctacttcaaggccgcccgcatcgccatcgagatctacctgaagctgcatgacaaccccctgacagatgagaacaaggagcacgaggccgacacagccaacatgtctgacaaggagctgaagaagctgaggaacaagcagaggcgggcccagaagaaggcccagatcgaggaggagaagaagaatgctgagaaggagaagcagcagaggaaccagaagaagaagaaggatgatgatgatgaggagattggaggccccaaggaggagctgatccctgagaagctggccaaggtggagacccccctggaggaggccatcaagttcctgacccccctgaagaacctggtgaagaacaagattgagacccacctgtttgcctttgagatctacttcaggaaggagaagttcctgctgatgctgcagagcgtgaagagggcctttgccatcgacagcagccacccctggctgcacgagtgcatgatccgcctcttcaacacagctgtgtgtgagagcaaggacctgagtgacacagtgaggacagtgctgaagcaggagatgaacagactctttggagccaccaaccccaagaacttcaatgagaccttcctgaagaggaacagcgacagcctgccccaccggctgtctgctgccaagatggtgtactacctggaccccagcagccagaagagggccatcgagctggccaccaccctggatgagagcctgaccaacagaaacctgcagacctgcatggaggtgctggaggccctgtatgatggcagcctgggggactgcaaggaggccgctgagatctaccgggccaactgccacaagctgttcccctatgccctggccttcatgcctcctggctatgaggaggacatgaagatcaccgtgaatggagacagcagcgctgaggccgaggagctggccaatgagatctag

SEQ ID NO: 22485 - DNA, 183 bp, Artificial Sequence
  Description of Artificial Sequence: Synthetic coding sequence
atgagctgcaccatcgagaaggccctggctgatgccaaggccctggtggagcggctgcgggaccatgatgatgctgctgagagcctcatcgagcagaccacagccctgaacaagagggtggaggccatgaagcagtaccaggaggagatccaggagctgaatgaggtggcccggcacaggtag

SEQ ID NO: 22486 - DNA, 1419 bp, Artificial Sequence
  Description of Artificial Sequence: Synthetic coding sequence
atgggcaaggagcaggagctgctggaggccgccaggacaggccacctgcctgctgtggagaagctgctgagcggcaagaggctgagcagcggctttggaggcggcggcggcggcggcagcggcggcggcggcggcggcagcggcggcggcggcggcggcctgggcagcagcagccaccccctgagcagcctgctgtccatgtggaggggccccaacgtgaactgtgtggacagcacaggctacacccccctgcaccacgccgccctgaatggccacaaggatgtggtggaggtgctgctgagaaatgatgccctgaccaacgtggccgacagcaagggctgctaccccctgcacctggccgcctggaagggagatgcccagatcgtgcggctgctgatccaccagggccccagccacaccagggtgaatgagcagaacaatgacaatgaaacagccctgcactgtgccgcccagtatggccacacagaggtggtgaaggtgctgctggaggagctgacagaccccaccatgaggaacaacaagtttgagacccccctggacctggccgccctgtatggccgcctggaggtggtgaagatgctgctgaatgcccaccccaacctgctgagctgcaacaccaagaagcacacccccctgcacctggccgccagaaatggccacaaggctgtggtgcaggtgctgctggatgctggcatggacagcaactaccagacagagatgggcagcgccctgcacgaggccgccctgtttgggaagacagatgtggtgcagatcctgctggccgccggcacagatgtgaacatcaaggacaaccacggcctgacagccctggacacagtgcgggagctgcccagccagaagagccagcagattgctgccctgattgaggaccacatgaccgggaagaggagcaccaaggaggtggacaagaccccaccaccccagcccccactcatcagctccatggacagcatcagccagaagagccagggagatgtggagaaggctgtgacagagctgatcatcgactttgatgccaatgctgaggaggagggcccctatgaggccctgtacaatgccatcagctgccacagcctggacagcatggccagcggccgcagcagtgaccaggacagcaccaacaaggaggccgaggccgccggcgtgaagccagctggggtgcggccccgggagaggcctcctcctccagccaagcccccaccagatgaggaggaggaggaccacatcgacaagaagtacttccccctgacagccagcgaggtgctgtccatgaggccccgcatccacggcagcgctgcccgggaggaggatgagcacccctatgagctgctgctgacagctgagaccaagaagaagaagaagaagaagaagaagtag

SEQ ID NO: 22487 - DNA, 1392 bp, Artificial Sequence
  Description of Artificial Sequence: Synthetic coding sequence
atgtctgggggcaccccctacatcggcagcaagatcagcctcatcagcaaggccgagatccgctatgagggcatcctgtacaccatcgacacagagaacagcacagtggccctggccaaggtgcgcagctttggaacagaagatcggcccacagaccggcccatccccccaagagatgaggtgtttgagtacatcatcttccggggcagtgacatcaaggacctgactgtgtgtgagccccccaagccccagtgcagcctgccccaggaccctgccatcgtgcagagcagcctgggcagcagcaccagcagcttccagagcatgggcagctatggccccttcggccgcatgcccacctacagccagttcagccccagcagcctggtgggccagcagtttggagctgtgggcgtggccggcagcagcctgaccagctttggaacagagaccagcaacagcggcaccctgccccagagcagcgctgtgggcagcgccttcacccaggacaccaggagcctgaagacccagctgagccagggccgcagcagcccccagctggaccccctgaggaagagccccaccatggagcaggccgtgcagacagccagcgcccacctgcctgccccagctgctgtgggccgccgcagccctgtgtccacccggcccctgcccagcgccagccagaaggccggggagaaccaggagcacagaagagctgaggtgcacaaggtgtccaggccagaaaatgagcagctgagaaatgacaacaagaggcaggtggcccctggggcccccagcgccccccggcggggccggggcggccacagaggaggccggggccgcttcggcatcagaagagatggccccatgaagtttgagaaggactttgattttgagagcgccaatgcccagttcaacaaggaggagattgaccgggagttccacaacaagctgaagctgaaggaggacaagctggagaagcaggagaagcctgtgaatggagaagataaaggagacagcggcgtggacacccagaacagcgagggcaatgctgatgaggaggaccccctgggccccaactgctactatgacaagaccaagagcttctttgacaacatcagctgtgatgacaaccgggagcggcggcccacctgggccgaggagcggcggctgaatgctgagaccttcggcatccccctgcggcccaacagaggccggggcggctaccggggccggggcggcctgggcttccggggcggccggggccggggcggcggccggggcggcaccttcaccgccccccggggcttccggggcggcttccggggcggccggggcggccgggagtttgctgactttgagtacaggaaggacaacaaggtggccgcctag

SEQ ID NO: 22488 - DNA, 1287 bp, Artificial Sequence
  Description of Artificial Sequence: Synthetic coding sequence
atgggcggcggcgtgggcgccagcagcagcggcggcggccctgggggcagcggcggcggcggcagcggcggccctggagctggcaccagcttccccccacctggggtgaagctgggccgggacagcggcaaggtgaccaccgtggtggccaccctgggccagggccctgagaggagccaggaggtggcctacacagacatcaaggtgattggaaatggcagctttggagtggtgtaccaggcccggctggccgagacccgggagctggtggccatcaagaaggtgctgcaggacaagcgcttcaagaaccgggagctgcagatcatgaggaagctggaccactgcaacatcgtgcggctgcgctacttcttctacagcagtggagagaagaaggatgagctgtacctgaacctggtgctggagtatgtgcctgagaccgtgtacagagtggcccggcacttcaccaaggccaagctgaccatccccatcctgtatgtgaaggtgtacatgtaccagctgttccgcagcctggcctacatccacagccagggcgtgtgccaccgggacatcaagccccagaacctgctggtggaccctgacacagctgtgctgaagctgtgtgactttggaagtgccaagcagctggtgcggggggagcccaacgtgtcctacatctgcagccgctactaccgggcccctgagctgatctttggagccacagactacaccagcagcattgatgtgtggagcgctggctgtgtgctggccgagctgctgctgggccagcccatcttccctggggacagcggcgtggaccagctggtggagatcatcaaggtgctgggcacccccacccgggagcagatccgggagatgaaccccaactacacagagttcaagttcccccagatcaaggcccacccctggaccaaggtgttcaagagcaggaccccacctgaggccatcgccctgtgcagcagcctgctggagtacacccccagcagccggctgagccccctggaggcctgtgcccacagcttctttgatgagctgcgctgcctgggcacccagctgcccaacaaccggcccctgcccccactcttcaacttctctgctggggagctgagcatccagcccagcctgaatgccatcctgatccccccccacctgcggagccctgctggcaccaccaccctgacccccagcagccaggccctgacagagacccccaccagcagtgactggcagagcacagatgccacccccaccctgaccaacagcagctag

SEQ ID NO: 22489 - DNA, 657 bp, Artificial Sequence
  Description of Artificial Sequence: Synthetic coding sequence
atggatgctgagcaccctgagctgcggagctatgcccagagccagggctggtggacaggagagggggagttcaacttcagcgaggtgttcagccctgtggaggaccacctggactgtggggccggcaaggacagcctggagaagcaggaggagagcatcaccgtgcagaccatgatgaacaccctgcgggacaaggccagcggcgtgtgcattgattctgagttcttcctgaccacagccagcggcgtgtctgtgctgccccagaacagaagcagcccctgcatccactacttcaccggcaccccagaccccagccgcagcatcttcaagcccttcatctttgtggatgatgtgaagctggtgcccaagacccagagcccctgctttggagatgatgatcctgccaagaaggagccccgcttccaggagaagccagacagaagacatgagctgtacaaggcccacgagtgggcccgggccatcatcgagagtgaccaggagcagggcaggaagctgcggagcaccatgctggagctggagaagcagggcctggaggccatggaggagatcctgaccagcagcgagcccctggaccctgctgaggtgggggacctcttctatgactgtgtggacacagagatcaagttcttcaagtag

SEQ ID NO: 22490 - DNA, 573 bp, Artificial Sequence
  Description of Artificial Sequence: Synthetic coding sequence
atggccctgctggccgagcacctgctgaagcccctgcctgctgacaagcagatcgagaccggccccttcctggaggccgtgagccacctgccccccttctttgactgcctgggcagccctgtgttcacccccatcaaggctgacatcagcggcaacatcaccaagatcaaggctgtgtatgacaccaacccagccaagttccgcaccctgcagaacatcctggaggtggagaaggagatcggcctgcgcttcatccaggtgttcctgcagagcatctgtgatggagagagagatgagaaccaccccaacctgatccgggtgaatgccaccaaggcctatgagatggccctgaagaagtaccacggctggatcgtgcagaagatcttccaggccgccctgtatgctgccccctacaagagtgacttcctgaaggccctgagcaagggccagaatgtgacagaggaggagtgcctggagaagatccgcctcttcctggtgaactacacagccaccattgatgtgatctatgagatgtacacccagatgaatgctgagctgaactacaaggtgtag

SEQ ID NO: 22491 - DNA, 762 bp, Artificial Sequence
  Description of Artificial Sequence: Synthetic coding sequence
atgagcatctgcagcagcctggccaggaagttccccaagctgaccatcattggagaggaggacctgcccagcgaggaggtggaccaggagctgattgaggacagccagtgggaggagatcctgaagcagccctgccccagccagtacagcgccatcaaggaggaggacctggtggtgtgggtggaccccctggatggcaccaaggagtacacagagggcctgctggacaacgtgacagtgctgattggcatcgcctatgagggcaaggccatcgccggggtcatcaaccagccctactacaactatgaggccggcccagatgctgtgctgggccgcaccatctggggcgtgctgggcctgggcgccttcggcttccagctgaaggaggtgcctgctgggaagcacatcatcaccaccaccaggagccacagcaacaagctggtgacagactgtgtggccgccatgaacccagatgctgtgctgcgggtgggcggggccggcaacaagatcatccagctgattgagggcaaggccagcgcctacgtgtttgccagccctggctgcaagaagtgggacacctgtgcccctgaggtgatcctgcatgctgtgggcggcaagctgacagacatccatggaaatgtgctgcagtaccacaaggatgtgaagcacatgaacagcgctggggtgctggccaccctgaggaactatgactactatgccagccgggtgcctgagagcatcaagaatgccctggtgccctag

SEQ ID NO: 22492 - DNA, 1590 bp, Artificial Sequence
  Description of Artificial Sequence: Synthetic coding sequence
atgggcgcctacctgagccagcccaacacagtgaagtgcagcggagatggagtgggcgtgtccatggaggatgcccacaactgcatccctgagctggacagcgagacagccatgttttctgtgtatgatggccatggaggagaggaggtggccctgtactgtgccaagtacctgcctgacatcatcaaggaccagaaggcctacaaggagggcaagctgcagaaggccctggaggatgccttcctggccattgatgccaagctgaccacagaggaggtgatcaaggagctggcccagattgctggccggcccacagaagatgaagatgagaaggagaaggtggctgatgaagatgatgtggacaatgaggaggccgccctgctgcacgaggaggccaccatgaccatcgaggagctgctgaccaggtatggccagaactgccacaagggccccccccacagcaagagcggcggcggcaccggggaggagcccggcagccagggcctgaatggagaggccggccctgaggacagcacccgggagacccccagccaggagaatggccccacagccaaggcctacacaggcttcagcagcaacagcgagcggggcacagaagctggccaggtgggggagcccggcatccccactggagaggccggccccagctgcagcagcgccagtgacaagctgccccgggtggccaagagcaagttctttgaagattctgaagatgaaagtgatgaggccgaggaggaggaggaggacagtgaagaatgttctgaggaggaggatggctacagcagcgaggaggctgaaaatgaggaggatgaagatgacacagaggaggccgaggaggatgatgaggaggaggaggaggagatgatggtgcccggcatggagggcaaggaggagcccggcagtgacagcggcaccacagctgtggtggccctgatccggggcaagcagctgattgtggccaatgctggggacagccgctgtgtggtgtctgaggccggcaaggccctggacatgtcctatgaccacaagccagaagatgaggtggagctggcccgcatcaagaatgccggcggcaaggtgaccatggatggccgggtgaatggaggcctgaacctgagccgggccatcggggaccacttctacaagaggaacaagaacctgcccccagaggagcagatgatcagcgccctgcctgacatcaaggtgctgaccctgacagatgaccacgagttcatggtgattgcctgtgatggcatctggaatgtgatgagcagccaggaggtggtggacttcatccagagcaagatcagccagagagatgaaaatggagagctgcggctgctgagcagcatcgtggaggagctgctggaccagtgcctggccccagacaccagcggagatggcaccggctgtgacaacatgacctgcatcatcatctgcttcaagcccaggaacacagctgagctgcagcctgagagcggcaagaggaagctggaggaggtgctgagcacagaaggagctgaggagaatggaaacagcgacaagaagaagaaggccaagagggactag

SEQ ID NO: 22493 - DNA, 1293 bp, Artificial Sequence
  Description of Artificial Sequence: Synthetic coding sequence
atgacctttgagctgtatgatgagtggatccaggccagcaatgtgcaggagcaggacaagaagctgcaggccctgtggaatgcctgtgagaagctgcccaaggccaaccacaacaacatccgctacctgatcaagttcctgagcaagctgtctgagtaccaggatgtgaacaagatgacccccagcaacatggccatcgtgctgggccccaacctgctgtggccccaggccgagggcaacatcacagagatgatgaccaccgtgtccctgcagatcgtgggcatcatcgagcccatcatccagcacgccgactggttcttccctggagaaattgagttcaacatcaccggcaactacggcagccctgtgcacgtgaaccacaatgccaactacagctccatgcccagcccagacatggaccctgctgaccggcggcagcctgagcaggcccggcggcccctgtctgtggccacagacaacatgatgctggagttctacaagaaggatggcatgggcgtgcgggtgatggacaccaactgggtggcccggcggggcagcagcgctggcaggaaggtgtcctgtgccccacccagcatgcagcccccagcccccccagctgagctggccgcccccctgcccagccccctgcctgagcagcccctggacagccctgctgccccagccctgagccccagcggcctgggcctgcagcccggccctgagaggaccagcaccaccaagagcaaggagctgagccctggcagcgcccagaagggcagccctggcagcagccagggcacagcctgtgccggcacccagcccggggcccagcccggggcccagcccggggccagccccagccccagccagcccccagctgaccagagcccccacaccctgaggaaggtgtccaagaagctggcccccatcccccccaaggtgcccttcggccagcccggggccatggctgaccagagcgctggccagcccagccctgtgtccctgagccccaccccacccagcacccccagcccctacggcctgagctacccccagggctacagcctggccagcggccagctgagccctgctgctgccccacccctggccagccccagcgtcttcaccagcaccctgagcaagagccggcccacccccaagccccggcagaggcccaccctgcccccaccccagcccccaacagtgaacctgagcgccagcagcccccagagcacagaggcccccatgctggatggcatgagccctggagagagcatgagcacagctgtgtag

SEQ ID NO: 22494 - DNA, 846 bp, Artificial Sequence
  Description of Artificial Sequence: Synthetic coding sequence
atgcctggcccccggcggctgcggagccctgggggcagcggctgcagcagccggggcagcggcccccggctgagcacccggcgctggaggccctgctgctactgcggcggcagcggcgtgtggctgctgcggaccccacccagccccagcgcctggccagcccggcgctgccccaggcacagatttgagttctgtgagcccgcctttgtggtgggcaactgcctgcagatcgccagtgacagccaccagtatgaccgcatctactgtggggccggcgtgcagaaggaccacgagaactacatgaagatcctgctgaaggtgggcggcatcctggtgatgcccatcgaggaccagctgacccagatcatgaggacaggccagaacacctgggagagcaagaacatcctggccgtgtcctttgcccccctggtgcagcccagcaagaatgacaatggcaagccagacagcgtgggcctgcccccctgtgctgtgaggaacctgcaggacctggcccgcatctacatccggaggaccctgaggaacttcatcaatgatgagatgcaggccaagggcatcccccagagggccccacccaagaggaagaggaagagggtgaagcagaggatcaacacctacgtgtttgtgggcaaccagctgatcccccagcccctggacagcgaggaggatgagaagatggaggaggacaacaaggaggaggaggagaaggaccacaatgaggccatgaagccagaggagcccccccagaacctgctgcgggagaagatcatgaagctgcccctgcctgagagcctgaaggcctacctgacctacttccgggacaagtag

SEQ ID NO: 22495 - DNA, 1251 bp, Artificial Sequence
  Description of Artificial Sequence: Synthetic coding sequence
atgagccctgccatgctgtctgtgctggtgaagatgatgctggcccaggcccaggagagcgtgtttgagaagatcagcctgcccggcatcagaaatgagttcttcatgctggtgaaggtggcccaggaggccgccaaggtgggggaggtgtaccagcagctgcacgccgccatgagccaggcccctgtgaaggagaacatcccctacagctgggccagcctggcctgtgtgaaggcccaccactatgctgccctggcccactacttcaccgccatcctgctgattgaccaccaggtgaagccaggcacagacctggaccaccaggagaagtgcctgagccagctgtatgaccacatgcctgagggcctgacccccctggccaccctgaagaatgaccagcagaggcggcagctgggcaagagccacctgcggcgggccatggcccaccacgaggagagcgtgcgggaggccagcctgtgcaagaagctgcggagcattgaggtgctgcagaaggtgctgtgtgccgcccaggagaggagccggctgacctacgcccagcaccaggaggaggatgacctgctgaacctgattgatgcccccagcgtggtggccaagacagagcaggaggtggacatcatcctgccccagttcagcaagctgactgtgacagacttcttccagaagctgggccccctgtctgtgttcagcgccaacaagcgctggaccccacccaggagcatccgcttcaccgctgaggagggggacctgggcttcaccctgcggggaaatgcccctgtgcaggtgcacttcctggacccctactgcagcgcctctgtggccggggcccgggagggggactacatcgtgtccatccagctggtggactgcaagtggctgaccctgtctgaggtgatgaagctgctgaagagctttggagaagatgaaattgagatgaaggtggtgtccctgctggacagcaccagctccatgcacaacaagagcgccacctacagcgtgggcatgcagaagacctacagcatgatctgcctggccattgatgatgatgacaagacagacaagaccaagaagatcagcaagaagctgtccttcctgtcctggggcaccaacaagaaccggcagaagagcgccagcaccctgtgcctgcccagcgtgggcgccgcccggccccaggtgaagaagaagctgcccagccccttcagcctgctgaacagcgacagctcctggtactag

SEQ ID NO: 22496 - DNA, 6201 bp, Artificial Sequence
  Description of Artificial Sequence: Synthetic coding sequence
atgtgcagcaccccaggcatgcctgcccctggggccagcctggccctgcgggtgtcctttgtggatgtgcacccagatgtgattcctgtgcagctgtggggcctggtgggggagaggagaggagagtacctgcggctgagccgggagatccaggaggccgccgccacccggggccagtgggccctgggcagcgccagcgccagccctggagagctgtgcctggtgcaggtgggcctgctgtggcaccgctgccgggtggtgtcccggcaggcccaggagagcagggtcttcctgctggatgagggccgcaccatcacagctggagctggcagcctggcccctggccggcgggagttcttcaacctgcccagcgaggtgctgggctgtgtgctggccggcctggtgcctgctggctgtggggccggcagcggggagcccccccagcactggccagcagatgctgtggacttcctgagcaacctgcagggcaaggaggtgcacggctgtgtgctggatgtgctgctgctgcaccggctggtgctgctggaggtgcctgatgtgttccagcagatgagggagctgggcctggcccggcgggtgcctgacagcctcttccgcagcctgctggagcgctacctgacagctgccacagcctctgtgggcagcggcgtgcctgtgctgagccgggtgcccctgaagcagaagcagcccggcctggactacttctacccccagctgcagctgggcgtgacagaagctgtggtgatcacccaggtgtgccacccccaccgcatccactgccagctgcggtctgtgtcccaggagatccaccggctgtctgagagcatggcccaggtgtaccggggcagcactggaactggagatgagaacagcaccagcgccacctgggaggagcgggaggagagcccagacaagccaggcagcccctgtgccagctgtggcctggatggccactggtaccgggccctgctgctggagaccttccggccccagagatgtgcccaggtgctgcacgtggactatggcaggaaggagctggtgtcctgcagcagcctgcgctacctgctgcctgagtacttcaggatgcctgtggtgacctacccctgtgccctgtatggcctgtgggatggcggccggggctggagccgcagccaggtgggggacctgaagaccctcatcctgggcaaggctgtgaatgccaagattgagttctactgcagctttgaacatgtgtactacgtgtccctgtatggagaagatggcatcaacctgaacagagtgtttggagtgcagagctgctgcctggccgacagagtgctgcagagccaggccacagaggaggaggagcctgagaccagccagagccagagccctgctgaggaggtggatgaggagatcagcctgcctgccctgcggagcatccggctgaagatgaatgccttctatgatgcccaggtggagtttgtgaagaaccccagcgagttctggatccggctgaggaagcacaacgtgaccttcagcaagctgatgaggaggatgtgtggcttctacagcagcgccagcaagctggatggagtggtgctgaagccagagccagatgacctgtgctgcgtgaagtggaaggaaaatggctactaccgggccatcgtgaccaagctggatgacaagtctgtggatgtgttcctggtggaccggggcaacagtgaaaatgtggactggtatgatgtgaggatgctgctgccccagttccggcagctgcccatcctggccgtgaagtgcaccctggccgacatctggcccctgggcaagacctggagccaggaggccgtgtccttcttcaagaagacagtgctgcacaaggagctggtgatccacatcctggacaagcaggaccaccagtatgtgattgagatcctggatgagagcaggactggagaggagaacatcagcaaggtgattgcccaggccggctacgccaagtaccaggagtttgagaccaaggagaacatcctggtgaatgcccacagccctggccacgtgagcaaccacttcaccacagagagcaacaagatcccctttgccaagacaggagagggggagcagaaggccaagcgggagaacaagaccacctctgtgtccaaggccctgagtgacaccaccgtggtgaccaacggcagcacagagctggtggtgcaggagaaggtgaagagggcctctgtgtacttccccctgatgcagaactgcctggagatcaagccaggcagcagcagcaaaggagagctggaggtgggcagcacagtggaggtgcgggtgtcctatgtggagaaccctggctacttctggtgccagctgaccaggaacatccagggcctgaagaccctgatgtctgacatccagtactactgcaagaacacagctgccccccaccagaggaacaccctggcctgcctggccaagaggacagtgaaccggcagtggagccgggccctgatcagcggcatccagagcgtggagcacgtgaatgtgacctttgtggactatggagaccgggagatggtgtctgtgaagaacatctacagcatcagcgaggagttcctgaaggtgaaggcccaggccttccgctgcagcctgtacaacctgatccagcctgtgggccagaacccctttgtgtgggatgtgaaggccatccaggccttcaatgagttcatcgacaatgcctggcagaagaacctggagctgaagtgcaccatctttgccctggccagcatcaatgaggagctgttcaacatcgtggacctgctgacccccttccagagcgcctgccacttcctggtggagaagaggctggcccggcctgtgaagctgcagaagcccctggagagctctgtgcagctgcacagctacttctacagcacccatgacatgaagattggcagcgaggagctggtgtacatcacccacattgatgacccctggaccttctactgccagctggccagaaatgccaacatcctggagcagctgagctgcagcatcacccagctgagcaaggtgctgctgaacctgaagaccagccccctgaaccctggcaccctgtgcctggccaagtacacagatggcaactggtaccggggcatcgtgattgagaaggagcccaagaaggtgttctttgtggactttggaaacatctacgtggtgaccagtgatgacctgctgcccatccccagtgatgcctatgatgtgctgctgctgcccatgcaggccgtgcgctgcagcctgagtgacatcccagaccacatccctgaggaggtggtggtgtggttccaggagaccatcctggacaagagcctgaaggccctggtggtggccaaggaccctgatggcaccctcatcatcgagctgtatggagacaacatccagatcagcgccagcatcaacaagaagctgggcctgctgagctacaaggaccgcatcaggaagaaggagagcgaggtgctgtgcagcaccacagagaccctggaggagaagaatgaaaacatgaagctgccctgcacagagtacctgagcaagtctgtgggctacaagctgcccaacaaggagatcctggaggagagctacaagccccagatcaacagcagctacaaggagctgaagctgctgcagagcctgaccaagaccaacctggtgacccagtaccaggacagcgtgggcaacaagaacagccaggtgttccccctgaccacagagaagaaggaggagatctctgctgagacccccctgaagacagcccgggtggaggccaccctgtctgagaggaagattggagacagctgtgacaaggacctgcccctgaagttctgtgagttcccccagaagaccatcatgcctggcttcaagaccaccgtgtatgtgagccacatcaatgacctgagtgacttctacgtgcagctgattgaagatgaagctgagatcagccacctgtctgagcggctgaacagcgtgaagaccaggcctgagtactacgtgggcccccccctgcagagaggagacatgatctgtgctgtgtttcctgaggacaacctgtggtaccgggccgtcatcaaggagcagcagcccaatgacctgctgtctgtgcagttcatcgactatggaaatgtgtctgtggtgcacaccaacaagattggccgcctggacctggtgaatgccatcctgcccggcctgtgcatccactgcagcctgcagggctttgaggtgcctgacaacaagaacagcaagaagatgatgcactacttcagccagaggaccagcgaggccgccatccgctgtgaatttgtgaagttccaggaccgctgggaggtgatcctggctgatgagcacggcatcatcgcagatgacatgatcagccgctatgccctgtctgagaagagccaggtggagctgagcacccaggtgatcaagagcgccagcagcaagtctgtgaacaagagtgacatcgacaccagcgtcttcctgaactggtacaaccctgagaagaagatgatccgggcctatgccaccgtgattgatggccctgagtacttctggtgccagtttgctgacacagagaagctgcagtgcctggaggtggaggtgcagacagctggggagcaggtggccgacagaagaaactgcatcccctgcccctacatcggggacccctgcatcgtgcgctaccgggaggatggccactactaccgggccctgatcaccaacatctgtgaggactacctggtgtctgtgcggctggtggactttggaaatattgaggactgtgtggaccccaaggccctgtgggccatccccagcgagctgctgtctgtgcccatgcaggccttcccctgctgcctgagcggcttcaacatcagcgagggcctgtgcagccaggagggcaatgactacttctatgagatcatcacagaagatgtgctggagatcaccatcctggagatcagaagagatgtgtgtgacatccccctggccatcgtggacctgaagagcaagggcaagagcatcaatgagaagatggagaagtacagcaagacaggcatcaagagcgccctgccctatgagaacatcgacagcgagatcaagcagaccctgggcagctacaacctggatgtgggcctgaagaagctgagcaacaaggctgtgcagaacaagatctacatggagcagcagacagatgagctggccgagatcacagagaaggatgtgaacatcatcggcaccaagcccagcaacttccgggaccccaagacagacaacatctgtgagggctttgagaacccctgcaaggacaagattgacacagaggagctggagggggagctggagtgccacctggtggacaaggccgagtttgatgacaagtacctgatcaccggcttcaacaccctgctgccccacgccaatgagaccaaggagatcctggagctgaacagcctggaggtgcccctgagcccagatgatgagagcaaggagttcctggagctggagagcattgagctgcagaacagcctggtggtggatgaggagaagggggagctgagccctgtgcccccaaatgtgcccctgagccaggagtgtgtgaccaagggggccatggagctgttcaccctgcagctgcccctgagctgtgaggccgagaagcagcctgagctggagctgcccacagcccagctgcccctggatgacaagatggaccccctgagcctgggcgtgtcccagaaggcccaggagagcatgtgcacagaggacatgaggaagagcagctgtgtggagagctttgatgaccagaggaggatgagcctgcacctgcacggggctgactgtgaccccaagacccagaatgagatgaacatctgtgaggaggagtttgtggagtacaagaacagagatgccatcagcgccctgatgcccctcttcagcgaggaggagagcagtgatggcagcaagcacaacaacggcctgcctgaccacatcagcgcccagctgcagaacacctacaccctgaaggccttcaccgtgggcagcaaatgtgtggtgtggagcagcctgaggaacacctggagcaaatgtgagatcctggagacagctgaggagggcaccaggaagaggggcctggaggtgatggagatctag

SEQ ID NO: 22497 - DNA, 264 bp, Artificial Sequence
  Description of Artificial Sequence: Synthetic coding sequence
atgagcagctgtgtgagcagccagcccagcagcaacagagctgccccccaggatgagctgggcggccggggcagcagcagcagcgagagccagaagccctgtgaggccctgcggggcctgagcagcctgagcatccacctgggcatggagagcttcatcgtggtgacagaatgtgagcccggctgtgctgtggacctgggcctggcccgggaccggcccctggaggctgatggccaggaggtgcccctggacaccagcggctag

SEQ ID NO: 22498 - DNA, 2469 bp, Artificial Sequence
  Description of Artificial Sequence: Synthetic coding sequence
atggctgctgagggggaccctgagtggggccccaccccacccagcaccagcgccaccacagctgccaggagagctgtgaacaaggtggtgtatgatgaccacgagagcgaggaggaggaggaggaggaggacatggtgtctgaggaggaggaggaggaggatggagatgctgaggagacccaggacagtgaagatgatgaggaggatgagatggaggaggatgatgatgacagcgactacccagaggagatggaggatgatgatgatgatgccagctactgcacagagagcagcttccgcagccacagcacctacagcagcaccccaggaagaaggaagccccgggtgcaccggcccaggagccccatcctggaggagaaggacatcccccccctggagttccccaagagcagcgaggacctgatggtgcccaatgagcacatcatgaatgtcatcgccatctatgaggtgctgaggaactttggaacagtgctgcggctgagccccttccgctttgaggacttctgtgccgccctggtgtcccaggagcagtgcaccctgatggccgagatgcacgtggtgctgctgaaggctgtgctgcgggaggaggacaccagcaacaccaccttcggccctgctgacctgaaggacagcgtgaacagcaccctgtacttcattgatggcatgacctggccagaggtgctgcgggtgtactgtgagagtgacaaggagtaccaccacgtgctgccctaccaggaggccgaggactacccctacggccctgtggagaacaagatcaaggtgctgcagttcctggtggaccagttcctgaccaccaacatcgcccgggaggagctgatgtctgagggcgtcatccagtatgatgaccactgccgggtgtgccacaagctgggggacctgctgtgctgtgagacctgcagcgctgtgtaccacctggagtgtgtgaagccacccctggaggaggtgcctgaagatgagtggcagtgtgaggtgtgtgtggcccacaaggtgcctggggtgacagactgtgtggccgagatccagaagaacaagccctacatcagacatgagcccatcggctatgacaggagcaggaggaagtactggttcctgaacagaagactcatcatcgaggaggacacagaaaatgaaaatgagaagaagatctggtactacagcaccaaggtgcagctggccgagctgattgactgcctggacaaggactactgggaggccgagctgtgcaagatcctggaggagatgagggaggagatccaccgccacatggacatcacagaggacctgaccaacaaggcccggggcagcaacaagagcttcctggccgccgccaatgaggagatcctggagagcatccgggccaagaagggggacatcgacaacgtgaagagccctgaggagacagagaaggacaagaatgaaacagaaaatgacagcaaggatgctgagaagaaccgggaggagtttgaggaccagagcctggagaaggacagtgatgacaagaccccagatgatgatcctgagcagggcaagtctgaggagcccacagaggtgggggacaagggcaacagcgtgtctgccaacctgggggacaacaccaccaatgccaccagcgaggagaccagccccagcgagggccgcagccctgtgggctgcctgtctgagaccccagacagcagcaacatggccgagaagaaggtggccagcgagctgccccaggatgtgcctgaggagcccaacaagacctgtgagagcagcaacaccagcgccaccaccaccagcatccagcccaacctggagaacagcaacagcagcagcgagctgaacagcagccagagcgagagcgccaaggccgcagatgatcctgaaaatggagagcgggagagccacacccctgtgtccatccaggaggagatcgtgggggacttcaagtctgagaagagcaatggagagctgtctgagagccctggagctggaaaaggagccagcggcagcacccgcatcatcacccggctgaggaacccagacagcaagctgagccagctgaagagccagcaggtggccgctgctgcccacgaggccaacaagctgttcaaggagggcaaggaggtgctggtggtgaacagccagggcgagatcagccggctgagcaccaagaaggaggtgatcatgaagggcaacatcaacaactacttcaagctgggccaggagggcaagtacagagtgtaccacaaccagtacagcaccaacagctttgccctgaacaagcaccagcaccgggaggaccatgacaagagaagacacctggcccacaagttctgcctgaccccagctggggagttcaagtggaatggatctgtgcacggcagcaaggtgctgaccatcagcaccctgcggctgaccatcacccagtacggggagaacctgtag

SEQ ID NO: 22499 - DNA, 552 bp, Artificial Sequence
  Description of Artificial Sequence: Synthetic coding sequence
atgctgcagcagacctggaccagccgctgcctgatgaagttctatgctgtggtggccaccagccctgcctcctgggagagccacaagattgctgagcgcatcgagcagaggatcctgaacagcaaccctgtgatggaggcctttggaaatgcctgcaccctgaggaacaacaacagcagcagatttgggaagttcatccagctgcagctgaacagagcccagcagatgactggagctgctgtgcagacctacctgctggagaagaccagggtggcctgccaggccagcagcgagaggaacttccacatcttctaccagatctgcaagggggcctctgaagatgagcggctgcagtggcacctgcctgagggcgccgccttctcctggctgcccaaccctgagaggagcctggaggaggactgctttgaggtgacccgggaggccatgctgcacctgggcatcgacacccccacccagaacaacatcttcaaggtgcggaggaaggccacccccctgaagtttggaagagatgatggccagccctttgcctag

SEQ ID NO: 22500 - DNA, 744 bp, Artificial Sequence; identical to SEQ ID NO: 20004
  Description of Artificial Sequence: Synthetic coding sequence

SEQ ID NO: 22501 - DNA, 981 bp, Artificial Sequence
  Description of Artificial Sequence: Synthetic coding sequence
atgctgggcggcgtgggggaggagaatgagaagctgtggagcttcaccaagaaggccagccacatccagctggacagcctgcctgaggtgcccctgctggtggatgtgccctgcctgagcgcccagctggatgacagcatcctgaacatcgtgaaggaccacatcttcaagcacggcaccgtggccagcaggcctcctgtgcagatcgaggagctgattgagaagccaggcggcatcatcgtgcgctggtgcaaggtggatgatgacttcaccgcccaggactaccgcctgcagttcaggaagtgcaccagcaaccactttgaagatgtgtatgtgggcagcgagacagagttcatcgtgctgcacatcgaccccaacgtggactaccagttccgggtgtgtgcccggggagatggccggcaggagtggagcccctggagcgtgccccagatcggccacagcaccctggtgccccatgagtggacagctggctttgagggctacagcctgagcagcagaagaaacatcgccctgagaaatgacagcgagagcagtggagtgctgtacagccgggcccccacctacttctgtggccagaccctgaccttccgggtggagaccgtgggccagcctgacagaagagacagcattggagtgtgtgccgagaagcaggacggctatgacagcctgcagagggaccaggccgtgtgcatcagcaccaatggagctgtgtttgtgaatggcaaggagatgaccaaccagctgcctgctgtgaccagcggcagcacagtgacctttgacatcgaggccgtgaccctgggcaccaccagcaacaatgaaggaggccacttcaagctgcgggtgaccatcagcagcaacaaccgggaggtggtgtttgactggctgctggaccagagctgtggcagcctgtacttcggctgcagcttcttctacccaggctggaaggtgctggtgttctag

SEQ ID NO: 22502 - DNA, 2436 bp, Artificial Sequence
  Description of Artificial Sequence: Synthetic coding sequence
atggtgtctgaggaggaggaggaggaggatggagatgctgaggagacccaggacagtgaagatgatgaggaggatgagatggaggaggatgatgatgacagcgactacccagaggagatggaggatgatgatgatgatgccagctactgcacagagagcagcttccgcagccacagcacctacagcagcaccccaggaagaaggaagccccgggtgcaccggcccaggagccccatcctggaggagaaggacatcccccccctggagttccccaagagcagcgaggacctgatggtgcccaatgagcacatcatgaatgtcatcgccatctatgaggtgctgaggaactttggaacagtgctgcggctgagccccttccgctttgaggacttctgtgccgccctggtgtcccaggagcagtgcaccctgatggccgagatgcacgtggtgctgctgaaggctgtgctgcgggaggaggacaccagcaacaccaccttcggccctgctgacctgaaggacagcgtgaacagcaccctgtacttcattgatggcatgacctggccagaggtgctgcgggtgtactgtgagagtgacaaggagtaccaccacgtgctgccctaccaggaggccgaggactacccctacggccctgtggagaacaagatcaaggtgctgcagttcctggtggaccagttcctgaccaccaacatcgcccgggaggagctgatgtctgagggcgtcatccagtatgatgaccactgccgggtgtgccacaagctgggggacctgctgtgctgtgagacctgcagcgctgtgtaccacctggagtgtgtgaagccacccctggaggaggtgcctgaagatgagtggcagtgtgaggtgtgtgtggcccacaaggtgcctggggtgacagactgtgtggccgagatccagaagaacaagccctacatcagacatgagcccatcggctatgacaggagcaggaggaagtactggttcctgaacagaagactcatcatcgaggaggacacagaaaatgaaaatgagaagaagatctggtactacagcaccaaggtgcagctggccgagctgattgactgcctggacaaggactactgggaggccgagctgtgcaagatcctggaggagatgagggaggagatccaccgccacatggacatcacagaggacctgaccaacaaggcccggggcagcaacaagagcttcctggccgccgccaatgaggagatcctggagagcatccgggccaagaagggggacatcgacaacgtgaagagccctgaggagacagagaaggacaagaatgaaacagaaaatgacagcaaggatgctgagaagaaccgggaggagtttgaggaccagagcctggagaaggacagtgatgacaagaccccagatgatgatcctgagcagggcaagtctgaggagcccacagaggtgggggacaagggcaacagcgtgtctgccaacctgggggacaacaccaccaatgccaccagcgaggagaccagccccagcgagggccgcagccctgtgggctgcctgtctgagaccccagacagcagcaacatggccgagaagaaggtggccagcgagctgccccaggatgtgcctgtgggggacttcaagtctgagaagagcaatggagagctgtctgagagccctggggccggcaagggggccagcggcagcacccgcatcatcacccggctgagaaatccagacagcaagctgagccagctgaagagccagcaggtggccgccgccgcccacgaggccaacaagctgttcaaggagggcaaggaggtgctggtggtgaacagccagggcgagatcagccggctgagcaccaagaaggaggtgatcatgaagggcaacatcaacaactacttcaagctgggccaggagggcaagtacagagtgtaccacaaccagtacagcaccaacagctttgccctgaacaagcaccagcacagagaagatcatgacaagaggaggcacctggcccacaagttctgcctgaccccagctggggagttcaagtggaatggatctgtgcacggcagcaaggtgctgaccatcagcaccctgcggctgaccatcacccagctggagaacaacatccccagcagcttcctgcaccccaactgggccagccaccgggccaactggatcaaggctgtgcagatgtgcagcaagccccgggagtttgccctggccctggccatcctggagtgtgctgtgaagcctgtggtgatgctgcccatctggagggagagcctgggccacacccggctgcacaggatgaccagcattgagcgggaggagaaggagaaggtgaagaagcgggaggagactggaagaagaagaaatgatgctgccagtgacatgggcaagatccacatcagcagctag

SEQ ID NO: 22503 - DNA, 1752 bp, Artificial Sequence
  Description of Artificial Sequence: Synthetic coding sequence
atggcccctgagctgaccccagaggaggagcaggccaccaagcagttcctggaggagatcaacaagtggacagtgcagtacaacgtgagccccctgtcctggaatgtggccgtgaagttcctgatggccaggaagtttgatgtgctgcgggccatcgagctgttccacagctaccgggagaccaggaggaaggagggcatcgtgaagctgaagccccatgaggagcccctgcggtctgagatcctgagcggcaagttcaccatcctgaatgtgcgggaccccactggagccagcatcgccctcttcaccgcccggctgcaccacccccacaagtctgtgcagcacgtggtgctgcaggccctcttctacctgctggacagagctgtggacagctttgagacccagagaaatggcctggtgttcatctatgacatgtgtggcagcaactatgccaactttgagctggacctgggcaagaaggtgctgaacctgctgaagggggccttccctgcccggctgaagaaggtgctgattgtgggcgcccccatctggttccgggtgccctacagcatcatcagcctgctgctgaaggacaaggtgcgggagcgcatccagatcctgaagaccagcgaggtgacccagcacctgcccagagaatgtctgcctgagaacctgggcggctacgtgaagattgacctggccacctggaacttccagttcctgccccaggtgaatggccacccagacccctttgatgagatcatcctcttcagcctgcccccagccctggactgggacagcgtgcacgtgcccggcccccacgccatgaccatccaggagctggtggactatgtgaatgcccggcagaagcagggcatctatgaggagtatgaggacatcagaagagaaaatcctgtgggcaccttccactgcagcatgagccctggcaacctggagaagaacagatatggagatgtgccctgcctggaccagaccagggtgaagctgaccaagaggagcggccacacccagacagactacatcaatgccagcttcatggatggctacaagcagaagaatgcctacatcggcacccagggccccctggagaacacctacagagacttctggctgatggtgtgggagcagaaggtgctggtgattgtgatgaccaccaggtttgaggagggcggcagaagaaaatgtggccagtactggcccctggagaaggacagccgcatccgcttcggcttcctgactgtgaccaacctgggcgtggagaacatgaaccactacaagaagaccaccctggagatccacaacacagaggagcggcagaagaggcaggtgacccacttccagttcctgtcctggccagactatggagtgcccagcagcgctgccagcctgattgacttcctgcgggtggtgaggaaccagcagagcctggccgtgagcaacatgggcgcccggagcaagggccagtgcccagagccccccatcgtggtgcactgcagcgctggcattggaagaacaggcaccttctgcagcctggacatctgcctggcccagctggaggagctgggcaccctgaatgtgttccagacagtgtccaggatgaggacccagagggccttcagcatccagaccccagagcagtactacttctgctacaaggccatcctggagtttgctgagaaggagggcatggtgagcagcggccagaacctgctggccgtggagagccagtag

SEQ ID NO: 22504 - DNA, 396 bp, Artificial Sequence; identical to SEQ ID NO: 22413
  Description of Artificial Sequence: Synthetic coding sequence

SEQ ID NO: 22505 - DNA, 435 bp, Artificial Sequence
  Description of Artificial Sequence: Synthetic coding sequence
atggcctctgtggccgccgcccgggctgtgcctgtgggcagcggcctgcggggcctgcagaggaccctgcccctggtggtgatcctgggcgccaccggcaccgggaagagcaccctggccctgcagctgggccagaggctgggcggggagatcgtgtctgctgacagcatgcaggtgtatgagggcctggacatcatcaccaacaaggtgtctgcccaggagcagaggatctgccgccaccacatgatcagctttgtggaccccctggtgaccaactacacagtggtggacttcaggaacagagccacagccctgattgaggacatctttgcccgggacaagatccccatcgtggtgggcggcaccaactactacatcgagagcctgctgtggaaggtgctggtgaacaccaaggtgtccctggtgcacagctag

SEQ ID NO: 22506 - DNA, 1386 bp, Artificial Sequence
  Description of Artificial Sequence: Synthetic coding sequence
atggccgccagcagcctggagcagaagctgagccggctggaggccaagctgaagcaggagaaccgggaggcccggaggagaattgacctgaacctggacatcagcccccagaggccccggcccaccctgcagctgcccctggccaatgatggcggcagccgcagccccagcagcgagagcagcccccagcaccccaccccaccagcccggcccaggcacatgctgggcctgcccagcaccctcttcacccccaggtccatggagagcattgaaattgaccagaagctgcaggagatcatgaagcagacaggctacctgaccatcggcggccaggtgccccccagcctgtggagaggagagggcggcggccctgcccggctggaccccagctgggagcggcagtggggcgccggcggcggcggccggcccggcaccctgcagcccagcctgagcagccagcgctaccaggccgagatcaatgacctggagaacctgggggagatgggcagcggcacctgtggccaggtgtggaagatgaggttcaggaagacaggccacgtgattgctgtgaagcagatgaggaggagcggcaacaaggaggagaacaagaggatcctgatggacctggatgtggtgctgaagagccatgactgcccctacatcgtgcagtgcttcggcaccttcatcaccaacacagatgtgttcatcgccatggagctgatgggcacctgtgccgagaagctgaagaagaggatgcagggccccatccctgagcgcatcctgggcaagatgacagtggccatcgtgaaggccctgtactacctgaaggagaagcatggagtcatccacagagatgtgaagcccagcaacatcctgctggatgagcggggccagatcaagctgtgtgactttggcatcagcggccgcctggtggacagcaaggccaagaccaggtctgctggctgtgccgcctacatggcccctgagagaattgatcctccagaccccaccaagccagactatgacatccgggcagatgtgtggagcctgggcatcagcctggtggagctggccaccggccagttcccctacaagaactgcaagacagactttgaggtgctgaccaaggtgctgcaggaggagccccccctgctgcccggccacatgggcttcagcggggacttccagagctttgtgaaggactgcctgaccaaggaccacaggaagaggcccaagtacaacaagctgctggagcacagcttcatcaagagatatgagaccctggaggtggatgtggcctcctggttcaaggatgtgatggccaagacagagagccccaggaccagcggcgtgctgagccagccccacctgcccttcttcagatag

SEQ ID NO: 22507 - DNA, 1611 bp, Artificial Sequence
  Description of Artificial Sequence: Synthetic coding sequence
atggagaccagtgacatccagatcttctaccaggaggaccctgagtgccagaacctgtctgagaacagctgccccccatctgaggtgtctgacaccaacctgtacagccccttcaagcccaggaactaccagctggagctggccctgcctgccatgaagggcaagaacaccatcatctgtgcccccaccggctgcggcaagacctttgtgtccctgctgatctgtgagcaccacctgaagaagttcccccagggccagaagggcaaggtggtgttctttgccaaccagatccctgtgtatgagcagcagaagtctgtgttcagcaagtactttgagcggcacggctacagagtgacaggcatcagcggggccacagcagaaaatgtgcctgtggagcagatcgtggagaacaatgacatcatcatcctgaccccccagatcctggtgaacaacctgaagaagggcaccatccccagcctgagcatcttcaccctgatgatctttgatgagtgccacaacaccagcaagcagcacccctacaacatgatcatgttcaactacctggaccagaagctgggcggcagcagcggccccctgccccaggtgattggcctgacagcctctgtgggcgtgggagatgccaagaacacagatgaggccctggactacatctgcaagctgtgtgccagcctggatgccagcgtcatcgccaccgtgaagcacaacctggaggagctggagcaggtggtgtacaagccccagaagttcttcaggaaggtggagagccgcatcagtgacaagttcaagtacatcatcgcccagctgatgagggacacagagagcctggccaagaggatctgcaaggacctggagaacctgagccagatccagaaccgggagtttggcacccagaagtatgagcagtggatcgtgacagtgcagaaggcctgcatggtgttccagatgccagacaaggatgaggagagccgcatctgcaaggccctcttcctgtacaccagccacctgaggaagtacaatgatgccctgatcatcagcgagcacgccaggatgaaggatgccctggactacctgaaggacttcttcagcaatgtgcgggccgccggctttgatgaaattgagcaggacctgacccagagatttgaggagaagctgcaggagctggagagcgtgtcccgggaccccagcaatgaaaaccccaagctggaggacctgtgcttcatcctgcaggaggagtaccacctgaaccctgagaccatcaccatcctgtttgtgaagacccgggccctggtggatgccctgaagaactggattgagggcaaccccaagctgtccttcctgaagccaggcatcctgaccggccggggcaagaccaaccagaacacaggcatgaccctgcctgcccagaagtgcatcctggatgccttcaaggccagcggggaccacaacatcctgattgccacctctgtggctgatgagggcattgatattgcccagtgcaacctggtgatcctgtatgaatatgtgggcaatgtcatcaagatgatccagacccgggaggaggagcaggaggtggccagcgccagcttctag

SEQ ID NO: 22508 - DNA, 2883 bp, Artificial Sequence; identical to SEQ ID NO: 18452
  Description of Artificial Sequence: Synthetic coding sequence

SEQ ID NO: 22509 - DNA, 666 bp, Artificial Sequence
  Description of Artificial Sequence: Synthetic coding sequence
atgctggccgccggcctgctggaggagctgcgggacttccaccggcgctacaaccagaagaatgtgtctgagaacagccaggactaccagcacggcatcttccagagcatcggcttcaaggagttccacgagtacctgatcacagagggcaagtgcaccctggagaccagcaaccagctgctgaagaagggcatcgaggccctgaagcaggtgaccaagagatatgccaggaagcagaaccgctgggtgaagaaccgcttcctgagcaggcctggccccatcgtgccccctgtgtatggcctggaggtgtctgatgtgtccaagtgggaggagagcgtgctggagcccgccctggagatcgtgcagagcttcatccagggccacaagcccacagccacccccatcaagatgccctacaatgaagctgagaacaagaggagctaccacctgtgtgacctgtgtgaccgcatcatcattggagaccgggagtgggccgcccacatcaagagcaagagccacctgaaccagctgaagaagagaagaaggctggacagtgatgctgtgaacaccatcgagagccagagcgtgtccccagaccacaacaaggagcccaaggagaagggcagccctggccagaatgaccaggagctgaagtgcagcgtgtag

SEQ ID NO: 22510 - DNA, 2649 bp, Artificial Sequence
  Description of Artificial Sequence: Synthetic coding sequence
atgccccgggtgaagcccaagctggagaagcagctgcagaaggacaaggagaaggtggaggagttcaagagcatcccagccaagagcaacaacatcatcaatgagaccaccaccagaaataatgccctggagaaggagaaggagaaggaggagaagaagctgaaggaggtgatggacagcctgaagcaggagacccagggcctgcagaaggagaaggagagccgggagaaggagctgatgggcttcagcaagtctgtgaatgaggcccggagcaagatggatgtggcccagagcgagctggacatctacctgagccgccacaacacagctgtgtcccagctgaccaaggccaaggaggccctgattgctgccagcgagaccctgaaggagaggaaggccgccatccgggacatcgagggcaagctgccccagacagagcaggagctgaaggagaaggagaaggagctgcagaagctgacccaggaggagaccaacttcaagagcctggtgcatgacctcttccagaaggtggaggaggccaagagcagcctggccatgaacagaagccggggcaaggtgctggatgccatcatccaggagaagaagagcggccgcatccctggcatctacggccgcctgggggacctgggcgccattgatgagaagtatgatgtggccatcagcagctgctgccacgccctggactacatcgtggtggacagcattgacatcgcccaggagtgtgtgaacttcctgaagaggcagaacattggagtggccaccttcatcggcctggacaagatggctgtgtgggccaagaagatgacagagatccagaccccagagaacaccccccggctgtttgacctggtgaaggtgaaggatgagaagatccggcaggccttctactttgccctgcgggacaccctggtggccgacaacctggaccaggccaccagggtggcctaccagaaggaccggcgctggagggtggtgaccctgcagggccagatcatcgagcagagcggcaccatgactggaggcggcagcaaggtgatgaagggccgcatgggcagcagcctggtgattgagatcagcgaggaggaggtgaacaagatggagagccagctgcagaatgacagcaagaaggccatgcagatccaggagcagaaggtgcagctggaggagcgggtggtgaagctgcggcacagcgagcgggagatgaggaacaccctggagaagttcaccgccagcatccagaggctgattgagcaggaggagtacctgaatgtgcaggtgaaggagctggaggccaacgtgctggccacagccccagacaagaagaagcagaagctgctggaggagaatgtgtctgccttcaagacagaatatgatgctgtggccgagaaggccggcaaggtggaggccgaggtgaagaggctgcacaacaccatcgtggagatcaacaaccacaagctgaaggcccagcaggacaagctggacaagatcaacaagcagctggatgaatgtgccagcgccatcaccaaggcccaggtggccatcaagacagctgacaggaacctgcagaaggcccaggacagcgtgctgaggacagagaaggagatcaaggacacagagaaggaggtggatgacctgacagctgagctgaagagcctggaggacaaggctgctgaggtggtgaagaacaccaatgctgctgaggagagcctgcctgagatccagaaggagcacaggaacctgctgcaggagctgaaggtgatccaggagaatgaacatgccctgcagaaggatgccctgagcatcaagctgaagctggagcagattgatggccacatcgccgagcacaacagcaagatcaagtactggcacaaggagatcagcaagatcagcctgcaccccatcgaggacaaccccatcgaggagatctctgtgctgagccctgaggacctggaggccatcaagaacccagacagcatcaccaaccagatcgccctgctggaggcccgctgccacgagatgaagcccaacctgggcgccatcgccgagtacaagaagaaggaggagctgtacctgcagagggtggccgagctggacaagatcacctatgagcgggacagcttccggcaggcctatgaggacctgaggaagcagaggctgaatgagttcatggccggcttctacatcatcaccaacaagctgaaggagaactaccagatgctgaccctgggcggagatgctgagctggagctggtggacagcctggaccccttcagcgagggcatcatgttttctgtgcggccccccaagaagtcctggaagaagatcttcaacctgagcggcggggagaagaccctgagcagcctggccctggtgtttgccctgcaccactacaagcccacccccctgtacttcatggatgaaattgatgctgccctggacttcaagaatgtgtccatcgtggccttctacatctatgagcagaccaagaatgcccagttcatcatcatcagcctgaggaacaacatgtttgagatcagtgaccggctgattggcatctacaagacctacaacatcaccaagtctgtggccgtgaaccccaaggagatcgccagcaagggcctgtgctag

SEQ ID NO: 22511 - DNA, 1038 bp, Artificial Sequence
  Description of Artificial Sequence: Synthetic coding sequence
atgttcctgacccggcccaaggtgtgtgtggacctgaacagaagagtgaccctgtatggagtcttcaccatccacttcagccccaacgtgcccagccgctgcctgctgctggagctgctggatgtgtctgtgtctgagctgctgctgtacagcagccaccagggctgcagcatgtggatgatccagcactgtgccagagatgtgctggaggccctggccttcctgcaccacgagggctacgtgcatgctgacctgaagcccaggaacatcctgtggagcgcagaaaatgaatgcttcaagctgattgactttggcctgtccttcaaggagggcaaccaggatgtgaagtacatccagacagatggctaccgggcccctgaggccgagctgcagaactgcctggcccaggccggcctgcagagcgacacagagtgcaccagcgctgtggacctgtggagcctgggcatcatcctgctggagatgttttctggcatgaagctgaagcacacagtgcgcagccaggagtggaaggccaacagcagcgccatcatcgaccacatctttgccagcaaggctgtggtgaatgctgccatcccagcctaccacctgcgggacctgatcaagtccatgctgcatgatgaccccagccgccgcatcccagctgagatggccctgtgcagccccttcttcagcatcccctttgccccccacatcgaggacctggtgatgctgcccacccctgtgctgcggctgctgaatgtgctggatgatgactacctggagaatgaggaggagtatgaagatgtggtggaggatgtgaaggaggagtgccagaagtatggccctgtggtgtccctgctggtgcccaaggaaaatcctggccggggccaggtgtttgtggagtatgccaatgctggggacagcaaggccgcccagaagctgctgaccggccgcatgtttgatggcaagtttgtggtggccaccttctaccccctgagcgcctacaagaggggctacctgtaccagaccctgctgtag

SEQ ID NO: 22512 - DNA, 954 bp, Artificial Sequence
  Description of Artificial Sequence: Synthetic coding sequence
atgtggctggcccgggagggcatcgtggcccccctgcctggagagtggaagccctgccaggacatcactggagacatctactacttcaactttgccaacggccagagcatgtgggaccacccctgtgatgagcactaccgcagcctggtgatccaggagcgggccaagctgagcaccagcggggccatcaagaagaagaagaagaagaaggagaagaaggacaagaaggaccgggacccccccaagagcagcctggagacccagcctgaggagggcctgctgccccccagcagcttcctgtgcagcctgagccccccatctgcccctggcctggccgacctggacctggaccaggagatgcaggccatcagcgagggcagctacaacaagggcaagagccctggcatgctgggggacaccccctggaggttcatgggcgccctgcccaggaagctgcagcccctgagcaagggccagcccagccagatccaccaggtgtttgctgacatggagaagatcctgggccgggccccagcccagtgccggcgggagctgggggaccagcagggcctggagaagctgcagaaggccacagagaagatctacctgggcttcagtgaccctgagacagaggagctggagatgaggagccggcagcagaagctgggcaccccagccccccagaacacaggcctgctgcagaacatgcaggatgtggtggagagcaggaaccaggcctctgtgcacagcaagctgtctgaggccatcaagggcctgcccctgaagggggagcagcacagccacagcctggccaagctgagccccaccggccctggaggagacaagggccagagccccatccccatgtggatctgctgccgcctgcgggccagcaactgcaggaacaccagcgctgcctggaggctgaagctgaagaggagcagcacctgctag

SEQ ID NO: 22513 - DNA, 162 bp, Artificial Sequence
  Description of Artificial Sequence: Synthetic coding sequence
atgggcaacagcgacagccagtacaccctgcagggcagcaagaaccacagcaacaccatcactggagccaagcagatcccctgcagcctgaagatccggggcatccacgccaaggaggagaagagcctgcacggctggggccacggcagcaatggagcctag

SEQ ID NO: 22514 - DNA, 1203 bp, Artificial Sequence
  Description of Artificial Sequence: Synthetic coding sequence
gcctggctgcagagcgctggggagctgcccagtgatggcggctgcagccggctgcgctggcaggcccacctggagttcacccacaaccatgatgtgggggacctgacctgggacaagattgctgtgtccctgcccaggtctgagaagctgcggagcctggtgctggccggcatcccccacggcatgaggccccagctgtggatgaggctgagcggggccctgcagaagaagaggaacagcgagctgagctaccgggagatcgtgaagaacagcagcaatgatgagaccatcgccgccaagcagatcgagaaggacctgctgcggaccatgcccagcaatgcctgctttgcctccatgggcagcattggagtgccccggctgcggcgggtgctgcgggccctggcctggctgtacccagaaattggctactgccagggcaccggcatggtggccgcctgcctgctgctcttcctggaggaggaggatgccttctggatgatgtctgccatcatcgaggacctgctgcctgccagctacttcagcaccaccctgctgggcgtgcagacagaccagagggtgctgcggcacctgattgtgcagtacctgccccggctggacaagctgctgcaggagcatgacatcgagctgagcctcatcaccctgcactggttcctgacagcctttgcctctgtggtggacatcaagctgctgctgcgcatctgggacctcttcttctatgagggcagccgggtgctcttccagctgaccctgggcatgctgcacctgaaggaggaggagctgatccagagtgaaaattctgccagcatcttcaacaccctgagtgacatccccagccagatggaggatgctgagctgctgctgggcgtggccatgaggctggccggcagcctgacagatgtggccgtggagacccagaggaggaagcacctggcctacctgattgctgaccagggccagctgctgggcgccggcaccctgaccaacctgagccaggtggcccaggacggcggcccccacctggacccccagcacacaggccggcggggccacctggaggtgcagagcgctggagctgctgagaacaagccagccctgcctgccctgccccccagcctggcccagagcgaccacagctgtggggtcatccaggccagcagcggctttgtgcacctgcgcttctag

SEQ ID NO: 22515 - DNA, 294 bp, Artificial Sequence
  Description of Artificial Sequence: Synthetic coding sequence
atgctgcggggcaccaaggagatggacaacatgagcccccggctgcgggccttcctgtctgagcccatcggggagaaggatgtgtgctgggtggatggcatcagccatgagctggccatcaacctggtgaccaagggcatcaacaaggcctacatcctgctgggccagttcctgctgatgcacaagaatgaagctgagttccagcgctggctgatctgctgctttggagccacagaatgtgaggcccagcagaccagccactgcctgaaggagtggtgtgcctgcttcctgtag

SEQ ID NO: 22516 - DNA, 1011 bp, Artificial Sequence
  Description of Artificial Sequence: Synthetic coding sequence
atggagtacctgggcggcggcagcgccctggacctgctgaagccaggccccctggaggagacctacatcgccaccatcctgcgggagatcctgaagggcctggactacctgcacagcgagaggaagatccaccgggacatcaaggccgccaacgtgctgctgtctgagcagggagatgtgaagctggccgactttggagtggccggccagctgacagacacccagatcaagaggaacacctttgtgggcacccccttctggatggcccctgaggtgatcaagcagagcgcctatgacttcaaggctgacatctggagcctgggcatcacagccatcgagctggccaagggggagccccccaacagcgacctgcaccccatgagggtgctcttcctgatccccaagaacagcccccccaccctggagggccagcacagcaagcccttcaaggagtttgtggaggcctgcctgaacaaggacccccgcttccggcccacagccaaggagctgctgaagcacaagttcatcacccgctacaccaagaagaccagcttcctgacagagctgattgaccgctacaagcgctggaagtctgagggccatggagaggagagcagcagcgaggacagcgacattgatggagaggctgaagatggagagcagggccccatctggaccttcccccccaccatccggcccagcccccacagcaagctgcacaagggcacagccctgcacagcagccagaagccagctgagcctgtgaagaggcagcccaggagccagtgcctgagcaccctggtgcggcctgtgtttggagaggtgttcagccagctgaaggagaagcacaagcagagcggcggctctgtgggcgccctggaggagctggagaatgccttcagcctggccgaggagagctgccccggcatcagtgacaagctgatggtgcacctggtggagcgggtgcagcgcttcagccacaacagaaaccacctgaccagcaccaggtag

SEQ ID NO: 22517 - DNA, 1455 bp, Artificial Sequence
  Description of Artificial Sequence: Synthetic coding sequence
atggtgcatgagaccagctacagcgcccagttcaagggggaggccagcaagcccaccacagctgacaacaaggtgattgacagaagacgcatccgcagcctgtacagcgagcccttcaaggagccccccaaggtggagaagcccagcgtgcagagcagcaagcccaagaagaccagcgccagccacaagcccaccaggaaggccaaggacaagcaggccgtgtctggccaggccgccaagaagaagtctgctgagggccccagcaccaccaagccagatgacaaggagcagagcaaggagatgaacaacaagctggccgaggccaaggagagcctggcccagcctgtgtctgacagcagcaagacccagggccctgtggccacagagccagacaaggaccagggctctgtggtgcccggcctgctgaagggccagggccccatggtgcaggagcccctgaagaagcagggctctgtggtgcccggcccccccaaggacctgggccccatgatccccctgcctgtgaaggaccaggaccacacagtgcctgagcccctgaagaatgaaagccctgtgatcagcgcccctgtgaaggaccagggccccagcgtgcctgtgccccccaagaaccagagccccatggtgcctgccaaggtgaaggaccagggctctgtggtgcctgagagcctgaaggaccagggcccccgcatccctgagcctgtgaagaaccaggcccccatggtgcctgcccctgtgaaggatgagggccccatggtgtctgcctctgtgaaggaccagggccccatggtgtctgcccctgtgaaggaccagggccccatcgtgcctgcccctgtgaagggggagggccccatcgtgcctgcccctgtgaaggatgagggccccatggtgtctgcccccatcaaggaccaggaccccatggtgcctgagcaccccaaggatgagagcgccatggccacagcccccatcaagaaccagggctccatggtgtctgagcctgtgaagaaccagggcctggtggtgtctggccctgtgaaggaccaggatgtggtggtgcctgagcacgccaaggtgcatgattctgctgtggtggcccctgtgaagaaccagggccctgtggtgcctgagagcgtgaagaaccaggaccccatcctgcctgtgctggtgaaggaccagggccccaccgtgctgcagccccccaagaaccagggccgcatcgtgcctgagcccctgaagaaccaggtgcccatcgtgcctgtgcccctgaaggaccaggaccccctggtgcctgtgcctgccaaggaccagggccctgctgtgcctgagcccctgaagacccagggcccccgggacccccagctgcccaccgtgagccccctgccccgggtgatgatccccacagccccccacacagagtacatcgagagcagcccctag

SEQ ID NO: 22518 - DNA, 2103 bp, Artificial Sequence
  Description of Artificial Sequence: Synthetic coding sequence
atggccctgggggaggagaaggccgaggccgaggccagcgaggacaccaaggcccagagctatggccggggcagctgccgggagcagcccccccggctggaggccgagggcggcctcatcagccctgtgtggggcgctgagggcatcccagcccccacctgctggattggaacagaccccggcggccccagccgggcccaccagccccaggccagtgatgccaaccgggagcctgtggccgagaggtctgagcccgccctgagcggcctgcccccagccaccatgggcagcggggacctgctgctgtctggagagagccaggtggagaagaccaagctgagcagcagcgaggagttcccccagaccctgagcctgcccaggaccaccaccatctgcagcggccatgatgctgacacagaagatgaccccagcctggccgacctgccccaggccctggacctgagccagcagccccacagcagcggcctgagctgcctgagccagtggaagtctgtgctgagccctggcagcgctgcccagcccagcagctgcagcatcagcgccagcagcacaggcagcagcctgcagggccaccaggagcgggcagagccccggggcggcagcctggccaaggtgagcagcagcctggagcctgtggtgccccaggagcccagctctgtggtgggcctgggcccccggccccagtggagcccccagcccgtcttctctggaggagatgccagcggcctgggcagaagaaggctgtccttccaggccgagtactgggcctgtgtgctgcctgacagcctgccccccagcccagacagacacagccccctgtggaaccccaacaaggagtatgaggacctgctggactacacctaccccctgcggcccggcccccagctgcccaagcacctggacagccgggtgcctgctgaccctgtgctgcaggacagcggcgtggacctggacagcttctctgtgtccccagccagcaccctgaagagccccaccaacgtgagccccaactgccccccagctgaggccacagccctgcccttcagcggcccccgggagcccagcctgaagcagtggcccagccgggtgccccagaagcagggcggcatgggcctggcctcctggagccagctggccagcaccccccgggcccctggcagcagagatgcccgctgggagcggcgggagcccgccctgcggggggccaaggaccggctgaccatcggcaagcacctggacatgggcagcccccagctgcggacccgggaccggggctggcccagccccaggcctgagcgggagaagaggaccagccagagcgcccggcggcccacctgcacagagagccgctggaagtctgaggaggaggtggagagtgatgatgagtacctggccctgcctgcccggctgacccaggtgagcagcctggtgtcctacctgggcagcatcagcaccctggtgaccctgcccaccggggacatcaagggccagagccccctggaggtgtctgacagtgatggccctgccagcttccccagcagcagcagccagagccagctgcccccaggagctgccctgcagggcagcggggaccctgagggccagaacccctgcttcctgcggagctttgtgcgggcccatgacagcgctggggagggcagcctgggcagcagccaggccctgggcgtgagcagcggcctgctgaagacccggcccagcctgcctgcccggctggaccgctggcccttcagtgaccctgatgtggagggccagctgcccaggaagggcggggagcagggcaaggagagcctggtgcagtgtgtgaagaccttctgctgccagctggaggagctgatctgctggctgtacaacgtggctgatgtgacagaccacggcacagctgcccggagcaacctgaccagcctgaagagcagcctgcagctgtacagagtcatctgtggccctggcagcggcctcttcccccacaagtctgtggccaagctgctggactacaaggtgaagagccagatcaccaacgtgtggtacgtgattgcccagctgaccatcatccctgagatctag

SEQ ID NO: 22519 - DNA, 1626 bp, Artificial Sequence
  Description of Artificial Sequence: Synthetic coding sequence
atgaagagctatgtgtctgagaccatggccagccctgggaaggacaactacaggatgaagagctacaagaacaatgccctgaaccctgaggagatgagaagaagaagagaggaggagggcatccagctgaggaagcagaagcgggagcagcagctgttcaagagaagaaatgtggagctgatcaatgaggaggccgccatgtttgacagcctgctgatggacagctatgtgagcagcaccactggagagagcgtcatcacccgggagatggtggagatgctgttcagtgatgacagcgacctgcagctggccaccacccagaagttcaggaagctgctgagcaaggagcccagcccccccattgatgaggtgatcaacaccccccgggtggtggacagatttgtggagttcctgaagagaaatgaaaactgcaccctgcagtttgaggccgcctgggccctgaccaacatcgccagcggcaccagccagcagaccaagatcgtgattgaagctggagctgtgcccatcttcatcgagctgctgaacagcgactttgaagatgtgcaggagcaggccgtgtgggccctgggcaacattgctggggacagctctgtgtgccgggactatgtgctgaactgcagcatcctgaaccccctgctgaccctgctgaccaagagcacccggctgaccatgaccagaaatgctgtgtgggccctgagcaacctgtgccggggcaagaaccccccacctgagtttgccaaggtgagcccctgcctgcctgtgctgagccggctgctcttcagcagtgacagcgacctgctggctgatgcctgctgggccctgagctacctgagtgatggccccaatgagaagatccaggccgtcatcgacagcggcgtgtgccggcggctggtggagctgctgatgcacaatgactacaaggtggccagccctgccctgcgggctgtgggcaacatcgtgactggagatgacatccagacccaggtgatcctgaactgcagcgccctgccctgcctgctgcacctgctgagcagccccaaggagagcatcaggaaggaggcctgctggaccatcagcaacatcacagctggcaacagagcccagatccaggccgtgattgatgccaacatcttccctgtgctgattgagatcctgcagaaggccgagttccgcaccaggaaggaggccgcctgggccatcaccaatgccaccagcggcggcaccccagagcagatccgctacctggtgtccctgggctgcatcaagcccctgtgtgacctgctgactgtgatggacagcaagatcgtgcaggtggccctgaatggcctggagaacatcctgcggctgggggagcaggagggcaagaggagcggcagcggcgtgaacccctactgcggcctgattgaggaggcctacggcctggacaagattgagttcctgcagagccatgagaaccaggagatctaccagaaggcctttgacctgattgagcactactttggagtggaggatgatgacagcagcctggccccccaggtggatgagacccagcagcagttcatcttccagcagcctgaggcccccatggagggcttccagctgtag

SEQ ID NO: 22520 - DNA, 1716 bp, Artificial Sequence
  Description of Artificial Sequence: Synthetic coding sequence
atgctggactgtggcatgcacatgggcttcaatgatgaccggcgcttcccagacttctcctacatcacccagaatggccgcctgacagacttcctggactgtgtgatcatcagccacttccacctggaccactgtggggccctgccctacttcagcgagatggtgggctatgatggccccatctacatgacccaccccacccaggccatctgccccatcctgctggaggactacaggaagattgctgtggacaagaagggggaggccaacttcttcaccagccagatgatcaaggactgcatgaagaaggtggtggccgtgcacctgcaccagacagtgcaggtggatgatgagctggagatcaaggcctactatgccggccacgtgctgggcgccgccatgttccagatcaaggtgggcagcgagagcgtggtgtacacaggagactacaacatgaccccagacagacacctgggcgccgcctggattgacaagtgccggcccaacctgctgatcacagagagcacctacgccaccaccatccgggacagcaagcgctgccgggagcgggacttcctgaagaaggtgcatgaaacagtggagcggggcggcaaggtgctgatccctgtgtttgccctgggccgggcccaggagctgtgcatcctgctggagaccttctgggagaggatgaacctgaaggtgcccatctacttcagcacaggcctgacagagaaggccaaccactactacaagctgttcatcccctggaccaaccagaagatcaggaagacctttgtgcagaggaacatgtttgagttcaagcacatcaaggcctttgaccgggcctttgctgacaaccctggccccatggtggtgtttgccaccccaggcatgctgcatgctggccagagcctgcagatcttcaggaagtgggccggaaatgagaagaacatggtgatcatgcctggctactgtgtgcagggcaccgtgggccacaagatcctgagcggccagaggaagctggagatggagggccggcaggtgctggaggtgaagatgcaggtggagtacatgtccttcagcgcccacgcagatgccaagggcatcatgcagctggtgggccaggccgagcctgagagcgtgctgctggtgcatggagaggccaagaagatggagttcctgaagcagaagattgagcaggagctgcgggtgaactgctacatgcctgccaatggagagaccgtgaccctgcccaccagccccagcatccctgtgggcatcagcctgggcctgctgaagcgggagatggcccagggcctgctgcctgaggccaagaagccccggctgctgcacggcaccctcatcatgaaggacagcaacttccggctggtgagcagcgagcaggccctgaaggagctgggcctggccgagcaccagctgcgcttcacctgccgggtgcacctgcatgacaccaggaaggagcaggagacagccctgcgggtgtacagccacctgaagtctgtgctgaaggaccactgtgtgcagcacctgcctgatggctctgtgacagtggagagcgtgctgctgcaggccgccgcccccagcgaggaccccggcaccaaggtgctgctggtgtcctggacctaccaggatgaggagctgggcagcttcctgaccagcctgctgaagaagggcctgccccaggcccccagctag

SEQ ID NO: 22521 - DNA, 2232 bp, Artificial Sequence
  Description of Artificial Sequence: Synthetic coding sequence
atggaggccgctgctgtgacagtgaccaggtctgccaccaggagaagaagacggcagctgcagggcctggccgcccctgaggccggcacccaggaggagcaggaggaccaggagccccggcccaggagaagaagacctggccgcagcatcaaggatgaggaggaggagaccgtcttccgggaggtggtgtccttctccccagaccccctgcctgtgcgctactatgacaaggacaccaccaagcccatctccttctacctgagcagcctggaggagctgctggcctggaagccccggctggaggatggcttcaacgtggccctggagcccctggcctgccggcagccccccctgagcagccagaggcccaggaccctgctgtgccacgacatgatgggcggctacctggatgaccgcttcatccagggctctgtggtgcagaccccctatgccttctaccactggcagtgcattgatgtgtttgtgtacttcagccaccacacagtgaccatcccccctgtgggctggaccaacacagcccacagacatggagtgtgtgtgctgggcaccttcatcacagagtggaatgaaggaggccgcctgtgtgaggccttcctggccggagatgagaggagctaccaggccgtggccgaccggctggtgcagatcacccagttcttccgctttgatggctggctgatcaacatcgagaacagcctgagcctggccgctgtgggcaacatgccacccttcctgcgctacctgaccacccagctgcaccggcaggtgcctgggggcctggtgctgtggtatgattctgtggtgcagagcggccagctgaagtggcaggatgagctgaaccagcacaacagagtcttctttgacagctgtgatggcttcttcaccaactacaactggagggaggagcacctggagaggatgctgggccaggccggggagaggagagcagatgtgtatgtgggcgtggatgtgtttgcccggggaaatgtggtgggcggccgctttgacacagacaagagcctggagctgatcaggaagcacggcttctctgtggccctgtttgcccctggctgggtgtatgagtgcctggagaagaaggacttcttccagaaccaggacaagttctggggccgcctggagcgctacctgcccacccacagcatctgcagcctgccctttgtgaccagcttctgcctgggcatgggcgccaggagagtgtgctacggccaggaggaggccgtgggcccctggtaccacctgagcgcccaggagatccagcccctgtttggagagcaccggctgggcggagatggccggggctgggtgaggacccactgctgcctggaggatgcctggcacggcggcagcagcctgctggtgcggggcgtcatccccccagaggtgggcaatgtggccgtgcggctcttcagcctgcaggcccctgtgccccccaagatctacctgtccatggtgtacaagctggagggccccacagatgtgacagtggccctggagctgaccactggagatgctggcagctgccacatcggcggcatctctgtgctgaatgctgagaccagcagccgccacagcctgcggcccctgcgggtgccccccaccaagctggcccgctgggtgggccgctgtggccggcagctgagcggcggctgggtgcagcactgctatgaggtgtccctgcggggctgcctgctgctggacctgctggtgtgcttcagccggcccccaggcagccgggaggaggagagcttcacctgccgcctgggggagatccaggtggtggatgctgccagcctgctggcccccctgccccaggtgcaggccgtgaccatcagccacatccgctggcagcccagcgccagcgagcgggagggccccccagccctgctgcagctgagctgcaccctgcactggagcttcctgctgagccaggtgcgctgcttccgcatccactgctggggcggcatgtctgatgacagccctggccgggagctgcccaggcctgagatgcccatgttcctgggcctggcctttgccacccagtacagaattgtggacctgctggtggaggccgccggccctggccaggacaggaggatggagttcctggtggagcctgtgcccaaggagggcttccgggtgccccaggccgagtggggccgggctgtgctgctgtacagcgccccagcctag

SEQ ID NO: 22522 - DNA, 396 bp, Artificial Sequence
  Description of Artificial Sequence: Synthetic coding sequence
atggagctgcgggtgcacatggtgagccacactggagagatgccctacaaggtgcggctgggcctgagccctggccctggcctgggcggcccccgcatcctgcctgctgagcccttcacctggggcgctgtgcgccacctgccccacagcagctgccagggcgcctgcctgccctgcctgccctgcctgagcagcgcccccctgagccggcagggcctgtctgctgccagcccccccaggagcctgctgggcccctgcttcttcccctggaggacaggcctggccagcagcggccagctgagccctgaggccctgctgtgcaccatcctgcacaccaggtctggagtgctgcctgagagcagccaccggggcctgcccctggtgcctgccctgtag

SEQ ID NO: 22523 - DNA, 909 bp, Artificial Sequence
  Description of Artificial Sequence: Synthetic coding sequence
atggagcacggcatcgtgaaggactggaatgacatggagcgcatctggcagtatgtgtacagcaaggaccagctgcagaccttcagcgaggagcaccctgtgctgctgacagaggcccccctgaaccccaggaagaaccgggagagagctgctgaggtgttctttgagaccttcaacgtgcctgccctcttcatctccatgcaggccgtgctgagcctgtatgccaccggccgcaccaccggggtggtgctggacagcggagatggagtgacccatgctgtgcccatctatgagggctttgccatgccccacagcatcatgagaattgatattgctggaagagatgtgagccgcttcctgcggctgtacctgaggaaggagggctatgacttccacagcagcagcgagtttgaaattgtgaaggccatcaaggagcgggcctgctacctgagcatcaacccccagaaggatgagaccctggagacagagaaggcccagtactacctgcctgatggcagcaccattgaaattggccccagccgcttccgggcccctgagctgctcttccggccagacctgattggagaggagagcgagggcatccacgaggtgctggtgtttgccatccagaagagtgacatggacctgcggaggaccctcttcagcaacatcgtgctgagcggcggcagcaccctcttcaagggctttggagaccggctgctgtctgaggtgaagaagctggcccccaaggatgtgaagatccgcatcagcgccccccaggagcggctgtacagcacctggattggaggcagcatcctggccagcctggacaccttcaagaagatgtgggtgtccaagaaggagtatgaagaagatggagcccggagcatccacaggaagaccttctag

SEQ ID NO: 22524 - DNA, 780 bp, Artificial Sequence
  Description of Artificial Sequence: Synthetic coding sequence
atgctgcgctgtggccagatgatgctggcccaggccctgatctgccgccacctgggccgggactggagctgggagaagcagaaggagcagcccaaggagtaccagaggatcctgcagtgcttcctggacaggaaggactgctgctacagcatccaccagatggcccagatgggcgtgggggagggcaagagcattggagagtggtttggccccaacacagtggcccaggtgctgaagaagctggccctgtttgatgagtggaacagcctggccgtgtatgtgtccatggacaacacagtggtgattgaggacatcaagaagatgtgccgggtgctgcccctgtctgctgacacagctggggaccggcccccagacagcctgacagccagcaaccagagtgatgagctgatcttcctggacccccacaccacccagacctttgtggacacagaggagaatggaacagtgaatgaccagaccttccactgcctgcagagcccccagaggatgaacatcctgaacctggaccccagcgtggccctgggcttcttctgcaaggaggagaaggactttgacaactggtgcagcctggtgcagaaggagatcctgaaggagaacctgaggatgtttgagctggtgcagaagcaccccagccactggcccccatttgtgcccccagccaagccagaggtgaccaccaccggggctgagttcatcgacagcacagagcagctggaggagtttgacctggaggaggactttgagatcctgtctgtgtag

SEQ ID NO: 22525 - DNA, 957 bp, Artificial Sequence
  Description of Artificial Sequence: Synthetic coding sequence
atgagggcccagagtgatgagctggagaagattgagaagcacggccgcagcagcaaggacaaggaaaatgccaagagcctggacaagccagagcagttcctgtatgagctgagcctcatccccaacttcagcgagagggtcttctgcatcctcttccagagcaccttcagcgagagcatctgcagcatccggaggaagctggagctgctgcagaagctgtgtgagaccctgaagaatggacctggggtgatgcaggtgctgggcctggtgctggcctttggaaactacatgaatggaggcaacaagacccggggccaggctgatggcttcggcctggacatcctgcccaagctgaaggatgtgaagagcagtgacaacagccgcagcctgctgagctacatcgtgtcctactacctgaggaactttgatgaagatgctgggaaggagcagtgcctcttccccctgcctgagccccaggacctcttccaggccagccagatgaagtttgaggacttccagaaggacctgaggaagctgaagaaggacctgaaggcctgtgaggtggaggccggcaaggtgtaccaggtgagcagcaaggagcacatgcagcccttcaaggagaacatggagcagttcatcatccaggccaagattgaccaggaggccgaggagaacagcctgacagagacccacaagtgcttcctggagaccacagcctacttcttcatgaagcccaagctgggggagaaggaggtgagccccaatgccttcttcagcatctggcatgagttcagcagtgacttcaaggacttctggaagaaggagaacaagctgctgctgcaggagcgggtgaaggaggccgaggaggtgtgccggcagaagaagggcaagagcctgtacaagatcaagcccaggcatgacagcggcatcaaggccaagatctccatgaagacctag

SEQ ID NO: 22526 - DNA, 345 bp, Artificial Sequence
  Description of Artificial Sequence: Synthetic coding sequence
atgagcagctccatgtggtacatcatgcagagcatccagagcaagtacagcctgtctgagcggctcatccgcaccatcgccgccatccgctccttcccccatgacaacgtggaggacctgatccggggcggcgcagatgtgaactgcacccacggcaccctgaagcccctgcactgtgcctgcatggtgtctgatgctgactgtgtggagctgctgctggagaagggagctgaggtgaatgccctggatggctacaacagaacagccctgcactatgctgctgagaaggatgaggcctgtgtggaggtgctgctggagtatggagccaaccccaatgccctgtag

SEQ ID NO: 22527 - DNA, 1365 bp, Artificial Sequence; identical to SEQ ID NO: 18754
  Description of Artificial Sequence: Synthetic coding sequence

SEQ ID NO: 22528 - DNA, 1047 bp, Artificial Sequence; identical to SEQ ID NO: 18886
  Description of Artificial Sequence: Synthetic coding sequence

SEQ ID NO: 22529 - DNA, 2163 bp, Artificial Sequence
  Description of Artificial Sequence: Synthetic coding sequence
atgtatggcagcgcccggtctgtgggcaaggtggagcccagcagccagagccctggccgcagcccccggctgcccaggagcccccggctgggccacaggaggaccaacagcactggaggcagcagcggcagctctgtgggcggcggcagcggcaagaccctgtccatggagaacatccagagcctgaatgctgcctatgccaccagcggccccatgtacctgagtgaccatgaaaatgtgggcagcgagacccccaagagcaccatgaccctgggccgcagcggcggccgcctgccctacggcgtgaggatgacagccatgggcagcagccccaacatcgccagcagcggcgtggccagtgacaccatcgcctttggagagcaccacctgccccctgtgtccatggccagcacagtgccccacagcctgcggcaggcccgggacaacaccatcatggacctgcagacccagctgaaggaggtgctgcgggagaatgacctgctgaggaaggatgtggaggtgaaggagagcaagctgagcagctccatgaacagcatcaagaccttctggagccctgagctgaagaaggagcgggccctgaggaaggatgaggccagcaagatcaccatctggaaggagcagtacagagtggtgcaggaggagaaccaggtggatgccctgcggctgcggctggaggagaaggagaccatgctgaacaagaagaccaagcagatccaggacatggccgaggagaagggcacccaggccggggagatccatgacctgaaggacatgctggatgtgaaggagaggaaggtgaatgtgctgcagaagaagattgagaacctgcaggagcagctgcgggacaaggagaagcagatgagcagcctgaaggagcgggtgaagagcctgcaggccgacaccaccaacacagacacagccctgaccaccctggaggaggccctggccgagaaggagaggaccatcgagcggctgaaggagcagagggacagagatgagcgggagaagcaggaggagattgacaactacaagaaggacctgaaggacctgaaggagaaggtgtccctgctgcagggcgacctgtctgagaaggaggccagcctgctggacctgaaggagcacgccagcagcctggccagcagcggcctgaagaaggacagccggctgaagaccctggagatcgccctggagcagaagaaggaggagtgcctgaagatggagagccagctgaagaaggcccatgaagctgccctggaggcccgggccagccctgagatgtctgaccgcatccagcacctggagcgggagatcacccgctacaaggatgagagcagcaaggcccaggccgaggtggaccggctgctggagatcctgaaggaggtggagaatgagaagaatgacaaggacaagaagattgctgagctggagagcctgaccagccggcaggtgaaggaccagaacaagaaggtggccaacctgaagcacaaggagcaggtggagaagaagaagagcgcccagatgctggaggaggcccggcggcgggaggacaacctgaatgacagcagccagcagctgcaggacagcctgaggaagaaggatgacagaattgaggagctggaggaggccctgcgggagagcgtgcagatcacagctgagcgggagatggtgctggcccaggaggagagcgcccggaccaatgctgagaagcaggtggaggagctgctgatggccatggagaaggtgaagcaggagctggagagcatgaaggccaagctgagcagcacccagcagagcctggccgagaaggagacccacctgaccaacctgcgggcagagaggaggaagcacctggaggaggtgctggagatgaagcaggaggccctgctggccgccatcagcgagaaggatgccaacatcgccctgctggagctgagcagcagcaagaagaagacccaggaggaggtggccgccctgaagcgggagaaggaccggctggtgcagcagctgaagcagcagacccagaacaggatgaagctgatggctgacaactatgaagatgaccacttcaagagcagccacagcaaccagaccaaccacaagcccagcccagaccaggatgaggaggagggcatctgggcctag

SEQ ID NO: 22530 - DNA, 768 bp, Artificial Sequence
  Description of Artificial Sequence: Synthetic coding sequence
atggccgccagcaccatgtctgtgtgcagcagcgcctgcagcgacagctggcaggtggatgcctgcccagagagctgctgtgagccccactgctgtgccctgagctgctgtgccccagccccctgcctgaccctggtgtgcacccctgtgtcccgggtgagcagcccctgctgccaggccgcctgtgagcccagcccctgccagagcggctgcaccagcagctgcacccccagctgctgccagcagagcagctgccagcctgcctgctgcaccagcagcccctgccagcaggcctgctgcgtgcctgtgtgctgcaagcctgtgtgctgcctgcccacctgcagcaaggacagcagcagctgctgccagcagagcagctgccagcccacctgctgtgccagcagcagcagccagcagagctgctgcgtgcctgtgtgctgcaagcctgtgtgctacgtgcccacctgcagcgaggacagcagcagctgctgccagcagagcagctgccacccagcctgctgcaccagcagcccctgccagcaggcctgctgcgtgcctgtgcgctgcaagcctgtgtgctgcaagcccatctgctgcgtgcctgtgtgcagcggggccagcaccagctgctgccagcagagcagctgccagcctgcctgctgcaccaccagctgctgccggcccagcagctctgtgtccctgctgtgcaggcctgtgtgcaggcctgcctgctgcagcctgtgcagcggccaggagagcagctgctag

SEQ ID NO: 22531 - DNA, 2562 bp, Artificial Sequence
  Description of Artificial Sequence: Synthetic coding sequence
atgtctgagaaggtggactggctgcagagccagaatggagtgtgcaaggtggatgtgtacagccctggggacaaccaggcccaggactggaagatggacaccagcacagatcctgtgcgggtgctgtcctggctgcggcgggacctggagaagagcacagctgagttccaggatgtgcgcttcaagccaggagagagctttggaggagagaccagcaacagcggggacccccacaagggcttctctgtggactactacaacaccaccaccaagggcaccccagagcggctgcactttgagatgacccacaaggagatcccctgccagggcccccgggcccagctgggcaatggcagctctgtggatgaggtgtccttctacgccaaccggctgaccaacctggtgattgccatggccaggaaggagatcaatgagaagattgatggctctgaaaataaatgtgtgtaccagagcctgtacatgggaaatgagcccacccccaccaagagcctgagcaagatcgccagcgagctggtgaatgagaccgtgtctgcctgcagcagaaatgctgccccagacaaggcccctggcagcggggacagagtgtctggcagcagccagagcccccccaacctgaagtacaagagcaccctgaagatcaaggagagcaccaaggagcggcagggcccagatgacaagccacccagcaagaagagcttcttctacaaggaggtgtttgagagcagaaatggagactatgcccgggagggcggccgcttcttcccccgggagaggaagcgcttccggggccaggagaggccagatgacttcaccgcctctgtgtctgagggcatcatgacctacgccaacagcgtggtgtctgacatgatggtgtccatcatgaagaccctgaagatccaggtgaaggacaccaccatcgccaccatcctgctgaagaaggtgctgctgaagcacgccaaggaggtggtgtctgacctgattgacagcttcctgaggaacctgcacagcgtgacaggcaccctgatgacagacacccagtttgtgtctgctgtgaagaggacagtgttcagccacggcagccagaaggccacagacatcatggatgccatgctgaggaagctgtacaacgtgatgtttgccaagaaggtgcctgagcacgtgaggaaggcccaggacaaggccgagagctacagcctcatctccatgaagggcatgggagaccccaagaacagaaatgtgaactttgccatgaagtctgagaccaagctgcgggagaagatgtacagcgagcccaagtctgaggaggagacctgtgccaagaccctgggggagcacatcatcaaggagggcctgaccctgtggcacaagacccagcagaaggagtgcaagagcctgggcttccagcacgccgcctttgaggcccccaacacccagaggaagccagccagtgacatcagctttgagtacccagaggacatcggcaacctgagcctgcccccctacccacctgagaagccagagaacttcatgtatgacagcgacagctgggccgaggacctgattgtgtctgccctgctgctgatccagtaccacctggcccagggcggcagaagagatgcccggagctttgtggaggccgccggcaccaccaacttccctgccaatgagccccctgtggccccagatgagagctgcctgaagagcgcccccatcgtgggggaccaggagcaggccgagaagaaggacctgcggagcgtcttcttcaacttcatccggaacctgctgtctgagaccatcttcaagagggaccagagccctgagcccaaggtgcctgagcagcctgtgaaggaggacaggaagctgtgtgagcggcccctggccagcagccccccccggctgtatgaagatgatgagacccctggggccctgagcggcctgaccaagatggctgtgtcccagattgatggccacatgagcggccagatggtggagcacctgatgaacagcgtgatgaagctgtgtgtgatcatcgccaagagctgtgatgccagcctggccgagctgggagatgacaagtctggagatgccagccggctgaccagcgccttcccagacagcctgtatgagtgcctgcctgccaagggcactggatctgctgaggccgtgctgcagaatgcctaccaggccatccacaatgagatgaggggcaccagcggccagcccccagagggctgtgccgcccccaccgtcatcgtgagcaaccacaacctgacagacacagtgcagaacaagcagctgcaggccgtgctgcagtgggtggccgccagcgagctgaatgtgcccatcctgtactttgctggagatgatgagggcatccaggagaagctgctgcagctgtctgctgctgctgtggacaagggctgcagcgtgggggaggtgctgcagagcgtgctgcgctatgagaaggagcggcagctgaatgaggccgtgggcaatgtgacccccctgcagctgctggactggctgatggtgaacctgtag

SEQ ID NO: 22532 - DNA, 1263 bp, Artificial Sequence
  Description of Artificial Sequence: Synthetic coding sequence
atggtgcacggcaggaaggccaatgcccaggtgatggagagcgaggagttcatgctgctgcctgccaaccagctgattgacatcatcagcagtgatgagctgaatgtgcgctctgaggagcaggtgttcaatgctgtgatggcctgggtgaagtacagcatccaggagcggcggccccagctgccccaggtgctgcagcacgtgcggctgcccctgctgagccccaagttcctggtgggcaccgtgggcagtgaccccctcatcaagagtgatgaagaatgtcgggacctggtggatgaggccaagaactacctgctgctgccccaggagcggcccctgatgcagggccccaggacccggcccaggaagcccatccgctgtggggaggtgctgtttgctgtgggcggctggtgcagcggagatgccatcagctctgtggagagatatgacccccagaccaatgagtggaggatggtggcctccatgagcaagagaagatgtggggtgggcgtgtctgtgctggatgacctgctgtatgctgtgggcggccatgatggcagcagctacctgaacagcgtggagagatatgaccccaagaccaaccagtggagcagtgatgtggcccccaccagcacctgcaggacctctgtgggcgtggccgtgctgggcggcttcctgtatgctgtgggcggccaggatggagtgtcctgcctgaacatcgtggagagatatgaccccaaggagaacaagtggaccagggtggcctccatgagcacccggcggctgggcgtggccgtggccgtgctgggcggcttcctgtatgctgtgggcggcagtgatggcaccagccccctgaacacagtggagcgctacaacccccaggagaaccgctggcacaccatcgcccccatgggcaccaggaggaagcacctgggctgtgctgtgtaccaggacatgatctatgctgtgggcggcagagatgacaccacagagctgagcagcgctgagcgctacaaccccaggaccaaccagtggagccctgtggtggccatgaccagccgccgcagcggcgtgggcctggccgtggtgaatggccagctgatggctgtgggcggctttgatggcaccacctacctgaagaccatcgaggtgtttgatcctgatgccaacacctggaggctgtatggaggcatgaactacagaaggctgggcggcggcgtgggcgtcatcaagatgacccactgtgagagccacatctggtag

SEQ ID NO: 22533 - DNA, 519 bp, Artificial Sequence
  Description of Artificial Sequence: Synthetic coding sequence
atgagctgcaccatcgagaaggccctggctgatgccaaggccctggtggagcggctgcgggaccatgatgatgctgctgagagcctcatcgagcagaccacagccctgaacaagagggtggaggccatgaagcagtaccaggaggagatccaggagctgaatgaggtggcccggcaccggcccaggagcaccctggtgatgggcatccagcaggagaaccggcagatccgggagctgcagcaggagaacaaggagctgcggaccagcctggaggagcaccagagcgccctggagctgatcatgagcaagtaccgggagcagatgttccggctgctgatggccagcaagaaggatgaccccggcatcatcatgaagctgaaggagcagcacagcaagattgacatggtgcacaggaacaagtctgagggcttcttcctggatgccagccgccacatcctggaggccccccagcacggcctggagcggcggcacctggaggccaaccagaatgtgcactag

SEQ ID NO: 22534 - DNA, 813 bp, Artificial Sequence
  Description of Artificial Sequence: Synthetic coding sequence
atgctgttcatcttccccctgagcctgccctggaggcccagctgctggaaggagagctgcagcacaggccagaggcaggccggccgcagccgggaggacagcgtgaccccaccacccagcagcccctggcccaccccacctgctggggccatgagcaccaagcaggaggccaggagagatgaaggagaggcccggacccggggccaggaggcccagctgcgggaccgggcccacctgagcctgcacaaggacagcgctgacctgctgcccctggacagcctgaagaggctgggcaccagcaaggacctgcagcccaggagcgtcatccagaggcggctggtggagggcaaccccaactggctgcagggcgagccccccaggatgcaggacctgattcatggccaggagagcaggaggaagaccagcaggacagagatcccagccctgctggtgaactgcaagtgccaggaccagctgctgcgggtggccgtggacaccggcacccagtacaaccgcatctctgctggctgcctgagccggctgggcctggagaagagggtgctgaaggccagcgctggggacctggcccctggcccccccacccaggtggagcagctggagctgcagctgggccaggagaccgtggtgtgcagcgcccaggtggtggatgctgagagccctgagttctgcctgggcctgcagaccctgctgagcctgaagtgctgcatcgacctggagcacggcgtgctgcggctgaaggcccccttcagcgagctgcccttcctgcccctgtaccaggagcccggccagtag

SEQ ID NO: 22535 - DNA, 243 bp, Artificial Sequence
  Description of Artificial Sequence: Synthetic coding sequence
accagctgctgccggcccagcagctctgtgtccctgctgtgccaccctgtgtgcagctgcagccctgcctgccagcccacctgctgcatccacagcccctgccaggccagctgctacgtgcctgtgtcctgccagcccatcatctacgtgacccccagctgccagagcagcggctgctgccagcccccctgcaccacagccctgtgccggcccatcagctgcagcacccccagctgctgctag

SEQ ID NO: 22536 - DNA, 2013 bp, Artificial Sequence
  Description of Artificial Sequence: Synthetic coding sequence
atggccctgggggaggagaaggccgaggccgaggccagcgaggacaccaaggcccagagctatggccggggcagctgccgggagcgggagctggacatccctggccccatgtctggagagcagcccccccggctggaggccgagggcggcctcatcagccctgtgtggggcgctgagggcatcccagcccccacctgctggattggaacagaccccggcggccccagccgggcccaccagccccaggccagtgatgccaaccgggagcctgtggccgagaggtctgagcccgccctgagcggcctgcccccagccaccatgggcagcggggacctgctgctgtctggagagagccaggtggagaagaccaagctgagcagcagcgaggagttcccccagaccctgagcctgcccaggaccaccaccatctgcagcggccatgatgctgacacagaagatgaccccagcctggccgacctgccccaggccctggacctgagccagcagccccacagcagcggcctgagctgcctgagccagtggaagtctgtgctgagccctggcagcgctgcccagcccagcagctgcagcatcagcgccagcagcacaggcagcagcctgcagggccaccaggagcgggcagagccccggggcggcagcctggccaaggtgagcagcagcctggagcctgtggtgccccaggagcccagctctgtggtgggcctgggcccccggccccagtggagcccccagcccgtcttctctggaggagatgccagcggcctgggcagaagaaggctgtccttccaggccgagtactgggcctgtgtgctgcctgacagcctgccccccagcccagacagacacagccccctgtggaaccccaacaaggagtatgaggacctgctggactacacctaccccctgcggcccggcccccagctgcccaagcacctggacagccgggtgcctgctgaccctgtgctgcaggacagcggcgtggacctggacagcttctctgtgtccccagccagcaccctgaagagccccaccaacgtgagccccaactgccccccagctgaggccacagccctgcccttcagcggcccccgggagcccagcctgaagcagtggcccagccgggtgccccagaagcagggcggcatgggcctggcctcctggagccagctggccagcaccccccgggcccctggcagcagagatgcccgctgggagcggcgggagcccgccctgcggggggccaaggaccggctgaccatcggcaagcacctggacatgggcagcccccagctgcggacccgggaccggggctggcccagccccaggcctgagcgggagaagaggaccagccagagcgcccggcggcccacctgcacagagagccgctggaagtctgaggaggaggtggagagtgatgatgagtacctggccctgcctgcccggctgacccaggtgagcagcctggtgtcctacctgggcagcatcagcaccctggtgaccctgcccaccggggacatcaagggccagagccccctggaggtgtctgacagtgatggccctgccagcttccccagcagcagcagccagagccagctgcccccaggagctgccctgcagggcagcggggaccctgagggccagaacccctgcttcctgcggagctttgtgcgggcccatgacagcgctggggagggcagcctgggcagcagccaggccctgggcgtgagcagcggcctgctgaagacccggcccagcctgcctgcccggctggaccgctggcccttcagtgaccctgatgtggagggccagctgcccaggaagggcggggagcagggcaaggagagcctggtgcagtgtgtgaagaccttctgctgccagctggaggagctgatctgctggctgtacaacgtggctgatgtgacagaccacggcacagctgcccggagcaacctgaccagcctgaagagcagcctgcagctgtaccgcttctag

SEQ ID NO: 22537 - DNA, 702 bp, Artificial Sequence
  Description of Artificial Sequence: Synthetic coding sequence
atgaagcagctgattgaggacacagagaagaacaaggtgtatgtggccatggtgacagattatggagccttcatcaagatccctggctgcaggaagcagggcctggtgcacaggacccacatgagcagctgccgggtggacaagcccagcgagatcgtggatgtgggggacaaggtgtgggtgaagctgattggccgggagatgaagaatgaccgcatcaaggtgtccctgtccatgaaggtggtgaaccagggcaccgggaaggacctggaccccaacaacgtcatcatcgagcaggaggagaggagaagaagaagcttccaggactacacaggccagaagatcaccctggaggccgtgctgaacaccacctgcaagaagtgtggctgcaagggccactttgccaaggactgcttcatgcagcccggcggcaccaagtacagcctcatcccagatgaggaggaggagaaggaggaggccaagtctgctgagtttgagaagccagaccccaccaggaaccccagcaggaagaggaagaaggagaagaagaagaagaagcaccgggacaggaagagcagtgacagcgacagcagtgacagcgagagtgacaccgggaagagggcccggcacaccagcaaggacagcaaggccgccaagaagaagaagaagaagaagaagcacaagaagaagcacaaggagtag

SEQ ID NO: 22538 - DNA, 492 bp, Artificial Sequence
  Description of Artificial Sequence: Synthetic coding sequence
atgggctggaggctgctgacccaggatgagggccctgccctggtgcctgggggccgcctgggggacctgtgggactaccaccagcaccgctacctgcagggcgtgcctgagggcgtgcgggacctgcccccaggagtggccctgcccctggagagcaacctggccttcatgaatggagtgtccttcaccaagggctgctacatcggccaggagctgacagcccggacccaccacatgggcgtcatcaggaagaggctcttccctgtgcgcttcctggaccccctgcccaccagcggcatcacccctggggccaccgtgctgacagccagcggccagacagtgggcaagttccgggccggccagggcaatgtgggcctggccctgctgtggagcgagaagatcaagggccccctgcacatccgggccagcgagggcgcccaggtggccctggccgcctctgtgcctgactggtggcccaccgtgtccaagtag

SEQ ID NO: 22539 - DNA, 804 bp, Artificial Sequence
  Description of Artificial Sequence: Synthetic coding sequence
atggccatggagatgaggctgcctgtggccaggaagcccctgtctgagcggctgggccgggacaccaagaagcacctggtggtgcctggggacaccatcaccacagacaccggcttcatgaggggccacggcacctacatgggagaggagaagctgattgcctctgtggccggctctgtggagcgggtgaacaagctgatctgtgtgaaggccctgaagacccgctacatcggggaggtgggggacatcgtggtgggccgcatcacagaggtgcagcagaagcgctggaaggtggagaccaacagccggctggacagcgtgctgctgctgagctccatgaacctgcccggcggggagctgcggcggcgctctgcagaagatgagctggccatgaggggcttcctgcaggagggggacctgatcagcggcgtgctggtgcaggtgagccccagcctggtgaagaggcagaagacccacttccatgacctgccctgtggggccagcgtcatcctgggcaacaacggcttcatctggatctaccccaccccagagcacaaggaggaggaggccggcggcttcatcgccaacctggagcctgtgtccctggccgaccgggaggtgatcagccggctgaggaactgcatcatcagcctggtgacccagaggatgatgctgtatgacaccagcatcctgtactgctatgaggccagcctgccccaccagatcaaggacatcctgaagccagagatcatggaggagatcgtgatggagacccggcagaggctgctggagcaggagggctag

SEQ ID NO: 22540 - DNA, 3111 bp, Artificial Sequence
  Description of Artificial Sequence: Synthetic coding sequence
atgcctgtgttcaaggaggtgaaggtgcacctgctggaggatgctggcatcgagaaggatgctgtgacccaggagacccgcatcagccccagcggcattgattctgccaccaccgtggccgccgccacagctgctgccatcgccacagctgcccccctcatcaaggtgcagagcgacctggaggccaaggtgaacagcgtgacagagctgctgagcaagctgcaggagacagacaagcacctgcagagggtgacagagcagcagaccagcatccagaggaagcaggagaagctgcactgccacgaccacgagaagcagatgaatgtgttcatggagcagcacatccgccacctggagaagctgcagcagcagcagattgacatccagacccacttcatctctgctgccctgaagaccagcagcttccagcctgtgtccatgcccagcagcagagctgtggagaagtacagcgtgaagccagagcaccccaacctgggcagctgcaaccccagcctgtacaacacctttgccagcaagcaggcccccctgaaggaggtggaggacaccagctttgacaagcagaagagccccctggagaccccagcccccaggagatttgcccctgtgcctgtgtccagagatgatgagctgagcaagcgggagaacctgctggaggagaaggagaacatggaggtgtcctgccacagaggaaatgtgcggctgctggagcagatcctgaacaacaatgacagcctgaccaggaagtctgagagcagcaacaccaccagcctgaccaggagcaagattggctggaccccagagaagaccaaccgcttccccagctgtgaggagctggagaccaccaaggtgaccatgcagaagagtgatgatgtgctgcatgacctgggccagaaggagaaggagaccaacagcatggtgcagcccaaggagagcctgtccatgctgaagctgcctgacctgccccagaacagcgtgaagctgcagaccaccaacaccaccaggtctgtgctgaaggatgctgagaagatcctgcggggcgtgcagaacaacaagaaggtgctggaggagaacctggaggccatcatccgggccaaggatggagctgccatgtacagcctcatcaatgccctgagcaccaaccgggagatgtctgagaagatccgcatcaggaagacagtggatgagtggatcaagaccatctctgctgagatccaggatgagctgagcaggacagattatgagcagaagagatttgaccagaagaaccagaggaccaagaagggccagaacatgaccaaggacatccgcaccaacacccaggacaagacagtgaacaagagcgtcatccccaggaagcacagccagaagcagatcgaggagcacttcaggaacctgcccatgaggggcatgcctgccagcagcctgcagaaggagaggaaggagggcctgctgaaggccaccaccgtcatccaggatgaggactacatgctgcaggtgtatggcaagcctgtgtaccagggccacaggagcaccctgaagaagggcccctacctgcgcttcaacagccccagccccaagagccggccccagaggcccaaggtgattgaaagagtgaagggcaccaaggtgaagagcatccgcacccagacagacttctacgccaccaagcccaagaagatggacagcaagatgaagcacagcgtgcctgtgctgccccacggggaccagcagtacctgttcagccccagccgggagatgcccaccttcagcggcaccctggagggccacctgatccccatggccatcctgctgggccagacccagagcaacagcgacaccatgcccccagctggggtgattgtgtccaagccccaccctgtgacagtgaccaccagcatcccccccagcagcaggaaggtggagactggagtgaagaagcccaacatcgccatcgtggagatgaagtctgagaagaaggaccccccccagctgactgtgcaggtgctgcccagcgtggacatcgacagcatcagcaacagcagcgcagatgtgctgagccccctgagcagccccaaggaggccagcctgccccctgtgcagacctggatcaagaccccagagatcatgaaggtggatgaggaggaggtgaagtttcctggcaccaactttgatgagatcattgatgtgatccaggaggaggagaagtgtgatgagatcccagattctgagcccatcctggagttcaacagatctgtgaaggctgacagcaccaagtacaatggaccacccttcccccctgtggccagcaccttccagcccacagctgacatcctggacaaggtgattgaaaggaaggagaccctggagaacagcctcatccagtgggtggagcaggagatcatgagccgcatcatcagcggcctcttccctgtgcagcagcagatcgcccccagcatctctgtgtctgtgtctgagaccagcgagcccctgaccagtgacatcgtggagggcaccagcagcggggccctgcagctgtttgtggatgctggggtgcctgtgaacagcaatgtcatcaagcactttgtgaatgaggccctggccgagaccatcgctgtgatgctgggggaccgggaggccaagaagcagggccctgtggccaccggggtgtctggagatgccagcaccaatgagacctacctgcctgcccgggtgtgcacccccctgcccaccccccagcccaccccaccctgcagccccagcagccctgccaaggaatgtgtgctggtgaagaccccagacagcagcccctgtgacagcgaccatgacatggccttccctgtgaaggagatctgtgccgagaagggagatgacatgcctgccatcatgctggtgaacacccccaccgtgacccccaccaccaccccacctcctgctgctgctgtgttcacccccaccctgagtgacatcagcattgacaagctgaaggtgagcagccctgagctgcccaagccctggggagatggagacctgcccctggaggaggagaaccccaacagcccccaggaggagctgcacccccgggccatgtag

SEQ ID NO: 22541 - DNA, 3351 bp, Artificial Sequence; identical to SEQ ID NO: 19573
  Description of Artificial Sequence: Synthetic coding sequence

SEQ ID NO: 22542 - DNA, 816 bp, Artificial Sequence
  Description of Artificial Sequence: Synthetic coding sequence
atgaggcagctgcaccctgaggccatcgccgccatccagagcaaggccctcttcagcaaggccgaggagcagctgctgagcaaggtgggcagcaccagccagcccaccctggagaccttccaggacctgctgcaccgccacccagatgccttctacctggccaggacagccaaggccctgcaggcccactggcagctgatgaagcagtactacctgctggaggaccagacagtgcagcccctgcccaagggggaccaggtgctgaacttcagtgatgctgaggacctgattgatgacagcaagctgaaggacatgagagatgaggtgctggagcacgagctgatggtggccgaccggcggcagaagcgggagatccggcagctggagcaggagctgcacaagtggcaggtgctggtggacagcatcaccggcatgagcagcccagactttgacaaccagaccctggccgtgctgcggggccgcatggtgcgctacctgatgaggagccgggagatcaccctgggccgggccaccaaggacaaccagattgatgtggacctgagcctggagggccctgcctggaagatcagcaggaagcagggcgtcatcaagctgaagaacaacggggacttcttcatcgccaatgaaggccggcggcccatctacattgatggccggcctgtgctgtgtggcagcaagtggaggctgagcaacaacagcgtggtggagatcgccagcctgcgctttgtgttcctgatcaaccaggacctgattgccctgatccgggcagaggccgccaagatcaccccccagtag

SEQ ID NO: 22543 - DNA, 2751 bp, Artificial Sequence
  Description of Artificial Sequence: Synthetic coding sequence
atggagatgcccctgcccccagatgaccaggagctgagaaatgtcatcgacaagctggcccagtttgtggccagaaatggacctgagtttgagaagatgaccatggagaagcagaaggacaaccccaagttctccttcctgtttggaggagagttctacagctactacaagtgcaagctggccctggagcagcagcagctgatctgcaagcagcagaccccagagctggagcctgctgccaccatgccacccctgccccagccccccctggccccagctgcccccatccccccagcccagggcgcccccagcatggatgagctgatccagcagagccagtggaacctgcagcagcaggagcagcacctgctggccctgcggcaggagcaggtgacagctgctgtggcccatgctgtggagcagcagatgcagaagctgctggaggagacccagctggacatgaatgaatttgacaacctgctgcagcccatcatcgacacctgcaccaaggatgccatctctgctgggaagaactggatgttcagcaatgccaagagccccccccactgtgagctgatggccggccacctgaggaaccgcatcacagcagatggagcccactttgagctgcggctgcacctgatctacctgatcaatgatgtgctgcaccactgccagaggaagcaggcccgggagctgctggccgccctgcagaaggtggtggtgcccatctactgcaccagcttcctggccgtggaggaggacaagcagcagaagatcgcccggctgctgcagctgtgggagaagaatggctactttgatgacagcatcatccagcagctgcagagccctgccctgggcctgggccagtaccaggccaccctcatcaatgagtacagctctgtggtgcagcctgtgcagctggccttccagcagcagatccagaccctgaagacccagcacgaggagtttgtgaccagcctggcccagcagcagcagcagcagcagcagcagcagcagcagctgcagatgccccagatggaggccgaggtgaaggccaccccacctcctccagcccctcctccagccccagccccagccccagccatcccccccaccacccagccagatgacagcaagccacccatccagatgcctggcagcagtgaatatgaggcccctgggggcgtgcaggaccctgctgctgctggcccccggggccctggcccccatgaccagatcccccccaacaagccaccctggtttgaccagccccaccctgtggccccctggggccagcagcagcccccagagcagcccccctacccccaccaccagggcggccccccccactgccccccctggaacaacagccatgagggcatgtggggcgagcagagaggagaccccggctggaatggccagagagatgccccctggaacaaccagccagatgctgcctggaacagccagtttgagggcccctggaacagccagcacgagcagcccccctggggcggcggccagcgggagccccccttcaggatgcagaggcctccccacttccggggccccttccccccccaccagcagcacccccagttcaaccagcccccccacccccacaacttcaaccgcttccccccacgcttcatgcaggatgacttccccccaagacacccctttgagaggcctccctacccccacagatttgactacccccagggcgacttccctgctgagatgggccccccccaccaccaccctggccacaggatgccccaccctggcatcaatgagcaccccccctgggccggcccccagcacccagactttggccccccacctcatggcttcaacggccagcccccccacatgaggcggcagggccccccccacatcaaccatgatgaccccagcctggtgcccaacgtgccctactttgacctgcctgctggcctgatggcccccctggtgaagctggaggaccacgagtacaagcccctggaccccaaggacatccggctgcccccacccatgcctccttctgagcggctgctggccgctgtggaggccttctacagcccccccagccatgaccggcccagaaattctgagggctgggagcagaatggcctgtatgagttcttccgggccaagatgagggcccggcggaggaagggccaggagaagaggaacagcggccccagccgcagccgcagccgcagcaagagccggggccgcagcagcagccgcagcaacagccgcagcagcaagagcagcggcagctacagccgcagccgcagccgcagctgcagccgcagctacagccgcagccgcagccgcagccgcagccgcagccgcagcagccgcagccgcagccgcagccagagccgcagccgcagcaagagctacagccctggaagaagaagaagaagccgcagccgcagccccaccccacccagcagcgctggcctgggcagcaacagcgccccacccatcccagacagccggctgggggaggagaacaagggccaccagatgctggtgaagatgggctggagcggcagcggcggcctgggcgccaaggagcagggcatccaggaccccatcaagggaggagatgtgcgggacaagtgggaccagtacaagggcgtgggcgtggccctggatgacccctatgagaactacagaagaaacaagagctacagcttcatcgccaggatgaaggccagagatgagtgcaagtag

SEQ ID NO: 22544 - DNA, 963 bp, Artificial Sequence
  Description of Artificial Sequence: Synthetic coding sequence
atgagcaagtctgagagccccaaggagcctgagcagctgaggaagctgttcatcggcggcctgagctttgagaccacagatgagagcctgcggagccactttgagcagtggggcaccctgacagactgtgtggtgatgagggaccccaacaccaagaggagccggggctttggatttgtgacctacgccaccgtggaggaggtggatgctgccatgaatgcccggccccacaaggtggatggccgggtggtggagcccaagagagctgtgtcccgggaggacagccagaggcctggggcccacctgactgtgaagaagatctttgtgggcggcatcaaggaggacacagaggagcaccacctgcgggactactttgagcagtatggcaagattgaagtcatcgagatcatgacagaccggggcagcggcaagaagaggggctttgcctttgtgacctttgatgaccatgacagcgtggacaagatcgtcatccagaagtaccacacagtgaatggccacaactgtgaggtgaggaaggccctgagcaagcaggagatggccagcgccagcagcagccagaggggccgcagcggcagcggcaactttggaggcggccggggcggcggctttggaggaaatgacaactttggccggggcggcaacttcagcggccggggcggctttggaggcagcagaggaggcggcggctatggaggcagcggagatggctacaatggatttggaaatgatggcagcaactttggaggcggcggcagctacaatgactttggaaactacaacaaccagagcagcaactttggccccatgaagggcggcaactttggaggccgcagcagcggcccctatggaggcggcggccagtactttgccaagcccaggaaccagggcggctatggaggcagcagcagcagcagcagctatggcagcggccgccgcttctag

SEQ ID NO: 22545 - DNA, 735 bp, Artificial Sequence; identical to SEQ ID NO: 19104
  Description of Artificial Sequence: Synthetic coding sequence

SEQ ID NO: 22546 - DNA, 4125 bp, Artificial Sequence
  Description of Artificial Sequence: Synthetic coding sequence
atgaccagcgctgctgagatcaagaagccccctgtggcccccaagcccaagtttgtggtggccaacaacaagccagcccccccacccatcgcccccaagccagacatcgtcatcagctctgtgccccagagcaccaagaagatgaagccagccatcgcccccaagcccaaggtgctgaagaccagccctgtgcgggagatcggccagagccccagcaggaagatcatgctgaacctggagggccacaagcaggagctggccgagagcacagacaacttcaactgcaagtatgagggcaaccagagcaatgactacatcagccccatgtgcagctgcagcagcgagtgcatccacaagctgggccaccgggagaacctgtgtgtgaagcagctggtgctggagcccctggagatgaatgaaaacctggagaacagcaagattgatgagaccctgaccatcaagaccaggagcaaatgtgacctgtatggagagaaggccaagaaccagggcggcgtggtgctgaaggcctctgtgctggaggaggagctgaaggatgccctgatccaccagatgccacccttcatcagcgcccagaagcaccggcccacagacagccctgagatgaatggaggctgcaacagcaatggccagttccgcatcgagtttgctgacctgagccccagccccagcagctttgagaaggtgcctgaccaccacagctgccacctgcagctgcccagtgatgaatgtgagcactttgagacctgccaggatgacagcgagaagagcaacaactgcttccagagcagcgagctggaggccctggagaatggcaagaggagcaccctcatcagcagtgatggagtgtccaagaagtctgaggtgaaggacctgggccccctggagatccacctggtgccctacacccccaagttccccacccccaagcccaggaagaccaggacagcccggctgctgcggcagaagtgtgtggacaccccatctgagagcacagaggagcccggcaacagcgacagcagcagcagctgcctgacagagaacagcctgaagatcaacaagatctctgtgctgcaccagaatgtgctgtgcaagcaggagcaggtggacaagatgaagctgggcaacaagtctgagctgaacatggagagcaacagtgatgcccaggacctggtgaacagccagaaggccatgtgcaatgagaccaccagctttgagaagatggcccccagctttgacaaggacagcaacctgagcagtgacagcaccaccgtggatggcagctccatgagcctggccgtggatgagggcaccggcttcatccgctgcaccgtgtccatgagcctgcccaagcagctgaagctgacctgcaatgagcacctgcagagcggcaggaacctgggcgtgtctgccccccagatgcagaaggagagcgtcatcaaggaggagaacagcctgcgcatcgtgcccaagaagccccagaggcacagcctgcctgccactggagtgctgaagaaggccgccagcgaggagctgctggagaagagcagctaccccagcagcgaggagaagagcagcgagaagagcctggagaggaaccacctgcagcacctgtgtgcccagaacagaggagtgagcagcagctttgacatgcccaagagggccagcgagaagcctgtgtggaagctgccccaccccatcctgcccttcagcggcaaccctgagttcctgaagtctgtgacagtgagcagcaacagcgagcccagcacagccctgaccaagccccgggccaagagcctgagcgccatggatgtggagaagtgcaccaagccctgcaaggacagcaccaagaagaacagcttcaagaagctgctgtccatgaagctgagcatctgcttcatgaagagtgacttccagaagttctggagcaagagcagccagctgggggacaccaccaccggccacctgagcagcggggagcagaagggcatcgagagtgactggcagggcctgctggtgggggaggagaagaggagcaagcccatcaaggcctacagcacagagaactacagcctggagagccagaagaagaggaagaagagccggggccagaccagcgctgccaacggcctgcgggcagagagcctggatgaccagatgctgagccgggagagcagcagccaggccccctacaagtctgtgaccagcctgtgtgccccagaatatgagaacatccgccactatgaggagatcccagaatatgagaacctgcccttcatcatggccatcaggaagacccaggagctggagtggcagaacagcagctccatggaggatgctgatgccaacgtgtatgaggtggaggagccctatgaggccccagatggccagctgcagctgggccccaggcaccagcacagcagcagcggggccagccaggaggagcagaatgacctgggcctgggggacctgcccagtgatgaggaggagatcatcaacagcagtgatgaagatgatgtgagcagcgagagcagcaagggggagccagaccccctggaggacaagcaggatgaggacaatggcatgaagagcaaggtgcaccacatcgccaaggagatcatgagcagcgagaaggtgtttgtggatgtgctgaagctgctgcacatcgacttcagagatgctgtggcccacgccagccggcagctgggcaagcctgtgattgaggaccgcatcctgaaccagatcctgtactacctgccccagctgtatgagctgaacagagacctgctgaaggagctggaggagaggatgctgcactggacagagcagcagagaattgctgacatctttgtgaagaagggcccctacctgaagatgtacagcacctacatcaaggagtttgacaagaacatcgccctgctggatgagcagtgcaagaagaaccctggctttgctgctgtggtgcgggagtttgagatgagcccccgctgtgccaacctggccctgaagcactacctgctgaagcctgtgcagaggatcccccagtaccgcctgctgctgacagactacctgaagaacctgattgaagatgctggggactacagagacacccaggatgccctggccgtggtgattgaggtggccaaccacgccaatgacaccatgaagcagggcgacaacttccagaagctgatgcagatccagtacagcctgaatggccaccatgaaattgtgcagcccggccgggtcttcctgaaggagggcatcctgatgaagctgagcaggaaggtgatgcagcccaggatgttcttcctgttcaatgatgccctgctgtacaccacccctgtgcagagcggcatgtacaagctgaacaacatgctgagcctggccggcatgaaggtgaggaagcccacccaggaggcctaccagaatgagctgaagattgagagcgtggagaggagcttcatcctgagcgccagcagcgccacagaaagagatgagtggctggaggccatcagccgggccatcgaggagtatgccaagaagaggatcaccttctgccccagccgcagcctggatgaagctgacagcgagaacaaggaggaggtgagccccctgggcagcaaggcccccatctggatcccagacacccgggccaccatgtgcatgatctgcaccagcgagttcaccctgacctggaggaggcaccactgccgggcctgtgggaagatcgtgtgccaggcctgcagcagcaacaagtatggcctggactacctgaagaaccagcctgcccgggtgtgtgagcactgcttccaggagctgcagaagctggaccaccagcacagccccagaattggcagccctggcaaccacaagagccccagcagcgccctgagctctgtgctgcacagcatccccagcggcaggaagcagaagaagatcccagctgccctgaaggaggtgtctgccaacacagaggacagctccatgagcggctacctgtaccgcagcaagggcaacaagaagccctggaagcacttctggtttgtgatcaagaacaaggtgctgtacacctacgccgccagcgaggtgcgctctgagatctag

SEQ ID NO: 22547 - DNA, 1446 bp, Artificial Sequence; identical to SEQ ID NO: 20055
  Description of Artificial Sequence: Synthetic coding sequence

SEQ ID NO: 22548 - DNA, 468 bp, Artificial Sequence
  Description of Artificial Sequence: Synthetic coding sequence
atggacaccatgatgctgaatgtgaggaacctgtttgagcagctggtgagaagagtggagatcctgtctgagggcaatgaggtgcagttcatccagctggccaaggactttgaggacttcaggaagaagtggcagaggacagaccacgagctgggcaagtacaaggacctgctgatgaaggccgagacagagaggtctgccctggatgtgaagctgaagcacgccaggaaccaggtggatgtggagatcaagaggcggcagagagctgaggccgactgtgagaagctggagcggcagatccagctgatccgggagatgctgatgtgtgacaccagcggcagcatccagctgtctgaggagcagaagagcgccctggccttcctgaacagaggccagcccagcagcagcaatgccggcaacaagaggctgagcaccattgatgaaagtggcagcatcctgagtgactag

SEQ ID NO: 22549 - DNA, 420 bp, Artificial Sequence
  Description of Artificial Sequence: Synthetic coding sequence
atggacaccatgatgctgaatgtgaggaacctgtttgagcagctggtgagaagagtggagatcctgtctgagggcaatgaggtgcagttcatccagctggccaaggactttgaggacttcaggaagaagtggcagaggacagaccacgagctgggcaagtacaaggacctgctgatgaaggccgagacagagaggtctgccctggatgtgaagctgaagcacgccaggaaccaggtggatgtggagatcaagaggcggcagagagctgaggccgactgtgagaagctggagcggcagatccagctgatccgggagatgctgatgtgtgacaccagcggcagcatccagctgtctgaggagcagaagagcgccctggccttcctgaacagaggccagcccagcagcagcaatgccggctag

SEQ ID NO: 22550 - DNA, 3282 bp, Artificial Sequence
  Description of Artificial Sequence: Synthetic coding sequence
atgggcggcaaggcctggccccggcgggctgtgggcacagctgggggcccctgtgccgagcagatcagcgcccccttccagaccctgctgatgccccacctgcccctggccagcttccggccccccttctggggcctgcggcacagccggggcctgccccgcttccacagcgtgtccacccagagcgagccccacggcagccccatcagcagaagaaaccgggaggccaagcagaagaggctgcgggagaagcaggccaccctggaggccgagattgctggggagagcaagagccctgctgagagcatcaaggcctggaggcccaaggagctggtgctgtatgagatccccaccaagccaggagagaagaaggatgtgtctggccccctgcccccagcctacagcccccgctacgtggaggccgcctggtacccctggtgggtgcgggagggcttcttcaagccagagtaccaggcccggctgccccaggccactggagagaccttctccatgtgcatccccccaccaaatgtgacaggcagcctgcacatcggccacgccctgactgtggccatccaggatgccctggtgcgctggcacaggatgagaggagaccaggtgctgtgggtgcccggcagtgaccacgccggcatcgccacccaggccgtggtggagaagcagctgtggaaggagcggggcgtgagaagacatgagctgagccgggaggccttcctgcgggaggtgtggcagtggaaggaggccaagggcggggagatctgtgagcagctgcgggccctgggcgccagcctggactgggaccgggagtgcttcaccatggatgtgggcagctctgtggccgtgacagaggcctttgtgcggctgtacaaggccggcctgctgtacagaaaccaccagctggtgaactggagctgtgccctgcggagcgccatcagtgacatcgaggtggagaaccggcccctgcccggccacacccagctgcggctgcccggctgccccacccctgtgtcctttggcctgctcttctctgtggccttccctgtggatggagagccagatgctgaggtggtggtgggcaccaccaggcctgagaccctgcctggagatgtggccgtggccgtgcacccagatgacagccgctacacccacctgcacggccggcagctgcggcaccccctgatgggccagcccctgcccctcatcacagattatgctgtgcagccccacgtgggcaccggggctgtgaaggtgaccccagcccacagccctgcagatgctgagatgggcgcccggcacggcctgagccccctgaatgtgattgctgaagatggcaccatgaccagcctgtgtggggactggctgcagggcctgcacagatttgtggcccgggagaagatcatgtctgtgctgtctgagtggggcctcttccggggcctgcagaaccaccccatggtgctgcccatctgcagccgctctggagatgtgattgagtacctgctgaagaaccagtggtttgtgcgctgccaggagatgggcgcccgggccgccaaggctgtggagagcggggccctggagctgagccccagcttccaccagaagaactggcagcactggttcagccacatcggggactggtgtgtgtcccggcagctgtggtggggccaccagatcccagcctacctggtggtggaggaccacgcccagggcgaggaggactgctgggtggtgggccgctctgaggccgaggcccgggaggtggccgctgagctgaccggccggcctggagctgagctgaccctggagcgggaccctgatgtgctggacacctggttcagcagcgccctcttccccttcagcgccctgggctggccccaggagaccccagacctggcccgcttctaccccctgagcctgctggagactggaagtgacctgctgctcttctgggtgggccgcatggtgatgctgggcacccagctgaccggccagctgcccttcagcaaggtgctgctgcaccccatggtgcgggaccggcagggcaggaagatgagcaagagcctgggcaatgtgctggacccccgggacatcatcagcggcgtggagatgcaggtgctgcaggagaagctgcggagcggcaacctggaccctgctgagctggccatcgtggccgccgcccagaagaaggacttcccccacggcatcccagaatgtggcacagatgccctgcgcttcaccctgtgcagccatggagtgcaggccggggacctgcacctgtctgtgtctgaggtgcagagctgccgccacttctgcaacaagatctggaatgccctgcgcttcatcctgaatgccctgggggagaagtttgtgccccagcctgctgaggagctgagccccagcagccccatggatgcctggatcctgagccggctggccctggccgcccaggagtgtgagcggggcttcctgacccgggagctgagcctggtgacccacgccctgcaccacttctggctgcacaacctgtgtgatgtgtacctggaggccgtgaagcctgtgctgtggcacagcccccggcccctgggccccccccaggtgctcttcagctgtgccgacctgggcctgcggctgctggcccccctgatgcccttcctggccgaggagctgtggcagaggctgcccccccggcccggctgccccccagcccccagcatctctgtggccccctaccccagcgcctgcagcctggagcactggaggcagcctgagctggagcggcgcttcagccgggtgcaggaggtggtgcaggtgctgcgggccctgcgggccacctaccagctgaccaaggcccggccccgggtgctgctgcagagcagcgagcccggggaccagggcctgtttgaggccttcctggagcccctgggcaccctgggctactgtggggctgtgggcctgctgcccccaggagctgctgcccccagcggctgggcccaggcccccctgagtgacacagcccaggtgtacatggagctgcagggcctggtggacccccagatccagctgcccctgctggccgcccggcgctacaagctgcagaagcagctggacagcctgacagcccggaccccatctgagggggaggccggcacccagaggcagcagaagctgagcagcctgcagctggagctgagcaagctggacaaggccgccagccacctgcggcagctgatggatgagcccccagcccctggcagccctgagctgtag

SEQ ID NO: 22551 - DNA, 231 bp, Artificial Sequence
  Description of Artificial Sequence: Synthetic coding sequence
atgaacagcgtgggggaggcctgcacagacatgaagcgggagtatgaccagtgcttcaaccgctggtttgctgagaagttcctgaagggggacagcagcggggacccctgcacagacctcttcaagcgctaccagcagtgtgtgcagaaggccatcaaggagaaggagatccccatcgagggcctggagttcatgggccacggcaaggagaagccagagaacagcagctag

SEQ ID NO: 22552 - DNA, 735 bp, Artificial Sequence; identical to SEQ ID NO: 19104
  Description of Artificial Sequence: Synthetic coding sequence

SEQ ID NO: 22553 - DNA, 774 bp, Artificial Sequence
  Description of Artificial Sequence: Synthetic coding sequence
atgccccacctgcccctggccagcttccggccccccttctggggcctgcggcacagccggggcctgccccgcttccacagcgtgtccacccagagcgagccccacggcagccccatcagcagaagaaaccgggaggccaagcagaagaggctgcgggagaagcaggccaccctggaggccgagattgctggggagagcaagagccctgctgagagcatcaaggcctggaggcccaaggagctggtgctgtatgagatccccaccaagccaggagagaagaaggatgtgtctggccccctgcccccagcctacagcccccgctacgtggaggccgcctggtacccctggtgggtgcgggagggcttcttcaagccagagtaccaggcccggctgccccaggccactggagagaccttctccatgtgcatccccccaccaaatgtgacaggcagcctgcacatcggccacgccctgactgtggccatccaggatgccctggtgcgctggcacaggatgagaggagaccaggtgctgtgggtgcccggcagtgaccacgccggcatcgccacccaggccgtggtggagaagcagctgtggaaggagcggggcgtgagaagacatgagctgagccgggaggccttcctgcgggaggtgtggcagtggaaggaggccaagggcggggagatctgtgagcagctgcgggccctgggcgccagcctggactgggacagagtcttctaccacggctgctggctgctgagcggctgtgactag

SEQ ID NO: 22554 - DNA, 804 bp, Artificial Sequence
  Description of Artificial Sequence: Synthetic coding sequence
atgagcaagtctgagagccccaaggagcctgagcagctgaggaagctgttcatcggcggcctgagctttgagaccacagatgagagcctgcggagccactttgagcagtggggcaccctgacagactgtgtggtgatgagggaccccaacaccaagaggagccggggctttggatttgtgacctacgccaccgtggaggaggtggatgctgccatgaatgcccggccccacaaggtggatggccgggtggtggagcccaagagagctgtgtcccgggaggacagccagaggcctggggcccacctgactgtgaagaagatctttgtgggcggcatcaaggaggacacagaggagcaccacctgcgggactactttgagcagtatggcaagattgaagtcatcgagatcatgacagaccggggcagcggcaagaagaggggctttgcctttgtgacctttgatgaccatgacagcgtggacaagatcgtcatccagaagtaccacacagtgaatggccacaactgtgaggtgaggaaggccctgagcaagcaggagatggccagcgccagcagcagccagaggggccgcagcggcagcggcaactttggaggcggcagctacaatgactttggaaactacaacaaccagagcagcaactttggccccatgaagggcggcaactttggaggccgcagcagcggcccctacggcggcggcggccagtactttgccaagcccaggaaccagggcggctacggcggcagcagcagcagcagcagctatggcagcggccgccgcttctag

SEQ ID NO: 22555 - DNA, 531 bp, Artificial Sequence
  Description of Artificial Sequence: Synthetic coding sequence
atgaatgaaagcaagccaggggacagccagaacctggcctgtgtgttctgcaggaagcatgatgactgccccaacaagtatggagagaagaagaccaaggagaagtggaacctgactgtgcactactactgcctgctgatgagcagcggcatctggcagaggggcaaggaggaggagggcgtgtatggcttcctgattgaggacatcaggaaggaggtgaacagagccagcaagctgaagtgctgcgtgtgcaagaagaatggagccagcatcggctgtgtggccccccgctgcaagaggagctaccacttcccctgtggcctgcagcgggagtgcatcttccagttcaccggcaactttgccagcttctgctgggaccacaggcctgtgcagatcatcaccagcaacaactaccgggagagcctgccctgcaccatctgcctggagttcatcgagcccatccccagctacaacatcctgcggagcccctgctgcaagaatgcctggttccaccgggactgcctgcagtag

SEQ ID NO: 22556 - DNA, 3171 bp, Artificial Sequence
  Description of Artificial Sequence: Synthetic coding sequence
atgctgtctgtggtggagaatggcctggacccccaggccgccatccctgtgatcaagaagaagctggtgggctctgtgaaggccctgcagaagcagtatgtgtccctggacacagtggtgaccagtgaagatggagatgccaacaccatgtgcagcgccctggaggccgtgttcatccacggcctgcacgccaagcacatccgggcagaggccggcggcaagaggaagaagagcgcccaccagaagcccctgccccagcctgtgttctggcccctgctgaaggctgtgacccacaagcacatcatcagcgagctggagcacctgacctttgtgaacacagatgtgggccgctgccgggcctggctgcggctggccctgaatgatggcctgatggagtgctacctgaagctgctgctgcaggagcaggcccggctgcacgagtactaccagcccacagccctgctgagagatgctgaggagggggagttcctgctgtccttcctgcagggcctgaccagcctgagctttgagctgagctacaagagcgccatcctgaatgagtggaccctgacccccctggccctgagcggcctgtgccccctgtctgagctggaccccctgagcaccagcggggctgagctgcagaggaaggagagcctggacagcatcagccacagcagcggcagcgaggacatcgaggtgcaccacagcggccacaagatcagaagaaaccagaagctgacagccagcagcctgagcctggacacagccagcagcagccagctgagctgcagcctgaacagcgacagctgcctgctgcaggagaatggcagcaagagcccagaccactgtgaggagcccatgagctgtgacagcgacctgggcacagccaatgctgaggacagcgacaggagcctgcaggaggtgctgctggagttcagcaaggcccaggtgaacagcgtgcccaccaacggcctgagccaggagacagagatccccaccccccaggccagcctgagcctgcacggcctgaacaccagcacctacctgcactgtgaggccccagctgagcccctgcctgcccaggccgccagcggcacccaggatggagtgcacgtgcaggagccccggccccaggcccccagccccctggacctgcagcagcctgtggagagcaccagcggccagcagcccagcagcacagtgtctgaaacagcccgggaggtgggccagggcaatggcctgcagaaggcccaggcccatgatggagctggcctgaagctggtggtgagcagccccaccagccccaagaacaagtcctggatcagtgaagatgacttctaccggcccagccgggagcagcccctggagagcgccagtgaccaccccatcgccagctaccggggcaccccaggcagcaggcctggcctgcaccgccacttcagccaggagcccaggaagaactgcagcctgggcgccctggaccaggcctgtgtgcccagccctggccggcggcaggcccaggccgcccccagccagggccacaagagcttccgggtggtgcaccggcggcagatgggcctgagcaaccccttccggggcctgatgaagctgggcaccgtggagaggagaggagccatgggcatctggaaggagctgttctgtgagctgagccccctggagttccggctgtacctgagcaatgaggagcacacctgtgtggagaactgcagcctgctgcgctgtgagagcgtgggccctgcccacagtgatggccgctttgagctggtgttttctgggaagaagctggccctgcgggccagcagccaggatgaagctgaggactggctggacagagtgcgggaggccctgcagaaggtgcggccccagcaggaggatgagtgggtgaatgtgcagtacccagaccagcctgaggagcccccagaggccccccagggctgcctgagccccagcgacctgctgtctgagcctgctgccctgcagggcacccagtttgactggagcagcgcccaggtgcctgagccagatgccatcaaggagagcctgctgtacctgtacatggacaggacctggatgccctacatcttcagcctgagcctggaggccctgaagtgcttccgcatccggaacaatgagaagatgctgagtgacagccacggcgtggagaccatccgggacatcctgcctgacaccagcctgggcggccccagcttcttcaagatcatcacagccaaggctgtgctgaagctgcaggccggaaatgctgaggaggccgccctgtggagggacctggtgaggaaggtgctggccagctacctggagacagctgaggaggccgtgaccctgggcggcagcctggatgagaactgccaggaggtgctgaagtttgccaccagagaaaatggcttcctgctgcagtacctggtggccatccccatggagaagggcctggacagccagggctgcttctgtgccggctgcagccggcagatcggcttctcctttgtgcggcccaagctgtgtgccttcagcggcctgtactactgtgacatctgccaccaggatgatgccagcgtcatcccagcccgcatcatccacaactgggacctgaccaagaggcccatctgccggcaggccctgaagttcctgacccagatccgggcccagcccctcatcaacctgcagatggtgaatgccagcctgtatgaacatgtggagaggatgcacctgattggaagaagaagagagcagctgaagctgctgggggactacctgggcctgtgccgcagcggggccctgaaggagctgagcaagaggctgaaccacaggaactacctgctggagagcccccaccgcttctctgtggccgacctgcagcagattgctgatggagtgtatgagggcttcctgaaggccctgattgaatttgccagccagcacgtgtaccactgtgacctgtgcacccagaggggcttcatctgccagatctgccagcaccacgacatcatcttcccctttgaatttgacaccaccgtgcgctgtgccgagtgcaagacagtgttccaccagagctgccaggccgtggtgaagaagggctgcccccgctgtgcccggcggaggaagtaccaggagcagaacatctttgcctag

SEQ ID NO: 22557 - DNA, 390 bp, Artificial Sequence; identical to SEQ ID NO: 19988
  Description of Artificial Sequence: Synthetic coding sequence

SEQ ID NO: 22558 - DNA, 348 bp, Artificial Sequence
  Description of Artificial Sequence: Synthetic coding sequence
atgaccaagaagagaagaaacaacggccgggccaagaagggccggggccacgtgcagcccatccgctgcaccaactgtgcccgctgtgtgcccaaggacaaggccatcaagaagtttgtgatccggaacatcgtggaggccgctgctgtgcgggacatcagcgaggtgtctgtgtttgatgcctacgtgctgcccaagctgtatgtgaagctgcactactgtgtgtcctgtgccatccacagcaaggtggtgaggaacagaagccgggaggccaggaaggacaggaccccaccaccccgcttccggcctgctggggccgcccctggccccccacccaagcccatgtag

SEQ ID NO: 22559 - DNA, 1899 bp, Artificial Sequence; identical to SEQ ID NO: 18887
  Description of Artificial Sequence: Synthetic coding sequence

SEQ ID NO: 22560 - DNA, 390 bp, Artificial Sequence; identical to SEQ ID NO: 19988
  Description of Artificial Sequence: Synthetic coding sequence

SEQ ID NO: 22561 - DNA, 5220 bp, Artificial Sequence
  Description of Artificial Sequence: Synthetic coding sequence
atgatggagggcaatggaacagagaacagctgcagcaggacccggggctggctgcagcaggacaatgatgccaagccctggctgtggaagttcagcaactgcttcagcaggcctgagcagaccctgccccacagcccccagaccaaggagtacatggagaacaagaaggtggccgtggagctgaaggatgtgcccagccccctgcacgccggcagcaagctgtttcctgctgtgcccctgcctgacatccgcagcctgcagcagcccaagatccagctgagctctgtgcccaaggtgtcctgctgtgcccactgccccaatgagcccagcaccagccccatgagatttggaggcggcggcggcggcagcggcggcaccagcagcctcatccaccctggggccctgctggacagccagagcaccaggaccatcacctgccaggtgggcagcggctttgccttccagagcgccagcagcctgcagaatgccagcgccaggaacaacctggccggcatcgccagtgacttccccagcatgtgcctggagagcaacctgagcagctgcaagcacctgccctgctgcggcaagctgcacttccagagctgccacggcaatgtgcacaagctgcaccagttccccagcctgcagggctgcaccagcgctggctacttcccctgcagcgacttcaccagcggggcccctggccacctggaggagcacatcagccagagcgagctgaccccccacctgtgcaccaacagcctgcacctgaatgtggtgccccctgtgtgcctgaagggcagcctgtactgtgaggactgcctgaacaagccagccaggaacagcatcattgatgctgccaaggtgtggcccaacatccccccacccaacacccagcctgcccccctggccgtgcccctgtgcaatggctgcggcaccaagggcaccgggaaggagaccaccctgctgctggccaccagcctgggcaaggccgccagcaagtttgaggtggccgtggccggccaggtgctggagaacctgccccccatcggggtcttctgggacatcgagaactgcagcgtgcccagcggccgcagcgccacagctgtggtgcagaggatccgggagaagttcttcaagggccaccgggaggccgagttcatctgtgtgtgtgacatcagcaaggagaacaaggaggtgatccaggagctgaacaactgccaggtgacagtggcccacatcaatgccacagccaagaatgctgctgatgacaagctgcggcagagcctgcggagatttgccaacacccacacagccccagccaccgtggtgctggtgtccacagatgtgaactttgccctggagctgagtgacctgcggcacagacatggcttccacatcatcctggtgcacaagaaccaggccagcgaggccctgctgcaccacgccaatgagctgatccgctttgaggagttcatcagtgacctgcccccccggctgcccctgaagatgccccagtgccacaccctgctgtatgtgtacaacctgcctgccaacaaggatggcaagtctgtgagcaaccggctgcggcggctgagtgacaactgtggcggcaaggtgctgagcatcaccggctgcagcgccatcctgcgcttcatcaaccaggacagcgctgagcgggcccagaagaggatggagaatgaagatgtgtttggaaaccgcatcatcgtgtccttcacccccaagaaccgggagctgtgtgagaccaagagcagcaatgccatcgctgacaaggtgaagagccccaagaagctgaagaaccccaagctgtgcctgatcaaggatgccagcgagcagagcagcagcgccaaggccaccccaggcaagggcagccaggccaacagcggcagcgccaccaagaacaccaacgtgaagagcctgcaggagctgtgcaggatggagagcaagacaggccacaggaacagcgagcaccagcagggccacctgcggctggtggtgcccacccacggcaacagcagcgctgctgtgtccacccccaagaacagcggcgtggccgagcctgtgtacaagaccagccagaagaaggagaacctgagcgcccggtctgtgaccagcagccctgtggagaagaaggacaaggaggagaccgtcttccaggtgtcctaccccagcgccttcagcaagctggtggccagccggcaggtgagccccctgctggccagccagagctggagcagccgctccatgagccccaacctgctgaacagagccagccccctggccttcaacatcgccaacagcagcagcgaggccgactgcccagacccctttgccaacggggctgatgtgcaggtgagcaacatcgactaccgcctgagcaggaaggagctgcagcagctgctgcaggaggcctttgcccggcacggcaaggtgaagtctgtggagctgagcccccacacagactaccagctgaaggctgtggtgcagatggagaacctgcaggatgccatcggggctgtgaacagcctgcaccgctacaagattggcagcaagaagatcctggtgtccctggccaccggggccgccagcaagagcctgagcctgctgtctgctgagaccatgtctgtgctgcaggatgccccagcctgctgcctgcccctcttcaagttcacagacatctatgagaagaagtttggccacaagctgaatgtgtctgacctgtacaagctgacagacacagtggccatccgggagcagggcaatggccgcctggtgtgcctgctgcccagcagccaggcccggcagagccccctgggcagcagccagagccatgatggcagcagcaccaactgcagccccatcatctttgaggagctggagtaccacgagcctgtgtgccggcagcactgcagcaacaaggacttcagcgagcatgaatttgatcctgacagctacaagatccccttcgtcatcctgagcctgaagacctttgccccccaggtgcacagcctgctgcagacccatgagggcaccgtgcccctgctgtccttcccagactgctacatcgccgagtttggagacctggaggtggtgcaggagaaccagggcggcgtgcccctggagcacttcatcacctgtgtgcctggggtgaacatcgccacagcccagaatggcatcaaggtggtgaagtggatccacaacaagcccccaccacccaacacagacccctggctgctgcggagcaagagccctgtgggcaacccccagctgatccagttcagccgggaggtgattgacctgctgaagagccagcccagctgtgtgatccccatcagccacttcatccccagctaccaccaccactttgccaagcagtgccgggtgtctgactatggctacagcaagctgattgagctgctggaggccgtgccccacgtgctgcagatcctgggcatgggcagcaagaggctgctgaccctgacccaccgggcccaggtgaagcgcttcacccaggacctgctgaagctgctgaagagccaggccagcaagcaggtgattgtgcgggagttcagccaggcctaccactggtgcttcagcaaggactgggatgtgacagaatatggagtgtgtgagctgattgacatcgtgtctgagatcccagacaccaccatctgcctgagccagcaggacaatgagatggtgatctgcatccccaagcgggagaggacccaggatgaaattgaaagaaccaagcagttcagcaaggatgtggtggacctgctgcggcaccagccccacttcaggatgcccttcaacaagttcatccccagctaccaccaccacttcggccggcagtgcaagctggcctactacggcttcaccaagctgctggagctgtttgaggccatcccagacaccctgcaggtgctggagtgtggggaggagaagatcctgaccctgacagaggtggagcgcttcaaggccctggccgcccagtttgtgaagctgctgcggagccagaaggacaactgcctgatgatgacagacctgctgacagaatatgccaagaccttcggctacaccttccggctgcaggactatgatgtgagcagcatcagcgccctgacccagaagctgtgccacgtggtgaaggtggccgacattgaaagtggccggcagatccagctgatcaacaggaagagcctgcggagcctgacagcccagctgctggtgctgctgatgtcctgggagggcaccacccacctgtctgtggaggagctgaagaggcactatgagagcacccacaacacccccctgaacccctgtgaatatggcttcatgaccctgacagagctgctgaagagcctgccctacctggtggaggtgttcaccaatgacaagatggaggagtgtgtgaagctgaccagcctgtacctgtttgccaagaatgtgcgcagcctgctgcacacctaccactaccagcagatcttcctgcacgagttctccatggcctacaccaagtatgtgggggagaccctgcagcccaagacctacggccacagctctgtggaggagctgctgggcgccatcccccaggtggtgtggatcaagggccacggccacaagagaattgtggtgctgaagaatgacatgaagagccggctgagcagcctgagcctgagccctgccaaccacgagaaccagcccagcgagggggagcgcatcctggaggtgcctgagagccacacagccagcgagctgaagctgggcgcagatggcagcggccccagccacacagagcaggagctgctgcggctgacagatgacagccctgtggacctgctgtgtgcccctgtgcccagctgcctgcccagcccccagctgcggccagaccctgtgatcctgcagagcgctgacctgatccagtttgaggagcggccccaggagcccagcgagatcatgatcctgaaccaggaggagaagatggagatccccatccctgggaagagcaagaccctgaccagtgacagcagcagcagctgcatctctgctgctgtgcctgtgcccccctgccccagcagcgagaccagcgagagcctgctgagcaaggaccctgtggagagccctgccaagaagcagcccaagaacagagtgaagctggccgccaacttcagcctggcccccatcaccaagctgtag

SEQ ID NO: 22562 - DNA, 390 bp, Artificial Sequence; identical to SEQ ID NO: 19988
  Description of Artificial Sequence: Synthetic coding sequence

SEQ ID NO: 22563 - DNA, 432 bp, Artificial Sequence
  Description of Artificial Sequence: Synthetic coding sequence
atgaccctgcgctgcctggagcccagcggaaatggaggagagggcaccaggagccagtggggcacagctggcagcgctgaggagcccagcccccaggccgcccggctggccaaggccctgcgggagctgggccagacaggctggtactggggctccatgacagtgaatgaggccaaggagaagctgaaggaggcccctgagggcaccttcctgatccgggacagcagccacagcgactacctgctgaccatctctgtgaagaccagcgctggccccaccaacctgagaattgagtaccaggacggcaagttccggctggacagcatcatctgtgtgaagagcaagctgaagcagtttgattctgtggtgcacctgattgactactacgtgcagatgtgcaaggacaagaggacaggccctgaggccccctag

SEQ ID NO: 22564 - DNA, 156 bp, Artificial Sequence
  Description of Artificial Sequence: Synthetic coding sequence
atgagcagctccatgtggtacatcatgcagagcatccagagcaagtacagcctgtctgagcggctcatccgcaccatcgccgccatccgctccttcccccatgacaacgtggaggacctgatccggggcggcgcagatgtgaactgcacccactag

SEQ ID NO: 22565 - DNA, 1902 bp, Artificial Sequence
  Description of Artificial Sequence: Synthetic coding sequence
atggaggagagccccctgagccgggcccccagcagaggaggagtgaacttcctgaatgtggcccggacctacatccccaacaccaaggtggagtgccactacaccctgcccccaggcaccatgcccagcgccagtgactggattggcatcttcaaggtggaggccgcctgtgtgcgggactaccacacctttgtgtggagctctgtgcctgagagcaccacagatggcagccccatccacacctctgtgcagttccaggccagctacctgcccaagccaggggcccagctgtaccagttccgctacgtgaaccggcagggccaggtgtgtggccagagcccccccttccagttccgggagccccggcccatggatgagctggtgaccctggaggaggctgatggcggcagtgacatcctgctggtggtgcccaaggccaccgtgctgcagaaccagctggatgagagccagcaggagagaaatgacctgatgcagctgaagctgcagctggagggccaggtgacagagctgcggagccgggtgcaggagctggagcgggccctggccacagcccggcaggagcacacagagctgatggagcagtacaagggcatcagccgcagccatggagagatcacagaggagcgggacatcctgagccggcagcagggcgaccacgtggcccgcatcctggagctggaggatgacatccagaccatcagcgagaaggtgctgaccaaggaggtggagctggaccggctgcgggacacagtgaaggccctgacccgggagcaggagaagctgctgggccagctgaaggaggtgcaggccgacaaggagcagagcgaggccgagctgcaggtggcccagcaggagaaccaccacctgaacctggacctgaaggaggccaagtcctggcaggaggagcagagcgcccaggcccagaggctgaaggacaaggtggcccagatgaaggacaccctgggccaggcccagcagagggtggccgagctggagcccctgaaggagcagctgcggggggcccaggagctggccgccagcagccagcagaaggccaccctgctgggggaggagctggccagcgctgctgctgcccgggacaggaccatcgccgagctgcacaggagccggctggaggtggccgaggtgaatggccgcctggccgagctgggcctgcacctgaaggaggagaagtgccagtggagcaaggagagagctggcctgctgcagagcgtggaggccgagaaggacaagatcctgaagctgtctgctgagatcctgcggctggagaaggctgtgcaggaggagaggacccagaaccaggtgttcaagacagagctggcccgggagaaggacagcagcctggtgcagctgtctgagagcaagcgggagctgacagagctgcggagcgccctgcgggtgctgcagaaggagaaggagcagctgcaggaggagaagcaggagctgctggagtacatgaggaagctggaggcccggctggagaaggtggctgatgagaagtggaatgaagatgccaccacagaagatgaggaggccgctgtgggcctgagctgcccagctgccctgacagattctgaagatgagagccctgaggacatgaggctgcccccctacggcctgtgtgagcggggggaccccggcagcagccctgctggcccccgggaggccagccccctggtggtgatcagccagcctgcccccatcagcccccacctgagcggccctgctgaggacagcagcagtgacagcgaggccgaggatgagaagtctgtgctgatggctgctgtgcagagcggcggggaggaggccaacctgctgctgcctgagctgggcagcgccttctatgacatggccaggtag

SEQ ID NO: 22566 - DNA, 810 bp, Artificial Sequence; identical to SEQ ID NO: 21274
  Description of Artificial Sequence: Synthetic coding sequence

SEQ ID NO: 22567 - DNA, 618 bp, Artificial Sequence
  Description of Artificial Sequence: Synthetic coding sequence
atggacaaggacagccagggcctgctggacagcagcctgatggccagcggcacagccagccgctcagaagatgaggagagcctggccggccagaagagggccagcagccaggccctgggcaccatccccaagagaagaagcagcagccgcttcatcaagaggaagaagtttgatgatgagctggtggagagcagcctggccaagagcagcacccgggccaagggggccagcggcgtggagcccggccgctgcagcggcagcgagcccagcagcagcgagaagaagaaggtgtccaaggcccccagcacccctgtgccccccagccctgccccagcccctggcctgaccaagagggtgaagaagagcaagcagcccctgcaggtgaccaaggacctgggccgctggaagccagcagatgacctgctgctgatcaatgctgtgctgcagaccaatgacctgacctctgtgcacctgggcgtgaagttcagctgccgcttcaccctgcgggaggtgcaggagcgctggtacgccctgctgtatgaccccgtcatcagcaagctggcctgccaggccatgaggcagctgcaccctgaggccatcgccgccatccagagctag

SEQ ID NO: 22568 - DNA, 540 bp, Artificial Sequence
  Description of Artificial Sequence: Synthetic coding sequence
atggactggaccccccggctgcccagccgccacatcatcagcgagctggagcacctgacctttgtgaacacagatgtgggccgctgccgggcctggctgcggctggccctgaatgatggcctgatggagtgctacctgaagctgctgctgcaggagcaggcccggctgcagctgcagaggaaggagagcctggacagcatcagccacagcagcggcagcgaggacatcgaggtgcaccacagcggccacaagatcagaagaaaccagaagctgacagccagcagcctgagcctggacacagccagcagcagccagctgagctgcagcctgaacagcgacagctgcctgctgcaggagaatggcagcaagagcccagaccactgtgaggagcccatgagctgtgacagcgacctgggcacagccaatgctgaggacagcgacaggagcctgcaggagaagacccgggccggcagccagaggatgaccagcacaggcctgcccggcagcaacccctggagggtgctgcagaccacccagtag

SEQ ID NO: 22569 - DNA, 735 bp, Artificial Sequence; identical to SEQ ID NO: 19104
  Description of Artificial Sequence: Synthetic coding sequence

SEQ ID NO: 22570 - DNA, 558 bp, Artificial Sequence
  Description of Artificial Sequence: Synthetic coding sequence
atggacaaggacagccagggcctgctggacagcagcctgatggccagcggcacagccagccgctcagaagatgaggagagcctggccggccagaagagggccagcagccaggccctgggcaccatccccaagagaagaagcagcagccgcttcatcaagaggaagaagtttgatgatgagctggtggagagcagcctggccaagagcagcacccgggccaagggggccagcggcgtggagcccggccgctgcagcggcagcgagcccagcagcagcgagaagaagaaggtgtccaaggcccccagcacccctgtgccccccagccctgccccagcccctggcctgaccaagagggtgaagaagagcaagcagcccctgcaggtgaccaaggacctgggccgctggaagccagcagatgacctgctgctgatcaatgctgtgctgcagaccaatgacctgacctctgtgcacctgggcgtgaagttcagctgccgcttcaccctgcgggaggtgcaggagcgctggtacgccctgctgtatgaccccgtcatctcctag

SEQ ID NO: 22571 - DNA, 3003 bp, Artificial Sequence
  Description of Artificial Sequence: Synthetic coding sequence
atggtggagtgctttgaaagtggcggcacccggctgagcctgagcagcttcaacgtgtcctgtgacagcctgcgggagcagctgcgggagtggcgctgcttccagtggtggaggatggactggaccccccggctgcccagccgccacatcatcagcgagctggagcacctgacctttgtgaacacagatgtgggccgctgccgggcctggctgcggctggccctgaatgatggcctgatggagtgctacctgaagctgctgctgcaggagcaggcccggctgcacgagtactaccagcccacagccctgctgagagatgctgaggagggggagttcctgctgtccttcctgcagggcctgaccagcctgagctttgagctgagctacaagagcgccatcctgaatgagtggaccctgacccccctggccctgagcggcctgtgccccctgtctgagctggaccccctgagcaccagcggggctgagctgcagaggaaggagagcctggacagcatcagccacagcagcggctctgaagatattgaggtgcaccacagcggccacaagatcagaagaaaccagaagctgacagccagcagcctgagcctggacacagccagcagcagccagctgagctgcagcctgaacagcgacagctgcctgctgcaggagaatggcagcaagagcccagaccactgtgaggagcccatgagctgtgacagcgacctgggcacagccaatgcagaagattctgacaggagcctgcaggaggtgctgctggagttcagcaaggcccaggtgaacagcgtgcccaccaacggcctgagccaggagacagagatccccaccccccaggccagcctgagcctgcacggcctgaacaccagcacctacctgcactgtgaggccccagctgagcccctgcctgcccaggccgccagcggcacccaggatggagtgcacgtgcaggagccccggccccaggcccccagccccctggacctgcagcagcctgtggagagcaccagcggccagcagcccagcagcacagtgtctgaaacagcccgggaggtgggccagggcaatggcctgcagaaggcccaggcccatgatggagctggcctgaagctggtggtgagcagccccaccagccccaagaacaagtcctggatcagtgaagatgacttctaccggcccagccgggagcagcccctggagagcgccagtgaccaccccatcgccagctaccggggcaccccaggcagccggcccggcctgcaccgccacttcagccaggagcccaggaagaactgcagcctgggcgccctggaccaggcctgtgtgcccagccctggaagacggcaggcccaggccgcccccagccagggccacaagagcttccgggtggtgcaccggcggcagatgggcctgagcaaccccttccggggcctgatgaagctgggcaccgtggagcggcggggggccatgggcatctggaaggagctgttctgtgagctgagccccctggagttccggctgtacctgagcaatgaggagcacacctgtgtggagaactgcagcctgctgcgctgtgagagcgtgggccctgcccacagtgatggccgctttgagctggtgttcagcggcaagaagctggccctgcgggccagcagccaggatgaagctgaggactggctggacagagtgcgggaggccctgcagaaggtgcggccccagcaggaggatgagtgggtgaatgtgcagtacccagaccagcctgaggagcccccagaggccccccagggctgcctgagccccagcgacctgctgtctgagcctgctgccctgcagggcacccagtttgactggagcagcgcccaggtgcctgagccagatgccatcaaggagagcctgctgtacctgtacatggacaggacctggatgccctacatcttcagcctgagcctggaggccctgaagtgcttccgcatcagaaataatgagaagatgctgagtgacagccatggagtggagaccatccgggacatcctgcctgacaccagcctgggcggccccagcttcttcaagatcatcacagccaaggctgtgctgaagctgcaggccggaaatgctgaggaggccgccctgtggagggacctggtgaggaaggtgctggccagctacctggagacagctgaggaggccgtgaccctgggcggcagcctggatgagaactgccaggaggtgctgaagtttgccacccgggagaatggcttcctgctgcagtacctggtggccatccccatggagaagggcctggacagccagggctgcttctgtgccggctgcagccggcagatcggcttctcctttgtgcggcccaagctgtgtgccttcagcggcctgtactactgtgacatctgccaccaggatgatgccagcgtcatcccagcccgcatcatccacaactgggacctgaccaagaggcccatctgccggcaggccctgaagttcctgacccagatccgggcccagcccctcatcaacctgcagatggtgaatgccagcctgtatgagcacgtggagaggatgcacctgattggaagaagaagagagcagctgaagctgctgggggactacctgggcctgtgccgcagcggggccctgaaggagctgagcaagaggctgaaccacaggaactacctgctggagagcccccaccgcttctctgtggccgacctgcagcagattgctgatggagtgtatgagggcttcagccccaaggtgcccagcgaggccgccggcctgcggccctggggcgcccggagccctgaggccgccagcgccttccgctgcatcgacagcagccacctgcccagcctgaggaaggtggtgcccaccctcttcctgaagtgctacttcatgcagtacacagtgcccagcgagcagggcagcggccctgaggagagcctgcagtgcatcgagggcattgctgctgtgtag

SEQ ID NO: 22572 - DNA, 525 bp, Artificial Sequence
  Description of Artificial Sequence: Synthetic coding sequence
atggacaccatgatgctgaatgtgaggaacctgtttgagcagctggtgagaagagtggagatcctgtctgagggcaatgaggtgcagttcatccagctggccaaggactttgaggacttcaggaagaagtggcagaggacagaccacgagctgggcaagtacaaggacctgctgatgaaggccgagacagagaggtctgccctggatgtgaagctgaagcacgccaggaaccaggtggatgtggagatcaagaggcggcagagagctgaggccgactgtgagaagctggagcggcagatccagctgatccgggagatgctgatgtgtgacaccagcggcagcatccagctgtctgaggagcagaagagcgccctggccttcctgaacagaggccagcccagcagcagcaatgccggcaacaagaggctgagcaccattgatgaaagtggcagcatcctgagtgacatcagctttgacaagacagatgagagcctggactgggacagcagcctggtgaagacctag

SEQ ID NO: 22573 - DNA, 2904 bp, Artificial Sequence
  Description of Artificial Sequence: Synthetic coding sequence
atggactggaccccccggctgcccagccgccacatcatcagcgagctggagcacctgacctttgtgaacacagatgtgggccgctgccgggcctggctgcggctggccctgaatgatggcctgatggagtgctacctgaagctgctgctgcaggagcaggcccggctgcacgagtactaccagcccacagccctgctgagagatgctgaggagggggagttcctgctgtccttcctgcagggcctgaccagcctgagctttgagctgagctacaagagcgccatcctgaatgagtggaccctgacccccctggccctgagcggcctgtgccccctgtctgagctggaccccctgagcaccagcggggctgagctgcagaggaaggagagcctggacagcatcagccacagcagcggctctgaagatattgaggtgcaccacagcggccacaagatcagaagaaaccagaagctgacagccagcagcctgagcctggacacagccagcagcagccagctgagctgcagcctgaacagcgacagctgcctgctgcaggagaatggcagcaagagcccagaccactgtgaggagcccatgagctgtgacagcgacctgggcacagccaatgcagaagattctgacaggagcctgcaggaggtgctgctggagttcagcaaggcccaggtgaacagcgtgcccaccaacggcctgagccaggagacagagatccccaccccccaggccagcctgagcctgcacggcctgaacaccagcacctacctgcactgtgaggccccagctgagcccctgcctgcccaggccgccagcggcacccaggatggagtgcacgtgcaggagccccggccccaggcccccagccccctggacctgcagcagcctgtggagagcaccagcggccagcagcccagcagcacagtgtctgaaacagcccgggaggtgggccagggcaatggcctgcagaaggcccaggcccatgatggagctggcctgaagctggtggtgagcagccccaccagccccaagaacaagtcctggatcagtgaagatgacttctaccggcccagccgggagcagcccctggagagcgccagtgaccaccccatcgccagctaccggggcaccccaggcagccggcccggcctgcaccgccacttcagccaggagcccaggaagaactgcagcctgggcgccctggaccaggcctgtgtgcccagccctggaagacggcaggcccaggccgcccccagccagggccacaagagcttccgggtggtgcaccggcggcagatgggcctgagcaaccccttccggggcctgatgaagctgggcaccgtggagcggcggggggccatgggcatctggaaggagctgttctgtgagctgagccccctggagttccggctgtacctgagcaatgaggagcacacctgtgtggagaactgcagcctgctgcgctgtgagagcgtgggccctgcccacagtgatggccgctttgagctggtgttcagcggcaagaagctggccctgcgggccagcagccaggatgaagctgaggactggctggacagagtgcgggaggccctgcagaaggtgcggccccagcaggaggatgagtgggtgaatgtgcagtacccagaccagcctgaggagcccccagaggccccccagggctgcctgagccccagcgacctgctgtctgagcctgctgccctgcagggcacccagtttgactggagcagcgcccaggtgcctgagccagatgccatcaaggagagcctgctgtacctgtacatggacaggacctggatgccctacatcttcagcctgagcctggaggccctgaagtgcttccgcatcagaaataatgagaagatgctgagtgacagccatggagtggagaccatccgggacatcctgcctgacaccagcctgggcggccccagcttcttcaagatcatcacagccaaggctgtgctgaagctgcaggccggaaatgctgaggaggccgccctgtggagggacctggtgaggaaggtgctggccagctacctggagacagctgaggaggccgtgaccctgggcggcagcctggatgagaactgccaggaggtgctgaagtttgccacccgggagaatggcttcctgctgcagtacctggtggccatccccatggagaagggcctggacagccagggctgcttctgtgccggctgcagccggcagatcggcttctcctttgtgcggcccaagctgtgtgccttcagcggcctgtactactgtgacatctgccaccaggatgatgccagcgtcatcccagcccgcatcatccacaactgggacctgaccaagaggcccatctgccggcaggccctgaagttcctgacccagatccgggcccagcccctcatcaacctgcagatggtgaatgccagcctgtatgagcacgtggagaggatgcacctgattggaagaagaagagagcagctgaagctgctgggggactacctgggcctgtgccgcagcggggccctgaaggagctgagcaagaggctgaaccacaggaactacctgctggagagcccccaccgcttctctgtggccgacctgcagcagattgctgatggagtgtatgagggcttcctgaaggccctgattgaatttgccagccagcacgtgtaccactgtgacctgtgcacccagaggggcttcatctgccagatctgccagcaccacgacatcatcttcccctttgaatttgacaccaccgtgcgctgtgccgagtgcaagacagtgttccaccagagctgccaggccgtggtgaagaagggctgcccccgctgtgcccggcggaggaagtaccaggagcagaacatctttgcctag

SEQ ID NO: 22574 - DNA, 1446 bp, Artificial Sequence; identical to SEQ ID NO: 20055
  Description of Artificial Sequence: Synthetic coding sequence

SEQ ID NO: 22575 - DNA, 462 bp, Artificial Sequence
  Description of Artificial Sequence: Synthetic coding sequence
atggcccctggcagcagaggagagaggagcagcttccgcagcagaagaggccctggggtgcccagcccccagccagatgtgaccatgctgagccggctgctgaaggagcaccaggccaagcagaatgaaaggaaggagctgcaggagaagagaagaagagaggccatcacagctgccacctgcctgacagaggccctggtggaccacctgaatgtgggcgtggcccaggcctacatgaaccagaggaagctggaccacgaggtgaagaccctgcaggtgcaggccgcccagtttgccaagcagacaggccagtggattggcatggtggagaacttcaaccaggccctgaaggagattggagatgtggagaactgggcccggagcattgagctggacatgaggaccatcgccacagccctggagtatgtgtacaagggccagctgcagagcgcccccagctag

SEQ ID NO: 22576 - DNA, 1311 bp, Artificial Sequence
  Description of Artificial Sequence: Synthetic coding sequence
atgctgtggaacttcaagccccacgcccgggcctaccgctacgtgggccacaaggatgtggtgacctctgtgcagttcagcccccacggcaacctgctggccagcgccagccgggacagaacagtgcggctgtggatcccagacaagaggggcaagttcagcgagttcaaggcccacacagcccctgtgcgctctgtggacttcagcgcagatggccagttcctggccacagccagcgaggacaagagcatcaaggtgtggagcatgtaccggcagcgcttcctgtacagcctgtaccgccacacccactgggtgcgctgtgccaagttctccccagatggccgcctgattgtgtcctgcagcgaggacaagaccatcaagatctgggacaccaccaacaagcagtgtgtgaacaacttcagtgacagcgtgggctttgccaactttgtggacttcaaccccagcggcacctgcatcgccagcgctggcagtgaccagacagtgaaggtgtgggatgtgcgggtgaacaagctgctgcagcactaccaggtgcacagcggcggcgtgaactgcatctccttccaccccagcggcaactacctgatcacagccagcagtgatggcaccctgaagatcctggacctgctggagggccgcctcatctacaccctgcagggccacacaggccctgtgttcaccgtgtccttcagcaagggcggggagctgtttgccagcggcggcgctgacacccaggtgctgctgtggaggaccaactttgatgagctgcactgcaagggcctgaccaagaggaacctgaagaggctgcactttgacagccccccccacctgctggacatctaccccaggaccccccacccccatgaggagaaggtggagaccgtggagatcaaccccaagctggaggtgattgacctgcagatcagcaccccacctgtgatggacatcctgagctttgacagcaccaccaccacagagaccagcggccgcaccctgcctgacaagggggaggaggcctgtggctacttcctgaaccccagcctgatgagccctgagtgcctgcccaccaccaccaagaagaagacagaggacatgtctgacctgccctgtgagagccagaggagcatccccctggccgtgacagatgccctggagcacatcatggagcagctgaatgtgctgacccagacagtgtccatcctggagcagaggctgaccctgacagaggacaagctgaaggactgcctggagaaccagcagaagctgttctctgctgtgcagcagaagagctag

SEQ ID NO: 22577 - DNA, 597 bp, Artificial Sequence; identical to SEQ ID NO: 19257
  Description of Artificial Sequence: Synthetic coding sequence

SEQ ID NO: 22578 - DNA, 597 bp, Artificial Sequence; identical to SEQ ID NO: 19257
  Description of Artificial Sequence: Synthetic coding sequence

SEQ ID NO: 22579 - DNA, 495 bp, Artificial Sequence
  Description of Artificial Sequence: Synthetic coding sequence
atgatggagggcaatggaacagagaacagctgcagcaggacccggggctggctgcagcaggacaatgatgccaagccctggctgtggaagttcagcaactgcttcagcaggcctgagcagaccctgccccacagcccccagaccaaggagtacatggagaacaagaaggtggccgtggagctgaaggatgtgcccagccccctgcacgccggcagcaagctgtttcctgctgtgcccctgcctgacatccgcagcctgcagcagcccaagatccagctgagctctgtgcccaaggtgtcctgctgtgcccactgccccaatgagcccagcaccagccccatgagatttggaggcggcggcggcggcagcggcggcaccagcagcctcatccaccctggggccctgctggacagccagagcaccaggaccatcacctgccaggtgggcagcggctttgccttccagagcgccagcagcctgcagaatgccagctag

SEQ ID NO: 22580 - DNA, 855 bp, Artificial Sequence
  Description of Artificial Sequence: Synthetic coding sequence
atgctgtctgtggtggagaatggcctggacccccaggccgccatccctgtgatcaagaagaagctggtgggctctgtgaaggccctgcagaagcagtatgtgtccctggacacagtggtgaccagtgaagatggagatgccaacaccatgtgcagcgccctggaggccgtgttcatccacggcctgcacgccaagcacatccgggcagaggccggcggcaagaggaagaagagcgcccaccagaagcccctgccccagcctgtgttctggcccctgctgaaggctgtgacccacaagcacatcatcagcgagctggagcacctgacctttgtgaacacagatgtgggccgctgccgggcctggctgcggctggccctgaatgatggcctgatggagtgctacctgaagctgctgctgcaggagcaggcccggctgcagctgcagaggaaggagagcctggacagcatcagccacagcagcggctctgaagatattgaggtgcaccacagcggccacaagatcagaagaaaccagaagctgacagccagcagcctgagcctggacacagccagcagcagccagctgagctgcagcctgaacagcgacagctgcctgctgcaggagaatggcagcaagagcccagaccactgtgaggagcccatgagctgtgacagcgacctgggcacagccaatgcagaagattctgacaggagcctgcaggacatcaagatcttctcctgggcccagtggctgacccctgtgatcccagccctgtgggaggccgaggccggcggcagccagaggcagcagatcgagaccttcctggccaacacagtgaagccccacctgtactag

SEQ ID NO: 22581 - DNA, 3282 bp, Artificial Sequence
  Description of Artificial Sequence: Synthetic coding sequence
atgggcggcaaggcctggccccggcgggctgtgggcacagctgggggcccctgtgccgagcagatcagcgcccccttccagaccctgctgatgccccacctgcccctggccagcttccggccccccttctggggcctgcggcacagccggggcctgccccgcttccacagcgtgtccacccagagcgagccccacggcagccccatcagcagaagaaaccgggaggccaagcagaagaggctgcgggagaagcaggccaccctggaggccgagattgctggggagagcaagagccctgctgagagcatcaaggcctggaggcccaaggagctggtgctgtatgagatccccaccaagccaggagagaagaaggatgtgtctggccccctgcccccagcctacagcccccgctacgtggaggccgcctggtacccctggtgggtgcgggagggcttcttcaagccagagtaccaggcccggctgccccaggccactggagagaccttctccatgtgcatccccccaccaaatgtgacaggcagcctgcacatcggccacgccctgactgtggccatccaggatgccctggtgcgctggcacaggatgagaggagaccaggtgctgtgggtgcccggcagtgaccacgccggcatcgccacccaggccgtggtggagaagcagctgtggaaggagcggggcgtgagaagacatgagctgagccgggaggccttcctgcgggaggtgtggcagtggaaggaggccaagggcggggagatctgtgagcagctgcgggccctgggcgccagcctggactgggaccgggagtgcttcaccatggatgtgggcagctctgtggccgtgacagaggcctttgtgcggctgtacaaggccggcctgctgtacagaaaccaccagctggtgaactggagctgtgccctgcggagcgccatcagtgacatcgaggtggagaaccggcccctgcccggccacacccagctgcggctgcccggctgccccacccctgtgtcctttggcctgctcttctctgtggccttccctgtggatggagagccagatgctgaggtggtggtgggcaccaccaggcctgagaccctgcctggagatgtggccgtggccgtgcacccagatgacagccgctacacccacctgcacggccggcagctgcggcaccccctgatgggccagcccctgcccctcatcacagattatgctgtgcagccccacgtgggcaccggggctgtgaaggtgaccccagcccacagccctgcagatgctgagatgggcgcccggcacggcctgagccccctgaatgtgattgctgaagatggcaccatgaccagcctgtgtggggactggctgcagggcctgcacagatttgtggcccgggagaagatcatgtctgtgctgtctgagcggggcctcttccggggcctgcagaaccaccccatggtgctgcccatctgcagccgctctggagatgtgattgagtacctgctgaagaaccagtggtttgtgcgctgccaggagatgggcgcccgggccgccaaggctgtggagagcggggccctggagctgagccccagcttccaccagaagaactggcagcactggttcagccacatcggggactggtgtgtgtcccggcagctgtggtggggccaccagatcccagcctacctggtggtggaggaccacgcccagggcgaggaggactgctgggtggtgggccgctctgaggccgaggcccgggaggtggccgctgagctgaccggccggcctggagctgagctgaccctggagcgggaccctgatgtgctggacacctggttcagcagcgccctcttccccttcagcgccctgggctggccccaggagaccccagacctggcccgcttctaccccctgagcctgctggagactggaagtgacctgctgctcttctgggtgggccgcatggtgatgctgggcacccagctgaccggccagctgcccttcagcaaggtgctgctgcaccccatggtgcgggaccggcagggcaggaagatgagcaagagcctgggcaatgtgctggacccccgggacatcatcagcggcgtggagatgcagctgctgcaggagaagctgcggagcggcaacctggaccctgctgagctggccatcgtggccgccgcccagaagaaggacttcccccacggcatcccagaatgtggcacagatgccctgcgcttcaccctgtgcagccatggagtgcaggccggggacctgcacctgtctgtgtctgaggtgcagagctgccgccacttctgcaacaagatctggaatgccctgcgcttcatcctgaatgccctgggggagaagtttgtgccccagcctgctgaggagctgagccccagcagccccatggatgcctggatcctgagccggctggccctggccgcccaggagtgtgagcggggcttcctgacccgggagctgagcctggtgacccacgccctgcaccacttctggctgcacaacctgtgtgatgtgtacctggaggccgtgaagcctgtgctgtggcacagcccccggcccctgggccccccccaggtgctcttcagctgtgccgacctgggcctgcggctgctggcccccctgatgcccttcctggccgaggagctgtggcagaggctgcccccccggcccggctgccccccagcccccagcatctctgtggccccctaccccagcgcctgcagcctggagcactggaggcagcctgagctggagcggcgcttcagccgggtgcaggaggtggtgcaggtgctgcgggccctgcgggccacctaccagctgaccaaggcccggccccgggtgctgctgcagagcagcgagcccggggaccagggcctgtttgaggccttcctggagcccctgggcaccctgggctactgtggggctgtgggcctgctgcccccaggcacagctgcccccagcggctgggcccaggcccccctgagtgacacagcccaggtgtacatggagctgcagggcctggtggacccccagatccagctgcccctgctggccgcccggcgctacaagctgcagaagcagctggacagcctgacagcccggaccccatctgagggggaggccggcacccagaggcagcagaagctgagcagcctgcagctggagctgagcaagctggacaaggccgccagccacctgcggcagctgatggatgagcccccagcccctggcagccctgagctgtag

SEQ ID NO: 22582 - DNA, 3621 bp, Artificial Sequence
  Description of Artificial Sequence: Synthetic coding sequence
atgaccagcgctgctgagatcaagaagccccctgtggcccccaagcccaagtttgtggtggccaacaacaagccagcccccccacccatcgcccccaagccagacatcgtcatcagctctgtgccccagagcaccaagaagatgaagccagccatcgcccccaagcccaaggtgctgaagaccagccctgtgcgggagatcggccagagccccagcaggaagatcatgctgaacctggagggccacaagcaggagctggccgagagcacagacaacttcaactgcaagtatgagggcaaccagagcaatgactacatcagccccatgtgcagctgcagcagcgagtgcatccacaagctgggccaccgggagaacctgtgtgtgaagcagctggtgctggagcccctggagatgaatgaaaacctggagaacagcaagattgatgagaccctgaccatcaagaccaggagcaaatgtgacctgtatggagagaaggccaagaaccagggcggcgtggtgctgaaggcctctgtgctggaggaggagctgaaggatgccctgatccaccagatgccacccttcatcagcgcccagaagcaccggcccacagacagccctgagatgaatggaggctgcaacagcaatggccagttccgcatcgagtttgctgacctgagccccagccccagcagctttgagaaggtgcctgaccaccacagctgccacctgcagctgcccagtgatgaatgtgagcactttgagacctgccaggatgacagcgagaagagcaacaactgcttccagagcagcgagctggaggccctggagaatggcaagaggagcaccctcatcagcagtgatggagtgtccaagaagtctgaggtgaaggacctgggccccctggagatccacctggtgccctacacccccaagttccccacccccaagcccaggaagaccaggacagcccggctgctgcggcagaagtgtgtggacaccccatctgagagcacagaggagcccggcaacagcgacagcagcagcagctgcctgacagagaacagcctgaagatcaacaagatctctgtgctgcaccagaatgtgctgtgcaagcaggagcaggtggacaagatgaagctgggcaacaagtctgagctgaacatggagagcaacagtgatgcccaggacctggtgaacagccagaaggccatgtgcaatgagaccaccagctttgagaagatggcccccagctttgacaaggacagcaacctgagcagtgacagcaccaccgtggatggcagctccatgagcctggccgtggatgagggcaccggcttcatccgctgcaccgtgtccatgagcctgcccaagcagctgaagctgacctgcaatgagcacctgcagagcggcaggaacctgggcgtgtctgccccccagatgcagaaggagagcgtcatcaaggaggagaacagcctgcgcatcgtgcccaagaagccccagaggcacagcctgcctgccactggagtgctgaagaaggccgccagcgaggagctgctggagaagagcagctaccccagcagcgaggagaagagcagcgagaagagcctggagaggaaccacctgcagcacctgtgtgcccagaacagaggagtgagcagcagctttgacatgcccaagagggccagcgagaagcctgtgtggaagctgccccaccccatcctgcccttcagcggcaaccctgagttcctgaagtctgtgacagtgagcagcaacagcgagcccagcacagccctgaccaagccccgggccaagagcctgagcgccatggatgtggagaagtgcaccaagccctgcaaggacagcaccaagaagaacagcttcaagaagctgctgtccatgaagctgagcatctgcttcatgaagagtgacttccagaagttctggagcaagagcagccagctgggggacaccaccaccggccacctgagcagcggggagcagaagggcatcgagagtgactggcagggcctgctggtgggggaggagaagaggagcaagcccatcaaggcctacagcacagagaactacagcctggagagccagaagaagaggaagaagagccggggccagaccagcgctgccaacggcctgcgggcagagagcctggatgaccagatgctgagccgggagagcagcagccaggccccctacaagtctgtgaccagcctgtgtgccccagaatatgagaacatccgccactatgaggagatcccagaatatgagaacctgcccttcatcatggccatcaggaagacccaggagctggagtggcagaacagcagctccatggaggatgctgatgccaacgtgtatgaggtggaggagccctatgaggccccagatggccagctgcagctgggccccaggcaccagcacagcagcagcggggccagccaggaggagcagaatgacctgggcctgggggacctgcccagtgatgaggaggagatcatcaacagcagtgatgaagatgatgtgagcagcgagagcagcaagggggagccagaccccctggaggacaagcaggatgaggacaatggcatgaagagcaaggtgcaccacatcgccaaggagatcatgagcagcgagaaggtgtttgtggatgtgctgaagctgctgcacatcgacttcagagatgctgtggcccacgccagccggcagctgggcaagcctgtgattgaggaccgcatcctgaaccagatcctgtactacctgccccagctgtatgagctgaacagagacctgctgaaggagctggaggagaggatgctgcactggacagagcagcagagaattgctgacatctttgtgaagaagggcccctacctgaagatgtacagcacctacatcaaggagtttgacaagaacatcgccctgctggatgagcagtgcaagaagaaccctggctttgctgctgtggtgcgggagtttgagatgagcccccgctgtgccaacctggccctgaagcactacctgctgaagcctgtgcagaggatcccccagtaccgcctgctgctgacagactacctgaagaacctgattgaagatgctggggactacagagacacccaggatgccctggccgtggtgattgaggtggccaaccacgccaatgacaccatgaagcagggcgacaacttccagaagctgatgcagatccagtacagcctgaatggccaccatgaaattgtgcagcccggccgggtcttcctgaaggagggcatcctgatgaagctgagcaggaaggtgatgcagcccaggatgttcttcctgttcaatgatgccctgctgtacaccacccctgtgcagagcggcatgtacaagctgaacaacatgctgagcctggccggcatgaaggtgaggaagcccacccaggaggcctaccagaatgagctgaagattgagagcgtggagaggagcttcatcctgagcgccagcagcgccacagaaagagatgagtggctggaggccatcagccgggccatcgaggagtatgccaagaagaggatcaccttctgccccagccgcagcctggatgaagctgacagcgagaacaagtag

SEQ ID NO: 22583 - DNA, 435 bp, Artificial Sequence
  Description of Artificial Sequence: Synthetic coding sequence
atggacaaggacagccagggcctgctggacagcagcctgatggccagcggcacagccagccgctcagaagatgaggagagcctggccggccagaagagggccagcagccaggccctgggcaccatccccaagagaagaagcagcagcaggaccctgtaccgcttcatcaagaggaagaagtttgatgatgagctggtggagagcagcctggccaagagcagcacccgggccaagggggccagcggcgtggagcccggccgctgcagcggcagcgagcccagcagcagcgagaagaagaaggtgtccaaggcccccagcacccctgtgccccccagccctgccccagcccctggcctgaccaagagggtgaagaagagcaagcagcccctgcaggtgaccaaggacctgggccgctggaagccagcagatgactag

SEQ ID NO: 22584 - DNA, 810 bp, Artificial Sequence; identical to SEQ ID NO: 21274
  Description of Artificial Sequence: Synthetic coding sequence

SEQ ID NO: 22585 - DNA, 501 bp, Artificial Sequence
  Description of Artificial Sequence: Synthetic coding sequence
atggccaatgaccccctggagggcttccacgaggtgaacctggccagccccaccagcccagacctgctgggcgtgtatgagagcggcacccaggagcagaccaccagccccagcgtcatctaccggccccaccccagcgccctgagctctgtgcccatccaggccaatgccctggatgtgtctgagctgcccacccagcctgtgtacagcagcccccggcggctgaactgtgccgagatcagcagcatctccttccacgtgacagatcctgccccctgcagcaccagcggcgtgacagctggcctgaccaagctgaccaccaggaaggacaactacaatgctgagcgggagttcctgcagggcgccaccatcacagaggcctgtgatggcagtgatgacatcttcggcctgagcacagacagcctgagccggctgcggagccccagcgtgctggaggtgcgggagaagggctatgaaaggctgaaggaggagctggcctag

SEQ ID NO: 22586 - DNA, 390 bp, Artificial Sequence
  Description of Artificial Sequence: Synthetic coding sequence
atggacaccatgatgctgaatgtgaggaacctgtttgagcagctggtgagaagagtggagatcctgtctgagggcaatgaggtgcagttcatccagctggccaaggactttgaggacttcaggaagaagtggcagaggacagaccacgagctgggcaagtacaaggacctgctgatgaaggccgagacagagaggtctgccctggatgtgaagctgaagcacgccaggaaccaggtggatgtggagatcaagaggcggcagagagctgaggccgactgtgagaagctggagcggcagatccagctgatccgggagatgctgatgtgtgacaccagcggcagcatccagctgtctgaggagcagaagagcgccctggccttcctgaactag

SEQ ID NO: 22587 - DNA, 486 bp, Artificial Sequence
  Description of Artificial Sequence: Synthetic coding sequence
atgaccctgcgctgcctggagcccagcggaaatggaggagagggcaccaggagccagtggggcacagctggcagcgctgaggagcccagcccccaggccgcccggctggccaaggccctgcgggagctgggccagacaggctggtactggggctccatgacagtgaatgaggccaaggagaagctgaaggaggcccctgagggcaccttcctgatccgggacagcagccacagcgactacctgctgaccatctctgtgaagaccagcgctggccccaccaacctgagaattgagtaccaggacggcaagttccggctggacagcatcatctgtgtgaagagcaagctgaagcagtttgattctgtggtgcacctgattgactactacgtgcagatgtgcaaggacaagaggacaggccctgaggcccccagaaatggaacagtgcacctgtacctgaccaagcccctgtacaccagcgccccctag

SEQ ID NO: 22588 - DNA, 1389 bp, Artificial Sequence; identical to SEQ ID NO: 19306
  Description of Artificial Sequence: Synthetic coding sequence

SEQ ID NO: 22589 - DNA, 576 bp, Artificial Sequence; identical to SEQ ID NO: 18243
  Description of Artificial Sequence: Synthetic coding sequence

SEQ ID NO: 22590 - DNA, 1212 bp, Artificial Sequence
  Description of Artificial Sequence: Synthetic coding sequence
atggccagcagctctgtgcccccagccaccgtgtctgctgccacagctggccctggccctggcttcggctttgccagcaagaccaagaagaagcactttgtgcagcagaaggtgaaggtgttccgggctgctgaccccctggtgggcgtcttcctgtggggcgtggcccacagcatcaatgagctgagccaggtgcccccacctgtgatgctgctgcctgatgacttcaaggccagcagcaagatcaaggagtactgcccccaggtgttcaggaacctgcgggacagatttggaattgatgaccaggactacctggtgtccctgaccaggaacccccccagcgagagcgagggcagtgatggccgcttcctgatctcctatgacaggaccctggtgatcaaggaggtgtccagtgaagatattgctgacatgcacagcaacctgagcaactaccaccagtacatcgtgaagtgccacggcaacaccctgctgccccagttcctgggcatgtacagagtgtctgtggacaatgaagacagctacatgctggtgatgaggaacatgttcagccaccggctgcctgtgcacaggaaatatgacctgaagggcagcctggtgtcccgggaggccagtgacaaggagaaggtgaaggagctgcccaccctgaaggacatggacttcctgaacaagaaccagaaggtgtacatcggggaggaggagaagaagatcttcctggagaagctgaagagagatgtggagttcctggtgcagctgaagatcatggactacagcctgctgctgggcatccatgacatcatccggggcagcgagcctgaggaggaggcccctgtgcgggaggatgaaagtgaggtggatggagactgcagcctgaccggccccccagccctggtgggcagctatggcaccagccctgagggcatcggcggctacatccacagccaccggcccctgggccctggagaatttgagagcttcattgatgtgtatgccatccgctctgctgagggcgccccccagaaggaggtgtacttcatgggcctgattgacatcctgacccagtatgatgccaagaagaaggccgcccacgccgccaagacagtgaagcacggggccggggctgagatcagcacagtgcaccctgagcagtatgccaagcgcttcctggacttcatcaccaacatctttgcctag

SEQ ID NO: 22591 - DNA, 576 bp, Artificial Sequence
  Description of Artificial Sequence: Synthetic coding sequence
aagattgaggtgattgagatcatgacagaccggggcagcggcaagaagaggggctttgcctttgtgacctttgatgaccatgattctgtggacaagatcgtcatccagaagtaccacacagtgaatggccacaactgtgaggtgaggaaggccctgagcaagcaggagatggccagcgccagcagcagccagaggggccgcagcggcagcggcaactttggaggcggccggggcggcggctttggaggaaatgacaactttggccggggcggcaacttcagcggccggggcggctttggaggcagccggggcggcggcggctacggcggcagcggagatggctacaacggctttggaaatgatggcagcaactttggaggcggcggcagctacaatgactttggaaactacaacaaccagagcagcaactttggccccatgaagggcggcaactttggaggccgcagcagcggcccctacggcggcggcggccagtactttgccaagcccaggaaccagggcggctacggcggcagcagcagcagcagcagctatggcagcggccgccgcttctag

SEQ ID NO: 22592 - DNA, 543 bp, Artificial Sequence
  Description of Artificial Sequence: Synthetic coding sequence
atggagctgaccatcttcatcctgcggctggccatctacatcctgaccttccccctgtacctgctgaacttcctgggcctgtggagctggatctgcaagaagtggttcccctacttcctggtgcgcttcaccgtcatctacaatgagcagatggccagcaagaagcgggagctgttcagcaacctgcaggagtttgctggccccagcggcaagctgagcctgctggaggtgggctgcggcactggagccaacttcaagttctacccacctggctgccgggtgacctgcatcgaccccaaccccaactttgagaagttcctgatcaagagcattgctgaaaatagacacctgcagtttgaaagatttgtggtggccgccggggagaacatgcaccaggtggctgatggctctgtggatgtggtggtgtgcaccctggtgctgtgcagcgtgaagaaccaggagcgcatcctgcgggaggtgtgccgggtgctgcggcctgggggcgccttctacttcatggagcacgtggccgcagaatgttag

SEQ ID NO: 22593 - DNA, 1431 bp, Artificial Sequence
  Description of Artificial Sequence: Synthetic coding sequence
atgggcctgaagaagatgaagggcctgtcctatgatgaggcctttgccatggccaatgaccccctggagggcttccacgaggtgaacctggccagccccaccagcccagacctgctgggcgtgtatgagagcggcacccaggagcagaccaccagccccagcgtcatctaccggccccaccccagcgccctgagctctgtgcccatccaggccaatgccctggatgtgtctgagctgcccacccagcctgtgtacagcagcccccggcggctgaactgtgccgagatcagcagcatctccttccacgtgacagatcctgccccctgcagcaccagcggcgtgacagctggcctgaccaagctgaccaccaggaaggacaactacaatgctgagcgggagttcctgcagggcgccaccatcacagaggcctgtgatggcagtgatgacatcttcggcctgagcacagacagcctgagccggctgcggagccccagcgtgctggaggtgcgggagaagggctatgaaaggctgaaggaggagctggccaaggcccagcgggagctgaagctgaaggatgaggagtgtgagcggctgagcaaggtgcgggaccagctgggccaggagctggaggagctgacagccagcctgtttgaggaggcccacaagatggtgcgggaggccaacatcaagcaggccacagctgagaagcagctgaaggaggcccagggcaagattgatgtgctgcaggccgaggtggccgccctgaagaccctggtgctgagcagcagccccaccagccccacccaggagcccctgcccggcggcaagacccccttcaagaagggccacaccaggaacaagagcaccagcagcgccatgagcggcagccaccaggacctgagcgtcatccagcccatcgtgaaggactgcaaggaggccgacctgagcctgtacaatgagttccggctgtggaaggatgagcccaccatggacaggacctgccccttcctggacaagatctaccaggaggacatcttcccctgcctgaccttcagcaagtctgagctggccagcgctgtgctggaggccgtggagaacaacaccctgagcattgagcctgtgggcctgcagcccatccgctttgtgaaggccagcgctgtggagtgtggcggccccaagaagtgtgccctgaccggccagagcaagagctgcaagcaccgcatcaagctgggggacagcagcaactactactacatcagccccttctgccgctaccgcatcacctctgtgtgcaacttcttcacctacatccgctacatccagcagggcctggtgaagcagcaggatgtggaccagatgttctgggaggtgatgcagctgaggaaggagatgagcctggccaagctgggctacttcaaggaggagctgtag

SEQ ID NO: 22594 - DNA, 336 bp, Artificial Sequence
  Description of Artificial Sequence: Synthetic coding sequence
atggacaccatgatgctgaatgtgaggaacctgtttgagcagctggtgagaagagtggagatcctgtctgagggcaatgaggtgcagttcatccagctggccaaggactttgaggacttcaggaagaagtggcagaggacagaccacgagctgggcaagtacaaggacctgctgatgaaggccgagacagagaggtctgccctggatgtgaagctgaagcacgccaggaaccaggtggatgtggagatcaagaggcggcagagagctgaggccgactgtgagaagctggagcggcagatccagctgatccgggagatgctgatgtgtgacacctag

SEQ ID NO: 22595 - DNA, 324 bp, Artificial Sequence
  Description of Artificial Sequence: Synthetic coding sequence
atgatcaagaacctggaggtgcagctgcggcgggccacagatgagatgaaggcctacatcagcagtgaccagcaggagaagaggaaggccatccgggagcagtacaccaagaacacagctgagcaggagaacctgggcaagaagctgcgggagaagcagaaggtgatccgggagagccacggccccaacatgaagcaggccaagatgtggagggacctggagcagctgatggagtgcaagaagcagtgcttcctgaagcagcagagccagaccagcatcggccaggtgatccaggagggcggggaggacaggctcatcctgtag

SEQ ID NO: 22596 - DNA, 2772 bp, Artificial Sequence
  Description of Artificial Sequence: Synthetic coding sequence
atgtgcatccccccaccaaatgtgacaggcagcctgcacatcggccacgccctgactgtggccatccaggatgccctggtgcgctggcacaggatgagaggagaccaggtgctgtgggtgcccggcagtgaccacgccggcatcgccacccaggccgtggtggagaagcagctgtggaaggagcggggcgtgagaagacatgagctgagccgggaggccttcctgcgggaggtgtggcagtggaaggaggccaagggcggggagatctgtgagcagctgcgggccctgggcgccagcctggactgggaccgggagtgcttcaccatggatgtgggcagctctgtggccgtgacagaggcctttgtgcggctgtacaaggccggcctgctgtacagaaaccaccagctggtgaactggagctgtgccctgcggagcgccatcagtgacatcgaggtggagaaccggcccctgcccggccacacccagctgcggctgcccggctgccccacccctgtgtcctttggcctgctcttctctgtggccttccctgtggatggagagccagatgctgaggtggtggtgggcaccaccaggcctgagaccctgcctggagatgtggccgtggccgtgcacccagatgacagccgctacacccacctgcacggccggcagctgcggcaccccctgatgggccagcccctgcccctcatcacagattatgctgtgcagccccacgtgggcaccggggctgtgaaggtgaccccagcccacagccctgcagatgctgagatgggcgcccggcacggcctgagccccctgaatgtgattgctgaagatggcaccatgaccagcctgtgtggggactggctgcagggcctgcacagatttgtggcccgggagaagatcatgtctgtgctgtctgagcggggcctcttccggggcctgcagaaccaccccatggtgctgcccatctgcagccgctctggagatgtgattgagtacctgctgaagaaccagtggtttgtgcgctgccaggagatgggcgcccgggccgccaaggctgtggagagcggggccctggagctgagccccagcttccaccagaagaactggcagcactggttcagccacatcggggactggtgtgtgtcccggcagctgtggtggggccaccagatcccagcctacctggtggtggaggaccacgcccagggcgaggaggactgctgggtggtgggccgctctgaggccgaggcccgggaggtggccgctgagctgaccggccggcctggagctgagctgaccctggagcgggaccctgatgtgctggacacctggttcagcagcgccctcttccccttcagcgccctgggctggccccaggagaccccagacctggcccgcttctaccccctgagcctgctggagactggaagtgacctgctgctcttctgggtgggccgcatggtgatgctgggcacccagctgaccggccagctgcccttcagcaaggtgctgctgcaccccatggtgcgggaccggcagggcaggaagatgagcaagagcctgggcaatgtgctggacccccgggacatcatcagcggcgtggagatgcagctgctgcaggagaagctgcggagcggcaacctggaccctgctgagctggccatcgtggccgccgcccagaagaaggacttcccccacggcatcccagaatgtggcacagatgccctgcgcttcaccctgtgcagccatggagtgcaggccggggacctgcacctgtctgtgtctgaggtgcagagctgccgccacttctgcaacaagatctggaatgccctgcgcttcatcctgaatgccctgggggagaagtttgtgccccagcctgctgaggagctgagccccagcagccccatggatgcctggatcctgagccggctggccctggccgcccaggagtgtgagcggggcttcctgacccgggagctgagcctggtgacccacgccctgcaccacttctggctgcacaacctgtgtgatgtgtacctggaggccgtgaagcctgtgctgtggcacagcccccggcccctgggccccccccaggtgctcttcagctgtgccgacctgggcctgcggctgctggcccccctgatgcccttcctggccgaggagctgtggcagaggctgcccccccggcccggctgccccccagcccccagcatctctgtggccccctaccccagcgcctgcagcctggagcactggaggcagcctgagctggagcggcgcttcagccgggtgcaggaggtggtgcaggtgctgcgggccctgcgggccacctaccagctgaccaaggcccggccccgggtgctgctgcagagcagcgagcccggggaccagggcctgtttgaggccttcctggagcccctgggcaccctgggctactgtggggctgtgggcctgctgcccccaggcacagctgcccccagcggctgggcccaggcccccctgagtgacacagcccaggtgtacatggagctgcagggcctggtggacccccagatccagctgcccctgctggccgcccggcgctacaagctgcagaagcagctggacagcctgacagcccggaccccatctgagggggaggccggcacccagaggcagcagaagctgagcagcctgcagctggagctgagcaagctggacaaggccgccagccacctgcggcagctgatggatgagcccccagcccctggcagccctgagctgtag

SEQ ID NO: 22597 - DNA, 2076 bp, Artificial Sequence
  Description of Artificial Sequence: Synthetic coding sequence
atggaggagagccccctgagccgggcccccagcagaggaggagtgaacttcctgaatgtggcccggacctacatccccaacaccaaggtggagtgccactacaccctgcccccaggcaccatgcccagcgccagtgactggattggcatcttcaaggtggaggccgcctgtgtgcgggactaccacacctttgtgtggagctctgtgcctgagagcaccacagatggcagccccatccacacctctgtgcagttccaggccagctacctgcccaagccaggggcccagctgtaccagttccgctacgtgaaccggcagggccaggtgtgtggccagagcccccccttccagttccgggagccccggcccatggatgagctggtgaccctggaggaggctgatggcggcagtgacatcctgctggtggtgcccaaggccaccgtgctgcagaaccagctggatgagagccagcaggagagaaatgacctgatgcagctgaagctgcagctggagggccaggtgacagagctgcggagccgggtgcaggagctggagcgggccctggccacagcccggcaggagcacacagagctgatggagcagtacaagggcatcagccgcagccatggagagatcacagaggagcgggacatcctgagccggcagcagggcgaccacgtggcccgcatcctggagctggaggatgacatccagaccatcagcgagaaggtgctgaccaaggaggtggagctggaccggctgcgggacacagtgaaggccctgacccgggagcaggagaagctgctgggccagctgaaggaggtgcaggccgacaaggagcagagcgaggccgagctgcaggtggcccagcaggagaaccaccacctgaacctggacctgaaggaggccaagtcctggcaggaggagcagagcgcccaggcccagaggctgaaggacaaggtggcccagatgaaggacaccctgggccaggcccagcagagggtggccgagctggagcccctgaaggagcagctgcggggggcccaggagctggccgccagcagccagcagaaggccaccctgctgggggaggagctggccagcgctgctgctgcccgggacaggaccatcgccgagctgcacaggagccggctggaggtggccgaggtgaatggccgcctggccgagctgggcctgcacctgaaggaggagaagtgccagtggagcaaggagagagctggcctgctgcagagcgtggaggccgagaaggacaagatcctgaagctgtctgctgagatcctgcggctggagaaggctgtgcaggaggagaggacccagaaccaggtgttcaagacagagctggcccgggagaaggacagcagcctggtgcagctgtctgagagcaagcgggagctgacagagctgcggagcgccctgcgggtgctgcagaaggagaaggagcagctgcaggaggagaagcaggagctgctggagtacatgaggaagctggaggcccggctggagaaggtggctgatgagaagtggaatgaagatgccaccacagaagatgaggaggccgctgtgggcctgagctgcccagctgccctgacagattctgaagatgagagccctgaggacatgaggctgcccccctacggcctgtgtgagcggggggaccccggcagcagccctgctggcccccgggaggccagccccctggtggtgatcagccagcctgcccccatcagcccccacctgagcggccctgctgaggacagcagcagtgacagcgaggccgaggatgagaagtctgtgctgatggctgctgtgcagagcggcggggaggaggccaacctgctgctgcctgagctgggcagcgccttctatgacatggccagcggcttcaccgtgggcaccctgtctgagaccagcactggaggccctgccacccccacctggaaggaatgtcccatctgcaaggagcgcttccctgctgagagtgacaaggatgccctggaggaccacatggatggccacttcttcttcagcacccaggaccccttcacctttgaatag

SEQ ID NO: 22598 - DNA, 366 bp, Artificial Sequence
  Description of Artificial Sequence: Synthetic coding sequence
atgaatgaaagcaagccaggggacagccagaacctggcctgtgtgttctgcaggaagcatgatgactgccccaacaagtatggagagaagaagaccaaggagaagtggaacctgactgtgcactactactgcctgctgatgagcagcggcatctggcagaggggcaaggaggaggagggcgtgtatggcttcctgattgaggacatcaggaaggaggtgaacagagccagcaagctgaagtgctgcgtgtgcaagaagaatggagccagcatcggctgtgtggccccccgctgcaagaggagctaccacttcccctgtggcctgcagcgggagtgcatcttccagttcaccggcaactttgcctag

SEQ ID NO: 22599 - DNA, 657 bp, Artificial Sequence; identical to SEQ ID NO: 19199
  Description of Artificial Sequence: Synthetic coding sequence

SEQ ID NO: 22600 - DNA, 1899 bp, Artificial Sequence; identical to SEQ ID NO: 18887
  Description of Artificial Sequence: Synthetic coding sequence

SEQ ID NO: 22601 - DNA, 1134 bp, Artificial Sequence; identical to SEQ ID NO: 20043
  Description of Artificial Sequence: Synthetic coding sequence

SEQ ID NO: 22602 - DNA, 1134 bp, Artificial Sequence; identical to SEQ ID NO: 20043
  Description of Artificial Sequence: Synthetic coding sequence

SEQ ID NO: 22603 - DNA, 774 bp, Artificial Sequence; identical to SEQ ID NO: 22553
  Description of Artificial Sequence: Synthetic coding sequence

SEQ ID NO: 22604 - DNA, 1446 bp, Artificial Sequence; identical to SEQ ID NO: 20055
  Description of Artificial Sequence: Synthetic coding sequence

SEQ ID NO: 22605 - DNA, 597 bp, Artificial Sequence; identical to SEQ ID NO: 19257
  Description of Artificial Sequence: Synthetic coding sequence

SEQ ID NO: 22606 - DNA, 345 bp, Artificial Sequence
  Description of Artificial Sequence: Synthetic coding sequence
atgaccacccggcaggccaccaaggaccccctgctgcggggcgtgagccccacccccagcaagatccctgtgcgcagccagaagaggacccccttccccaccgtgaccagctgtgctgtggaccaggagaaccaggacccccggcgctgggtgcagaagccacccctgaacatccagaggcccctggtggacagcgctggcccccggcccaaggcccggcaccaggccgagaccagccagaggctggtgggcatcagccagcccaggaaccccctggaggagctgcggcccagcccccggggccagaatgtgggccctggccccccagcccagacagaggcctag

SEQ ID NO: 22607 - DNA, 1446 bp, Artificial Sequence; identical to SEQ ID NO: 20055
  Description of Artificial Sequence: Synthetic coding sequence

SEQ ID NO: 22608 - DNA, 396 bp, Artificial Sequence; identical to SEQ ID NO: 20854
  Description of Artificial Sequence: Synthetic coding sequence

SEQ ID NO: 22609 - DNA, 765 bp, Artificial Sequence; identical to SEQ ID NO: 19033
  Description of Artificial Sequence: Synthetic coding sequence

SEQ ID NO: 22610 - DNA, 2772 bp, Artificial Sequence
  Description of Artificial Sequence: Synthetic coding sequence
atgtgcatccccccaccaaatgtgacaggcagcctgcacatcggccacgccctgactgtggccatccaggatgccctggtgcgctggcacaggatgagaggagaccaggtgctgtgggtgcccggcagtgaccacgccggcatcgccacccaggccgtggtggagaagcagctgtggaaggagcggggcgtgagaagacatgagctgagccgggaggccttcctgcgggaggtgtggcagtggaaggaggccaagggcggggagatctgtgagcagctgcgggccctgggcgccagcctggactgggaccgggagtgcttcaccatggatgtgggcagctctgtggccgtgacagaggcctttgtgcggctgtacaaggccggcctgctgtacagaaaccaccagctggtgaactggagctgtgccctgcggagcgccatcagtgacatcgaggtggagaaccggcccctgcccggccacacccagctgcggctgcccggctgccccacccctgtgtcctttggcctgctcttctctgtggccttccctgtggatggagagccagatgctgaggtggtggtgggcaccaccaggcctgagaccctgcctggagatgtggccgtggccgtgcacccagatgacagccgctacacccacctgcacggccggcagctgcggcaccccctgatgggccagcccctgcccctcatcacagattatgctgtgcagccccacgtgggcaccggggctgtgaaggtgaccccagcccacagccctgcagatgctgagatgggcgcccggcacggcctgagccccctgaatgtgattgctgaagatggcaccatgaccagcctgtgtggggactggctgcagggcctgcacagatttgtggcccgggagaagatcatgtctgtgctgtctgagtggggcctcttccggggcctgcagaaccaccccatggtgctgcccatctgcagccgctctggagatgtgattgagtacctgctgaagaaccagtggtttgtgcgctgccaggagatgggcgcccgggccgccaaggctgtggagagcggggccctggagctgagccccagcttccaccagaagaactggcagcactggttcagccacatcggggactggtgtgtgtcccggcagctgtggtggggccaccagatcccagcctacctggtggtggaggaccacgcccagggcgaggaggactgctgggtggtgggccgctctgaggccgaggcccgggaggtggccgctgagctgaccggccggcctggagctgagctgaccctggagcgggaccctgatgtgctggacacctggttcagcagcgccctcttccccttcagcgccctgggctggccccaggagaccccagacctggcccgcttctaccccctgagcctgctggagactggaagtgacctgctgctcttctgggtgggccgcatggtgatgctgggcacccagctgaccggccagctgcccttcagcaaggtgctgctgcaccccatggtgcgggaccggcagggcaggaagatgagcaagagcctgggcaatgtgctggacccccgggacatcatcagcggcgtggagatgcaggtgctgcaggagaagctgcggagcggcaacctggaccctgctgagctggccatcgtggccgccgcccagaagaaggacttcccccacggcatcccagaatgtggcacagatgccctgcgcttcaccctgtgcagccatggagtgcaggccggggacctgcacctgtctgtgtctgaggtgcagagctgccgccacttctgcaacaagatctggaatgccctgcgcttcatcctgaatgccctgggggagaagtttgtgccccagcctgctgaggagctgagccccagcagccccatggatgcctggatcctgagccggctggccctggccgcccaggagtgtgagcggggcttcctgacccgggagctgagcctggtgacccacgccctgcaccacttctggctgcacaacctgtgtgatgtgtacctggaggccgtgaagcctgtgctgtggcacagcccccggcccctgggccccccccaggtgctcttcagctgtgccgacctgggcctgcggctgctggcccccctgatgcccttcctggccgaggagctgtggcagaggctgcccccccggcccggctgccccccagcccccagcatctctgtggccccctaccccagcgcctgcagcctggagcactggaggcagcctgagctggagcggcgcttcagccgggtgcaggaggtggtgcaggtgctgcgggccctgcgggccacctaccagctgaccaaggcccggccccgggtgctgctgcagagcagcgagcccggggaccagggcctgtttgaggccttcctggagcccctgggcaccctgggctactgtggggctgtgggcctgctgcccccaggagctgctgcccccagcggctgggcccaggcccccctgagtgacacagcccaggtgtacatggagctgcagggcctggtggacccccagatccagctgcccctgctggccgcccggcgctacaagctgcagaagcagctggacagcctgacagcccggaccccatctgagggggaggccggcacccagaggcagcagaagctgagcagcctgcagctggagctgagcaagctggacaaggccgccagccacctgcggcagctgatggatgagcccccagcccctggcagccctgagctgtag

SEQ ID NO: 22611 - DNA, 5229 bp, Artificial Sequence
  Description of Artificial Sequence: Synthetic coding sequence
atgatggagggcaatggaacagagaacagctgcagcaggacccggggctggctgcagcaggacaatgatgccaagccctggctgtggaagttcagcaactgcttcagcaggcctgagcagaccctgccccacagcccccagaccaaggagtacatggagaacaagaaggtggccgtggagctgaaggatgtgcccagccccctgcacgccggcagcaagctgtttcctgctgtgcccctgcctgacatccgcagcctgcagcagcccaagatccagctgagctctgtgcccaaggtgtcctgctgtgcccactgccccaatgagcccagcaccagccccatgagatttggaggcggcggcggcggcagcggcggcaccagcagcctcatccaccctggggccctgctggacagccagagcaccaggaccatcacctgccaggtgggcagcggctttgccttccagagcgccagcagcctgcagaatgccagcgccaggaacaacctggccggcatcgccagtgacttccccagcatgtgcctggagagcaacctgagcagctgcaagcacctgccctgctgcggcaagctgcacttccagagctgccacggcaatgtgcacaagctgcaccagttccccagcctgcagggctgcaccagcgctggctacttcccctgcagcgacttcaccagcggggcccctggccacctggaggagcacatcagccagagcgagctgaccccccacctgtgcaccaacagcctgcacctgaatgtggtgccccctgtgtgcctgaagggcagcctgtactgtgaggactgcctgaacaagccagccaggaacagcatcattgatgctgccaaggtgtggcccaacatccccccacccaacacccagcctgcccccctggccgtgcccctgtgcaatggctgcggcaccaagggcaccgggaaggagaccaccctgctgctggccaccagcctgggcaaggccgccagcaagtttggcagccctgaggtggccgtggccggccaggtgctggagaacctgccccccatcggggtcttctgggacatcgagaactgcagcgtgcccagcggccgcagcgccacagctgtggtgcagaggatccgggagaagttcttcaagggccaccgggaggccgagttcatctgtgtgtgtgacatcagcaaagaaaacaaggaggtgatccaggagctgaacaactgccaggtgacagtggcccacatcaatgccacagccaagaatgctgctgatgacaagctgcggcagagcctgcggagatttgccaacacccacacagccccagccaccgtggtgctggtgtccacagatgtgaactttgccctggagctgagtgacctgcggcaccgccacggcttccacatcatcctggtgcacaagaaccaggccagcgaggccctgctgcaccacgccaatgaactcatccgctttgaggagttcatcagtgacctgcccccccggctgcccctgaagatgccctgccacaccctgctgtatgtgtacaacctgcctgccaacaaggatggcaagtctgtgagcaaccggctgcggcggctgagtgacaactgtggcggcaaggtgctgagcatcaccggctgcagcgccatcctgcgcttcatcaaccaggacagcgctgagcgggcccagaagaggatggagaatgaagatgtgtttggaaaccgcatcatcgtgtccttcacccccaagaaccgggagctgtgtgagaccaagagcagcaatgccatcgctgacaaggtgaagagccccaagaagctgaagaaccccaagctgtgcctgatcaaggatgccagcgagcagagcagcagcgccaaggccaccccaggcaagggcagccaggccaacagcggcagcgccaccaagaacaccaacgtgaagagcctgcaggagctgtgcaggatggagagcaagacaggccacaggaacagcgagcaccagcagggccacctgcggctggtggtgcccacccacggcaacagcagcgctgctgtgtccacccccaagaacagcggcgtggccgagcctgtgtacaagaccagccagaagaaggagaacctgagcgcccggtctgtgaccagcagccctgtggagaagaaggacaaggaggagaccgtcttccaggtgtcctaccccagcgccttcagcaagctggtggccagccggcaggtgagccccctgctggccagccagagctggagcagcagccgctccatgagccccaacctgctgaacagagccagccccctggccttcaacatcgccaacagcagcagcgaggccgactgcccagacccctttgccaatggagcagatgtgcaggtgagcaacatcgactaccgcctgagcaggaaggagctgcagcagctgctgcaggaggcctttgcccggcacggcaaggtgaagtctgtggagctgagcccccacacagactaccagctgaaggctgtggtgcagatggagaacctgcaggatgccatcggggctgtgaacagcctgcaccgctacaagattggcagcaagaagatcctggtgtccctggccactggagctgccagcaagagcctgagcctgctgtctgctgagaccatgtctgtgctgcaggatgccccagcctgctgcctgcccctcttcaagttcacagacatctatgagaagaagtttggccacaagctgaatgtgtctgacctgtacaagctgacagacacagtggccatccgggagcagggcaatggccgcctggtgtgcctgctgcccagcagccaggcccggcagagccccctgggcagcagccagagccatgatggcagcagcaccaactgcagccccatcatctttgaggagctggagtaccacgagcctgtgtgccggcagcactgcagcaacaaggacttcagcgagcacgagtttgatcctgacagctacaagatcccctttgtgatcctgagcctgaagacctttgccccccaggtgcacagcctgctgcagacccatgagggcaccgtgcccctgctgtccttcccagactgctacatcgccgagtttggagacctggaggtggtgcaggagaaccagggcggcgtgcccctggagcacttcatcacctgtgtgcctggggtgaacatcgccacagcccagaatggcatcaaggtggtgaagtggatccacaacaagcccccaccacccaacacagacccctggctgctgcggagcaagagccctgtgggcaacccccagctgatccagttcagccgggaggtgattgacctgctgaagagccagcccagctgtgtgatccccatcagccacttcatccccagctaccaccaccactttgccaagcagtgccgggtgtctgactatggctacagcaagctgattgagctgctggaggccgtgccccacgtgctgcagatcctgggcatgggcagcaagaggctgctgaccctgacccaccgggcccaggtgaagcgcttcacccaggacctgctgaagctgctgaagagccaggccagcaagcaggtgattgtgcgggagttcagccaggcctaccactggtgcttcagcaaggactgggatgtgacagaatatggagtgtgtgagctgattgatattgtgtctgagatcccagacaccaccatctgcctgagccagcaggacaatgagatggtgatctgcatccccaagcgggagaggacccaggatgaaattgaaagaaccaagcagttcagcaaggatgtggtggacctgctgcggcaccagccccacttcaggatgcccttcaacaagttcatccccagctaccaccaccacttcggccggcagtgcaagctggcctactacggcttcaccaagctgctggagctgtttgaggccatcccagacaccctgcaggtgctggagtgtggggaggagaagatcctgaccctgacagaggtggagcgcttcaaggccctggccgcccagtttgtgaagctgctgcggagccagaaggacaactgcctgatgatgacagacctgctgacagaatatgccaagaccttcggctacaccttccggctgcaggactatgatgtgagcagcatcagcgccctgacccagaagctgtgccacgtggtgaaggtggccgacatcgagagcggccggcagatccagctgatcaacaggaagagcctgcggagcctgacagcccagctgctggtgctgctgatgtcctgggagggcaccacccacctgtctgtggaggagctgaagaggcactatgagagcacccacaacacccccctgaacccctgtgaatatggcttcatgaccctgacagagctgctgaagagcctgccctacctggtggaggtgttcaccaatgacaagatggaggagtgtgtgaagctgaccagcctgtacctgtttgccaagaatgtgcgcagcctgctgcacacctaccactaccagcagatcttcctgcacgagttctccatggcctacaccaagtatgtgggggagaccctgcagcccaagacctacggccacagctctgtggaggagctgctgggcgccatcccccaggtggtgtggatcaagggccacggccacaagagaattgtggtgctgaagaatgacatgaagagccggctgagcagcctgagcctgagccctgccaaccacgagaaccagcccagcgagggggagcgcatcctggaggtgcctgagagccacacagccagcgagctgaagctgggcgcagatggcagcggccccagccacacagagcaggagctgctgcggctgacagatgacagccctgtggacctgctgtgtgcccctgtgcccagctgcctgcccagcccccagctgcggccagaccccgtcatcctgcagagcgctgacctgatccagtttgaggagcggccccaggagcccagcgagatcatgatcctgaaccaggaggagaagatggagatccccatccctgggaagagcaagaccctgaccagtgacagcagcagcagctgcatctctgctgctgtgcctgtgcccccctgccccagcagcgagaccagcgagagcctgctgagcaaggaccctgtggagagccctgccaagaagcagcccaagaacagagtgaagctggccgccaacttcagcctggcccccatcaccaagctgtag

SEQ ID NO: 22612 - DNA, 774 bp, Artificial Sequence; identical to SEQ ID NO: 22553
  Description of Artificial Sequence: Synthetic coding sequence

SEQ ID NO: 22613 - DNA, 1134 bp, Artificial Sequence; identical to SEQ ID NO: 20043
  Description of Artificial Sequence: Synthetic coding sequence

SEQ ID NO: 22614 - DNA, 495 bp, Artificial Sequence; identical to SEQ ID NO: 22255
  Description of Artificial Sequence: Synthetic coding sequence

SEQ ID NO: 22615 - DNA, 393 bp, Artificial Sequence
  Description of Artificial Sequence: Synthetic coding sequence
atggacaccatgatgctgaatgtgaggaacctgtttgagcagctggtgagaagagtggagatcctgtctgagggcaatgaggtgcagttcatccagctggccaaggactttgaggacttcaggaagaagtggcagaggacagaccacgagctgggcaagtacaaggacctgctgatgaaggccgagacagagaggtctgccctggatgtgaagctgaagcacgccaggaaccaggtggatgtggagatcaagaggcggcagagagctgaggccgactgtgagaagctggagcggcagatccagctgatccgggagatgctgatgtgtgacaccagcggcagcatccagctgtctgaggagcagaagagcgccctggccttcctgaacagatag

SEQ ID NO: 22616 - DNA, 324 bp, Artificial Sequence
  Description of Artificial Sequence: Synthetic coding sequence
atggacaccatgatgctgaatgtgaggaacctgtttgagcagctggtgagaagagtggagatcctgtctgagggcaatgaggtgcagttcatccagctggccaaggactttgaggacttcaggaagaagtggcagaggacagaccacgagctgggcaagtacaaggacctgctgatgaaggccgagacagagaggtctgccctggatgtgaagctgaagcacgccaggaaccaggtggatgtggagatcaagaggcggcagagagctgaggccgactgtgagaagctggagcggcagatccagctgatccgggagatgctgtag

SEQ ID NO: 22617 - DNA, 885 bp, Artificial Sequence
  Description of Artificial Sequence: Synthetic coding sequence
atggacaccatgatgctgaatgtgaggaacctgtttgagcagctggtgagaagagtggagatcctgtctgagggcaatgaggtgcagttcatccagctggccaaggactttgaggacttcaggaagaagtggcagaggacagaccacgagctgggcaagtacaaggacctgctgatgaaggccgagacagagaggtctgccctggatgtgaagctgaagcacgccaggaaccaggtggatgtggagatcaagaggcggcagagagctgaggccgactgtgagaagctggagcggcagatccagctgatccgggagatgctgatgtgtgacaccagcggcagcatccagctgtctgaggagcagaagagcgccctggccttcctgaacagaggccagcccagcagcagcaatgccggcaacaagaggctgagcaccattgatgaaagtggcagcatcctgagtgacatcagctttgacaagacagatgagagcctggactgggacagcagcctggtgaagaccttcaagctgaagaagcgggagaagagaagaagcaccagccggcagtttgtggatggccccccaggccctgtgaagaagaccaggagcatcggcagcgctgtggaccagggcaatgaaagcatcgtggccaagaccaccgtgacagtgcccaatgatggcggccccatcgaggccgtgtccaccatcgagaccgtgccctactggaccaggagcaggaggaagacaggcaccctgcagccctggaacagcgacagcaccctgaacagccggcagctggagcccaggacagaaacagacagcgtgggcaccccccagagcaatggaggcatgaggctgcatgactttgtgtccaagacagtgtag

SEQ ID NO: 22618 - DNA, 504 bp, Artificial Sequence; identical to SEQ ID NO: 18805
  Description of Artificial Sequence: Synthetic coding sequence

SEQ ID NO: 22619 - DNA, 882 bp, Artificial Sequence
  Description of Artificial Sequence: Synthetic coding sequence
atgctgcgggagcccaggaagcagggcctggccggccgggcccacctgctgagccctggcaccaccggctccatgaagacccctgtggagctggccgtgtctggcatgcagaccctgggcctgcagcaccgctgccggggcggctacagagtgaaggcccggaccagctatgtggatgagaccctgtttggcagccctgctggcacccggcccaccccaccagactttgaccccccctgggtggagaaggccaacagaacccggggcgtgggcaaggaggccagcaaggccctgggcgccaagggcagctgtgagaccacccccagccggggcagcacccccaccctgacccccaggaagaagaacaagtaccggcccatcagccacacccccagctactgtgatgagagcctgtttggcagccgctctgagggcgccagctttggagcccccaggatggccaagggagatgctgccaagctgcgggccctgctgtggaccccaccacccaccccccggggcagccacagcccccggccccgggaggcccccctgcgggccatccaccctgctggccccagcaagacagagcccggccctgctgctgacagccagaagctgtccatgggcggcctgcacagcagccggcccctgaagaggggcctgagccacagcctgacccacctgaatgtgcccagcacaggccacccagccaccagcgccccccacaccaacggcccccaggacctgcggcccagcaccagcggcgtgaccttccgcagccccctggtgaccagccgggcccggtctgtgtccatctctgtgcccagcaccccccggcggggcggggccacccagaagcccaagccaccctggaagtag

SEQ ID NO: 22620 - DNA, 3282 bp, Artificial Sequence; identical to SEQ ID NO: 22581
  Description of Artificial Sequence: Synthetic coding sequence

SEQ ID NO: 22621 - DNA, 276 bp, Artificial Sequence
  Description of Artificial Sequence: Synthetic coding sequence
atgggcaagaagaccaagaggacagctgacagcagcagcagtgaagatgaggaggagtatgtggtggagaaggtgctggaccggcgggtggtgaagggccaggtggagtacctgctgaagtggaagggcttcagcgaggagcacaacacctgggagcctgagaagaacctggactgcccagagctgatcagcgagttcatgaagaagtacaagaagatgaaggagggggagaacaacaagccccgggagaagtctgagagcaacaagaggaagtag

SEQ ID NO: 22622 - DNA, 390 bp, Artificial Sequence; identical to SEQ ID NO: 19988
  Description of Artificial Sequence: Synthetic coding sequence

SEQ ID NO: 22623 - DNA, 1134 bp, Artificial Sequence; identical to SEQ ID NO: 20043
  Description of Artificial Sequence: Synthetic coding sequence

SEQ ID NO: 22624 - DNA, 2031 bp, Artificial Sequence; identical to SEQ ID NO: 18328
  Description of Artificial Sequence: Synthetic coding sequence

SEQ ID NO: 22625 - DNA, 456 bp, Artificial Sequence
  Description of Artificial Sequence: Synthetic coding sequence
atggacaccatgatgctgaatgtgaggaacctgtttgagcagctggtgagaagagtggagatcctgtctgagggcaatgaggtgcagttcatccagctggccaaggactttgaggacttcaggaagaagtggcagaggacagaccacgagctgggcaagtacaaggacctgctgatgaaggccgagacagagaggtctgccctggatgtgaagctgaagcacgccaggaaccaggtggatgtggagatcaagaggcggcagagagctgaggccgactgtgagaagctggagcggcagatccagctgatccgggagatgctgatgtgtgacaccagcggcagcatccagctgtctgaggagcagaagagcgccctggccttcctgaacagaggccagcccagcagcagcaatgccggcaacaagaggctgagcaccattgatgaaagtggcagctag

SEQ ID NO: 22626 - DNA, 1446 bp, Artificial Sequence; identical to SEQ ID NO: 20055
  Description of Artificial Sequence: Synthetic coding sequence

SEQ ID NO: 22627 - DNA, 765 bp, Artificial Sequence; identical to SEQ ID NO: 19033
  Description of Artificial Sequence: Synthetic coding sequence

SEQ ID NO: 22628 - DNA, 1446 bp, Artificial Sequence; identical to SEQ ID NO: 20055
  Description of Artificial Sequence: Synthetic coding sequence

SEQ ID NO: 22629 - DNA, 1974 bp, Artificial Sequence
  Description of Artificial Sequence: Synthetic coding sequence
atgctgggccccagctgggatggagatgaagctgagagcactggagagatcatccggctgggggacacagcccacaccttcagcctgcggagcaatggagcccagtgccccaatgagatgctgagcaagaaggccctggccagccccagcagcaagagccatgaggacatgctgtacccacccagcgtgctgagcaagagcaggaccagctttgtggaggacacagagaccctgtctgtgtctggcatccccaatgccaggaagctgggggagcccatccgggccgccatccccctgcaccccccctaccaccccagcgagccccgggccccctgccccatcggcaaggagtacctgcacagcagccactgcagccctgctgtgaacagcactggagagcacacagagttcagcggggacctggatgatggcctcttcctgatcagcaagctgcccaagggcagcaagtgggaggtgtacccagcccaggtgcagggccccaggaccaggaagccacccaagggcaagagaaatgaaaatagagccacagccagcagctgcaacagccccttcccccagaggcccaggaagaggctgacagagcaggagctgcatgatgtgtctgagaagctgagccagaggctgtctgagctggactggatgctgaagagcgccctgggggaccgcatcaaggagaagacagaccacaaggaggagaacacaggaaatgaggaggtggaggatggaacagaggagaccctgagccagcacagtgatggcatcgtggagtatggccccaagaagagcaggcctggcctgtccatgaggaggaagccaccctaccgcagccacagcctgagccccagccctgtgaacaagcacaagcagttccacctggagaggaagaggcagaggaagccccgggagacagatgtgcggcagttccaggcccaggccttcacagaggcctttgagcgggagctgcggcggcacaaggtgcaggagaacatcggccccctgcgcatccacgagaaggaggaggagacagagaagatctacagaggagaggccgtgaggaagggcaccccagagtgcagccagccctggaagatctacagcaggaagaccaccacccagagcctgcggggcggcctgcccaagcccaacaaggctgtgcccatgaaggtgtctgagcacagcctgctgcccctgatgctggagcagttccccttcctgtatgtgtctggccccaccctgagcaagatgtggaagcagcagatcgcccaggtggagcagctgaagaaggaggcctgccgggagaacagaagcaagaagaagctgcaggatgaaattgaggaggccctgcggagacatgacctgctgaccaccctggtgaagaaggagtatgagcacaacaagaggctgcaggacttcaaggactgcatccggcggcagaggctgacccagagcaagatcaaggagaaccggcagcagatcgtgcgggccaggaagtactatgatgactacagagtgcagctgtgtgccaagatgatgaggatgaggacccgggaggagatgatcttcaagaagctgtttgaggagggcctgaacatccagaagcagaggctgcgggacctgagaaattatgccaaggagaagagagatgagcagaggagaagacaccaggatgagctggacagcatggagaactactacaaggaccagttcagcctgctggccgaggccatcagccaggagcaccaggagctgaaggcccgggagaagagccaggcccagaccctgcacaaggtgaagcgggagctgcggagcaagatggagaaggagatccagcagctgcaggacatgatcacccagaatgatgatgatgtgttcttccgggagctggaggccgagcgcttccgcagccggctgcagctggccagcttccagtacagcaagagccccagcctgtag

SEQ ID NO: 22630 - DNA, 507 bp, Artificial Sequence
  Description of Artificial Sequence: Synthetic coding sequence
atgcagaccttcctgaagggcaagagggtgggctactggctgtctgagaagaagatcaagaagctgaacttccaggcctttgctgagctgtgcaggaagaggggcatggaggtggtgcagctgaacctgagccggcccatcgaggagcagggccccctggatgtgatcatccacaagctgacagatgtgatcctggaggccgaccagaatgacagccagagcctggagctggtgcaccgcttccaggagtacattgatgcccaccctgagaccatcgtgctggaccccctgcctgccatccgcaccctgctggacaggagcaagagctatgagctgatcaggaagattgaggcctacatggaggatgaccgcatctgcagcccccccttcatggagctgaccagcctgtgtggagatgacaccatgaggctgctggagaagaatggcctgaccttccccttcatctgcaagaccagggtggcccacggcaccaacagccatgaatag

SEQ ID NO: 22631 - DNA, 2211 bp, Artificial Sequence
  Description of Artificial Sequence: Synthetic coding sequence
atgctgatcccagccctgcagatcagtgacagcgagagcgtgggcctggaggatggcatcgagcagagcgcctacctgacagagagcaagatgaatgaaagcaagccaggggacagccagaacctggcctgtgtgttctgcaggaagcatgatgactgccccaacaagtatggagagaagaagaccaaggagaagtggaacctgactgtgcactactactgcctgctgatgagcagcggcatctggcagaggggcaaggaggaggagggcgtgtatggcttcctgattgaggacatcaggaaggaggtgaacagagccagcaagctgaagtgctgcgtgtgcaagaagaatggagccagcatcggctgtgtggccccccgctgcaagaggagctaccacttcccctgtggcctgcagcgggagtgcatcttccagttcaccggcaactttgccagcttctgctgggaccacaggcctgtgcagatcatcaccagcaacaactaccgggagagcctgccctgcaccatctgcctggagttcatcgagcccatccccagctacaacatcctgcggagcccctgctgcaagaatgcctggttccaccgggactgcctgcaggtgcaggccatcaatgctggggtcttcttcttccgctgcaccatctgcaacaacagcgacatcttccagaaggagatgctgaggatgggcatccacatccctgagaaggatgcctcctgggagctggaggagaatgcctaccaggagctgctgcagcactatgaaagatgtgatgtgcggcgctgccgctgcaaggagggccgggactacaatgccccagacagcaagtgggagatcaagcgctgccagtgctgcggcagcagcggcacccacctggcctgcagcagcctgcgctcctgggagcagaactgggagtgcctggagtgccggggcatcatctacaacagcggggagttccagaaggccaagaagcacgtgctgcccaacagcaacaacgtgggcatcacagactgcctgctggaggagagcagccccaagctgccccggcagagccctggcagccagagcaaggacctgctgcggcagggcagcaagttcagaagaaatgtgtccaccctgctgattgagctgggcttccagatcaagaagaagaccaagaggctgtacatcaacaaggccaacatctggaacagcgccctggatgccttcaggaacagaaacttcaaccccagctatgccatcgaggtggcctacgtgattgaaaatgacaactttggaagtgagcaccctggcagcaagcaggagttcctgagcctgctgatgcagcacctggagaacagcagcctgtttgagggcagcctgagcaagaacctgagcctgaacagccaggccctgaaggaaaatctctactatgaagctgggaagatgctggccatcagcctggtgcatggaggccccagccctggcttcttcagcaagaccctcttcaactgcctggtgtatggccctgagaacacccagcccatcctggatgatgtgtctgactttgatgtggcccagatcatcatccgcatcaacacagccaccaccgtggccgacctgaagagcatcatcaatgaatgctacaactacctggagctgattggctgcctgcggctcatcaccaccctgagtgacaagtacatgctggtgaaggacatcctgggctaccacgtgatccagagggtgcacaccccatttgagagcttcaagcagggcctgaagaccctgggcgtgctggagaagatccaggcctacccagaggccttctgcagcatcctgtgccacaagccagagagcctgagcgccaagatcctgtctgagctgttcaccgtgcacaccctgcctgatgtgaaggccctgggcttctggaacagctacctgcaggccgtggaggatggcaagagcaccaccaccatggaggacatcctgatctttgccaccggctgcagcagcatccccccagctggcttcaagcccacccccagcattgagtgcctgcacgtggacttccctgtgggcaacaagtgcaacaactgcctggccatccccatcaccaacacctacaaggagttccaggagaacatggacttcaccatccggaacaccctgcggctggagaaggaggagagcagccactacatcggccactag

SEQ ID NO: 22632 - DNA, 1131 bp, Artificial Sequence
  Description of Artificial Sequence: Synthetic coding sequence
atggccaacagcgccaacaccaacacagtgcccaagctgtacagatctgtgattgaagatgtgatcaatgatgtgcgggacatcttcctggatgatggagtggatgagcaggtgctgatggagctgaagaccctgtgggagaacaagctgatgcagagcagagctgtggatggcttccacagcgaggagcagcagctgctgctgcaggtgcagcagcagcaccagccccagcagcagcagcaccaccaccaccaccaccaccagcaggcccagccccagcagacagtgccccagcaggcccagacccagcaggtgctgatcccagccagccagcaggccacagccccccaggtgattgtgcctgacagcaagctgatccagcacatgaatgccagcaacatgtctgctgctgccacagctgccaccctggccctgcctgctggggtgacccctgtgcagcagatcctgaccaacagcggccagctgctgcaggtggtgcgggccgccaacggggcccagtacatcttccagccccagcagagcgtggtgctgcagcagcaggtgatcccccagatgcagcccggcggcgtgcaggcccctgtgatccagcaggtgctggcccccctgcccggcggcatcagcccccagacaggagtcatcatccagccccagcagatcctcttcaccggcaacaagacccaggtgatccccaccaccgtggccgcccccaccccagcccaggcccagatcacagccaccggccagcagcagccccaggcccagcctgcccagacccaggcccccctggtgctgcaggtggatggcaccggggacaccagcagtgaagaagatgaagatgaggaggaggactatgatgatgatgaggaggaggacaaggagaaggatggagcagaagatggccaggtggaggaggagcccctgaacagtgaagatgatgtgtctgatgaggagggccaggagctgtttgacacagaaaatgtggtggtgtgccagtatgacaagatccacaggagcaagaacaagtggaagttccacctgaaggatggcatcatgaacctgaatggccgggactacatcttcagcaaggccatcggagatgctgagtggtag

SEQ ID NO: 22633 - DNA, 237 bp, Artificial Sequence
  Description of Artificial Sequence: Synthetic coding sequence
atggagacagactgcaaccccatggagctgagctccatgagcggctttgaggagggcagcgagctgaatggatttgagggcacagacatgaaggacatgaggctggaggccgaggccgtggtgaatgatgtgctgtttgctgtgaacaacatgtttgtgtccaagagcctgcgctgtgctgatgatgtggcctacatcaacgtggagaccaaggagaggaaccgctactgcctgtag

SEQ ID NO: 22634 - DNA, 747 bp, Artificial Sequence; identical to SEQ ID NO: 21508
  Description of Artificial Sequence: Synthetic coding sequence

SEQ ID NO: 22635 - DNA, 2370 bp, Artificial Sequence
  Description of Artificial Sequence: Synthetic coding sequence
atgtctgcccagaccagccctgctgagaagggcctgaaccctggcctgatgtgccaggagagctatgcctgcagcggcacagatgaggccatctttgaatgtgatgagtgctgcagcctgcagtgcctgcgctgtgaggaggagctgcaccggcaggagcggctgaggaaccacgagcgcatccggctgaagccaggccacgtgccctactgtgacctgtgcaagggcctgagcggccacctgcccggggtgcggcagagggccatcgtgcgctgccagacctgcaagatcaacctgtgcctggagtgccagaagaggacccacagcggcggcaacaagaggaggcaccctgtgacagtgtacaacgtgagcaacctgcaggagagcctggaggccgaggagatggatgaggagaccaagaggaagaagatgacagagaaggtggtgtccttcctgctggtggatgaaaatgaggagatccaggtgaccaatgaggaggacttcatcaggaagctggactgcaagccagaccagcacctgaaggtggtgtccatcttcggcaacacaggagatggcaagagccacaccctgaaccacaccttcttctacggccgggaggtgttcaagaccagccccacccaggagagctgcaccgtgggcgtgtgggccgcctatgaccctgtgcacaaggtggccgtcatcgacacagagggcctgctgggcgccaccgtgaacctgagccagaggacccggctgctgctgaaggtgctggccatcagtgacctggtgatctaccgcacccatgctgaccggctgcacaatgacctcttcaagttcctgggagatgccagcgaggcctacctgaagcacttcaccaaggagctgaaggccaccacagcccgctgtggcctggatgtgcccctgagcaccctgggccctgctgtgatcatcttccatgaaacagtgcacacccagctgctgggcagtgaccaccccagcgaggtgcctgagaagctgatccaggaccgcttcaggaagctgggccgcttccctgaggccttcagcagcatccactacaagggcaccaggacctacaaccccccaacagacttcagcggcctgcggcgggccctggagcagctgctggagaacaacaccaccaggagccccaggcaccctggggtcatcttcaaggccctgaaggccctgagtgaccgcttcagcggggagatcccagatgaccagatggcccacagcagcttcttcccagatgagtacttcacctgcagcagcctgtgcctgagctgtggggtgggctgcaagaagtccatgaaccacggcaaggagggcgtgccccatgaggccaagagccgctgccgctacagccaccagtatgacaacagagtgtacacctgcaaggcctgctatgaaagaggagaggaggtgtctgtggtgcccaagaccagcgccagcacagacagcccctggatgggcctggccaagtatgcctggagcggctacgtgattgagtgccccaactgtggggtggtgtaccgcagccggcagtactggtttggaaaccaggaccctgtggacacagtggtgaggacagaaattgtgcacgtgtggccaggcacagatggcttcctgaaggacaacaacaatgctgcccagaggctgctggatggcatgaacttcatggcccagagcgtgtctgagctgagcctgggccccaccaaggctgtgacctcctggctgacagaccagatcgccccagcctactggaggcccaacagccagatcctgagctgcaacaagtgtgccaccagcttcaaggacaatgacaccaagcaccactgccgggcctgtggggagggcttctgtgacagctgcagcagcaagaccaggcctgtgcctgagcggggctggggccctgcccctgtgcgggtgtgtgacaactgctatgaggccagaaatgtgcagctggccgtgacagaggcccaggtggatgatgaaggaggcaccctgattgccaggaaggtgggggaggccgtgcagaacaccctgggcgctgtggtgacagccatcgacatccccctgggcctggtgaaggatgctgcccggcctgcctactgggtgcctgaccacgagatcctgcactgccacaactgcaggaaggagttcagcatcaagctgagcaagcaccactgccgggcctgtggccagggcttctgtgatgaatgttctcatgaccggcgggctgtgcccagccggggctgggaccaccctgtgcgggtgtgcttcaactgcaacaagaagccagcctggaccagcctgtctgtgatgaccgggaagggccccctgtgctag

SEQ ID NO: 22636 - DNA, 2271 bp, Artificial Sequence
  Description of Artificial Sequence: Synthetic coding sequence
ctggccggaaatgaaacagagtgggtgaccatcgccaacaacctgctcttcaagtgccacatccacctgcgcatccacgagctgcaggactgtgatgccaacgtgttcatcgccctgtaccagagcatcctgggggagaaggtgcctgacctgattgtcatccccaggagccaggaggatgatgcccacaacgtgcaggccgtgattgacagcctggccctggactacctgcaggtgtccctgagccacatcacagccctgtacagcgtgtccaggaggaagtacagcgagaggaggatgctgggccccagctgggatggagatgaggccgagagcactggagagatcatccggctgggggacacagcccacaccttcagcctgcggagcaatggagcccagtgccccaatgagatgctgagcaagaaggccctggccagccccagcagcaagagccatgaggacatgctgtacccaccttctgtgctgagcaagagcaggaccagctttgtggaggacacagagaccctgtctgtgtctggcatccccaatgccaggaagctgggggagcccatccgggccgccatccccctgcaccccccctaccaccccagcgagccccgggccccctgccccatcggcaaggagtacctgcacagcagccactgcagccctgctgtgaacagcactggagagcacacagagttcagcggggacctggatgatggcctcttcctgatcagcaagctgcccaagggcagcaagtgggaggtgtacccagcccaggtgcagggccccaggaccaggaagccacccaagggcaagagaaatgaaaatagagccacagccagcagctgcaacagccccttcccccagaggcccaggaagaggctgacagagcaggagctgcatgatgtgtctgagaagctgagccagaggctgtctgagctggactggatgctgaagagcgccctgggggaccgcatcaaggagaagacagaccacaaggaggagaacacaggaaatgaggaggtggaggatggaacagaggagaccctgagccagcacagtgatggcatcgtggagtatggccccaagaagagccggcccggcctgtccatgaggaggaagccaccctaccgcagccacagcctgagccccagccctgtgaacaagcacaagcagttccacctggagaggaagaggcagaggaagccccgggagacagatgtgcggcagttccaggcccaggccttcacagaggcctttgagcgggagctgcggcggcacaaggtgcaggagaacatcggccccctgcgcatccacgagaaggaggaggagaccgtgggcaagaacatccagaggaggagctttgtgaaggagctgcagaatgtggtgtccccaggccgcttcaccctggagaagccccagaggagagtgcggggcggcctgcccaagcccaacaaggctgtgcccatgaaggtgtctgagcacagcctgctgcccctgatgctggagcagttccccttcctgtatgtgtctggccccaccctgagcaagatgtggaagcagcagatcgcccaggtggagcagctgaagaaggaggcctgcagagaaaatagaagcaagaagaagctgcaggatgaaattgaggaggccctgcggagacatgacctgctgaccaccctggtgaagaaggagtatgagcacaacaagaggctgcaggacttcaaggactgcatccggcggcagaggctgacccagagcaagatcaaggaaaatcggcagcagatcgtgcgggccaggaagtactatgatgactacagagtgcagctgtgtgccaagatgatgaggatgaggacccgggaggagatgatcttcaagaagctgtttgaggagggcctgaacatccagaagcagaggctgcgggacctgaggaactatgccaaggagaagagagatgagcagaggcggcggcaccaggatgagctggacagcatggagaactactacaaggaccagttcagcctgctggccgaggccatcagccaggagcaccaggagctgaaggcccgggagaagagccaggcccagaccctgcacaaggtgaagcgggagctgcggagcaagatggagaaggagatccagcagctgcaggacatgatcacccagaatgatgatgatgtgttcttccgggagctggaggccgagcgcttccgcagccggctgcagctggccagcttccagtacagcaagagccccagcctgtag

SEQ ID NO: 22637 - DNA, 420 bp, Artificial Sequence; identical to SEQ ID NO: 21325
  Description of Artificial Sequence: Synthetic coding sequence

SEQ ID NO: 22638 - DNA, 300 bp, Artificial Sequence
  Description of Artificial Sequence: Synthetic coding sequence
atgacagacacccggcggcgggtgaaggtgtacaccctgaatgaagatcggcagtgggatgaccggggcaccggccacgtgagcagcggctacgtggagcggctgaagggcatgagcctgctggtgcgggcagagagtgatggcagcctgctgctggagagcaagatcaaccccaacacagcctaccagaagcagcaggacaccctcatcgtgtggagcgaggccgagaactatgacctggccctgtccttccaggagaaggccggctgtgatgagatctgggagaagatctgccagtag

SEQ ID NO: 22639 - DNA, 2463 bp, Artificial Sequence; identical to SEQ ID NO: 19206
  Description of Artificial Sequence: Synthetic coding sequence

SEQ ID NO: 22640 - DNA, 396 bp, Artificial Sequence
  Description of Artificial Sequence: Synthetic coding sequence
atgaatgaaagcaagccaggggacagccagaacctggcctgtgtgttctgcaggaagcatgatgactgccccaacaagtatggagagaagaagaccaaggagaagtggaacctgactgtgcactactactgcctgctgatgagcagcggcatctggcagaggggcaaggaggaggagggcgtgtatggcttcctgattgaggacatcaggaaggaggtgaacagagccagcaagctgaagtgctgcgtgtgcaagaagaatggagccagcatcggctgtgtggccccccgctgcaagaggagctaccacttcccctgtggcctgcagcgggagtgcatcttccagttcaccggcaactttgccagcttctgctgggaccacaggcctgtgcagtag

SEQ ID NO: 22641 - DNA, 5934 bp, Artificial Sequence
  Description of Artificial Sequence: Synthetic coding sequence
atggccgcccggagcgcccccagctgccacctgcggctggagtgggtgtatggctaccggggccaccagtgcaggaacaacctgtactacacagctgccaaggagatcgtgtactttgtggccggcgtgggcgtggtgtacagcccccgggagcaccggcagaagttctaccggggccacagtgatgacatcatcagcctggccctgcaccctgagcgggtgctggtggccaccggccaggtgggcaaggagccctacatctgcatctgggacagctacacagtgcagaccatctctgtgctgaaggatgtgcacacccatggaattgcctgcctggcctttgacctggatggccagaggctggtgtctgtgggcctggacagcaagaatgctgtgtgtgtgtgggactggaagaggggcaagatgctgtccatggcccctggccacacagaccgcatctttgacatctcctgggacctgtaccagcccaacaagctggtgtcctgtggggtgaagcacatcaagttctggagcctgtgtggaaatgccctgacccccaagaggggcgtgtttgggaagacaggagacctgcagaccatcctgtgcctggcctgtgccagagatgagctgacctacagcggggccctgaatggagacatctacgtgtggaagggcatcaacctgatccgcaccatccagggcgcccatgctgctggcatcttctccatgaatgcctgtgaggagggctttgccaccggcggcagagatggctgcatccggctgtgggacctgaccttcaagcccatcaccgtcatcgacctgcgggagacagaccagggctacaagggcctgtctgtgcgctctgtgtgctggaggggggaccacatcctggtgggcacccaggacagcgagatctttgagatcgtggtgcaggagaggaacaagcccttcctgatcatgcagggccactgtgagggggagctgtgggccctggccgtgcaccccaccaagcccctggccgtgacaggcagtgatgacagatctgtgcgcatctggagcctggtggaccacgccctgattgcccgctgcaacatggaggagcccatccgctgtgccgctgtgaatgctgatggcatccacctggccctgggcatgaaggatggcagcttcaccgtgctgcgggtgcgggacatgacagaggtggtgcacatcaaggacaggaaggaggccatccacgagctgaagtacagcccagatggcacctacctggccgtgggctgcaatgacagctctgtggacatctatggagtggcccagcgctacaagaaggtgggggagtgcctgggcagcctgtccttcatcacccacctggactggagcagtgacagccgctacctgcagaccaatgatggaaatggcaagaggctcttctacaggatgcctgggggcaaggaggtgaccagcacagaggagatcaagggcgtgcactgggcctcctggacctgtgtgtctggcctggaggtgaatggcatctggcccaagtacagcgacatcaatgacatcaacagcgtggatggcaactacatcggccaggtgctggtgacagcagatgattatggcatcatcaagctgttccgctacccctgcctgaggaagggggccaagttcaggaagtacatcggccacagcgcccacgtgaccaacgtgcgctggagccatgactaccagtgggtgatcagcattggaggagctgaccacagcgtcttccagtggaagttcatccctgagaggaagctgaaggatgctgtgcacatcgccccccaggagagcctggccgacagccacagtgatgaaagtgacagcgacctgagtgatgtgcctgagctggacagcgagattgagcaggagacccagctgacctaccgccggcaggtgtacaaggaggacctgccccagctgaaggagcagtgcaaggagaagcagaagagcgccaccagcaagaggcgggagcgggcccctggcaacagcatccggctgcactttgtgcacggctaccggggctatgactgccgcagcaacctcttctacacccagattggagagatcgtgtaccacgtggccgctgtgggcgtcatctacaaccggcagcagaacacccagcgcttctacctgggccatgatgatgacatcctgtgcctgaccatccaccccctgaaggactatgtggccaccggccaggtgggccgggaccccagcatccacatctgggacacagagaccatcaagcccctgagcatcctgaagggccaccaccagtatggagtgtctgctgtggacttcagcgcagatggcaagaggctggcctctgtgggcattgatgacagccacacagtggtgctgtgggactggaagaagggggagaagctgagcatcgcccggggcagcaaggacaagatctttgtggtgaagatgaacccctacgtgcctgacaagctgatcacagctggcatcaagcacatgaagttctggaggaaggccggcggcggcctgattggaaggaagggctacatcggcaccctgggcaagaatgacaccatgatgtgtgctgtgtatggctggacagaggagatggccttcagcggcaccagcactggagatgtgtgcatctggagggacatcttcctggtgaagacagtgaaggcccatgatggccctgtgttctccatgcacgccctggagaagggctttgtgactggaggcaaggatggcatcgtggccctgtgggatgacagctttgagcgctgcctgaagacctacgccatcaagagagctgccctggcccctggcagcaagggcctgctgctggaggacaaccccagcatccgggccatcagcctgggccacggccacatcctggtgggcaccaagaatggagagatcctggaggtggacaagagcggccccatcaccctgctggtgcagggccacatggagggggaggtgtggggcctggccacccacccctacctgcccatctgtgccaccgtgtctgatgacaagaccctgcgcatctgggacctgagccccagccactgcatgctggccgtgaggaagctgaagaagggcggccgctgctgctgcttctccccagatggcaaggccctggccgtgggcctgaatgatggcagcttcctgatggccaatgctgacaccctggaggacctggtgtccttccaccacaggaaggacatgatcagtgacatccgcttcagccctggcagcggcaagtacctggccgtggccagccatgacagcttcatcgacatctacaacgtgatgagcagcaagagggtgggcatctgcaagggggccaccagctacatcacccacatcgactgggacatccggggcaagctgctgcaggtgaacacaggagccaaggagcagctgttctttgaggccccccggggcaagaagcagaccatccccagcgtggaggtggagaagatcgcctgggcctcctggacctctgtgctgggcctgtgctgtgagggcatctggcctgtgattggagaggtgacagatgtgacagccagctgcctgaccagtgacaagatggtgctggccactggagatgacctgggctttgtgaagctgttccgctaccccaccaagggcaagtttgggaagttcaagcgctacgtggcccacagcacccacgtgaccaacgtgcgctggacctatgatgacagcatgctggtgaccctgggcggcacagacatgagcctgatggtgtggaccaatgagatggagggctaccgggagaagaggccctgtgacagcgaggagagtgacatcgacagcgaggaggatggcggctatgacagtgatgtgaccagagaaaatgagatctcctacaccatccgggccctgagcaccaacatccggcccatgctgggcatcaagccccacctgcagcagaaggagcccagcattgatgagcggcagggcgtggtgcggggcagccggccccctgtgtcccgggccccaccccagcctgagaagctgcagaccaacaacgtgggcaagaagaagaggcccatcgaggacctggtgctggagctgatcttcggctaccggggccgggactgcagaaataatgtgcactacctgaatgatggagatgacatcatctaccacacagcctctgtgggcatcctgcacaacgtggccaccggcagccagagcttctaccaggagcacaatgatgacatcctgtgcctgactgtgaaccagcaccccaagttcatcaacatcgtggccaccggccaggtgggggacagcgctgacatgtctgccacagcccccagcatccacatctgggatgccatgaacaagcagaccctgagcatcctgcgctgctaccacagcaagggcgtgtgcagcgtgtccttcagcgccaccgggaagctgctgctgtctgtgggcctggaccctgagcacaccatcaccatctggcgctggcaggagggcgccaagatcgccagccgggccggccacaaccagaggatctttgtggccgagttccggccagacagcgacacccagtttgtgtctgtgggcgtgaagcacgtgaagttctggaccctggccggccgggccctgctgagcaagaagggcctgctgagcaccctggaggatgccaggatgcagaccatgctggccatcgccttcggggccaacaacctgaccttcaccggcaccatctctggagatgtgtgtgtgtggaaggaccacatcctgtgccgcatcgtggcccgggcccacaacggccctgtgtttgccatgtacaccaccctgagagatggcctgattgtgactggaggcaaggagcggcccagcaaggagggcggcgctgtgaagctgtgggaccaggagctgcggcgctgccgggccttccggctggagaccggccaggccacagactgtgtgcgctctgtgtgccggggcaagggcaagatcctggtgggcaccagaaatgctgagatcatcgaggtgggggagaagaatgctgcctgcaacatcctggtgaatggccacgtggatggccccatctggggcctggccacccaccccagccgggacttcttcctgtctgctgctgaagatggcaccgtgcggctgtgggacattgctgacaagaagatgctgaacaaggtgaacctgggccatgctgccaggacagtgtgctacagccctgagggggacatggtggccatcggcatgaagaatggagagttcatcatcctgctggtgagcagcctgaagatctggggcaagaagagggaccggcgctgtgccatccatgacatccgcttctccccagacagccgctacctggccgtgggcagcagcgagaacagcgtggacttctatgacctgaccctgggccccaccctgaaccgcatctcctactgcaaggacatccccagctttgtgatccagatggacttctctgctgacagcagctacctgcaggtgagcagcggctgctacaagagacatgtgtatgaggtgcccagcggcaagcacctgatggaccatgctgccatcgaccgcatcacctgggccacctggaccagcatcctgggagatgaggtgctgggcatctggagcagacatgctgagaaggcagatgtgaactgtgcctgtgtgagccacagcggcatcagcctggtgactggagatgactttggcatggtgaagctgtttgacttcccctgcccagagaagtttgccaagcacaagcgcttcctgggccacagcccccacgtgaccaacatccgcttcaccagcggggacagacatgtggtgtctgctggaggagatgactgcagcctgtttgtgtggaagtgtgtgcacaccccccactag

SEQ ID NO: 22642 - DNA, 2502 bp, Artificial Sequence
  Description of Artificial Sequence: Synthetic coding sequence
atgacagacacccggcggcgggtgaaggtgtacaccctgaatgaagatcggcagtgggatgaccggggcaccggccacgtgagcagcggctacgtggagcggctgaagggcatgagcctgctggtgcgggcagagagtgatggcagcctgctgctggagagcaagatcaaccccaacacagcctaccagaagcagcaggacaccctcatcgtgtggagcgaggccgagaactatgacctggccctgtccttccaggagaaggccggctgtgatgagatctgggagaagatctgccaggtgcagggcaaggaccccagcgtggacatcacccaggacctggtggatgaaagtgaggaggagagatttgatgacatgagcagccctggcctggagctgcccagctgtgagctgagccggctggaggagattgctgagctggtggccagcagcctgcccagccccctgcggcgggagaagctggccctggccctggagaatgaaggctacatcaagaagctgctggagctgttccacgtgtgtgaggacctggagaacatcgagggcctgcaccacctgtatgagatcatcaagggcatcttcctgctgaacagaacagccctgtttgaggtgatgttttctgaggagtgcatcatggatgtgattggctgcctggagtatgaccctgccctgagccagcccaggaagcaccgggagttcctgaccaagacagccaagttcaaggaggtgatccccatcagtgaccctgagctgaagcagaagatccaccagacctacagagtgcagtacatccaggacatggtgctgcccaccccatctgtgtttgaggagaacatgctgagcaccctgcacagcttcatcttcttcaacaaggtggagatcgtgggcatgctgcaggaggatgagaagttcctgacagacctgtttgcccagctgacagatgaggccacagatgaggagaagaggcaggagctggtgaacttcctgaaggagttctgtgccttcagccagaccctgcagccccagaacagagatgccttcttcaagaccctgagcaacatgggcatcctgcctgccctggaggtgatcctgggcatggatgacacccaggtgcgctctgctgccacagacatcttctcctacctggtggagtacaaccccagcatggtgcgggagtttgtgatgcaggaggcccagcagaatgatgatgtgtccaagaagctgacagagcagaagatcaccagcaaggacatcctgctgatcaacctgatcatcgagcacatgatctgtgacacagatcctgagctgggcggcgctgtgcagctgatgggcctgctgcggaccctggtggaccctgagaacatgctggccacagccaacaagacagagaagacagagttcctgggcttcttctacaagcactgcatgcacgtgctgacagcccccctgctggccaacaccacagaggacaagcccagcaaggatgacttccagacagcccagctgctggccctggtgctggagctgctgaccttctgtgtggagcaccacacctaccacatcaagaactacatcatcaacaaggacatcctgcggcgggtgctggtgctgatggccagcaagcacgccttcctggccctgtgtgccctgcgcttcaagaggaagatcatcggcctgaaggatgagttctacaaccgctacatcatgaagagcttcctgtttgagcctgtggtgaaggccttcctgaacaacggcagccgctacaacctgatgaacagcgccatcatcgagatgtttgagttcatccgggtggaggacatcaagagcctgacagcccacgtgattgagaactactggaaggccctggaggatgtggactatgtgcagaccttcaagggcctgaagctgcgctttgagcagcagcgggagcggcaggacaaccccaagctggacagcatgaggagcatcctgaggaaccaccgctacagaagagatgcccggaccctggaggatgaggaggagatgtggttcaacacagatgaagatgacatggaggatggagaggccgtggtgagccccagcgacaagaccaagaatgatgatgacatcatggaccccatcagcaagttcatggagaggaagaagctgaaggagagcgaggagaaggaggtgctgctgaagaccaacctgagcggccggcagagccccagcttcaagctgagcctgagcagcggcaccaagaccaacctgaccagccagagcagcaccaccaacctgcccggcagccctggcagccctggcagccctggcagccctggcagccctggctctgtgcccaagaacaccagccagacagctgccatcaccaccaagggcggcctggtgggcctggtggactacccagatgatgatgaagatgatgatgaagatgaggacaaggaggacaccctgcccctgagcaagaaggccaagtttgacagctag

SEQ ID NO: 22643 - DNA, 3987 bp, Artificial Sequence
  Description of Artificial Sequence: Synthetic coding sequence
atgtggaggaggaagcaccccaggaccagcggcggcacccggggcgtgctgagcggcaacagaggagtggagtatggcagcggccggggccacctgggcacctttgagggccgctggaggaagctgcccaagatgcctgaggccgtgggcacagaccccagcaccagcaggaagatggccgagctggaggaggtgaccctggatggcaagcccctgcaggccctgcgggtgacagacctgaaggccgccctggagcagaggggcctggccaagagcggccagaagagcgccctggtgaagaggctgaagggggccctgatgctggagaacctgcagaagcacagcacccctcatgctgccttccagcccaacagccagattggagaggagatgagccagaacagcttcatcaagcagtacctggagaagcagcaggagctgctgcggcagaggctggagcgggaggcccgggaggccgctgagctggaggaggccagcgctgagagtgaagatgagatgatccaccctgagggcgtggccagcctgctgcccccagacttccagagcagcctggagaggcctgagctggagctgagccgccacagccccaggaagagcagcagcatcagcgaggagaagggggacagtgatgatgagaagcccaggaaaggagagcggcgcagcagccgggtgcggcaggcccgggccgccaagctgtctgagggcagccagcctgctgaggaggaggaggaccaggagacccccagcaggaacctgcgggtgcgggctgacaggaacctgaagacagaggaggaggaggaggaggaggaggaggaggaggaggatgatgaggaggaggagggagatgatgagggccagaagagccgggaggcccccatcctgaaggagttcaaggaggagggggaggagatcccccgggtgaagccagaggagatgatggatgagcggcccaagaccaggagccaggagcaggaggtgctggagcggggcggccgcttcaccaggagccaggaggaggccaggaagagccacctggcccggcagcagcaggagaaggagatgaagaccaccagccccctggaggaggaggagcgggagatcaagagcagccagggcctgaaggagaagagcaagagccccagccccccccggctgacagaggacaggaagaaggccagcctggtggccctgcctgagcagacagccagcgaggaggagaccccaccacccctgctgaccaaggaggccagcagccccccaccccacccccagctgcacagcgaggaggagattgagcccatggagggccctgccccagctgtgctgatccagctgagcccccccaacacagatgctgacacccgggagctgctggtgtcccagcacacagtgcagctggtgggcggcctgagccccctgagcagccccagcgacaccaaggccgagagccctgctgagaaggtgcctgaggagagcgtgctgcccctggtgcagaagagcaccctggccgactacagcgcccagaaggacctggagcctgagagtgacagaagtgcccagcccctgcccctgaagattgaggagctggccctggccaagggcatcacagaagaatgtctgaagcagcccagcctggagcagaaggagggccggcgggccagccacaccctgctgcccagccaccggctgaagcagagcgctgacagcagcagcagccgcagcagcagcagcagcagcagcagcagccgcagccgcagccgcagcccagacagcagcggcagccgcagccacagccccctgcggagcaagcagagagatgtggcccaggcccggacccacgccaacccccggggccggcccaagatgggcagccgcagcaccagcgagagccgcagccgcagccgcagccgcagccgcagcgccagcagcaacagcaggaagagcctgagccctggggtgtcccgggacagcagcaccagctacacagagaccaaggaccccagcagcggccaggaggtggccaccccacctgtgccccagctgcaggtgtgtgagcccaaggagaggaccagcaccagcagcagctctgtgcaggcccggcggctgagccagcctgagagcgctgagaagcacgtgacccagaggctgcagcctgagcggggcagccccaagaagtgtgaggccgaggaggccgagcccccagctgccacccagccccagaccagcgagacccagaccagccacctgcctgagagcgagcgcatccaccacacagtggaggagaaggaggaggtgaccatggacaccagcgagaacagaccagaaaatgatgtgcctgagccccccatgcccatcgctgaccaggtgtccaatgatgacaggcctgagggctctgtggaggatgaggagaagaaggagagcagcctgcccaagagcttcaagaggaagatctctgtggtgtccaccaagggcgtgcctgctggcaacagcgacacagaaggaggccagcccggcaggaagaggcgctggggcgccagcacagccaccacccagaagaagcccagcatcagcatcaccacagagagcctgaaggaggccgtggtggacctgcatgctgatgacagccgcatcagtgaagatgaaacagaaagaaatggagatgatggcacccatgacaagggcctgaagatctgcaggacagtgacccaggtggtgcctgctgagggccaggagaatggccagcgggaggaggaggaggaggagaaggagcctgaggccgagccccctgtgcccccccaggtgtctgtggaggtggccctgcccccacctgctgagcacgaggtgaagaaggtgaccctgggggacaccctgacccggcgcagcatcagccagcagaagagcggcgtgtccatcaccattgatgatcctgtgaggacagcccaggtgcccagccccccccggggcaagatcagcaacatcgtgcacatcagcaacctggtgcggcccttcaccctgggccagctgaaggagctgctgggccgcacaggcaccctggtggaggaggccttctggattgacaagatcaagagccactgctttgtgacctacagcacagtggaggaggccgtggccaccaggacagccctgcatggagtgaagtggccccagagcaaccccaagttcctgtgtgccgactatgcagagcaggatgagctggactaccaccggggcctgctggtggaccggcccagcgagaccaagacagaggagcagggcatcccccggcccctgcaccccccacctcctcctcctgtgcagcccccccagcaccccagggctgagcagcgggagcaggagagagctgtgcgggagcagtgggccgagcgggagcgggagatggagcggcgggagaggaccaggtctgagcgggagtgggaccgggacaaggtgcgggagggccccaggagccgcagccgcagccgggacagaagaaggaaggagcgggccaagagcaaggagaagaagtctgagaagaaggagaaggcccaggaggagcccccagccaagctgctggatgacctcttcaggaagaccaaggccgccccctgcatctactggctgcccctgacagacagccagatcgtgcagaaggaggccgagagagctgagcgggccaaggagcgggagaagaggaggaaggagcaggaggaggaggagcagaaggagcgggagaaggaggccgagcgggagaggaaccggcagctggagcgggagaagagaagagagcacagccgggagcgggaccgggagcgggagcgggagcgggagcgggacagaggagaccgggaccgggaccgggagcgggaccgggagcggggccgggagcgggacagaagagacaccaagaggcacagccgcagccgcagccgcagcacccctgtgcgggacagaggaggaagaagatag

SEQ ID NO: 22644 - DNA, 1089 bp, Artificial Sequence; identical to SEQ ID NO: 20401
  Description of Artificial Sequence: Synthetic coding sequence

SEQ ID NO: 22645 - DNA, 420 bp, Artificial Sequence; identical to SEQ ID NO: 21325
  Description of Artificial Sequence: Synthetic coding sequence

SEQ ID NO: 22646 - DNA, 2256 bp, Artificial Sequence
  Description of Artificial Sequence: Synthetic coding sequence
atgtctgaggaggagctgaccaaggccatggagggcctgggcatggatgaaggagatggagagggcaacatcctgcccatcatgcagagcatcatgcagaacctgctgagcaaggatgtgctgtaccccagcctgaaggagatcacagagaagtacccagagtggctgcagagccaccgggagagcctgcccccagagcagtttgagaagtaccaggagcagcacagcgtgatgtgcaagatctgtgagcagtttgaagctgagacccccacagattctgagaccacccagaaggccaggtttgagatggtgctggacctgatgcagcagctgcaggacctgggccacccccccaaggagctggccggggagatgctgacctggctgttcttctgtggcagccagtgggtgtatggcccctggctgacctacgtgggctggctgcagcagaccagcttcaagatgagcagcaagggcagcagcacagatggccgcacagacctggccaacggcagcctgagcagcagccctgaggagatgtctggagctgaggagggccgggagaccagcagcggcatcgaggtggaggccagtgacctgagcctgagcctgactggagatgatggcggccccaacagaaccagcacagagagccggggcacagacacagagagcagcggggaggacaaggacagcgacagcatggaggacaccggccactacagcatcaatgatgagaacagagtgcatgacagaagtgaggaggaggaggaggaggaggaggaggaggaggaggagcagccccggcggcgggtgcagaggaagagggccaacagagaccaggacagcagtgatgatgagcgggccctggaggactgggtgagcagcgagaccagcgccctgccccggccccgctggcaggccctgcctgccctgcgggagcgggagctgggcagcagcgccaggtttgtgtatgaggcctgtggggcccgggtgtttgtgcagcgcttccggctgcagcacggcctggagggccacacaggctgtgtgaacaccctgcacttcaaccagaggggcacctggctggccagcggcagtgatgacctgaaggtggtggtgtgggactgggtgcggcggcagcctgtgctggactttgaaagtggccacaagagcaatgtgttccaggccaagttcctgcccaacagcggggacagcaccctggccatgtgtgccagagatggccaggtgcgggtggccgagctgagcgccacccagtgctgcaagaacaccaagagggtggcccagcacaagggggccagccacaagctggccctggagccagacagcccctgcaccttcctgtctgctggggaggatgctgtggtgttcaccatcgacctgcggcaggacaggcctgccagcaagctggtggtgaccaaggagaaggagaagaaggtgggcctgtacaccatctacgtgaacccagccaacacccaccagtttgctgtgggcggccgggaccagtttgtgcgcatctatgaccagaggaagattgatgaaaatgaaaacaacggggtgctgaagaagttctgcccccaccacctggtgaacagcgagagcaaggccaacatcacctgcctggtgtacagccatgatggaacagagctgctggccagctacaatgatgaggacatctacctgttcaacagcagccacagtgatggagcccagtatgtgaagcgctacaagggccacaggaacaatgccaccgtgaagggcgtgaacttctacggccccaagtcagaatttgtggtgtctggcagtgactgtggccacatcttcctgtgggagaagagcagctgccagatcatccagttcatggagggggacaagggcggcgtggtgaactgcctggagccccacccccacctgcctgtgctggccaccagcggcctggaccatgatgtgaagatctgggcccccacagctgaggccagcacagagctgaccggcctgaaggatgtgatcaagaagaacaagcgggagagagatgaggacagcctgcaccagacagacctgtttgacagccacatgctgtggttcctgatgcaccacctgcggcagaggaggcaccaccggcgctggagggagcccggggtgggcgccacagatgctgacagtgatgagagccccagcagcagtgacaccagtgatgaggaggagggccctgacagagtgcagtgcatgcccagctag

SEQ ID NO: 22647 - DNA, 1056 bp, Artificial Sequence; identical to SEQ ID NO: 18539
  Description of Artificial Sequence: Synthetic coding sequence

SEQ ID NO: 22648 - DNA, 588 bp, Artificial Sequence
  Description of Artificial Sequence: Synthetic coding sequence
atgcccctgcccttcggcctgaagctgaagaggacccggcgctacacagtgagcagcaagagctgcctggtggcccgcatccagctgctgaacaatgaatttgtggagttcaccctgtctgtggagagcacaggccaggagagcctggaggccgtggcccagaggctggagctgcgggaggtgacctacttcagcctgtggtactacaacaagcagaaccagaggcgctgggtggacctggagaagcccctgaagaagcagctggacaagtatgccctggagcccaccgtgtactttggagtggtgttctacgtgcccagcgtgtcccagctgcagcaggagatcacccgctaccagtactacctgcagctgaagaaggacatcctggagggcagcatcccctgcaccctggagcaggccatccagctggccggcctggccgtgcaggccgactttggagactttgaccagtatgagagccaggacttcctgcagaagtttgccctcttccctgtgggctggctgcaggatgagaaggtgctggaggaggccacccagaaggtggccctgctgcaccagaagtactag

SEQ ID NO: 22649 - DNA, 354 bp, Artificial Sequence
  Description of Artificial Sequence: Synthetic coding sequence
atgggagacaagaagagccccacccggcccaagaggcagcccaagcccagcagtgatgagggctactgggactgcagcgtgtgcaccttcagaaattctgctgaggccttcaagtgcatgatgtgtgatgtgaggaagggcaccagcacccgggacagcaaggagggcggcaagctggtgtcctacagcacagccagcctgggcgtgcggggcaccctgaggaacagagtgggcggcggcagcagcgaggagaagaagcaggccgagtacctggcccctggaagaagaagaaatattgtgcacagaggagtgggccctggccagaggagcggccccagcctgaaggaggcctag

SEQ ID NO: 22650 - DNA, 3285 bp, Artificial Sequence; identical to SEQ ID NO: 18609
  Description of Artificial Sequence: Synthetic coding sequence

SEQ ID NO: 22651 - DNA, 1353 bp, Artificial Sequence
  Description of Artificial Sequence: Synthetic coding sequence
atgagggagatcgtgcacatccaggccggccagtgtggcaaccagatcggggccaagttctgggaggtgatcagtgatgagcacggcatcgaccccagcggcaactacgtgggggacagcgacctgcagctggagcgcatctctgtgtactacaatgaggccagcagccacaagtatgtgccccgggccatcctggtggacctggagcccggcaccatggattctgtgcgcagcggggccttcggccacctgttccggccagacaacttcatcttcggccagagcggggccggcaacaactgggccaagggccactacacagaaggagctgagctggtggacagcgtgctggatgtggtgaggaaagaatgtgagaactgtgactgcctgcagggcttccagctgacccacagcctgggcggcggcactggaagtggcatgggcaccctgctgatcagcaaggtgcgggaggagtacccagaccgcatcatgaacaccttctctgtggtgcccagccccaaggtgtctgacacagtggtggagccctacaatgccaccctgagcatccaccagctggtggagaacacagatgagacctactgcatcgacaatgaggccctgtatgacatctgcttccgcaccctgaagctggccacccccacctacggggacctgaaccacctggtgtctgccaccatgtctggagtgaccaccagcctgcgcttccctggccagctgaatgctgacctgaggaagctggccgtgaacatggtgcccttcccccggctgcacttcttcatgcctggctttgcccccctgacagcccggggcagccagcagtaccgggccctgactgtgcctgagctgacccagcagatgtttgatgccaagaacatgatggccgcctgtgaccccaggcatggccgctacctgactgtggccaccgtcttccggggccgcatgtccatgaaggaggtggatgagcagatgctggccatccagagcaagaacagcagctactttgtggagtggatccccaacaacgtgaaggtggccgtgtgtgacatccccccccggggcctgaagatgagcagcaccttcatcggcaacagcacagccatccaggagctgttcaagaggatcagcgagcagttcaccgccatgttccggaggaaggccttcctgcactggtacacaggagagggcatggatgagatggagttcacagaagctgagagcaacatgaatgacctggtgtctgagtaccagcagtaccaggatgccacagctgaggaggagggggagatgtatgaagatgatgaggaggagagcgaggcccagggccccaagtag

SEQ ID NO: 22652 - DNA, 240 bp, Artificial Sequence
  Description of Artificial Sequence: Synthetic coding sequence
atgaatgaaagcaagccaggggacagccagaacctggcctgtgtgttctgcaggaagcatgatgactgccccaacaagtatggagagaagaagaccaaggagaagtggaacctgactgtgcactactactgcctgctgatgagcagcggcatctggcagaggggcaaggaggaggagggcgtgtatggcttcctgattgaggacatcaggaaggaggtgaacagagccagcaagctgtag

SEQ ID NO: 22653 - DNA, 1785 bp, Artificial Sequence; identical to SEQ ID NO: 21127
  Description of Artificial Sequence: Synthetic coding sequence

SEQ ID NO: 22654 - DNA, 540 bp, Artificial Sequence
  Description of Artificial Sequence: Synthetic coding sequence
atggccgagagcagcagcgagagtgaccacttccgctgccgggaccggctgagcccctgggccgcccggagcacccaccggggcaccaggagcctgcccaccgtggaggtgacagagaaggtgaacaccatcaccagcaccctgcaggacaccagcaggaacctgcggcaggtggaccagatgctgggccgctaccgggagtacagcaatggccaggccggggccatcgagcacctgaaggagagcctggagcagagcattgaccagctgcggagccagaggctgctgagaaattctgggggccgcagcatctctgtgaccagcctgagcgccagtgacctggatggcggcaccggcagcgagctgcaccacttcccccccaccagccccctgaaggactatggagacccccagggcatcaagaggatgaggagcaggactggagtgcgctttgtgcaggagacagatgacatgacccagctgcacggcttccaccagagcctgcgggacctgagcagcgagcagatccggctgggctag

SEQ ID NO: 22655 - DNA, 1056 bp, Artificial Sequence; identical to SEQ ID NO: 18539
  Description of Artificial Sequence: Synthetic coding sequence

SEQ ID NO: 22656 - DNA, 330 bp, Artificial Sequence
  Description of Artificial Sequence: Synthetic coding sequence
atggagacagactgcaaccccatggagctgagctccatgagcggctttgaggagggcagcgagctgaatggatttgagggcacagacatgaaggacatgaggctggaggccgaggccgtggtgaatgatgtgctgtttgctgtgaacaacatgtttgtgtccaagagcctgcgctgtgctgatgatgtggcctacatcaacgtggagaccaaggagaggaaccgctactgcctggagctgacagaagctggcctgaaggtggtgggctacgcctttgaccaggtggatgaccacctgcagaccccctaccacgagaccgtgtacagctag

SEQ ID NO: 22657 - DNA, 387 bp, Artificial Sequence
  Description of Artificial Sequence: Synthetic coding sequence
atggccgagagcagcagcgagagtgaccacttccgctgccgggaccggctgagcccctgggccgcccggagcacccaccggggcaccaggagcctgcccaccgtggaggtgacagagaaggtgaacaccatcaccagcaccctgcaggacaccagcaggaacctgcggcaggtggaccagatgctgggccgctaccgggagtacagcaatggccaggccggggccatcgagcacctgaaggagagcctggagcagagcattgaccagctgcggagccagaggctgctgagaaattctgggggccgcagcatctctgtgaccagcctgagcgccagtgacctggatggcggcaccggcagcgagctgcaccacttcccccccacctag

SEQ ID NO: 22658 - DNA, 369 bp, Artificial Sequence; identical to SEQ ID NO: 19201
  Description of Artificial Sequence: Synthetic coding sequence

SEQ ID NO: 22659 - DNA, 420 bp, Artificial Sequence; identical to SEQ ID NO: 21325
  Description of Artificial Sequence: Synthetic coding sequence

SEQ ID NO: 22660 - DNA, 4602 bp, Artificial Sequence
  Description of Artificial Sequence: Synthetic coding sequence
atgcctgtgaagaggctgcgggaggtggtgtcccagaaccacggggaccacctggtgctgctgaaggatgagctgccctgtgtgcccccagccctgagcgccaacaagaggctgcctgtgggcaccggcaccagcctgaatggcaccagccggggcagcagtgacctgaccagcgccaggaactgctaccagcccctgctggagaaccccatggtgtctgagagtgacttcagcaaggatgtggccgtgcaggtgctgcccctggacaagattgaggagaacaacaagcagaaggccaatgacatcttcatcagccagtacaccatgggccagaaggatgccctgaggacagtgctgaagcagaaggcccagagcatgcctgtgttcaaggaggtgaaggtgcacctgctggaggatgctggcatcgagaaggatgctgtgacccaggagacccgcatcagccccagcggcatcgacagcgccaccaccgtggccgccgccacagctgctgccatcgccacagctgcccccctcatcaaggtgcagagcgacctggaggccaaggtgaacagcgtgacagagctgctgagcaagctgcaggagacagacaagcacctgcagagggtgacagagcagcagaccagcatccagaggaagcaggagaagctgcactgccacgaccacgagaagcagatgaatgtgttcatggagcagcacatccgccacctggagaagctgcagcagcagcagattgacatccagacccacttcatctctgctgccctgaagaccagcagcttccagcctgtgtccatgcccagcagcagagctgtggagaagtacagcgtgaagccagagcaccccaacctgggcagctgcaaccccagcctgtacaacacctttgccagcaagcaggcccccctgaaggaggtggaggacaccagctttgacaagcagaagagccccctggagaccccagcccccaggagatttgcccctgtgcctgtgtccagagatgatgagctgagcaagcgggagaacctgctggaggagaaggagaacatggaggtgtcctgccacagaggaaatgtgcggctgctggagcagatcctgaacaacaatgacagcctgaccaggaagtctgagagcagcaacaccaccagcctgaccaggagcaagattggctggaccccagagaagaccaaccgcttccccagctgtgaggagctggagaccaccaaggtgaccatgcagaagagtgatgatgtgctgcatgacctgggccagaaggagaaggagaccaacagcatggtgcagcccaaggagagcctgtccatgctgaagctgcctgacctgccccagaacagcgtgaagctgcagaccaccaacaccaccaggtctgtgctgaaggatgctgagaagatcctgcggggcgtgcagaacaacaagaaggtgctggaggagaacctggaggccatcatccgggccaaggatggagctgccatgtacagcctcatcaatgccctgagcaccaaccgggagatgtctgagaagatccgcatcaggaagacagtggatgagtggatcaagaccatctctgctgagatccaggatgagctgagcaggacagattatgagcagaagagatttgaccagaagaaccagaggaccaagaagggccagaacatgaccaaggacatccgcaccaacacccaggacaagacagtgaacaagagcgtcatccccaggaagcacagccagaagcagatcgaggagcacttcaggaacctgcccatgaggggcatgcctgccagcagcctgcagaaggagaggaaggagggcctgctgaaggccaccaccgtcatccaggatgaggactacatgctgcaggtgtatggcaagcctgtgtaccagggccacaggagcaccctgaagaagggcccctacctgcgcttcaacagccccagccccaagagccggccccagaggcccaaggtgattgagcgggtgaagggcaccaaggtgaagagcatccgcacccagacagacttctacgccaccaagcccaagaagatggacagcaagatgaagcacagcgtgcctgtgctgccccatggagaccagcagtacctgttcagccccagccgggagatgcccaccttcagcggcaccctggagggccacctgatccccatggccatcctgctgggccagacccagagcaacagcgacaccatgcctcctgctggggtcatcgtgtccaagccccaccctgtgacagtgaccaccagcatcccccccagcagcaggaaggtggagaccggggtgaagaagcccaacatcgccatcgtggagatgaagtctgagaagaaggaccccccccagctgactgtgcaggtgctgcccagcgtggacatcgacagcatcagcaacagcagcgcagatgtgctgagccccctgagcagccccaaggaggccagcctgccccctgtgcagacctggatcaagaccccagagatcatgaaggtggatgaggaggaggtgaagtttcctggcaccaactttgatgagatcattgatgtgatccaggaggaggagaagtgtgatgagatcccagacagcgagcccatcctggagttcaacagatctgtgaaggctgacagcaccaagtacaacggcccccccttcccccctgtggccagcaccttccagcccacagctgacatcctggacaaggtgattgaaaggaaggagaccctggagaacagcctcatccagtgggtggagcaggagatcatgagccgcatcatcagcggcctcttccctgtgcagcagcagatcgcccccagcatctctgtgtctgtgtctgagaccagcgagcccctgaccagtgacatcgtggagggcaccagcagcggggccctgcagctgtttgtggatgctggggtgcctgtgaacagcaatgtcatcaagcactttgtgaatgaggccctggccgagaccatcgctgtgatgctgggggaccgggaggccaagaagcagggccctgtggccactggagtgtctggagatgccagcaccaatgagacctacctgcctgcccgggtgtgcacccccctgcccaccccccagcccaccccaccctgcagccccagcagccctgccaaggaatgtgtgctggtgaagaccccagacagcagcccctgtgacagcgaccatgacatggccttccctgtgaaggagatctgtgccgagaagggagatgacatgcctgccatcatgctggtgaacacccccaccgtgacccccaccaccaccccacctcctgctgctgctgtgttcacccccaccctgagtgacatcagcattgacaagctgaaggtgagcagccctgagctgcccaagccctggggagatggagacctgcccctggaggaggagaaccccaacagcccccaggaggagctgcacccccgggccatcgtgatgtctgtggccaaggatgaggagcctgagagcatggacttccctgcccagcccccacctcctgagcctgtgcccttcatgcccttccctgctggcaccaaggcccccagccccagccagatgcctggcagtgacagcagcaccctggagagcaccctgtctgtgacagtgacagaaacagagaccctggacaagcccatcagcgagggggagatcctcttcagctgtggccagaagctggcccccaagatcctggaggacatcggcctgtacctgaccaacctgaatgacagcctgagcagcaccctgcatgatgctgtggagatggaggatgatcctccttctgagggccaggtgatccgcatgagccacaagaagttccacgcagatgccatcctgagctttgccaagcagaaccaggagagcgctgtgtcccagcaggccgtgtaccacagcgaggacctggagaacagcgtgggggagctgtctgagggccagaggccccagctgacagctgctgctgagaacatcctgatgggccacagcctgtacatgcagccccctgtgaccaacacccagagcctggaccagcagtgtgaccccaagcccctgagccggcagtttgacacagtgtctggcagcatctatgaggacagctgtgccagccacggccccatgagcctgggggagctggagctggagcccaacagcaagctggtgctgcccaccaccctgctgacagcccaggagaatgatgtgaacctgcctgtggccgctgaggacttcagccagtaccagctgaagcagaaccaggatgtgaagcaggtggagcacaagcccagccagagctacctgcgggtgaggaacaagagtgacatcgcccccagccagcagcaggtgtcccctggggacatggacaggacccagatcgagctgaacccctacctgacctgtgtgttttctgggggcaaggctgtgcccctgagcgccagccagatgcccccagccaagatgtctgtgatgctgcccagcgtgaacctggaggactgcagccagagcctgagcctgagcaccatgcaggaggacatggagagcagcggggctgacaccttctag

SEQ ID NO: 22661 - DNA, 2334 bp, Artificial Sequence
  Description of Artificial Sequence: Synthetic coding sequence
atgtctgcccagaccagccctgctgagaagggcctgaaccctggcctgatgtgccaggagagctatgcctgcagcggcacagatgaggccatctttgaatgtgatgagtgctgcagcctgcagtgcctgcgctgtgaggaggagctgcaccggcaggagcggctgaggaaccacgagcgcatccggctgaagccaggccacgtgccctactgtgacctgtgcaagggcctgagcggccacctgcccggggtgcggcagagggccatcgtgcgctgccagacctgcaagatcaacctgtgcctggagtgccagaagaggacccacagcggcggcaacaagaggaggcaccctgtgacagtgtacaacgtgagcaacctgcaggagagcctggaggccgaggagatggatgaggagaccaagaggaagaagatgacagagaaggtggtgtccttcctgctggtggatgaaaatgaggagatccaggtgaccaatgaggaggacttcatcaggaagctggactgcaagccagaccagcacctgaaggtggtgtccatcttcggcaacacaggagatggcaagagccacaccctgaaccacaccttcttctacggccgggaggtgttcaagaccagccccacccaggagagctgcaccgtgggcgtgtgggccgcctatgaccctgtgcacaaggtggccgtcatcgacacagagggcctgctgggcgccaccgtgaacctgagccagaggacccggctgctgctgaaggtgctggccatcagtgacctggtgatctaccgcacccatgctgaccggctgcacaatgacctcttcaagttcctgggagatgccagcgaggcctacctgaagcacttcaccaaggagctgaaggccaccacagcccgctgtggcctggatgtgcccctgagcaccctgggccctgctgtgatcatcttccatgaaacagtgcacacccagctgctgggcagtgaccaccccagcgaggtgcctgagaagctgatccaggaccgcttcaggaagctgggccgcttccctgaggccttcagcagcatccactacaagggcaccaggacctacaaccccccaacagacttcagcggcctgcggcgggccctggagcagctgctggagaacaacaccaccaggagccccaggcaccctggggtcatcttcaaggccctgaaggccctgagtgaccgcttcagcggggagatcccagatgaccagatggcccacagcagcttcttcccagatgagtacttcacctgcagcagcctgtgcctgagctgtggggtgggctgcaagaagtccatgaaccacggcaaggagggcgtgccccatgaggccaagagccgctgccgctacagccaccagtatgacaacagagtgtacacctgcaaggcctgctatgaaagaggagaggaggtgtctgtggtgcccaagaccagcgccagcacagacagcccctggatgggcctggccaagtatgcctggagcggctacgtgattgagtgccccaactgtggggtggtgtaccgcagccggcagtactggtttggaaaccaggaccctgtggacacagtggtgaggacagaaattgtgcacgtgtggccaggcacagatggcttcctgaaggacaacaacaatgctgcccagaggctgctggatggcatgaacttcatggcccagagcgtgtctgagctgagcctgggccccaccaaggctgtgacctcctggctgacagaccagatcgccccagcctactggaggcccaacagccagatcctgagctgcaacaagtgtgccaccagcttcaaggacaatgacaccaagcaccactgccgggcctgtggggagggcttctgtgacagctgcagcagcaagaccaggcctgtgcctgagcggggctggggccctgcccctgtgcgggtgtgtgacaactgctatgaggccagaaatgtgcagctggccgtgacagaggcccaggtggatgatgaaggaggcaccctgattgccaggaaggtgggggaggccgtgcagaacaccctgggcgctgtggtgacagccatcgacatccccctgggcctggtgaaggatgctgcccggcctgcctactgggtgcctgaccacgagatcctgcactgccacaactgcaggaaggagttcagcatcaagctgagcaagcaccactgccgggcctgtggccagggcttctgtgatgaatgttctcatgaccggcgggctgtgcccagccggggctgggaccaccctgtgcgggtgtgcttcaactgcaacaagaagccaggggacctgtag

SEQ ID NO: 22662 - DNA, 867 bp, Artificial Sequence
  Description of Artificial Sequence: Synthetic coding sequence
atggagaagctgagcgccctgcaggagcagaagggggagctgaggaagaggctgagctacaccacccacaagctggagaagctggagacagaatttgacagcaccaggcactacctggagattgagctgcggcgggcccaggaggagctggagaaggtgacagagaagctgcggcgcatccagagcaactacatggccctgcagaggatcaaccaggagctggaggacaagctgtacaggatgggccagcactatgaggaggagaagagggccctgagccatgagatcgtggccctgaacagccacctgctggaggccaaggtgaccatcgacaagctgtctgaagataatgagctgtacaggaaggactgcaacctggccgcccagctgctgcagtgcagccagacctacggccgggtgcacaaggtgtctgagctgcccagcgacttccaggagcgggtgtccctgcacatggagaagcacggctgcagcctgcccagccccctgtgccacccagcctatgctgacagcgtgcccacctgtgtgattgccaaggtgctggagaagccagaccctgccagcctgagcagccggctgagtgatgccagcgcccgggacctggccttctgtgatggagtggagaagccaggcccccggcccccctacaagggggacatctactgcagcgacacagccctgtactgcccagaggagcggcggcgggacagaagacccagcgtggatgcccctgtgacagatgtgggcttcctgcgggcccagaacagcacagattctgctgctgaggaggaggaggaggccgaggccgccgccttccctgctggcttccagcacgaggccttcccctag

SEQ ID NO: 22663 - DNA, 1263 bp, Artificial Sequence
  Description of Artificial Sequence: Synthetic coding sequence
tgaacccaggccatggccctggagacccccaccccaggccccccccgggagggccagagccctgccagccaggccggcacccagcaccccccagcccaggccacagcccacagccagagcagccctgagttcaagggcagcctggccagcctgagtgacagcctgggcgtgtctgtgatggccacagaccaggacagctacagcaccagcagcacagaggaggagctggagcagttcagcagccccagcgtgaagaagaagcccagcatgatcctgggcaaggcccggcaccggctgagctttgccagcttcagctccatgtttcatgccttcctgagcaacaacaggaagctgtacaagaaggtggtggagctggcccaggacaagggcagctacttcggcagcctggtgcaggactacaaggtgtacagcctggagatgatggcccggcagaccagcagcacagagatgctgcaggagatccgcaccatgatgacccagctgaagagctacctgctgcagagcacagagctgaaggccctggtggaccctgccctgcacagcgaggaggagctggaggccatcgtggagagcgccctgtacaagtgtgtgctgaagcccctgaaggaggccatcaacagctgcctgcaccagatccacagcaaggatggcagcctgcagcagctgaaggagaaccagctggtgatcctggccaccaccaccacagacctgggcgtgaccacctctgtgcctgaggtgcccatgatggagaagatcctgcagaagttcacctccatgcacaaggcctacagccctgagaagaagatcagcatcctgctgaagacctgcaagctgatctatgacagcatggccctgggcaaccctgggaagccctatggagcagatgacttcctgcctgtgctgatgtatgtgctggcccggagcaacctgacagagatgctgctgaatgtggagtacatgatggagctgatggaccctgccctgcagctgggggagggcagctactacctgaccaccacctacggggccctggagcacatcaagagctatgacaagatcaccgtgacccggcagctgtctgtggaggtgcaggacagcatccaccgctgggagaggaggaggaccctgaacaaggcccgggccagccgcagctctgtgcaggtgcggcctgagagcggccggggccctgtgggcccctgccccaggcaccacccctgctgcctgctggccaaggagccctag

SEQ ID NO: 22664 - DNA, 2466 bp, Artificial Sequence
  Description of Artificial Sequence: Synthetic coding sequence
atggccggcagtgatgctgagtgggtgaccatcgccaacaacctgctcttcaagtgccacatccacctgcgcatccacgagctgcaggactgtgatgccaacgtgttcatcgccctgtaccagagcatcctgggggagaaggtgcctgacctgattgtcatccccaggagccaggaggatgatgcccacaacgtgcaggccgtgattgacagcctggccctggactacctgcaggtgtccctgagccacatcactggagaaaatattgtgaagggggacaaggagagcatcaagaacctgctggagatctttgatggcctgctggagtacctgacagagcgcatcagcgagaccagccatgagaagtcagaaacagagcagtacttcaaggagagtgacagaggagagcggctggaggagcctgagagcaccaaggagagcaagagctcctggaagagggtgtcctttggccgctgcagcctgagcagcgagatgctgggccccagctgggatggagatgaagctgagagcactggagagatcatccggctgggggacacagcccacaccttcagcctgcggagcaatggagcccagtgccccaatgagatgctgagcaagaaggccctggccagccccagcagcaagagccatgaggacatgctgtacccacccagcgtgctgagcaagagcaggaccagctttgtggaggacacagagaccctgtctgtgtctggcatccccaatgccaggaagctgggggagcccatccgggccgccatccccctgcaccccccctaccaccccagcgagccccgggccccctgccccatcggcaaggagtacctgcacagcagccactgcagccctgctgtgaacagcactggagagcacacagagttcagcggggacctggatgatggcctcttcctgatcagcaagctgcccaagggcagcaagtgggaggtgtacccagcccaggtgcagggccccaggaccaggaagccacccaagggcaagagaaatgaaaatagagccacagccagcagctgcaacagccccttcccccagaggcccaggaagaggctgacagagcaggagctgcatgatgtgtctgagaagctgagccagaggctgtctgagctggactggatgctgaagagcgccctgggggaccgcatcaaggagaagacagaccacaaggaggagaacacaggaaatgaggaggtggaggatggaacagaggagaccctgagccagcacagtgatggcatcgtggagtatggccccaagaagagcaggcctggcctgtccatgaggaggaagccaccctaccgcagccacagcctgagccccagccctgtgaacaagcacaagcagttccacctggagaggaagaggcagaggaagccccgggagacagatgtgcggcagttccaggcccaggccttcacagaggcctttgagcgggagctgcggcggcacaaggtgcaggagaacatcggccccctgcgcatccacgagaaggaggaggagacagagaagatctacagaggagaggccgtgaggaagggcaccccagagtgcagccagccctggaagatctacagcaggaagaccaccacccagagcctgcggggcggcctgcccaagcccaacaaggctgtgcccatgaaggtgtctgagcacagcctgctgcccctgatgctggagcagttccccttcctgtatgtgtctggccccaccctgagcaagatgtggaagcagcagatcgcccaggtggagcagctgaagaaggaggcctgccgggagaacagaagcaagaagaagctgcaggatgaaattgaggaggccctgcggagacatgacctgctgaccaccctggtgaagaaggagtatgagcacaacaagaggctgcaggacttcaaggactgcatccggcggcagaggctgacccagagcaagatcaaggagaaccggcagcagatcgtgcgggccaggaagtactatgatgactacagagtgcagctgtgtgccaagatgatgaggatgaggacccgggaggagatgatcttcaagaagctgtttgaggagggcctgaacatccagaagcagaggctgcgggacctgagaaattatgccaaggagaagagagatgagcagaggagaagacaccaggatgagctggacagcatggagaactactacaaggaccagttcagcctgctggccgaggccatcagccaggagcaccaggagctgaaggcccgggagaagagccaggcccagaccctgcacaaggtgaagcgggagctgcggagcaagatggagaaggagatccagcagctgcaggacatgatcacccagaatgatgatgatgtgttcttccgggagctggaggccgagcgcttccgcagccggctgcagctggccagcttccagtacagcaagagccccagcctgtag

SEQ ID NO: 22665 - DNA, 4560 bp, Artificial Sequence
  Description of Artificial Sequence: Synthetic coding sequence
atgaggatcccagaccagaagtatgtgaccctgaagctgaatgatgtgatccgcttcggctatgacagcaacatgtatgtgctggagcgggtgcagcaccgggtgcctgaggaggccctgaagcatgagaagtacaccagccagctgcaggtgtctgtgaagggcctggcccccaagaggtctgaggccctgcctgagcacaccccctactgtgaggccagcaaccccaggcctgagaagggggacagaagacctggaacagaagctgccagctaccgcacccccctgtatggccagcccagctggtggggagaagatgatggcagcaccctgcctgatgcccagaggcagggcgagccctacccagagcggcccaagggccctgtgcagcaggatggagagctgcacggcttccgggccccagctgagccccagggctgcagcttccggcgggagcccagctactttgagatccccaccaaggagaccccccagcccagccagcccccagaggtgcctgcccacgagatgcccaccaaggatgctgaggccggcggcggcggggccgcccctgtggtgcagagccacgccagcttcaccattgaatttgatgactgcagccctgggaagatgaagatcaaggaccacatcaccaagttcagcctgcggcagaggaggcctcctgggaaggaggccaccccaggagagatggtgtctgctgagaccaaggtggccgactggctggtgcagaatgaccccagcctgctgcaccgggtgggccctggagatgacagacacagcaccaagagtgacctgcctgtgcacaccaggaccctgaagggccacaagcatgaagatggcacccagagcgacagcgaggaccccctggccaaggccgccagcgctgctggggtgcccctggaggccagcggggagcaggtgcggctgcagaggcagatcaagagggacccccaggagctgctgcacaaccagcaggccttcgtcatcgagttctttgatgaggacacccccaggaagaagaggagccagagcttcacccacagccccagcggggaccccaaggctgacaagagaagaggccccaccccagctgaccgggaccggcccagcgtgcctgcccctgtgcaggccggcggccgcagcagcggcccccagagagctggcagcctgaagcgggagaagacagaggagcggctgggcagccccagccctgccagcaggaccccagcccggcccttcggctctgtgggcagaagaagccggctggcccaggacttcatggcccagtgcctgcgggagagcagccctgctgcccggcccagccctgagaaggtgccccctgtgctgcctgcccccctgacccctcatggcaccagccctgtgggcccccccaccccacctccagcccccacagacccccagctgaccaaggccaggaagcaggaggaggatgacagcctgagtgatgctggcacctacaccatcgagacagaggcccaggacacagaggtggaggaggccaggaagatgattgaccaggtgtttggagtgctggagagccctgagctgagccgggccagcagcgccaccttccggcctgtgatccggggggacagagatgaaagtgatgatggaggagtggcccagaggatggccctgctgcaggagtttgccagccggcccctgggcgccgccccccaggccgagcaccagggcctgcctgtgcccggcagccctgggggccagaagtgggtgagccgctgggccagcctggccgacagctacagcgaccccggcctgacagaagatggcctgggccggcggggcggggagcctgagggcagcctgcctgtgaggatgagaagaaggctgccccagctgcccagcgagagagctgacagccctgctggccctgagagcagcagaagaagtggccctggccccccagagctggacagcgagcagcccagccggctgtttggccaggaggagctggaccctgacagcctgagtgatgccagcggcagtgatggcggccggggccctgagcccggggtggagccccaggacagcagaagaagaagcccccaggagggccccacctggagccggggcagaagaagcccccgggcccctggagagcccaccccagccagcttcttcatcggggaccagaatggagatgctgtgctgagcaggaagcccctggccgcccctggagatggagagggcctgggccagacagcccagcccagccccccagccagagatggagtgtatgtgtctgccaatggaaggatggtgatccagctgcggcccggccgcagccctgagccagatggccctgccccagccttcctgcggcaggagagcttcaccaaggagcccgccagcggccccccagcccctgggaagccaccccacatcagcagccaccccctgctgcaggacctggccgccacccgggccgccaggatggacttccacagccaggacacccacctgatcctgaaggagacagaaacagccctggccgccctggaggcccggctgctgagcaacagcgtggatgctgaatgtgagggcggcagcaccccccggcccccagaagatgccctgagcggggacagtgatgtggacacagccagcacagtgtccctgcggagcggcaagagcggccccagccccaccaccccccagcccctgcgggcccagaaggagatgagccccagccccccagctgcccaggaccccggcggcacagccctggtgtctgcccgggagcagagcagcgagcggcagcaccaccccctgggccccacagacatgggccgcggggagcctgtgagaagaagtgccatccggcggggccaccggccccggggcagcctggactggcccagcgaggagcggggccctgtgctggcccacctgcccagcagtgatgtgatggccagcaaccacgagaccccagaggccactggagctggccgcctgggcagcaggaggaagccagctgcccccccacccagccctgctgcccgggaggagcagagccgcagcagcgccagcagccagaagggcccccaggccctgaccaggagcaacagcctgagcaccccccggcccacccgggccagccggctgcggcgggcccggctgggagatgccagtgacacagaagctgctgatggagagcggggcagcctgggcaaccctgagcctgtgggccggcctgctgctgagcaggccaagaagctgagccggctggacatcctggccatgcccaggaagagagctggcagcttcaccggcaccagtgaccctgaggccgccccagcccggaccagcttcagcggccgctctgtggagctgtgctgtgccagcaggaagcccaccatggccgaggcccgggctgtgtccaggaaggccgccaacacagccaccaccaccggcccccggcagcccttcagccgggcccggagcggcagcgcccgctacaccagcaacacccggcggcggcagcagggcagtgactacaccagcaccagcgaggaggagtatggcagcagacatggcagccccaagcacaccaggagccacaccagcacagccacccagaccccccgggccggcagcagcagccgggcccggagccgggcccctggcccccgggacacagatgatgatgaggaggagccagacccctacggcttcatcgtgcagacagctgagattgctgagatcgcccggctgagccagaccctggtgaaggatgtggccatcctggcccaggagatccatgatgtggccggagatggagacaccctgggcagcagcgagcccgcccacagcgccagcctgagcaacatgcccagcaccccagccagcaccatcagcgcccgggaggagctggtgcagagaattcctgaggccagcctgaacttccagaaggtgcccccaggcagcctgaacagccgggactttgaccagaacatgaatgacagctgtgaagatgccctggccaacaagacccggcccaggaaccgggaggaggtgatctttgacaacctgatgctgaaccctgtgtcccagctgagccaggccatcagagaaaatacagagcacctggccgagaagatgaagatcctcttccagaacacaggccgggcctgggaggacctggaggcccgcatcaatgcagaaaatgaggtgcccatcctgaagaccagcaacaaggagatcagcagcatcctgaaggagctgcggcgggtgcagaagcagctggaggtgatcaatgccatcgtggaccccagcggcagcctggacctgctgactggaaacagaagcctggccagcagcgcccagcccggcctgggcaagggccgggtggccgcccagagcccccccagccctgccagcgctgaggccctgctgcctgccctgcccctgaggaacttcccccagagggccagctgtggcccccccagcctgcctgaccccaccttcctgcctgatgctgagcgcttcctgatctag

SEQ ID NO: 22666 - DNA, 378 bp, Artificial Sequence; identical to SEQ ID NO: 18822
  Description of Artificial Sequence: Synthetic coding sequence

SEQ ID NO: 22667 - DNA, 3525 bp, Artificial Sequence; identical to SEQ ID NO: 19066
  Description of Artificial Sequence: Synthetic coding sequence

SEQ ID NO: 22668 - DNA, 1245 bp, Artificial Sequence; identical to SEQ ID NO: 18541
  Description of Artificial Sequence: Synthetic coding sequence

SEQ ID NO: 22669 - DNA, 2256 bp, Artificial Sequence; identical to SEQ ID NO: 22646
  Description of Artificial Sequence: Synthetic coding sequence

SEQ ID NO: 22670 - DNA, 1056 bp, Artificial Sequence; identical to SEQ ID NO: 18734
  Description of Artificial Sequence: Synthetic coding sequence

SEQ ID NO: 22671 - DNA, 2394 bp, Artificial Sequence
  Description of Artificial Sequence: Synthetic coding sequence
atggctgtgcagggcagccagaggcggctgctgggcagcctgaacagcacccccacagccatcccccagctgggcctggccgccaaccagacaggagcccgctgcctggaggtgtccatcagtgatggcctcttcctgagcctgggcctggtgtccctggtggagaatgccctggtggtggccaccatcgccaagaacagaaacctgcacagccccatgtactgcttcatctgctgcctggccctgagtgacctgctggtgtctggcagcaatgtgctggagacagctgtgatcctgctgctggaggccggggccctggtggcccgggctgctgtgctgcagcagctggacaacgtgattgatgtgatcacctgcagctccatgctgagcagcctgtgcttcctgggcgccatcgctgtggaccgctacatcagcatcttctacgccctgcgctaccacagcatcgtgaccctgccccgggcccggcgggctgtggccgccatctgggtggcctctgtggtgttcagcaccctcttcatcgcctactatgaccacgtggccgtgctgctgtgcctggtggtgttcttcctggccatgctggtgctgatggctgtgctgtatgtgcacatgctggcccgggcctgccagcacgcccagggcatcgcccggctgcacaagaggcagaggcctgtgcaccagggcttcggcctgaagggagctgtgaccctgaccatcctgctgggcatcttcttcctgtgctggggccccttcttcctgcacctgaccctcatcgtgctgtgcccagagcaccccacctgtggctgcatcttcaagaacttcaacctcttcctggccctgatcatctgcaatgccatcatcgaccccctcatctatgccttccacagccaggagctgcggaggaccctgaaggaggtgctgacctgcagctgcagccaggaccgggccctggtgtcctgggatgtgaagagcctgggcggctctgtgtgccaggagctgctgccccagcagccccaggagaagggcctgtgtgaccagaaggccagcagcacagccctgcagaggctgctgcagaaggagttctgggaggtgatcagtgatgaacatggaattgaccccagcggcaactacgtgggggacagcgacctgcagctggagcgcatctctgtgtactacaatgaggccagcagccacaagtatgtgccccgggccatcctggtggacctggagcccggcaccatggacagcgtgcgcagcggggccttcggccacctgttccggccagacaacttcatcttcggccagagcggggccggcaacaactgggccaagggccactacacagagggcgctgagctggtggacagcgtgctggatgtggtgaggaaagaatgtgagaactgtgactgcctgcagggcttccagctgacccacagcctgggcggcggcaccggcagcggcatgggcaccctgctgatcagcaaggtgcgggaggagtacccagaccgcatcatgaacaccttctctgtggtgcccagccccaaggtgtctgacacagtggtggagccctacaatgccaccctgagcatccaccagctggtggagaacacagatgagacctactgcatcgacaatgaggccctgtatgacatctgcttccgcaccctgaagctggccacccccacctatggagacctgaaccacctggtgtctgccaccatgtctggagtgaccaccagcctgcgcttccctggccagctgaatgctgacctgaggaagctggccgtgaacatggtgcccttcccccggctgcacttcttcatgcctggctttgcccccctgacagcccggggcagccagcagtaccgggccctgactgtgcctgagctgacccagcagatgtttgatgccaagaacatgatggccgcctgtgaccccaggcatggccgctacctgactgtggccaccgtcttccggggccgcatgtccatgaaggaggtggatgagcagatgctggccatccagagcaagaacagcagctactttgtggagtggatccccaacaacgtgaaggtggccgtgtgtgacatccccccccggggcctgaagatgagcagcaccttcatcggcaacagcacagccatccaggagctgttcaagaggatcagcgagcagttcaccgccatgttccggaggaaggccttcctgcactggtacaccggggagggcatggatgagatggagttcacagaggccgagagcaacatgaatgacctggtgtctgagtaccagcagtaccaggatgccacagctgaggaggagggggagatgtatgaagatgatgaggaggagagcgaggcccagggccccaagtag

SEQ ID NO: 22672 - DNA, 99 bp, Artificial Sequence
  Description of Artificial Sequence: Synthetic coding sequence
atggccgagagcagcagcgagagtgaccacttccgctgccgggaccggctgagcccctgggccgcccggagcacccaccggggcaccaggagcctgtag

SEQ ID NO: 22673 - DNA, 453 bp, Artificial Sequence
  Description of Artificial Sequence: Synthetic coding sequence
atgacagacacccggcggcgggtgaaggtgtacaccctgaatgaagatcggcagtgggatgaccggggcaccggccacgtgagcagcggctacgtggagcggctgaagggcatgagcctgctggtgcgggcagagagtgatggcagcctgctgctggagagcaagatcaaccccaacacagcctaccagaagcagcaggacaccctcatcgtgtggagcgaggccgagaactatgacctggccctgtccttccaggagaaggccggctgtgatgagatctgggagaagatctgccaggtgcagggcaaggaccccagcgtggacatcacccaggacctggtggatgaaagtgaggaggagagatttgatgacatgagcagccctggcctggagctgcccagctgtgagctgagccggctggaggagattgctgagctggtggccagcagctag

SEQ ID NO: 22674 - DNA, 504 bp, Artificial Sequence
  Description of Artificial Sequence: Synthetic coding sequence
atggactggaaggaggtgctgcggcggcggctggccacccccaacacctgccccaacaagaagaagtctgagcaggagctgaaggatgaggagatggacctcttcaccaagtactacagcgagtggaagggcggcaggaagaacaccaatgagttctacaagaccatcccccgcttctactaccgcctgcctgcagaagatgaggtgctgctgcagaagctgcgggaggagagcagagctgtgttcctgcagaggaagagccgggagctgctggacaatgaggagctgcagaacctgtggttcctgctggacaagcaccagaccccacccatgattggagaggaggccatgatcaactatgagaacttcctgaaggtgggggagaaggccggggccaagtgcaagcagttcttcaccgccaaggtgtttgccaagctgctgcacacagacagctatggccgcatcagcatcatgcagttcttcaactacgtgatgaggaagtag

SEQ ID NO: 22675 - DNA, 507 bp, Artificial Sequence; identical to SEQ ID NO: 22630
  Description of Artificial Sequence: Synthetic coding sequence

SEQ ID NO: 22676 - DNA, 822 bp, Artificial Sequence
  Description of Artificial Sequence: Synthetic coding sequence
atgcctggcctgagctgccgcttctaccagcacaagtttcctgaggtggaggatgtggtgatggtgaatgtgcgcagcattgctgagatgggcgcctacgtgtccctgctggagtacaacaacatcgagggcatgatcctgctgtctgagctgagcagaagacgcatccgcagcatcaacaagctgatcagaattggaagaaatgaatgtgtggtggtgatccgggtggacaaggagaagggctacatcgacctgagcaagagaagagtgtccccagaggaggccatcaagtgtgaggacaagttcaccaagagcaagacagtgtacagcatcctgcggcacgtggccgaggtgctggagtacaccaaggatgagcagctggagagcctcttccagaggacagcctgggtgtttgatgacaagtacaagaggcctggctatggagcctatgatgccttcaagcatgctgtgtctgaccccagcatcctggacagcctggacctgaatgaagatgagcgggaggtgctgatcaacaacatcaacagaaggctgaccccccaggccgtgaagatccgggctgacatcgaggtggcctgctacggctatgagggcattgatgctgtgaaggaggccctgcgggccggcctgaactgcagcacagagaacatgcccatcaagatcaacctgattgccccacccaggtatgtgatgaccaccaccaccctggagaggacagagggcctgtctgtgctgagccaggccatggccgtcatcaaggagaagattgaggagaagaggggcgtcttcaacgtgcagatgtag

SEQ ID NO: 22677 - DNA, 2757 bp, Artificial Sequence
  Description of Artificial Sequence: Synthetic coding sequence
tgaagaaccaacagcagatttgtgaaggtggtgctgatgtctgccaccatcagctgcaaggagtttgctgactactttgctgtgcctgtgcagaacaagatgaacccagcctacatctttgaggtggagggcaagccccacagcgtggaggagtactacctgaatgacctggagcacatccaccacagcaagctgagcccccacctgctggaggagcctgtgatcaccaaggacatctatgaggtggccgtgtccctcatccagatgtttgatgacctggacatgaaggagagcggcaacaaggcctggagcggggcccagtttgtgctggagaggagctctgtgctggtgttcctgcccggcctgggggagatcaactacatgcatgagctgctgaccagcctggtgcacaagaggctgcaggtgtaccccctgcacagctctgtggccctggaggagcagaacaacgtgttcctgagccctgtgcccggctacaggaagatcatcctgagcaccaacattgctgagagctctgtgacagtgcctgatgtgaagtatgtgattgacttctgcctgaccaggaccctggtgtgtgatgaggacaccaactaccagagcctgcggctgtcctgggccagcaagaccagctgcaaccagaggaagggccgggccggccgggtgtcccggggctactgctaccgcctggtgcacaaggacttctgggacaacagcatcccagaccacgtggtgcctgagatgctgcgctgccccctgggcagcaccatcctgaaggtgaagctgctggacatgggagagccccgggccctgctggccacagccctgagccccccaggcctgagtgacattgaaagaaccatcctgctgctgaaggaggtgggcgccctggccgtgtctggccagagagaagatgagaacccccatgatggagagctgaccttcctgggccgggtgctggcccagctgcctgtgaaccagcagctgggcaagctgattgtgctgggccacgtgtttggctgcctggatgaatgtctcatcatcgctgctgccctgagcctgaagaacttctttgccatgcccttccggcagcacctggatggctacagaaacaaggtgaacttcagcggcagcagcaagagtgactgcatcgccctggtggaggccttcaagacctggaaggcctgccggcagacaggagagctgcgctaccccaaggatgagctgaactggggccgcctgaactacatccagatcaagaggatccgggaggtggccgagctgtatgaggagctgaagacccgcatcagccagttcaacatgcacgtggacagcagaagacctgtgatggaccaggagtacatctacaagcagcgcttcatcctgcaggtggtgctggccggggccttctaccccaactacttcaccttcggccagccagatgaggagatggctgtgcgggagctggccggcaaggaccccaagaccaccgtggtgctgaagcacatccccccctacggcttcctgtactacaagcagctgcagagcctcttccggcagtgtggccaggtgaagagcatcgtgtttgatggagccaaggcctttgtggagttcagcaggaaccccacagagcgcttcaagaccctgcctgctgtgtacatggccatcaagatgagccagctgaaggtgtccctggagctgtctgtgcacagcgctgaggagattgagggcaaggtgcagggcatgaatgtgtccaagctgaggaacaccagggtgaatgtggacttccagaagcagacagtggaccccatgcaggtgtccttcaacaccagtgacaggagccagacagtgacagacctgctgctgaccattgatgtgacagaggtggtggaggtgggccacttctggggctacagaattgatgagaacaacagcgagatcctgaagaagctgacagctgagatcaaccagctgaccctggtgcccctgcccacccacccccacccagacctggtgtgcctggccccctttgctgactttgacaagcagcgctacttccgggcccaggtgctgtatgtgtctggcaacagcgctgaggtgttctttgtggactatggcaacaagagccacgtggacctgcacctgctgatggagatcccctgccagttcctggagctgcccttccaggccctggagttcaagatctgcaagatgaggcccagcgccaagagcctggtgtgtgggaagcactggagcgatggagccagccagtggtttgccagcctggtgtctggctgcaccctgctggtgaaggtgttttctgtggtgcacagcgtgctgcacgtggatgtgtaccagtacagcggcgtgcaggatgccatcaacatcagagatgtgctgatccagcagggctatgcagagctgacagaggagagctatgagagcaaggtgaacatcctgcgggccgccatcaacaagctggtgtgtgatggccccaacggctgcaagtgcctgggccctgagcgggtggcccagctgcaggacatcgcccggcagaagctgctgggcctcttctgccagagcaagccccgggagaagatcgtgcccaagtggcatgagaagccctatgagtggaaccaggtggaccccaagctggtgatggagcaggccgaccgggagagcagccggggcaagaacaccttcctgtaccagctgcacaagctggtggtgctgggcacctag

SEQ ID NO: 22678 - DNA, 507 bp, Artificial Sequence
  Description of Artificial Sequence: Synthetic coding sequence
atggagaagctgagcgccctgcaggagcagaagggggagctgaggaagaggctgagctacaccacccacaagctggagaagctggagacagaatttgacagcaccaggcactacctggagattgagctgcggcgggcccaggaggagctggagaaggtgacagagaagctgcggcgcatccagagcaactacatggccctgcagaggatcaaccaggagctggaggacaagctgtacaggatgggccagcactatgaggaggagaagagggccctgagccatgagatcgtggccctgaacagccacctgctggaggccaaggtgaccatcgacaagctgtctgaagataatgagctgtacaggaaggactgcaacctggccgcccagctgctgcagtgcagccagacctacggccgggtgcacaaggtgtctgagctgcccagcgacttccaggagcgggtgtccctgcacatggagaagcacggctgcagcctgcccagcccctag

SEQ ID NO: 22679 - DNA, 636 bp, Artificial Sequence
  Description of Artificial Sequence: Synthetic coding sequence
atggacatgggcaaccagcaccccagcatcagccggctgcaggagatccagaaggaggtgaagtctgtggagcagcaggtgattggcttcagcggcctgagtgatgacaagaactacaagaagctggagcgcatcctgaccaagcagctgtttgaaattgattctgtggacacagagggcaaaggagacatccagcaggccaggaagagagctgcccaggagacagagcggctgctgaaggagctggagcagaatgccaaccacccccaccgcatcgagatccagaacatctttgaggaggcccagagcctggtgcgggagaagatcgtgcccttctacaacggcggcaactgtgtgacagatgaatttgaggagggcatccaggacatcatcctgcggctgacccacgtgaagacaggaggcaagatcagcctgaggaaggcccgctaccacaccctgaccaagatctgtgctgtgcaggagatcatcgaggactgcatgaagaagcagcccagcctgcccctgtctgaagatgcccaccccagcgtggccaagatcaactttgtgatgtgtgaggtgaacaaggcccggggcgtgctgattgccctgctgatgggcgtgaacaacaatgaatag

SEQ ID NO: 22680 - DNA, 2985 bp, Artificial Sequence
  Description of Artificial Sequence: Synthetic coding sequence
atgagccagtggaccccagagtacaatgagctgtacaccctgaaggtggacatgaagtctgagatccccagtgatgcccccaagacccaggagagcctgaagggcatcctgctgcaccctgagcccatcggggccgccaagagcttccctgctggggtggagatgatcaacagcaaggtgggcaatgagttcagccacctgtgtgatgacagccagaagcaggagaaggagatgaatggaaaccagcaggagcaggagaagagcctggtggtgaggaagaagaggaagagccagcaggccggccccagctatgtgcagaactgtgtgaaggagaaccagggcatcctgggcctgcggcagcacctgggcacccccagtgatgaggacaatgacagcagcttcagtgactgcctgagcagccccagcagcagcctgcactttggagacagcgacacagtgaccagtgatgaggacaaggaggtgtctgtgcgccacagccagaccatcctgaatgccaagagccgcagccacagcgcccggagccacaagtggcccaggacagaaacagaatctgtgtctggcctgctgatgaagaggccctgcctgcacggcagcagcctgcggcggctgccctgcaggaagagatttgtgaagaacaacagcagccagaggacccagaagcagaaggagcgcatcctgatgcagaggaagaagcgggaggtgctggcccggaggaaatatgccctgctgcccagcagcagcagcagcagtgaaaatgacctgagcagcgagagcagcagcagcagcagcacagaaggagaggaggacctgtttgtgtctgccagcgagaaccaccagaacaacccagctgtgcccagcggcagcattgatgaagatgtggtggtgattgaggccagcagcaccccccaggtgacagccaatgaggagatcaacgtgaccagcacagacagcgaggtggagatcgtgacagtgggggagagctaccgcagccgcagcaccctgggccacagccgcagccactggagccagggcagcagcagccacgccagccggccccaggagcccaggaacagaagccgcatcagcaccgtcatccagcccctgcggcagaatgctgctgaggtggtggacctgactgtggatgaagatgagcccaccgtggtgcccaccaccagcgccaggatggagagccaggccaccagcgccagcatcaacaacagcaaccccagcaccagcgagcaggccagtgacacagccagcgctgtgaccagcagccagcccagcacagtgtctgagaccagcgccaccctgaccagcaacagcaccaccggcaccagcattggagatgacagcaggaggaccaccagcagcgctgtgacagaaacaggccccccagccatgccccggctgcccagctgctgcccccagcacagcccctgtggcggcagcagccagaaccaccacgccctgggccacccccacaccagctgcttccagcagcacggccaccacttccagcaccaccaccaccaccaccacaccccccaccctgctgtgcctgtgagccccagcttcagtgaccctgcctgccctgtggagcggcccccccaggtgcaggccccctgtggggccaacagcagcagcggcaccagctaccacgagcagcaggccctgcctgtggacctgagcaacagcggcatccgcagccacggcagcggcagcttccatggagccagcgcctttgacccctgctgccctgtgagcagcagcagagctgccatcttcggccaccaggccgctgctgctgcccccagccagcccctgagcagcattgatggctacggcagctccatggtggcccagccccagccccagcccccaccccagcccagcctgagcagctgccgccactacatgcccccaccctatgccagcctgacccggcccctgcaccaccaggccagcgcctgcccccacagccacggcaaccccccaccccagacccagcccccaccccaggtggactatgtgatcccccaccctgtgcacgccttccacagccagatcagcagccacgccaccagccaccctgtggcccctcctccacccacccacctggccagcacagctgcccccatcccccagcacctgccccccacccaccagcccatcagccaccacatcccagccacagcccccccagcccagaggctgcacccccatgaggtgatgcagaggatggaggtgcagaggaggaggatgatgcagcaccccacccgggcccacgagcggcccccaccccacccccacaggatgcaccccaactacggccacggccaccacatccacgtgccccagaccatgagcagccacccccggcaggcccctgagaggtctgcctgggagctgggcatcgaggccggcgtgacagctgccacctacacccctggggccctgcacccccacctggcccactaccacgccccaccccggctgcaccacctgcagctgggcgccctgcccctgatggtgcctgacatggccggctacccccacatccgctacatcagcagcggcctggatggcaccagcttccggggccccttccggggcaactttgaggagctgatccacctggaggagcggctgggcaatgtgaacagaggagccagccagggcaccatcgagcgctgcacctacccccacaagtacaagaaggtgaccacagactggttcagccagaggaagctgcactgcaagcaggatggagaggagggcacagaggaggacacagaggagaagtgcaccatctgcctgagcatcctggaggagggagaagatgtgcggcggctgccctgcatgcacctgttccaccaggtgtgtgtggaccagtggctgatcaccaacaagaagtgccccatctgccgggtggacatcgaggcccagctgcccagcgagagctag

SEQ ID NO: 22681 - DNA, 1158 bp, Artificial Sequence; identical to SEQ ID NO: 19077
  Description of Artificial Sequence: Synthetic coding sequence

SEQ ID NO: 22682 - DNA, 7464 bp, Artificial Sequence
  Description of Artificial Sequence: Synthetic coding sequence
tgagaagaggaggaggatgatgatgatgaggaggaggaggtgtctgaggtggagagcttcatcctggaccaggatgacctggagaaccccatgctggagacagccagcaagctgctgctgtctggaacagcagatggagctgacctgaggacagtggaccctgagacccaggcccggctggaggccctgctggaggccgccggcatcggcaagctgagcacagcagatggcaaggcctttgctgaccctgaggtgctgcggcggctgaccagctctgtgtcctgtgccctggatgaggccgccgccgccctgaccaggatgagagctgagagcacagccaatgccggccagagcgacaacagaagcctggccgaggcctgcagtgaaggagatgtgaatgctgtgaggaagctgctgattgagggccgctctgtgaatgagcacacagaggagggggagagcctgctgtgcctggcctgcagcgctggctactatgagctggcccaggtgctgctggccatgcacgccaacgtggaggaccggggcatcaagggggacatcacccccctgatggctgctgccaatggaggccacgtgaagatcgtgaagctgctgctggcccacaaggcagatgtgaatgcccagagcagcacaggcaacacagccctgacctacgcctgtgccggcggctacgtggatgtggtgaaggtgctgctggagagcggggccagcattgaggaccacaatgaaaatggccacacccccctgatggaggccggcagcgctggccacgtggaggtggcccggctgctgctggagaatggagctggcatcaacacccacagcaatgagttcaaggagagcgccctgaccctggcctgctacaagggccacctggagatggtgcgcttcctgctggaggccggggctgaccaggagcacaagacagatgagatgcacacagccctgatggaggcctgcatggatggccacgtggaggtggcccggctgctgctggacagcggggcccaggtgaacatgcctgctgacagctttgagagccccctgaccctggccgcctgtggcggccacgtggagctggccgccctgctgattgaaagaggagccagcctggaggaggtgaatgatgagggctacacccccctgatggaggccgcccgggagggccacgaggagatggtggccctgctgctgggccagggcgccaacatcaatgcccagacagaggagacccaggagacagccctgaccctggcctgctgcggcggcttcctggaggtggccgacttcctgatcaaggccggggctgacatcgagctgggctgcagcacccccctgatggaggccgcccaggagggccacctggagctggtgaagtacctgctggccgccggggccaacgtgcacgccaccacagccactggagacacagccctgacctacgcctgtgaaaatggccacacagatgtggctgatgtgctgctgcaggccggggctgacctggagcacgagagcgagggcggccgcacccccctgatgaaggccgcccgggccggccacgtgtgcaccgtgcagttcctgatcagcaaaggagccaacgtgaacagaaccacagccaacaatgaccacacagtgctgagcctggcctgtgccggcggccacctggccgtggtggagctgctgctggcccatggagctgaccccacccaccggctgaaggatggcagcaccatgctgattgaagctgccaagggcggccacacctctgtggtgtgctacctgctggactaccccaacaacctgctgagcgcccctcctccagatgtgacccagctgaccccacccagccatgacctgaacagagccccccgggtgcctgtgcaggccctgcccatggtggtgcccccccaggagccagacaagcccccagccaacgtggccaccaccctgcccatccggaacaaggccgccagcaagcagaagagcagcagccacctgcctgccaacagccaggatgtgcagggctacatcaccaaccagagccctgagagcatcgtggaggaggcccagggcaagctgacagagctggagcagaggatcaaggaggccatcgagaagaatgcccagctgcagagcctggagctggcccatgctgaccagctgaccaaggagaagattgaggagctgaacaagacccgggaggagcagatccagaagaagcagaagatcctggaggagctgcagaaggtggagcgggagctgcagctgaagacccagcagcagctgaagaagcagtacctggaggtgaaggcccagaggatccagctgcagcagcagcagcagcagagctgccagcacctgggcctgctgacccctgtgggcgtgggggagcagctgtctgagggggactatgcccggctgcagcaggtggaccctgtgctgctgaaggatgagccccagcagacagctgcccagatgggctttgcccccatccagcccctggccatgccccaggccctgcccctggccgccggccccctgcccccaggcagcatcgccaacctgacagagctgcagggcgtgattgtgggccagcctgtgctgggccaggcccagctggccggcctgggccagggcatcctgacagagacccagcagggcctgatggtggccagccctgcccagaccctgaatgacaccctggatgacatcatggctgtgtctggccgggccagcgccatgagcaacacccccacccacagcattgctgccagcatcagccagccccagacccccacccccagccccatcatcagccccagcgccatgctgcccatctacccagccattgatattgatgcccagacagagagcaaccacgacacagccctgaccctggcctgtgccggcggccacgaggagctggtgcagaccctgctggagcggggggccagcattgagcaccgggacaagaagggcttcacccccctcatcctggccgccacagctggccacgtgggcgtggtggagatcctgctggacaacggggctgacatcgaggcccagagcgagaggaccaaggacacccccctgagcctggcctgcagcggcggccggcaggaggtggtggagctgctgctggcccggggggccaacaaggagcacagaaatgtgtctgactacacccccctgagcctggccgccagcggcggctacgtgaacatcatcaagatcctgctgaatgctggagctgagatcaacagcaggacaggcagcaagctgggcatcagccccctgatgctggccgccatgaatggccacacagctgctgtgaagctgctgctggacatgggcagtgacatcaatgcccagatcgagaccaacagaaacacagccctgaccctggcctgcttccagggccgcacagaggtggtgtccctgctgctggacaggaaggccaacgtggagcaccgggccaagacaggcctgacccccctgatggaggccgccagcggcggctacgccgaggtgggccgggtgctgctggacaagggagcagatgtgaatgcccctcctgtgcccagcagccgggacacagccctgaccatcgctgctgacaagggccactacaagttctgtgagctgctgattggccgcggggcccacattgatgtgaggaacaagaagggcaacacccccctgtggctggccgccaacggcggccacctggatgtggtgcagctgctggtgcaggccggggctgatgtggatgctgctgacaacaggaagatcacccccctgatggccgccttcaggaagggccacgtgaaggtggtgcgctacctggtgaaggaggtgaaccagttccccagcgacagcgagtgcatgagatacatcgccaccatcacagacaaggagatgctgaagaagtgccacctgtgcatggagagcatcgtgcaggccaaggaccggcaggccgctgaggccaacaagaatgccagcatcctgctggaggagctggacctggagaagctgcgggaggagagccggcggctggccctggccgccaagcgggagaagaggaaggagaagaggaggaagaagaaggaggagcagaggaggaagctggaggagattgaggccaagaacaaggagaactttgagctgcaggccgcccaggagaaggagaagctgaaggtggaggatgagcctgaggtgctgacagagcccccatctgccaccaccaccaccaccatcggcatcagcgccacctggaccaccctggccggcagccacggcaagaggaacaacaccatcaccaccaccagcagcaagaggaagaacaggaagaacaagatcaccccagaaaatgtgcagatcatctttgatgaccccctgcccatctcctacagccagcctgagaaggtgaatggagagagcaagagcagcagcaccagcgagagcggggacagcgacaacatgaggatcagcagctgcagtgatgagagcagcaacagcaacagcagcaggaagagtgacaaccacagccctgctgtggtgaccaccaccgtgagcagcaagaagcagcccagcgtgctggtgaccttccccaaggaggagaggaagtctgtgtctgggaaggccagcatcaagctgtctgagaccatcagcgagggcaccagcaacagcctgagcacctgcaccaagagcggccccagccccctgagcagccccaacgggaagctgactgtggccagccccaagaggggccagaagcgggaggagggctggaaggaggtggtgagaagaagcaagaaggtgtctgtgcccagcaccgtcatcagccgggtgattggccggggcggctgcaacatcaatgccatccgggagttcaccggggcccacattgatattgacaagcagaaggacaagacaggagaccgcatcatcaccatccggggcggcacagagagcacccggcaggccacccagctgatcaatgccctgatcaaggaccctgacaaggagattgatgagctgatccccaagaaccggctgaagagcagcagcgccaacagcaagattggcagcagcgcccccaccaccacagctgccaacaccagcctgatgggcatcaagatgaccaccgtggccctgagcagcaccagccagacagccacagccctgactgtgcctgccatcagcagcgccagcacccacaagaccatcaagaaccctgtgaacaacgtgcggcccggcttccctgtgtccctgcccctggcctaccccccaccccagtttgcccacgccctgctggccgcccagaccttccagcagatccggcccccccggctgcccatgacccactttggaggcaccttccccccagcccagagcacctggggccccttccctgtgcggcccctgagccctgcccgggccaccaacagccccaagccccacatggtgcccaggcacagcaaccagaacagcagcggcagccaggtgaacagcgctggcagcctgaccagcagccccaccaccaccaccagcagcagcgccagcacagtgcccggcaccagcaccaacggcagccccagcagccccagcgtgcggcggcagctgtttgtgacagtggtgaagaccagcaatgccaccaccaccaccgtgaccaccacagccagcaacaacaacacagcccccaccaatgccacctaccccatgcccacagccaaggagcactaccctgtgagcagccccagcagccccagccccccagcccagcccggcggcgtgtccaggaacagccccctggactgtggcagcgccagccccaacaaggtggccagcagcagcgagcaggaggccggcagcccccctgtggtggagaccaccaacacccggccccccaacagcagcagcagcagcggcagcagcagcgcccacagcaaccagcagcagcccccaggctctgtgtcccaggagcccaggcctcccctgcagcagagccaggtgcccccacctgaggtgaggatgacagtgccccccctggccaccagcagcgcccctgtggccgtgcccagcacagcccctgtgacctaccccatgccccagacccccatgggctgcccccagcccacccccaagatggagaccccagccatccggcccccacctcatggcaccacagccccccacaagaacagcgcctctgtgcagaacagctctgtggccgtgctgtctgtgaaccacatcaagaggccccacagcgtgcccagctctgtgcagctgcccagcaccctgagcacccagagcgcctgccagaacagcgtgcacccagccaacaagcccatcgcccccaacttcagcgcccccctgcccttcggccccttcagcaccctgtttgagaacagccccaccagcgcccacgccttctggggcggctctgtggtgagcagccagagcaccccagagagcatgctgagcggcaagagcagctacctgcccaacagcgaccccctgcaccagagcgacaccagcaaggcccctggcttccggccccccctgcagaggcctgcccccagccccagcggcatcgtgaacatggacagcccctacggctctgtgacccccagcagcacccacctgggcaactttgccagcaacatcagcggcggccagatgtatggccctggggcccccctgggcggggccccagctgctgccaacttcaaccggcagcacttcagccccctgagcctgctgaccccctgcagcagcgccagcaatgacagcagcgcccagagcgtgtcctctggagtgcgggcccccagccctgcccccagctctgtgcccctgggcagcgagaagcccagcaatgtgtcccaggacaggaaggtgcctgtgcccatcggcacagagaggtctgcccgcatccggcagacaggcaccagcgcccccagcgtcatcggcagcaacctgagcacctctgtgggccacagcggcatctggagctttgagggcattggaggcaaccaggacaaggtggactggtgcaaccctggcatgggcaaccccatgatccaccggcccatgtctgaccccggggtcttcagccagcaccaggccatggagcgggacagcactggaattgtgaccccatctggcaccttccaccagcacgtgcctgctggctacatggacttccccaaggtgggcggcatgcccttctctgtgtatggaaatgccatgatcccccctgtggcccccatcccagatggagctgggggccccatcttcaacggcccccatgctgctgaccccagctggaacagcctcatcaagatggtgagcagcagcacagagaacaacggcccccagacagtgtggacaggcccctgggccccccacatgaacagcgtgcacatgaaccagctgggctag

SEQ ID NO: 22683 - DNA, 33 bp, Artificial Sequence
  Description of Artificial Sequence: Synthetic coding sequence
atggccctgccccatgacagcaatgagacctag

SEQ ID NO: 22684 - DNA, 462 bp, Artificial Sequence
  Description of Artificial Sequence: Synthetic coding sequence
atggccaccatgatcccccctgtgaagctgaagtggctggagcacctgaacagctcctggatcacagaagattctgagagcatcgccacccgggagggcgtggccgtgctgtacagcaagctggtgagcaacaaggaggtggtgcccctgccccagcaggtgctgtgcctgaagggcccccagctgcctgactttgagcgggagagcctgagcagtgatgagcaggaccactacctggatgccctgctgagcagccagctggccctggccaagatggtgtgcagcgacagcccctttgctggggccctgaggaagaggctgctggtgctgcagagggtcttctacgccctgagcaacaagtaccatgacaagggcaaggtgaagcagcagcagcacagccctgagagcagcagcggcagcgcagatgtgcacagcgtgtctgagcggcccaggagcagctag

SEQ ID NO: 22685 - DNA, 111 bp, Artificial Sequence
  Description of Artificial Sequence: Synthetic coding sequence
atgctgccccccaagcacctgagcgccaccaagcccaagaagtcctgggcccccaacctgtatgagctggacagcgacctgaccaaggagccagatgtgatcattggatag

SEQ ID NO: 22686 - DNA, 315 bp, Artificial Sequence
  Description of Artificial Sequence: Synthetic coding sequence
atggcccagagcggcggggaggcccggcccggccccaagacagctgtgcagatccgggtggccatccaggaggccgaggatgtggatgagctggaggatgaggaggagggcgctgagaccagaggagctggggaccctgcccgctacctgagccctggctggggcagcgccagcgaggaggagcccagccggggccacaggacagcccagctgccctggctggagagccagcaggtgttcagcctgaagcccttcctgctgcccactggaattgagctgaccccagagaacccctggggcagctctgtgtcctag

SEQ ID NO: 22687 - DNA, 645 bp, Artificial Sequence
  Description of Artificial Sequence: Synthetic coding sequence
atggccctgccccatgacagcaatgagaccagctacctgctgccccccaacaatgaagactggggccggcagaccatcccagactttgtgtatggccagaaggacctgatggccgagggcatccagtggcccagaaatgcccctggcatcccagatgccctgccccagagcccctttgatgctgccctgtgcagcgcctggaagcagagggtggagctgggcctcttccgctaccgcctgcgggagctgcagacccagatcctgcctggagctgtgggctttgtggcccagctgaatgtggagcggggcgtgcagaggcggcccccccagaccatcaagtctgtgcggcaggcctttgatcctgtgcagttcaacttcaacaagatccggcctggagaggtgctcttccggctgcaccgggagccagacctgcccggcaccctgctgcaggaggacatcctggtggtgatcaacgtgagccccctggagtggggccacgtgctgctggtgcctgagcccgcccggcagctgccccagaggctgctgcccggggccctgcgggccggcatcgaggccgtgctgctgagcctgcaccctggcttccgggtgggcttcaacagcctgggcggcctggcctctgtgtag

SEQ ID NO: 22688 - DNA, 2988 bp, Artificial Sequence
  Description of Artificial Sequence: Synthetic coding sequence
atgagccagtggaccccagagtacaatgagctgtacaccctgaaggtggacatgaagtctgagatccccagtgatgcccccaagacccaggagagcctgaagggcatcctgctgcaccctgagcccatcggggccgccaagagcttccctgctggggtggagatgatcaacagcaaggtgggcaatgagttcagccacctgtgtgatgacagccagaagcaggagaaggagatgaatggaaaccagcaggagcaggagaagagcctggtggtgaggaagaagaggaagagccagcaggccggccccagctatgtgcagaactgtgtgaaggagaaccagggcatcctgggcctgcggcagcacctgggcacccccagtgatgaggacaatgacagcagcttcagtgactgcctgagcagccccagcagcagcctgcactttggagacagcgacacagtgaccagtgatgaggacaaggaggtgtctgtgcgccacagccagaccatcctgaatgccaagagccgcagccacagcgcccggagccacaagtggcccaggacagaaacagaatctgtgtctggcctgctgatgaagaggccctgcctgcacggcagcagcctgcggcggctgccctgcaggaagagatttgtgaagaacaacagcagccagaggacccagaagcagaaggagcgcatcctgatgcagaggaagaagcgggaggtgctggcccggaggaaatatgccctgctgcccagcagcagcagcagcagtgaaaatgacctgagcagcgagagcagcagcagcagcagcacagaaggagaggaggacctgtttgtgtctgccagcgagaaccaccagaacaacccagctgtgcccagcggcagcattgatgaagatgtggtggtgattgaggccagcagcaccccccaggtgacagccaatgaggagatcaacgtgaccagcacagacagcgaggtggagatcgtgacagtgggggagagctaccgcagccgcagcaccctgggccacagccgcagccactggagccagggcagcagcagccacgccagccggccccaggagcccaggaacagaagccgcatcagcaccgtcatccagcccctgcggcagaatgctgctgaggtggtggacctgactgtggatgaagatgagcccaccgtggtgcccaccaccagcgccaggatggagagccaggccaccagcgccagcatcaacaacagcaaccccagcaccagcgagcaggccagtgacacagccagcgctgtgaccagcagccagcccagcacagtgtctgagaccagcgccaccctgaccagcaacagcaccaccggcaccagcattggagatgacagcaggaggaccaccagcagcgctgtgacagaaacaggccccccagccatgccccggctgcccagctgctgcccccagcacagcccctgtggcggcagcagccagaaccaccacgccctgggccacccccacaccagctgcttccagcagcacggccaccacttccagcaccaccaccaccaccaccacaccccccaccctgctgtgcctgtgagccccagcttcagtgaccctgcctgccctgtggagcggcccccccaggtgcaggccccctgtggggccaacagcagcagcggcaccagctaccacgagcagcaggccctgcctgtggacctgagcaacagcggcatccgcagccacggcagcggcagcttccatggagccagcgcctttgacccctgctgccctgtgagcagcagcagagctgccatcttcggccaccaggccgctgctgctgcccccagccagcccctgagcagcattgatggctacggcagctccatggtggcccagccccagccccagcccccaccccagcccagcctgagcagctgccgccactacatgcccccaccctatgccagcctgacccggcccctgcaccaccaggccagcgcctgcccccacagccacggcaaccccccaccccagacccagcccccaccccaggtggactatgtgatcccccaccctgtgcacgccttccacagccagatcagcagccacgccaccagccaccctgtggcccctcctccacccacccacctggccagcacagctgcccccatcccccagcacctgccccccacccaccagcccatcagccaccacatcccagccacagcccccccagcccagaggctgcacccccatgaggtgatgcagaggatggaggtgcagaggaggaggatgatgcagcaccccaccggcctgtttgtgttctgtgtgtccagaagagcccacgagcggcccccaccccacccccacaggatgcaccccaactacggccacggccaccacatccacgtgccccagaccatgagcagccacccccggcaggcccctgagaggtctgcctgggagctgggcattgaagctggggtgacagctgccacctacacccctggggccctgcacccccacctggcccactaccacgccccaccccggctgcaccacctgcagctgggcgccctgcccctgatggtgcctgacatggccggctacccccacatccgctacatcagcagcggcctggatggcaccagcttccggggccccttccggggcaactttgaggagctgatccacctggaggagcggctgggcaatgtgaacagaggagccagccagggcaccatcgagcgctgcacctacccccacaagtacaagaagaggaagctgcactgcaagcaggatggagaggagggcacagaggaggacacagaggagaagtgcaccatctgcctgagcatcctggaggagggggaggatgtgcggcggctgccctgcatgcacctgttccaccaggtgtgtgtggaccagtggctgatcaccaacaagaagtgccccatctgccgggtggacatcgaggcccagctgcccagcgagagctag

SEQ ID NO: 22689 - DNA, 1851 bp, Artificial Sequence
  Description of Artificial Sequence: Synthetic coding sequence
atggccggcggccgcggggcccctggccggggcagagatgagcccccagagagctacccccagaggcaggaccacgagctgcaggccctggaggccatctacggggctgacttccaggacctgcggccagatgcctgtggccctgtgaaggagcccccagagatcaacctggtgctgtacccccagggcctgactggagaggaggtgtatgtgaaggtggacctgcgggtgaagtgcccccccacctacccagatgtggtgcctgagattgagctgaagaatgccaagggcctgagcaatgaatctgtgaacctgctgaagagccggctggaggagctggccaagaagcactgtggggaggtgatgatctttgagctggcctaccacgtgcagagcttcctgtctgagcacaacaagcccccacccaagagcttccacgaggagatgctggagcggcgggcccaggaggagcagcagaggctgctggaggccaagaggaaggaggagcaggagcagcgggagatcctgcacgagatccagaggaggaaggaggagatcaaggaggagaagaagaggaaggagatggccaagcaggagcggctggagatcgccagcctgagcaaccaggaccacaccagcaagaaggaccccggcggccacaggacagctgccatcctgcatggaggcagcccagactttgtgggcaatggcaagcaccgggccaacagcagcggccgcagccggcgggagcggcagtacagcgtgtgcaacagcgaggacagccctggcagctgtgagatcctgtacttcaacatgggcagcccagaccagctgatggtgcacaagggcaagtgcatcggcagtgatgagcagctgggcaagctggtgtacaatgccctggagacagccaccggcggctttgtgctgctgtatgagtgggtgctgcagtggcagaagaagatgggccccttcctgaccagccaggagaaggagaagattgacaagtgcaagaagcagatccagggcacagaaacagagttcaacagcctggtgaagctgagccaccccaacgtggtgcgctacctggccatgaacctgaaggagcaggatgacagcatcgtggtggacatcctggtggagcacatctctggagtgtccctggccgcccacctgagccacagcggccccatccctgtgcaccagctgcggcgctacacagcccagctgctgagcggcctggactacctgcacagcaacagcgtggtgcacaaggtgctgagcgccagcaatgtgctggtggatgctgagggcaccgtgaagatcacagactacagcatcagcaagaggctggccgacatctgcaaggaggatgtgtttgagcagaccagggtgcgcttcagtgacaatgccctgccctacaagacaggcaagaagggagatgtgtggaggctgggcctgctgctgctgagcctgagccagggccaggagtgtggggagtaccctgtgaccatccccagcgacctgcctgctgacttccaggacttcctgaagaagtgtgtgtgcctggatgacaaggagcgctggagcccccagcagctgctgaagcacagcttcatcaacccccagcccaagatgcccctggtggagcagagcccagaagattctgagggccaggactatgtggagaccgtcatccccagcaaccggctgcccagcgctgccttcttcagcgagacccagaggcagttcagccgctacttcatcgagtttgaggagctgcagctgctgggcaagggggcctttggagctgtgatcaaggtgtggtacagagtcatccccagccccctgtag

SEQ ID NO: 22690 - DNA, 396 bp, Artificial Sequence
  Description of Artificial Sequence: Synthetic coding sequence
atgagccagtggaccccagagtacaatgagctgtacaccctgaaggtggacatgaagtctgagatccccagtgatgcccccaagacccaggagagcctgaagggcatcctgctgcaccctgagcccatcggggccgccaagagcttccctgctggggtggagatgatcaacagcaaggtgggcaatgagttcagccacctgtgtgatgacagccagaagcaggagaaggagatgaatggaaaccagcaggagcaggagaagagcctggtggtgaggaagaagaggaagagccagcaggccggccccagctatgtgcagaactgtgtgaaggagaaccagggcatcctgggcctgcggcagcacctgggcacccccagtgatgaggacaatgactag

SEQ ID NO: 22691 - DNA, 1863 bp, Artificial Sequence
  Description of Artificial Sequence: Synthetic coding sequence
atggccccagacagcgaccccttccctgagggccccctgctgaagctgctgcccctggatgcccgggaccggggcacccagcgctgccgcctgggccctgctgccctgcacgccctgggcgcccggctgggcagcgctgtgaagatcagcctgcctgatggcggcagctgcctgtgcacagcctggcccaggagagatggagcagatggctttgtgcagctggaccccctgtgtgccagccctggagctgctgtgggcgccagccgcagcagaagaagcctgagcctgaaccggctgctgctggtgccctgcccccccctgcggcgggtggccgtgtggcctgtgctgcgggagcgggccggggcccctggggccaggaacacagctgctgtgctggaggccgcccaggagctgctgaggaaccggcccatcagcctgggccacgtggtggtggcccctcctggggcccctggcctggtggccgccctgcacatcgtgggcggcacccccagcccagaccctgctggcctggtgacccccaggaccagggtgtccctgggcggggagccccccagcgaggcccagccccagcctgaggtgcccctgggcggcctgtctgaggccgctgacagcctgcgggagctgctgcggctgcccctgcgctacccccgggccctgacagccctgggcctggccgtgccccggggcgtgctgctggccggccccccaggagtgggcaagacccagctggtgcgggctgtggcccgggaggccggggctgagctgctggccgtgtctgccccagccctgcagggcagcaggcctggagaaacagaggagaatgtgagaagagtcttccagagggcccgggagctggccagccggggccccagcctgctcttcctggatgagatggatgccctgtgcccccagaggggcagccgggcccctgagagccgggtggtggcccaggtgctgaccctgctggatggagccagcggggaccgggaggtggtggtggtgggcgccaccaacagaccagatgccctggaccctgccctgcggcggcccggccgctttgaccgggaggtggtgattggcacccccaccctgaagcagaggaaggagatcctgcaggtgatcaccagcaagatgcccatcagcagccacgtggacctgggcctgctggccgagatgacagtgggctacgtgggcgctgacctgacagccctgtgccgggaggccgccatgcacgccctgctgcacagcgagaagaaccaggacaaccctgtgattgatgaaattgacttcctggaggccttcaagaacatccagcccagcagcttccgctctgtgattggcctgatggacatcaagcctgtggactgggaggagatcggcggcctggaggatgtgaagctgaagctgaagcagagcattgagtggcccctgaagttcccctgggagtttgtgaggatgggcctgacccagcccaagggcgtgctgctgtatggccccccaggctgtgccaagaccaccctggtgcgggccctggccaccagctgccactgcagctttgtgtctgtgtctggagctgacctcttcagcccctttgtgggggacagcgagaaggtgctgagccagatcttccggcaggcccgggccagcaccccagccatcctcttcctggatgaaattgacagcatcctgggcgcccggagcgccagcaagacaggctgtgatgtgcaggagcgggtgctgtctgtgctgctgaatgagctggatggagtgggcctgaagaccatcgagcggcggggcagcaagagcagccagcagggcaagtacaaggagctgaagaagtag

SEQ ID NO: 22692 - DNA, 4767 bp, Artificial Sequence; identical to SEQ ID NO: 19038
  Description of Artificial Sequence: Synthetic coding sequence

SEQ ID NO: 22693 - DNA, 63 bp, Artificial Sequence
  Description of Artificial Sequence: Synthetic coding sequence
atggccaccatgatcccccctgtgaagctgaagtggctggagcacctgaacagctcctggtag

SEQ ID NO: 22694 - DNA, 4389 bp, Artificial Sequence
  Description of Artificial Sequence: Synthetic coding sequence
atgtaccagccagaagatgacaacaacagtgatgtgaccagtgatgatgacatgaccaggaacagaagagagagcagccccccccacagcgtgcacagcttcagtgaccgggactgggacagaagaggccgcagccgggacatggagccccgggaccgctggagccacaccaggaaccccaggagcaggatgccaccccgggacctgagcctgcctgtggtggccaagaccagctttgagatggaccgggaggatgaccgggacagccgggcctatgagagccgcagccaggatgctgagagctaccagaatgtggtggacctggccgaggacaggaagccccacaacaccatccaggacaacatggagaactacaggaagctgctgagcctggtgcagctggccgaggatgatggccacagccacatgacccagggccacagcagccgcagcaagaggtctgcctaccccagcaccagccggggcctgaagaccatgcctgaggccaagaagagcacccacagaagaggcatctgtgaagatgagagcagccatggagtcatcatggagaagttcatcaaggatgtgagccgcagcagcaagagcggccgggcccgggagagcagtgacaggagccagcgcttccccaggatgtctgatgacaactggaaggacatcagcctgaacaagcgggagagcgtcatccagcagagggtgtatgagggcaatgccttccggggcggcttccgcttcaacagcaccctggtgtccaggaagagggtgctggagaggaagaggcgctaccactttgacacagatggcaagggcagcatccatgaccagaagggctgccccaggaagaagccctttgaatgtggcagcgagatgaggaaggccatgtctgtgagcagcctgagcagcctgagcagccccagcttcacagagagccagcccatcgactttggagccatgccctacgtgtgtgatgaatgtggccgctccttcagcgtcatcagcgagtttgtggagcaccagatcatgcacacccgggagaacctgtatgaatatggagagagcttcatccacagcgtggccgtgtctgaggtgcagaagagccaggtgggcggcaagagatttgagtgcaaggactgtggggagaccttcaacaagtctgctgccctggccgagcacaggaagatccacgcccggggctacctggtggagtgcaagaaccaggagtgtgaggaggccttcatgcccagccccaccttcagcgagctgcagaagatctacggcaaggacaagttctatgagtgccgggtgtgcaaggagaccttcctgcacagcagcgccctgattgagcaccagaagatccactttggagatgacaaggacaatgaaagagagcacgagcgggagcgggagcgggagcggggggagaccttccggcccagccctgccctgaatgagttccagaagatgtatggcaaggagaagatgtatgagtgcaaggtgtgtggggagaccttcctgcacagcagcagcctgaaggagcaccagaagatccacacccggggcaacccctttgagaacaagggcaaggtgtgtgaggagaccttcatccctggccagagcctgaagaggcggcagaagacctacaacaaggagaagctgtgtgacttcacagatggaagagatgccttcatgcagagcagcgagctgtctgagcaccagaagatccacagcaggaagaacctgtttgagggccggggctatgagaagagcgtcatccacagcggccccttcacagagagccagaagagccacaccatcacccggcccctggagagtgatgaagatgagaaggccttcaccatcagcagcaacccctatgagaaccagaagatccccaccaaggaaaatgtgtatgaggccaagagctatgaaagaagtgtcatccacagcctggcctctgtggaggcccagaagagccacagcgtggccggccccagcaagcccaaggtgatggccgagagcaccatccagagctttgatgccatcaaccaccagagggtgcgggccggcggcaacaccagcgagggccgggagtacagccgcagcgtcatccacagcctggtggccagcaagcccccaagaagccacaatggaaatgagctggtggagagcaatgagaagggggagagcagcatctacatcagtgacctgaatgacaagaggcagaagatcccagcccgggagaacccctgtgagggcggcagcaagaacagaaattatgaggacagcgtcatccagagcgtcttccgggccaagccccagaagtctgtgcctggagagggcagcggggagttcaagaaggatggagagttctctgtgcccagcagcaatgtgcgggagtaccagaaggcccgggccaagaagaagtacatcgagcacaggagcaatgagaccagcgtcatccacagcctgccctttggagagcagaccttccggccccggggcatgctgtatgagtgccaggagtgtggggagtgctttgcccacagcagtgacctgacagagcaccagaagatccatgaccgggagaagcccagcggcagcaggaactatgagtggagcgtcatccgcagcctggcccccacagacccccagaccagctatgcccaggagcagtatgccaaggagcaggccaggaacaagtgcaaggacttccggcagttctttgccaccagcgaggacctgaacaccaaccagaagatctatgaccaggagaagagccatggagaggagagccagggcgagaacacagatggagaggagacccacagcgaggagacccacggccaggagaccattgaagatcctgtgatccagggcagtgacatggaggacccccagaaggatgatcctgatgacaagatctatgaatgtgaggactgtggcctgggctttgtggacctgacagacctgacagaccaccagaaggtgcacagcaggaagtgcctggtggacagccgggagtacacccacagcgtcatccacacccacagcatcagcgagtaccagagggactacaccggggagcagctgtatgagtgccccaagtgtggggagagcttcatccacagcagcttcctgtttgagcaccagagaattcatgagcaggaccagctgtacagcatgaagggctgtgatgatggcttcatcgccctgctgcccatgaagcccaggaggaacagagctgctgagaggaacccagccctggccggcagcgccatccgctgcctgctgtgtggccagggcttcatccacagcagcgccctgaatgagcacatgaggctgcacagagaagatgacctgctggagcagagccagatggccgaggaggccatcatccctggcctggccctgacagagttccagaggagccagacagaggagcggctgtttgaatgtgctgtgtgtggggagagctttgtgaacccagctgagctggccgaccacgtgacagtgcacaagaatgagccctatgaatatggcagcagctacacccacaccagcttcctgacagagcccctgaagggggccatccccttctatgagtgcaaggactgtgggaagagcttcatccacagcacagtgctgaccaagcacaaggagctgcacctggaggaggaggaggaggatgaagctgctgctgctgctgctgctgctgcccaggaggtggaggccaacgtgcacgtgccccaggtggtgctgcgcatccagggcctgaatgtggaggccgctgagcctgaggtggaggccgctgagcctgaggtggaggccgctgagcctgaggtggaggccgctgagcccaatggagaggccgagggcccagatggagaggccgctgagcccatcggggaggccggccagcccaacggggaggccgagcagcccaatggagatgctgatgagccagatggagctggcattgaagatcctgaggagagagctgaggagcctgagggcaaggccgaggagccagaaggagatgctgatgagccagatggagtgggcatcgaggaccctgaggagggggaggaccaggagatccaggtggaggagccctactatgactgccatgaatgtacagagaccttcaccagcagcacagccttcagcgagcacctgaagacccacgcctccatgatcatctttgagcccgccaatgcctttggagaatgttctggctacatcgagcgggccagcaccagcactggaggagccaaccaggctgatgagaagtacttcaagtgtgatgtgtgtggccagctgttcaatgaccggctgagcctggcccggcaccagaacacccacactggatag

SEQ ID NO: 22695 - DNA, 438 bp, Artificial Sequence
  Description of Artificial Sequence: Synthetic coding sequence
atggccaccatgatcccccctgtgaagctgaagtggctggagcacctgaacagctcctggatcacagaagattctgagagcatcgccacccgggagggcgtggccgtgctgtacagcaagctggtgagcaacaaggaggtggtgcccctgccccagcaggtgctgtgcctgaagggcccccagctgcctgactttgagcgggagagcctgagcagtgatgagcaggaccactacctggatgccctgctgagcagccagctggccctggccaagatggtgtgcagcgacagcccctttgctggggccctgaggaagaggctgctggtgctgcagagggtcttctacgccctgagcaacaagtaccatgacaagggcaaggtgaagcagcagcagcacagccctgagagcagcagcggcagcgcagatgtgcacagctag

SEQ ID NO: 22696 - DNA, 4284 bp, Artificial Sequence
  Description of Artificial Sequence: Synthetic coding sequence
tgagccaagcaggagcggctggagatcgccagcctgagcaaccaggaccacaccagcaagaaggaccccggcggccacaggacagctgccatcctgcatggaggcagcccagactttgtgggcaatggcaagcaccgggccaacagcagcggccgcagccggcgggagcggcagtacagcgtgtgcaacagcgaggacagccctggcagctgtgagatcctgtacttcaacatgggcagcccagaccagctgatggtgcacaagggcaagtgcatcggcagtgatgagcagctgggcaagctggtgtacaatgccctggagacagccaccggcggctttgtgctgctgtatgagtgggtgctgcagtggcagaagaagatgggccccttcctgaccagccaggagaaggagaagattgacaagtgcaagaagcagatccagggcacagaaacagagttcaacagcctggtgaagctgagccaccccaacgtggtgcgctacctggccatgaacctgaaggagcaggatgacagcatcgtggtggacatcctggtggagcacatctctggagtgtccctggccgcccacctgagccacagcggccccatccctgtgcaccagctgcggcgctacacagcccagctgctgagcggcctggactacctgcacagcaacagcgtggtgcacaaggtgctgagcgccagcaatgtgctggtggatgctgagggcaccgtgaagatcacagactacagcatcagcaagaggctggccgacatctgcaaggaggatgtgtttgagcagaccagggtgcgcttcagtgacaatgccctgccctacaagacaggcaagaagggagatgtgtggaggctgggcctgctgctgctgagcctgagccagggccaggagtgtggggagtaccctgtgaccatccccagcgacctgcctgctgacttccaggacttcctgaagaagtgtgtgtgcctggatgacaaggagcgctggagcccccagcagctgctgaagcacagcttcatcaacccccagcccaagatgcccctggtggagcagagcccagaagattctgagggccaggactatgtggagaccgtcatccccagcaaccggctgcccagcgctgccttcttcagcgagacccagaggcagttcagccgctacttcatcgagtttgaggagctgcagctgctgggcaagggggcctttggagctgtgatcaaggtgcagaacaagctggatggctgctgctatgctgtgaagaggatccccatcaacccagccagccggcagttccgccgcatcaagggggaggtgaccctgctgagccggctgcaccacgagaacatcgtgcgctactacaatgcctggattgaaagacatgagaggcctgctggccctggcaccccacctccagacagcggccccctggccaaggatgacagagctgcccggggccagcctgccagtgacacagatggcctggacagcgtggaggccgccgcccccccacccatcctgagcagctctgtggagtggagcaccagcggggagaggtctgccagcgcccgcttccctgccaccggccctggcagcagtgatgatgaagatgatgatgaagatgaacatggaggagtcttcagccagagcttcctgcctgccagtgacagcgagagtgacatcatctttgacaatgaagatgagaacagcaagagccagaaccagatggagtactgtgagaagagcaccctgcgggacaccatcgaccagggcctgtacagagacacagtgcggctgtggaggctcttccgggagatcctggatggcctggcctacatccacgagaagggcatgatccaccgggacctgaagcctgtgaacatcttcctggacagtgatgaccacgtgaagatcggggactttggcctggccacagaccacctggccttctctgctgacagcaagcaggatgaccagacaggagacctgatcaagagtgaccccagcggccacctgaccggcatggtgggcacagccctgtatgtgtccccagaggtgcagggcagcaccaagagcgcctacaaccagaaggtggacctcttcagcctgggcatcatcttctttgagatgagctaccaccccatggtgacagccagcgagcgcatctttgtgctgaaccagctgcgggaccccaccagccccaagtttcctgaggactttgatgatggagaacatgccaagcagaagagcgtcatctcctggctgctgaaccacgaccctgccaagaggcccacagccacagagctgctgaagtctgagctgctgcccccaccccagatggaggagagcgagctgcacgaggtgctgcaccacaccctgaccaacgtggatggcaaggcctaccgcaccatgatggcccagatcttcagccagaggatcagccctgccatcgactacacctatgacagcgacatcctgaagggcaacttcagcatcagaacagccaagatgcagcagcacgtgtgtgagaccatcatccgcatcttcaagagacatggagctgtgcagctgtgcacccccctgctgctgcccaggaaccggcagatctatgagcacaatgaagctgccctcttcatggaccacagcggcatgctggtgatgctgccctttgacctgcgcatcccctttgcccgctacgtggccaggaacaacatcctgaacctgaagcgctactgcatcgagagggtcttccggcccaggaagctggaccgcttccaccccaaggagctgctggagtgtgcctttgatattgtgaccagcaccaccaacagcttcctgcccacagctgagatcatctacaccatctatgagatcatccaggagttccctgccctgcaggagaggaactacagcatctacctgaaccacaccatgctgctgaaggccatcctgctgcactgcggcatccctgaggacaagctgagccaggtgtacatcatcctgtatgatgctgtgacagagaagctgacccggcgggaggtggaggccaagttctgcaacctgagcctgagcagcaacagcctgtgccgcctgtacaagttcatcgagcagaagggggacctgcaggacctgatgcccaccatcaacagcctcatcaagcagaagacaggcatcgcccagctggtgaagtatggcctgaaggacctggaggaggtggtgggcctgctgaagaagctgggcatcaagctgcaggtgctgatcaacctgggcctggtgtacaaggtgcagcagcacaacggcatcatcttccagtttgtggccttcatcaagaggcggcagagagctgtgcctgagatcctggccgccggcggccgctatgacctgctgatcccccagttccggggcccccaggccctgggccctgtgcccacagccatcggcgtgtccatcgccatcgacaagatctctgctgctgtgctgaacatggaggagagcgtgaccatcagcagctgtgacctgctggtggtgtctgtgggccagatgtccatgagccgggccatcaacctgacccagaagctgtggacagctggcatcacagctgagatcatgtatgactggagccagagccaggaggagctgcaggagtactgccgccaccacgagatcacctacgtggccctggtgtctgacaaggagggcagccacgtgaaggtgaagagctttgagaaggagcggcagacagagaagagggtgctggagacagagctggtggaccacgtgctgcagaagctgcggaccaaggtgacagatgaaagaaatggccgggaggccagtgacaacctggccgtgcagaacctgaagggcagcttcagcaatgccagcggcctgtttgagatccacggggccaccgtggtgcccatcgtgtctgtgctggcccctgagaagctgagcgccagcacccggcggcgctatgagacccaggtgcagacccggctgcagaccagcctggccaacctgcaccagaagagcagcgagattgagatcctggccgtggacctgcccaaggagaccatcctgcagttcctgagcctggagtgggatgctgatgagcaggccttcaacaccaccgtgaagcagctgctgagccggctgcccaagcagcgctacctgaagctggtgtgtgatgagatctacaacatcaaggtggagaagaaggtgtctgtgctcttcctgtacagctacagagatgactactaccgcatcctcttctag

SEQ ID NO: 22697 - DNA, 4767 bp, Artificial Sequence; identical to SEQ ID NO: 19038
  Description of Artificial Sequence: Synthetic coding sequence

SEQ ID NO: 22698 - DNA, 3012 bp, Artificial Sequence; identical to SEQ ID NO: 21236
  Description of Artificial Sequence: Synthetic coding sequence

SEQ ID NO: 22699 - DNA, 150 bp, Artificial Sequence
  Description of Artificial Sequence: Synthetic coding sequence
atggccctgccccatgacagcaatgagaccagctacctgctgccccccaacaatgaagactggggccggcagaccatcccagactttgtgtatggccagaaggacctgatggccgagggcatccagtggcccagaaatgcccctggatag

SEQ ID NO: 22700 - DNA, 375 bp, Artificial Sequence; identical to SEQ ID NO: 19268
  Description of Artificial Sequence: Synthetic coding sequence

SEQ ID NO: 22701 - DNA, 93 bp, Artificial Sequence
  Description of Artificial Sequence: Synthetic coding sequence
atggccacagacagctgggccctggccgtggatgagcaggaggccgctgctgagagcaggacagagctgcccagcccctacagcaccagctag

SEQ ID NO: 22702 - DNA, 804 bp, Artificial Sequence; identical to SEQ ID NO: 21120
  Description of Artificial Sequence: Synthetic coding sequence

SEQ ID NO: 22703 - DNA, 1113 bp, Artificial Sequence; identical to SEQ ID NO: 20376
  Description of Artificial Sequence: Synthetic coding sequence

SEQ ID NO: 22704 - DNA, 2712 bp, Artificial Sequence
  Description of Artificial Sequence: Synthetic coding sequence
atggccaccagcgctgacagccccagcagccccctgggcgctgaggacctgctgagtgacagcagcgagcccccaggcctgaaccaggtgagcagcgaggtgaccagccagctgtatgccagcctgcggctgagccggcaggccgaggccacagcccgggcccagctgtacctgcccagcaccagcccccctcatgagggcctggatggctttgcccaggagctgagccgcagcctgtctgtgggcctggagaagaacctgaagaagaaggatggcagcaagcacatctttgagatggagagcgtgcggggccagctgcagaccatgctgcagaccagccgggacacagcctacagagaccccctcatccctggggccggcagcgagcggcgggaggaggacagctttgacagcgacagcacagccaccctgctgaacacccggcccctgcaggacctgagccccagcagcagcgcccaggccctggaggagctgttcccccgctacaccagcctgcggcccggcccccccctgaaccccccagacttccagggcctgagagatgccctggacagcgagcacaccaggaggaagcactgtgagcggcacatccagagcctgcagaccagggtgctggagctgcagcagcagctggccgtggccgtggccgctgacaggaagaaggacaccatgattgagcagctggacaagaccctggcccgggtggtggagggctggaacagacatgaagctgagaggacagaggtgctgcggggcctgcaggaggagcaccaggccgctgagctgaccaggagcaagcagcaggagaccgtgacccggctggagcagagcctgtctgaggccatggaggccctgaaccgggagcaggagagcgcccggctgcagcagcgggagcgggagaccctggaggaggagcggcaggccctgaccctgcggctggaggccgagcagcagcgctgctgcgtgctgcaggaggagagagatgctgcccgggccggccagctgtctgagcaccgggagctggagaccctgcgggccgccctggaggaggagcggcagacctgggcccagcaggagcaccagctgaaggagcactaccaggccctgcaggaggagagccaggcccagctggagcgggagaaggagaagagccagcgggaggcccaggccgcctgggagacccagcaccagctggccctggtgcagagcgaggtgcggcggctggagggggagctggacacagcccggcgggagagagatgccctgcagctggagatgagcctggtgcaggcccgctatgagagccagaggatccagctggagagcgagctggccgtgcagctggagcagagggtgacagagcggctggcccaggcccaggagagcagcctgcggcaggccgccagcctgcgggagcaccacaggaagcagctgcaggacctgagcggccagcaccagcaggagctggccagccagctggcccagttcaaggtggagatggccgagcgggaggagcggcagcagcaggtggctgaagattatgagctgcggctggcccgggagcaggcccgggtgtgtgagctgcagagcggcaaccagcagctggaggagcagagggtggagctggtggagcggctgcaggccatgctgcaggcccactgggatgaggccaaccagctgctgagcaccaccctgcccccacccaaccccccagcccccccagctggccccagcagccctggcccccaggagcctgagaaggaggagaggagagtgtggaccatgccacccatggctgtggccctgaagcctgtgctgcagcagagccgggaggccagagatgagctgcccggggcccctcctgtgctgtgcagcagcagcagtgacctgagcctgctgctgggccccagcttccagagccagcacagcttccagcccctggagcccaagccagacctgaccagcagcacagctggggccttcagcgccctgggcgccttccacccagaccacagagctgagcggcccttcccagaagaagatcctggcccagatggagagggcctgctgaagcagggcctgcccccagcccagctggagggcctgaagaacttcctgcaccagctgctggagaccgtgccccagaacaatgaaaaccccagcgtggacctgctgccccccaagagcggccccctgactgtgcccagctgggaggaggccccccaggtgccccgcatccccccacctgtgcacaagaccaaggtgcccctggccatggccagcagcctcttccgggtgcctgagccccccagcagccacagccagggcagcggccccagcagcggcagccctgagagaggaggagatggcctgaccttcccccggcagctgatggaggtgtcccagctgctgcggctgtaccaggcccggggctggggcgccctgcctgctgaggacctgctgctgtacctgaagaggctggagcacagcggcacagatggccgcggggacaacgtgcccaggaggaacacagacagccggctgggggagatccccaggaaggagatccccagccaggccgtgccccggcggctggccacagcccccaagacagagaagcccccagccaggaagaagagcggccacccagcccccagctccatgaggagcagaggaggagtgtggaggtag

SEQ ID NO: 22705 - DNA, 138 bp, Artificial Sequence
  Description of Artificial Sequence: Synthetic coding sequence
atgcccctgctggtggagggccggcgggtgcggctgccccagagcgctggggacctggtgcgggcccacccccccctggaggcccccagccccttctgggtgctgatgatgcccctgctggtgaccctgtggagctag

SEQ ID NO: 22706 - DNA, 1083 bp, Artificial Sequence; identical to SEQ ID NO: 18837
  Description of Artificial Sequence: Synthetic coding sequence

SEQ ID NO: 22707 - DNA, 1353 bp, Artificial Sequence; identical to SEQ ID NO: 18425
  Description of Artificial Sequence: Synthetic coding sequence

SEQ ID NO: 22708 - DNA, 1113 bp, Artificial Sequence; identical to SEQ ID NO: 20376
  Description of Artificial Sequence: Synthetic coding sequence

SEQ ID NO: 22709 - DNA, 738 bp, Artificial Sequence
  Description of Artificial Sequence: Synthetic coding sequence
atgggcggcggctatgacctgaacctgtttgccagccccccagacagcaactttgtgtgcagcgtgtgccacggcgtgctgaagaggcctgcccggctgccctgcagccacatcttctgcaagaagtgcatcctgcgctggctggcccggcagaagacctgcccctgctgcaggaaggaggtgaagaggaagaaggtggtgcacatgaacaagctgaggaagaccatcggccgcctggaggtgaagtgcaagaatgctgatgctggctgcatcgtgacctgccccctggcccacaggaagggccaccaggacagctgcccctttgagctgacagcctgccccaatgaaggctgcaccagccaggtgccccggggcaccctggccgagcaccggcagcactgccagcagggcagccagcagcgctgccccctgggctgtggggccaccctggaccctgctgagcgggcccggcacaactgctaccgggagctgcacaatgcctggagcgtgcggcaggagaggagaagacccctgctgctgagcctgctgcggcgggtgcgctggctggaccaggccacctctgtggtgagaagagagctggccgagctgagcaacttcctggaggaggacacagccctgctggagggcgccccccaggaggaggccgaggccgcccctgagggcaatgtgggcgctgaggtggtgggggagccccgggccaacatcccctgcaagtag

SEQ ID NO: 22710 - DNA, 309 bp, Artificial Sequence; identical to SEQ ID NO: 19549
  Description of Artificial Sequence: Synthetic coding sequence

SEQ ID NO: 22711 - DNA, 1473 bp, Artificial Sequence; identical to SEQ ID NO: 20500
  Description of Artificial Sequence: Synthetic coding sequence

SEQ ID NO: 22712 - DNA, 1809 bp, Artificial Sequence; identical to SEQ ID NO: 19244
  Description of Artificial Sequence: Synthetic coding sequence

SEQ ID NO: 22713 - DNA, 618 bp, Artificial Sequence; identical to SEQ ID NO: 20195
  Description of Artificial Sequence: Synthetic coding sequence

SEQ ID NO: 22714 - DNA, 360 bp, Artificial Sequence; identical to SEQ ID NO: 19407
  Description of Artificial Sequence: Synthetic coding sequence

SEQ ID NO: 22715 - DNA, 1473 bp, Artificial Sequence
  Description of Artificial Sequence: Synthetic coding sequence
atgcccatgcccacagagggcaccccaccacccctgagcggcacccccatccctgtgcctgcctacttcagacatgctgagcccggcttcagcctgaagaggccccggggcctgagccgcagcctgcccccacctcctccagccaagggcagcatccccatcagccgcctcttcccccccaggaccccaggctggcaccagctgcagcccaggagagtgtccttccggggggaggccagcgagaccctgcagagccctggctatgaccccagcaggcctgagagcttcttccagcagagcttccagaggctgagccggctgggccacggcagctatggagaggtgttcaaggtgcgcagcaaggaggatggccgcctgtatgctgtgaagaggtccatgagccccttccggggccccaaggaccgggccaggaagctggccgaggtgggcagccatgagaaggtgggccagcacccctgctgcgtgcggctggagcaggcctgggaggagggcggcatcctgtacctgcagacagagctgtgtggccccagcctgcagcagcactgtgaggcctggggcgccagcctgcctgaggcccaggtgtggggctacctgcgggacaccctgctggccctggcccacctgcacagccagggcctggtgcacctggatgtgaagccagccaacatcttcctgggcccccggggccgctgcaagctgggggactttggcctgctggtggagctgggcacagctggggccggggaggtgcaggagggggacccccgctacatggcccctgagctgctgcagggcagctatggaacagctgctgatgtgttcagcctgggcctgaccatcctggaggtggcctgcaacatggagctgccccacggcggggagggctggcagcagctgcggcagggctacctgcccccagagttcaccgctggcctgagcagcgagctgcggtctgtgctggtgatgatgctggagccagaccccaagctgcgggccacagctgaggccctgctggccctgcctgtgctgcggcagccccgggcctggggcgtgctgtggtgcatggctgctgaggccctgagccggggctgggccctgtggcaggccctgctggccctgctgtgctggctgtggcacggcctggcccacccagcctcctggctgcagcccctgggccccccagccaccccacctggcagccccccctgcagcctgctgctggacagcagcctgagcagcaactgggatgatgacagcctgggccccagcctgagccctgaggccgtgctggccaggacagtgggcagcaccagcacccccaggagccgctgcaccccaagagatgccctggacctgagtgacatcaacagcgagcccccccggggcagcttccccagctttgagcccaggaacctgctgagcctgtttgaggacaccctggaccccacctag

SEQ ID NO: 22716 - DNA, 1293 bp, Artificial Sequence
  Description of Artificial Sequence: Synthetic coding sequence
atgctggagcgctggcaccagctgcagcccaggagagtgtccttccggggggaggccagcgagaccctgcagagccctggctatgaccccagcaggcctgagagcttcttccagcagagcttccagaggctgagccggctgggccacggcagctatggagaggtgttcaaggtgcgcagcaaggaggatggccgcctgtatgctgtgaagaggtccatgagccccttccggggccccaaggaccgggccaggaagctggccgaggtgggcagccatgagaaggtgggccagcacccctgctgcgtgcggctggagcaggcctgggaggagggcggcatcctgtacctgcagacagagctgtgtggccccagcctgcagcagcactgtgaggcctggggcgccagcctgcctgaggcccaggtgtggggctacctgcgggacaccctgctggccctggcccacctgcacagccagggcctggtgcacctggatgtgaagccagccaacatcttcctgggcccccggggccgctgcaagctgggggactttggcctgctggtggagctgggcacagctggggccggggaggtgcaggagggggacccccgctacatggcccctgagctgctgcagggcagctatggaacagctgctgatgtgttcagcctgggcctgaccatcctggaggtggcctgcaacatggagctgccccacggcggggagggctggcagcagctgcggcagggctacctgcccccagagttcaccgctggcctgagcagcgagctgcggtctgtgctggtgatgatgctggagccagaccccaagctgcgggccacagctgaggccctgctggccctgcctgtgctgcggcagccccgggcctggggcgtgctgtggtgcatggctgctgaggccctgagccggggctgggccctgtggcaggccctgctggccctgctgtgctggctgtggcacggcctggcccacccagcctcctggctgcagcccctgggccccccagccaccccacctggcagccccccctgcagcctgctgctggacagcagcctgagcagcaactgggatgatgacagcctgggccccagcctgagccctgaggccgtgctggccaggacagtgggcagcaccagcacccccaggagccgctgcaccccaagagatgccctggacctgagtgacatcaacagcgagcccccccggggcagcttccccagctttgagcccaggaacctgctgagcctgtttgaggacaccctggaccccacctag

SEQ ID NO: 22717 - DNA, 666 bp, Artificial Sequence; identical to SEQ ID NO: 19418
  Description of Artificial Sequence: Synthetic coding sequence

SEQ ID NO: 22718 - DNA, 2232 bp, Artificial Sequence; identical to SEQ ID NO: 22521
  Description of Artificial Sequence: Synthetic coding sequence

SEQ ID NO: 22719 - DNA, 579 bp, Artificial Sequence
  Description of Artificial Sequence: Synthetic coding sequence
atgagcacagctgctgtgcctgagctgaagcagatcagccgggtggaggccatgaggctgggccctggctggagccacagctgccacgccatgctgtatgctgccaaccctggccagctgtttggccgcatccccatgaggttctctgtgctgatgcagatgagatttgatggcctgctgggcttccctgggggctttgtggaccggcgcttctggagcctggaggatggcctgaacagagtgctgggcctgggcctgggctgcctgcggctgacagaggccgactacctgagcagccacctgacagagggcccccaccgggtggtggcccacctgtatgcccggcagctgaccctggagcagctgcatgctgtggagatctctgctgtgcacagccgggaccacggcctggaggtgggccccccacctggcccccggcccccaccccggggcctggccctggccccctggaaggcccccatgggcgccggccccagggctggccctgctgtgcaccctgagggccccagccggcggctgccccagctgcctgagcagaggctgcgggagcacggctag

SEQ ID NO: 22720 - DNA, 2553 bp, Artificial Sequence
  Description of Artificial Sequence: Synthetic coding sequence
atgctggagcggcgggccctgctgtggcagcgggaggccggccctggctggggagaccgggcccgggccggcactggaggagctgggggcggctgcggcggggccatggccgagcggggccctgccttctgtggcctgtatgacaccagcagcctgctgcgctactgcaatgatgacaacctgagcggcaccagcggcatggaggtggatgacagagtgtctgccctggagcagaggctgcagctgcaggaggatgagctggccgtgctgaaggccgccctggctgatgccctgcggcggctgcgggcctgtgaggagcagggcgccgccctgcgggcccggggcacccccaagggccgggccccaccccggctgggcaccacagcctctgtgtgccagctgctgaagggcctgcccaccaggacccccctgaatggaagtggccccccaagaagagtgggcggctacgccaccagccccagcagccccaagaaggaggccaccagcggccgcagctctgtgcggcgctacctgagccctgagcggctggcctctgtgagaagagaggaccccaggagcaggaccaccagcagcagcagcaactgcagcgccaagaaggagggcaagaccaaggaggtgatcttctctgtggaggatggctctgtgaagatgttcctgcggggccggcctgtgcccatgatgatcccagatgagctggcccccacctacagcctggacaccaggtctgagctgcccagctgccgcctgaagctggagtgggtgtatggctaccggggccgggactgccgggccaacctgtacctgctgcccaccggggagatcgtgtactttgtggcctctgtggccgtgctgtacagcgtggaggagcagaggcagaggcactacctgggccacaatgatgacatcaagtgcctggccatccacccagacatggtgaccatcgccaccggccaggtggccggcaccaccaaggagggcaagcccctgccccctcatgtgcgcatctgggacagcgtgtccctgagcaccctgcacgtgctgggcctgggcgtgtttgacagagctgtgtgctgcgtgggcttcagcaagagcaatggaggcaacctgctgtgtgctgtggatgagagcaatgaccacatgctgtctgtgtgggactgggccaaggagaccaaggtggtggatgtgaagtgcagcaatgaggccgtgctggtggccaccttccaccccacagaccccaccgtgctgatcacctgtgggaagagccacatctacttctggaccctggagggcggcagcctgagcaagaggcagggcctgtttgagaagcatgagaagcccaagtatgtgctgtgtgtgaccttcctggagggcggagatgtggtgactggagacagcggcggcaacctgtatgtgtggggcaaaggaggcaaccgcatcacccaggccgtgctgggcgcccatgatggaggagtgtttggcctgtgtgccctgagagatggcaccctggtgtctgggggcggccgggacagaagagtggtgctgtggggcagtgactacagcaagctgcaggaggtggaggtgcctgaggactttggacctgtgaggacagtggccgagggccacggggacaccctgtatgtgggcaccaccaggaacagcatcctgcagggctctgtgcacacaggcttcagcctgctggtgcagggccacgtggaggagctgtggggcctggccacccaccccagccgggcccagtttgtgacctgtggccaggacaagctggtgcacctgtggagcagtgacagccaccagcccctgtggagccgcatcattgaagatcctgcccggtctgctggcttccaccccagcggctctgtgctggccgtgggcaccgtgacaggccgctggctgctgctggacacagagacccatgacctggtggccatccacacagatggaaatgagcagatctctgtggtgtccttctccccagatggagcctacctggccgtgggcagccatgacaacctggtgtatgtgtacacagtggaccagggcggcaggaaggtgtcccggctgggcaagtgcagcggccacagcagcttcatcacccacctggactgggcccaggacagcagctgctttgtgaccaacagcggggactatgagatcctgtactgggaccctgccacctgcaagcagatcaccagcgcagatgctgtgaggaacatggagtgggccacagccacctgtgtgctgggcttcggcgtgtttggcatctggagcgagggcgcagatggaacagacatcaatgctgtggcccggagccatgatggcaagctgctggccagcgcagatgactttgggaaggtgcacctgttctcctacccctgctgccagccccgggccctgagccacaagtatggaggccacagcagccacgtgaccaacgtggccttcctgtgggatgacagcatggccctgaccactggaggcaaggacacctctgtgctgcagtggagggtggtgtag

SEQ ID NO: 22721 - DNA, 2502 bp, Artificial Sequence; identical to SEQ ID NO: 21332
  Description of Artificial Sequence: Synthetic coding sequence

SEQ ID NO: 22722 - DNA, 3351 bp, Artificial Sequence; identical to SEQ ID NO: 19573
  Description of Artificial Sequence: Synthetic coding sequence

SEQ ID NO: 22723 - DNA, 2055 bp, Artificial Sequence; identical to SEQ ID NO: 19471
  Description of Artificial Sequence: Synthetic coding sequence

SEQ ID NO: 22724 - DNA, 378 bp, Artificial Sequence
  Description of Artificial Sequence: Synthetic coding sequence
atggctgatgaggagctggaggccctgcggcggcagaggctggccgagctgcaggccaagcatggagaccctggagatgctgcccagcaggaggccaagcaccgggaggccgagatgaggaacagcatcctggcccaggtgctggaccagagcgcccgggcccggctgagcaacctggccctggtgaagccagagaagaccaaggctgtggagaactacctgatccagatggcccgctatggccagctgtctgagaaggtgtctgagcagggcctgattgagatcctgaagaaggtgtcccagcagacagagaagaccaccaccgtgaagttcaacagaaggaaggtgatggacagtgatgaagatgatgactactag

SEQ ID NO: 22725 - DNA, 3327 bp, Artificial Sequence; identical to SEQ ID NO: 19236
  Description of Artificial Sequence: Synthetic coding sequence

SEQ ID NO: 22726 - DNA, 594 bp, Artificial Sequence; identical to SEQ ID NO: 21015
  Description of Artificial Sequence: Synthetic coding sequence

SEQ ID NO: 22727 - DNA, 906 bp, Artificial Sequence; identical to SEQ ID NO: 19231
  Description of Artificial Sequence: Synthetic coding sequence

SEQ ID NO: 22728 - DNA, 990 bp, Artificial Sequence; identical to SEQ ID NO: 19529
  Description of Artificial Sequence: Synthetic coding sequence

SEQ ID NO: 22729 - DNA, 1263 bp, Artificial Sequence
  Description of Artificial Sequence: Synthetic coding sequence
atgctgagcagcttccctgtggtgctgctggagaccatgagccactacacagatgagccccgcttcaccatcgagcagattgacctgctgcagaggctgcggaggacaggcatgaccaagcatgagatcctgcacgccctggagaccctggaccggctggaccaggagcacagcgacaagtttggaagaagaagcagctatggaggcagcagctatggcaacagcaccaacaacgtgcctgccagcagcagcacagccacagccagcacccagacccagcacagcggcatgagccccagccccagcaacagctatgacaccagcccccagccctgcaccaccaaccagaatggccgggagaacaatgaaaggctgagcaccagcaatggcaagatgagccccacccgctaccacgccaacagcatgggccagaggagctacagctttgaggccagcgaggaggacctggatgtggatgacaaggtggaggagctgatgagaagagacagcagcgtcatcaaggaggagatcaaggccttcctggccaacagacgcatcagccaggccgtggtggcccaggtgacaggcatcagccagagccgcatcagccactggctgctgcagcagggcagtgacctgtctgagcagaagaagagggccttctaccgctggtaccagctggagaagaccaaccctggggccaccctgtccatgaggcctgcccccatccccatcgaggaccctgagtggaggcagaccccacctcctgtgtctgccaccagcggcaccttccggctgcggcggggcagccgcttcacctggaggaaagaatgtctggccgtgatggagagctacttcaatgaaaaccagtacccagatgaggccaagcgggaggagatcgccaatgcctgcaatgctgtgatccagaagccaggcaagaagctgagtgacctggagcgggtgaccagcctgaaggtgtacaactggtttgccaacagaaggaaggagatcaagagaagagccaacattgaagctgccatcctggagagccatggaattgatgtgcagagccctgggggccacagcaacagtgatgatgtggatggaaatgactacagcgagcaggatgacagcaccagccacagcgaccaccaggaccccatcagcctggccgtggagatggctgctgtgaaccacaccatcctggccctggcccggcagggcgccaatgagatcaagacagaggccctggatgatgactag

SEQ ID NO: 22730 - DNA, 1263 bp, Artificial Sequence; identical to SEQ ID NO: 22729
  Description of Artificial Sequence: Synthetic coding sequence

SEQ ID NO: 22731 - DNA, 915 bp, Artificial Sequence
  Description of Artificial Sequence: Synthetic coding sequence
atgctgagcagcttccctgtggtgctgctggagaccatgagccactacacagatgagccccgcttcaccatcgagcagattgacctgctgcagaggctgcggaggacaggcatgaccaagcatgagatcctgcacgccctggagaccctggaccggctggaccaggagcacagcgacaagtttggaagaagaagcagctatggaggcagcagctatggcaacagcaccaacaacgtgcctgccagcagcagcacagccacagccagcacccagacccagcacagcggcatgagccccagccccagcaacagctatgacaccagcccccagccctgcaccaccaaccagaatggccgggagaacaatgaaaggctgagcaccagcaatggcaagatgagccccacccgctaccacgccaacagcatgggccagaggagctacagctttgaggccagcgaggaggacctggatgtggatgacaaggtggaggagctgatgagaagagacagcagcgtcatcaaggaggagatcaaggccttcctggccaacagacgcatcagccaggccgtggtggcccaggtgacaggcatcagccagagccgcatcagccactggctgctgcagcagggcagtgacctgtctgagcagaagaagagggccttctaccgctggtaccagctggagaagaccaaccctggggccaccctgtccatgaggcctgcccccatccccatcgaggaccctgagtggaggcagaccccacctcctgtgtctgccaccagcggcaccttccggctgcggcggggcagccgcttcacctggaggaaagaatgtctggccgtgatggagaggaacacctggagccctgagaggaggatggaggagaacaagtggaagctgctgtctgctggatag

SEQ ID NO: 22732 - DNA, 1332 bp, Artificial Sequence
  Description of Artificial Sequence: Synthetic coding sequence
atgctgagcagcttccctgtggtgctgctggagaccatgagccactacacagatgagccccgcttcaccatcgagcagattgacctgctgcagaggctgcggaggacaggcatgaccaagcatgagatcctgcacgccctggagaccctggaccggctggaccaggagcacagcgacaagtttggaagaagaagcagctatggaggcagcagctatggcaacagcaccaacaacgtgcctgccagcagcagcacagccacagccagcacccagacccagcacagcggcatgagccccagccccagcaacagctatgacaccagcccccagccctgcaccaccaaccagaatggccgggagaacaatgaaaggctgagcaccagcaatggcaagatgagccccacccgctaccacgccaacagcatgggccagaggagctacagctttgaggccagcgaggaggacctggatgtggatgacaaggtggaggagctgatgagaagagacagcagcgtcatcaaggaggagatcaaggccttcctggccaacagacgcatcagccaggccgtggtggcccaggtgacaggcatcagccagagccgcatcagccactggctgctgcagcagggcagtgacctgtctgagcagaagaagagggccttctaccgctggtaccagctggagaagaccaaccctggggccaccctgtccatgaggcctgcccccatccccatcgaggaccctgagtggaggcagaccccacctcctgtgtctgccaccagcggcaccttccggctgcggcggggcagccgcttcacctggaggaaagaatgtctggccgtgatggagagctacttcaatgaaaaccagtacccagatgaggccaagcgggaggagatcgccaatgcctgcaatgctgtgatccagaagccaggcaagaagctgagtgacctggagcgggtgaccagcctgaaggtgtacaactggtttgccaacagaaggaaggagatcaagagaagagccaacattgctgccatcctggagagccacggcattgatgtgcagagccctgggggccacagcaacagtgatgatgtggatggaaatgactacagcgagcaggacacctggcaggtgagaaatggagaggaggaggagggccgcagcagcgagggcggccgggaggccgagaaggatgacagcaccagccacagcgaccaccaggaccccatcagcctggccgtggagatggctgctgtgaaccacaccatcctggccctggcccggcagggcgccaatgagatcaagacagaggccctggatgatgactag

SEQ ID NO: 22733 - DNA, 357 bp, Artificial Sequence
  Description of Artificial Sequence: Synthetic coding sequence
atgctgagcagcttccctgtggtgctgctggagaccatgagccactacacagatgagccccgcttcaccatcgagcagattgacctgctgcagaggctgcggaggacaggcatgaccaagcatgagatcctgcacgccctggagaccctggaccggctggaccaggagcacagcgacaagtttggaagaagaagcagctatggaggcagcagctatggcaacagcaccaacaacgtgcctgccagcagcagcacagccacagccagcacccagacccagcacagcggcatgagccccagccccagcaacagctatgacaccagcccccagccctgcaccaccaaccagaatggatag

SEQ ID NO: 22734 - DNA, 1332 bp, Artificial Sequence; identical to SEQ ID NO: 22732
  Description of Artificial Sequence: Synthetic coding sequence

SEQ ID NO: 22735 - DNA, 1218 bp, Artificial Sequence
  Description of Artificial Sequence: Synthetic coding sequence
atgctgagcagcttccctgtggtgctgctggagaccatgagccactacacagatgagccccgcttcaccatcgagcagattgacctgctgcagaggctgcggaggacaggcatgaccaagcatgagatcctgcacgccctggagaccctggaccggctggaccaggagcacagcgacaagtttggaagaagaagcagctatggaggcagcagctatggcaacagcaccaacaacgtgcctgccagcagcagcacagccacagccagcacccagacccagcacagcggcatgagccccagccccagcaacagctatgacaccagcccccagccctgcaccaccaaccagaatggccgggagaacaatgaaaggctgagcaccagcaatggcaagatgagccccacccgctaccacgccaacagcatgggccagaggagctacagctttgaggccagcgaggaggacctggatgtggatgacaaggtggaggagctgatgagaagagacagcagcgtcatcaaggaggagatcaaggccttcctggccaacagacgcatcagccaggccgtggtggcccaggtgacaggcatcagccagagccgcatcagccactggctgctgcagcagggcagtgacctgtctgagcagaagaagagggccttctaccgctggtaccagctggagaagaccaaccctggggccaccctgtccatgaggcctgcccccatccccatcgaggaccctgagtggaggcagaccccacctcctgtgtctgccaccagcggcaccttccggctgcggcggggcagccgcttcacctggaggaaagaatgtctggccgtgatggagagctacttcaatgaaaaccagtacccagatgaggccaagcgggaggagatcgccaatgcctgcaatgctgtgatccagaagccaggcaagaagctgagtgacctggagcgggtgaccagcctgaaggtgtacaactggtttgccaacagaaggaaggagatcaagagaagagccaacattgctgccatcctggagagccacggcattgatgtgcagagccctgggggccacagcaacagtgatgatgtggatggaaatgactacagcgagcaggacacctggcaggtgagaaatggagaggaggaggagggccgcagcagcgagggcggccgggaggccgagaaggtggaggaggagcggcgcatctag

SEQ ID NO: 22736 - DNA, 1380 bp, Artificial Sequence
  Description of Artificial Sequence: Synthetic coding sequence
atgaccgccgaggagatgaaggccaccgagagcggcgcccagagcgctccccttcctatggaaggcgtggatatctccccgaagcaggacgaaggggtgctcaaggtgattaagagggaaggcactggcaccgaaatgccaatgattggcgatcgtgtgtttgttcactataccggctggttgttggacggaaccaagtttgactcctccctggatagaaaggataaattttccttcgacctggggaagggtgaagtgataaaggcttgggacatcgcaatcgctacgatgaaagtcggagaggtctgccatatcacctgtaaaccagagtatgcctatgggagtgcagggtctccccctaagattccgcccaacgcgacgctggtcttcgaagtagaattgttcgagttcaaaggcgaggacctgaccgaagaggaagatggcggaattatccgccggatccagacccgaggagaaggctatgcaaagcctaatgagggcgccatcgtagaggttgctctcgagggctactataaggacaagctgtttgaccagcgggagctgcggttcgaaattggtgagggagagaatctggacctgccatatggcctcgagcgggctatccaacggatggaaaagggcgagcatagtatcgtgtacctgaagccatcctatgccttcggttctgtcgggaaggagaaatttcaaataccacctaacgcagaactcaagtacgagctgcacctgaaatctttcgagaaggctaaagagtcgtgggagatgaactctgaagagaagctcgaacagagtaccatcgtaaaagagaggggcaccgtgtatttcaaagagggtaagtacaagcaggccctgctgcagtacaagaaaatcgtgtcctggctggagtacgaatcctcattttcgaacgaagaggcacagaaagcacaagcgctgcgattggcgtcccacttgaaccttgccatgtgccacctgaagttgcaggcctttagtgctgccatagagtcttgcaataaggccctggaactggactctaacaatgaaaaaggactcttccgaagaggagaggcgcaccttgcggtgaacgattttgagctggccagggctgacttccagaaagtgctgcagctgtaccccaataacaaggctgctaagacacagttagccgtttgccagcagcgtatccggagacagctcgcaagagagaaaaagctgtatgccaatatgttcgaacgtctggcggaggaagaaaataaagccaaggctgaagctagctcaggagaccaccccactgacactgaaatgaaagaagaacagaaatcaaataccgctgggtctcagtcccaagtggaaacagaagcttag

SEQ ID NO: 22737 - DNA, 477 bp, Artificial Sequence
  Description of Artificial Sequence: Synthetic coding sequence
atggagccccccgagggcgccggcaccggcgagatcgtgaaggaggcagaggtgccgcaagcagccctaggcgtccccgcccagggaacaggcgataatggccatactcccgtcgaggaggaggtgggtggcattcccgttcctgccccagggttactccaggtgacggagcgccgccagccactgtcaagcgtgagtagcttggaggttcactttgatcttcttgacctcacagagctcactgacatgagcgaccaggagctggcagaggtgtttgcagatagtgacgatgaaaacctaaataccgaatcccctgctggactgcatcctctcccccgagccggctacctcagatccccgtcctggaccaggacccgcgccgagcagagccacgaaaagcagcctctcggagaccccgaaagacaagctactgttcttgacacctttctcacagtagagcgcccacaggaggattag

SEQ ID NO: 22738 - DNA, 954 bp, Artificial Sequence
  Description of Artificial Sequence: Synthetic coding sequence
atggccagcgtgatccccgccagcaaccggagcatgcggagcgacagaaacacgtacgtgggcaagagattcgtgcatgtgaagaacccttatctcgatctaatggatgaagatatactctaccacctggatctgggcactaagacgcacaatctgccagcaatgtttggagacgtgaagttcgtgtgtgtaggggggtctcccaaccgcatgaaagcgtttgccttattcatgcataaggaactcggtttcgaagaagccgaggaggacattaaagatatttgcgctggtaccgatcgttactgcatgtacaagacaggccccgtcctggccatctcccatggtatgggcatcccttctatctcgatcatgctgcatgagctgattaagctgctccaccatgcccgctgttgcgatgttacaatcatcaggattggaacctccggcggaatcggtatcgctcccgggacagtcgtgatcacagacattgctgtagattccttttttaaacctcgatttgagcaggtgatattagataatattgtgacgaggagcacagaactcgacaaagaactcagtgaggaactttttaattgcagtaaggagattccaaactttcctaccctggtaggccacacaatgtgtacatatgacttctatgagggacagggaaggctggatggagccctgtgctccttttcccgcgaaaagaaattggattatttaaagagggctttcaaggcgggcgtgagaaatattgagatggagtccaccgtgtttgccgccatgtgtggcctgtgcggacttaaggctgctgttgtgtgtgtgaccctgttggaccgtctagattgcgatcaaatcaacctgccgcatgatgtgttggtggagtaccaacagagaccccaactgctgatatccaattttattcgccgacggttaggtctgtgtgattag

SEQ ID NO: 22739 - DNA, 1095 bp, Artificial Sequence
  Description of Artificial Sequence: Synthetic coding sequence
atgagcgaggtggaggccgccgccggcgccaccgccgtgcccgccgctactgtcccagcaactgctgctggggtcgtggccgttgtggtccctgtgcccgccggggagccccagaagggaggcggcgccggggggggcggaggcgccgcctctggccctgctgcaggaaccccaagtgcccccggctccaggactcccgggaatcctgcgaccgctgtgagcgggacacctgcaccaccggcgcgctctcaggcggataaaccagtcctggctatccaggtgctcgggactgtcaagtggtttaacgtgagaaatggctacggcttcattaatagaaatgacaccaaggaggacgtcttcgtgcaccagaccgccattaagcgtaacaacccgagaaagtttttacggtcagttggagatggcgagacagtggagttcgatgttgtggaaggagagaaaggcgccgaggccaccaacgtaaccgggcctgggggcgtgcctgtcaaagggtctcgttatgcaccaaaccgcaggaaaagccggcggtttatcccacggcccccatccgtggccccacctccaatggttgctgaaatcccctctgccggcacagggccagggtcaaaaggcgaacgggctgaggactcagggcagcgccctcgtcgatggtgcccccctccgttcttttaccgccgtagattcgtcagggggccgcgcccgccaaatcagcagcagcctatcgaggggacagatcgggtggaacctaaggaaaccgcacctctggaggggcaccagcagcaaggcgacgaacgggtgccccctccaagattcagaccaagataccggcgaccttttcgcccaagaccacgtcagcagcctacgacagagggaggggatggcgagaccaaacccagtcagggcccagcggacggcagcaggcctgaaccacagcgccctcgcaataggccatactttcagcgcaggcgacaacaggctcccggcccacagcaagctccaggcccacgacaacccgccgcgcccgagaccagcgcccctgtcaactctggggaccctacgacaactattcttgagtag

SEQ ID NO: 22740 - DNA, 5706 bp, Artificial Sequence
  Description of Artificial Sequence: Synthetic coding sequence
atggccaccttccggaacaaccacatgaagaccaaggccagcgtgcggaaatcattttccgaagacgtgttccagtcggtgaaatccctgttgcagagccagaaagagttgtgctcggtgacagcagaagattgcctgcagcaagacgaacatgcaaatctgaccgaagtcaccttcctgggctttaacgaagaaaccgatgcagcccatatccaagacctggccgccgtttctttggagctacccgatattctgaactccctgcacttctgcagtctgaacgagaatgaaatcatctgcatgaagaatatcaacaaacccctggacatcagcagtgatcccctgaaccagtcccacccctccgggatgctttgcgtcatgcgcgtcagcccaacatcaccacgactgcggattgactttatttttagtctgttgagcaagtatgctaccgggatacggtataccctcgacacctttctgcatcagaagcatcagctggaaaccacagacgaggatgatgatgacaccaatcagtccgtttcatcaattgaggatgacttcgtaaccgcgttcgagcatctggaagaggaggaaaccagcaaaccatataacgacggcatgaacataaccgtgctgcgctcccagtgtgacgctgcctcccagaccgtgactggacaccacctcgagacacacgacctcaaaattctcattagcagcggccagcagaaaagtttagcaaagccttcaacatcttccgtgaatgtacttggtcataaagagttgccctctgtgaagacaagcgtaacaacatcaatcagtgagccctggactcagagatcattctatagatcaagcaatgcatctgacaaagactctgaccttcagaaaaccttctttagctctagcccagcttacagttcagaaagcgagtgttcttcaccttctcctgtcatattcttagatgaagaaggctaccagaagagtctgaaagccaagctcgagctcccaaagattcctgtcatgaaggacgatatcgaagatagtgattctgaggttagtgagtttttcgactcttttgaccagttcgatgaacttgagcaaacgctggaaacatgcctgtttaataaagatccagtaattgggaaaagtagccagcgaaaaggacacaagcacggaaagagttgtatgaacccacagaagttcaagttcgacagaccagccctgcccgccaacgttcggaaaccgacaccaaggaaacccgagagcccttacgggaacctttgcgacgcgcctgatagcccccggcctgttaaagcctctagggaggacagtgggctatttagcccaatccgctcatctgccttttcccctctgggtggctgcactcctgccgaatgtttttgtcaaaccgacatcggaggcgaccgaattcacgaaaatcacgactccgtctactacacatatgaggactacgctaaatccatctcctgtgaggtgctcggctccgtgctgcgcacccaccatactaataccctgtccaacataaactccatcaaacacggagagaacaagacagttacttttaaacatggaaatctagaccagaaaaacaagtcaaaaaacaagagccttatgatcaaggattccattcagaagttcgcggccgacctggtggaaaaaagcttcgggtcagccttcaaggatctgcaaaaaggagtgtcaagctgcacaaatgcgctctaccacctggccatcaagctgacgagttcagtcctccaaatggcctttgacgaactgcggagacagagggctttcagtctgaaagagagggcaatctctgggttggccaattttctggtgtcagaagctctgtcaaatgccctgaaggacttgcaatatgtcaagaagcaaattttcacaaataccgtggcacgcttcgcagctgatctcgcagaggaacttgtgttcgaaggtatcatggaggtttgccagtttagttacccacagacgcccgcgtccccacagtgtggatcctttgattttgaggataaagtcgttaagttgtatgcgaaggacctcagtgaatcggtaatacaagaagccttcattgaactgagtcaggtcgacgtgacgtttacaaccaaggccgccgtttccgtgtcaactgacaacataaaatatgtgtcagctgagtcagtggtgcccagcacgcaggctgtcacattttcgccttccttccataatcaggcgatcatggtgactaagccagtccaggagtacaaaaaggaatacacagtccagcaagccctgttctgcacctctggcattgtgacttccatccctgtcccactggcggggtccgccttacttccataccatatatcctccactgcttgccaggcgaaggctcatctttccagcgacgatagcaactcaaacggtgattctgctcaggttcatatcgctacgaagaaccgagaggagaaggccgcgtgtctcagaaacatatgcctaccctcggaacataacccagggaatcagaatgattttaagcccaccaacgacgacattgagatgcagtcgagttctaaactgcccaacgatcccgcaatcatctcaaactttagcgcagcagtggtccacactatcgttaacgagacactggagtctatgacgtctcttgaggtaaccaagatggtcgatgagcggactgactatctcacaaagtctctcaaggagaagactcctccatttagtcactgcgaccaggccgtgctgcagtgcagcgaagcctcatcaaacaaagacatgtttgctgaccggctaagcaaaagtattatcaagcacagcattgacaagtctaagtctgtgattccaaacatcgacaaaaacgccgtttataaagagagcctgcccgtctctggtgaggaaagccagcttactcctgagaagtcgcccaaatttcccgacagccagaaccagctgactcactgctccctctctgccgctaaggactgtgttcccgaatgcaaggtcagcatggtgcatggatctagcttggagactctgccatcttgccctgctgttactggacaaaagagcgatctcaaagaatcagccaaggaccaaccactgaagaagcataatctgaatagcacaagtctggaggccctgtcgtttggacaggagaatccctttcctcacagccatacattctcatccaccgccctcacctgtgtggacggtttacacgtggaggataaacagaaggtccgcgatcgtaacgttattcctgataccccccctagtacaccactggtaccgtctcgggctagcagcgagtgggacatcaagaaactgaccaagaagctcaagggtgagttggctaaggaattcgcccccgccaccccccccagcacacctcataattccagcgtcgggtccctgtccgagaacgagcagaacacaattgagaaggaggagtttatgctgaagcttatgaggtcactctccgaggaggtggaaagtagtgaatctggcgaattacccgaagtggacgttaagtcagagcatagcgggaaaaaggtgcagtttgcagaagccctggccacccacatactgagtttggccacagagatggccgcgtcacatctggacaacaagatcattcaagagcctaaagtcaagaatccctgcttaaacgtccaatctcagaggtcagtgtctcccacatttctgaatccttcagacgagaacctgaaaacgttgtgtaactttgcgggagatcttgcggccgaggtgatcaccgaggcggagaagatcgccaaagtgagaaattgtatgctttttaagcagaaaaagaacagctgctacgccgacggtgacgaggactacaaggtagaggaaaagctggacatcgaagccgtcgttcatcccagagaagtggatccgtttatcctgtcactgccacctagcagctgtatgtcagggctgatgtacaagtaccccagttgtgaatctgtgacggacgaatacgctggacatctgatccagatccttaaacaagagggaggcaactctgaactgattatggaccaatatgctaatagactggcctacagaagcgtcaaaagcggacttcaggaggcggccaagaccaccaaggttcagtgcaatagcagaatgtttccggtcccatcttcacaagttaagaccaataaagaactactaatgttctccaataaagagcaccaccaggaagctgacaagaagcgtcagtctaaacggaatgagggctatttttgcaagaatcagacctgtgaacgaaccctggatccatacaggaacgaagtctctcagctgtatagcttctcaacatctctcgtacactccattacaaaggacgccaaggaagagttgaccgcaagtctggtcggcctgcctaaatcactgactgactcctgcctgttcgagaaatccggatatgaggaggacaacgagtgtcacgttaccccagagctcccaaagtccctgcagccgtcgtcacagaaccacagattttatcacagcactgggtctttgaatggctacggctgtggcgacaatgtcgtgcaggccgtagagcagtatgccaaaaaagtcgtagacgacactctggaattgactctcggctctacggttttcagggtgagcgagaccaccaaatccgcagaccgggtcacatatgccgagaagctgtcccctctgaccggccaggcatgtagatactgcgatctgaaagaactgcacaattgtacagggaattcttcccagcacttctttcgccagggttctctcgcttcatccaagccggcgtcaaatcccaaattctccagcaggtaccagaaatctagaatatttcacctctcagtgcctcagatccacgttaacctggacaaaaaggcggtgttagcagaaaaaattgtagccgaggccatcgagaaggccgagagagagctgtcttctacctctttggctgcagatagcgggatcggtcaggaaggcgcgagcttcgctgaatcacttgccactgaaaccatgacagccgccgtcacgaatgtgggtcatgcagtgtctagctcgaaagagatagaagatttccagtccaccgaatccgtgagtagtcagcaaatgaacctgtcaattggagacgattccaccgggtcctggagcaatctgtcgttcgaggacgagcatcaggacgagtcatcatcgttccaccacctttccgaaagtaacggcaactctagctcttggtcatctctgggcctggaaggtgatctttacgaggataatctcagcttccctactagtgactctgatggcccagacgacaaagatgaggaacacgaggacgaggtggaggggttggggcaagatggcaagactctgctgatcacaaatattgacatggagccttgcaccgtggatcctcagcttagaattatcttgcaatggttaattgccagcgaggccgaggtggctgagctgtacttccacgactctgcaaataaggaatttatgctcttatccaagcaactgcaagaaaaagggtggaaggtgggcgacctcctgcaggcagttctgcagtattacgaggtcatggagaaagcaagcagcgaggagcgttgcaagtcactctttgattggctgctcgagaacgcttag

SEQ ID NO: 22741 - DNA, 417 bp, Artificial Sequence
  Description of Artificial Sequence: Synthetic coding sequence
atggccgagctgcagcagctgcgggtgcaggaggccgtggagagcatggtgaagtctctggaacgcgaaaatatcaggaaaatgcagggcctcatgtttcgttgttcggcctcatgctgcgaagatagccaggcatctatgaagcaggtccaccaatgcatcgaaaggtgccacgttccccttgcacaggctcaggccctggtgacatctgaactggaaaagtttcaggatcgccttgctcgctgtacaatgcattgtaatgataaagctaaggattccatcgacgcggggagtaaagagctgcaggtgaaacagcaattggactcatgtgtcactaagtgcgtcgacgaccacatgcatttaatcccaaccatgacgaagaagatgaaggaggcccttctgtctatcggaaagtag

SEQ ID NO: 22742 - DNA, 1110 bp, Artificial Sequence
  Description of Artificial Sequence: Synthetic coding sequence
atgaccctggaggccatccggtacagccggggcagcctgcagatcttggatcagcttctgctaccgaaacaatctcggtacgaggctgtggggtctgtgcaccaggcatgggaggcaattcgcgcgatgaaagtgcggggggcccccgccattgcactggtgggatgtctgtcactcgccgttgagctccaggccggagctggcggccccggcctggctgccctggtggctttcgttcgcgataaactgagcttcttggtgacagctagacccacagcagtcaacatggcccgagcagccagagacctggctgatgtggccgctcgtgaagcggagcgcgagggcgcaactgaggaagccgtgcgcgagagggtgatttgctgcacagaagacatgttggagaaagaccttcgggacaaccgatctatcggtgatctgggcgcgagacacctccttgaacgggtggcccccagcggggggaaggtgactgtgcttacgcactgcaataccggggctcttgctacggccgggtatgggaccgctctgggggttattaggtcgctccattctctcgggagattggaacacgccttctgtactgagacccgcccctataatcagggggccagactgactgcctttgagttggtttacgaacaaataccagcaacgctgatcaccgacagtatggttgccgccgccatggcccataggggagtgagtgcggtagttgtaggcgccgatagagtggtcgccaacggcgacaccgcaaataaagtaggaacgtatcaactcgccattgtggccaagcatcacgggatcccattctacgtggccgctccctctagcagctgtgatctacggttagaaacaggaaaggagatcattatagaggagcgccccggccaggaactgactgatgtaaacggggtgaggatcgccgcaccagggatcggcgtttggaaccccgcgtttgatgtgacgccccacgacctgataacaggcggaatcattacggagttaggggtgttcgctccagaagagctgcgaaccgcactgacaactactatcagttcccgagatggcaccctggacggtccccagatgtag

SEQ ID NO: 22743 - DNA, 3660 bp, Artificial Sequence
  Description of Artificial Sequence: Synthetic coding sequence
atgatgagcctgagcgtgcggccccagcggcggctgctgagcgcccgcgtgaaccggagccagtctttcgccggagtgttaggaagtcacgagcgaggccctcgttcctttccagttttctcaccgcccgggcccccccggaagcctccagcgctgagccgcgttagcagaatgttctctgtagcccacccagcagcgaaagtgccacagcccgaacgactggaccttgtctacaccgcccttaaacggggtctgactgcttacttggaggtccaccagcaggagcaggagaaattacagggccagatcagggaatcaaagcggaattctcgacttggtttcctgtatgatctggacaaacaggtgaagtcaatcgagcgttttctgaggagattagaattccatgcaagtaagattgacgaattgtatgaggcttattgcgtgcagaggaggctgcgagatggggcttataatatggtacgagcatatacgacgggctctcccggtagccgcgaagcacgagattccttggctgaggccactcggggtcatcgggagtacactgagagtatgtgcctcctggagtccgagttagaggctcagttaggtgagttccacctcaggatgaagggtctggccggcttcgctcggctgtgtgtgggtgaccagtacgaaatctgtatgaagtatgggcgtcagcgctggaaactgaggggaagaattgaggggtcaggtaagcaggtgtgggatagcgaagagacaatcttcctgcccttgctcactgagttcctgagcataaaggtgacagagctgaagggcttggcaaatcatgtggtggtagggagcgtgagttgtgagaccaaggatttgttcgccgcccttccacaggtggtggctgtggatataaacgacctgggaactattaagctgagtttagaggtgacctggagcccattcgacaaggatgatcagccttcagcagcttccagtgtgaataaagcctcaacagtaacaaaaaggttctcgacctactcccagagccccccagacacaccttccttacgggagcaggcattttataacatgttaagacgccaagaagaactggagaatggcactgcctggagtctgtcatccgagagctctgacgactcttcgagtccccagctcagtggaaccgctcgccactcaccggcccctcggccattggtccagcaaccagagcctcttcccatccaggtcgcttttaggaggcccgagacaccttctagcggcccactggatgaggaaggagccgtggcccctgtgcttgccaatgggcacgccccatattccagaactctgtctcatatttccgaagcgagtgtcgacgcagcgctggctgaagccagtgtagaggccgtggggccagagtcactcgcttggggcccaagtccaccaacacatcctgcacctacccacggcgaacatccatcccccgtgcctcccgcgcttgaccccgggcactccgctacttctagtacccttgggaccacaggaagcgtgccgacctcaacggacccagcgccatctgcacatctggacagcgtccacaagagcaccgatagcggcccatcagaactgccaggccccacacatactaccacgggaagcacctattctgctatcactacgacacatagcgcgccatcgcctctcacccacaccacaacagggagtacccacaagcccattatatccaccctgacaacgaccgggccgacactgaatatcatcgggccagtccagactacgacatcccctacacatacaatgccgtccccgacccataccaccgcatcccccactcacacctctacaagcccgacccatacacctacttccccaactcataaaacatcaatgagtccccctaccactaccagccccacaccctccgggatggggcttgtacaaaccgccaccagtcccactcatccaaccacatctcccacccatccgaccacatcaccaatccttatcaatgtttccccttctaccagtctggagttggcaaccttgtcttccccctccaaacactcagatcctaccctccctgggactgattccttgccgtgttcccctccagtttccaactcgtacactcaggcggatccaatggccccaaggaccccgcacccctcacccgcccactccagccggaagccgctgacatctcccgcccccgacccatcagaaagcacagttcagtcgctctctcccaccccgtcccctccaacacccgccccacagcacagtgatctgtgtctggcaatggctgtccagacacctgttcctacagcagccggaggcagcggggataggtccttggaggaggctcttggggctttaatggccgccctggatgattatcggggccagttcccggaactacagggcctagagcaggaggttacacgcctcgaaagtctgctgatgcagagacagggtctcaccaggtccagagcttccagcctgagcataaccgttgagcacgctctggagtcgttctcattcctgaatgaagacgaggatgaggacaatgatgtgcccggtgatagacctccaagttcacccgaagcaggcgccgaggacagtatcgatagcccttcagctagacccctgtcgacagggtgtccagccttagatgcggccctcgtccgccatctgtatcattgttctagactgttgctgaaacttggaacatttgggccactccgatgtcaggaggcatgggctctggaacgcctattgagagaggctcgagtactggaggccgtatgcgagttttcaagacggtgggaaatacctgcctcaagcgctcaggaagtagtgcaattcagcgcctctaggccaggattcttgaccttctgggatcagtgtacagagcgtctctcatgttttctgtgtcctgtggaaagggttcttctgacattttgcaaccagtacggtgctaggctgtcactcagacagccaggtttagctgaagcggtatgtgtgaagtttctagaagatgcgctgggacaaaagcttcccaggagaccgcaaccgggccctggcgagcagttaacagtctttcagttttggtcatttgttgaaacgttagattcccctacaatggaggcttacgttactgaaaccgcagaagaggtccttcttgtacgaaatctcaattccgatgaccaggccgtggtgctcaaggccctgcgtctggccccagaaggccggctgcgcagagacggactgagagctctgtcaagccttctggttcacggcaacaataaggttatggccgctgtatcaacccagctgaggtctcttagcttgggcccgacttttcgggaacgtgccttgctttgtttcttggatcagctggaggatgaggatgtgcagacgagagtggctggctgcctggcgttggggtgcatcaaagcccctgaagggatagagcccctggtgtacctatgccagacagacactgaggccgttcgggaagccgctagacagtctcttcagcaatgtggggaagaaggtcagtctgcgcaccgcaggctggaagaaagtttggatgccctgccccgcatattcggaccagggtctatggcgtctaccgcattctag

SEQ ID NO: 22744 - DNA, 1326 bp, Artificial Sequence
  Description of Artificial Sequence: Synthetic coding sequence
atggccagcgtggccgccgcccgggccgtgcccgtgggcagcggcttgcgcggtctgcagaggacactgccccttgttgtgatcctgggagccacgggtactggcaaaagcacgctggcattgcagctcggacagcgcctaggaggagagatcgttagcgctgatagtatgcaggtgtatgaaggtctggacatcataacgaacaaggtcagcgcccaagagcagagaatctgtcgacatcatatgatctctttcgtagaccccctggttactaattacactgtggttgattttagaaatcgagccaccgctctgatagaggacatctttgctcgagacaagatccccatcgtggtgggcgggactaattactatatcgagtctttgctgtggaaagtgcttgtcaataccaagccgcaggagatggggacagagaaggtcatcgatcgcaaagtggaacttgagaaagaggacggactcgtactgcacaaaaggctgtcccaggtagacccagagatggcagcgaaactccacccacacgacaaaaggaaagtggcacggtctctacaagtttttgaagaaactggaattagccactctgagtttctgcatcgccagcacaccgaggaaggcgggggtcccctgggtggacccttgaagttctccaatccttgcattttatggctccatgcggaccaggccgtgcttgatgaacggctcgataagagagtcgatgacatgctggctgctggattgttagaagaactgcgggacttccacaggcggtataatcagaagaacgtgtccgagaactcccaggattaccagcatggaatctttcagtctatcggtttcaaagagtttcacgagtatctgattacagagggaaagtgtacccttgagacctcgaaccagctcttaaaaaagggccccggtccaatagttccacccgtgtacgggctggaggtgtctgacgtgtcaaagtgggaggaatccgttctggaacccgcgttggagatcgtccagagctttatccagggacataagccaactgccacccccatcaagatgccctacaacgaggccgagaataaacggtcctaccacctgtgcgatctctgcgaccgcatcatcataggtgaccgcgaatgggccgctcatataaaaagtaagagccacttgaatcagctcaaaaaacgtagacggttagattctgacgcggtgaacaccattgaatcccagagcgttagccccgatcataacaaggaaccaaaggagaaaggtagtcctgggcaaaatgaccaggaattgaagtgctccgtgtag

SEQ ID NO: 22745 - DNA, 618 bp, Artificial Sequence
  Description of Artificial Sequence: Synthetic coding sequence
atggccgagcccctgcagcccgaccccggcgccgccgaggacgccgccgcccaggcagtggagacccccggctggaaagcaccagaggatgccgggcctcaacctggctcctacgaaatccgtcactatggcccggccaaatgggtgagcacatctgttgagagcatggactgggactctgccattcaaactgggtttacgaagctgaactcatatatccagggtaagaacgagaaggagatgaaaatcaaaatgacagcgcccgtgacaagttacgtggaacctgggtccgggccgtttagcgaaagcactattacgatttctctttacatcccctccgaacagcagtttgatccccctaggccccttgaatcagacgtgtttattgaagaccgtgctgaaatgacagtatttgtgagatctttcgatggattctcctccgcccaaaagaatcaggaacaattattaactctggcaagtatcctcagggaggacggcaaagtgttcgatgagaaggtgtactacactgctggctataactcccccgtaaaactgttgaataggaataatgaagtgtggttgatacaaaaaaacgagccaaccaaggaaaacgaatag

SEQ ID NO: 22746 - DNA, 624 bp, Artificial Sequence
  Description of Artificial Sequence: Synthetic coding sequence
atgagctgcaccatcgagaagatcctgaccgacgccaagaccctgctcgagcgactccgagagcacgatgctgcagctgaatctttggtcgatcagagcgccgcgttacataggcgcgtggcggcaatgcgggaagcaggtaccgcgcttcccgaccagtaccaggaggacgcttcagatatgaaagacatgagcaaatacaaaccccacatcctgctaagccaagagaacacgcaaatcagagacctccaacaggagaatagggagctgtggatcagcctcgaagagcaccaagacgctctagagcttatcatgagcaagtaccggaaacagatgctgcagctgatggttgccaagaaagccgtggacgcagagcccgttctcaaagcacaccagtcccattcagccgagatagaatcacagatcgatcggatttgcgaaatgggtgaggtgatgcgcaaagccgtacaagttgacgatgatcagttctgcaaaatccaggaaaaactggcacaactggagctcgaaaacaaagagctccgtgaattactgtccataagtagtgaatctctgcaggcccggaaggagaatagtatggacaccgccagccaagccatcaagtag

SEQ ID NO: 22747 - DNA, 1032 bp, Artificial Sequence
  Description of Artificial Sequence: Synthetic coding sequence
atgaacatccaccggagcacccccatcaccatcgcccggtacggcagatctcgtaataagacccaggacttcgaggaactctcctccatccgcagcgctgagcctagccagtcattctcccccaacctgggaagcccttctccccccgagacacctaacctatcccattgcgtatcctgcatcggcaaataccttcttctggaacctctggagggcgaccacgttttcagggcagtccacctccatagcggcgaggaactagtctgcaaagtctttgacattagttgttaccaggagtccctggccccttgtttctgcctatcggcgcacagcaacattaaccagattactgagattatcctgggagagacgaaagcatatgtatttttcgagagaagttatggtgatatgcattctttcgtgcggacttgcaaaaagcttcgtgaggaagaggcagccagactgttctaccagattgcatcagccgttgctcattgtcacgacggaggcctggtgctgagagatttgaaactgaggaagttcatcttcaaagacgaggaacgtactcgagtcaaactggaaagcctggaagatgcttacattctccgaggagacgacgactccttgagcgataagcacggttgccctgcttacgtctcccccgagatcttaaacaccagtggttcttacagtgggaaagctgccgatgtctggtctctcggtgtcatgttgtacacaatgttagttggaaggtacccgtttcatgatatagagcccagttccctcttctccaagatccgacggggccaattcaacattcctgagacgctgtcaccgaaagccaaatgtctgatacgcagcatcttgcggagggaacccagtgaaagattgaccagccaagagattctcgatcatccatggtttagcaccgacttctccgttagcaacagcgcatacggtgctaaggaggtgtctgatcagcttgtgcccgatgtgaatatggaagaaaacctcgacccgttcttcaattag

SEQ ID NO: 22748 - DNA, 3048 bp, Artificial Sequence
  Description of Artificial Sequence: Synthetic coding sequence
atgcggcggttcctgcggcccggccacgaccccgtgcgggagcggcttaagagagacctgttccaatttaacaagacagttgagcacggctttcctcaccaaccatctgccctgggatactcaccatctctgagaatcctcgcaattggtacccgtagcggagccataaaactatacggagcgccgggggtcgagtttatggggttgcaccaggaaaacaatgcagtgacccagatccacctcctgccaggtcagtgccagcttgtgactctgctggatgataacagcctgcatctgtggagtctgaaggtgaaagggggagccagcgaactccaagaggacgagtccttcacactgcggggcccacccggtgctgcaccctccgccacccagatcacagtcgtcctgccccactccagctgcgagctgctttatctcgggacggaaagtgggaacgtgttcgttgtgcagctgcctgcgtttcgcgccctggaagatagaaccattagcagtgatgcagtgctccagaggctgcccgaagaagcccggcatcgcagagttttcgagatggttgaagccctgcaggagcaccctagagaccccaatcagatcctcatcgggtattcacgcggcctcgttgtcatctgggacctgcaggggagcagggttctctaccattttttgagcagccagcagttggagaacatttggtggcaacgcgacggcagactgcttgttagttgccactccgacgggagctactgccagtggcccgtatccagtgaggcacaacagcccgaacctttgcgaagcctggtcccatatggtccgtttccatgcaaggcaatcaccaggattctctggttaactacccgtcaggggcttcccttcaccatctttcagggagggatgccccgggccagttacggagatcgccactgcatcagcgttatacatgatgggcaacagaccgctttcgatttcaccagtagggtcattggatttactgtgctcaccgaggcggatccggctgcaaccttcgacgatccttatgccctggtcgtgttggctgaagaggagctcgttgtaatcgacctccagaccgccgggtggccccccgtgcaacttccatatctggccagcctgcactgctccgctataacttgctctcaccacgtgtctaacattccacttaaattgtgggaacgtataatagctgctggtagcagacagaatgctcacttttctactatggagtggcctatcgacggcgggactagtctgaccccagcccccccccagcgggacctgttattaaccgggcatgaggacggtactgtgcggttctgggatgcctccggagtctgtctaaggctcctctacaaactttcaaccgttagagtgttcctgaccgacaccgatccaaatgagaacttttcggcacagggtgaagacgagtggccgcccttgagaaaggtgggtagctttgacccatacagcgacgatcccagattgggcatccagaaaatattcctatgtaagtattccggatacctggcagtcgctggaacagccggccaggtcctcgttctggagcttaatgatgaggctgccgaacaggctgtcgagcaggtagaggccgatttgctccaggatcaggagggttacagatggaaagggcatgagcgcctggccgcgagaagcggacctgtgagatttgaaccagggttccaaccattcgtgctggtgcagtgccagcccccagcagtcgtcaccagtctggccctccacagtgaatggcgcttggttgcctttggcacatcccacggctttggactgttcgaccaccagcaaagaaggcaggtcttcgtcaagtgcacgctgcacccctcagaccaattagcccttgaaggccccctgagtagggtaaaaagccttaagaagtcgttgagacagtcctttagacggatgcgacgtagccgggtgtcgagtaggaagcggcatcccgcggggccgccgggggaagcccaggagggctccgctaaagccgagaggccaggtctgcaaaatatggagcttgctccggtccagcggaagattgaagctcgaagcgcggaggattccttcaccggatttgtaagaaccctgtactttgccgacacatacctaaaagatagtagccgccattgtcctagcctatgggccggaactaatgggggcacaatatatgcattttctctgcgtgtcccaccagccgaacgacggatggatgagcccgtgagagccgagcaggctaaggagatccaactgatgcacagggcaccagttgttggtatactggtccttgatggccatagcgtccccttacctgagcccctggaggtggcccacgacttatctaagtcccccgacatgcagggatcccaccaactgctggttgtcagcgaagagcagttcaaggtcttcactctgcctaaagtttccgccaagcttaagcttaaactcaccgcattggaaggctcccgagtccgccgggtttctgtggcccatttcggaagcaggcgtgctgaggattacggtgaacatcatcttgcggtgttgactaacctgggggacatccaagtggtctcactaccactcctaaagccccaggttcgctatagctgtattcgaagggaggatgtcagcggcatcgcgtcgtgtgtattcacaaaatatggtcaggggttctacctgatcagtcccagcgagtttgagcgattttcacttagcactaaatggctggttgaacctcgatgtctggtcgattcggctgagacaaagaatcacaggccaggtaacggagccggaccgaagaaagcgcccagcagggctagaaattccgggacacaaagcgacggcgaagagaagcagcccggcctggtaatggagcgcgccttactgagcgatgagagagcagctaccggcgttcacatcgagccaccttggggggccgcttcagctatggccgaacagtccgaatggctgagcgtccaggccgctcggtag

SEQ ID NO: 22749 - DNA, 897 bp, Artificial Sequence
  Description of Artificial Sequence: Synthetic coding sequence
atggccgccgccgagcccgccgtgctggccctgcccaacagcggcgcagggggggcaggagcacctagcggaacggttcctgtgctgttttgcttctctgtctttgctcgccctagctccgtaccccatggggctggttacgagctacttatccagaaattcctctctctatacggcgaccagatagatatgcatagaaagtttgtcgtgcaactcttcgccgaagagtggggccaatatgtggatttgccaaaaggcttcgccgtgagcgagcggtgcaaggttagactggtgcctctccaaattcagttgactactctcggcaatcttaccccatcctccacagtcttcttttgctgtgatatgcaagagcgatttcggcctgccattaagtactttggcgatatcatctctgttggacagaggctcctgcagggcgccagaatactgggcatacctgttattgtaacagagcagtaccccaagggtctcggttctacagtccaggaaattgatctaactggcgtgaagctagttttgccgaaaacaaagttcagcatggtgctgccagaggtggaggcggccctggccgagatcccaggagtgagaagcgtagtgctcttcggggtggagacacatgtctgtatacagcagacagctctggagcttgtgggaagaggcgtcgaggttcatatcgtagcggacgcaacatctagtcgcagcatgatggaccggatgttcgccctagagagattagcgcgcacaggaataatcgtgaccacgtctgaagcagtattactgcagctcgttgccgacaaagaccaccctaagttcaaggaaattcaaaatctaatcaaagctagtgctcccgagtccggccttctgtctaaagtgtag

SEQ ID NO: 22750 - DNA, 2439 bp, Artificial Sequence
  Description of Artificial Sequence: Synthetic coding sequence
atgagcgagcagggcgacctgaaccaggccatcgccgaggagggcggtaccgaacaggagactgcgacgcctgaaaatggaatcgtcaagagcgagtctctcgatgaggaagagaagttagaactacagaggcgcttggaggctcaaaatcaggaaagaaggaagagcaagagcggggcggggaaggggaagttgacccggagtctggcggtatgtgaagagtcaagtgcgcggccaggaggcgagtcgctccaggaccaagaatcaattcacttacagttgtcctccttctcgagcctccaggaggaagataaatcaaggaaagacgactcagaacgcgaaaaggaaaaggacaagaataaagacaagacctcagaaaagcccaaaatacgaatgctgtctaaggactgcagccaagaatacaccgactccacgggtatcgatctgcacgagtttctcatcaacacgctgaaaaataacagccgcgataggatgatattactgaagatggagcaggaaattatagatttcatcgctgataacaataatcattacaaaaaatttccacagatgagttcatatcagcggatgttagtgcatcgggttgcggcgtactttggcctagaccacaatgttgatcaaacggggaagtctgtcatcataaataaaacaagctccacgagaatcccggagcaacggttttgcgagcatcttaaagatgagaaaggcgaagaatctcagaagagatttattcttaaacgtgacaattcatcaatcgataaggaggacaatcagcagaatcggatgcacccgtttcgcgatgatagaaggtccaagagtattgaagagagagaggaggagtatcaacgcgttcgggagagaatcttcgctcatgattccgtgtgctcacaggagtcgctgttcgtagagaactcgcggttgttggaggactctaacatctgtaacgaaacatataaaaagcgacagctgtttcgcggcaatcgggatggcagcggacgtacaagtggctcccgccagagttcgtctgagaatgagctgaaatggagtgatcatcagcgggcttggtcaagcactgattctgattctagcaatcgcaacttgaaacccgctatgacaaagacagcctctttcggcgggataaccgtcctgacccgcggcgactctacttcctccacccgctcaacaggaaaactgagcaaggccgggtctgaaagttccagctcagcgggatcaagcggctccctgtctaggacacatccacccttgcaatctacacctttggtatctggggttgcagcggggtcccctggatgcgtgccttatcccgaaaatggaatcgggggccaggttgcaccttcctcaacaagctatatcctgctgccactcgaagcagcaaccggcatacctccaggctcaattctgttgaacccccacaccgggcaaccgtttgtgaaccctgatggtactcctgctatctacaatccccctacatctcaacagcctctccgttcagccatggtggggcagagccagcaacagccaccccagcagcaaccaagcccacagccacagcagcaggtccagccacctcagccacagatggccggaccactcgtgactcagcgcgacgatgtggccactcagttcggtcagatgaccctaagtcggcagtcatccggggaaaccccggagccgccttccgggcctgtatacccatcatctctcatgccgcaaccagcccagcagccttcttatgtgatcgcctctacaggccagcaactgcccaccgggggattcagtggctcggggcctcctatttcccagcaggtgctgcagcccccgccctcaccccaggggtttgtgcaacagccgcctccagcgcagatgcccgtgtactactatccctcaggccagtatcccacgtccaccactcagcagtatcggcccatggcccccgtgcagtacaacgcccaaagatcacagcaaatgccacaggctgctcaacaggcaggctaccagccagtactttccggccagcaggggttccaaggcctgattggggtccagcagccccctcagtctcagaacgtgataaacaaccagcagggcacccccgtgcagagcgttatggttagttatccgaccatgtcctcctaccaggtacctatgacgcaggggagtcagggtcttcctcagcagtcctaccagcaacccattatgttacctaaccaagctggtcagggctccttgcctgccacaggaatgcccgtgtactgcaacgtgacacctccaaccccccagaataatctgcggctaataggcccacattgtcccagcagcacagtgcccgtgatgtccgcgtcatgccgcaccaactgtgcgagcatgtccaatgcaggttggcaagtaaagttttag

SEQ ID NO: 22751 - DNA, 1191 bp, Artificial Sequence
  Description of Artificial Sequence: Synthetic coding sequence
atgaccaccctggtgctggacaacggcgcctacaacgccaagatcggctacagccacgagaatgtgagcgtgattcctaactgccagttccgatctaagacagctcgcctgaaaacgtttacggccaatcagattgacgaaattaaggacccctcgggtctattttatattctgccatttcaaaaagggtacctcgtaaattgggatgtccagcgtcaggtttgggattatctcttcgggaaggaaatgtatcaggttgactttctggacacaaacataatcatcaccgagccgtactttaactttacatctattcaggaatcaatgaatgaaatcttgttcgaggagtaccaattccaggctgtcctgcgggtgaacgccggtgccttgtccgctcaccgctattttagagacaacccctcagagctctgttgtataatcgtggacagcggttacagctttacacatatcgttccatattgtaggtctaagaagaagaaggaggccatcattcggatcaatgtgggtggaaaactcctaaccaaccacttgaaagagatcatatcctataggcaattgcacgtcatggatgagacccatgtaatcaaccaggtgaaggaggatgtctgttatgtcagccaggatttttacagagatatggacattgccaaactgaagggcgaagagaacaccgttatgattgactacgtgctgcccgatttttctacaattaagaaaggattttgcaagcctagggaagagatggtgctgagtggcaagtataaatccggagaacaaatcctgcggctggcgaatgagagattcgctgtcccagaaatcctgttcaaccccagtgatataggaatccaggagatggggattccagaagcgattgtgtattccattcagaatctgccagaagagatgcagccacactttttcaagaatattgttctaacagggggaaactcgttgtttccaggattccgagatcgcgtctacagcgaagtgagatgccttacccctactgactacgacgtgagcgtggtgctccctgagaaccccataacgtatgcctgggaggggggcaagttaattagcgagaacgacgatttcgaggatatggttgtaacccgagaggattacgaagaaaatggacattcagtatgcgaggagaagttcgacatatag

SEQ ID NO: 22752 - DNA, 1005 bp, Artificial Sequence
  Description of Artificial Sequence: Synthetic coding sequence
atggagcccggccccaccgccgcccagcggcggtgcagcctgcccccatggctgcctttggggcttctgctttggtcggggttggcccttggagcgttgcccttcggttcctcaccccatagggttttccatgatttgctctctgagcaacagttgctggaagtggaggatctaagcctcagcctcctccaggggggaggcctgggtccactaagtttgccacctgatctgccagacctggaccccgaatgtcgcgagttgctactggactttgcgaactcatctgcggagcttacaggctgtcttgttcggtccgcaaggccagtacgtctgtgtcagacttgctatcccttatttcagcaagtcgtcagtaaaatggacaatatctctcgggctgctgggaatacatccgagagccagtcctgtgcccggtcactgttgatggccgatcgtatgcaaattgttgtgattttgtccgagttttttaacactacgtggcaggaggcaaattgcgctaactgtctgactaacaatagtgaagagctctctaacagtaccgtatattttttgaatttgtttaatcatacattgacgtgtttcgagcacaaccttcagggaaatgctcatagcctgctgcagacaaaaaattatagcgaggtgtgcaaaaactgtcgggaagcttacaagaccctgagcagcttatactctgagatgcagaaaatgaacgaactggagaacaaagcagagccaggcacacacctttgcatagacgtggaagacgcaatgaacatcactcgcaaactctggtcacgtacctttaactgttccgtgccgtgctctgacacggtgcccgttatagccgtctccgtgttcatcctcttcctgcccgtagtgttctatctcagttcattcctgcactcagaacagaagaagcgcaaactcattctgcctaaacgtctgaaaagtagtacttcatttgctaacatacaagagaacagtaactag

SEQ ID NO: 22753 - DNA, 2172 bp, Artificial Sequence
  Description of Artificial Sequence: Synthetic coding sequence
atgagcaccgccaccggccccgaggccgcccccaagcccagcgccaagagcatttacgagcagcgcaagaggtattcaaccgtggttatggccgacgtcagccagtaccctgtaaatcaccttgtgacattctgcctgggggaagacgacggcgtccacactgttgaggatgcctcccgaaagctggcagtgatggatagccaaggaagagtgtgggcccaggaaatgctgctgcgggtgtcccctgaccacgtgaccctgttggatccagcctccaaggaagaactggaatcgtacccactaggtgctattgtcagatgcgacgctgtcatgccacctggtagatctagatccctgctcctgctggtgtgtcaggagccagaacgggctcaaccagatgtgcatttcttccagggacttaggttaggagctgagctgattcgggaggacattcagggcgcactccacaactaccggtctggacgcggagaacgtagggcagccgctctgcgagccactcaagaggagctccaaagggaccggtcaccagccgccgagacacccccattacaaaggcgcccctctgtccgggcggtgatttccaccgtagaacggggcgcaggccgcggccgccctcaggcaaagccaattcctgaggccgaagaggcccagcggccagagccggtcgggacatcttcgaacgctgactccgcttcaccagatctgggccctagaggacctgacctggccgtactgcaagcggaacgagaagtagacattctgaaccacgtcttcgatgacgttgagtcattcgtctctagactacagaagtcagctgaagcagctcgggtgctcgaacaccgggaacggggccggcgttccaggaggcgcgccgccggtgaaggattgctgacactgcgagcaaaacccccctctgaggcagaatatacagatgtcctgcagaagattaaatatgcattttctcttcttgctcgcctgcgaggaaacattgctgaccctagtagccctgagctccttcatttcttgtttgggcccctgcaaatgatagtcaacacctcaggcggtcccgagttcgccagcagtgtccgccgaccccacctcacatccgacgccgtggctctgctgagagacaacgttaccccccgcgaaaatgaactttggacaagcctaggggattcctggacgaggccaggattagaactttcaccggaagaaggccccccctatagacccgagtttttctcgggctgggagcctccagtcacagaccctcaatctcgcgcatgggaggacccagtagagaaacaattgcagcacgagcgcaggaggcggcagcagagcgcccctcaggtcgctgtgaatggtcatcgtgacttggagcccgagtctgagccccagttggagtcagaaactgctggaaaatgggtgctgtgtaattatgattttcaagcacgcaatagcagcgagctgtcggtcaaacagcgggatgtattggaagtgttggatgactcaaggaagtggtggaaggttcgggatccagccggtcaagagggctacgtcccttacaacatcctgacaccatatccaggcccccggctgcatcactctcaaagccctgcccgttcattgaactctaccccaccgccaccccctgcccctgctccagctccaccccctgctctcgcacggccccgatgggaccggcctcggtgggacagttgtgacagcttaaatggactggatccctccgaaaaagagaagtttagccaaatgctaattgttaatgaggagctccaggctagactcgcccaagggaggtctgggccatcaagagccgtgcctggcccccgcgcccccgagccccaactttcacctggcagcgacgcctcggaagtccgcgcatggcttcaggccaagggtttctcatccggcactgttgacgccctcggagttctgacaggtgcccagttattctctctgcagaaagaggagttgcgcgctgtttcccccgaagagggcgcccgcgtgtactcccaggtcactgtgcagcggtctttgctggaagacaaggagaaggtttctgagttggaagctgtgatggagaaacaaaagaagaaggtggaaggcgaagtggaaatggaggtgatttag

SEQ ID NO: 22754 - DNA, 5622 bp, Artificial Sequence
  Description of Artificial Sequence: Synthetic coding sequence
atgttcagccggcggagccacggcgacgtgaagaagagcacccagaaagtcctcgaccccaagaaggacgttctgacccgcctaaagcacctgcgagctctcctggacaacgtggatgccaatgaccttaaacagttctttgagaccaattatagccagatatactttatattctacgagaatttcattgcactggagaattctctcaagctaaaaggcaacaacaaatcacagcgtgaagagctggattcaattctgtttttgtttgagaagatcttacagttcctaccagaaaggatctttttcagatggcactatcagagtattgggtcaacattaaaaaagttgcttcatactgggaactctattaaaatccgctgcgagggcatcagacttttcttgctctggctgcaggctctgcagacaaattgtgcagaggagcaggtcctcatcttcgcatgtctcgtgccggggtttccagctgtaatgtcatcacggggaccatgcacactcgaaactcttattaacccaagcccgtcagtcgccgacgtgaagatatatcctgaagaaattacccccctgctacctgccatctctggcgaaaaaattgctgaggatcagacgtgtttcttccttcagatcctgctaaagtacatggtaatacaggctgcgagcttggagtggaagaataaagaaaaccaggacaccggcttcaagtttctatttaccttgtttcgaaagtattacttgccccacctgtttccatcttttacaaagcttaccaatatatataagccagtgctggacataccacatctcagacccaaacccgtttacataaccacaaccagggacaacgagaacatctactccaccaagattccctatatggccgcgcgggtagtgttcattaaatggattgtgactttcttcctggaaaagaagtacctaactgcaactcaaaataccaaaaacggcgtagacgtccttcctaaaatcattcagaccgtcggcggcggcgccgttcaggagagggcaccagagttggatgggggaggccctaccgaacaagacaagagccatagcaatagctcaaccctgagtgatagaaggctttctaactcctccctgtgcagtatcgaggaagagcatcggatggtttacgaaatggtgcagcgtatccttctgagcaccaggggatacgtgaattttgtgaatgaggtttttcatcaggcttttctgttgccctcctgcgagattgccgtcaccaggaaggtggtacaggtttatcgcaaatggatcctccaggacaaaccagtgttcatggaggagccagaccgtaaggacgtggcacaggaagacgccgagaagctagggttctcagagaccgatagtaaagaggcgtcctccgagagctccggtcacaagagatcatcttcatgggggcgcacatactcattcacgtcagccatgtctcgaggctgcgtaactgaggaggagaacaccaatgtcaaggccggggtacaggcacttctccaggtttttctgaccaattccgcaaacattttcctgctggaaccttgtgcagaggtacccgtgttgctgaaggaacaagtcgacgcatgcaaggcagtcttaataattttcagacggatgattatggaactcactatgaacaagaaaacctgggaacaaatgctccagattttactgagaatcaccgaggcagtcatgcagaagccgaaagacaagcagatcaaggatctgtttgcgcagtctcttgccgggctactgtttagaacgttgatggtggcctggattcgcgcgaacttgtgtgtctatatttcacgcgaactgtgggacgattttcttggtgttctgtcctccctgaccgagtgggaggaactcattaacgagtgggcaaatattatggattctctgaccgccgtccttgcgagaaccgtttatggggtagaaatgactaacctgccgctggacaaactctccgagcagaaggaaaagaagcagcgcggaaaaggatgtgtgctggatccacagaagggaacgactgtgggtaggagctttagcttgagctggcgttctcatcccgacgtcactgagccgatgcggtttcgttcggcaacaacttcaggagctcccggagtagaaaaagcaagaaatatagtaaggcagaaggctactgaggtagaagagtgtcagcagtcagagaacgctccggccgctggctccggacacctcaccgttggtcagcaacaacaggtcctgcggtcttccagcacgtccgacatacctgagccattatgctctgattcttcacaaggccagaaggcagaaaacacacagaattcaagcagctccgaaccgcagccaatacaggaaaataagggtcatgtgaaaagggagcacgaaggaatcaccatcctggtcaggcggagctcctcacccgccgaattggatctgaaggatgatcttcagcaaacacagggaaagtgtagagaaaggcagaaatcagaatctactaatagcgataccaccttaggatgtactaatgaggcggagctgagcatgggcccttggcaaacatgcgaggaggacccagagctcaacacgccaacagacgtcgtagcagacgcggatgcaaggcattggctccagcttagcccaactgatgcatccaatctcacggatagctccgagtgtcttacagatgattgtagcattatcgcaggcgggtcgctgaccgggtggcatccagactctgcggccgtcctatggcgccgggtgcttggaattttgggtgacgtaaataacatccagtctcctaagatacatgcccgtgtcttctgctatttgtatgagctgtggtacaagttagccaaaatccgagataatctggccattagcctggacaatcaatcttcgccaagcccccccgtgcttatcccccctctacgcatgttcgcctcttggctgttcaaagccgcaaccctccccaacgaatataaagagggtaagttacaagcctataggctgatctgtgcgatgatgacccgcaggcaggatgtactccccaactcagatttcctcgtccacttttaccttgtcatgcatctggggctaacgagtgaggatcaggacatcttgaacactataatcagacactgtcccccccgcttcttcagtctgggattccccggttttagtatgctggtaggcgatttcattaccgctgccgccagagtgctgtcaacagatatactgaccgccccacgaagcgaggccgtgactgtgcttggctcactggtgtgcttccctaacacttatcaggagatacccctgctgcagtccgttcctgaagtgaacgaggctattactggaaccgaagacgtaaaacactacctaatcaatattctgctgaagaacgctaccgaagaacccaacgaatatgcccgctgtatagcggtgtgctccctaggcgtgtggatctgcgaggaactggctcagtgcacttcgcaccctcaagtgaaggaggcaatcaatgtgatcggcgttactctgaaattcccaaataaaattgtagcccaggtagcatgcgatgttttacagctgttggtgtcctactgggaaaagctccagatgttcgagacaagcctccccaggaaaatggccgagattctggtcgctaccgtggccttcctcttgccaagcgcagagtattcctcggtggaaacagacaagaagttcattgtcagcctcctgctgtgtctccttgactggtgtatggcattgcccgtatctgtgctgctccacccagtgtcaaccgccgtgctcgaggaacagcactccgctcgggctcccctactcgactatatctatcgtgtccttcattgctgtgtctgcggtagttccacatatacacagcagtcccactatattctgactttggccgacctgagcagcaccgattacgacccgtttctcccattggccaacgtgaaatcgtcagaacctgtccagtatcactcctctgcggaactcggtaacctgttgactgtggaggaggagaaaaagcgtaggtccctagagttgattccactcactgctcgtatggtgatggctcacctggtaaaccatctgggacactatccactttccggaggtcctgctatcttgcactcccttgtgtctgagaatcatgacaatgcccatgtggaggggagtgagttgtccttcgaagtgttccgcagcccgaatttacagctgttcgtatttaacgactcgactctaatcagctacctgcagacccctaccgagggtcccgtgggcggaagcccagtgggttctttaagcgacgtacgggtcatagtgagggatatatctggtaagtactcttgggatggcaaggttctttacggccctctggaaggctgccttgccccaaatggacgaaaccccagtttcctgataagttcatggcatcgggacacattcggcccccagaaagattcatcccaagtagaggagggtgacgacgtcctcgacaagctattggaaaatattggccacactagtcctgagtgtctactgccttcccaactcaatctgaacgagccaagtcttactccatgtgggatgaattacgaccaagaaaaggagatcattgaggtgattttgcggcaaaacgcccaggaggacgaatacatccaatcccacaatttcgattccgccatgaaggttaccagccagggacagcctagccctgttgaacccaggggccctttctacttttgccgcctccttctggatgatcttggaatgaatagttgggaccgccgcaagaactttcatctgttaaagaaaaacagtaaattactgcgggagctgaaaaatttggactcacgccagtgccgggagactcataagattgccgtgttctatatcgccgaaggccaggaagataaatgttcgattttgtctaatgaacggggcagtcaagcctacgaggattttgtggccgggctgggctgggaggtggacctgtctacccactgtggatttatgggtggcctgcagcgcaatggtagcaccgggcagaccgctccttactacgccacctccacagttgaggtgatctttcatgtgagcacacggatgccctcagactccgatgattccctgaccaagaaactacgccacttaggtaacgacgaggtgcacatagtttggtccgaacacagccgcgactatcggaggggcataattccaaccgccttcggcgacgtgtctatcattatctatccgatgaagaatcatatgtttttcatcgccataacaaaaaagccagaggtaccatttttcggccctctatttgatggagcaatagtctcaggtaagctgttaccctctctagtctgcgctacctgcatcaatgcaagcagggcagtgaaatgtctgatcccactgtatcagtcattttacgaagagcgcgcattgtacctggaggccattatccagaatcatcgggaggtgatgacctttgaggacttcgcagctcaggtgttttcgccatcaccttcatacagtctgagcggcacagactag

SEQ ID NO: 22755 - DNA, 1041 bp, Artificial Sequence
  Description of Artificial Sequence: Synthetic coding sequence
atggcccggcccggccagcggtggctgggcaagtggctggtggccatggttgtttgggcactatgccgtctcgctacgccactggcgaaaaatttggagccagtgtcatggtcctcattgaacccaaagtttctgagcggaaaggggctcgtgatctatccaaaaattggcgataagctagacattatatgcccacgggccgaagccggccgtccgtacgagtactataagctttacttggtgagacccgagcaagccgcagcatgttctaccgtgctcgatcccaacgtgctcgtgacatgcaataggcctgaacaggagattcgttttacaattaaattccaggaattcagtccaaactatatgggtttagagttcaaaaagcaccatgattactatatcacctctacctccaacggaagcctggaggggctagagaaccgagagggtggagtgtgccgcactcgtacaatgaaaataattatgaaggtgggccaggatccaaacgcagtcacccctgagcagcttacgacatcccgccccagcaaggaggcagataataccgtcaaaatggctactcaggcaccaggttcaagaggtagtttgggagactccgatggcaaacatgagaccgtcaaccaggaggagaaatctggtcccggagcatccggcgggagctccggagatcctgatggcttttttaactcaaaggtagccctctttgcggccgtcggagcggggtgtgtcattttcctcctaatcataatatttctgaccgtgctgttattgaaactgcggaagaggcaccgtaagcatacccagcagagagctgctgcattgagtttgagcacgttggcatcacctaagggcggcagcgggaccgccgggaccgagccttccgatattataatccctttgagaaccaccgaaaacaattactgcccccattacgagaaagtgagcggcgactatggacaccccgtgtatattgtccaggaaatgcccccacagagccctgccaacatctattacaaggtttag

SEQ ID NO: 22756 - DNA, 1617 bp, Artificial Sequence
  Description of Artificial Sequence: Synthetic coding sequence
atggccagcgaccccatcttcaccctggccccccccctgcactgccactatggagcattcccaccaaacgcgtccggttgggaacagccaccaaatgcatccggggtttctgtcgcaagcgccgccctggccgcaagtgcagcatccagagtcgccactagtaccgatcccagctgctctggctttgcccctccagatttcaatcactgtctaaaggattgggactataacggcttgccagttctgactaccaatgctattggtcagtgggacctggtttgcgacttggggtggcaggtcattctggagcagattctgttcattctggggttcgcaagcggctacctttttctcggatatccagcagatcgctttggcagaagggggatcgtgctcttaacactgggcttggtggggccctgtggggtcggcggggcagctgccggctcttctaccggtgtaatggctcttcgcttcttgcttggctttcttctcgctggcgtcgatctgggggtttatctcatgagactggaactgtgtgaccccacccaacgcctgcgggttgccctggccggagaactggttggcgtcggagggcacttcctattcctcggactggcattagttagtaaggactggcgattcctacaaagaatgattacagcaccttgtatcctgtttcttttctatgggtggccgggattgtttctggagtccgcccgatggctcattgtgaaacgtcagattgaggaagcacaaagtgtgctgcgaatcctggcagagcgaaaccgcccgcatgggcagatgctcggagaagaggcgcaggaggcactgcaggatctggagaacacttgtcctttacctgcaaccagctcgttttccttcgcatccttgctgaactaccggaatatatggaagaacctcctcatattggggtttacaaattttattgcccacgcaattaggcattgctatcagcccgtgggcggcggcggatctcctagcgatttttatctctgtagcctgctcgccagcggcactgctgctctggcatgtgtgttcctgggagtgacagtggatcggtttggccgtcgaggaatcctcctcctaagcatgaccctgacaggtattgcctcactggtgctgttaggcctgtgggactgcgagcaccccatattcccgactgtgtgggcccagcagggcaatcctaaccgcgacttaaacgaagccgctattacgacgttctctgtgcttggattgttttctagccaagcagctgcaatcctcagcaccttgctcgccgcggaagtgatcccgaccactgttagaggaagaggcctgggcctgattatggccttaggagcccttgggggtctttcgggtcccgcccagcgtttgcatatgggacatggagcatttctgcagcacgtggttctggcagcatgcgctctcctgtgtatactttccattatgctgctgccagagaccaagaggaagctcttacccgaggttttgcgcgacggagagctttgcaggagaccttcactcctgaggcagccaccaccgacccggtgcgaccacgtcccgctgttggccacgcctaatccagccctgtag

SEQ ID NO: 22757 - DNA, 1128 bp, Artificial Sequence
  Description of Artificial Sequence: Synthetic coding sequence
atgagcaccgccggcaaggtgatcaagtgcaaggccgccgtgctgtgggaactcaaaaagcctttcagcatcgaggaagtcgaagtcgcgcctcccaaggctcatgaagtacgcataaagatggtagccgtgggaatctgtgggacagatgatcatgtagtgtcaggcacaatggttaccccactccccgtgatcctcggacatgaagccgccgggattgttgaatctgtcggtgagggagtgaccaccgtcaagccaggcgataaagtcatccctctggccattcctcaatgtggaaagtgtcggatatgcaagaatccagaaagcaactattgcttgaagaatgatgtgagcaacccgcagggcaccctgcaggacgggacctccaggtttacgtgtcgccgcaaacccattcaccacttccttgggatttccacgttttcccagtacacagtcgtggacgaaaatgctgttgccaagattgacgctgcctctccgcttgagaaagtttgcctgatcgggtgcggattctctacaggctatggtagcgccgttaacgttgcaaaggtgacccctggtagcacttgtgcggtgtttggactggggggggtcggattgtcagcaattatggggtgtaaagcagctggagcagcaaggataatcgctgtggatataaataaagacaaattcgccaaggctaaggaactcggagccactgaatgtatcaatccacaggattacaagaaaccaatccaggaagtactgaaagaaatgacagatgggggagtggattttagcttcgaggttattgggcgcctggatactatgatggcatcactcctgtgctgccatgaggcatgcggaacttcggtaatcgtaggtgttccccccgactcacaaaacctcagtatgaacccgatgctactgctcaccggacgcacttggaagggcgccattctaggcggtttcaaaagcaaggagtgtgttcccaagcttgttgccgattttatggctaaaaaattctctttggacgcgctgatcactcatgtgctgccttttgagaagattaatgaaggatttgacctgcttcattctggaaaatcgatacggaccatcttaatgttctag

SEQ ID NO: 22758 - DNA, 1641 bp, Artificial Sequence
  Description of Artificial Sequence: Synthetic coding sequence
atgtgcagcctgggcctgttcccccccccccccccccggggccaggtcacactgtacgaacataacaatgaactggtgacgggaagctcctacgaatcaccgccccccgatttccgtgggcagtggataaatttgccggtgctacagctgactaaagacccactcaagacaccgggtcggctggatcacgggacacgcaccgcattcattcatcaccgtgaacaggtgtggaaacggtgtattaatatatggagggatgtcggtctattcggcgttctcaatgaaattgccaattcggaggaagaagtttttgaatgggtcaagaccgcctctgggtgggctctggccctctgcagatgggcgagctcgctacacggctccctgtttccacatttatctctcagatccgaagatctgatcgcagagtttgcccaagtgaccaactggtcatcgtgctgcctacgggttttcgcctggcatccacataccaataagttcgctgttgcactgctggatgacagcgtgagggtctataatgctagttcaactatcgtgccgtccctcaagcacaggctgcagcggaacgtggcctcgctggcctggaagcccttgtctgcctccgtgttggctgtggcctgccagtcatgcattctgatctggaccctagaccccacatccctgagtaccagacctagctctgggtgcgcgcaggtcctctctcatcctgggcatactccggtcacatcactggcctgggcccccagtgggggcagactcctgtcggcaagcccagtggatgcagccatccgcgtgtgggacgtttctaccgagacttgtgtcccactgccctggttccggggaggaggcgtgactaacttactgtggtctcccgacgggagtaagatccttgcaactaccccttctgctgtgttccgcgtgtgggaggctcagatgtggacttgcgagagatggccaacattaagcggccggtgtcagacagggtgttggagtccagacggatcacgtcttttattcacagtgctgggcgagcccctgatatactcactgtctttccccgaaaggtgcggtgaggggaagggctgtgtgggcggtgcgaagtcggccaccatcgtcgccgacttgtcagagaccactattcagaccccggacggagaggaaaggttagggggggaggcccactcgatggtttgggatccatccggggagagactggccgtactaatgaaaggaaaacctcgggtgcaagacggcaagccagtgatactgctgttcaggacaagaaactctcccgtcttcgagctccttccctgcggcatcatccagggtgaacctggcgctcagcctcagctgattacatttcatcctagctttaataagggtgctctgctgagtgtcggatggagcacaggacgaattgcccatatccctctgtactttgtcaatgcccagtttccccggttctcccccgtgttaggacgtgcccaggaaccccctgccggcgggggcgggtccatccacgatctgccgcttttcacagagactagtcccacttccgccccttgggatcctcttccagggcctcccccagtcctgccacattctcctcactcgcacctttag

SEQ ID NO: 22759 - DNA, 576 bp, Artificial Sequence
  Description of Artificial Sequence: Synthetic coding sequence
atgggcaagaagaccaagcggaccgccgacagcagcagcagcgaggatgaagaggaatacgtcgttgaaaaagtgttggatcgtagggttgtaaaaggccaggtggaatacctgctgaagtggaaaggcttctccgaagaacacaacacttgggagcctgagaagaatttagattgtccagagctgataagcgaatttatgaagaaatacaagaagatgaaagagggcgagaacaataagccccgtgaaaaaagtgaatctaacaagaggaagtctaactttagcaactctgccgatgatatcaagtctaagaaaaaaagagagcagagcaacgacatcgctaggggcttcgaaagagggctggaacccgagaaaattatcggcgccaccgacagctgcggcgacctgatgtttttgatgaagtggaaagataccgacgaggctgatctggtgcttgctaaagaagctaacgttaagtgcccacagattgtcatagccttctatgaggaaagactgacctggcacgcttatcccgaggatgccgagaacaaagaaaaggagacagctaagtcatag

SEQ ID NO: 22760 - DNA, 1554 bp, Artificial Sequence
  Description of Artificial Sequence: Synthetic coding sequence
atgggccggaagagcaagaagtggggcaagaaggtgagccggtacgagggcaaggtccgccttaagaaggttcccgccaaaaagttggtgcccgcctggaaagagaaagtactctgggcattactggcagtcttgctggccagctggaggttatgggccatcaaagacttccaagagtgcacttggcaggtggtgctaaatgagtttaaacgggtgggcgaaagcggggtgagcgactcgttttttgaacaggaacctgtggacactgtgagttccttgttccatatgctcgtggactcgccgatcgatccttccgagaagtacctcggattcccatattacctgaagatcaattatagttgcgaggagaagccctctgaagatctcgtgaggatggggcatctcaccgggctcaagccgcttgtgctggttacattccagagccctgtgaacttctaccgctggaaaatcgaacagcttcagatccagatggaagcagcgccattccggtccaagggagggcctgggggcggcgggcgtgaccggaacctcgcagggatgaatatcaatggattcttgaaacgagaccgcgataacaatatccagtttacagttggcgaggagctgtttaacctgatgcctcagtactttgtgggagtctcaagccgacctttatggcatactgtggaccagtctccagtgctgatcctgggcggaatccctaatgagaaatatgtactgatgacggacaccagctttaaagacttcagcttggtggaggtgaacggggtaggacaaatgcttagtattgacagttgctgggtgggcagcttttactgcccgcattcagggtttacagcaaccatctacgacacgatcgccactgaaagcaccctcttcattcggcagaatcagctggtgtactatttcaccgggacctataccactctgtatgaaaggaaccgtgggagtggagagtgtgccgtggcaggtccgaccccgggtgagggtaccctggtaaatccaagtacggaaggatcttggatccgagtgctggcatccgaatgtatcaaaaagctctgtcccgtttactttcatagcaacggctcagagtacataatggctcttacaactggcaagcatgaggggtacgtacatttcggcaccattcgggtgactacttgctctatcatctggagtgagtacatcgctggagagtacacattacttcttcttgtggagagcggctacggcaacgcctccaagcgcttccaggtcgtttcgtataacactgcttctgatgacttagagctgctttatcacatccccgagttcattccagaggccagaggcctggagtttcttatgatcctcggaaccgagagctatactagtaccgctatggcgcctaaaggcatattttgtaatccctacaataacctgatcttcatttggggcaatttcctgctacagcgcagcggaacaagctggcgcgccgcgacaggctccaccagttgttcacttcctcgggctggcagatgcaccagtgcttag

SEQ ID NO: 22761 - DNA, 1203 bp, Artificial Sequence
  Description of Artificial Sequence: Synthetic coding sequence
atgagcggccgggtgggcgacctgagccccaagcaggccgagaccctggcaaaatttagagaaaacgtccaagatgtcctgccagcgctgcctaaccctgatgactactttctgctacgatggctccgtgcccgaaattttgatttgcagaagtctgaggctctgttgaggaagtatatggaattccgaaaaacaatggacattgaccacattttagactggcagccccctgaggtgatccagaagtacatgccggggggtctctgcggatacgatcgggacggctgtcccgtatggtatgatattatcggaccactcgaccctaagggactgcttttttctgttactaaacaggaccttctcaagaccaaaatgcgcgactgtgagagaatcctgcacgaatgtgacctgcagacagaacgtctgggaaaaaagatcgagaccattgtgatgatctttgactgtgagggactagggctgaagcatttttggaaacccctggtggaggtctaccaagagttctttggactgcttgaggagaattaccctgaaactttaaaattcatgttaatagtgaaggcaacgaaactttttcccgtgggatacaacctgatgaagccgtttctttcagaggacacaaggcggaagatcatcgttctcgggaataattggaaggaggggcttttgaagcttatttccccagaggaactgccagcccaattcggcggcaccctaaccgatccagatggcaatcccaagtgtctgacgaagatcaactacggtggagagatccctaagtctatgtacgttcgggaccaagtcaaaacccaatacgaacactctgtccagatcaacagaggctcaagtcaccaggtggaatatgagattctgttcccaggatgcgttttgaggtggcagtttagtagtgacggtgccgacattggatttggtgtttttctaaaaactaagatgggggagaggcagagagccggcgaaatgaccgacgttcttccttcgcagagatacaacgctcacatggtccctgaagatggcaacttgacatgctcagaggcaggagtatacgtgttaaggtttgataacacgtactcctttgtacacgctaagaaggtgtcttttaccgtggaggtgctgcttccagatgagggaatgcagaaatacgacaaagaactaacacccgtatag

SEQ ID NO: 22762 - DNA, 636 bp, Artificial Sequence
  Description of Artificial Sequence: Synthetic coding sequence
atggccgagcagcacggcgcccccgagcaggccgccgccggcaagtctcacggagatttgggaggctcgtacaaagtgattctctacgagctggagaatttccaggggaagaggtgtgagctgtccgctgaatgcccaagcttgacggactccctcctggaaaaggttggcagtatccaggtggaatctggtccctggttagctttcgaatccagagcattcagaggggaacagtttgttctcgaaaagggtgattaccccagatgggatgcatggagtaattctcgggattcagacagtctcctttcacttagacctttaaatatcgatagccctcatcacaagctccatctgttcgagaatcctgctttcagtggcaggaagatggaaatcgttgatgacgacgtcccatccctctgggcacacggttttcaggatcgggtggcctcggttagggcaatcaatggaacatgggtggggtacgaattccctggatatcgcgggaggcaatacgtgttcgaaagaggcgaatatcgccactggaatgagtgggacgcctcccaaccacagttgcagagtgttcggcgaattcgtgaccaaaaatggcacaaaaggggacgctttccgtcatcttag

SEQ ID NO: 22763 - DNA, 387 bp, Artificial Sequence
  Description of Artificial Sequence: Synthetic coding sequence
atgaccgaggccgacgtgaaccccaaggcctaccccctggccgacgcacacctgaccaaaaaactgcttgacctcgtgcagcaatcgtgtaattataagcagctgcgaaagggcgcaaatgaggccactaaaactctgaatagaggcattagcgagttcattgttatggccgccgatgcagagcctttggaaattattctgcacctgccgctcctgtgtgaggacaagaatgtcccctacgttttcgtgagatctaagcaagccctaggaagggcctgcggtgtgtcaagaccagttattgcctgttctgtgaccatcaaagaaggaagccaactgaagcagcagattcagtccatccaacagtcaatcgaacgccttttagtgtag

SEQ ID NO: 22764 - DNA, 2592 bp, Artificial Sequence
  Description of Artificial Sequence: Synthetic coding sequence
atggccggcccccggggcgccctgctggcctggtgccggcggcagtgcgaaggctaccggggagtagagatccgcgacctttcgagtagctttcgggatggtctggctttctgtgctatcttgcaccgccatagacccgacctgctggacttcgatagcctgtctaaggacaatgtgttcgaaaacaaccgtctggctttcgaggtggcagaaaaggaattgggcatcccggcgcttctggatcctaacgatatggtgtcaatgtccgtgccagactgtctcagcatcatgacttatgtcagtcaatattataaccacttttgttccccaggacaagccggcgtaagccccccacggaaagggcttgccccatgtagccccccaagcgtggcccccacgcccgtggagcccgaggacgttgcacagggcgaggaactgagtagtggctctctgtccgaacaaggtaccggacagacgcccagctccacatgtgccgcctgccaacagcatgtacacctagtgcagcgctaccttgcagacggtcgcctataccaccggcattgcttccgatgccgtcggtgctcctccacactgctccctggcgcttacgagaacggtccagaggaggggacgtttgtctgcgctgaacactgtgccaggctggggcccggcaccaggagcggaacacgccccggaccattcagccagcccaagcagcaacatcaacagcagctggccgaagacgccaaagatgtgccagggggtgggccatcatcaagcgcacctgctggcgctgaggcagatggacccaaagcctccccggaggcccgcccccagatcccaactaagcctagagtgcctggcaagcttcaggagttggcaagtccacctgccggccggcctactccggcaccaaggaaggcttccgaatccaccaccccagcccccccgactcccagacccagatccagcctacagcaagagaatcttgtggagcaagctggcagtagctccctcgtgaacgggcggttgcatgagcttccagtgccaaaaccacgcgggacccctaagccttccgagggcacgccggccccgcgcaaggatccaccatggattacgctggtgcaggccgaacctaagaagaaacccgcacccctgcccccctcgagttcccccggcccgccctctcaagatagcaggcaggtggagaacggtggcaccgaggaggttgcgcagccctcgcccacagcaagcctcgagagcaagccctataacccattcgaagaagaggaggaagacaaggaggaagaggcaccagccgccccctccctggccaccagtcctgcattgggccatcctgagagcacccctaagtctctccacccctggtacggaatcacccccacatcatctcctaagaccaaaaagcgacctgcccccagagcaccaagcgcaagtccactcgccctgcacgcgtctcggctctcacactcagagcctcctagcgctactcctagtccagcgctgtccgtggagtcactgtcttcagagtcagcatcgcaaacggcgggcgctgaactgttagagcctccggcagtacctaagtcttcctctgagcccgccgtccacgcaccagggactcccggcaaccccgtcagtctttccacaaattcctccctggcttcgtccggcgaactcgttgagccccgcgttgaacagatgcctcaagcttcccccgggctcgcccccaggactagggggtccagcggtccacaacccgccaagccatgctccggagcaacacccacaccgcttcttctcgtcggagataggtctcctgtcccctcccctggttctagctccccccagctccaggttaagagctcatgcaaagagaatccattcaacagaaagccatctcccgctgcttctccagccaccaaaaaggccaccaagggatctaaacccgtgcggccccccgccccagggcatgggtttcctttaattaaacgaaaggtgcaggcagaccaatatattcccgaggaggacattcatggagaaatggacaccatcgaacggcgcttggacgccctagagcaccgtggggtgttactggaagaaaaactccgaggtgggttaaatgaggggcgggaagacgacatgctggtggactggtttaaactcatccacgagaaacacctactggtccggcgagagagtgagctgatatatgtgtttaagcaacaaaatcttgagcagaggcaggccgatgttgagtatgagttgcggtgcctgcttaataagcctgagaaggattggactgaggaggatagggctcgtgagaaggtgctcatgcaagagcttgtcaccctcatcgagcagcgcaatgcgatcattaactgcctggacgaagatcggcaacgagaagaggaagaggacaagatgcttgaggccatgatcaagaagaaagagttccagcgcgaggctgagccagaaggcaagaaaaaaggcaagttcaagaccatgaagatgctgaaattgctgggaaataagagggacgctaagagtaaatctcccagggataaatcgtag

SEQ ID NO: 22765 - DNA, 708 bp, Artificial Sequence
  Description of Artificial Sequence: Synthetic coding sequence
atgtggcggggccgggccggcgccctgctgcgggtgtggggcttctggcctacaggagtacctcgccggagaccactgagttgtgacgcggcctcccaggctggcagcaattatccgcgttgttggaactgtgggggcccttggggtcctgggcgggaggataggttcttttgtccacaatgtagagccctccaagcccccgaccccacccgcgattacttcagtctgatggactgcaatcggagtttcagggtagacacggctaagcttcaacaccgataccagcagcttcaaaggttggtccatccagactttttcagtcagcgatcacagactgagaaggactttagtgagaaacatagcacactggtcaacgacgcctacaagacattgctggcgccactatctaggggattatatctactgaaactacacggcatagagatcccagaacggaccgactatgaaatggatcgtcagttcctaatcgagattatggaaattaacgagaagctagctgaggcagaatctgaggccgcgatgaaagagatcgagtcaatcgtcaaagccaagcaaaaagaatttacagacaatgtctcttcggccttcgagcaggatgacttcgaagaggcgaaggaaatccttaccaaaatgcgatacttcagcaacattgaagaaaagatcaagctcaaaaaaattcccctctag

SEQ ID NO: 22766 - DNA, 2010 bp, Artificial Sequence
  Description of Artificial Sequence: Synthetic coding sequence
atggccaccgagcggagccggagcgccatggacagccccgtgcccgctagcatgtttgcacccgagccatcatcacccggcgccgccagggccgcggcggcagctgccagactgcatggcggctttgacagcgattgctcagaagatggcgaagccctaaatggcgaacccgaactcgatctcacgtcaaagttggtgctggtttctccaacttccgagcagtacgactcacttcttcgacagatgtgggaacggatggatgaaggatgtggcgaaacaatatatgtaattggacaggggtcagacgggactgaatatggcctctcagaggcagacatggaggcctcgtacgcaactgtgaagtcaatggccgagcagatcgaggcagacgttatcttactgagagaacgtcaggaagctggtgggagagtgcgagattatttggtgaggaagagggtgggggacaacgacttcttggaggtcagagtcgccgtcgtgggcaacgttgacgcaggtaaatcaactttgctaggggtcctcacccacggcgagctggataacggccggggcttcgcaaggcaaaagctgtttagacataaacatgagatcgaaagcggccggacttcatccgtcggcaacgacattcttggttttgactcagagggtaatgtggttaataagcctgactctcacggaggatcacttgaatggacaaaaatatgtgagaagtcaaccaaagtcatcaccttcatcgatctcgcaggccatgagaaatacctaaaaactaccgtatttgggatgaccgggcatcttcctgatttttgcatgctcatggtgggctctaacgctggaatcgttggtatgacaaaggagcacttgggtttggcactggcattgaatgtgcctgtgttcgttgtggtgactaagatagacatgtgcccagccaacatccttcaggaaactcttaaactcctgcagcgattacttaagtcgcccgggtgccgcaagataccggtacttgtgcagtccaaggacgatgttatcgttacagcgtccaacttcagcagtgagaggatgtgtcccatcttccagataagcaatgtgacgggcgaaaatctggatctgcttaaaatgtttttgaaccttttgagccctaggactagttacagggaagaagaaccggctgaatttcaaattgatgatacctacagtgtaccgggcgtggggaccgtggtgagtggtaccacattacgggggcttataaagctgaacgacaccctgctactggggccggaccctttagggaacttcttgtcaattgcagtcaaatcaattcatcggaaaagaatgcccgttaaggaagtacgcgggggacagactgcgagctttgctttaaagaaaataaaacgcagctctatcagaaagggaatggtaatggtcagtccaagactgaatcctcaggcatcatgggagtttgaagccgagatcctcgttttacaccatccgactaccatctccccccggtatcaggcaatggtgcactgcggctctatacgtcagacagctacgattctgtctatggataaggactgccttcggaccggggataaggctaccgtgcacttcagattcattaagacaccggagtatctccacattgatcagaggctggtcttcagggagggtcgtacgaaagccgtaggaaccattacgaaacttctccagactaccaacaattctcctatgaacagtaagcctcagcagattaagatgcagagtaccaagaagggcccactgacaaaacgagacgagggcggcccttcaggaggacctgctgtcggcgctccacctccaggggatgaagcctctagtgtcggtgctggtcaaccagccgcgagcagtaatcttcagccccagcctaaaccatcaagcggggggcgaaggagaggagggcaaagacacaaggtcaagtcccagggcgcctgtgtgacaccagcatcagggtgctag

SEQ ID NO: 22767 - DNA, 1656 bp, Artificial Sequence
  Description of Artificial Sequence: Synthetic coding sequence
atggccgcccccgccctgagctggcggctgcccctgctgatcctgctgctgcctttggcaacctcatgggctagcgccgccgtcaacggtacctcccaattcacttgtttttataactctcgtgcaaatattagctgtgtttggtcccaagatggtgctttacaggatactagctgtcaggtccatgcctggccagaccgccgccggtggaaccagacatgtgaacttctacctgtgagccaggccagttgggcatgtaatcttattttgggggccccagactctcaaaagctgaccactgtggatatcgtgactctgcgggtactatgtcgtgagggtgtgcgctggcgtgtgatggccatacaggattttaagccctttgaaaatctacgactcatggctccaatcagtcttcaggtggtgcacgtcgagacccacaggtgcaatatctcctgggagatctcccaagcatcgcactacttcgagaggcacctggagtttgaagccagaaccctgagtccaggacacacatgggaagaagcaccactcctcaccctcaaacagaaacaggagtggatttgcttggagacacttacccccgacacccagtacgaattccaggtccgggtcaagcccctgcagggtgagttcaccacctggtctccctggtcccagcccctggccttcaggacaaaacctgctgcccttggtaaggacaccatcccctggctcggccacctgctggttggactctcaggcgcatttggttttataatcctggtatacctgctcatcaattgccgcaatactggcccgtggctgaagaaagtcctgaaatgcaacactccggatccgagcaagtttttctcccagctttcctccgaacacggaggcgacgtgcagaagtggctcagtagtcctttcccttcttccagcttctcccccggagggctcgcccccgagatcagccccttggaggtcctggaacgagacaaggtcacacagctgctgctgcagcaggataaggttcccgagccagcttcactgtcttctaaccacagcctcacttcatgtttcacaaaccagggctattttttctttcacctgcccgacgccctggagatcgaggcatgccaagtctacttcacttacgacccctacagcgaagaagaccctgatgagggcgtggctggtgctccaaccggcagctccccacagcccctgcagccgctgtcaggcgaagatgatgcctattgcaccttcccaagcagggacgacctcttgctattttctccatcgctgctcggcgggccatcaccgccctctaccgctccagggggctccggagcaggggaagagcggatgccaccgagcctgcaggaaagagtgccccgcgactgggatccacagcctttggggccccccaccccaggggtgcctgatctggtggatttccaaccaccacctgaactagtgctgagggaggctggtgaagaggtgccagatgccgggccccgggaaggagtcagtttcccttggagcagaccacccgggcagggcgagttcagagcccttaacgctagactgccccttaataccgacgcatatctgtctctgcaggagctgcagggccaggatcctacacaccttgtctag

SEQ ID NO: 22768 - DNA, 3516 bp, Artificial Sequence
  Description of Artificial Sequence: Synthetic coding sequence
atggagaacaacctgaagacctgccccaaggaggacggcgacttcgtgagtgacaaaatcaagtttaagatcgaagaggaagacgatgacgggatcccacctgattctctcgaaaggatggatttcaagagcgaacaagaagacatgaaacagacagatagtggaggcgagcgagctgggttagggggtacaggttgctcatgtaagcctcctggaaaatatctttcggccgagtccgaggacgactacggtgctctcttctcgcagtacagctcaaccctgtatgacgtggcgatggaagccgtgacacagagcctcttgtcgtccagaaacatgagcagtcgcaaaaaatccccagcctggaagcacttcttcattagcccccgggattccacgaaagctatttgcatgtactgtgtgaaagaatttagccgcggaaaaaatgaaaaggatctttccactagctgcttgatgcgtcacgttagacgggcacatcctaccgtgcttatccaagagaatggatccgtaagtgccgtcagcagctttcctagcccttctctgctcttaccgccgcagcccgcagacgcaggtgatctaagtacaatcttgagtcccatcaaattagtgcagaaggtagcatcgaagattcctagccccgataggatcacagaggaaagcgtgtccgttgtaagttcagaggagatcagctccgatatgtccgtgtcagagaaatgtggcagagaagaggcactggtcggatcgtcaccacacctccccgcgctgcattatgacgaacccgcggagaacctggccgaaaaatctcttcccctgcccaagtccacatccggctcacgcagaagaagcgccgtctggaagcacttctatctttcacccctggataattccaaagcagtttgcatccattgtatgaatgagttttcccggggaaagaacggcaaagacctgggcacgtcttgcttgatccggcatatgtggcgagcacatcgcgccattgtcctgcaagagaatggcggcacgggcattccccccctctactctacaccgccaacactgctcccgtccttgcttccaccagaaggggagctgtcctctgtttcctcatcccctgttaagccagttcgtgaaagccctagcgccagttcttcacctgatcggctgaccgaggacctgcaaagccacttaaatcctggggatggtctcatggaggatgtcgccgccttcagtagcagcgatgacatcggagaagcctccgccagttccccggagaaacagcaggccgatggactatctccccgcctgtttgagagcggtgctatattccagcagaataagaaagtgatgaagcggcttaagtcagaggtctggcaccacttctcgttggcgcccatggactcactcaaggcggagtgtcggtactgcggatgtgcgattagtcgcggtaaaaagggcgacgtgggtacgtcttgcctcatgaggcacctttataggagacatccagaggtggttggctcacaaaaagggtttctgggggcctcgctggctaacagcccctacgccacccttgcttctgccgaaagttcttcatctaaattgaccgatctcccaactgtggttaccaagaataaccaagtgatgttccctgtgaatagtaaaaagacgagcaagctgtggaaccattttagtatatgtagtgccgacagcaccaaggttgtctgcctgcattgtgggaggacaatctcacggggaaaaaaacctacgaacttaggaacaagctgtttgctgcggcatctgcaaaggttccactctaacgttctcaaaactgaggtgtccgaaacagctcggcctagctcacccgatactcgtgtgccaagagggactgaactctctggcgctagcagctttgacgacacaaatgaaaaattttacgactcacacccagtcgcaaaaaaaattacttctctgatcgcagaaatgattgcgttagacctccagccatacagctttgtggataatgtaggattcaatcgcttgctggaatatctgaaaccacagtacagcctcccggccccttcttacttttcaaggacggcgatacccggcatgtacgataatgtaaagcagatcattatgtctcacctgaaggaggcggaatcaggcgtaattcacttcaccagcggaatttggatgtccaaccagaccagggagtatcttaccctgaccgctcattgggtctcattcgagtcacctgcccgacccagatgtgacgaccaccactgcagcgccctgttagacgtatcacaggttgactgtgattactctgggaactctattcagaaacagctggaatgttggtgggaagcctgggtcacttccactggcctccaagtggggataaccgtgactgataatgcttctatcggcaagactctgaacgagggggaacacagctccgtgcagtgttttagccacacagtgaacctgatcgtgtcagaggctattaagagccaaaggatggttcaaaatctgctatcattggcgcgaaaaatatgtgaacgggtgcatcgctctccaaaggctaaggagaaattagcagagctacaacgagaatatgctcttccccagcatcatctaatacaggatgtgccatccaagtggtccactagcttccacatgctcgagcgactaattgagcagaaacgcgctattaatgaaatgagcgtagagtgtaactttcgcgagctgatatcttgtgaccagtgggaggtgatgcaaagcgtctgtagagctctgaaaccatttgaagccgcaagtagagagatgagcacgcagatgtccacactgtcacaagtcatcccaatggtccacattttgaaccgcaaggttgagatgctcttcgaggagacaatgggaattgacacaatgcttcgtagcctgaaagaggctatggtgagtcgcttgtccgccacccttcatgatcctcgttacgtcttcgctacactccttgacccgcggtataaagcctctctattcacagaagaagaagcagagcagtataagcaggacctcattcgcgagctggaacttatgaattctacgtcagaagacgtggctgcaagccatcggtgcgacgcaggatccccgagcaaagattctgccgctgaggagaacctgtggtctctggtagctaaagtcaagaagaaggacccaagggagaagttgcccgaagcgatggttctcgcatacctggaggaagaagtcctggaacacagttgtgatcctctgacctactggaacctgaaaaaagcttcttggccggggttgtcagcacttgccgtacgctttctggggtgcccgccaagcatagtcccttccgagaaactttttaacacacctaccgaaaatgggagtctgggccagtcacgacttatgatggaacactttgaaaagctcatttttctcaaggtaaatctgccgctgatctactttcaatactag

SEQ ID NO: 22769 - DNA, 744 bp, Artificial Sequence
  Description of Artificial Sequence: Synthetic coding sequence
atgcagcccatcctgctgctgctggccttcctgctgctgccccgggctgacgcaggtgagattatcggagggcacgaggcgaaaccgcattcccgaccatacatggcttatctcatgatctgggatcaaaaaagcctcaagaggtgcggaggatttcttatccgagacgatttcgtgctcaccgcagcccattgctgggggtcctcaataaatgtgacgcttggagcacataatatcaaagaacaggaacctacccagcagttcattccagtaaagagacccatacctcatcctgcatacaaccccaaaaatttctccaacgacattatgctgctccagctcgagcgaaaggccaagagaacccgcgcggtacagcctttgcgactgcccagtaacaaagctcaggttaaaccaggacagacttgctctgttgcaggatggggccagacggcccccctgggcaagcacagccacacactccaggaggtgaagatgacggtgcaagaagatagaaagtgtgaaagtgatctaagacattattacgacagtacgatcgagctttgtgtaggcgaccccgaaattaagaagacatcttttaagggtgattctgggggcccactcgtttgcaataaggtggctcagggcattgtctcctatggtcggaataacggcatgcctcccagagcgtgtacgaaagtctccagtttcgtgcattggattaaaaagacaatgaaaagatactag

SEQ ID NO: 22770 - DNA, 1062 bp, Artificial Sequence
  Description of Artificial Sequence: Synthetic coding sequence
atggaggacggcgtgctgaaggagggcttcctggtgaagcggggccacatcgtgcataattggaaggctcggtggtttatcctgagacagaataccctggtgtattacaagctcgaaggtgggagacgcgtaacccctcctaaagggaggatcttgctggatggatgcaccatcacatgcccatgcctagagtatgagaacaggccactgcttatcaaactcaagactcagacctccactgaatattttttggaagcttgcagccgcgaggagagggacgcatgggcgttcgagatcaccggggccatccatgcagggcagcccggaaaagtgcagcaactgcactctctcaggaattcatttaagctgcccccacacatcagtctccacaggattgtagacaaaatgcatgacagcaacaccgggattcgcagttctccgaacatggaacagggctccacttacaaaaaaacctttcttgggagttctctggtagattggttgatcagcaactctttcacagccagccggctcgaggccgtgacgctagcctccatgttgatggaggagaactttctgagacctgtcggggtgcggtcaatgggggctatcaggtcaggtgacttggctgagcagttcttggacgactctaccgcattatatacttttgccgaatcttataaaaagaagatcagcccaaaagaggaaatttctctttcaacagtcgaactgagtggtaccgtcgtcaagcagggatacttagctaagcaggggcataagcggaaaaattggaaagtgagaagattcgtcctgagaaaagatcctgcttttctccactactatgacccttcaaaggaggagaaccgccccgtaggaggattctctcttcggggctctctggtgtctgccctcgaggataatggcgtgcccactggcgtaaaagggaacgttcagggaaacctgttcaaagtaatcaccaaagacgatacacactactacatccaagcttccagtaaggctgaacgggccgaatggatcgaagctattaaaaagttaacctag

SEQ ID NO: 22771 - DNA, 2025 bp, Artificial Sequence
  Description of Artificial Sequence: Synthetic coding sequence
atggccgaggtgcccgaggactacgacagcggccccgacgaggacggcgagcttgagccggaacgcccagaactgcccggattgcacaagctgtatgaaaatgcggagcccgataccatggccaaggctgacagcaaactcccggccgagatctatcaggagccgcagccagagaccgaggaagaggactttaaggagggcgagcctgattctgctaagaacgtgcagcttaagcctgggggtacctcgcaggaaggcatcgcaaaagagagtaagcgcgatgtgccatcagaaacggaaccagggatccaccaagaagtgaagtccgagaccagtcgagagatgggcgaatttttcaaagacctggaagcccccatggatgaaacccataaggaaagcgacctggagccgcctgaggaagcaaagccaaacgtaacagaggacgtttttttggagagcgccatggagactgatcccgaccctgtccctccaaccgagacaatgtcagaagtgagcggcgctacggtccgtgaacgcaacttggaactgcttgaggaggagactgagcccggcgttcccgaggagagcctgagggtgcagcacgaagagactggcctcgaaccccctgaacaaaccaaacaggatttccccagcgagaaactgggcgaatcactggaagagactgatctccaacctcccaaaatgactaagcctgaaacacctgaggagactcagcgggagtctacagaaaaaaagagaactgaaccacctgaacaggcccgactcgaatttttagagaaggagcccagaaagtcgagtgaagaagcgggcctggagcctcccgaggagacccagcccgaggttccagaagagatgcagagaaaagccacggaggaaaaaggaacggaactaccagaacgcacgaagccagatttccctgaccataagccgcggaaatccacagacgaaaatgttcccgagccgctagaagagattaaattagagttccctgaggaggaatctcggaaaactaatgaggagacaatccttgagcagagtgagatgatgaagcctgaaagccctgaagaaatcagaaaatccaacgagaaaaagaatcctcagcctccggaggaaaccggtcctgtcctgcctcaagagattaaccctcaagttgaggaaaagacccagaccaaacccaccgagaagattctggagcttcccgacgagacgaaaccgcgggagactcatgtggagtttagcaaagaggacagacctgaaccaattaagtcaaagtacagcgtgggaaatgacgagctggaacacagggagccaaagcgcggaaaactttcgctgtcagataagttccgcaaggagtactacgccctggggtccttgagggagtctgaggaatctatagggacacattacgagtttctccaacccctgcaaaaattactcaacgtctccgaagaatgttcatacagtgatccctctgagtcacagactgaactgtcagagttcgtccatgaaaaggaggtggttgatctctcccaggagcttaaagagagagtgagtgaggatgatgagacccagccagaaaaaggaaccgaattgcagtttgaacacctgaactgggaccccgaagaggtggcggaatggatcagccaactgggcttcccccagtacaaggaatgctttattaccaatttcataagcggcaggaagctcatccatgtgaactgctcaaatctcccacagatgggaatcacaaatttcgaagacatgaaggccatttccagacatacacaagaactactggagatcgaggagcccctctttaaacggtccatcagtctgccttatcgggatataatcggactctacctagaacaaaaggggcatactggcatcaaaagtgactccctgaccctgagcgagtttgttaaagcggccggcttacaggactatgccccagaaataaccgctcccgaggagaacgaggaactcccatgcaccgaaccatag

SEQ ID NO: 22772 - DNA, 1689 bp, Artificial Sequence
  Description of Artificial Sequence: Synthetic coding sequence
atgcggcccgagcccggcggctgctgctgccggcggaccgtgcgggcaaatggatgtgtcgcgaacggggaagtgaggaatggttacgttcgttcctccgccgccgccgcagctgccgccgctgcagggcagattcatcacgttacacaaaacggagggttatacaagcggcccttcaacgaagcctttgaagagacgccaatgttggttgctgtactgacatacgtaggatacggggttcttaccctgtttggatacttacgtgacttcctaaggtattggcgcattgaaaaatgccaccatgccactgagcgtgaggagcaaaaagatttcgtctcgctctaccaggactttgaaaatttctatacacgtaatctctacatgaggatccgcgataattggaacaggccaatttgcagtgtgccaggtgctagggtggatatcatggagaggcagagtcacgactataattggtcatttaaatataccggaaacattattaaaggtgtgataaatatgggctcttataattacttaggcttcgcacggaataccggctcttgtcaggaagctgccgcaaaggtactggaggagtacggtgccggcgtatgctccaccagacaggagatcgggaatttagacaagcacgaagagctcgaggagcttgtggccagattccttggggtggaagccgctatggcctacggtatgggcttcgcaaccaattcaatgaacattccggccttggtgggaaaaggatgtctcattctgagcgatgaactgaaccacgcctcattggttctcggcgctcgcctgagcggggcaaccatacggatctttaagcacaacaacatgcaaagcctagaaaagctgctgaaagatgctattgtgtacggccagcccagaacacggagaccatggaagaaaatcctgatattagtagaggggatctacagcatggaaggatccattgtgcgacttcccgaggtgatagctctcaagaagaaatacaaagcctatctatacctggacgaagcccatagcatcggtgccttaggtccaacaggtaggggggtggtagagtactttggattagaccccgaggacgtagatgtgatgatggggacattcacaaaaagttttggagcatccggaggatacattggaggtaagaaggaacttatagactatctgaggacccattcccatagtgcagtgtacgcaacatctttgagtccccctgtggtggaacaaattatcacttctatgaagtgcatcatgggccaggacgggacttctctcgggaaagagtgtgtgcagcagttggcagagaacacaagatactttagacggagactcaaagagatgggcttcattatctacgggaatgaggactcacctgtcgttcccctgatgctgtacatgcccgcaaagataggggccttcggacgggaaatgctgaagcgaaacattggggtggtcgtggttgggttcccagcgacacctattattgagtccagagcccgcttctgtctgagcgcagcccacactaaagaaattctggacactgcactcaaggaaattgatgaggtaggtgacctcctgcagctcaaatacagtaggcacaggctggttccgctcctcgaccggccttttgatgaaacaacttacgaagagaccgaggactag

SEQ ID NO: 22773 - DNA, 2346 bp, Artificial Sequence
  Description of Artificial Sequence: Synthetic coding sequence
atgagcagcagcagccccaccggccagatcgccagcgccgccgacatcaaacaggagaacgggatggaatctgctagcgagggacaggaagcccacagagaagtcgcagggggagcggccgtggggctatctcctccagcccccgctccgttcccccttgagccaggcgacgccgctactgcggcggccagagtgagcggagaagagggcgccgtggctgccgccgccgccggggccgcagcagaccaggtgcagctacattctgaactcctgggccgtcaccatcatgccgctgcagctgctgctcagacacccctggccttctcacctgatcacgtggcttgcgtgtgcgaagcactacagcaaggaggtaatctagaccgtcttgcaagatttctgtggtctcttccacagagtgacttactacgcggaaatgagtctcttttgaaggccagagctctggtggcgttccaccaaggtatatacccagagctgtattcaatccttgagtcgcattcttttgaatcagccaatcaccctttgctccaacaactgtggtataaagcacggtacactgaggccgaaagagcacgcgggaggcccctgggagctgtggataaatacaggctgcggaggaaatttccccttcctaggacaatttgggacggggaggaaactgtgtattgtttcaaggagaagtctcgaaatgccctaaaagaattgtataagcaaaaccgatacccaagtcctgctgagaagaggcacctggccaaaatcaccggcctgtcacttactcaggtgtcaaactggttcaagaatcgaaggcagagagacagaaacccatccgaaactcaatccaagtctgaatctgatggcaatccttctacggaggatgaaagtagtaagggccacgaggatctgtccccacatcccctgtccagtagcagcgacggcattaccaatttaagcctgagctctcacatggaacctgtctacatgcagcagatagggaatgccaagatcagcctgtcctctagcggtgtgctccttaacggaagtctagtcccagcctccacctcaccagtttttctgaatggtaatagtttcatccagggcccctcgggcgtgattctgaatggcctcaacgttggcaacacccaagcggtcgccctgaatcccccgaaaatgagtagcaacatcgtgagcaatggtatttctatgacagacattctcggctcgacatctcaggatgtgaaggaattcaaggtgttgcagagcagcgccaacagcgcaacaactacttcatactctccatctgttcccgtgagcttcccagggctaattccaagcactgaagtgaaacgggaaggaattcagaccgtcgcgagccaggacggcggcagtgtggtaacatttacaacccctgtccagatcaatcagtatgggatcgtacagattcccaacagcggcgccaactctcagttcctgaacggatccatcgggtttagtcccctgcaactgccgcctgttagtgtggctgcgagccaggggaatattagcgtgagctcttccacctccgatggctctactttcacatccgaatcgactaccgtgcagcagggtaaggtgtttctctcttctctcgccccgtctgccgtagtttacaccgttcccaacaccggccagacgattggctccgttaaacaggagggtctggagagatctttagtattctcccaactcatgcccgttaaccagaacgctcaggtgaacgctaatctgtccagcgagaacattagtgggtcaggactgcatcccctagcctcctctctggttaacgtgtctcctacacacaacttcagtctgtctccttcaacactgttaaatccaaccgaactgaaccgcgacattgctgattcccagccaatgtccgcacccgttgcctccaaatccacagtcacatcggtttcgaacaccaattatgccacccttcagaattgcagcttaattactgggcaagacctcctcagtgtgcctatgacccaggctgcccttggcgagatcgtcccaactgccgaggatcaagtgggacatccatctccagccgtccaccaggattttgtgcaagaacaccgtctggtcctccagagtgtagccaacatgaaagagaatttccttagtaactctgagagcaaggcaacaagcagcctcatgatgctggatagcaagtccaaatacgtgctagatggcatggtagataccgtgtgtgaggatctagaaaccgataagaaggaattagcgaagctgcaaaccgtacagcttgacgaggacatgcaggacctgtag

SEQ ID NO: 22774 - DNA, 1392 bp, Artificial Sequence
  Description of Artificial Sequence: Synthetic coding sequence
atgggcaaggagaagacccacatcaacatcgtggtgatcggccacgttgacagtggtaagtccaccacaacgggccatcttatatataagtgcggaggcatagacaaacgtacaattgaaaagttcgaaaaggaggctgctgaaatgggaaagggaagcttcaaatatgcatgggtacttgataaattgaaggccgaacgggaacgcggcattacaatcgacattagcctttggaagtttgagacaacaaagtactatatcactattattgatgcccctggccatcgagatttcatcaagaacatgatcactgggacttctcaggctgactgtgctgtcctcatagtagcggctggcgtgggggaatttgaggcgggaatctcaaagaacggtcagaccagagagcatgctctgttggcttacaccctcggcgttaagcagctgattgtcggtgtcaataagatggattctacggagcctgcctattcagaaaagcggtacgatgagatagtcaaagaggtgtccgcatacattaagaagatcggatataacccagccactgtgcccttcgtgccgataagcggctggcacggtgacaatatgctcgaaccctccccaaacatgccttggttcaaaggttggaaagtggaaaggaaggaaggcaatgcctcaggcgtctccctgttagaggctcttgataccatcctccctcccacccgccccactgacaaacccctgcgactgcccctgcaggacgtttataagattggcgggatcgggacagtgcccgtcggtagagttgaaacaggcatcctccgacctggtatggtggttacttttgcccctgtaaatatcacaacagaggtgaaatccgtggaaatgcaccatgaagcattatcagaagcattgccaggagacaatgtcggatttaacgtgaagaacgtgtccgtcaaggatatacggcgtggcaatgtgtgcggagatagcaagtcagatccaccgcaggaagctgcccagttcactagccaggtgatcatcctaaatcatcccgggcagataagtgcagggtacagccccgtcattgactgccatacggctcacatcgcgtgcaagttcgctgagctgaaggaaaaaatcgaccggagaagcggcaagaaactggaagacaatcccaaatccttaaagagcggtgacgctgccatcgtggaaatggttcctgggaaaccaatgtgtgtcgaatcattctcccaatatcctccgctgggcagattcgcagttcgggatatgaggcagaccgtggccgtgggagtgataaagaacgtggaaaagaaatcagggggcgctgggaaagtcaccaagagtgcccaaaaggctcagaaagctggtaaatag

SEQ ID NO: 22775 - DNA, 600 bp, Artificial Sequence
  Description of Artificial Sequence: Synthetic coding sequence
atggccgccgccaacaagggcaagtgcctgcccggcgtggtgggccttgcccaagctttgcccgtggggcctggcaggcgtgccatcgctgccggtaacaaaccacgagtccggagcatacgctttgctgcaggacacgatgcggaaggaagccactctcacgtgcactttgatgaaaaactgcacgactcggtggtgatggtgacacaggaatctgactcgagcttcttagtgaaagtgggtttcctgaaaatcctgcataggtacgagatcacctttaccctgccccccgtgcacaggttgagtaaagacgtgcgtgaggcccccgtcccgagtttacatctcaagctgttgtctgtggtgcctgtgccagagggttacagcgtcaaatgcgagtattccgcccacaaggaaggtgtgttgaaagaagaaattcttctggcatgcgagggtgggactgggacctgcgtgcgcgtgaccgtgcaggctagagtgatggaccgacatcatgggacacctatgctgctggacggggttaagtgtgttggtgcagaactcgagtacgattccgagcactctgattggcatggctttgactag

SEQ ID NO: 22776 - DNA, 270 bp, Artificial Sequence
  Description of Artificial Sequence: Synthetic coding sequence
atgcagctgcaggccagcctgagcttcctgctgatcctgaccctgtgtctggagctgcggagtgaactggcacgagacaccatcaaagatcttctgccaaatgtgtgcgcattccccatggagaaggggccatgccagacctatatgactagatggttcttcaatttcgaaacaggagagtgcgagctgtttgcttacggtggatgtggcggaaactcaaacaattttcttcgcaaggaaaaatgcgaaaaattctgcaagttcacgtag

SEQ ID NO: 22777 - DNA, 1251 bp, Artificial Sequence
  Description of Artificial Sequence: Synthetic coding sequence
atgagcgaggccgacggcctgcggcagcggcggcccctgcggccccaagttgtgacagacgatgacgggcaggctcccgaggcaaaggacgggagcagcttcagcgggagagtttttagggtcaccttccttatgctggctgtgagtctgaccgtgcctctacttggggccatgatgctactggaatcgcctatcgatccccagccactgagttttaaggagccccccttgctcctgggggtgctgcatccaaacacgaaactgcgccaggcggagcggctctttgaaaatcagttagtggggcctgaaagcatcgctcacattggcgatgtcatgttcacagggaccgccgatggcagggtggtgaaactggaaaacggcgaaattgaaacgatcgctcgctttggcagcggcccatgcaagacccgagacgatgagcctgtatgcggccgcccactcggcatcagggccggacctaacgggaccttgttcgtggctgacgcttacaagggcctcttcgaggtgaacccttggaagagggaggtgaaactgctcctgtcctctgagaccccgatcgagggaaagaatatgtcgttcgttaatgatctgaccgtaacccaggacgggaggaagatttactttaccgatagcagttcaaagtggcaacgccgcgactacctgctccttgtgatggagggcacagatgacgggcgattactggaatacgataccgtcaccagggaggtcaaggtcctgctggaccaattgaggttccccaacggggttcagctttcccctgcagaggacttcgtgctggtggccgaaacaaccatggcgagaatccgccgcgtgtacgttagcggcctcatgaagggcggggcagacctgtttgtagagaacatgcccggattccctgataacatccggccatcgtctagcggcggttattgggtgggaatgtccacgatcaggcccaaccctggctttagcatgctcgacttcttatccgagcgcccctggataaagcgaatgattttcaagctgttctctcaggagacagtgatgaaattcgtcccacgttattcgctcgtgctcgagttaagcgattccggggcctttcgtcgctcactgcacgatcccgacggcctggtggcgacctacatttcagaagtgcacgagcatgacggccacctctatctcggatcattcagatccccatttctgtgccgcctgtctctacaagctgtctag

SEQ ID NO: 22778 - DNA, 870 bp, Artificial Sequence
  Description of Artificial Sequence: Synthetic coding sequence
atggtgggcgtgaagcccgtgggcagcgaccccgacttccagcccgaactgtcaggagccgggtcgcggctcgcagttgtgaagtttacaatgagaggatgcgggccttgcttgaggatcgctcctgcgtttagcagtatgtcaaacaaatatccacaggctgtgtttctggaagtggatgtgcatcagtgtcagggtacagcagccactaacaatatcagcgcgacacctaccttcctcttcttccgaaacaaagtgcgcatcgaccagtaccagggcgcagatgccgtcggcctggaagaaaagattaagcaacatttggagaacgacccagggtccaacgaggataccgacattcccaaggggtacatggatttgatgccattcattaacaaggccggttgcgaatgcctaaacgagtctgacgaacatgggttcgataattgtttacggaaagacacgacattccttgagtcagattgtgacgagcaactgctgatcacagtggcttttaatcagcccgtcaaactttacagcatgaagttccaggggcctgacaacggtcagggtcccaaatacgtgaagattttcattaacctcccacgttccatggactttgaagaggcagagaggtcagagcctacccaggctctagaattaaccgaggacgacataaaggaggacgggatcgtcccgctcagatatgtgaagttccagaacgtgaatagtgttactatttttgttcaatccaatcaaggggaagaagagactacacgcatctcttattttactttcattggtacccccgtccaggcaaccaatatgaatgatttcaagagagttgtggggaagaagggcgagtcacactag

SEQ ID NO: 22779 - DNA, 1164 bp, Artificial Sequence
  Description of Artificial Sequence: Synthetic coding sequence
atggtgttcgccttctggaaggtgttcctgatcctgagctgcctggccggccaggtctccgttgttcaggtcactattcctgacgggtttgtcaatgtgaccgtcgggtcaaacgtgactctgatttgtatctacactaccaccgtggcaagcagagagcagctctctatccaatggtcttttttccacaagaaagagatggagcctatcagcatatacttttcacaaggaggccaggctgttgccataggacaattcaaggaccgtatcacaggttcgaatgatcctgggaacgcctctataacgataagccacatgcaaccagctgactcgggaatttatatctgcgacgtgaacaaccctcctgacttcctgggccagaaccaagggattctcaatgtgtcagtcttagtcaaaccatcaaagcctctgtgcagcgtgcaagggcggcctgaaaccggccataccattagtctgagctgtctctccgccctaggcactcccagcccagtctactactggcataaactggaggggagagacattgtgcctgtgaaggaaaactttaatcctactaccggtatcttggtcatcggcaacctgacaaatttcgagcagggctattaccagtgtacagctattaatagattgggaaactccagttgtgaaatagatcttacgtcgagtcaccctgaggtgggaatcatagtcggcgccctcatcgggagtctcgtgggggccgccatcatcatttcagtcgtgtgcttcgcacgaaacaaggccaaggctaaagccaaggaaagaaactcgaaaactatcgcagagctggaacccatgactaagatcaaccccagaggagaatcagaggctatgcccagggaagacgcaacccagctggaagtcacactaccttcatctattcacgaaacaggacccgacaccattcaggagcccgactacgagcccaagccaactcaggaaccagcacccgagcctgccccagggagtgagcctatggccgtgcctgatttagatattgagctggagttggaacccgagacacagtccgagctggaaccagagccagaacctgagcccgagtccgagcccggcgtggtcgtggagcccctgagcgaagatgaaaaaggtgtagtcaaagcctag

SEQ ID NO: 22780 - DNA, 1821 bp, Artificial Sequence
  Description of Artificial Sequence: Synthetic coding sequence
atgagcgacaccagcgagagcggcgccggcctgacccggttccaggccgaggcctcagaaaaagactctagctctatgatgcagaccctgctgacagttactcagaatgtggaggtacccgaaactccaaaggccagtaaggcactggaagtctcggaggacgtgaaggtttctaaggcatccggggtgtccaaggcaacagaagtgagcaagactcctgaagccagagaggcccctgcaacacaggccagctctacaacccagttgacggatactcaggttctggccgcagaaaacaaaagccttgcagccgacactaagaaacagaacgccgacccgcaggcagtgaccatgcctgcgaccgagacaaagaaggtaagccatgttgccgatacgaaggtgaacacaaaagcacaggaaactgaggccgcgccaagccaggcaccagccgatgagcctgaaccagagagcgccgcagcccagagtcaggaaaaccaagacacgagaccaaaggttaaagccaaaaaagctcgaaaggtcaagcacctggatggtgaggaggatgggtctagcgaccaaagccaggcgtctggcacaactgggggaaggagggtgtcgaaagcgctgatggctagtatggcccgtcgggcatccagaggcccaatcgccttctgggccagacgcgccagcaggacaaggctggcagcctgggcacggagagccttgctgagcctgagaagccctaaggcccggcgcggcaaagctcggcgacgagcagcaaagctacagtcgagtcaggagcccgaggcaccaccacctagggacgtggccctcctgcagggccgtgctaacgacctggtcaagtatttactggccaaggaccaaaccaaaattccaataaaaaggagtgacatgctcaaggatattatcaaggaatacactgacgtctatcccgaaatcatagagcgggccgggtactctttggaaaaggtttttggcatccaattgaaagagatcgacaagaacgatcatctctatattctgcttagtacactggagcctacagacgcaggaattttgggtacgactaaggatagtcccaaactggggctgctgatggtgctgctgtccattatctttatgaatggcaatcggtcatctgaggctgtgatttgggaggttctgcgcaagctcgggctcagaccagggatccaccatagcctttttggcgacgtgaaaaaactaattacagatgagtttgtcaagcaaaagtatcttgactacgcccgtgttccaaattccaatcctcctgagtacgagttcttctggggcttgcggtcatattacgagacttctaaaatgaaagttctgaagtttgcatgcaaagtgcagaagaaggatcccaaggagtgggccgcacagtatagagaggcaatggaagccgatctgaaagccgcagccgaggcagcagcagaagctaaagcccgggcagaaattcgggccagaatgggcattggtttgggatccgagaacgccgctggtccctgcaattgggacgaggccgacatcggaccatgggccaaagcgcgcatacaggccggagccgaagcaaaagccaaagcccaggaaagtggaagcgcatctactggggcttccacaagtacaaacaacagcgcctcagcatcagcctcaacctccggtggcttctccgcaggagcgagcctcacagctacgctgacttttgggttgttcgcaggccttgggggggcaggggccagtaccagcggaagtagtggcgcatgcggcttctcctacaaatag

SEQ ID NO: 22781 - DNA, 369 bp, Artificial Sequence
  Description of Artificial Sequence: Synthetic coding sequence
atgaccaccgccacccggcaggaggtgctgggcctgtaccggagcattttcagactagctcgaaagtggcaggctacaagcggccagatggaggacaccatcaaggagaagcaatatatcctgaatgaggccaggaccctgttccgcaagaataagaaccttactgatacggatctgattaagcagtgcatcgacgagtgtactgcgaggatcgaaattggcttgcactacaagataccttatcccaggcctatacacctgcctccgatgggtctcacgcccttgagaggcaggggactcaggtcacaggaaaagttgagaaagctgagcaagcccgtatacctaagatcacatgatgaggtgagctag

SEQ ID NO: 22782 - DNA, 582 bp, Artificial Sequence
  Description of Artificial Sequence: Synthetic coding sequence
atgctgggcgtgctggagctgctgctgctgggcgccgcctggctggcaggccctgcccgaggtcagaacgagactgagcccatcgtgctcgaaggtaagtgcctggtggtgtgtgattctaatcccacctccgatcccaccggaacagcgttgggcatctcagtgcgatctgggagcgccaaagtcgcctttagcgcaattaggagtacaaaccacgaacccagcgaaatgtctaatcgcaccatgatcatctacttcgaccaagtgctggtgaatatcgggaataactttgattcagaacgcagcaccttcattgcaccccggaaagggatctatagcttcaatttccacgtggtgaaagtgtacaataggcaaactatacaggtatccctgatgctgaacggatggcctgtaatttccgcattcgccggagatcaggacgtcacacgcgaggctgctagcaatggtgtgctgatacagatggaaaagggcgaccgggcttatttgaaactggaacgggggaaccttatgggaggctggaagtattcgacctttagtgggtttctcgttttcccattgtag

SEQ ID NO: 22783 - DNA, 1578 bp, Artificial Sequence
  Description of Artificial Sequence: Synthetic coding sequence
atgagccggcagctgctgcccgtgctgctgctgctgctgctgcgggccagttgtccctggggacaggagcagggcgcccgctctcccagtgaggaaccacctgaggaggaaattccaaaagaagatggcatcttagttctgtcaaggcatactctcggattggccctaagggagcaccctgccctgctcgtggagttttacgctccctggtgcggtcattgccaggccctcgcacccgagtactccaaagccgccgcagtgctggccgcagaatccatggtcgtgaccctggccaaagtggacggccctgctcagcgggaactcgccgaggaattcggggtcacagagtatcccactctgaaatttttccgcaatggtaatcgcacccaccccgaggagtacacaggcccacgcgatgctgaaggaatcgccgaatggcttcgtcggagagtcgggccatccgctatgagacttgaagatgaggcagccgcgcaggcactcatcggcggcagggacctcgtggtgattggtttctttcaggatttgcaggatgaagacgtggctacatttttggccctcgcacaggatgctctggacatgacattcggcctcaccgacagaccacgtctgtttcagcaattcggactcacaaaagacaccgtggtgttatttaagaaattcgatgaaggtcgcgcggattttcctgtggatgaggagcttggcctggaccttggcgatctcagtcgcttcctcgtgacgcatagtatgcggctggtgactgagtttaacagtcagacctccgcaaaaatatttgcggctaggattctgaaccatctgctcctgtttgtcaaccagactctggctgcacaccgagagctcttagcaggcttcggagaggccgcccctcgttttcgcggacaggttctgtttgtggtcgtcgatgtggccgctgacaatgagcatgtgctccagtactttggcctaaaagcagaggcggcccccacccttcggctggtgaacctggagacaacaaagaagtacgcgcctgtggatggcggtccggtgacggccgcgtcaattacagcattttgccatgccgtactgaatggtcaagtcaaaccttatttgctttcccaggaaatacctcctgactgggaccagcgtccagtgaagaccctcgtggggaagaatttcgagcaagttgctttcgacgagacaaagaatgtattcgtgaagttctacgctccatggtgcactcactgcaaggaaatggcaccagcttgggaggcactggccgagaagtaccaagatcacgaggacattattattgccgagctcgatgccaccgcaaacgagctagatgcatttgctgtgcatgggtttcccacactgaaatactttcccgcgggcccaggcagaaaggtgattgagtataagtctactagagaccttgagacattttcaaagttcctggacaatggtggagtactgcctactgaagaaccccctgaggagcctgcggcgccattccccgagcctcctgcaaacagcacgatgggatccaaggaggaactgtag

SEQ ID NO: 22784 - DNA, 2262 bp, Artificial Sequence
  Description of Artificial Sequence: Synthetic coding sequence
atggccgacaagcggaagctgcagggcgagatcgaccggtgcctgaagaaggtctccgaaggggtggagcagtttgaggatatttggcaaaagctccacaatgcagccaacgccaaccaaaaggaaaaatacgaggctgatctgaagaaggagataaagaaactgcagcggctgcgggatcaaatcaagacctgggttgcctcaaacgagataaaagacaaacgacaattgattgataatagaaaactgatagaaacacagatggaacgcttcaaggtggtggaacgggagacaaagacaaaggcttattctaaggagggactcggacttgcgcagaaggtcgaccccgcacagaaggagaaagaggaagtaggtcagtggctcaccaatactattgataccctaaacatgcaggtagatcaattcgaatctgaagtcgagagtctcagcgtgcagacccggaaaaaaaagggcgacaaagacaaacaggatcgtatcgagggccttaagcgacacatcgagaagcaccggtaccacgtcaggatgctggagactattctccgtatgcttgacaatgacagcatcctggtagatgcaatccggaagatcaaagatgatgtcgagtattacgtagattcatcccaagaccccgacttcgaggagaatgagttcctctatgacgatcttgatcttgaagacatcccacaggccctggtggcaacctcgccaccaagccattctcatatggaggatgagatcttcaaccaaagttcaagcactccaacttctactacctcttcatctccaatccctcccagtccagctaactgcacaactgagaacagcgaggatgacaagaagcgagggcggtcaaccgacagcgaagttagccagtctcccgccaagaatggatcaaaacccgtccatagcaaccagcatccacaatcccctgccgtcccaccaacctaccctagcgggcctccaccggccgcttcagcgctgtccactacgcctggcaataacggagtacccgctccggctgctccccctagtgccctgggacctaaagcttctcccgcccccagtcacaactctggaactcctgcgccttatgctcaggcggttgctccgcctgctcccagcggccccagcactacacaaccaagacccccgtccgtacagccatccggtggcgggggcggaggaagcggcgggggtggctcttctagtagctccaacagtagtgccgggggaggtgctggaaaacagaacggcgccacttcttatagctcagtggttgctgactcgcctgccgaagtcgctctctctagtagcggcggaaacaacgcatcatcccaggcacttggtcccccatccggtccccataacccaccaccctccacaagtaaggaacccagtgccgccgcgcctacgggtgccggaggtgttgctccaggctcaggcaacaatagcggtggcccgagtttactggttccgctgccagtgaatccaccttcctccccgactccttcttttagtgatgccaaggccgcgggcgcactcctcaatggacctccacagttttctactgccccggagatcaaggccccggaaccactgtccagcttaaagtccatggctgaacgggccgccataagttcaggaatcgaagatcctgtaccgaccctgcacctgacagagcgggatatcatactatcctcaacatcagccccacctgcctccgcccagcccccccttcagctgagtgaagtgaacataccattatcgctgggcgtctgcccactgggacccgtcccactgactaaggaacaactgtatcagcaggccatggaagaagccgcctggcatcatatgcctcaccctagcgacagcgaacgcatccggcagtatctccctagaaatccatgtcccacccctccgtaccaccatcagatgccacctccacattctgacaccgtggaattttatcagagattgtccacagagaccttgttctttattttctattatttagaagggacaaaagctcaatatctagcggccaaggcgttgaagaagcagtcctggaggttccataccaaatacatgatgtggttccaaagacacgaagaacctaagaccattaccgacgaatttgagcaggggacttacatttacttcgactacgagaagtggggccagcgcaagaaggagggctttaccttcgagtatcgctacttggaggatcgggacctgcagtag

SEQ ID NO: 22785 - DNA, 1146 bp, Artificial Sequence
  Description of Artificial Sequence: Synthetic coding sequence
atgcccttcggcaacacccacaacaagttcaagctgaactacaagccagaagaggaatatcccgatctctctaagcataacaaccacatggccaaggttcttactctggagttgtacaagaagctgcgagataaagagacaccttctgggttcacggtggacgacgtcattcaaactggtgtggataatccgggtcatccgttcataatgacagtcggatgcgtggctggggacgaagagagttatgaggtctttaaagagctatttgatcctatcatctccgatcgccatgggggttacaaacctactgataaacacaagaccgatttgaatcacgaaaacttaaagggtggcgacgacctggacccgaactatgtcttatcctccagagtgcggacaggaaggagtatcaaaggatatacgttgccaccccattgtagccggggcgagcgcagggccgttgaaaaactatcagttgaggcgctgaattctttgacaggagagtttaaaggtaagtattacccccttaaatctatgactgaaaaagagcagcagcagttaatcgacgaccatttcctctttgataagccggtgagccctctcctcctggcttcaggcatggccagggactggccagacgctcgaggaatctggcataacgataacaagagcttcctggtttgggtgaacgaagaagaccatcttcgggtgatcagcatggagaaaggcgggaacatgaaagaagtgtttaggcggttctgcgtcggcctccagaagatcgaggagatttttaagaaggccggtcacccttttatgtggaaccagcacttaggttatgtcctcacctgcccctccaacctgggaacaggcctgcgggggggtgtgcacgtgaagttggcccatctcagtaagcatccgaaattcgaagagatactgaccaggctgcggctgcaaaagcgaggcacgggtggtgtggacacagcagccgtgggctcagtcttcgatgtgtcaaacgctgacagattaggctcctcagaagtggaacaagtccagctggtggtcgacggtgtaaagttgatggtggagatggagaaaaaactcgaaaaaggtcagagtattgacgatatgatccctgctcagaagtag

SEQ ID NO: 22786 - DNA, 300 bp, Artificial Sequence
  Description of Artificial Sequence: Synthetic coding sequence
atggcccagggccagcggaagttccaggcccacaagcccgccaagagtaagacggccgccgctgccagcgagaagaaccgaggaccacggaaggggggccgtgtcatcgcaccaaagaaagcccgtgtcgtccagcagcaaaagctgaagaagaacctggaggttggtattcgtaaaaaaatcgaacacgacgttgtgatgaaagcctcatcttctctacccaaaaagttggcgctcctcaaggcaccagcgaagaagaaaggagcagctgccgccacctctagtaagaccccatcttag

SEQ ID NO: 22787 - DNA, 1491 bp, Artificial Sequence
  Description of Artificial Sequence: Synthetic coding sequence
atggacgacgtgcccgcccccacccccgcccccgccccccccgccgccgcagccccacgggtcccatttcactgttccgaatgcggaaagagctttcggtacaggtccgacctgcgccgccactttgctagacataccgcactgaaaccccacgcttgtccccggtgcggtaaaggattcaaacacagtttcaatctggctaaccatctgcgatcacacactggggaaagaccgtaccggtgctccgcctgtccgaagggattcagggactctactggccttctacaccaccaagtggtgcatacaggggagaaaccctattgttgcctagtctgcgagctccgtttttcatcaagatcctccctgggaagacatctgaagagacagcaccggggtgtgctccccagtccattgcagccaggaccaggtctgcccgctctctccgcgccttgctccgtctgctgtaatgtcggcccatgctcagtttgtggtggcagcggggctggggggggggaagggcccgagggggccggcgccgggctgggtagctggggtttggctgaagccgcagccgctgcagcagctagtctcccaccatttgcttgtggcgcctgcgctagacgcttcgaccatggtcgcgagctggcagcgcattgggccgcccacacagatgttaagccatttaagtgccctcggtgtgagcgcgattttaatgcaccagcgttattagagcgccacaagttgacacacgacctccaaggtccaggcgcgccacccgctcaggcctgggccgccggaccaggggcagggccagagacagctggagagggtaccgcagctgaggcaggtgacgcacccctcgcctccgatcggcgcctacttctgggccctgccggcggaggcgttcctaaactggggggcctgctcccggaaggagggggcgaggccccagccccagccgccgctgccgagccaagcgaggacactctgtatcaatgtgactgtggcaccttctttgcttccgcagctgcactggctagccacctcgaagcacactcaggccctgcaacctatggatgcggccattgtggcgctttgtacgctgcactggctgccttagaagagcaccgaagagtgtcccacggggagggcggcggggaagaagcagctacagctgcccgcgagagagaaccagcgtccggtgaacctccctcaggcagtggccgaggaaagaaaatttttggctgttcagagtgcgagaagctgtttaggagcccccgggaccttgagagacacgtgttagtgcacactggggagaagccttttccttgtcttgagtgcggcaagttttttagacacgaatgttacctcaaacgacaccgcctcctgcacgggaccgagcgaccatttccatgtcacatctgcgggaaggggtttattacactttctaatctgtcacggcatctgaaattacataggggcatggattag

SEQ ID NO: 22788 - DNA, 663 bp, Artificial Sequence
  Description of Artificial Sequence: Synthetic coding sequence
atgaagagcgtgatctaccacgccctgagccagaaggaggccaacgactctgatgtacaaccaagtggagcgcagagagcagaggcttttgtgcgagcattcttgaaacgctccacgccccggatgtccccccaagcccgtgaggaccagctgcagcgcaaagctgtggtgctggaatattttactcggcataaacgaaaagaaaaaaagaagaaagcaaagggtctgagtgcccgccagcggagggagctacggttgttcgacatcaaaccagagcagcagaggtactcgctttttctgcctctccatgagctgtggaagcagtatatccgcgatctttgttccggcctgaaacccgatactcaacctcagatgatccaggccaagttgctcaaggctgacctgcatggcgccattatttccgttacaaagtcaaagtgcccctcttatgtcgggatcacaggcatcctgctgcaggagaccaaacacatctttaagattattacaaaagaggaccgtctgaaagttattccaaaactcaattgtgtgtttaccgtggagactgatggatttatttcctatatctatgggagcaaattccagctgcggagtagtgaacgcagcgctaagaaattcaaagccaagggcaccatcgacctctag

SEQ ID NO: 22789 - DNA, 768 bp, Artificial Sequence
  Description of Artificial Sequence: Synthetic coding sequence
atggcccgggccaaggccctgctgggcggccccggcgaggagctggaggctgatactgaatacctggaccccttcgacgcacagccccacccagccccccctgatgatgggtacatggagccatatgatgctcaatgggtgatgagcgagttacccggaagaggcgttcaactttatgacacaccctatgaggaacaggaccccgagaccgctgacggccctccctccggccaaaaaccccggcaatctcggatgccacaggaggatgagcgtcccgctgatgagtatgaccagccttgggaatggaaaaaagatcacatctcccgagcctttgcagtgcagttcgacagtcctgagtgggagcgtacccctggaagcgcgaaggaacttcgtaggccgcctccccggagcccacaaccagcagaacgcgtcgacccggccctgccactggagaagcaaccatggttccacggccccctgaaccgggctgatgcggagtcgttgctgagcctgtgcaaagaggggtcctacctggtgcggttaagtgagacgaacccccaggattgctctctgtctctccgatccagccaaggctttctacacctcaaatttgctcgtactcgggagaaccaggtggtactgggccagcattcaggacccttcccatctgtgcccgagctcgtgctgcactactcttcccgtcccctccctgtgcagggcgccgaacatcttgcacttctgtacccagtggtgactcagaccccatag

SEQ ID NO: 22790 - DNA, 858 bp, Artificial Sequence
  Description of Artificial Sequence: Synthetic coding sequence
atgagcgacgacttcctgtggttcgagggcatcgccttccccaccatgggattccgctcggagaccctgaggaaggtgagagatgagttcgtaattagggacgaggacgtcataatcctgacttaccccaagtctggtactaattggctggctgaaatcctttgcctgatgcatagcaagggtgatgcaaagtggatccagtctgtgcctatttgggagagatctccgtgggtggagagcgagatcggatatacggcgctgtccgaaacagagagtcctaggctgttctcgagccatttgcctatacagctgtttcctaagtcttttttcagctcaaaagccaaggtgatttatctgatgcggaatcccagggatgtgctcgtgtctgggtatttcttctggaaaaacatgaaattcattaaaaaacccaagagctgggaggagtatttcgagtggttctgccagggcacagtcctctatgggagctggttcgaccatatacatggctggatgccgatgagagaagaaaagaattttctcctactgtcttatgaagaacttaaacaggacacaggtcgcacaatagagaaaatctgtcagttcttgggcaagactctagagcctgaggaactcaatcttattctgaaaaactcttcattccagtcaatgaaagagaataagatgtcaaattatagtctgttaagtgtggactatgtggtggataaagcacagttgctgaggaaaggggtgagtggtgactggaagaaccattttactgtggcccaggcggaggactttgacaaactgttccaggagaagatggctgatcttccccgggagctatttccctgggagtag

SEQ ID NO: 22791 - DNA, 1647 bp, Artificial Sequence
  Description of Artificial Sequence: Synthetic coding sequence
atgaagacccccgccgacaccggcttcgccttccccgactgggcctacaagccagagagctcgcccggttcaaggcaaatccagctttggcactttatattggagcttttacgaaaggaagagtaccagggagttatcgcgtggcagggcgactacggcgagtttgtaatcaaggaccctgacgaggtggccaggctctggggggtacgtaagtgtaagcctcaaatgaattacgacaagctctctagagccctccggtattattacaacaagcggattctacataaaacaaaaggtaagcggttcacttataaatttaattttaacaagctggtgctggttaactacccttttattgacgttggcctcgctggaggagctgtgccgcagagcgcaccccccgtgccctctggcgggtctcattttagatttcccccttctaccccctccgaggtactgtccccgacagaagacccgcggtcccctccagcttgtagcagcagttccagcagcctgttttcggccgttgtagccaggcgactgggaagaggctcagtgagtgactgttcggacggtacgagcgaactggaggagccgcttggtgaagacccaagagcccgtccgcccgggccacctgatctcggcgcctttcgcggcccccctctcgcacggttaccccacgaccccggcgtattcagagtttacccacgcccacgaggcggtcccgaacccttgtcgccgttccctgtgtccccgctagctggacctgggagcctgctgccaccacagctctctccagccttacctatgactcccacccacctggcctataccccttctcctacactgtcacccatgtatccttctggggggggtgggccgtcaggctctggcggcgggtctcacttcagctttagccccgaagacatgaaacgatatctacaggcacacacccagtctgtgtataactatcacctttccccccgggcttttcttcactacccaggactggttgtgccacagccccaacgcccagacaaatgtccactccctccaatggctcccgagacacctcccgtgcctagctcagcatcaagcagttcttcaagttccagtagccccttcaaatttaaattgcagcccccaccactaggacgcagacagagagcagctggggaaaaggccgtggcaggagccgacaaatcaggaggcagtgccggtgggctcgcagaaggggcaggcgcactcgccccccccccaccccctcctcagatcaaagtggagccgatcagcgaaggcgaaagcgaagaggttgaagttacagacatctccgatgaggatgaagaggacggagaagtattcaaaacccccagggccccccctgccccaccaaaacctgagcccggcgaagctcccggagctagccagtgcatgccactcaagctgagattcaaaagacggtggtccgaagattgcaggctggaggggggtgggggccccgcaggagggttcgaagatgaaggagaggataaaaaggtgcggggcgagggaccaggggaagcaggcgggcctctgactcctagacgtgtttcttccgacctgcagcatgccacagcccaattgtcccttgaacaccgcgattcctag

SEQ ID NO: 22792 - DNA, 1530 bp, Artificial Sequence
  Description of Artificial Sequence: Synthetic coding sequence
atgggcgtgctgaagttcaagcacatcttcttccggagcttcgtgaagagctccggggtttcacagattgttttcacattcctgcttattccatgctgtttgactctcaattttagggcacccccggtcattcccaacgtgcctttcctgtgggcctggaacgcaccaagcgaattctgtctcggtaagttcgatgaacctctggatatgtccctgtttagctttatagggtcgccacggattaatgctaccggccagggtgtcactatcttctacgttgaccgattgggatattatccctatattgactcaatcaccggggtcaccgttaatggagggatcccacagaagatatccctgcaggatcacctcgacaaagctaaaaaggacatcaccttttatatgccagtggacaatttaggaatggcagtgattgactgggaagagtggcgcccaacctgggcccgtaactggaagcccaaagacgtatacaagaacaggagcattgagctggtgcaacaacagaacgtccagcttagccttactgaagcaaccgagaaggcaaaacaggaattcgaaaaggccggaaaagatttcctcgtggaaactatcaagcttggcaaacttttacggcccaaccatctttggggttactatctcttcccggactgttataatcatcactacaaaaagcccggctacaacggaagctgctttaatgtggagattaagaggaatgatgatctgtcatggctgtggaatgagtcaacggccctgtacccctctatctacctcaatacccagcagtctcctgtcgccgccaccctgtacgttcgcaatcgggtacgggaagctatcagggtgtcaaagatacccgatgcgaaatctccactgcccgtctttgcctacacaagaatagttttcacagatcaggtgctgaagttcctgtcccaggacgagctcgtttatactttcggcgaaaccgtagctttgggcgcgagcggcattgtgatttggggtactctgtccatcatgcgttcaatgaagtcttgccttctcctcgataattacatggagactatattaaatccgtacatcatcaatgtcacactggcagctaagatgtgtagccaggttctgtgtcaggaacagggggtttgtatacgcaagaactggaactcttccgattacctccatctgaatccagataattttgccattcagttggaaaaaggtggcaagttcacagtgcgggggaaacccaccctggaagaccttgagcaattctccgagaaattttactgttcttgctattctacgctaagctgcaaagaaaaggcagatgtgaaggatacagatgctgtcgatgtgtgcattgctgacggcgtgtgtatagacgccttcctgaagccccccatggaaacagaagagcctcagatcttctacaacgcgagccctagcacactgtctgcgacaatgtttatcgtatccatcttatttttgataatcagttccgttgcaagcctctag

SEQ ID NO: 22793 - DNA, 1041 bp, Artificial Sequence
  Description of Artificial Sequence: Synthetic coding sequence
atggagacccagctgagcaacggccccacctgcaacaacaccgccaatgggcccacgaccattaataataattgttcctccccggttgactcaggtaacaccgaggacagtaagactaacctgatcgtgaactacctaccacagaatatgacgcaggaagaactgaagagccttttcgggagcataggcgagatcgaaagctgcaagctggtcagggacaagattacaggacagtctctgggatacggctttgtgaactatatcgatcccaaagacgcagagaaggcaatcaatacacttaacgggctgaggctgcagacaaaaaccatcaaggtttcatacgctagaccttcaagcgctagcataagggatgccaatctctacgtcagtgggctgcccaaaacaatgactcagaaggaactggagcagctgtttagccagtacgggcgtattataacatcaaggattctggtcgaccaagtcactggcattagccgcggggtgggctttatcaggttcgataaaaggattgaagcagaggaagccatcaagggactgaacggccaaaagcccccgggcgctaccgagccaatcaccgtcaaatttgccaataaccctagccagaaaacaaatcaggccattctctcgcagctgtatcagagccctaatcggcgctatccaggaccgctcgcccagcaggctcagagattcaggttttcgcccatgaccatcgatggaatgacttctctcgccggaatcaacatccccggccacccgggtaccggctggtgtatctttgtgtataacttagccccggatgccgatgaaagtatattgtggcagatgttcggaccatttggtgctgtcacaaacgtgaaagtgattagagacttcaacacaaacaaatgtaaagggttcgggtttgtgacaatgacaaattacgatgaagcagctatggcaattgcgtcgctaaacggatatcgcttgggggatcgagttctacaggtttcattcaagactaataaaacacacaaggcgtag

SEQ ID NO: 22794 - DNA, 1437 bp, Artificial Sequence
  Description of Artificial Sequence: Synthetic coding sequence
atggcccacgtgcccgcccggaccagccccggccccggcccccagctgctgctgcttcttcttccactcttcttgctgctgctaagggacgtggccgggagccacagagctcctgcatggagcgccctccccgccgccgcggacggactgcagggggatcgagaccttcagaggcacccgggggatgcagcggctacactgggcccgtcagcacaggatatggttgccgtccacatgcatcgattatacgaaaagtactctcgccagggggctaggcctggaggtgggaatacggtcagatccttcagggctcggctcgaggtggttgaccagaaggctgtgtacttcttcaatcttacatccatgcaggatagcgaaatgatcctgaccgcaacattccatttctacagtgagccgcctaggtggcctcgggcactggaggtgctatgtaagccccgggccaagaatgcaagtggtaggcctctgccactgggtccacccacgagacagcacctgctgtttcggtctctgtctcagaacactgcaacgcaaggactgctgagaggggcaatggcgctagcacctcctccgaggggactctggcaggcgaaggatatcagtcctatcgtcaaggctgcccggcgggatggggaacttctgctgagcgcccagctcgattctgaagagagggacccgggcgtaccgaggccaagcccctacgctccatatatattggtatacgctaatgacctcgccatcagtgagcctaacagcgttgctgtcacgctgcagcggtacgatcctttccctgcaggcgacccagaacccagggcagcccctaataactctgccgacccaagagtccgtcgagccgctcaagccactggaccactgcaggacaacgagttgcctggtctagatgaaaggcctcctagagcgcatgctcaacacttccacaaacaccagctctggccctcacccttcagagcactcaagccaagacccggtagaaaagacagaaggaaaaagggccaggaggtgtttatggccgcctctcaggtcctagattttgatgagaaaaccatgcagaaagcacgcagaaagcagtgggatgagccgcgcgtctgcagccgaagatatctgaaagtggacttcgccgacatcggttggaatgagtggatcattagtcccaagtcctttgatgcctattactgtgccggcgcttgcgagttcccaatgcccaagatagtccggccctccaatcacgcaaccattcagagcatcgtccgcgccgtggggatcatcccaggaatacctgagccgtgctgtgtgcccgataagatgaattctttgggtgtgcttttcctggacgaaaaccgaaatgtagtgctgaaggtgtatcccaacatgagcgtggacacctgcgcatgtcggtag

SEQ ID NO: 22795 - DNA, 978 bp, Artificial Sequence
  Description of Artificial Sequence: Synthetic coding sequence
atggagagcaagatgggcgagctgcccctggacatcaacatccaggagccaaggtgggatcagagtacctttctaggccgggccaggcacttcttcacagttaccgatccacgcaacctcctcctcagtggagcccagttagaagcctctcgcaatatcgtgcaaaactatcgcgcaggagtcgtcactcctgggataactgaagatcaactctggagggctaagtacgtgtatgactcggcctttcatccagataccggggaaaaggtagtgctgataggccgcatgagcgcccaggtgccaatgaatatgactataacaggttgcatgctcaccttttacaggaagactcctacagtggtcttttggcagtgggtgaaccagtcttttaatgccatcgtgaactattcgaacagatccggagacaccccaatcaccgttcgccaattgggcactgcttacgtgagcgctaccacaggcgctgtcgcaacagctctgggattaaaaagcctgacaaagcatctgccacccttagtgggacggttcgtaccgttcgcagccgtcgctgctgctaactgcattaatataccactgatgagacagcgtgagctgcaggtgggtatccctgtagccgacgaagccggacagcggctgggatatagtgtgaccgctgccaaacaagggatttttcaagtggtcatctcgcgtatatgtatggctattcccgccatggcgatcccaccacttatcatggatactctggagaagaaggatttcctaaaacgcagaccctggctgggggcccctctccaagtgggactcgtgggtttttgcctcgtgtttgccactccactgtgctgcgcgctgtttccgcagaagtctagtatccatatctctaaccttgaaccggagctccgggctcagatccacgaacagaatccctccgtggaggttgtgtactacaataaaggactgtag

SEQ ID NO: 22796 - DNA, 1068 bp, Artificial Sequence
  Description of Artificial Sequence: Synthetic coding sequence
atggagccccacctgctgggcctgctgctgggcctgctgctgggcggaacccgtgtgctcgctggttatccaatttggtggagcctggcgctgggtcagcagtacacctccctgggcagccaacctttgttatgcggtagcatcccgggcctcgtaccaaagcagctacgcttttgcagaaactatattgagataatgccttctgtagccgagggcgtgaagttaggcattcaggagtgtcagcaccagtttcgtggccggagatggaactgtactacgattgatgattctctggctatcttcggtcctgttctggataaagccacacgcgagagcgccttcgttcacgccatcgcatcagctggcgttgccttcgcagtgacaaggtcctgcgcagagggaaccagtacaatttgcggatgtgattctcatcacaagggtccccccggggaggggtggaaatggggaggatgtagcgaggacgcagatttcggagtactggtcagccgcgagtttgctgatgccagagagaaccgcccagatgcccgctcagctatgaacaaacacaacaatgaagctggccgaacaactattctggaccacatgcatttaaaatgcaagtgccatggattaagcggtagctgtgaagtgaaaacttgctggtgggcacaacccgatttcagggcaatcggggatttcctgaaagataaatacgattcggcgtctgagatggtggtcgagaaacatcgcgagagcaggggctgggtggagaccttgcgcgccaagtattcacttttcaagcccccaacagaacgcgacctggtgtattacgaaaattccccaaacttttgtgagcctaaccctgagacaggcagcttcggtaccagggatcgaacgtgtaacgtgacctctcacgggatcgatggctgcgacctgctttgctgtgggcggggacacaacactaggacagaaaagcggaaggagaagtgtcattgtatcttccactggtgctgttacgtctcctgccaggagtgtatacgcatttacgacgtacacacttgcaagtag

SEQ ID NO: 22797 - DNA, 1437 bp, Artificial Sequence
  Description of Artificial Sequence: Synthetic coding sequence
atggccgcccggcccatcaccctgggcatcgacctgggcaccaccagcgtgaaagcggcgctgctgagagcggcccccgatgacccaagtggctttgccgtgttggcctcttgcgcccgagctgcccgtgctgaagccgccgtggagagtgcggtggcgggaccacagggtcgggagcaggatgtctcccgaatcctgcaggctctgcatgagtgtttggcagccctgcctaggccacagctgcggagtgtggttgggataggtgtgtcaggtcagatgcatggggtcgtattctggaagacgggccagggctgcgaatggacagaaggaggcattacccccgtgttcgagcctcgcgccgtgtctcacttggttacttggcaggacggacgatgttcctccgaatttctagctagtctgccacagccaaagagtcatttgtccgtcgcaacaggattcggctgcgcaaccatcttctggctgcttaagtatcggccagaattcttaaagagctatgacgccgccggcaccatccatgactacgtcgtggccatgctgtgcggcctaccccgtcctctgatgagtgatcaaaatgctgcctcctggggatacttcaatacccaatctcaatcatggaatgtggagactctacgtagttctggtttccctgtgcacctgttgcctgacatcgctgagcccggatcagtggccggccgcacttcccacatgtggtttgagataccgaaaggcacacaggttggtgtggccctgggcgacctgcaggcttcagtctactcatgcatggctcagcgaacagacgccgtgctgaatattagtacttccgtacaactggccgcgtctatgccctcgggcttccagcctgcccagacccctgatccgacagcccccgtggcatattttccttacttcaacagaacgtacctgggggtggccgccagcctcaacggcggaaacgttcttgccacttttgttcacatgctggttcaatggatggctgatctcgggctcgaagtggaagaaagtaccgtatatagccggatgattcaggcggcagtgcagcagagggatacacatttgacaatcacccccacagtgctgggtgagagacatttgcccgaccaactcgccagcgttactcgaatatccagctctgatctgagtctggggcacgtgacccgggccctctgcagagggatcgtgcaaaacttgcactctatgctgccaatccagcagttgcaggattggggcgtggagcgcgtaatgggttccgggagtgctctcagccgtaacgacgttttgaagcaagaggttcagcgtgctttccccctgccgatgtcttttgggcaggacgtggatgcggctgtgggcgccgctttagtcatgctgagacggcaccttaaccagaaggagtcgtag

SEQ ID NO: 22798 - DNA, 1578 bp, Artificial Sequence
  Description of Artificial Sequence: Synthetic coding sequence
atgcggcggcggcggcggcgggacggcttctaccccgcccccgacttcagggatcgcgaagccgaggacatggcaggggtcttcgacattgatctagatcaacccgaggatgcaggaagcgaggatgagctggaggagggcggtcagcttaacgaatcaatggaccatggtggggtgggcccctatgaacttgggatggaacattgtgagaagtttgaaatttcagaaacgtctgtcaatcgagggcctgagaaaataaggcctgagtgttttgagcttctgcgcgtgctggggaaaggcggttatgggaaagtgttccaggtgcgaaaagtcaccggtgctaacactggaaagattttcgctatgaaggttttaaaaaaggccatgattgttagaaatgccaaggacactgctcatacaaaagctgaacggaatatactggaagaagtgaaacatccttttattgtagacctgatctacgcatttcagactgggggcaaactatacctcattttggaatacctgtctggcggggagctgttcatgcagttagaacgagaaggaatttttatggaggatacggcctgcttctatctggcagagatttccatggccctgggccatctccatcagaaaggcatcatctaccgggatctcaaacccgaaaatatcatgctgaaccatcaggggcacgtcaagctgaccgacttcggcttgtgcaaggagagcatacatgacggtactgtgacacataccttttgcggaacaatcgagtacatggctccagaaatactgatgcggagcggccacaatcgggcagtcgactggtggtccttgggtgcactcatgtatgatatgctgacaggtgcaccacccttcacgggtgaaaatcggaaaaagacaatagacaaaattcttaagtgcaagttaaatctgccgccttacctaacacaggaagcccgagacctcctgaagaaactcctcaaacggaacgccgcttccaggttgggtgctggtcctggagatgctggagaagttcaagcacacccattcttcagacacattaactgggaggagctgctagctagaaaagtcgagccaccctttaaaccactgctccagtctgaagaggacgtctctcagtttgacagcaaattcactagacagacaccggttgatagccctgacgatagcaccctgagtgaatccgcgaaccaggtcttcctgggcttcacttacgtcgcaccctctgtcttggagtcagttaaagagaaattttcttttgaaccgaagatccggagtccccggaggttcatcggatcccctcgcacgcccgtgtcgccggtgaaattttcccccggggatttttggggtcgtggggcatccgcctccactgccaatccacagacaccagtggagtacccaatggaaacttcaggtatcgaacagatggatgtgacaatgtctggagaggcatccgctccactacctatccgccagcctaattcaggtccttacaagaaacaggcctttccaatgatcagcaagcgacctgagcacctccggatgaatctgtag

SEQ ID NO: 22799 - DNA, 987 bp, Artificial Sequence
  Description of Artificial Sequence: Synthetic coding sequence
atggcccggaccgtggtgctgatcaccggctgcagcagcggcatcggcttacacttagccgtgcgtctcgcaagtgatccttcgcagtccttcaaagtgtatgctactctgagagatctcaagacacaaggacggctctgggaagccgccagagctctagcctgcccccccggtagtctggagacacttcaactggatgtccgtgattccaagtctgtcgcggccgccagggaaagagtgacagaaggaagggtagacgtgctggtttgcaacgccggactcggactgttgggccctctggaggcattgggagaggatgccgtcgcttctgtcctcgatgtgaatgtggtgggcacagtgaggatgttgcaggccttcctgccagacatgaagcgcagaggttctggacgagtccttgtaacaggatcagttggaggcctcatgggactcccatttaacgatgtgtactgcgcctccaagtttgccttggaaggactttgcgaaagtcttgctgtcttgctgctgcctttcggcgtgcacctcagcttgatagagtgcggccctgtacatacggcatttatggagaaagtactggggagccctgaagaagtgcttgaccgcactgatatacatacctttcacagattctaccagtacctggcgcacagtaaacaggtgttcagagaagccgcccagaatccagaggaggtggcggaggtgtttctcactgctttaagagctcccaagccaaccctccgctactttacaaccgagaggttcctgccactgcttcgaatgaggctcgatgatcctagcggctccaattatgtgaccgcgatgcaccgagaggtgtttggagatgtgccggcgaaggcagaagctggcgccgaagcaggtggaggcgccggacctggggcagaggatgaggcaggcaggggcgcagtgggagatccagagttgggcgatccacccgctgccccacaatag

SEQ ID NO: 22800 - DNA, 1626 bp, Artificial Sequence
  Description of Artificial Sequence: Synthetic coding sequence
atgcccggcctgcggcgggaccggctgctgaccctgctgctgctgggtgctcttctcagcgccgacctgtattttcacctgtggccccaagtacaaaggcagcttcgccccagggaaagaccacggggctgtccatgcaccgggcgcgcctcttctctggctagagactctgccgcagccgccagcgatccaggcacaatcgttcataacttcagcaggaccgagcccaggacggaacccgccggcggcagtcattctggctcatcgtcaaaactccaggcactcttcgcacacccactttacaacgttccagaggagccccctctcctcggcgctgaagattcactcctggcttcacaagaagctctccgctactataggcgcaaggtagcccgatggaaccggagacacaaaatgtacagggaacagatgaacctgacgtcattggatccccctttgcagctccggttagaggcatcatgggtgcagttccatttgggcatcaaccgccatggcttatatagtaggtcatccccagtcgtatctaaacttttacaggacatgaggcacttccctaccataagtgctgattacagccaagatgagaaggccctgctaggcgcttgcgattgcacccagattgtcaagcctagtggcgtccacttgaaacttgtgctgaggttctcagactttggcaaagcaatgtttaaacccatgcggcagcagcgggacgaggaaacccccgtagatttcttctacttcatcgatttccagcgtcacaatgccgaaattgctgctttccatttagacagaatccttgatttccgcagggttccaccaacagtgggtcgcatagttaatgtcaccaaggaaatcctggaggttaccaagaacgaaatcctccagtcagtttttttcgtgagtccagcatcgaacgtgtgtttttttgcaaagtgtccatacatgtgcaagaccgagtatgccgtatgtggtaaccctcacctgctggagggctctctcagcgctttcctgccgtcattgaacctggcgccccggctcagtgttcctaatccctggataagaagctacacactggccggtaaggaagagtgggaggtcaaccccttatattgtgacacggtgaaacaaatttacccttacaacaacagtcagaggctcttgaacgtcatcgacatggccatctttgattttttaattgggaatatggatagacaccactatgaaatgttcacaaagttcggcgacgacgggtttctgatccatctcgacaatgctcgcgggtttggacgacacagtcatgacgagatatcaatcctatcccctcttagccagtgttgtatgattaagaaaaagacccttctccatctgcagttgctggcgcaagccgactatagactctcagacgtcatgagagaaagcctactcgaggatcagctttctccggtcctcaccgagccccacctactcgcactggacaggaggttacagacaatcctgaggacagtcgaggggtgtatcgtggcccacggccagcagagcgtcattgtggatggaccagtcgaacagctggccccagactcagggcaggcaaacttgacatcctag

SEQ ID NO: 22801 - DNA, 954 bp, Artificial Sequence
  Description of Artificial Sequence: Synthetic coding sequence
atgaagaccgccctgatcctgctgagcatcctgggcatggcctgcgctttttcaatgaaaaacctccataggagggtgaaaatcgaggactccgaagaaaacggcgtcttcaaatacagaccacggtactacctgtataagcacgcatatttttaccctcacctgaagcggtttccagttcagggttccagtgactctagtgaggagaacggcgacgattccagcgaagaagaggaagaggaggaggagaccagcaatgaaggggagaacaatgaagagagtaatgaggatgaagatagcgaggctgagaataccacactgtctgccactaccctggggtacggtgaagacgcgacaccagggaccggatatactggattagcggctatccagctgcctaagaaggccggagatatcactaataaagcaacaaaggagaaagaaagcgacgaagaggaggaggaagaagaggaggggaacgaaaacgaggagagcgaagctgaagtggatgagaatgagcagggcatcaatggcacctcaaccaactcaacggaggcggagaacggcaatgggagcagcgggggagacaacggggaggaaggggaagaagagtcagtgacaggtgccaacgctgaagatactacagagaccggcaggcagggcaagggaacctcaaaaacaacaacctccccaaacggcggatttgaacccactactccaccccaggtttatcgaactacatcaccaccattcggcaagaccactaccgtggagtatgagggtgagtacgagtataccggagctaatgaatacgacaatgggtatgagatatacgaatcagagaatggcgaaccgcgcggcgataactatcgcgcgtacgaggatgagtatagctattttaagggacaaggctatgacggctatgatggccaaaactactatcaccaccagtag

SEQ ID NO: 22802 - DNA, 345 bp, Artificial Sequence
  Description of Artificial Sequence: Synthetic coding sequence
atgagcctgcccagcagccgggccgcccgggtgcccggccccagcggaagcctctgtgccctcctcgcccttttgctactgctaactcctccaggcccccttgcttccgctggcccagtgtctgccgtgctaacagaattgcgatgtacctgtcttcgtgtgacactgagggtgaaccctaagacaatcggaaaattacaagtgtttcccgctggcccccagtgttccaaagtcgaggtcgttgctagtctcaaaaatggtaagcaggtgtgcctcgaccctgaagctccgttcttgaaaaaggtcattcagaaaattctggactcgggcaacaaaaaaaattag

SEQ ID NO: 22803 - DNA, 2100 bp, Artificial Sequence
  Description of Artificial Sequence: Synthetic coding sequence
atgcccagcctgtggcgggagatcctgctggagagcctgctgggctgtgtgtcgtggagcctgtatcacgacctgggccccatgatttactacttcccactgcaaactcttgaactcacaggtcttgagggtttttcgattgcctttctgagtccaatattcctcacaattacacctttctggaagctcgtaaataagaagtggatgttgacactgctcagaattatcactataggcagcatcgcatcctttcaagctcccaatgccaaactgcgtctgatggttctcgccttaggagtgtcaagctccctcattgtgcaggcggtgacatggtggtctggatctcacctacagcgctacttacggatctggggcttcatactcggccagattgtgctggttgtcctgaggatatggtatacctccttgaatcctatttggtcataccagatgagcaataaagtgattttgaccctcagtgcgatcgcgactctggaccggatcggcacggatggggattgttccaagccggaagaaaagaaaaccggagaggtagcaaccgggatggcctctcgacccaactggcttctcgctggggccgccttcgggagccttgtgttcctgacacattgggtgttcggcgaggttagcctggtcagccgttgggctgtcagcggacaccctcaccccggtccggatccaaatccatttggcggcgcagtactcttgtgtctcgcgtcagggttgatgctgccatcctgcctttggttcaggggaacaggactgatctggtgggtgaccggtaccgccagtgcagcaggcctgctgtacctgcacacatgggctgcagccgtaagtgggtgtgtgtttgcaatctttaccgcatccatgtggccccaaactcttggacacttaatcaacagcggaactaaccccgggaaaaccatgacaatcgccatgattttctaccttctcgaaatcttcttttgcgcctggtgcacagcttttaaatttgtgcccgggggcgtgtacgcccgagagaggtcggatgtgctgcttgggacaatgatgctcatcatcggtctgaacatgctcttcggtccgaagaagaacctggatctgttgttgcagaccaaaaactcatctaaggtgctgttcagaaagtcggagaagtatatgaagcttttcctctggcttcttgtgggtgtaggactgctgggcctggggctgcggcacaaggcgtacgagaggaaacttggtaaggtagcacccactaaagaggtgagtgccgccatttggcctttccggttcggttacgacaatgaggggtggagtagcctcgagcggtcagctcaccttctcaatgaaacaggcgccgactttatcacaatactcgagtcagatgcgagcaagccttacatggggaacaatgacctgacaatgtggttgggcgagaagctagggttctacactgactttggaccaagcactagatatcacacctggggcataatggctctatcacgctacccaattgttaaaagcgagcaccaccttttgccttcaccagagggcgagattgctccagccataacactgaccgtcaatatatctgggaagctggttgacttcgttgttacacactttgggaatcatgaagatgacctggacaggaaactgcaggctatcgctgtgagcaaactgctgaaatcctcttccaaccaggtcattttcctgggatatatcacgagcgctcctgggtctcgcgattacctgcagctcacagagcacgggaacgtgaaagacatcgattccactgaccatgatcgatggtgcgagtacatcatgtacagaggcctgatcaggctaggatatgcgcgcatcagccacgctgagcttagcgactctgaaatacagatggcaaagttccggatacccgacgacccaactaattacagggacaatcaaaaggtggtgattgatcatcgggaagtatcagagaagattcacttcaaccccaggtttggcagttacaaggaggggcataattacgagaacaatcatcacttccacatgaatacgcccaaatacttcctgtag

SEQ ID NO: 22804 - DNA, 1449 bp, Artificial Sequence
  Description of Artificial Sequence: Synthetic coding sequence
atgctgttcgagggcaaggtgaacccccagacccagagcctgctggcagaatgtggcgagtggacccggcgaagcctacacctgcgggtgctcggtcgccagttaatacttccaacagataaaggcgtccagcacttccaaggtagtacaccagctagtgctgtgcacaggcctccgttaagtgcctgtggacacagcagtaacatccgagagttgtgcatttcagggagccagattgtgcctgccgcactgtcggcctccgccttacccggtccagatgacactggtgtagccgaccttactgcccgcagcagtttggaggaggaagtataccatgtagacggcaagatcgaggagtatttcgcatttgacaggaaagaagatgatgacgagtgcttggagcagaaacctgctcagcccggcaggaaatggaggaagctgggcctgccaccagtatccccgagagactgtgtcaaggacgccgtcgccgccgaggtgtttgatcacgtatggaccaacatggtagaattactggaagagttgatcaggaaacactgggaaaccaccctcacggaaggaaaaaaacagcgcgagactttgaaggtggccggcaacagatttcctcacgtgcttgtgccgcacgcccatgctgatggggcaagcggaccacccagcggccatgctgaagcccacggcatttctttggcctcccgcctcaaccctccacaaattcatcacttctcaagcagtttctatagtgacatgaacggcgtcatgaccattcaagcaaagcctctacagagaagacctgcatattttgctgaccgaacccagaacgaaaaagaggacaaggccagcggtggaggtgccggtgctctgtccagcgccccccaccgcctgggcagagctagtgacactcacgggctgtccccctccgccaaaaagacgcccgtgccgtggcgactgccaagtctggccagcgactctcagcgccttaagacccctaacatttatagtgacgaggtgctaaggggcacaaaacttcccaccggcgttgatcatatggccagcccacttgtgcaaacctctagatctcgatttcctccacttgttaccgagacaagaggtcagaataccgctgttccaggatgtcggctcgtgtcatacagagggagacacttacagaatcgcgttttgagtgccatgccagacggtacagagcgttccagacttagagaacgcactgcaaccctggagagactgtctagaccctccacgactcacacatttaggcaatcagacacaccccgtaagagctccctaactcaaatggaatttgctgcccacacgtggacaggccagagtattctcaccggctcccagtatgtacctaagagttttcagcgtacaactttgacattcaaacgacgattccaggtcacctcctag

SEQ ID NO: 22805 - DNA, 1392 bp, Artificial Sequence
  Description of Artificial Sequence: Synthetic coding sequence
atgggcgccggccccagcctgctgctggccgccctgctgctgctgctgtcaggggacggagcggttagatgtgatacgcctgctaactgtacgtatctggatctgctgggcacatgggtgtttcaggtaggatcttcagggagccagcgtgacgtaaattgtagtgtgatggggcctcaagagaagaaggtggttgtttatcttcaaaaactcgataccgcatacgacgacctgggtaactctggtcacttcacaatcatctataatcagggattcgagatcgtattgaatgactacaagtggtttgccttctttaaatataaagaggaagggtctaaggtcacaacttactgtaatgaaacaatgacaggctgggtgcacgacgtgttagggcgtaattgggcctgctttactgggaagaaagtaggaaccgcctccgagaacgtgtatgtgaatattgcccacttaaagaactctcaggaaaagtatagtaataggctgtataagtacgaccataacttcgtgaaggccataaatgccatccaaaaaagttggaccgccaccacatacatggaatacgagaccctgactctgggagacatgatccggcggtccggcggacattcccgcaagatccccaggcccaaaccagccccactgacggcagagatccaacagaagattcttcatctgcctacctcatgggactggaggaacgttcatggtattaactttgtgagcccagtgcgcaatcaggcctcttgcggctcctgctacagttttgcttcgatgggcatgctggaggcccggatcaggattctgactaacaattctcagacacccattctgtcacctcaagaggttgtgagttgcagtcaatacgcgcagggatgcgaagggggctttccatacctcatagcagggaagtatgcccaggacttcggacttgtcgaagaggcatgcttcccctacaccggcaccgattcaccttgcaagatgaaggaggattgcttccggtattactcctcagagtatcactatgtggggggcttctacgggggatgcaatgaagcactcatgaaattggaactggtgcatcatggaccgatggcggtcgcctttgaagtgtacgatgattttctgcactacaaaaagggtatttaccaccataccgggctgcgagaccctttcaacccattcgaactgacaaaccacgctgtgttactcgtgggttacggaacggattccgctagcgggatggattattggatagttaaaaattcctggggaacgggctggggcgaaaatggctatttcagaatcaggagaggaaccgatgagtgcgcgattgagtcaatcgcagtcgctgccaccccgatcccaaagctttag

SEQ ID NO: 22806 - DNA, 1941 bp, Artificial Sequence
  Description of Artificial Sequence: Synthetic coding sequence
atgagcaagggccccgccgtgggcatcgacctgggcaccacctactcctgtgtgggtgtcttccagcacggaaaagtcgagattatcgccaacgaccagggtaaccgcaccactccatcttacgtggcttttacggacactgaaagacttatcggagatgcggcgaagaatcaagtggccatgaacccaacaaacactgtattcgacgccaaaaggctgattgggcggcgctttgacgacgcagttgtccaaagcgacatgaaacattggccatttatggttgtgaacgacgcaggaaggccaaaggtgcaggtagagtataaaggggagactaagagtttttatcccgaagaggtgtcttcaatggtgctcactaaaatgaaggagatcgccgaagcatacctgggcaagaccgttacaaacgccgtcgtgaccgttcccgcctatttcaacgattcccaacgccaggcgacaaaggatgcaggtactatcgcagggctcaatgtgctgagaataataaatgaaccaacagcggccgcgatcgcatatggtctggacaagaaagtcggcgccgagagaaatgtgctgattttcgacctcggcggcggtactttcgacgtgagtattctgacgatagaggacggaatattcgaagtaaaaagcacggctggtgatacacacctgggcggtgaagatttcgacaacagaatggttaaccattttattgccgaattcaagaggaagcataagaaggacatctctgaaaataaacgggccgtccgacgcctccgcaccgcctgcgaacgcgctaaacgaaccctgtcatcttccacgcaggcttccatcgaaatcgacagtctctatgagggcatcgatttttacacttcgataactagggctcgatttgaggagcttaacgcagacctgtttcgcggcactctggatcctgtcgaaaaagcacttagagacgccaagttagacaagtcccagatccatgacatcgtgctagtcggcggctccaccaggatccctaagattcagaagctgctgcaagactttttcaacgggaaagagttgaacaagagcatcaatcctgatgaagcggtcgcatatggcgccgctgtccaagccgccatcctgagcggagacaaatctgagaacgtgcaagaccttttactactcgatgtaactccgctgagcctagggatcgaaacagctggaggtgtgatgaccgttttaatcaaacgtaataccaccatccctactaaacagacccagacctttaccacctacagcgataaccagccaggcgttcttatacaagtgtacgagggcgagcgtgctatgactaaagacaacaacttattggggaagtttgagctcacgggcataccaccggctccccgaggcgtgcctcaaattgaggtgacattcgacatcgacgctaacggcatcttgaatgtgtcagctgtcgataagtcaactggcaaagaaaacaaaattaccatcacaaatgacaaggggcggctgtccaaggaggacattgaaaggatggtccaagaagcagaaaagtataaagcagaggacgagaagcagcgtgacaaagtgagttcgaagaatagcctggagtcttacgcatttaacatgaaagctacagttgaggacgagaaacttcaggggaaaattaacgatgaagacaagcagaagatcctagataaatgtaatgagatcatcaattggttggacaagaaccagaccgcagagaaagaggagtttgagcatcaacagaaggaactcgagaaggtctgtaatcccattatcaccaagctctatcagagcgcaggtgggatgccaggcggtatgcccggtggtttccctggcggcggcgccccaccctccggcggcgcatcttccggccccaccattgaagaggtcgactag

SEQ ID NO: 22807 - DNA, 1017 bp, Artificial Sequence
  Description of Artificial Sequence: Synthetic coding sequence
atgtgggaggccaaccccgagatgttccacaaggccgaggagctgttctcaaagaccactaataatgaagtcgacgacatggatacgtcagacacgcagtggggttggttctatctcgccgagtgtggaaaatggcacatgttccaacccgataccaattctcagtgttccgtatcttcggaggacattgagaaatccttcaagacaaacccatgtggatccatctccttcaccacaagtaagttttcttataagattgacttcgccgaaatgaaacagatgaacctcaccacagggaagcagaggctcattaagcgggcacccttctcaatctcagcgttcagttatatctgcgaaaacgaggctataccgatgccaccccattgggagaatgtcaacactcaggtgccataccagcttatccctttacacaatcagacacacgaatacaacgaagtggcaaacctgtttggcaaaacaatggaccggaatagaatcaaacgcatccagcgaatccagaacctggatctgtgggaattcttttgtcgtaagaaagcacagctgaagaaaaaaagaggcgtgccccagattaacgagcagatgctgttccacggaactagtagcgaattcgtggaggcaatctgtattcataatttcgactggaggatcaatggtatacacggggctgtgtttgggaagggcacttacttcgcacgagacgctgcttattcatcccggttttgcaaagatgacataaaacatgggaatacattccagatccacggcgtgagtctgcagcagcgtcacttgttccggacatataagtccatgttcttggctcgcgtcctaataggtgattacattaacggggatagcaaatacatgcggcctccatcaaaggatggctcttatgtgaacttatacgactcttgtgttgatgatacctggaaccccaagatattcgtggtgttcgacgcaaaccagatctatccagaatatctcatcgactttcactag

SEQ ID NO: 22808 - DNA, 1059 bp, Artificial Sequence
  Description of Artificial Sequence: Synthetic coding sequence
atggtgcggcccgtgcggcacaagaagcccgtgaactacagccagtttgatcattctgactccgatgatgattttgtgtcggcgactgtacccctgaacaaaaaatctcggactgcccccaaagaactgaagcaggacaagccaaaacccaatttgaacaatctaagaaaggaggagatccccgtgcaggagaagactcctaagaaacgtctgccagagggaaccttttcaatcccggccagtgcagtgccatgcactaaaatggcattggacgataaactgtaccagagggatctcgaagtggccctcgccctgagcgtgaaagaacttcccacagtcaccaccaatgtgcagaatagtcaggacaaatctattgaaaaacatggttcatccaaaatcgaaactatgaacaagtctccgcacatttccaattgttccgtggcctctgattatctggaccttgacaagattactgtggaagatgatgtggggggcgtgcaggggaagagaaaagccgcgagcaaagccgcggctcaacaacgcaaaatcctacttgaaggcagtgatggtgatagtgcaaacgacacagagccagactttgcacctggagaagatagtgaggatgattccgatttctgcgaatcggaggataacgacgaggatttctcaatgcggaagtctaaggtgaaggagatcaaaaagaaagaggtgaaggtcaaaagtcccgttgaaaaaaaggagaagaaaagcaaaagcaaatgtaacgcactcgtaactagcgtagactcggcacctgccgcggtgaaaagcgaaagtcagtccctcccgaagaaggtgtccctttcttccgacacgaccagaaagcccctcgagattaggtccccttcggcagagtcgaaaaagccaaagtgggtccccccagctgcctcaggcgggagccgatcttcatcatctcccctcgtggtcgtgagcgttaaatcgccaaatcagtcacttagattgggcctcagcaggctggcccgcgttaagcccttacatccgaacgctacctccacatag

SEQ ID NO: 22809 - DNA, 1488 bp, Artificial Sequence
  Description of Artificial Sequence: Synthetic coding sequence
atgaccgtgatgagcggcgagaacgtggacgaggccagcgccgccccagggcacccgcaggacggatcatatcctaggcaggccgatcatgatgaccacgagtgctgcgagcgggtcgtcattaacatctcagggctaagatttgaaacacagctaaagactctcgcccagtttcctaacactcttttaggaaacccaaagaagagaatgaggtattttgatcctttacggaacgaatactttttcgacagaaaccgcccaagcttcgacgccatactatactactaccaatctggcggccgcctcaggcggcccgtcaacgtcccactggacatgttctcagaagaaatcaagttttatgagctgggggaggaggctatggagaagttccgagaggatgaaggcttcatcaaagaagaggaaagacccctgcccgagaaggaataccagcgccaagtgtggctgctgtttgagtatccggaatcaagtggacctgcccgtgtgattgccatcgttagtgtgatggtgattctaataagcatcgttattttctgtctagaaaccctgccagaactgaaggacgataaggactttacagggaccgtacaccgaattgataacacaaccgtcatctataattctaatatctttactgacccattctttattgttgagacactgtgtattatctggttctccttcgagcttgtggttcggtttttcgcgtgcccatcgaaaacagatttcttcaagaacataatgaactttattgatattgtcgccatcatcccttattttattaccctcggtactgaaattgctgaacaggagggcaaccagaaaggagagcaggctacgagtctcgcgatactccgggtaatcaggttggtgagagtattccgaatattcaagctttcaagacactcaaaagggctccagattctgggacagacactgaaagcgagtatgagggaactgggactcctgatcttttttctctttatcggggtcatcctctttagcagcgccgtttatttcgccgaagccgaggaagccgaatcgcacttcagtagcatccccgacgccttctggtgggctgtcgtgtctatgacgaccgtgggatacggcgacatgtaccccgtgactatcgggggaaagatagtcggctccctgtgcgcaatcgccggcgtgcttacaatcgctctgccagtcccagttattgtctctaattttaattacttttaccatcgggagaccgaaggagaagagcaagcccagctgctgcacgtgtcttcaccaaatctggcatccgactcagatttgagtaggcggtccagtagcaccatgtccaaaagcgagtacatggaaattgaggaggatatgaacaattccatcgcacactatagacaggtgaatatccgcacagccaactgtacgactgcaaaccagaactgtgttaacaagtccaagcttctgactgacgtctag

SEQ ID NO: 22810 - DNA, 1632 bp, Artificial Sequence
  Description of Artificial Sequence: Synthetic coding sequence
atgcggaagcccgccgccggcttcctgcccagcctgctgaaggtgctgctgctgccccttgctccagccgccgcccaggacagcacccaggccagcactcctggctccccactcagcccaaccgagtatgagagattctttgcactgcttacgcctacttggaaagcggaaacaacttgtagactgagggctactcacggctgtcggaatcccaccttggtccaactagatcaatacgaaaaccacggcctcgttcccgacggcgcagtgtgtagcaacctgccctatgcctcttggttcgaatccttctgccagttcactcactatcgctgttcaaatcacgtttactatgccaaacgagtgttgtgttcccagcccgtaagtatcctgtcacctaacaccctaaaggagatcgaggcctctgccgaagtgtcaccaacaaccatgaccagcccgatctcgccacacttcactgttacggagaggcagacatttcagccctggccagagcgactgtctaataacgttgaagagctgctgcagagcagcctctccctcggcggccaggagcaggcgcccgaacacaagcaggaacaaggcgttgaacatagacaagagcccactcaggagcacaaacaagaagagggccagaagcaagaggagcaggaggaggagcaagaagaggaagggaagcaggaggaaggtcaggggacgaaagaggggagggaagctgtcagccagttacaaaccgactccgagccaaagttccacagcgaatcccttagttctaaccccagctccttcgccccccgtgtgagagaagtggaatcgacacccatgatcatggaaaatatccaggagctaatccggagcgcgcaagaaatcgacgaaatgaacgagatttacgacgagaactcttattggcgcaatcagaaccctggctccctcctccagctgccacacacagaggccctgctggtgctttgttactccatcgtcgagaacacatgtatcatcaccccgactgctaaggcctggaaatatatggaagaagaaatcctgggatttggaaagtcggtctgcgactccttaggtagaaggcacatgagtacttgtgccctgtgcgatttttgtagcctgaaattggaacagtgccacagcgaagcatcccttcagcgacagcagtgtgatacttcccataaaacacccttcgtgtctcccctgctggcatctcaatcactctccatcggaaatcaggtcggctccccagaaagcgggcgcttttacggcctggacctgtacggtggactccacatggacttttggtgtgcacgactcgctaccaaaggatgcgaggatgtaagagtgagcggctggctgcagaccgaatttttatctttccaggatggagatttccccacaaaaatctgcgacactgactatatccagtacccaaactattgttcctttaaaagtcagcagtgtctcatgcgtaaccggaacagaaaagtcagccggatgcggtgccttcagaacgaaacctactcggcactatctcctggcaagagcgaggatgtggtgttaagatggtctcaggaatttagcactcttaccctgggccagtttggttag

SEQ ID NO: 22811 - DNA, 666 bp, Artificial Sequence
  Description of Artificial Sequence: Synthetic coding sequence
atgagcggctgggccgacgagcggggcggcgagggcgacggccggatctacgtcggaaatctgccaactgatgttagagaaaaagaccttgaggacctgttttacaaatatggacgcattcgtgaaattgaactgaaaaaccggcatggcctggtgccgtttgcttttgttcgcttcgaggaccctagagacgccgaggatgcgatctatggtcgaaatggctacgattatggccaatgccgtcttagggtcgagttcccacggacttatggcggaagaggtggctggccacgtggcggacggaacgggcctcccacccggagaagcgactttcgcgttctggtatctggtttacctccatcgggcagctggcaggacctgaaggaccatatgagagaggcaggggacgtctgctacgcggacgtgcagaaggacggtgtcgggatggtcgaatacttgagaaaggaggatatggagtatgctctgagaaaacttgatgacacgaaattcaggagccacgaaggagagaccagttacataagagtgtaccctgagcggtccaccagctacggatattctaggagcaggtctggctcacggggcagggattcaccttatcagagtcggggttctccacactatttttcacctttccggccatactag

SEQ ID NO: 22812 - DNA, 2523 bp, Artificial Sequence
  Description of Artificial Sequence: Synthetic coding sequence
atgagcgccttccggctgtggcccggcctgctgatcatgctgggcagcctttgccacagaggctcaccatgcggtctgtctacgcatgtggaaattggtcatcgggcactggagtttctccaattacacaacggtcgggtgaattatagagaactccttcttgagcaccaggatgcttatcaggccgggatcgtttttccagactgtttttaccctagtatttgcaagggggggaaattccacgacgtgtccgaatccacccactggacccctttcctaaatgcaagcgtgcattatatcagggaaaactaccccctgccctgggagaaagacactgagaagctggttgctttcctctttggcataacaagccatatggctgccgatgtaagttggcattccctcggcctagagcagggcttcttaaggaccatgggagcaatcgatttccacggttcctacagcgaggctcactccgcaggggacttcggaggggatgtgctgagccaatttgaatttaacttcaattatctcgcgcgacgttggtacgtgcccgtaaaagacctgctgggcatctacgaaaagctgtacggtaggaaagtaatcacagagaacgtgattgttgactgctcacacattcaatttcttgagatgtacggagagatgctggccgtgagcaaactgtaccccacctactccaccaagtccccctttttggtcgagcagtttcaggaatactttctggggggactagacgacatggctttctggtccaccaacatttaccacctgacaagcttcatgcttgagaatgggacgtctgattgcaatctgccagaaaacccgctctttatcgcctgtggcggccagcagaatcatacgcagggttctaagatgcaaaaaaatgactttcaccgaaacctgactacctccctaactgaaagtgtagacaggaacattaattatactgaacgcggtgtgtttttttctgttaattcttggacgcctgatagcatgagcttcatctacaaggctctggaaaggaacatcagaacaatgttcatcggggggagtcaactcagccaaaagcacgtctccagcccactcgccagctacttcttgtcattcccgtacgcgcgcctgggatgggccatgacgtccgcagacctcaatcaggacggccatggagatctggtggtaggcgctccagggtacagcagaccaggccatatccacattggacgagtctacctgatctatggtaacgatctcggcctgcctcccgttgacttggacctggacaaagaagcccatagaatcctggaagggttccagccatctgggcgcttcgggtcggccctggccgtattggacttcaacgttgatggcgtaccggacctagcagttggtgccccgtctgtaggttcagagcagcttacctacaagggagcggtgtacgtatacttcggaagtaaacagggcgggatgagtagtagccctaacatcaccatcagctgtcaggatatctattgtaacctaggctggaccctgctggcggctgacgtgaacggcgattccgagcccgatttggtgatcggaagtcctttcgcacctgggggaggaaagcagaaaggcattgttgcggctttctactccggcccgagtctgagcgataaggagaagctgaacgtggaagctgccaactggaccgtgcggggggaagaggatttttcgtggttcggttatagcctacacggggtgactgtggacaacaggacactactgctggtggggtctccaacctggaagaacgccagtcgcctcggacaccttctccacatccgcgacgaaaagaagtccctgggccgggtgtacggatattttccacctaatggacagagttggtttaccatctctggagataaagcgatgggaaagctcggaacatccctgagttcaggtcacgtgttgatgaacggcacgctaaaacaggtgctgttggttggagcacctacttatgacgatgtttcaaaggtggcctttctgacagttacgctccaccagggaggcgcaacaagaatgtacgccctaacctcggatgctcagccactgctcttatctactttttctggggatcgccgattttccagattcgggggtgtgctgcacttgtcagatctggacgatgacggccttgatgagattatcatggctgcaccccttcgtatcgcagacgtgaccagcggcttgatcgggggcgaagatggccgcgtatatgtgtacaacggtaaggagacaactctgggtgacatgactggaaaatgcaaaagttggatcacgccgtgccccgaggaaaaggctcagtatgtcctgatctcgccagaggctagttcgagattcggatcttctctgattaccgtgcggtccaaagctaaaaaccaggttgtcatagctgccgggcgatcctcactgggagcacggctgtccggcgccctccacgtgtatagcttaggatccgattag

SEQ ID NO: 22813 - DNA, 972 bp, Artificial Sequence
  Description of Artificial Sequence: Synthetic coding sequence
atgaagagcgccctgttcacccggttcttcatcctgctgccctggatcctgatcgtcattattatgcttgatgttgacacccgtaggccagttcctccactgaccccccggccttacttttcaccatacgccgtcggccgcggaggagcaagattgcctttaaggcggggaggccctgcccatgggacccagaaaaggaatcagtcaaggccccagccgcagccagagcctcagctgccaacaatctatgcaattacccctacctactcacggccagtgcagaaagctgagctgacccgccttgccaacacatttaggcaagtcgctcagctccactggatcctggtcgaggatgccgccgcccgttcagagcttgtgtcacgcttccttgctagggcagggctgccttcaactcatctacatgtgcccacgccacggcgctataagcgtccaggactaccaagagctactgagcaacggaatgctggacttgcatggcttcggcaaaggcaccagcatcaacgggctcagcctggcgtactgttctttgctgatgacgacaatacctattcgctcgaactgttccaggaaatgcggactacccgtaaagtgagtgtatggccggtgggcctggtgggaggaaggagatacgaacggccactggtcgagaacggcaaggtcgtggggtggtatactgggtggcgtgccgataggcccttcgccatagatatggctggattcgccgtgtctctgcaggtgatcctgtctaaccccaaggcagttttcaaaagaagggggagtcagcccggcatgcaggagtcagactttcttaagcagatcactactgttgaagagctcgaaccaaaagctaataattgcaccaaagtcctggtctggcatacccggaccgagaaagtcaacctggctaatgaaccaaaataccatctcgacaccgtcaaaattgaggtgtag

SEQ ID NO: 22814 - DNA, 3213 bp, Artificial Sequence
  Description of Artificial Sequence: Synthetic coding sequence
atgggcgccgcccggggcagccccgcccggccccggcggctgcccctcttgagcgtccttcttctgcctctgttagggggaacccagaccgcaattgtgttcataaaacagcctagtagccaggatgctttacaggggcgtcgcgccttactccgatgcgaagtggaagcccccggacccgtgcacgtgtattggctcctggatggtgcccccgtgcaagatactgagcgcaggttcgctcaaggctcgtcactgtccttcgctgccgtggatcgactacaagattccggcaccttccaatgtgttgctcgcgacgacgtaactggagaggaggcccgctcagccaatgcttctttcaacattaagtggattgaagcaggccccgtagtacttaagcatccagcatcggaggctgagatccagccacagacccaagtgacccttaggtgtcacattgatggccacccccgtcccacctaccagtggtttagagacggaacccccctgtcagacggccagtccaaccacactgtgagttcgaaagagcgcaatctgactctgaggccagccggcccagagcattcaggtttatactcctgctgcgcacatagcgcgttcggccaggcatgcagctcgcagaactttaccttaagcattgctgacgaaagtttcgctagggtcgtgttagctccccaggacgtggtcgtggctaggtacgaggaagctatgtttcactgtcagttcagcgctcaaccccccccctctctccagtggctgtttgaggatgaaacaccaatcacaaataggagccgtcccccacacctgagacgggctacggtttttgccaatggctccttactgctgacacaggttcgcccccggaacgccggaatctatcgatgcataggtcaggggcagaggggccccccaatcattttagaagcaacactgcacctggctgaaatcgaagatatgcccctcttcgagccccgtgtctttacagctggcagcgaggagcgcgtgacctgccttcctccaaaaggtttaccagagcctagtgtgtggtgggagcacgccggcgtgaggctgcccacccacggacgggtgtaccagaagggtcacgaactcgtcctcgcaaacatcgcagagtccgacgctggagtgtatacatgtcacgctgccaacctcgctggacagcggagacaggatgtaaacatcacagtggctactgtgccctcatggctcaaaaagccccaggacagccagctggaggaaggcaaacctggatatctggactgcctgactcaggccacacccaaacccacagtggtgtggtacagaaatcagatgctcatctctgaagactcccggttcgaggtcttcaaaaatgggacgctgaggattaacagcgttgaggtgtacgacggcacatggtaccggtgcatgtccagcaccccagcagggagtatcgaagcccaggcccgcgtgcaagtgctggagaagctgaagtttaccccacctcctcaaccgcagcaatgtatggagttcgacaaagaagctactgttccctgctctgccacaggcagagaaaagccaacaattaagtgggagcgtgctgatggtagttcactgcctgagtgggtgactgacaacgcgggtactctgcacttcgcgagggttactcgggacgacgctggcaattacacctgcatagcctcgaatggaccgcagggacagatccgtgcccacgtgcagctgacagttgctgtattcatcacttttaaagtagaacccgaacgcaccacggtataccagggtcacactgctctcctccagtgtgaggcccagggagatcccaaaccgttaattcagtggaagggcaaagacaggatcttggatccaacaaaactggggcctaggatgcacatcttccagaatggttccctggttatccacgacgtggctccagaagacagtgggagatatacctgcattgcgggtaattcgtgcaatattaagcatacggaggcccccctctacgtagtcgacaaaccagtgcctgaggagagtgagggccctggttctccccctccctataagatgatacaaactatagggctgtctgttggagcagcagttgcctacatcatcgccgttctgggcctgatgttctattgtaagaagagatgtaaggccaagagacttcagaaacagcccgagggagaggagcctgaaatggaatgtctgaacgggggaccactgcaaaacggccagccatcagccgaaattcaagaagaggtggctctaacatcacttggctcaggacccgctgcgacaaacaagcggcacagtaccagtgacaagatgcactttccacgatcctctctgcagcctatcaccacgctcggcaaaagcgagttcggggaggtgttcctggccaaagcgcagggactagaggaaggcgtggctgagactcttgtgcttgtgaaatccctgcagtcgaaggatgagcagcaacagctggactttcggagagaactggaaatgttcggcaaattgaaccacgccaatgtcgttagattgcttggactatgcagagaggcggagccacactacatggtcctcgaatacgtcgacctgggcgatttgaagcagtttctgcgtattagtaagtctaaagatgagaagctcaagtctcaacctctgtcaacgaagcagaaggttgccctgtgcacccaggtggctctgggaatggagcacctctctaacaatcgatttgtgcacaaagatctggccgcccggaactgtcttgtctccgcacaacgccaggtcaaggttagtgcgcttggcctgtctaaagacgtgtacaattctgaatactatcatttcaggcaggcatgggttccactgaggtggatgtcacctgaagccatcttggagggagattttagcacaaaatccgatgtgtgggccttcggcgtgctgatgtgggaggtatttacccacggtgagatgccccacggtgggcaagctgacgatgaggtcttagcagacctgcaggccggtaaagcacggctgccacagcctgaaggatgtccttctaaactgtaccgtctgatgcaaagatgctgggcgctgtctccaaaggatcgtcccagtttcagtgagattgcatcagcactgggcgattctaccgtggattctaaaccctag

SEQ ID NO: 22815 - DNA, 1521 bp, Artificial Sequence
  Description of Artificial Sequence: Synthetic coding sequence
atgcccctgctgggcctgctgccccggcgggcctgggccagcctgctctcccagctgctgcggcccccttgcgcctcctgcacgggcgcagtgcgatgtcagtcgcaggttgccgaagcagttctgacctcccaattaaaagcgcatcaggagaagcccaactttattataaaaacccctaagggaacccgagacctcagccctcagcacatggttgtcagggagaagattctggacttggtgatctcctgctttaagaggcacggtgcgaaaggcatggatacacctgcatttgagctcaaagagactcttacggaaaagtacggagaagactccggactcatgtatgaccttaaagatcagggtggcgagttgctatccttacgatatgaccttactgttccatttgccagatacctcgctatgaataaggtgaaaaaaatgaaaaggtatcacgtgggcaaggtgtggagacgtgagtcccccacaatagtacaaggtcggtaccgtgaattctgtcaatgcgatttcgacatcgccggtcagttcgaccctatgatacccgatgccgaatgcctgaaaattatgtgtgaaatcctgtccggcctccagctgggagattttttaattaaggtgaacgataggagaattgttgatggcatgttcgcggtttgtggcgtgcctgagtcaaagtttcgcgctatttgcagctccatcgacaagctagacaaaatggcgtggaaagatgtccgccatgagatggtcgtgaaaaaggggttggctcccgaagtggcggaccgcattggcgattacgttcagtgccatggcggggtgagtctggttgaacagatgttccaagatccccggctttcacagaacaagcaggccctggagggtctgggtgacttaaagctactgtttgaatacctcaccctcttcgggatagccgataagatttcattcgacctcagcctggccaggggcttggactactacaccggcgtgatttatgaggctgtcctgctccaaacacctacacaagctggggaagaaccactgaatgtgggcagcgtggcagctggcggaagatatgacggcttggtggggatgtttgaccccaaggggcataaagtaccctgcgttggcctgtcaataggagtggaacggattttttacatcgtggagcagagaatgaagactaaaggggaaaaagtccgcacaacagaaactcaggtcttcgtcgctactcctcagaagaatttcctgcaggagaggctcaagcttatcgccgagctctgggactccgggattaaggctgaaatgctgtacaaaaataatcccaagctactaactcaactgcattattgtgaatcaacagggattccactggtagtgattatcggcgaacaggagttgaaagaaggggttattaaaatacggagcgtggctagtagagaggaagtggcaatcaaacgggaaaactttgtggctgagattcagaagaggctaagcgagtcatag

SEQ ID NO: 22816 - DNA, 912 bp, Artificial Sequence
  Description of Artificial Sequence: Synthetic coding sequence
atgcgggcctggatcttcttcctgctgtgcctggccggccgggccctggcagcaccacagcaggaagctctccctgacgagactgaagtcgtcgaagaaaccgtggcagaggtgacagaggtgtccgtcggagcgaatcctgtgcaggtggaagtcggagaatttgacgatggtgccgaagagactgaagaggaggtggtagctgagaatccttgccaaaaccatcactgcaagcacggaaaggtgtgcgaattggacgaaaacaatacacctatgtgcgtgtgccaggacccgaccagctgcccagctcctattggcgaatttgagaaggtctgctcgaatgacaataaaacgttcgacagttcttgccacttttttgctactaagtgcaccctcgagggcaccaagaagggacataaattacaccttgactatatcgggccatgtaagtatattcctccctgcctcgattccgagttgaccgagtttcctctgcgcatgcgagactggctgaagaatgtactcgtcacgctctacgaaagggatgaagacaacaacctcctcactgaaaagcagaaacttcgggtgaaaaagatccacgaaaatgaaaaaaggcttgaagccggagaccacccggtggagctgcttgcacgggattttgagaagaactacaatatgtacatcttccccgtgcactggcaatttgggcaactcgatcagcaccccatcgatggctacttgagccacacagaattggctccattgcgagccccactcattcctatggagcactgcactactcgcttcttcgaaacttgcgaccttgacaatgacaaatacatcgcgctcgacgagtgggccggttgttttggcataaagcaaaaggatatagataaggacctcgtgatctag

SEQ ID NO: 22817 - DNA, 2634 bp, Artificial Sequence
  Description of Artificial Sequence: Synthetic coding sequence
atggcccggccccggcgggcccgggagcccctgctggtggccctgttgccactcgcgtggttggcacaggcagggttggcccgcgctgccgggtctgtcagactagcaggaggcctgaccctgggcggactgttccccgttcacgcccgcggggcagccgggcgtgcctgtggacagctaaagaaggaacaaggcgtccatcgcttagaggccatgctttacgctcttgaccgcgtgaatgccgaccccgagctcttgcccggtgtgcggctgggagcaaggctgctcgacacatgctcacgcgatacctacgctcttgagcaggccctttccttcgtgcaggcccttattagaggaagaggcgatggtgatgaggtgggcgtgagatgtcctggaggcgtccctcctttaagacccgctcctcccgaacgcgtcgtcgcggtagtgggcgcttctgcgtccagcgtctctataatggtcgcaaacgtgctgagactttttgctatccctcagatctcatatgcgtctactgcccctgagctgagcgacagcacaagatatgactttttcagtagagttgtgccacccgattcttaccaggcccaagctatggttgacatcgttagagcactggggtggaattatgtcagtacattggcaagcgaggggaattacggagagtccggcgtggaggcattcgtgcagataagcagggaggctggcggcgtgtgcattgcccagtcaattaaaatccccagggagccaaaacctggagaattctccaaggtgattcggcgactcatggagacacccaatgcgcgtggaattattattttcgccaatgaagacgatataaggcgagtgctggaagccgcccggcaggctaacctgacaggacatttcctctgggtgggaagcgatagctggggtgcgaaaacttcacctattctgtctctggaggacgttgctgtgggcgcaatcacgatactgccaaagcgcgcttcaatagatggttttgaccagtactttatgaccaggtcattggaaaacaataggcgcaatatttggttcgctgaattttgggaggagaactttaactgcaagctgacctcttcggggactcagtctgacgactccacccgtaagtgcaccggggaagaaagaataggccgcgatagcacttacgagcaggaggggaaggtgcagtttgttattgacgcagtctacgccatcgcccacgcccttcatagcatgcaccaagctctctgcccaggtcacacaggattatgtcctgcaatggagccaaccgacggacggatgttgctgcagtacatccgtgccgttcgctttaatggctccgctggtaccccagtcatgttcaatgaaaatggagacgcccctggtagatacgatatcttccagtatcaagctacaaatgggtctgcaagcagcgggggttatcaggccgtagggcagtgggctgagaccctaagactagacgtggaagctctgcagtggtcaggcgacccacacgaagtcccatccagcctgtgttcattgccctgcggacctggggagcgaaaaaaaatggtgaaaggcgtgccatgctgttggcactgcgaggcctgcgacggataccgcttccaggttgacgagtttacctgcgaggcctgtcccggtgacatgcgccccacacctaatcacaccgggtgcaggccaactcccgtcgttagattatcatggtcctcaccttgggccgcgcctcccttgctgttagcggtcctgggcatagtcgcgacaacaaccgtggtggcaacctttgttaggtataataatactcctatcgtcagagctagtgggagagaactttcatacgtgctgctaacaggcatcttcttgatttacgccatcacatttctcatggtggcagagccgggagctgccgtgtgcgctgctagacgtctgttcctaggactcggcacaactctgtcctactctgcccttctgactaagacaaaccggatttacaggatctttgaacagggtaagagatctgtgaccccaccccccttcatttcacctaccagccagctcgtgattactttttcgcttacctctctgcaggtggtgggtatgatcgcatggctcggtgcacgaccaccacattctgtgattgactatgaagaacaaaggactgtggaccctgagcaggcccgtggggtgctaaagtgtgacatgtccgatctgtccctcattggctgtctgggctactcccttttgctcatggtgacgtgcaccgtgtacgccatcaaggcccggggagttcccgagacattcaatgaggcgaagccgataggctttaccatgtacacaacatgcatcatctggctggcgtttgtaccaatcttcttcggaacagctcagtccgccgagaagatctacatacagaccactacattgacagtaagcctctcactgagtgcatcggtctccctcggcatgttatacgtgcctaagacatacgtcatactattccaccctgaacagaacgtccagaaaagaaagcgatcattgaaggccacatctactgtcgccgcacctccaaagggtgaggatgctgaggcccataaatag

SEQ ID NO: 22818 - DNA, 798 bp, Artificial Sequence
  Description of Artificial Sequence: Synthetic coding sequence
atggccgccgccgtgcccaagcggatgcggggccccgcccaggccaagctcctgcctggttctgccatacaagccctcgtgggcctagctaggcctctggttctggcactactgctggtgtctgcggccctcagcagtgtcgtgtctcggaccgatagcccttctcctaccgtgttgaattcccatatctctacacccaatgtgaacgccctgacacatgagaatcagaccaaaccctccatcagccagatcagcaccacactgcctcctaccaccagcactaagaagagcgggggtgcctccgtggtgccccacccttcgcccacacctctgtcacaggaggaggctgataacaacgaagatccaagcatcgaagaggaagatctgctgatgctcaacagctctccttcaactgccaaagatactttggacaatggcgattatggcgagccagattacgattggacgaccggcccaagggatgacgacgagagcgacgatacgctcgaagaaaaccggggatatatggaaattgaacaaagcgtcaagtcgttcaaaatgccgtcatccaatattgaagaggaagactctcatttctttttccacttaatcattttcgctttctgtatcgcagtagtgtatataacttaccacaataagagaaaaatcttccttctcgtacagtctaggaagtggcgggatggcttatgtagtaagactgttgagtaccaccgactcgaccaaaatgttaacgaggccatgccttcactgaagattacaaatgactatatcttctag

SEQ ID NO: 22819 - DNA, 2349 bp, Artificial Sequence
  Description of Artificial Sequence: Synthetic coding sequence
atggcccccagcgcctgggccatctgctggctgctgggcggcctgctcctgcatgggggaagctccggccccagtcctgggccatcagtgccccgcctgcggctgtcgtatcgggacctcctatctgccaacagatccgcaatctttctcggccctcagggcagcctcaatctgcaggctatgtacttagatgaatatcgggacaggctgtttttgggcgggctggatgcattgtatagcctgagattggatcaagcttggcctgaccccagggaggtcttgtggcccccccagcccgggcagcgggaggagtgcgtgcgcaaaggccgggacccactgacagagtgcgccaactttgtgagagtgctgcaacctcataatcgcacgcatctcttagcctgcggcacaggtgcctttcagccaacctgcgcgctcatcacagtgggacacaggggggagcacgtgctgcatcttgagccaggatccgtcgagagcggcagagggcggtgcccacatgagccaagtagaccattcgccagtacttttatcgatggagagttatatacaggtctgactgctgactttcttggaagagaggccatgatatttcgctcaggcgggccccgccccgccctgcgctcggactctgaccagtctctcctgcatgaccctcggttcgtgatggcagcaagaatacccgagaacagcgatcaagacaacgacaaagtttacttctttttctccgagaccgtcccttcgcctgacgggggatccaatcatgtgacggtcagcagggttggacgagtctgtgtgaacgacgccggtggtcagcgggtgttagtcaataagtggtccactttcctgaaggctcgcctggtctgttcagtgccagggcctggcggcgccgagacccacttcgaccagctggaggacgtgtttctgctctggcccaaagccggaaaatcacttgaggtgtacgctctcttctccaccgtgtcagcagttttccaggggtttgcggtctgcgtgtatcacatggccgatatctgggaagtgttcaacggtcctttcgctcaccgggacgggccccaacatcagtggggaccctacggaggcaaggtgccattccctaggcccggagtatgtccgtcaaaaatgacagcccaacccggcaggccatttggatcaactaaagattatcctgatgaggtgcttcaattcgctagagcacaccctctaatgttctggcctgtgagaccaaggcacggacgacccgtgctagtcaaaactcacctggcccagcagctccatcagatcgtggtagacagggtcgaggcagaggacggcacctacgacgtcatctttctgggtaccgacagcgggtcagtgcttaaggtgatcgcactgcaggccggaggatccgccgagcccgaagaagtggttctggaggaactgcaggttttcaaggtgccgacgcccatcaccgaaatggagatctccgtgaagcgacagatgttgtacgtggggtccaggcttggggtggcccagctgcggctgcatcagtgtgagacatatgggacagcctgtgctgagtgttgcctggcccgggacccgtactgcgcgtgggatggcgctagctgtacacactatcgaccatcccttggtaagaggcgattcagaaggcaagacatccggcacggaaacccagcactccagtgcctgggacagagccaggaagaggaagctgtgggccttgtagccgctacaatggtctatggaactgagcacaattcaacctttttggaatgtttgccgaaatctccccaagcagctgtgcgctggttgttacagcgtcccggcgatgaggggccagaccaggtgaagacagacgagcgcgtcctgcacacagagcgggggctgctgttccggcgcctttccaggttcgatgctggtacctatacatgtacaaccttagagcatggattttctcagactgttgttaggcttgcactggtggtgattgttgcttcacagctggataatttgttcccccctgagcctaaacctgaggagccaccagctaggggcggcctggccagcacgcccccaaaggcctggtacaaagacatactgcagctcattgggttcgccaacctacctcgggtggacgaatactgtgagcgcgtatggtgcaggggaaccactgaatgctctggttgttttcggtctcgatcaagagggaaacaggcccgcggcaaatcatgggctgggctagagcttggcaaaaaaatgaagagccgggttcacgccgaacacaaccgcacaccgagggaagtcgaggccacatag

SEQ ID NO: 22820 - DNA, 1725 bp, Artificial Sequence
  Description of Artificial Sequence: Synthetic coding sequence
atggtggaggacggcgccgaggagctggaggacctggtgcacttcagcgtcagtgaactgccttccagagggtacggggttatggaagaaattcgaagacagggcaaactctgtgacgttacattaaagatcggtgaccataagttcagcgcccatagaattgtcctggcagcctcaattccatactttcatgctatgtttactaatgacatgatggagtgtaagcaggatgaaatagtgatgcaaggcatggaccctagcgccctggaggcgctgattaattttgcttacaatggaaatctcgccatagaccagcagaatgtccagagcctattgatgggagcctcctttctgcagctgcagtcaatcaaggatgcctgttgtacatttctgagagaacgcctacatcctaagaactgccttggcgttcgtcaattcgcagagactatgatgtgcgccgtgttgtatgatgccgcaaattcctttatccaccagcactttgtcgaggtttccatgagcgaggaatttttagcactgccattggaggacgtgttagagcttgtcagccgagatgagctgaacgtcaagtctgaagagcaagtttttgaagccgccctggcctgggtacgctatgatcgtgaacagcggggtccctacctacctgagttgctgtcaaacattcgcctgcccctgtgccgcccacagttcctaagtgaccgcgtgcagcaggacgacctggtgcgctgctgccataaatgccgcgatttagtggacgaggccaaagactaccatctgatgccagagcggcgaccgcacctgccggcctttcgcactaggccaaggtgctgtaccagcatcgctgggctaatctacgctgtgggtggactgaacagtgccggagactcacttaacgtggtggaggtctttgatcccatcgcaaactgttgggaacgttgtagaccaatgaccaccgctcggtctagagttggggtggctgtggtgaatgggctgctgtacgccattggagggtacgatggacagctgcggctgtccaccgtcgaggcgtataatcctgagactgacacctggaccagagtgggctccatgaactcaaagaggagcgctatggggaccgttgtgctcgatgggcagatttacgtgtgcgggggatacgacggcaactcatcactgtcaagtgtcgaaacatacagtcccgagacagacaaatggacggtggtcactagcatgtcttctaaccgcagcgcagctggggtgaccgtcttcgaaggcagaatctatgtttctggtggacacgacgggttacagatcttttctagcgtggaacattataaccatcatacagccacctggcaccctgccgccggtatgctgaacaaacgctgccgacacggcgctgcctccctggggtctaaaatgtttgtgtgtggagggtacgatggctctggcttcctatcaatcgcagaaatgtactcgagcgttgccgaccagtggtgcctgatagtacctatgcacaccagacggagtcgggtcagccttgtggcttcttgcggccggctgtacgcggtggggggatatgatgggcagtccaacttatcgtccgtcgaaatgtacgatccagagaccgactgttggacctttatggctccgatggcgtgtcatgaaggaggcgtcggtgtgggatgtatacctttgctaacaatatag

SEQ ID NO: 22821 - DNA, 486 bp, Artificial Sequence
  Description of Artificial Sequence: Synthetic coding sequence
atggccaaggaggagccccagagcatcagccgggacctgcaggagctgcagaagaaactctcactgttgatcgattcttttcagaataactcaaaagttgtcgccttcatgaaatcacccgtagggcagtacctcgattctcatccctttttggcattcactcttctggtgtttattgtgatgagcgccgtgccagttggcttcttccttctcatagtggtgttaaccaccctagccgctctgctgggcgtcataattctggaaggactggtgatctcagtggggggtttctcactcctctgcattctctgtggacttggctttgtatcccttgctatgagtggaatgatgattgcatcatatgtcgtcgttagctcactgatcagctgctggttcagcccacgcccactcactcagcaaaatacatcttgtgactttttgcccgcaatgaaaagcgctgaattcgagggactttatcaagagtag

SEQ ID NO: 22822 - DNA, 4503 bp, Artificial Sequence
  Description of Artificial Sequence: Synthetic coding sequence
atgacccggatcctgaccgccttcaaggtggtgcggaccctgaagactgggtttggatttacaaacgttactgcacatcagaagtggaagttttcccggccaggtatccgcctgctctcagttaaggcacaaaccgcacatattgtgttggaggatggcaccaaaatgaaagggtattcttttggtcacccaagctccgtcgctggggaagtggtcttcaataccggacttgggggataccctgaggcaatcactgaccctgcctataaaggacagatcttaaccatggccaatccaattataggtaatggcggggccccagatactactgcgctggacgaactgggcctgtcaaaatatctggaatcgaatggtatcaaggtgtctgggctgctggtacttgactatagtaaagattataatcactggttagccaccaaaagcctggggcagtggcttcaggaggagaaggttccggcgatttatggcgtggacacacggatgttaactaagatcattcgagacaagggcacaatgctaggaaaaatagagtttgagggccaaccagtggatttcgtggaccccaataagcaaaatctgatcgctgaagtgtcaaccaaggacgtcaaagtatacgggaaagggaacccgacgaaagttgtcgctgtggactgtgggatcaaaaacaatgtgatccgtctacttgtaaagcggggtgcagaggtgcatctggtgccttggaaccacgatttcaccaagatggagtatgatggaatcctgattgccgggggacctggaaacccagcactcgctgaaccgcttatccagaacgttagaaaaatactcgaaagcgacaggaaggagcctctcttcggaatcagcaccggcaacttaatcacaggcctggccgccggtgcgaaaacatataaaatgtccatggctaatcgaggccaaaatcaacctgtcttgaatattactaataaacaagccttcatcacggcacagaatcatggctacgctcttgacaataccctgcccgcgggatggaaaccactgtttgtcaatgtaaatgaccagaccaacgaaggaatcatgcatgagtccaagcccttcttcgccgtgcagttccatcctgaggtcactcccgggccaattgataccgagtatctttttgacagctttttcagccttatcaagaaggggaaagctactacaatcaccagcgtgttacccaagcccgccctggtggcaagcagggtggaggtatctaaagtgctgatcctcgggtctgggggcctctctatcggccaggcaggtgagtttgactactcagggtcccaggccgtgaaagccatgaaggaggaaaatgtcaaaacggtgctgatgaaccctaacatcgcctcagtacagacaaatgaggtcgggctaaaacaagctgataccgtgtacttcctgccaatcactccccagtttgtcacagaagtgataaaagccgaacaacccgatggtctcatcctgggaatgggcggacagactgcacttaattgcggtgtagaactattcaagcgaggggtgctcaaggagtatggggttaaggtgctgggtacgagtgtggagtcgattatggctacagaagacagacagctgtttagtgataaactaaacgaaatcaacgagaagatcgctccttcgttcgcagttgaaagcatagaggacgcgcttaaagcagcggatacaattgggtacccagtgatgattaggagtgcttatgctctcggtgggctgggaagcgggatctgtcccaatcgggaaaccctcatggacctgagcacaaaggcattcgccatgactaaccaaatcttggtggaaaagtccgtcaccggctggaaagagatcgaatacgaagtcgtccgcgacgccgatgacaactgtgtgaccgtgtgtaatatggagaacgtggatgctatgggggtgcatacaggagatagcgttgtggtcgcacccgcacaaacactttcgaatgccgaatttcagatgctgagacgcacctcaatcaacgtcgtcaggcacctgggcatcgtgggggagtgcaatatccagtttgctttgcacccaacaagcatggagtactgtataatcgaggtcaatgcccgcctttccagatctagtgcgttagctagcaaggccaccgggtaccctttggcctttatagctgctaaaattgcactgggtattccactgccggagataaagaacgtcgtcagcggaaagacatcggcctgtttcgagccgtccctggactatatggtgactaagataccaagatgggacctggacaggttccacggaacttctagccgtattgggtcatctatgaaatcagtgggcgaggtgatggccattggtaggacattcgaggagagcttccagaaggctctgcgcatgtgccatccaagcattgaagggtttacaccccggctgccaatgaacaaggagtggccatctaatttagatctgagaaaggaactgtcggagccgagcagcacaagaatttacgccatcgctaaggctattgacgacaacatgtcccttgatgagattgaaaaactgacatacatcgacaagtggtttctatataaaatgcgggacatccttaatatggagaagacccttaagggcctcaattcggagtcgatgaccgaagagaccttgaagcgggcgaaagagattggctttagtgataagcagatttcaaaatgccttggactgaccgaggcgcagactcgcgaactgcgactgaaaaagaacatccacccctgggtgaaacagatcgataccctggcagcagagtatccttccgtcaccaactatctgtacgtgacttataacggtcaggagcacgacgtcaacttcgacgaccacggcatgatggtccttgggtgcgggccctaccacattggatccagtgtcgagtttgattggtgtgcagtcagctctatcaggacgttacggcagctgggcaaaaaaacagtggttgtcaattgtaaccccgaaactgtctctaccgacttcgatgaatgtgataaactgtacttcgaggaattgtcccttgagcgcattcttgatatttaccaccaagaggcctgcggcggctgcataatctcagttggcggacagattccaaataacctggcggtcccgctttacaagaatggtgtgaagattatgggcacgagccctttgcagatcgacagagcagaagataggagcatctttagtgccgttttggatgagttgaaagtagctcaagcaccttggaaagctgtaaataccctgaatgaggcgttggaatttgcaaagtccgtggactacccatgtttgctgcgcccatcgtacgtactgagtggctcagctatgaacgtcgtcttttctgaagatgagatgaagaagtttctggaagaagcaaccagggtgagccaggagcatccagtggtccttacaaaatttgtggaaggcgctagagaggttgagatggacgcagtaggtaaggacggtcgggttatcagccacgctatcagcgaacatgtagaagatgccggtgtgcacagcggagatgccacactgatgttaccgacccagactatctctcagggtgctattgaaaaggtgaaagatgcaacgcgaaagatcgcaaaagcattcgccataagtggcccattcaacgtacaatttttagtgaagggcaatgacgtgttagtaattgagtgcaacctgcgagcttctagatcttttccttttgtcagcaagacccttggcgttgatttcatagatgttgctaccaaggtgatgatcggcgaaaatgtcgacgagaaacacttaccaacgctggatcacccaatcatacctgcagattacgtggcgattaaggctcccatgttttcatggccccgactgagagacgcagaccccatcctgagatgcgagatggcgagcaccggtgaagtagcctgttttggcgaagggattcacacagcctttctgaaagccatgctttctacaggatttaaaattcctcagaagggtatcttaatcggcattcaacagagttttagacctcgtttccttggtgttgcggaacagctccacaatgagggcttcaaactcttcgctacagaggccacttcagactggctgaatgccaacaacgttcctgcaacaccagtggcgtggcctagccaagagggacaaaacccatccctcagctctatacggaaattgattcgcgacgggtcaattgacctggtcattaacctgccaaataacaacaccaaattcgtccacgataattacgtcatcaggcgcactgccgtggattccggcatcccgctgctcaccaattttcaggtcactaagctgtttgctgaggccgtccaaaagagccgcaaggtcgattctaaatccctgtttcattacagacaatattctgctggtaaagctgcctag

SEQ ID NO: 22823 - DNA, 846 bp, Artificial Sequence
  Description of Artificial Sequence: Synthetic coding sequence
atggccgtgaacgtgtacagcaccagcgtgaccagcgagaacctgtcgcgccatgacatgctggcatgggtgaatgactcactacacctgaactatactaagatcgaacaactgtgttcaggggccgcatactgccagttcatggatatgctgtttcccggttgtgtccatctcaggaaagttaaatttcaggccaaactggagcacgagtacatccataatttcaaagtcctccaagctgcttttaaaaaaatgggtgtggataagatcattcccgtggagaagcttgtgaaaggaaagttccaggataatttcgagtttatccagtggttcaagaagttttttgatgccaactacgacggcaaagattacaacccactcttagctcgccaggggcaggatgtcgctccccctccaaacccaggcgatcagattttcaacaaatcaaagaaattgatcggcaccgccgtgccccagaggacgagtcctactggtcccaagaatatgcagacttctgggcgcctcagcaacgtggccccaccatgcatcttgaggaaaaaccctccttcggctcgcaacgggggacacgaaacagacgctcaaatcttagaattgaaccaacagctagtggatcttaaactcactgtcgacggtcttgagaaggaacgcgacttttacttttccaaacttcgggatatcgaattgatttgccaggagcatgaaagcgagaatagtcccgtcatctcaggtatcattgggatcctttacgcaaccgaggaaggcttcgccccccccgaggatgacgagattgaggagcatcaacaggaggaccaggatgagtactag

SEQ ID NO: 22824 - DNA, 531 bp, Artificial Sequence
  Description of Artificial Sequence: Synthetic coding sequence
atggccctgtggcgggcctaccagcgggccctggccgcccacccctggaaggtgcaggtcttgactgctggatctttgatgggactgggagacatcatctcccagcagctagtagagagacgtggactccaggagcatcagagagggcgtacccttaccatggtctccctgggatgcggattcgttggtcctgtagtaggtgggtggtataaggttctagaccggtttatccccgggacaacaaaggttgacgctctgaaaaagatgctgttggaccaaggggggtttgcaccttgtttcctcggatgctttctgcctctggtgggggcactcaacggacttagcgctcaggacaactgggccaaacttcagagagattatcctgacgccctcattactaattattatctatggccggcagtgcaactcgccaatttttatcttgtcccactccattataggctggctgtggtgcaatgtgtcgccgtcatctggaatagctatctaagttggaaggcccatcggctctag

SEQ ID NO: 22825 - DNA, 1143 bp, Artificial Sequence
  Description of Artificial Sequence: Synthetic coding sequence
atggccagcctgcccgtgctgcagaaggagagcgtgttccagagcggggcccatgcctacaggatcccagccctgctgtaccttccaggtcagcaatctctgctggcttttgcggaacagcgggcatccaaaaaggacgaacatgccgagttaattgtactgcgtaggggcgattatgatgcaccaacacaccaggtgcagtggcaggctcaggaagtggtggctcaggccagattggatgggcaccgctccatgaacccctgccctctgtacgacgcccagaccggtaccctgttcctctttttcattgcaattccagggcaggtgaccgaacagcagcagttgcagaccagggcaaatgttactcgattgtgccaggtcacaagtaccgatcacggtaggacctggtcatcgccgagagacctaacagatgccgccatcggacccgcctatagagaatggtccacctttgccgtgggcccaggacattgtctgcagctgcatgatcgagcaaggtcactcgtggtccccgcatatgcataccgcaagctccatcccatccagcggcctattccctctgctttctgttttctctcacacgatcatgggcgcacatgggcaagaggccacttcgtagctcaggatactctggagtgtcaagttgcggaagtcgagaccggcgagcagcgagttgtcactcttaatgccaggagtcatcttcgcgcccgagtacaggctcagtccaccaacgacggcctggattttcaggaatctcagctcgtcaaaaagctagtggagccgcctccacaaggatgtcaaggctcagtgatcagtttcccatcacctaggtcaggtcctggctctccggcacaatggctgctctacacacacccaacacattcatggcagcgggcagacctgggcgcttatctcaacccccgccctcctgcgccagaagcctggagtgaacctgtgctactggctaaaggatcatgtgcctattcagacctgcagagcatggggactggtcccgatggctcgccattatttggctgtttgtatgaagcaaatgattacgaggagattgtgttccttatgtttactttgaaacaagcttttccagccgaatatctcccacagtag

SEQ ID NO: 22826 - DNA, 3165 bp, Artificial Sequence
  Description of Artificial Sequence: Synthetic coding sequence
atggccgccgtgaaggagcccctggagttccacgccaagcggccctggagacctgaggaggctgtagaagatcccgatgaggaggacgaggataacaccagtgaggcagagaatgggttctcactggaagaggtcctgaggctcggcggcaccaagcaggactacctgatgctcgccactttggacgagaacgaggaagtaatcgacggaggcaagaaaggcgccattgatgatttgcaacagggcgaactggaggcctttatacagaacttaaaccttgcaaaatacacaaaagcgagccttgttgaagaggacgagccagctgagaaagagaactcttcaaaaaaggaagtcaagatacccaagatcaacaacaagaatacagcagagagccagaggactagcgtcaacaaggtgaagaataagaatcgtcccgaaccgcattcggacgaaaacggcagtaccacgccgaaggtgaagaaggacaagcagaacattttcgaatttttcgagagacaaacgctcttattgagacctggaggaaagtggtatgatttagagtactcaaacgagtatagtcttaagccgcaaccacaagacgtggtaagcaagtacaaaactctggctcagaagctttaccagcatgagatcaacttattcaagtccaagacaaattcacagaagggtgcttcttccacttggatgaaggccattgtctcatcaggcaccttaggtgatcggatggccgcaatgatccttctgatccaggacgacgcagtgcataccttgcagttcgttgaaaccctggtcaatcttgtcaagaagaaaggctctaaacagcagtgccttatggccctcgacactttcaaggaattgctgatcaccgacctcctgcccgacaatcgcaaactgcgaatattctcacagagaccatttgataagctggagcagcttagttccggtaacaaggatagcagggatcgccgcctaatcttgtggtattttgagcatcaacttaaacacctcgtggccgagtttgtacaagttctcgaaactctttcgcacgacaccctggtgaccacgaagacacgtgcattaactgtcgcccatgagttactgtgcaacaagccagaggaagagaaggctctgcttgttcaggtcgtgaataagttaggagaccctcagaaccggatagctactaaagcatcgcatctgcttgaaacgctcctttgcaaacacccaaatatgaaaggcgttgtgtctggcgaggtggagcggctcttatttcgttcaaacatcagttccaaggcccagtattatgctatttgcttcctgaaccagatggccctcagccacgaagaatctgagctggccaataaactcatcacagtctacttctgttttttccgcacctgtgttaagaagaaggacgtggagtcgaaaatgttaagcgcacttctcacaggagtgaatcgcgcatacccatattcccaaactggagacgataaagtgcgcgagcagattgacacactgttcaaagtgcttcacatcgtgaatttcaatacaagtgtgcaggcactaatgctgctgttccaggtcatgaacagccaacaaactatttccgataggtactacacagccttgtaccgcaaaatgctcgacccaggactcatgacttgtagcaagcaggcaatgtttctgaaccttgtgtataagtcgctcaaagccgacatcgtgctaagaagagtgaaagccttcgtgaaacggcttctgcaggttacttgtcagcagatgccgccatttatctgcggtgctctgtacctggttagcgagattctgaaagcaaagcccgggctgcgctcccagctggacgatcacccagaatctgacgatgaagaaaattttatcgatgccaatgacgatgaagacatggagaaattcactgatgccgacaaagaaaccgaaattgttaagaagcttgagacagaagagacagtccccgaaaccgacgtcgaaaccaagaaacctgaggtagcctcctgggtgcacttcgataatctgaagggaggtaaacagttgaataaatacgatccattcagtcgaaatccattgttctgcggagctgagaatacgagtctttgggagctaaagaaactgagtgtccacttccatccctctgtcgctttgttcgcaaaaacaattcttcaggggaactacatccaatactctggagaccccctccaggacttcacattgatgcgatttcttgaccgcttcgtttataggaatccaaagcctcataagggcaaagagaacacagactccgtggtgatgcagcctaagcgaaagcacttcatcaaagacatcaggcatcttcctgttaactcgaaggaatttcttgcaaaggaggaatcacagatccccgttgatgaagttttttttcataggtactacaagaaggttgctgtgaaagagaaacagaaacgagatgctgacgaagagtcaattgaggacgtggacgatgaagaattcgaggagctaatagatacgttcgaggacgacaactgcttctcctccgggaaagatgacatggatttcgccggcaatgtaaaaaagcgcactaagggagccaaggataacactctggacgaagatagtgagggctccgacgacgagctgggcaacctagatgatgacgaggtcagcttgggatcgatggacgatgaggaatttgctgaggttgatgaggacgggggcactttcatggacgtcctggacgatgaatccgaaagcgtgcccgagctagaagtgcactcaaaagtttcgacaaagaaatcaaagcgaaaaggcaccgatgatttcgactttgccggctcatttcaggggccacgcaaaaagaaacgtaatttgaatgacagctccttgttcgttagtgctgaggaattcgggcacctgctagacgagaacatggggagcaagtttgacaatattgggatgaatgccatggccaacaaggataatgcctctctcaaacagctacgctgggaggcagagcgggatgattggctgcataatcgggacgctaagagtattatcaaaaaaaagaaacacttcaaaaagaagagaatcaagacaacacaaaagacaaagaaacagcgcaaatag

SEQ ID NO: 22827 - DNA, 1107 bp, Artificial Sequence
  Description of Artificial Sequence: Synthetic coding sequence
atggagcccggccagccccgggagccccaggagccccgggagcccggcccgggagccgagacagcagccgcccccgtatgggaggaggccaaaattttttacgacaatctggctccaaaaaagaaacctaaaagccccaaaccccagaacgcagttacaatcgcggtgtcatctcgcgcgctgttccgaatggatgaggagcagcaaatctacacagaacaaggggtcgaagagtacgttaggtatcaactggagcacgagaacgagccctttagtcctggccctgccttcccttttgtgaaggctttagaggcggtgaaccgccggcttcgggagttgtatccagactccgaggatgttttcgacatcgttctcatgactaataatcacgcccaggtgggggtgaggttgataaattccattaatcactacgatttattcatcgagcgattttgcatgaccggcgggaacagtcctatatgttatctgaaagcctaccatacgaacttgtaccttagcgccgatgctgagaaagtgagagaggccattgacgaggggatagcagccgcaactatcttttctcccagcagggacgtcgtggtttctcagtctcagctgcgtgttgccttcgatggcgacgcagtgctgttttccgatgaaagtgaacgtattgttaaggcccacggcttagatcgcttctttgaacacgaaaaggcgcacgaaaataaacctcttgcacaggggccactaaaggggtttcttgaggccctgggccggctgcagaagaaattttactccaaggggttgagattggagtgtccgataagaacgtacctggttacagctagaagcgcagcctcttcaggcgcccgtgctctaaagaccttgagatcatggggcctggagaccgacgaggcactttttctggccggcgcccctaagggaccactactcgagaagattaggccccatattttctttgacgaccaaatgtttcatgttgctggggcccaggagatgggtactgtggcagctcatgtcccatatggagtcgctcagacacctcgccgcaccgcacctgccaagcaggcaccaagcgctcagtag

SEQ ID NO: 22828 - DNA, 1080 bp, Artificial Sequence
  Description of Artificial Sequence: Synthetic coding sequence
atgctgagcgccgccagccgggtggtgagccgggccgccgtgcactgtgcgttgagatctccaccacctgaggcccgggccctggcaatgagtcgacctccacctccccgcgtcgcatctgtacttggaactatggaaatggggcgtagaatggacgcccctgcgtcagctgcggctgttcgggcgttcctggaacgcggacacaccgagctggataccgcctttatgtactcagatgggcagtcagaaaccattttggggggcctggggctcggactgggtgggggggattgtcgagtgaaaattgctacaaaagccaacccatgggatgggaaatcccttaaacctgattctgtgcgctcccaactagagacatccctcaaacggctacagtgccctcaggtcgaccttttctatctgcatgctcctgaccacggaactcctgtcgaggagaccctacatgcctgtcagcgcctgcaccaagagggaaagttcgtcgagctaggtctgtccaactatgcctcttgggaggtggcagagatctgcacattgtgtaagtccaacggctggattttacccactgtttaccaagggatgtacaacgccactacacggcaagtggaaaccgaactgttcccgtgtctgaggcactttggcctgaggttctacgcttataatccgctcgctgggggactcctcactggaaagtataagtatgaagataaggatggtaagcagcccgtcggccgattcttcggaaactcatgggccgagacatatcgcaataggttctggaaagagcaccatttcgaggcaatcgccctggttgagaaggcccttcaagccgcttacggagcttccgcaccaagtgttacttccgcggctctccggtggatgtatcaccacagccagctacaaggggcacacggggacgccgtgattctgggtatgagtagcctggagcaactagaacagaatctggctgcgacggaggaggggcccctcgaacccgcggttgtggatgccttcaaccaggcttggcatcttgttgcacacgagtgcccaaattactttcgttag

SEQ ID NO: 22829 - DNA, 561 bp, Artificial Sequence
  Description of Artificial Sequence: Synthetic coding sequence
atggacgccgacagcgacgtggccctggacatcctgatcaccaacgtcgtctgcgtgtttcgcactcggtgccacctgaacctgcgcaaaatcgcacttgagggagccaatgtgatctacaaacgggacgtcggtaaagtcctgatgaagcttagaaagcccaggatcaccgcaaccatctggtcctcaggcaaaattatttgtacaggagctacttcagaggaggaggccaaatttggggctagacgcctcgcgcggtcactgcaaaagctgggctttcaggttattttcaccgacttcaaagtcgtgaacgtgttagccgtttgtaacatgccttttgaaatacgtctcccagagttcactaagaacaatcgcccccacgcctcttatgagcctgagctccatccggcggtgtgttatcggatcaagtccctccgcgcgacactgcagatcttttccacaggttccatcactgttacaggacctaatgtgaaggccgtggctaccgctgtagaacaaatttacccctttgtgttcgaatcaagaaaagagatcctttag

SEQ ID NO: 22830 - DNA, 537 bp, Artificial Sequence
  Description of Artificial Sequence: Synthetic coding sequence
atggccgcccccctgggcggcatgttcagcggccagccccccggccctcctcaggcaccacctgggctccccggacaggccagcctcctgcaggcggcacccggcgcccctcggcccagcagcagtactcttgtagacgagttggagagctcatttgaagcatgtttcgcttcgctcgtgtcacaggactacgtgaacggtacagaccaggaggagatcaggaccggcgtggatcagtgcatccagaagtttctggatatcgccaggcaaacagagtgtttcttcctgcagaagaggctccagttaagtgtgcagaagccagaacaggtcattaaggaggatgtgagtgaattacgtaatgagttacagagaaaagacgctttggtgcagaagcatctgactaaactgcgacattggcagcaggtgttggaggacatcaatgttcagcacaaaaaaccggccgacatcccccagggtagtctcgcctatctcgagcaagccagcgccaatattcctgccccactcaaacccacatag

SEQ ID NO: 22831 - DNA, 738 bp, Artificial Sequence
  Description of Artificial Sequence: Synthetic coding sequence
atggagaagaccgagctgatccagaaggccaagctggccgagcaggccgagagatacgatgatatggccacctgtatgaaggccgtgactgagcagggagcagaactaagcaacgaagagaggaatctcctgagcgtcgcctacaagaatgtggtggggggccgccgatcagcttggcgggtgatttcttcgattgaacaaaagaccgacactagcgacaagaaactccagctgattaaggactaccgcgagaaagtggagagcgaacttcgtagtatctgcacgacggtgctggagctcctggacaagtacttgattgctaacgctaccaacccagagtccaaagtgttctatctaaagatgaaaggagactactttaggtacctcgctgaggttgcatgcggggatgatcggaaacagactattgacaactctcagggggcgtatcaggaagcgttcgatatcagcaaaaaagaaatgcagcccacccatcctattcgcctgggtctcgctctcaatttttccgtgttttactacgagatcttgaacaatcccgaattggcctgcacactggctaagaccgccttcgatgaagcgatcgcagagctggataccctcaacgaagattcctataaagactcaactctgattatgcagctgctgagggataaccttacattgtggacctcagacagcgctggggaggaatgcgatgctgctgagggtgctgagaattag

SEQ ID NO: 22832 - DNA, 534 bp, Artificial Sequence
  Description of Artificial Sequence: Synthetic coding sequence
atgcccggcctgaccgcctacttcggcctgctggagatctgcggcgtaaaggggggcgagaccgtcatggtgaacgccgcagcaggggcggtcggctcagtcgtcgggcagatcgccaagctgaaagggtgtaaggttgtcggcgctgtcggtagcgacgagaaggtagcttatttgcagaagctcgggttcgatgtggtctttaactacaagaccgtggaaagcctcgaggagactctgaagaaggcctcccccgacgggtacgattgttacttcgacaacgtcggcggagaatttagcaatacggttattggacagatgaagaagtttggaagaattgcaatttgcggtgcaatctcgacatacaacaggactggaccgctacccccagggcctccacccgagattgtcatatatcaggagttgagaatggaggcatttgtggtgtaccggtggcagggagatgcacggcagaaagcactgaaggatctgctcaagtgggtcctcgagcttccgtacttcgtgatcgactag

SEQ ID NO: 22833 - DNA, 3660 bp, Artificial Sequence
  Description of Artificial Sequence: Synthetic coding sequence
atgttcggcgccggcgacgaggacgacaccgacttcctgagcccctccggaggcgcacgcttagcctccctgttcggcctagaccaggctgccgctggtcacgggaacgagttcttccagtatacagcgcctaagcagcccaagaagggtcaagggacagccgctaccgggaaccaagccacacccaaaaccgctcctgctactatgagtactccaaccattttggttgctacggctgtgcatgcctataggtatacaaacgggcagtatgtgaagcaggggaaatttggtgcagccgtcctaggtaaccacacagccagagagtataggatcctcttatatattagtcagcagcagccggtgacagtggcaagaattcacgttaattttgaactcatggttcgccctaataattatagcaccttctatgacgatcagcgacagaactggtctatcatgttcgagagcgaaaaggctgcagtggagtttaacaaacaggtgtgtatcgccaaatgcaattcaaccagttccctcgacgctgttcttagccaagatctgatcgtggcagacggccccgcagtggaggtgggcgacagcctggaagtggcctatactggctggctcttccagaatcatgtgcttggccaagtgttcgacagtaccgctaacaaggacaagctgctgagacttaaactgggcagcggcaaagtaatcaagggttgggaggacggtatgcttggcatgaagaaagggggcaagcgactgctaatcgttccccctgcctgtgccgttggcagtgaaggagtgataggttggacccaggcaaccgactccatcctggtcttcgaagtagaagtaagacgtgtcaagttcgctcgcgattccggcagtgacggccacagcgtgagttctcgagactctgccgccccttcacccattcctggggcagacaacctgtccgccgaccccgtggttagtcctccaaccagtataccattcaagtcaggagaaccagccctgcggaccaaaagtaatagcctgtcagagcagctggccatcaacacctcccccgacgctgttaaagcgaagctgattagcagaatggcaaagatgggccagcccatgcttccgatccttccaccccaattggatagcaacgatagcgagatcgaggatgtcaatacgctccaaggcggtggccaacccgtcgtgaccccatctgtccagcccagcttgcatcccgcgcatcccgcgctcccccagatgaccagtcaagctccccaaccctcagtgactgggctgcaggcaccctcagcggctctcatgcaggtttccagcctcgattcgcattctgctgtttccggtaacgcccagtcatttcagccatacgctggcatgcaagcttacgcctacccgcaggcctctgcagtgaccagtcagttgcaacctgtcagacccctgtacccggcccccctctcacagcccccgcatttccagggctcgggggatatggcttcatttctgatgaccgaggcccggcaacacaacacagaaatccgtatggcagtgtccaaggtggcggataaaatggaccacctaatgaccaaggtggaagagctgcagaaacactccgccgggaatagtatgttgatccccagcatgtccgttaccatggagacttccatgataatgagcaacattcagcgcatcattcaagagaacgaaaggctcaaacaggaaatactggagaagagtaatagaatcgaggagcaaaacgataagatctcagagctgattgaaaggaaccagcgatatgtggaacagtctaacttaatgatggagaaacggaataatagcctccagacagccaccgaaaacacacaagcccgcgtgctccatgcagagcaagaaaaggccaaggtgacggaggaactcgcggccgccaccgctcaggtgtcccacctccagctgaagatgaccgcccaccagaagaaagaaactgaactgcagatgcagctgaccgagagtctgaaggaaactgatttgctgaggggacagctcaccaaggttcaggctaagttatccgaactgcaggagactagcgagcaagcacagtccaaattcaagagtgaaaagcagaacaggaagcaacttgagcttaaagtgacgtctttggaggaagaactaactgatcttcgtgtggaaaaagaatccctggaaaagaatctgagtgagaggaagaaaaagagcgcacaggaaagaagccaagctgaagaggagatcgatgagatccgtaaaagttaccaggaagagttggataaactgaggcagctcctgaaaaagacaagagtttccaccgatcaggccgccgcggaacagctgagtctggtgcaggctgagctgcagacacagtgggaggcaaagtgcgaacaccttttagcttctgcaaaggatgagcacttacagcagtaccaagaggtctgcgcacagagggacgcctatcagcagaagctggtacagctacaggagaaatgccttgcactccaggctcaaattaccgcccttacaaaacagaatgaacaacacatcaaagagctggaaaagaataagagccagatgtctggcgtggaggctgctgcttctgatccatctgagaaagttaagaaaataatgaaccaggtgttccagtccttgcggcgggagttcgagctcgaggaatcctataatggacgaacgattttgggtaccattatgaacaccataaagatggtgacattacagttgctgaaccagcaggaacaagagaaggaggaaagttccagcgaagaggaagaagagaaagccgaggagcgcccccggagaccatcccaggagcagagcgcttccgctagctctggacagcctcaggctccactgaacagggagcgacctgaatcccccatggtgccctccgaacaggttgtggaggaggctgtgccacttccccctcaggcgctaaccacgtctcaggacggccaccgcagaaagggcgactcggaggctgaagcactatctgagattaaggatggcagtctgccgccagaactctcctgcattccatcccacagagttttggggccaccaacgagcatacctccggagcctctgggccccgtttccatggactccgaatgcgaagagtctcttgccgcttctcccatggccgccaagccggataaccctagcgggaaagtttgtgttagggaggtggcgcccgacgggcccctccaggaatccagcacacgcctgtccctgaccagtgaccccgaggagggcgatcctctggctttggggcctgagtcccctggggagccacaacctccccagctgaagaaggacgacgtcacaagcagtacaggaccacacaaagagctctcatctaccgaagccggtagcacagtagcaggtgctgccctgcgcccctcgcaccacagtcaacggtcctctctgtctggggacgaggaggatgagctgtttaaaggagccaccctcaaggccctgaggcctaaggcacaacccgaggaggaagacgaggacgaggtgtcgatgaaagggagaccaccccccacccctttatttggcgatgacgatgatgatgatgatatcgactggcttgggtag

SEQ ID NO: 22834 - DNA, 6978 bp, Artificial Sequence
  Description of Artificial Sequence: Synthetic coding sequence
atgaagaagggcagccagcagaagatcttcagcaaggccaagatcccctccagtagtcattcccccattcctagttccatgtcaaacatgcggtcacgttctctttcacctttgataggaagtgagactttgcctttccattccggcgggcagtggtgtgaacaggtggaaatcgctgacgaaaataatatgttattggattatcaggatcataagggcgctgatagtcatgcgggggttaggtacattacagaggctctcataaagaaattgacgaaacaggacaacctggccctgattaaatcacttaacttgtcgcttagcaaagatgggggtaaaaagtttaaatatatcgagaatcttgaaaaatgtgttaagctggaggtgttgaatcttagttacaacctgattggtaagatcgaaaaattggataaacttctgaaactacgagagcttaacctttcatataacaaaatctcaaagatagagggaattgagaatatgtgcaaccttcagaaacttaacctcgccggaaacgagattgaacatataccggtgtggctggggaagaagctcaagtcactcagagtccttaatttaaagggcaataaaatttcaagcctgcaagatatcagcaagctgaaacccctgcaggatctcattagcctgatcttggtagaaaatcctgtggttaccctgccacattacctgcagttcaccatctttcacttaaggtcgttggagtctctcgagggacagcccgtgacgacccaggatcgacaggaggccttcgagaggttttctcttgaggaagtggagaggttagagcgagatttggagaagaaaatgatcgaaactgaggaattgaagtctaagcagacaagattcctcgaggaaataaaaaatcaagataaactgaataaaagcctgaaagaagaggccatgctccagaaacagtcctgtgaggaactcaagagcgacctgaacacaaagaacgagttgttgaaacaaaagactatagaacttactagagcttgtcagaaacagtacgagctagaacaagaactggccttctacaagattgacgccaagttcgagccacttaattattatcccagtgagtacgctgagatcgacaaagctcctgacgagagcccgtatataggcaaaagtaggtacaagcggaacatgttcgccactgaatcgtacattattgactcagctcaggcagttcagattaagaagatggagccggatgaacagcttcgaaatgatcacatgaatctgaggggccatacccccctggacacacagttggaggataaggagaagaagatctccgctgcacagaccaggctgagtgagttgcacgacgagattgaaaaggcagaacagcaaattcttcgcgccactgaggaattcaagcagcttgaagaggctatccagcttaaaaaaatttccgaagccggaaaggatctcctttataaacagctgagtgggaggctgcagcttgtcaacaagctcagacaggaggctctagatctggagcttcagatggagaaacagaaacaggaaatcgccggcaaacaaaaagagattaaggacctgcaaatcgccatagactccctcgattccaaagatccgaagcactcacacatgaaggcacagaagagcggtaaagaacagcaattggatattatgaataagcagtaccagcagttggaatctcgccttgatgaaatcctgagtaggattgccaaggaaactgaggaaattaaagacttagaggaacagctgactgaggggcaaattgcagccaacgaggcactgaagaaagatctcgaaggggtgatctccggactgcaggagtacctgggcacgataaagggacaggcaacacaggctcagaacgaatgtagaaagcttcgggacgaaaaagaaacactgctccagagactgactgaagtagaacaagaacgggaccagctggagattgtggcgatggatgcagagaatatgcgcaaggagctggccgaacttgagtctgccctgcaggagcagcacgaagtcaatgccagcctgcagcagactcagggggacctgtcagcttatgaggccgagctggaggcccgccttaatctgagggatgctgaagcgaatcagctgaaggaagaactcgaaaaggtgaccaggcttacgcaactggaacagagcgccctgcaggcagagctcgaaaaggagagacaggccctaaagaatgcgctcggaaaggcccagttcagcgaagaaaaagaacaggaaaacagtgagttgcacgccaagttgaagcaccttcaggatgataacaacctccttaagcagcaactcaaggactttcaaaaccatctgaaccatgttgtggacggcctggtacgacctgaagaggtggctgcccgcgtggacgaactgcgcagaaagctgaaattgggaacgggggaaatgaatattcactcacccagtgacgtcctcggcaaatcgctggctgatctacagaaacagttctcagaaatccttgctagaagtaagtgggagcgagacgaagcacaggttcgagaacgcaagctccaggaagaaatggctctccagcaggagaaactcgccaccgggcaggaagagttccgacaggcatgcgagcgcgccctagaggcgcgcatgaacttcgataaacgccaacatgaggcacgcattcagcaaatggagaatgagatacattatttgcaggagaacctcaagagcatggaggagatccagggattgacagatcttcagctgcaggaggctgatgaggaaaaggaaaggatcctggcccagctgcgggagctagaaaaaaagaagaaactggaagacgcaaaaagccaggagcaagtctttggtctggataaagagctgaaaaagctgaaaaaggcagtggccacctccgacaaattggcaactgctgagctaacgattgccaaagatcagctcaaatccctccatggcactgttatgaaaatcaaccaagagagggccgaggagttgcaggaggcagagcgcttctctagaaaagcagctcaggccgccagagatctaacgagggccgaggcggaaattgagctgctgcagaatcttctgcgccagaagggtgagcagttccgtcttgagatggagaaaactggcgtgggaactggagcgaattcccaggtgcttgagatcgagaaactgaatgaaactatggaacgccaacgaaccgaaattgcccggttacaaaacgtgctggacttgacaggcagtgataacaagggtggatttgaaaacgtgttggaggaaatagccgagctgaggcgcgaagtttcttaccagaatgattatatttcatctatggctgatccattcaagaggaggggttattggtacttcatgcctccccctcccagttccaaagtctctagccacagttcccaggccacgaaagactccggggtaggcctcaaatatagtgctagcacccccgtccggaaaccacgtcctggccaacaggatggcaaggaagggagtcagccaccgcccgcttcgggatactgggtctacagcccaattaggtcaggcttgcataagctcttcccttctagggatgcggactccggtggcgatagccaggaagaatctgaactggacgatcaggaagagccgccatttgtgcctcccccggggtacatgatgtataccgtcctacctgacggttcacccgttccacaaggtatggcactgtatgccccacctccaccactgcccaacaattcccggcctctgactccagggacagtcgtgtatgggccaccccccgccggcgcgccaatggtgtatggacctcccccccctaatttcagtatcccatttatccccatgggggtgcttcactgcaatgtgcccgagcaccataacctggaaaatgaggtgtcccggctggaagacatcatgcaacatctgaagtcaaagaaaagggaggagcggtggatgagagcctcaaaaaggcagtcagaaaaggaaatggaggagctacatcacaatatcgacgatcttctacaggagaagaaatccctggagtgtgaggtagaggagctgcaccggaccgtgcagaagcggcagcagcagaaggattttattgacggaaacgtggagtccttaatgacagaactggaaattgaaaagtcactgaagcaccatgaggatatcgtggatgagattgaatgtatcgagaaaaccctgttgaaaaggcgctcagagctcagagaggcggatcgcttgttggccgaagcagagagtgagctctcatgcacaaaggaaaagaccaaaaatgcagtcgaaaagtttactgacgccaaacggtccctgctgcagacggagtccgacgcagaggaattggaacggcgggctcaagagactgcagtgaacctggtgaaagcggatcagcagctaaggagcctacaggctgacgcgaaagatctagaacaacataaaattaagcaggaggagattcttaaggaaattaataaaattgttgccgctaaggattcagactttcagtgtctatcgaagaagaaagaaaagcttacagaggaactgcagaagcttcagaaggatattgaaatggccgaaagaaacgaggaccaccacttgcaggtgctgaaggagagcgaagtgttacttcaggcgaaacgggccgagttggagaaactgaagtcccaggtgacatcccagcagcaggagatggctgtcctggatagacagctggggcacaaaaaagaggagcttcacctgttgcaaggaagtatggtgcaggctaaggctgatttgcaggaggcactgcgcctgggggagaccgaagtgaccgagaaatgcaatcacataagggaggtaaagagcctgctagaagagctctcctttcagaaaggcgagctgaatgtccagatcagcgaaagaaagactcaactcacccttatcaaacaagaaatcgaaaaagaggaggagaaccttcaggtagtcctgcgtcagatgagtaaacataagactgaattaaagaacattttggacatgctgcagctggaaaaccacgaactgcagggcctgaaattgcagcacgaccaacgtgttagtgaactggagaagacccaggtagctgtgctggaagaaaagctggagctggagaatctgcaacaaatcagccagcaacagaagggcgagattgaatggcagaaacaactactggagcgcgataaacgcgaaatcgagcggatgaccgcagaaagcagagcactgcaatcctgcgttgagtgcttgagcaaagaaaaggaggatcttcaggagaagtgcgatatctgggaaaaaaaactggcgcagacaaagagggtgctggccgccgccgaggagaactctaaaatggagcagagcaatctcgaaaagctggaactaaacgtaagaaagcttcaacaggaactggatcagctgaatcgggataaactgtctctccataacgatatctccgccatgcagcagcaactacaggagaaacgggaagcagtaaacagcttgcaggaggagctggcgaacgtgcaggaccacctgaacttggccaaacaggacctgcttcacactactaagcatcaagatgtcttgttgtcggagcagacacgactccagaaggacatcagtgaatgggcgaaccggttcgaggactgtcaaaaggaagaggagaccaagcaacaacagctccaggtcctgcaaaatgagatcgaggaaaacaagcttaaactggtgcaacaggaaatgatgtttcagagactgcaaaaagaacgtgagtccgaagagtccaagctcgaaaccagcaaggttaccttgaaggagcagcagcaccagttggagaaggagcttacagaccagaagagtaagctcgatcaagtattgagcaaggtactggctgcggaggagcgggtgcgtacactccaggaagaggagcggtggtgcgagtcattggaaaaaactttatcccagactaagagacagctgtctgagagagagcaacagctcgtggagaagtcaggcgagcttctggcacttcagaaagaggcagactctatgagagccgacttctccctgctcagaaaccaatttcttacagagcgcaagaaggctgagaagcaggtggcgagcttgaaagaagcactcaaaatccaacgctctcagcttgaaaaaaacctgttggagcaaaagcaggaaaattcctgcattcaaaaagaaatggccacaattgaactcgtggcccaagacaatcacgagcgggcccgccgcctgatgaaggagcttaatcagatgcaatatgagtacactgagctgaagaagcagatggcgaatcagaaagacttggaaagaagacagatggagatttctgacgccatgagaaccctgaaaagtgaggttaaggatgaaatcaggacatccctcaaaaaccttaaccagttcctgcccgagctgcctgccgatctcgaggcaatcttggaacgaaacgaaaacctggagggagaactggaatctctgaaggagaacttaccattcacgatgaatgaaggacctttcgaagagaagttgaatttcagtcaggtgcatattatggatgaacactggcgtggagaagccctgagggagaagttaagacacagagaagatcgcctgaaagcccagcttaggcactgtatgtccaaacaagccgaggtcctgatcaaaggcaagcggcagacagaaggtaccttacacagcctgagaaggcaagtggacgctttaggagagctagttacctccacaagcgcggacagcgccagttcgccgagtttgagtcagttagaaagctcattgacagaagactcacaactcggacagaaccaggagaagaacgcatcagctcggtag

SEQ ID NO: 22835 - DNA, 2811 bp, Artificial Sequence
  Description of Artificial Sequence: Synthetic coding sequence
atggagcccgacatcatccggatgtacagcagcagccccccccccctcgataacggagccgaagatgacgatgatgatgaattcggcgagtttggtgggttctccgaggtcagcccttcgggtgtgggctttgtagacttcgacaccccagattatactagacctaaggaagaattcgtacctagcaatcatttcatgcctatccacgaattctcagagaatgttgactccctgacctcatttaaatccatcaagaatggcaatgacaaggatattacagcagagctgagcgcccccgtgaaggggcagtctgatgtgctactcagtacaacctcaaaagaaattatttcatctgagatgctagcaacttctattgacgggatggagaggccaggcaacttgaataaggtggtagaacagcgccagaatgtgggaacgctggagagcttcagccctggcgacttccgcaccaatatgaatgtggtccaccagaacaagcagcttgagagctgtaatggcgaaaagcccccttgcctggagatcctcaccaacggtttcgctgtcctagagacggtaaatcctcagggcacagacgacttagacaatgtcgctgacagcaaaggcagaaaaccactgtcaacccacagcaccgagtacaacttggattccgtaccaagccccgctgaggagttcgccgatttcgctacatttagtaaaaaggagcgcattcaactggaagaaattgagtgtgctgtgctcaacgatcgagaggctttgaccattcgggaaaacaacaaaatcaaccgggttaatgagcttaatagtgtgaaagaggtggcactggggaggagcctcgacaataaaggggatactgatggtgaggaccaggtctgcgtttcagaaatttccattgtaacgaatcgcggcttttccgtggaaaaacagggactgcctacccttcagcaggacgagttcctgcagtccggggtccagtccaaagcttggagccttgttgattccgctgataacagtgaggcgattcggcgtgaacaatgcaaaaccgaggagaaactagaccttctaacttccaagtgcgctcatctgtgtatggacagtgtgaaaacctctgacgacgaggtaggtagtcccaaggaagagtctcgcaaattcacaaactttcaaagtccaaacatagacccgacggaggagaatgacctggatgacagtctcagtgtgaagaacggggattcttcaaacgacttcgtgacatgcaatgacataaacgaagacgatttcggagactttggggactttggatctgcctccggctccactccccccttcgtgaccgggacacaagattctatgtccgatgccacctttgaggagtcaagcgaacacttcccgcactttagcgaacccggcgacgactttggcgagttcggcgacatcaacgccgtttcctgccaggaggaaacgattctgaccaagtcagatttgaagcagacctcagataatctcagtgaggaatgtcagcttgcccgaaaaagctccggaacgggcacggagccagtcgctaagctcaaaaacggacaggaaggggagatcgggcactttgactcagtcccgaacatccaggacgactgtaatgggttccaggattcagacgactttgctgatttcagctctgccggtccgagccaggtggtagactggaacgcttttgaggatgagcagaaggattcttgttcttgggccgccttcggagatcaacaggcaacggaaagccatcaccggaaagaggcatggcaaagccacaggacagatgagaacattgacaccccaggtacacctaagacgcattctgtgccatctgcaactagcaaaggtgccgtggcatcaggccatctccaggaaagcgccacctctgttcaaaccgctctgttgaacaggctggaacggattttcgaagcatgcttcccttcaatccttgtgcccgatgccgaggaggaggtcacctcactgaagcacctacttgaaacctctacccttcctatcaagacgagagaggcgctgcctgagagcggcgaacttttagacgtgtggaccgaactgcaagatatccacgacgcccatggactacgttatcagtggggcggctcccattctaataaaaagctcttgtcaagcctgggcatagatacccggaatatcctgttcaccggtaataaaaaacaacccgtgatcgtgcctatgtatgcagcaggtttagggatgttggagcctactaaggaaccgctgaaaccactctccgccgctgagaagatcgcctcaataggtcaaacggctacaatgtctcccgacatgaatacctgtactagcgaccagtttcaagagtccttgcccccagttcaattcgactggtcttctagcggcctgaccaatccactagacgcctccggtgggagtacactcctgaacctggatttcttcggaccagtggacgattcatcatcaagctcttccactacgatcccaggcgtggaccccgagctgtatgagctgaccacaagtaaattggagattagtacgagctcactcaaagtaaccgatgctttcgccagactgatgagtaccgtcgaaaaaacgtcgacctccaccaggaagcccaagagagaggaacatctgtctgaagaggcaatcaaagtgattgctggcctgccagatctgacatttatgcacgcaaaggttctaatgtttccagctactttgaccccttccacgtcctcacaggaaaaagctgacggatag

SEQ ID NO: 22836 - DNA, 2730 bp, Artificial Sequence
  Description of Artificial Sequence: Synthetic coding sequence
atggagcccgacatcatccggatgtacagcagcagcccccccccccttgacaatggagccgaggatgatgacgacgacgagtttggtgagtttggaggtttttccgaggtatctcctagtggcgttggcttcgttgacttcgatacacctgattataccagacctaaagaggaattcgtgccctccaaccattttatgccaatccatgagtttagtgagaatgtggattctctgacgtcctttaagtccattaagaacgggaatgataaggacattacagccgagttgtcagcaccagtcaagggacagagcgatgttctcctgagcactaccagcaaggagattatcagtagtgagatgttggccaccagcatcgacggaatggagcgacctggaaatctgaataaggtagtggaacaaagacagaacgtcggcacgcttgagtccttcagcccaggcgattttcgtactaatatgaatgttgttcaccagaataagcaacttgagtcatgcaatggggagaagcccccatgcctagagatccttactaacggctttgccgtcctggagaccgtgaacccacaggggactgatgatctggataacgtggctgactccaaaggacgcaaaccactctcaacgcatagtaccgaatacaacctggacagtgtccctagccctgccgaagaattcgctgattttgcaactttttccaaaaaagagagaatacagctcgaggagatagagtgcgccgtcctgaatgaccgggaagcgttaaccatcagagaaaacaataaaatcaatagagtgaacgaacttaactctgtcaaggaggtcgccttaggacgcagccttgacaataagggggataccgacggagaagaccaggtctgtgttagtgagattagtatcgtgactaaccggggcttcagcgttgagaagcaggggctgcctaccctgcagcaggatgaatttttgcagtcaggcgtgcaatccaaggcatggagcctggtggattccgcggacaactctgaagccattcggagagagcagtgtaaaaccgaggagaaacttgaccttcttacaagcaaatgcgcacatctttgcatggacagtgtgaaaacgagtgatgatgaggtgggatccccaaaagaggagtctcgtaagtttactaatttccaaagtcctaacattgacccaaccgaggagaacgacctggatgactccctgtccgtcaagaatggagacagctcaaatgactttgtgacttgcaacgacatcaacgaggatgattttggcgacttcggggatttcggctctgctagtggctcaactccacctttcgtcacgggaacacaggactcaatgtccgacgctacctttgaggagtcaagcgagcattttccccatttttcagagccaggggacgatttcggtgaatttggagacattaacgcagtgagctgccaggaggaaactatcctcacaaaatctgatttgaaacagacctctgataacctctcagaggaatgccagctcgcccgtaagtcatctggaactggcactgagcctgttgcgaaactgaagaatggtcaggagggcgaaatcggccattttgactcggtacctaatatccaagacgattgcaacggcttccaggactctgatgattttgccgatttcagttctgcaggtcccagccaagtcgttgattggaacgcttttgaggacgagcaaaaagatagctgttcctgggccgcttttggcgatcagcaggctaccgaatctcaccacaggaaagaggcctggcaatctcatagaactgacgagaatatagatacaccagggactccaaaaacacactcggtgccctccgccacctcaaaaggggctgtggcatctggccatctccaagaatcagccacaagcgtacaaaccgccctactcaacaggctggagcggatttttgaggcttgttttccctcaatactggtgccagacgctgaggaggaggtcacatctctcaagcaccttttagagacaagcacactgcctatcaaaacaagagaagcccttcccgagagcggcgaactgctggacgtgtggacagaattacaggacatacacgatgcgcacggcctaagataccaatggggagggtcacactccaataaaaagctgctgtcatccctggggattgacacgcgaaacatactgtttactggaaataagaaacaacccgtcatcgtcccaatgtatgctgcgggcctgggaatgctggagccaaccaaagagcctctgaaacccctgagcgctgctgagaagatcgcttcaatcggacagactgcaactatgagtccggacatgaatacttgtacctcagaccagtttcaggagagcctgcctcccgttcaatttgactggagcagcagcgggctcacaaatccgttggacggtgtcgatcccgaactatatgagcttacaacctctaagctcgagatctctacctccagtctgaaagtgactgatgcattcgccagactcatgtcaacagtggagaaaacctcgaccagcactagtcgcaaacctaaacgtgaagagcatttgtcggaggaagccataaaagtgattgcagggttgccagacttgactttcatgcacgccaaggtgttaatgtttcccgctacactcacgccaagcacatcttcccaagagaaagccgacggatag

SEQ ID NO: 22837 - DNA, 306 bp, Artificial Sequence
  Description of Artificial Sequence: Synthetic coding sequence
atggtgtgcgagaagtgcgagaagaagctgggcaccgtgatcaccccagacacgtggaaagacggggcccgcaacacaacagagagtggaggaagaaagctgaacgagaacaaggcactcacttctaagaaagccaggttcgacccctacggaaaaaacaagttctccacatgtcgcatctgcaaatcctcagtccaccagcctggctctcactattgtcagggatgtgcttacaaaaagggtatatgcgctatgtgtgggaaaaaggttcttgatacaaaaaactacaaacaaacctccgtgtag

SEQ ID NO: 22838 - DNA, 1467 bp, Artificial Sequence
  Description of Artificial Sequence: Synthetic coding sequence
atgaacttcacccccacccacacccccgtgtgccggaagcggaccgtcgtatccaaaagaggggtggctgtgtccggcccaaccaagaggcgggggatggcagactcgctcgagtccacccccttgccatcccccgaggaccggctggcaaaactgcacccatccaaggagctgctcgagtattaccagaagaagatggcagagtgtgaagccgagaatgaagacctactgaagaagctggagctttacaaggaagcttgcgaaggccagcacaaactcgagtgcgacctccagcagcgcgaggaagagatcgccgaactgcagaaagcactgagcgacatgcaagtctgtctttttcaagagagagagcacgttctgagactttactctgagaatgataggctgagaataagggaattagaggataagaagaaaattcagaaccttcttgccctggtcgggactgacgcgggggaagttacttacttctgcaaagagccgccccacaaggttacaatcttacagaagacgatccaggcagtaggcgagtgtgagcaaagcgaaagttctgcttttaaggctgaccccaagatctctaaacggagaccaagccgggagagaaaggagagttccgaacactaccagagagacattcagaccctcatactccaggtggaagctctgcaagctcagctcggagaacagaccaagctcagtagggagcagatagagggtttgatcgaggatcgacggattcacctggaagaaatccaggtacagcaccaaagaaatcagaacaagatcaaagagttgacaaaaaatctgcatcatacacaggagctgctgtatgagtctactaaagattttctccagttgcgatccgaaaaccagaataaggagaagtcgtggatgctagagaaagacaacctcatgagtaagatcaagcagtatcgggttcagtgcaaaaaaaaagaagacaaaattggaaaggtgctccctgtgatgcacgaatcacaccatgcccaaagcgagtacattaaatctctgaaagataagctcgtacaagagaaaaagctgagcaacatgtatcaggagcagtgcatatccctggaggaggagctcgcccgcattcgggaggaagagggaatgcgcagagagattttcaaagacagaacgaacaagatgggcaagcgcctccagataatgacgaagcgttacgaggccctggagcgaaggcgcatcctggaagttgaaggttttaaaactgacattaaagtgctccggcagaagcttaaggacctggagcagatgttgtataaagccaccgtgaatgcaagagctaaccaggatctcgcactcctctgcgaggtccgggactccaatcgcagagctcacaagattcagggggaactcaagaatctgaagagtaaggtgtttggcctcgaaaatgagttgcgcctgtgttag

SEQ ID NO: 22839 - DNA, 258 bp, Artificial Sequence
  Description of Artificial Sequence: Synthetic coding sequence
atgagcaaggtgagcttcaagatcaccctgaccagcgacccccggctcccatataaagttctgagtgtgccagagtctaccccctttactgctgtgcttaaatttgccgccgaggagtttaaagtgcccgcagccacaagtgccattatcaccaatgacggtattggaatcaaccccgctcagactgccggcaatgtttttcttaagcatgggtctgaactccggatcattccgagagaccgtgtggggtcttgctag

SEQ ID NO: 22840 - DNA, 585 bp, Artificial Sequence
  Description of Artificial Sequence: Synthetic coding sequence
atggacgaggacggcctgcccctgatgggcagcggcatcgacctgactaaggtccctgcaatccagcagaagaggactgttgcattcctgaaccagttcgttgttcacaccgttcagttcctcaatcgatttagtacagtctgtgaggagaaactggcagatctgtcactgcgcatccagcaaatcgagacaaccttgaacattcttgatgcgaagctcagctccattcccggactggatgatgtgactgtggaagtttctccactcaacgttacatccgtgaccaacggcgcccaccccgaagcaacttccgaacaaccccagcaaaatagcacccaggactctggcctccaggagagcgaggtgagcgcagagaatatacttaccgtggcgaaggatccccgatacgcgaggtacttgaaaatggtgcaggtgggcgtacccgtaatggccatacgcaataagatgattagtgagggactggatcccgacctcctcgagaggcctgacgcacctgtacctgacggtgagagcgaaaagacagtcgaagagtcatctgacagcgagagcagcttcagcgactag

SEQ ID NO: 22841 - DNA, 2226 bp, Artificial Sequence
  Description of Artificial Sequence: Synthetic coding sequence
atgggcccccccggccccgccctgcccgccaccatgaacaacagcagcagtgaaacgcgcggccacccacacagcgcctcctctcctagcgagcgagtgttccctatgcctttgccccggaaggcccctctcaacatccccggaacacccgtcctggaagatttccctcagaatgatgatgaaaaggaaagactgcagcgccgtcgtagccgggtattcgatttgcaattctccactgactccccacgcctgctggcctcgccttcttctcgctctattgatataagcgctactatacccaaattcaccaatacccagatcaccgaacattactctacttgcatcaagctgagcaccgaaaataagattacaacaaagaacgcattcggactgcatctcattgatttcatgagtgagattttgaagcaaaaggacactgagcccactaactttaaagttgccgccggcaccctggacgcctcgaccaaaatttatgctgtgcgcgtcgacgcagtgcacgcagatgtgtatcgtgtcctcggaggcctgggcaaagatgccccatcactcgaggaggtcgagggccatgtcgcagacggctcagctacggaaatgggaaccaccaaaaaggccgttaagccaaagaagaagcatctgcatagaacaattgagcaaaatatcaataacctgaacgtgtcagaggctgacaggaaatgtgagatcgatcccatgtttcagaaaacagctgctagctttgatgaatgttcaacagctggtgtatttctgagcaccctccactgtcaagattatcggtctgaactgctgtttccttcggacgttcagacgctctccacaggcgaaccacttgaactgccagagctgggctgtgtcgaaatgactgacttgaaagctccactccagcagtgcgcggaggatcggcagatatgccctagtctcgcgggtttccagttcacccagtgggattccgagacacataacgagtcggtcagcgcccttgtcgacaaatttaaaaagaatgatcaggtcttcgatattaacgccgaagtcgacgaaagcgattgcggggactttcccgacgggagcctgggcgatgacttcgatgctaatgatgagcctgatcatacagccgtgggcgaccacgaagagtttcggagttggaaggaaccctgtcaggtgcagtcatgccaggaagagatgatatctctgggagatggtgatatcagaaccatgtgcccactgctgtctatgaagcccggagaatatagctacttcagcccccgcaccatgagtatgtgggcagggcctgaccattggcggtttcgacctcgacggaagcaggatgcaccctcccagtctgaaaataagaagaagtctaccaagaaagactttgaaatcgacttcgaggacgatatcgatttcgatgtgtacttccggaagaccaaagctgccaccattctgacaaagtcaactctcgaaaatcagaactggcgagcaacgaccttaccaaccgatttcaattacaacgttgatacactcgtccagctgcacctgaagcctgggacacggctattgaagatggctcagggccatagggtcgagactgaacattatgaagagatcgaagattatgattataacaatcccaacgacaccagtaatttttgcccaggcttgcaggccgctgatagtgacgatgaggacttagatgatctgttcgtcggtccggtgggcaattcagacctgtccccatatccatgtcatccacctaagacagcccaacagaacggcgatactccggaggcacaggggctggacataacaacatatggtgagtctaatttggtggcagagccacagaaggtaaacaaaatcgagatccactatgctaagaccgccaaaaagatggacatgaagaagctcaagcagagcatgtggtctcttctgactgccttgtccgggaaggaggcagatgcagaggcaaaccaccgagaggccggcaaggaagccgctctggctgaagtggcagatgagaaaatgctgagcggactgaccaaggacttacagagaagccttccacccgtcatggcacagaacctgagcatcccgttagcctttgcatgcctgctccacctggccaacgaaaagaatctgaaattagagggcactgaggacctgtcggatgtcctggtccgtcagggggactag

SEQ ID NO: 22842 - DNA, 510 bp, Artificial Sequence
  Description of Artificial Sequence: Synthetic coding sequence
atgaagggcagccggatcgagctgggcgacgtgaccccccacaacataaaacagttaaaacggctcaaccaggtgatttttccagtgtcatacaacgacaaattctataaagatgtgcttgaggtcggcgagttggctaagttagcttacttcaatgacatcgcagtgggtgccgtttgctgcagggttgatcatagccagaaccagaaacgactgtacatcatgacactaggttgcctcgctccctacagacggcttggaatcgggaccaagatgcttaaccatgtgttaaacatctgtgagaaagacggcacgtttgacaatatttacctccatgtgcagattagcaacgagtccgcaattgacttttaccggaaatttgggttcgaaattattgaaactaaaaagaactactataagcggatagagcccgccgatgctcatgtcctgcagaaaaatttgaaggtcccctctgggcaaaacgccgatgtgcagaaaaccgacaactag

SEQ ID NO: 22843 - DNA, 1245 bp, Artificial Sequence
  Description of Artificial Sequence: Synthetic coding sequence
atggccgccgccccccccagctactgcttcgtggccttccccccccgggctaaggatgggctggtcgtgtttggaaaaaacagtgcacgcccccgcgatgaggtgcaggaggtggtctacttcagcgccgccgaccacgagccagaaagcaaggtagagtgcacctatatttcgatagatcaggtgcccaggacttatgccattatgatttctaggcccgcctggctatggggagcggaaatgggcgcaaatgaacacggtgtgtgcatcgcaaatgaggctattaatacccgcgagcctgccgccgagattgaagcactcctgggaatggacttagtcagattaggtctcgaacgcggagaaactgctaaggaggcactagacgtgatcgtgagcctgctagaggagcatggacagggaggcaactattttgaggatgccaactcctgccatagcttccaatctgcctatctcatcgtggaccgcgacgaggcttgggtactcgagactataggcaaatactgggctgcagaaaaagtgaccgaaggtgtacgatgtatttgtagtcagttgagtctcactaccaagatggatgcagaacatccagaactccggtcctacgcacagtctcagggatggtggacaggagagggcgagtttaacttctcagaggtgttttcccccgtggaagaccatctggattgtggcgcaggcaaggatagcctcgagaagcaggaagagagcatcacagtccagaccatgatgaatacattgcgggataaagctagcggcgtgtgcattgatagcgagttctttctcaccactgcttccggggttagtgtgctgccgcagaataggtcatctccctgtatacactactttaccggaacgcccgacccatcccgctctattttcaaacctttcatttttgttgatgacgtgaagctggtgccaaaaacccagtcgccttgctttggggacgacgatcccgccaaaaaagagcctcgcttccaagagaagcccgatagaagacacgaactgtacaaagctcatgagtgggctagagccatcattgaatctgatcaggagcagggcaggaagttgaggtccaccatgttggaactagagaagcaaggacttgaggcaatggaagagatattgactagtagtgaaccgctggaccccgccgaagtgggagaccttttttacgattgtgtcgacactgagatcaagttcttcaagtag

SEQ ID NO: 22844 - DNA, 2031 bp, Artificial Sequence
  Description of Artificial Sequence: Synthetic coding sequence
atgagcgaccagatcaagttcatcatggacagcctgaacaaggagccgttccggaagaactataatctgattacatttgacagcttggagccaatgcagcttctgcaggtgctctccgacgtccttgccgaaatagacccaaagcagctggtggatatcagggaggagatgcccgaacaaactgccaaaaggatgctgtcactgctcgggattctaaagtataaaccttccggtaacgccacagatatgtccacttttcggcagggcctcgtaatcggtagtaaaccagttatatacccagtcctccattggttgcttcagcgcacaaacgagctaaagaagcgcgcatacctggcccggtttctcatcaaactggaagtgccctctgagttcttgcaggatgagacagtcgccgacaccaacaagcagtacgaggagctgatggaggcattcaaaacgctccataaggaatatgaacagctcaaaataagtggcttttccaccgctgagatccgcaaagacatctccgctatggaagaagagaaagatcaactaattaagcgtgtggagcatctgaaaaaacgggtggagacagcccagaaccatcagtggatgctgaagatagctcggcaactgcgagtggaaaaagagagggaagagtacctcgcacaacaaaagcaggagcagaagaaccaactcttccacgcagttcagcgcctgcagagggtacaaaaccaactcaagtctatgagacaagccgctgcagatgcgaagccggagagccttatgaagagattggaggaggaaattaagttcaatctgtacatggtgactgagaagttccctaaagagctggagaataagaaaaaggaattgcacttcctacagaaggtggttagcgagccagccatgggacacagcgatcttctggaactggagtcaaagataaatgaaattaacacagagattaatcagctcatcgagaagaaaatgatgagaaacgaacccatagaaggtaaactgtccctgtaccgtcaacaggcttcaataatctcgcgcaaaaaagaagctaaggccgaggagctgcaggaagcaaaggagaagctggcatctcttgagcgggaagcctccgtgaagcgcaaccagacacgcgaatttgacgggaccgaggtgctgaaaggagacgagttcaaaagatacgtgaataaattgcgttccaagtccacagtattcaaaaagaagcaccagataatcgccgagttgaaggcagagtttggacttctgcagcggacggaggaactgctgaaacaacgccatgaaaatatccagcagcagctgcaaactatggaagaaaagaaagggatttcagggtacagttacacacaagaggagctagaaagagtaagtgccttaaagtcagaagtggacgagatgaaaggcagaacccttgacgacatgtctgaaatggtcaaaaagctgtacagcttggtgagcgaaaagaagtccgcactagcatctgtgataaaagagctcagacagctcagacaaaagtatcaggaacttacccaagagtgcgatgagaaaaaatcgcagtacgacagttgcgcggcagggcttgaaagcaacaggtctaagctggagcaggaggttagacgcttacgcgaggagtgcctacaagaagaatcccgctatcattacaccaactgcatgattaaaaacctcgaggtccagctgaggcgcgcaaccgatgagatgaaagcgtatatcagttctgatcagcaagaaaagcggaaggccatccgagagcagtacacgaagaacaccgctgagcaagagaatctgggcaagaagctcagagaaaaacagaaagtcatccgtgaatcacatggacctaatatgaagcaggccaagatgtggcgtgacctcgaacaacttatggaatgtaagaaacagtgcttcttgaagcagcagagccagacctcgattggacaggtcattcaggaggggggggaagatcgcttgattctgtag

SEQ ID NO: 22845 - DNA, 948 bp, Artificial Sequence
  Description of Artificial Sequence: Synthetic coding sequence
atggccttccccgagcccaagccccggccccccgagctgccccagaagagacttaagaccctggattgcggccagggcgccgttagagcagtacgcttcaacgtggacgggaattattgcctcacatgcggaagcgacaaaacactgaagttgtggaaccccctccgaggaaccttgctgcggacctatagcgggcatggttacgaagtactcgacgccgccggaagcttcgacaacagctccctgtgttcagggggaggcgacaaggccgtggtgttgtgggacgttgctagcgggcaggtagtccgaaaattcaggggtcacgcgggtaaggttaatacagttcagttcaacgaagaggctaccgtcatcctcagtgggtcgatcgactcttctatcagatgctgggactgcaggagtcggagacccgagcctgtacaaactctggacgaggcccgagatggtgtatcgtccgtgaaagttagtgatcacgagatccttgcaggtagcgttgatggccgtgtccggaggtacgatctgcgaatgggacagctcttttcggactacgtggggtctcccatcacctgcacatgtttttcgcgcgatggacagtgtacccttgtgagcagcttggactctaccctccggttgctggataaggatacgggagagttgctgggggaatacaagggccacaagaaccaggagtacaagctggactgctgtctttctgagagagatacccacgtcgtctcttgttccgaggacgggaaagtgtttttctgggatctcgttgaaggggcactggcactcgctctcccagtaggctccggtgtcgtacagagcctggcatatcatcccaccgagccttgtttgctgaccgctatgggcggctccgttcagtgttggagagaggaggcatacgaggcagaagatggcgccgggtag

SEQ ID NO: 22846 - DNA, 1803 bp, Artificial Sequence
  Description of Artificial Sequence: Synthetic coding sequence
atggtgctgatcctgggccggcggctgaaccgggaggacctgggcgtaagagactctccagcgaccaagcggaaagtctttgaaatggacccaaagagcctcacagggcatgaatttttcgacttctcatccgggtcttctcacgctgagaatatactccagatcttcaacgagttccgggattccagattattcacagacgtgattatctgcgttgagggcaaggaattcccctgccacagggctgtcctgtccgcatgcagctcctattttcgagccatgttttgtaacgaccatagggagtccagagaaatgttagtggaaattaacggcatcctggccgaggcgatggagtgctttctccagtacgtttatacgggtaaggtcaaaatcacaacagagaacgtgcagtatttgtttgagacatcttccctgttccagataagcgtgctgagagacgcttgcgccaaatttttggaggagcagcttgacccttgtaactgtttaggaattcagaggttcgccgatacgcatagcttgaagacactgttcacaaagtgtaagaattttgctctgcagacctttgaagatgtttcgcaacatgaggagttcttagagttggacaaagacgaattaattgactacatctgcagtgacgagcttgtgatcggaaaggaggagatggtattcgaagccgtgatgcgctgggtgtatagagcagtggacctgcggagaccactcctccatgaactcctgactcatgtaaggcttccactgcttcatccaaattacttcgtccagactgtcgaagtcgatcaattaattcagaattcaccagaatgctaccagctcctccacgaggcccgccgctaccatatccttggaaacgaaatgatgtcaccaaggaccagacccagaaggtccaccggatactcggaggttattgtcgtcgtgggcggatgcgagagagttggtgggttcaacctgccgtacacagaatgctacgaccccgtcactggcgagtggaaaagcctcgctaagctgccggaattcaccaagagcgaatatgctgtctgtgctctgcggaatgacatcttggtaagtgggggtaggatcaacagtagagacgtttggatctacaacagccagctgaatatctggatccgtgttgccagcttgaacaaggggcggtggagacacaaaatggcggtgctgctcggcaaggtctatgtcgtgggaggttacgatggacagaaccggttaagctccgttgaatgctacgactctttttcaaaccgctggactgaagtcgccccattaaaggaagcagtgtcttcacctgccgtgacatcctgtgtaggtaagttgttcgtgattggaggcgggcctgatgacaatacatgttccgacaaggtccagtcatacgatcccgaaactaactcctggttgctgagggcagccatcccaatagccaaaagatgcattacagcagtctctttaaacaatctgatctacgtagccggcgggctgaccaaggcaatctactgttatgatccagtggaagattactggatgcacgtgcagaacaccttctctagacaagagaactgtgggatgagcgtctgtaacggtaaaatttacatactgggaggtagaagagaaaacggcgaggctacagatacaatcctctgctatgatccagccacaagtatcatcactggcgtggcagctatgccaaggcctgtgtcatatcacggctgcgtcacgatccaccgctacaatgagaagtgttttaagctgtag

SEQ ID NO: 22847 - DNA, 810 bp, Artificial Sequence
  Description of Artificial Sequence: Synthetic coding sequence
atgaaccaggaggacctggaccccgacagcaccaccgacgtgggcgacgttaccaacaccgaggaggaattgatccgagaatgtgaagagatgtggaaggacatggaggagtgtcaaaacaagctatcactaattggtaccgagacgctaaccgactctaacgcccagctgagcttactgatcatgcaggtcaagtgcctgacagcggaactttcccagtggcagaaaaaaacacccgagactatcccgttgaccgaggacgtcctcattacattaggaaaagaggaattccagaaattacgtcaggaccttgagatggtccttagcactaaggaaagcaaaaatgaaaaactgaaggaagacctagagcgagagcaacggtggttggatgagcaacaacagatcatggaatctctcaacgtgctgcacagcgagttgaaaaacaaggtagaaacgttctccgaatctcggatcttcaacgaactaaagacaaaaatgttgaatatcaaagaatacaaggaaaagctgctgtcaaccctgggcgagtttctcgaagatcatttccccttgccagacaggagtgtgaagaagaagaagaaaaatatccaggaatcctccgttaacctcatcaccctgcacgagatgctggagatactgattaatcgtttgttcgatgtgccccatgatccgtacgtgaaaatatccgactccttctggcctccttatgtcgaacttctgttgaggaatggcatcgccctaagacacccagaggatcccacacggatacggctggaagcctttcatcagtag

SEQ ID NO: 22848 - DNA, 1041 bp, Artificial Sequence
  Description of Artificial Sequence: Synthetic coding sequence
atgtgcgagggccccagccggatcagcggccccatcccccccgaccccaccctgtgccctgataattatcgacgccccacaagtgcacaggggaggcttgaggggaatgcgctgaagctggatctccttaccagtgaccgggctcttgatacgacagcccccaggggaccatgtataggacctggtgccggcgagatcctagagagaggacagcggggcgttggggatgtgctcctccagctcgaaggcatatctctgggtcccggagcctccctgaaaaggaaagatcctaaggaccacgaaaaagaaaatctcagacgcattagagagattcagaaaaggttccgtgaacaagagcgttctagagagcaaggacagccacgaccactcaaagcactttggagatcaccaaagtacgacaaggtggagtcaagggttaaggcacaactgcaagaacctggcccagccagcggtactgagtcagcacattttctgcgtgcccactcaaggtgcggcccaggacttcccccaccccacgtcagcagtcctcagcccacccccccgggcccagaggcgaaagaaccagggttgggtgttgattttataagacacaacgcaagggccgctaagcgcgctcctagacgccacagttgttctttgcaggttctagcacaagtcttggagcagcagaggcaggcccaggagcactacaatgctacccagaaagggcacgtaccgcattacctgctggagcggcgggacctttggaggagggaggctgaggcgcgtaaacagtctcaaccggaccccgctatgcccccaggtcatacacgaatgccagagaaccagagattggaaaccctgaccaaattgttgcagtcccagagccagttattgcgggaattggttctgctcccagcgggagcagattccttgcgcgcccaatctcaccgagccgaactggataggaaattagtgcaggtggaagaagcaattaagatattttctagacctaaagtctttgttaaaatggatgactag

SEQ ID NO: 22849 - DNA, 1824 bp, Artificial Sequence
  Description of Artificial Sequence: Synthetic coding sequence
atggccgccaacgtgttccccttccgggacgcccgggccgcccccgacccagtactggaagccggacccgtggcgcacggcccgctgcccgtgcccctcgttttagacaacggaagctttcaagtccgggctggatgggcttgccccggtcaggatcccggacccgagccaagactgcagtttcgcgccgtatgtgctcgcggccgaggtggcgcgcgcggcgccagcgggccccaggtggggaatgccctggggtcactggagcccctgcgctggatgttgcgctcgccattcgataggaatgttccagtaaaccttgagcttcaggaactgctcctcgattactccttccagcatcttggggtgtcttcccaaggttgcgtggatcaccctattgttctgacggaagctgtctgcaatcctctatacagtcgacagatgatgagtgagttgctgttcgagtgttacggaatcccaaaagtggcctatggcattgactccctatttagcttctaccataataagccaaagaactccatgtgtagcggcctcatcattagctcgggctaccagtgcactcatgtcctccccatcctggaaggacggctggatgccaagaactgcaaacggattaatttgggcgggtcccaggcagcaggatatctgcaaagactgttacagctgaaataccccggccacctggccgccattacgctgagcagaatggaagaaattcttcacgaacacagctatattgccgaagactatgtggaagaacttcacaagtggagatgtcccgattactacgagaataatgtgcacaaaatgcagttaccattctctagcaaactgctgggtagcacgctgacttccgaggaaaagcaggagcggcggcaacagcaactgagacgtctccaggagctcaatgcaaggcgccgtgaagagaaacttcagttggaccaagagcgcctcgatagattgctctatgttcaggaacttctggaggacggtcaaatggaccagtttcacaaagctcttatcgaactgaacatggatagccccgaagaacttcagtcatatatccagaagctctccatcgctgttgagcaggccaaacaaaaaatattgcaggccgaggtgaatttagaggtcgacgttgtggactcaaaacccgagactcctgacctcgaacaactagaacccagtctggaagatgtagaatccatgaacgactttgacccccttttcagcgaagaaacgccgggggtggaaaaaccagtgacaaccgttcaacctgtctttaatctggcggcttaccatcagctgttcgtgggaactgagcggattagagcccccgaaataattttccaacccagcttaatcggggaggagcaagctggcatcgcagaaacactccaatacatactggatcgctacccaaaggacattcaagagatgcttgtgcagaacgtcttcctgacaggcggcaacacgatgtaccccggcatgaaggcgcgtatggagaaggagttgttggaaatgagaccgttcaggagctcctttcaggtccagctggcctccaaccctgttctggatgcttggtacggcgcccgtgactgggcattgaatcacctcgacgacaatgaggtgtggataacaagaaaggagtacgaggaaaagggcggggagtatctaaaggagcactgtgcttcaaatatttacgtaccgatccggttgcccaagcaggcttcccgaagcagcgacgcccaagccagttctaaaggatctgctgctgggggagggggggctggagaacaggcgtag

SEQ ID NO: 22850 - DNA, 1383 bp, Artificial Sequence
  Description of Artificial Sequence: Synthetic coding sequence
atggccagccgggaggaggtgctggccctgcaggccgaggtggcccagcgcgaggaagaacttaacagccttaagcagaagctggctagcgcccttctggccgaacaggagccacaacccgagcggcttgtgccagtgtctcctctgccacctaaggctgctctctcccgggacgaaatactgcggtatagtagacagctggtgctgcctgagttgggagttcatggccagctgagattaggcacagcctgcgtgctgattgtggggtgcggagggcttgggtgccccctggcccaatatctcgcggctgccggagttgggcggctgggattggttgactacgacgtggtggagatgagtaaccttgcccggcaagtgctccatggtgaggctcttgctggtcaggctaaggccttcagcgctgcggccagtctgcgccgacttaacagtgcagtggagtgcgtaccatatacacaggcccttacccctgccaccgctctggacttagtcagacgctacgacgtggtggccgactgctccgataacgttcccaccaggtacctcgtcaatgacgcatgcgtgctagccgggagacccctggtgtcagcaagtgcattgcgctttgaaggccagattaccgtgtaccactacgacggcggtccatgctatcgttgcatctttccgcagcctcccccagcggaaactgtaacaaattgtgctgacgggggagtcctcggagttgtgaccggtgtgctgggctgcctgcaagcactggaagtcctgaaaatcgccgcagggctggggccctcctacagcggcagtctgctgctttttgatgctctcagggggcatttccgcagcatacgcctccgcagccgaagactggattgtgccgcttgcggagaacgccccacagtgaccgacctcctcgactacgaagccttttgcggcagctcagctaccgataagtgcaggagcctccagctgctctcaccagaggagcgtgtgtctgtcactgactataaacggttactagacagtggagcttttcaccttctgctggatgtcagacctcaggtcgaggtggatatttgtcgtcttccgcatgctcttcacatcccactgaagcatctcgagcgacgcgatgccgaatccctgaaactgttgaaagaggccatttgggaggagaagcagggtacccaggagggggctgccgtgccaatttatgtaatttgtaaattgggaaatgactcccagaaggccgtgaaaattctgcaatccctgtctgcagcccaggagctggatccgctgacggtgcgcgatgtagtcggcggtctgatggcttgggcagctaagattgacggcacattccctcagtactag

SEQ ID NO: 22851 - DNA, 1041 bp, Artificial Sequence
  Description of Artificial Sequence: Synthetic coding sequence
atggagagcgtgagctgcagcgccgccgccgtgcggaccggcgacatggagagccagagagatctgagtctcgtgcctgagcgccttcagaggcgtgagcaagagcggcagctggaggtggagagaaggaaacagaagcggcagaaccaggaagtggaaaaggagaactcacactttttcgttgccactttcgtgagggaaagagccgcggtcgaggagctgctggagcgtgccgaatctgtggagcgcctggaagaagccgctagccggctccaggggcttcagaagttgattaatgactcagtctttttcctggcggcatatgatctccgacagggccaggaagctctggcaaggttacaagcagcccttgcagagcgccgcagggggctgcaacctaagaaaaggtttgcattcaagaccaggggtaaggacgccgccagctcaaccaaggtggatgcagctcctgggattcccccagctgtggagtccatccaggattctccgttgcccaaaaaggcggaaggtgatcttggaccaagctgggtgtgtggtttttccaatctggaatctcaagtcctcgagaagagagcatccgagcttcatcagagagatgtgctgttaactgaactctccaactgtaccgtgcgattgtacgggaatcccaacacattaaggctgacaaaggcgcactcatgcaagcttctctgcggccccgtctccacaagcgtttttttggaggattgtagtgattgtgtactcgccgtggcgtgtcagcaattaagaattcactccaccaaggataccagaatttttctgcaggtgactagtcgtgctatagtcgaggactgcagcggtatccagtttgctccgtatacgtggagctacccggaaatcgacaaagatttcgaaagtagcggccttgatcggtcaaaaaataactggaatgatgttgacgacttcaattggcttgcaagagacatggcgtcgccaaattggtctatcttgcctgaggaggagagaaatattcagtgggactag

SEQ ID NO: 22852 - DNA, 747 bp, Artificial Sequence
  Description of Artificial Sequence: Synthetic coding sequence
atgacccccaagggccccgccatgtgcagcatgcccctgaccagcgctgactgtttttctaatgatatccacaagctggacactagcactatgacgtggactcttatctgcactaaagggagtccagcacgctggagagatttccacagcgccacaatgctgggatcacacatgtatgtcttcggcggaagggcagatagatttggcccatttcacagcaacaacgaaatctactgtaatagaatccgagtgttcgatacacgcacagaagcatggctggactgtcccccaactccggtgctgccagagggaaggcgatcccacagtgcgttcggctataacggcgaactttacatcttcggaggttataatgctcgtctgaacagacattttcacgatttgtggaagtttaaccccgtttcttttacatggaaaaagatcgagccaaaggggaaagggccctgcccgcggcggcgccagtgttgctgcatcgtaggcgacaaaatcgtgcttttcgggggaacatccccctctccggaggaagggctcggcgacgagttcgatctgatagaccacagcgacttgcacatattagacttttccccttcccttaaaactttgtgtaaattggctgtcatccagtataacctggaccagtcctgtttgccccacgatattaggtgggagctgaatgccatgacaacgaactctaacatctctcggcctatcgtgtcatctcatgggtag

SEQ ID NO: 22853 - DNA, 1401 bp, Artificial Sequence
  Description of Artificial Sequence: Synthetic coding sequence
atggagtacgagagctactacttcgtgaagttccagaagtaccccaagattgtaaagaagagctctgacaccgctgaaaataacttgcctcagcggtcacgggggaagacaagacgcatgatgaatgactcttgccaaaacctgcccaaaattaatcagcaaaggccgcgttcgaagactactgccggaaaaacaggcgacaccaaatctttgaacaaagaacaccccaaccaagaagtcgttgacaacaccaggctggaatccgccaatttcgggcttcatatcagccgtattagaaaagacagcggagaggaaaacgctcacccccggaggggtcaaatcatcgatttccagggccttcttacagacgcaattaagggagccaccagcgaactggcgctcaacacatttgaccacaacccagacccatctgaaaggttgttaaagcccctgagcgcctttatcggcatgaactccgaaatgcgtgagctggccgctgttgtctctagagacatctaccttcataatccaaacattaagtggaatgatatcatcgggcttgatgcggccaaacagctggtgaaagaagctgttgtctatcccatacgatacccccagcttttcacgggaattctgtccccctggaaaggcctgttgctgtatggcccaccaggcacggggaagactctgcttgcaaaggctgttgccaccgagtgcaagacaactttcttcaacatctccgcctctacaatagtttcgaagtggcgaggggactcggaaaaactggtccgggtcctgtttgaactggctagatatcatgccccatctacaatatttttggacgagttggaatcagtgatgagtcaacggggcaccgcatccggcggagagcacgaaggaagcctccgtatgaagacagagttgttggtgcagatggatgggctggcccgatctgaggacctggtttttgttttggccgcatccaacctgccatgggagttagactgtgctatgctgcgccgcctggagaagaggattttagttgacctgccgtcacgggaggctcgtcaggctatgatctatcattggttgccgcccgtttctaagagtcgggcgctcgagctacataccgagttggagtactccgtgctcagtcaggagaccgaggggtattctggatcagacatcaaactggtatgccgggaggcagccatgcgcccggttcggaaaatttttgatgcactggaaaatcatcaatctgagagcagcgaccttccacgcatccagctcgatatcgtcactaccgccgacttcctcgatgtgctgactcataccaaaccatccgcaaagaacctcgcccaacgatattccgactggcagcgggagtttgagtctgtttag

SEQ ID NO: 22854 - DNA, 6402 bp, Artificial Sequence
  Description of Artificial Sequence: Synthetic coding sequence
atggacgaggtggagcaggaccagcacgaggcccggctgaaggagctcttcgatagtttcgacacaaccggaaccgggtccctcggccaggaagaactcactgacctttgccatatgctgtctttggaggaggtagctccagtcctgcagcagaccttgctgcaggacaatctactaggaagagtacacttcgaccaattcaaagaggcactgatcctgattttgtctcgcacgctgtccaatgaggagcactttcaagagcccgattgtagcctggaagcgcagcccaagtatgtgaggggcggcaaaagatatggaaggcgatcactgcccgagtttcaggagtcagtcgaagaattccctgaggtgaccgtgattgagccactagatgaggaggcgagaccctcccatatcccagctggtgattgctccgaacattggaagacccagcggagcgaggagtacgaagcggagggccaactcagattctggaatcccgacgacttgaatgcttcacagtctgggtccagccctccccaggattggatcgaagagaagctgcaggaagtgtgtgaagatctgggtattacaagagatgggcatcttaaccggaagaagttggttagtatttgtgagcagtacgggctgcagaatgtggacggagagatgctcgaagaggttttccacaacctcgatccagatggcacaatgtcggtggaggactttttttatgggttgttcaaaaacggtaaaagccttacaccctcagccagcactccgtacaggcagttaaaaaggcacctgagcatgcagtcattcgacgaatcaggccgccggacaacaaccagcagcgccatgacctcaaccattggtttccgagtcttctcctgcctcgacgacggaatgggccacgccagcgttgagcgtatactcgatacctggcaggaggagggtatcgagaacagtcaggagattctcaaggctctcgactttagtctcgatgggaatatcaacctcacggaactcactcttgctttggagaacgagctgctcgtgaccaaaaacagtattcatcaggctgctttagcatcctttaaggctgaaatccgacacctgctggaacgtgtggatcaggtcgtcagggagaaagagaagctgcggtctgacctggacaaggccgaaaaactaaaatccttaatggcgtctgaggtggatgaccatcatgccgccatagaacggagaaatgagtacaacctgcgcaagctggacgaggaatacaaggaaaggatcgctgcactgaaaaacgagctcaggaaagaacgggagcagattttgcaacaagcaggcaagcaacggctcgagcttgagcaggagatcgaaaaggctaagactgaggagaattatattcgtgaccgcttggctcttagcttaaaagagaactctcgtttggaaaacgaactgctggagaacgcagaaaaactcgccgagtacgagaacttgactaacaaacttcagcgtaacctcgaaaacgttctggcagaaaaattcggagatctggaccctagctccgctgagttctttctgcaggaggaaaggctgacccagatgcgcaatgagtatgagcgccagtgccgggtactacaggaccaggtggacgaacttcagagtgagctggaagagtaccgcgcccagggtcgagtcttgcgattgccactcaagaattcaccgagcgaggaggtggaagcaaactcaggcgggattgaaccagagcacgggctgggcagcgaggagtgtaaccctctaaacatgtcgattgaagctgagcttgtcatcgaacagatgaaagagcaacatcatcgtgatatatgttgtcttcggttagagcttgaggacaaggtgaggcattacgagaaacaattggacgaaactgtggtatcctgtaaaaaagcccaggagaatatgaaacaacggcatgagaatgagacccacaccctagaaaagcagatcagcgatttgaagaacgagatcgctgagctgcagggccaggccgcagtccttaaagaggcccaccatgaggcaacttgcagacatgaagaagagaaaaagcagctccaggtgaagcttgaagaggaaaaaacacacttacaggagaagcttaggcttcagcacgagatggaacttaaagcccgattaacgcaggcacaggcatccttcgaaagagaacgagagggactccaatcttccgcctggacagaggagaaagtacgcgggctgacccaggaattggagcagttccatcaggagcagctgactagcctcgtcgaaaagcacacgctggagaaggaagagctgcggaaggagctgctggaaaagcatcagcgtgagctgcaggaagggagagagaaaatggagactgaatgtaaccgtcggactagccagattgaagcccaatttcaatccgattgccagaaagttactgagcggtgcgagtcagccctacagtctctagaaggaaggtatcgacaggaactgaaggaccttcaagaacagcaaagggaggaaaaaagccagtgggaatttgagaaggatgagttaactcaggaatgtgctgaagctcaagagcttctcaaagaaaccctgaagcgggaaaagacaacgagcttagtactgactcaggaacgggagatgttagagaaaacctacaaagagcatctgaattccatggttgtggaacgacagcagctgcttcaggatctcgaagatctgcgcaatgttagcgaaacccagcagtctttattgagcgaccagatcctcgaactgaaatcctcacacaagcgcgagttgagagaacgcgaggaagtgttgtgccaggccggggccagcgagcagcttgcctcgcagcggctcgaacgacttgagatggagcatgaccaggagcggcaggagatgatgtcaaagctcttagccatggaaaacatacacaaggccacttgcgagactgctgaccgcgaacgagcagaaatgtctacggaaatatcaaggctccaatctaagattaaggagatgcaacaggctacaagtcccttatcaatgctgcaatctgggtgccaggtcattggcgaggaggaggttgagggggatggggcactcagtctgctgcaacagggggagcagctcctggaagagaacggagatgtgctgctcagtctacagcgagcacacgagcaggctgtgaaagaaaatgttaagatggccactgagatttcacggttgcagcagagattgcagaagcttgagccaggattggtgatgtcctcttgcctcgatgagccagccaccgagtttttcggaaacactgcagagcagactgaacaattcctgcagcagaacaggactaaacaggtggagggggtaacccggcgacacgtgctgtcagacctcgaggacgacgaagtaagggatttgggtagcacaggaaccagctctgtgcagcgccaggaagtaaagattgaggagagcgaggcctcagtggagggtttctccgagctggagaatagtgaagagacaagaacagagagctgggaacttaaaaaccagatctcccagcttcaagagcaacttatgatgctctgcgccgactgtgacagggcctccgagaagaaacaggatttgctgtttgatgtgagcgtattgaaaaaaaagctgaagatgctggagcgtattccagaagcttcccctaaatataagctgctgtacgaggatgtgtctcgcgaaaatgactgccttcaggaggaactgaggatgatggagacacggtacgacgaggcattggagaacaataaagagctgacggccgaagtgtttaggttacaggacgagttgaagaaaatggaggaggtcacagagacattcctgtcgttagaaaaaagttatgacgaggtgaaaatagaaaacgagggtctcaacgtgcttgtgctgcgcctgcaaggcaagatagagaaattgcaagaaagtgtggtgcaacgatgtgactgctgtctctgggaagcctctctggaaaatctggagattgaacccgacggtaacattctgcagctgaaccagactctggaggagtgcgtcccgcgagtgagaagtgtacaccacgtgatcgaggaatgtaagcaagagaatcaatacctggaggggaatacccagctcctggaaaaagtcaaggcgcatgagatcgcctggctgcacggcacaatccagacccatcaggagaggccgagagtgcagaatcaagtgatattggaggagaacactacccttttgggcttccaggacaagcacttccagcaccaggctaccatcgccgaattagaactggaaaagactaaattacaggaactgacacgcaaactgaaggaaagggtgacaatcctggtgaagcagaaagacgtactttctcacggggagaaagaagaagagctgaaagcgatgatgcatgacctgcagataacctgctctgagatgcagcaaaaagttgagctgctcagatatgaaagcgagaaactacagcaggaaaactcaattttgcgcaacgagatcacaactcttaatgaagaggactcaatctccaacctgaagctggggacactgaacgggtctcaggaggaaatgtggcagaagacagaaaccgtgaagcaggagaatgccgccgtgcagaaaatggttgagaacctgaaaaagcagattagtgaactgaagatcaaaaatcagcagctggatctggaaaacactgagctgtctcagaagaactctcagaaccaggagaaactgcaagagttaaaccagagactgactgaaatgttgtgtcaaaaagaaaaggagcctggaaacagcgccctggaagagcgcgagcaggagaaatttaacctgaaagaagagcttgagcgctgtaaggtacaaagttcaacgcttgtgtcctccctggaggccgagctctcagaagtcaagatccagactcatatagtgcagcaagagaatcatctcctgaaggacgagctggagaagatgaagcagctacaccggtgtccggacctgagcgatttccagcagaagatttcctccgtcctgagctacaatgagaaattactcaaagagaaggaggcactgagcgaagagcttaactcgtgcgtggataagttggccaagtccagtctgctggagcatcggattgccactatgaagcaggagcagaagtcttgggagcatcagagcgcttccttaaagagccagctagtggcatcacaggaaaaggtgcagaacctggaggacacagttcagaacgtgaatctgcagatgtctcggatgaagtctgatctcagagttactcagcaggaaaaggaggccctgaagcaggaagtaatgtcccttcacaagcagctccaaaatgcaggaggcaaaagctgggctccggaaatcgccacccatccgtcaggtctacacaaccagcagaaaaggcttagttgggataagttagaccatctgatgaatgaagaacaacagctgttatggcaagaaaatgaacgcctgcaaaccatggttcagaatactaaggccgagcttacacacagccgggaaaaggtccggcagctcgaaagtaacctgttgccaaaacaccagaagcatctaaaccccagtggaaccatgaatcctaccgagcaagagaaactgagcttgaagcgcgagtgtgaccagtttcaaaaagagcaatcccctgcgaaccgaaaagtgagccagatgaatagcctggagcaggaattagagacaatccacttagaaaacgagggactcaaaaaaaagcaagtaaagctggatgaacaactgatggaaatgcaacacttgcgttctactgctactccgagcccttcacctcacgcttgggacctccagctcctgcagcagcaggcatgtcccatggtaccccgtgagcaatttcttcagctgcaacggcaattgttgcaggcagaacgaattaaccagcaccttcaggaagagctggaaaatcgcacaagtgaaacaaatactccacagggcaatcaggaacagcttgtgactgtcatggaagaaagaatgattgaggtggagcagaagttgaaactagttaaacgcctgctccaagagaaggtgaatcagctgaaagagcagctctgtaaaaacacaaaggcagatgctatggtgaaagatttgtacgtagaaaatgcacagctgttaaaggcactcgaggttacagagcagagacagaagacggctgagaagaaaaattacttgcttgaagagaaaatcgcatccttgtctaatatagtccgcaaccttacacccgcaccgctgacttccacgcctccgctgagatcctag

SEQ ID NO: 22855 - DNA, 1713 bp, Artificial Sequence
  Description of Artificial Sequence: Synthetic coding sequence
atggccggcggcgcccgggaggtgctgaccctgcagctgggccactttgcgggcttcgttggggcacattggtggaatcagcaggacgcagcattgggacgtgccactgattccaaagaaccgcccggcgaactatgccccgacgtcctttatcggactggccgtacactgcatggccaggaaacctatacacctagattaattctcatggatctcaaaggctccctgtcatctttaaaagaggaaggcgggctataccgagataagcagctagacgcagctattgcttggcaggggaagctcacaacccacaaagaagagttgtaccccaagaacccctatctgcaggatttcctgagcgcggaaggcgttctctcctcagatggggtgtggcgggtgaaatctatccccaacggtaaaggctcaagccccctgcctacagccactaccccgaagccgttaatccctaccgaagcaagtatccgcgtgtggtctgactttctgcgagttcacttgcatcccagaagtatctgtatgatccagaagtacaaccacgacggggaagccgggcggctggaagcattcggccaaggcgagtcagtgttgaaggaaccgaagtaccaggaggaacttgaagacaggctacatttttacgttgaagagtgtgactatctgcaaggatttcagattctgtgtgatctgcacgacggattcagcggggtgggtgcaaaggcggcggagcttcttcaagacgagtactcgggccgcggtatcattacttgggggttgctgccagggccctatcaccgaggcgaagcccaaagaaacatttacagattactcaatacggccttcgggctggtacatctgacggctcatagtagcctggtgtgtcccctgagtcttgggggctctctggggctgagaccagagccaccagtgtcttttccttacttgcattacgacgctactctccctttccattgttcagctattctggcaacagctttggataccgtgacagtgccatataggctgtgctcttcccctgtgagtatggtacacttggccgatatgttatcattttgtgggaagaaggtagttacagcaggcgccatcattccattcccacttgcccccggccagtccttgcccgatagtctcatgcagtttggcggggccacgccttggacacctctgtctgcctgtggcgagccaagtggaacccggtgctttgcccagagcgtggtgttacgtgggatcgaccgggcctgtcatacatcgcagttgactcctggcactcctccaccatccgctctacatgcatgcacaaccggcgaggaaattctggcacagtacttacagcagcagcagcctggggtaatgagctcttcccatttactgcttacaccatgtagggtggctcctccttatccccatctcttcagtagctgtagccccccagggatggtgctagacggatcacccaaaggggccgcagttgagagcatcccggtttttggggcattatgttcctcgagcagcttacatcaaactctcgaggccctggcccgggatctaacgaaactggatctacgacggtgggcctctttcatggatgccggggtggagcatgatgatgtggctgaactgcttcaggagctccagagtctcgcacagtgctatcagggaggcgactccttagtggattag

SEQ ID NO: 22856 - DNA, 1791 bp, Artificial Sequence
  Description of Artificial Sequence: Synthetic coding sequence
atgaaccggacctggccccggcggatctggggcagcagccaggacgaagcagaactgattagagaggacatccagggagctctccacaactatcgctctggacgaggggagagacgagcagctgccctcagagccacccaggaagagcttcagagggatcgctcaccagctgccgaaacaccacctctgcaacgacgaccatctgtgcgcgcagtgatctcaaccgttgaacgaggcgccggacgcggtcgaccccaagcgaagcccatccccgaggccgaggaggctcaaagaccagagccggtcggtacctcctcaaacgcagattctgcatccccagacctgggccccagaggccccgacttggcagttctgcaagccgagagagaggtcgacatattgaaccacgtcttcgacgacgtcgagtcttttgtctcccgactccagaaatctgccgaagcagctcgggtcttggaacacagggagcggggacggcggagtagacggcgcgccgccggggaagggttgcttaccctgcgggctaagccgcctagcgaggcggaatataccgacgtcctgcagaaaattaaatacgcgttctcccttctggcgaggcttcgaggaaacattgccgacccatcaagtcccgaactcctccacttcctctttgggccgctccagatgattgtcaatacctctggcggacccgagttcgcatcctcggtccgacgcccccatttgacttccgatgccgttgctctcctcagagataacgtcaccccaagagaaaacgagctctggacatccttgggggattcctggaccaggcccggactagagctctcacctgaggagggacctccctataggcccgagttcttctcgggctgggaacctcctgtgaccgacccacagagcagggcatgggaggaccccgtcgaaaagcaactgcagcacgagcgcaggaggcggcagcagagcgcaccacaagtcgccgttaacgggcatcgggacctggaaccggagagcgagccccagcttgagagcgagacggccggcaagtgggtgctctgcaattatgattttcaggccaggaatagtagtgagctgagcgtgaagcagcgagatgtactcgaggtcctagatgattccagaaagtggtggaaagtcagggaccccgctggacaagagggctacgtaccatacaatattctgacaccatatcctgggccccgcctgcaccacagccagtctcctgccaggtcattgaactcaactccaccccccccacccgctcccgcccctgctcctccacccgctctggccaggccaaggtgggatcggccacggtgggatagctgtgacagtttgaacggcctggacccctctgagaaggaaaaattttcccaaatgctgatcgtaaacgaagaactgcaggcgaggctggcccagggacggagtggtccctcgagggcagtcccagggcccagggccccggagccacagttgtcccctgggtccgatgctagtgaagtaagagcctggctccaagctaaaggcttttcctcaggaaccgtggatgccctaggagtgctcacgggggcccagctgttttctctgcaaaaagaggaactgcgcgcggttagccccgaagaaggcgctcgggtgtattctcaggttaccgtgcagcggtcactcctggaggataaggagaaagtgagtgagctggaggccgtcatggagaaacagaaaaaaaaggttgaaggtgaagtggaaatggaagtcatttag

SEQ ID NO: 22857 - DNA, 1950 bp, Artificial Sequence
  Description of Artificial Sequence: Synthetic coding sequence
atgagcagcttcggcgccggcaagaccaaggaggtgatcttcagcgtggaggatggatctgtcaagatgtttcttaggggacgacctgttcctatgatgatccctgacgagctcgcacccacatatagcctcgatactcggtctgaactcccttcctgccgattgaagctagagtgggtttacggctaccgcggtcgcgactgtcgagccaacctctaccttttacccaccggagagatcgtgtactttgttgcctcggtcgccgttttgtatagtgtggaagagcaaaggcagagacactacttaggtcataacgatgacattaaatgtctcgctatccaccctgacatggttaccatcgccaccggccaagtggcagggacaaccaaggagggtaagcccttgcctccacacgtaagaatctgggactcggttagtctctccacactgcatgtgctgggcctcggagtttttgaccgcgcggtgtgttgcgtgggattttcaaagagcaatggcggcaatctcctgtgcgccgtggacgagtctaacgatcacatgctgtcagtatgggactgggccaaagaaacaaaagtggtggatgtgaaatgtagcaatgaggccgttctggttgccactttccacccaactgatcctacagtcctgataacttgtggcaagtcacatatatatttctggacactggagggtggcagcctctccaaaagacagggcctttttgaaaagcatgaaaagcccaagtacgtcctctgcgtgacattccttgagggtggggatgtcgtgactggcgattctggtggcaacctttatgtgtggggtaagggaggaaatcgcatcacacaggccgtgctgggtgcccacgacggaggtgtgttcggcttgtgcgccctgcgggatggaacattggtgagcggaggcgggcgcgatcgtcgtgtggtactttggggttctgactatagtaagttgcaggaggtcgaagtgcccgaggattttggccccgttcggacagtggctgaaggccatggcgacacgctctatgtgggcaccacacgcaactctattctccaggggagtgtacacactgggtttagcctgctggtccaggggcacgtggaggaattgtggggcctggctacccacccatctagagcccagttcgtgacatgcgggcaggacaagctggtgcatctttggagctctgacagtcatcagccactgtggagccggattatcgaggaccccgcaagatccgcaggctttcatcctagcggtagtgtcctggccgtaggcaccgtaacgggtcggtggttgctgctcgacacagagacccatgacctggtcgcaatccacaccgacggaaacgagcagatttccgtagtcagcttctcccctgacggtgcttatttggcggtcggtagtcatgacaatctggtgtacgtctatactgttgatcagggggggcggaaagtctcccgcctcggcaaatgtagtggtcattcttcattcattacacacctagactgggcacaggatagcagctgcttcgttacgaacagtggcgactacgaaatactttattgggatccagccacatgtaagcaaataacatcagcagacgctgttcggaatatggaatgggccacagctacatgtgttctgggttttggcgtgtttggcatatggagtgagggcgccgatggaacagatattaacgccgtggcacgctcgcacgacggtaaattactagcctctgctgacgacttcggtaaagtccatctctttagctacccatgctgccagccacgggcactgtcccataagtatggcggtcattcctcacacgttactaacgttgcttttctatgggacgattccatggcacttacaaccggcggtaaagatacatctgtccttcagtggagagtggtgtag

SEQ ID NO: 22858 - DNA, 792 bp, Artificial Sequence
  Description of Artificial Sequence: Synthetic coding sequence
atggccggcctggaggtgctgttcgccagcgccgcccccgccatcacctgtagacaagacgccttagtttgctttctccactgggaggtggtaacacacggctacttcgggttaggggtgggtgaccagcccggaccaaatgataagaagagcgagctgctgccagcaggttggaataacaataaggatctgtacgtgctcaggtatgagtacaaggacggcagcagaaaactgctggtgaaggccattactgttgaatcctctatgatccttaatgtgctggaatacggttcacagcaagtcgccgacctgaccttaaacttagacgattatatcgacgctgagcatctaggagattttcacaggacatataaaaattccgaagaactgaggtccagaatcgtgtctggtatcatcacccctatccacgagcagtgggagaaagcaaatgtatcctccccacaccgcgaatttcccccagcaaccgcccgcgaagtggatcctctgcgaattcctccccaccaccctcacaccagccggcagccaccctggtgcgatcccctgggtccattcgtagtcgggggcgaagatctggatccctttggacctcggagagggggaatgatcgtggaccccctgaggagcgggttccccagagcgcttatcgacccttcttcaggactgccaaatcgcctgccccccggtgcagtgccacccggcgcccgattcgatccattcggccctatcgggacttctccacctggaccgagacctgacagaagaggacagtag

SEQ ID NO: 22859 - DNA, 273 bp, Artificial Sequence
  Description of Artificial Sequence: Synthetic coding sequence
atggacaacatgagcccccggctgcgggccttcctgagcgagcccatcggggagaaagacgtgtgctgggtggatggcataagccacgagctggctatcaacctcgtcaccaaagggatcaacaaggcatacatacttttagggcaattcctccttatgcataaaaatgaggctgagtttcaacgctggttaatctgttgcttcggagcgaccgagtgtgaggcacagcaaacctcgcactgtttaaaagaatggtgcgcatgtttcttatag

SEQ ID NO: 22860 - DNA, 888 bp, Artificial Sequence
  Description of Artificial Sequence: Synthetic coding sequence
atgcccgtgcacaccctgagccccggcgcccccagcgcccccgcccttccttgccgtctgcgcactcgcgtgccgggctatttactgcgcggtcccgctgatggaggcgctcgaaagccatccgctgtggaacggctggaggcggacaaggccaagtacgtcaagtccctgcatgttgctaacacccgccaggagcccgtgcaacctttgctttctaaacaacctctttttagtcctgagacccgccggaccgtgctgactccgtcacgcagagccttacctgggccatgccgaagaccccagttggaccttgatatcctgagttccctgatagatctttgtgactctcccgtgtctccggcagaagcctctaggacacccggccgggctgaaggggctggacgccctccccccgccacccctccaaggcctcctcctagcactagtgcagtcaggagagtcgacgtccgaccgctgcccgcctccccggcacgtccctgcccatctcccggacccgccgccgcgagttcccccgcccggccccctggtctccagaggtccaaaagtgacctttcggaacgcttttcgcgggctgccgctgatctcgaacggttctttaacttctgtggacttgaccccgaggaggcccggggcctcggcgtcgcgcatctcgctagagcttctagcgatattgtgtcgcttgccggtccatcggcagggcctggcagctcagaaggtggctgcagtagaagaagttctgttacagttgaggaaagagctcgggagagggttccctacggagtatcggtggtagaaaggaatgcccgtgtgatcaagtggctctatgggctgaggcaagctcgagaatcccctgccgccgaggggtag

SEQ ID NO: 22861 - DNA, 582 bp, Artificial Sequence
  Description of Artificial Sequence: Synthetic coding sequence
atgcccaccaccagccggcccgccctggacgtgaagggcggcacctctcccgcaaaagaagatgccaaccaggagatgtcgtccgtggcatatagtaatctggccgtgaaagacagaaaagccgttgccattcttcactaccccggcgtagccagcaacggcaccaaagcgagcggtgcccctacgagcagctccggcagcccaatcggttcgcctaccaccacgcccccgacaaagcctccaagctttaacctgcacccggcgcctcaccttttggcatctatgcatttgcagaagctgaatagccaatatcaaggaatggcagccgccacccccggccagccaggcgaggctgggcctttacagaattgggacttcggagcacaagcgggcggggccgagtcactgtccccatctgctggtgcacagagtcctgccattattgattccgacccggtggatgaagaggtactgatgagtctggtagtagagctgggccttgatagagcaaatgaactccctgagctttggttgggacaaaatgaattcgacttcacagcggatttcccctcgtcctgctag

SEQ ID NO: 22862 - DNA, 1077 bp, Artificial Sequence
  Description of Artificial Sequence: Synthetic coding sequence
atggccgccgtgctgaagcccgtgctgctgggcctgcgggacgcccctgttcatggctcacccactggtcccggcgcctggactgcttctaagctgggagggataccagatgccctgcccacggttgccgcacctcggcctgtctgtcaaaggtgcgggcagcccctggccctggtcgtgcaggtctactgcccactcgagggttctccctttcatcggctcttacacgtgttcgcctgtgcttgtccaggttgcagcacgggaggtgctcgcagttggaaggtcttccgttctcagtgtctgcaagtgcccgagagagaggcccaagatgcccagaagcaaggtaactctcttgccgcagaagactggtgcgagggagctgatgattgggggagcgacactgaagaggggccatccccgcaattcactctggactttggaaacgacgcctctagtgccaaagacgtggactggaccgcccgactgcaggatcttcggttgcaagacgccgttctcggtgctgctcatcccgtgcctcccgggctacctttgttcttaccctattatatctgtgtggccgatgaggacgattaccgcgactttgtcaacctggatcacgctcactccctgttgcgggactaccagcagcgcgagggcatagccatggaccagctgctgtcgcagtcactccctaacgacggcgatgaaaagtatgaaaaaacaatcataaaatcaggcgatcaaaccttctacaagtttatgaaaagaatcgcagcttgccaggaacagatcttgcgatacagctggtctggcgagccccttttcctcacatgtcccacctcagaggtgacggagttaccggcctgttcgcagtgtggcggccagaggattttcgagttccaactcatgcctgccctagtctcaatgttgaagagtgcaaacctggggttgtccgttgagtttggaaccatcttggtttatacatgtgagaaaagttgctggcccccaaaccaccaaacccctatggaggagttttgtatcatccaggaggaccctgacgaactgttatttaaatag

SEQ ID NO: 22863 - DNA, 1779 bp, Artificial Sequence
  Description of Artificial Sequence: Synthetic coding sequence
atggccagcgtggtggtgaagaccatctggcagagcaaggagatccacgaagctggagatacccccaccggagtggagtcctgctctcagttggtgcctgaggcaccgcggcgcgtgacttcaagggccaaaggaatccccaagaaaaagaaagctgtaagcttccacggagtcgagccccagatgagtcaccagccgatgcactggtgtctgaatcttaaaaggtctagtgcctgcaccaacgtgagccttctgaacctcgccgctatggaacctactgatagcaccggaacagatagtaccgtagaggacctctccgggcagctgaccttggctggaccaccagcttccccgaccttgccatgggaccctgacgatgccgacattacagaaattctgtcaggcgtgaattccggtctggtgcgagcaaaagattccattacaagtctcaaagagaaaaccaatcgcgtgaatcagcatgtccaaagtctgcagagtgagtgctcagttttgagcgaaaacttggaaaggagacgtcaggaagccgaggaactggaaggctactgtatccagctcaaggaaaactgctggaaagtgacgcgatctgtagaagatgctgaaattaagaccaatgtcttgaagcaaaattctgctctcctggaagaaaaattgaggtacttacagcagcagttacaagacgagaccccaaggaggcaagaggctgaattacaagagcccgaggagaaacaagagcctgaagaaaagcaggaaccagaggagaagcagaagcctgaggctggcctctcatggaattcattgggccccgctgccacctctcaggggtgccccggcccgcccggtagccccgacaaacctagccgcccccacggcttagttcccgctggttggggaatgggcccaagggccggcgagggaccctacgtctctgagcaagaactgcagaagctgtttaccggcattgaggagctgaggcgcgaggtcagtagtcttaccgcgcgttggcaccaagaggaaggtgcagtgcaggaggcactgcgactgctgggcggactcggagggcgcgtagatgggtttctcggacaatgggagcgtgcacagagagagcaggcacagaccgcgagggatctgcaagaactcaggggaagggcagatgaattatgtactatggtggagaggtccgcagtgagcgtggcatccctccgctccgaattggaagggttgggacctctgaaacccatccttgaggagtttgggcgccagttccagaacagtcgtagggggcctgacctgagtatgaatctcgaccgatcccaccagggcaattgcgcccggtgtgcttctcaaggtagccagctttctaccgagagcctccagcaacttttagatagagcccttacctccctggtcgatgaagtcaaacagagaggcctcacgcctgcatgtcccagctgtcagcgcctgcacaagaaaatcttggaactcgaacgtcaggcgctggcgaagcacgtgagggccgaggctctgtcatccaccctgcgacttgcgcaggacgaagccctgcgtgctaaaaatttactgctcaccgacaagatgaaacccgaagaaaaaatggccacgcttgaccacctgcatctcaagatgtgtagcctgcatgatcacctgtctaacctcccgctagagggaagtacggggaccatgggtggggggtcgtcagccggcacgccccccaaacaggggggctccgctcccgagcaatag

SEQ ID NO: 22864 - DNA, 2541 bp, Artificial Sequence
  Description of Artificial Sequence: Synthetic coding sequence
atgagcagcagccacttcgccagccggcaccggaaggacatcagcactgagatgattcggacgaaaatcgctcaccgtaaatcactttctcagaaagagaataggcacaaagagtatgaacggaataggcactttggtttgaaggatgtcaacatccctacgctggagggccggattttggtggagctcgacgagacttctcaggggcttgtgccggagaaaacaaacgtgaaacctcgtgctatgaagacaatcctgggggatcaacggaaacaaatgctgcagaagtataaggaagagaagcagctccagaagttgaaggagcaaagagaaaaagctaagaggggcatttttaaagttggccgttatcgtcctgacatgccctgtttcctactgagcaaccaaaacgctgttaaagcggaacctaaaaaggcgatcccatcctctgtacgcatcacccgcagcaaggctaaagaccagatggagcagactaaaattgacaatgaaagcgatgtgagggccatccgcccagggccacgtcagaccagcgaaaagaaggtgtccgacaaggagaagaaagtggtccagcccgtcatgcctacctccctcaggatgactcggtcggctacccaggctgccaaacaagttccccgaaccgtgtccagcacgacggctcgcaagccagtgacccgagcagccaatgaaaatgaacctgaaggcaaggtgccctcgaaggggcggcccgctaaaaacgtggagactaagcccgataagggcatctcctgtaaggttgactccgaagaaaataccctcaactcccagaccaacgcaacttcagggatgaaccccgatggagtgctgtcaaagatggagaatctgcccgagattaacacagctaagatcaagggaaaaaatagttttgccccaaaagatttcatgtttcagcctctggacgggctgaagacttatcaggttactcctatgaccccgcggtcagcgaatgcttttctaacacccagctacacatggactccattgaagaccgaagtggacgaaagtcaggctactaaggagatccttgcccagaaatgtaaaacctattccaccaaaacaattcagcaggatagcaataaacttccatgtcccctcggccccctaaccgtctggcatgaggagcacgttctgaacaagaatgaggctactacaaaaaatctgaatgggctgcctatcaaagaggtgcccagtctagagcggaatgagggccgtattgcccagccccatcatggcgttccctatttcagaaacatcctgcaatcagagacagagaagctcaccagtcattgtttcgagtgggatcggaagctcgaactggacattccagacgatgcaaaagacctcatcagaaccgctgtaggtcaaacccgtctgttaatgaaggaacgtttcaagcagtttgagggcctagtagacgactgcgagtataagcgtggcattaaggaaactacctgtacagacctagacggcttttgggacatggtttcattccagattgaggacgtgatccataaatttaacaaccttattaaattagaagagagcggctggcaagtgaacaacaacatgaatcataatatgaacaagaacgtgtttagaaagaaagttgtgagcggtatcgcctcgaaacctaaacaggatgatgccggtcgcatcgccgccagaaataggttagcagctataaagaacgccatgcgtgagaggatccgccaagaagagtgcgccgaaactgcagtttcagtgatacccaaagaggtggataaaattgtgtttgacgccggattctttcgggtggagagccccgtgaaattattttcagggctgagcgtctcatctgaggggccatcgcagagattggggacgcccaagtcagtgaataaagcagtctcacagtcaaggaatgagatgggcatccctcagcagacgacgagccctgagaatgcaggtccacaaaatacgaaaagcgaacatgtgaaaaaaacactgtttctatccatccccgagtcaagaagttcaatcgaggatgcccagtgtcctggcttgcctgacctgattgaagagaaccacgtggtgaacaaaacagacctgaaggtggattgtctgagcagcgagaggatgtccttaccattgttagctggaggcgtggccgatgatataaacactaataagaaggagggcatcagcgacgttgtggaaggtatggagctgaacagttctataacttcccaggatgtactgatgtcttctcccgagaagaataccgccagtcagaatagcatcctggaggagggggagaccaagatctctcaatctgagctgttcgacaataagagtctgactacggagtgtcacctcctggattcaccggggctaaactgctccaatccgttcacacagctggagagacggcaccaggagcatgcaaggcacatctcgtttggcggaaatctgatcacatttagcccccttcagccgggggagttttag

SEQ ID NO: 22865 - DNA, 1128 bp, Artificial Sequence
  Description of Artificial Sequence: Synthetic coding sequence
atggccagcgccccctggcccgagcgggtgccccggctgctggcccctaggttgccttcttatccacctcctcctcctaccgtgggcctgcggtctatggagcaggaggaaacttatctggagctatacctggatcagtgtgccgcccaggacgggctggcaccgccgagaagccccttattctcccccgtcgtgccgtacgatatgtatatactgaatgcttccaacccagataccgctttcaactctaatcccgaggtcaaagaaacaagtggagatttcagttctgtggacctctctttcctccctgatgaagtcactcaggagaataaagaccagccagtgatcagtaagcacgagacggaggaaaattcggagtctcagtcgccacaatctcggctgcccagcccttcagaacaagacgttggactgggcttaaactctagctccctgtccaattcccatagtcagctccacccaggagacacagattccgttcagcctagccccgaaaaacccaattcagatagcctttcactggcctcgattacgcctatgacaccaatgacccccatctcagaatgttgtggtatcgttccacagctccagaacatcgtcagtacagtaaaccttgcctgcaagctggacctcaagaagatcgctttgcatgccaaaaatgccgagtataacccaaagcgcttcgctgcggtcatcatgagaatcagggaaccacgaacgacagcccttatatttagctcaggtaaaatggtgtgcacgggagcaaagagcgaggaacagtctcgcctcgcagcgcgcaagtacgcccgcgtagtgcagaaacttggcttcccagccaggtttctggattttaagattcagaacatggtgggctcctgtgatgtccgttttcctattcgactggaggggttagtgttaacacatcaacagttcagttcctacgagccagaactgtttccaggtctcatctatcggatggtgaagccccggattgtcttacttatctttgtatcaggcaaagtggtcctgaccggggctaaggaacgttccgagatatacgaggcttttgaaaacatctatcccatccttaaaggtttcaagaaagcatag

SEQ ID NO: 22866 - DNA, 633 bp, Artificial Sequence
  Description of Artificial Sequence: Synthetic coding sequence
atgcaggccgagggccagggcaccggcggcagcaccggcgacgccgacggcccgggaggaccaggaatacctgacggaccaggaggaaacgccggaggccctggagaagccggggcaactggtgggcgtggcccccggggggcgggggcggcgcgcgcgagcggtcctcgaggaggcgcccctaggggcccgcacgggggcgctgcatcagcacaggacgggcgctgcccatgcggagctaggagacccgattctagactacttcagctccacattacaatgccctttagctcccctatggaggctgagctggttcgacgcatcctgtcccgagacgccgcaccactgcctcgccctggagccgtgttgaaagattttacggtatccggaaatctgctctttatgagcgtcagggaccaggatcgcgagggtgcaggaaggatgagagtggtgggctggggcttgggctccgcgtctccagaaggccagaaggcacgtgatctgcggactccaaaacacaaggtgagcgaacagcgcccagggacgcccggacccccacctcctgagggagcccaaggagatggctgtcggggtgttgctttcaacgtcatgtttagtgctcctcacatctag

SEQ ID NO: 22867 - DNA, 582 bp, Artificial Sequence
  Description of Artificial Sequence: Synthetic coding sequence
atggtggtgctgcgggccggcaagaagaccttcctgccccccctgtgtcgtgccttcgcctgccgcgggtgtcagttggcacccgaacgaggcgccgagcgccgagatacagcaccatccggcgtcagccggttctgccccccccggaagtcctgccacgactggatcggaccgcccgataagtacagcaatctacgacctgtgcatttctatatccccgagaatgaaagccccctggaacagaagttaaggaagttgcggcaggagactcaggaatggaaccagcagttctgggccaaccaaaatctcaccttcagcaaagaaaaggaggaatttatccattcccggctcaagacgaagggcctcggactgcggaccgaaagcgggcagaaagccaccctgaacgccgaagagatggctgacttctataaggagttcttgagcaagaattttcagaagcacatgtattataaccgagattggtacaagaggaactttgccataaccttttttatgggaaaggtcgctctggaaagaatatggaataaactaaaacaaaaacagaaaaaacgttctaactag

SEQ ID NO: 22868 - DNA, 1383 bp, Artificial Sequence
  Description of Artificial Sequence: Synthetic coding sequence
atggccaacgaccccctggagggcttccacgaggtgaacctggccagccccacctccccggatctcctgggcgtgtacgagtccggtactcaggagcagactacgtccccgtcggtcatctaccgtccccatccttcagcactttcctcagttcctatccaggctaacgctctggacgtcagcgaactgcctacacagcctgtatactctagtccgcggagattaaactgcgccgaaattagtagcataagcttccacgtgactgatcccgctccatgctcaacatctggcgtgacggccggacttacaaagctgacaacacgcaaagataattacaatgctgaaagggagttcctccagggcgctaccattaccgaggcttgcgacggaagcgatgatatattcggtttatctactgattctttatcacgcctgcggtccccatctgttttggaagtccgcgagaaagggtatgagaggctcaaggaggagttggcgaaggctcagagggagctgaaattgaaggatgaagagtgtgaacgcctcagtaaagtgagagatcagctgggtcaagaattggaggaactcacggccagcctttttgaagaggcacacaagatggtgagagaggccaacataaagcaagcaactgcagagaagcaattgaaggaggcgcaggggaagatcgatgttctccaagcagaggtggccgctctgaagactctggtgctgtcatcaagccccaccagccccacacaggaacctctgccgggcggcaaaactccgttcaaaaaaggccatacacgaaacaaatcaacatccagcgctatgagtggatctcaccaggatctgtctgtcatccagccaatcgtgaaggattgcaaggaagctgacttatctctgtataacgaattccgcctgtggaaagacgagcccacgatggatcgtacttgcccctttttagataaaatctaccaggaagatatctttccatgcttgaccttcagcaagtctgagttggcgtccgccgtcctggaggccgtggaaaacaatacgctctctattgagcccgtcggcctccagcccattcgctttgtaaaggcaagtgctgtggagtgcggaggaccaaagaagtgcgcgttaacaggccaatccaaatcttgcaaacatcggatcaagctgggagacagctctaattactactatatctcccccttctgtcgctaccgcatcaccagtgtttgcaatttctttacctatattcgctatatccagcagggtttagttaaacagcaggacgtcgaccaaatgttctgggaagtgatgcagctcaggaaagagatgtctttagccaagttaggatactttaaagaggagctctag

SEQ ID NO: 22869 - DNA, 981 bp, Artificial Sequence
  Description of Artificial Sequence: Synthetic coding sequence
atggccaccctggtggagctgcccgacagcgtgctgctggagatctttagctatcttccagtgagggatcggatcagaattagcagggtttgccatcggtggaaaaggcttgttgacgataggtggttgtggcggcatgtcgacctcactctctataccatgaggcctaaagtcatgtggcatctgctgagacgatatatggccagtcgcctgcactcccttcgaatgggcggataccttttttctgggagccaggccccccagctgtccccagctcttctccgagccctcggacagaagtgccccaacctcaagagactgtgcctacatgtggcagatctcagcatggttcccatcacctccctgccctctactttgcggaccctggaattgcactcgtgtgagatctccatggcttggctccacaaacagcaagaccccaccgtgttacctctgctcgagtgtatagtattagaccgggtcccagccttcagagatgaacatctgcagggcctgactaggttccgagcccttcgcagtctcgtcctcggcggtacataccgggtgacagagactggcttggacgcagggttacaggagctctcctatctccagcgactggaagttctgggttgtacgctttccgccgatagcacattgcttgcaatatcaaggcatcttcgcgacgttagaaagattcggctcacggtgagaggactgtcagctcctggattagccgtgctcgagggaatgccagcgctggaaagcctttgcttgcaaggccccttggtgacgcctgagatgccatctcctaccgaaattctgtcgtcctgcctgaccatgcctaaattaagggtcctggagttgcaagggctgggatgggaaggacaggaagctgaaaaaatcctgtgcaagggcctcccccattgcatggtcattgttcgggcatgccccaaggagtctatggactggtggatgtag

SEQ ID NO: 22870 - DNA, 3090 bp, Artificial Sequence
  Description of Artificial Sequence: Synthetic coding sequence
atggccagcgaggccgtgaaggtggtggtgcggtgccggcccatgaaccagagagagcgggaactgcgctgccagccagtggttaccgtcgattgcgcacgtgcacagtgctgtatacagaatccaggcgccgccgacgagccgcccaaacaattcacctttgacggggcgtaccatgtcgaccatgtcaccgagcagatctacaacgaaattgcgtatcccctcgtcgagggggtgaccgagggctacaacggaactatattcgcctatggccagaccggctctggaaaaagcttcacgatgcagggactgccagaccccccttcacagagagggattattccccgagccttcgagcatgtttttgagagcgtacagtgcgccgaaaacaccaagtttctggttcgggcttcatatttggaaatctataatgaagacgtcagagacctcctgggcgcagacactaaacaaaagctggaacttaaggagcaccctgaaaagggggtctacgtgaaaggactgtccatgcacaccgtccactcggtcgcgcagtgcgagcacatcatggaaacaggttggaaaaataggtcagtgggctacactttgatgaataaggacagtagtcgaagtcacagcatcttcaccattagcattgaaatgtcagcagtggacgagaggggcaaggatcatctgagggcaggtaagcttaatctggttgatctagccgggagtgagcgacagagcaagactggcgcaaccggggaaaggctaaaagaagctacaaaaatcaacctctctcttagcgccttgggcaacgtcatctctgcactcgtagacggccggtgtaaacatgtcccatatagggattctaagctgacaagacttttacaggactcactgggcggtaacaccaaaactcttatggtcgcatgtctatccccggccgacaacaactacgacgagacactttcaaccctgcgatatgcaaacagagcaaaaaatatcaggaataagcctaggatcaatgaggatcccaaggacgctctcttaagggaataccaagaggagataaagaaactgaaagcgattcttactcaacaaatgtcaccgagctccctgtcagcccttctgtctagacaggtgccaccagaccctgtgcaggttgaggaaaaactgctcccccagcccgtgatccagcatgacgtggaggctgaaaaacagctgataagggaggaatacgaggagagacttgctaggctgaaagccgactataaagcggaacaggagtccagagcaaggctcgaggaagacatcactgcgatgcgaaactcgtatgatgtccgcctgagtaccctcgaagaaaacttgcggaaagaaactgaggcagtgcttcaagtgggggtactctataaggccgaggtcatgagtcgggccgagtttgcttcttctgctgaatatccgccagctttccagtacgagaccgtggtcaaacctaaggtgttttcaactaccgataccttgccctcggatgatgtgagcaagacccaggtcagttctcggtttgcggaactgccgaaagtcgagccttccaaatctgagataagcctaggcagctctgaatcgagctctctggaagaaacctctgtgagcgaggcctttcctggtcccgaggaacccagtaatgtggaggtcagtatgcctacagaggagtcccggtcaaggtatttcttagacgagtgtttgggtcaggaggcagcgggccacctgctgggtgaacaaaattacctccctcaggaggagccccaggaggtccccctacaaggactgctagggctccaggatcctttcgcagaagtcgaggccaagctggctaggctgagctctaccgtggcacgcactgacgcccctcaagcggatgtgccaaaagtaccagtgcaagtgcctgctccaaccgatcttcttgagccttccgatgctcgacctgaagcggaagccgccgatgactttccacctcgccccgaggtggacctcgcctctgaggtcgcactggaagtggtcagaaccgctgagcctggcgtatggctggaggcgcaagcaccagtcgctttagtagctcaaccagagccacttcccgctaccgctggagtgaagcgagagagtgtgggcatggaagtggctgtactcacggatgaccccttgcctgtggtggatcagcagcaagtcctcgccaggctccaactcctcgagcaacaggtcgtcggcggtgagcaggccaaaaataaggatcttaaagagaaacacaagcgcagaaagcgctatgcagacgagagaaggaagcaactagtggcagcccttcagaacagtgacgaagacagcggcgactgggtgctcttgaacgtttacgactcaatccaggaggaagttcgcgcaaaatcaaaattgctggagaaaatgcagaggaaactgcgggccgctgaggtggagataaaagatttgcagagtgagtttcaactggagaagatcgattacttggctaccattaggcgccaagaacgggatagcatgttgttacagcagctgctggaacaagtgcagccattaatccgtcgtgattgcaactatagtaacttggagaaaattctgagagagtcatgttgggacgaagacaacggcttttggaagattcctcaccccgtgataactaaaacttcccttcccgtggccgtgagcaccggtccacagaataagcccgcacggaaaacaagcgcggctgataatggtgagcctaacatggaggacgacagatatcgcctgatgctttctaggtcaaactctgagaatattgccagtaactattttcgttctaaacgtgcctcacaaatcctcagcactgacgccaggaagagcctcacacaccacaactctcctcctggcctgtcttgcccgctgagtaataactcggcgattccacctacccaggcccctgaaatgccccagcccagaccatttcggcttgagtcccttgatattccattcaccaaggccaaacgcaaaaaatcaaagtccaacttcggctctgagcctctctag

SEQ ID NO: 22871 - DNA, 417 bp, Artificial Sequence
  Description of Artificial Sequence: Synthetic coding sequence
atgatcctgcagcagcccctgcagcggggcccccagggcggcgcccagcgcctaccacgggccgccctaggcgtgacctggggactcgacgcgtccagtcctcttaggggcgccgttcccatgagcacgaagcggcgcctggaagaggaacaagagccattgagaaagcagttcctgagcgaggagaacatggccacgcacttcagtcaactgagtctgcacaatgaccacccatattgcagccctccgatgacgttctccccagccctacccccactgaggtcgccctgcagtgagctgcttctctggaggtacccaggatccttgattcctgaggcacttcgactgctaaggctgggagacactccaagcccgccttatcctgcaacacctgcaggtgatatcatggaattgtag

SEQ ID NO: 22872 - DNA, 573 bp, Artificial Sequence
  Description of Artificial Sequence: Synthetic coding sequence
atgttccaggtgcccgacagcgagggcggccgggccggcagccgggccatgaagcccccaggaggcgaatctagtaacctgttcggctcacccgaggaggccacccctagcagccgccccaatagaatggcgagtaatatattcggcccaaccgaggaacctcaaaacatacccaagaggaccaatccacctggtggcaagggcagcggaatttttgatgagtctactcctgtgcagacacgccagcacttgaaccccccaggcggcaaaacaagcgatatctttggttcccccgtgacggccacgagcagacttgcgcaccccaataaacctaaggaccatgtatttctgtgtgaaggtgaggagccgaaaagtgatctaaaggctgcccgctcaatcccagccggcgcggagcccggcgaaaaagggtccgctcgtaaagcaggtcccgctaaggaacaggagcccatgccgacagtggacagtcacgagccgcggctcggaccaaggcccaggagccacaacaaggtgctaaatccaccaggagggaagtcaagtatctccttctattag

SEQ ID NO: 22873 - DNA, 690 bp, Artificial Sequence
  Description of Artificial Sequence: Synthetic coding sequence
atgacctgctgcagccaggtgcccccccggcggcggcccagcctggccctgtctccgcggctggattgtaatggactaaacggtgtgcccgggtctatttgggacttcgtctccgggtctttcagtccctcaccatcccctattcttagcgccgggccaccatcttcctcatccgccagtccgaacggagccgagttagcacgggtgaggaggcagctcgatgaagctaagaggaaaatacgtcaatgggaggagtcttggcagcaggtgaaacaggtgtgtgatgcttggcagcgggaagcgcaggaggctaaagagcgtgcgcgagtcgctgactccgaccggcaattggcattgcagaagaaggaggaggtggaggcacaggtgaagcagctccaggaggaattggaaggtctgggcgtagcaagcacgctaccagggctgcgcgggtgcggcgacattggtactattcctttgcctaagttgcacagtcttcagagccagctgagactggatctcgaagcagtggatggggtcatcttccagctacgggctaaacagtgtgtggcttgcagagaacgggctcacggagcggtcttaagaccctgtcagcatcacatactttgcgagccatgcgccgccactgctcctgagtgcccctattgtaagggacaacctctgcagtggtag

SEQ ID NO: 22874 - DNA, 5460 bp, Artificial Sequence
  Description of Artificial Sequence: Synthetic coding sequence
atggccagcatcacccagctgttcgacgacctgtgcgaggccctgctcccagccgccaagacccacctgggacaacggtcggtcaatcggaagagggctaagaggtctctcaagaaggtggcgtataatgctctttttaccaatctcttccaggacgagactcagcagcttcagcctgacatgagcaagttgcctgccagaaataaaatcctcatgctctcctttgacctccgtgtgggcggactggggccgaaagctgataggctagaggagctcgtggaggagctagaagcggccccatgctgcccattgttggaggtcggctccgttttagacttactcgttcagctagcgggtagcgggcctccccaggtgctgcccaggaagagggactactttctaaacaataagcacgtgggacggaacgtcccttattctggttacgattgcgatgacttaagcgtgtttgagatggatgtccagtccctgatctcgagggaggagtgcctgtgccattccatgatccaggagactctgcaggtgatggaagccgcccctggaacaggtctccccaccgtcggactgtttagttttggagatccatgtggcgaccgcttcgaaagggacactcgagttagcttgtttggagcccttgtccactcacgcacctacgatatggacgtgcgtttaggccttccacccgtacctgataatgcagacctgtctggactggctattaaggttccaccttcagtcgaccagtgggaagacgagggcttccaatcagcctccaacctgacacccgacagccagtccgagccgtcagtcactccagatgtggacttgtgggaggcggcactgacatacgaagcctcaaagagaagatgttgggaacgggtcggctgcccaccgggacaccgcgaggagccttatctgacagaggcgggcagagatgcattcgacaagttctgtagactccaccagggcgaactgcagcttcttgcgggaggggtgctgcaagcaccacagcctgtcctcgtcaaggagtgcgaacttgtcaaagacgttctaaatgtactcattggagtggtgtctgccacattcagcttatgtcagcccgcgcaggctttcgtggttaagcggggggtccacgtctcaggggcttcccccgagtccattagttccctcctgagcgaggtggcagagtacggcacgtgttatactcggctcagccacttcagcctgcaacctgtgctggactctctctattccaagggtctggttttccaagcctttacttccggactgaggaggtatttgcaatactacagagcctgcgtgttgagcacccctcctaccctttccctcttaaccataggttttctttttaaaaagcttggtcgccagctcagatatctggccgaactgtgtggcgtaggggccgtgctgcctggcacatgtggcggtggccctagggccgcattccccacgggcgtcaaactcttaagctatctttaccaggaggccttacacaactgcagcaacgagcactatcccgtgttactgtcccttctgaagacttcatgcgaaccctatactagattcattcacgattgggtgtacagcggggtgttcagagatgcttatggcgaattcatgatacaggtgaatcacgaatacttatcttttagggataaactctactggactcacggctatgtcctgatttccaaagaggtagaggactgcgtccctgtgttcctaaaacatattgcccatgacatctatgtgtgtggcaaaacaataaatctgctgaagctgtgttgcccacggcactacctgtgctggtcagacgtacctgtgcctagaatatctgtgatctttagcctggaagagttaaaagagattgagaaggactgcgccgtctatgtaggaagaatggaacgggtggcgagacactccagcgtctctaaagaagagaaagagctcagaatggagatcgcaaaacaggagctaattgcccatgctagggaagcagcttcaagagtactttcagccttgagtgatcgacagatgagcgaaaggatggcactagatgctcggaaaagggaacaattccaaagactcaaagagcagtttgtaaaggaccaggagagacggcaagctgctcggcaggaggaattggatgatgatttttcctatgccagagaattgcgcgatcgcgagcgccggcttaagtctctggaggaagagctggaacgcaaggcacggcaagctctcgtcgatcactattccaaactttctgccgaggccgcccgcagggagcagaaggccttgtggaggattcagcgacatcgtctggagagcgcacggcttagatttttactggaagacgagaagcatatccaggagatgctgaaggctgtgtccgaggcccaccagcctcaggagccacccgacgttctcttgtcagtgcacccgcaagtgactagcccaggacctgagcatcccgagggcggacaaggttgtgactctggcagtgcggaacaacattcaccggcttgggacggatggaaccgccctggccttcttacaccccagcccctcaagcccctggccgtgggagcgggcggacggggcctgcagcaggcagagggagccagacctttttccgatagtctgtcaattggggatttcctcccagtcggccccggcgcagaaccttccgtgcagaccggcatggtgcctttgcttgaggtggcactccagacgatcaatctggatctcccaccttccgcaccaggagaagcacccgcagcagcaagcactcagccttcacggcctcaggagtacgacttctcaacagttcttcgacccgctgtagcaacatcacccgcccctgggccactgcaagcagcagagtgcagcttgggaagctccggactacaattgtgggaggattcctgcggaaagatggacgcctgcggatccgctagcagggaaaccctcctgccttcacacccaccccgccgtgccgctctagaggagggatccagccaaccgacagaacggctcttcggccaggtctctgggggcggcctgccaactggggactatgcttccgagatcgccccaacccgccctagatggaatacacacggacacgtttctgatgccagcattcgcgtcggcgagaatgtgtcggacgtggcccccacgcagccccggtggaacacacacggacacgtgagtaacgcatccatcagcctcggcgagtccgtttctgatgttgcccctactcgcccccggtggaacatccatggacacgtgtctaacgcatctatccgagtgggcgaaaatgtgtctgacgtggctcctacgcggccccggtggaacacacacggccatgtctcaaacgcaagcatcagggttggtgagaacgtcagtgacgtagccccaacccggccccggtggaatactcatggacacgtttcagacgcttcaatctcacttggggagagtgtgagtgatatggcacctgccaggccacgctggaacacacatgggcatgtgtccgacgcctctatttccttgggggaatcagtgagcgatatggcccccactcggccgcgctggaacactcacggccacgtgtccgatactagtatccgcgtgggggagaacgtctccgatgtggcaccaattaggtccaggtgcaacactcacggccacgttagcgatgctagtattagtctgggtgagcctgtgagtgatgtcgtaagcacccggcccagatggaacacacatgttccaattccaccacctcatatggtgttaggcgctcttagcccagaggctgagccaaacaccccccgacctcagcagtcaccaccgggacacacatcccagagcgccctgagtctgggagctcagtccactgtgttggattgcgggcctaggttgcccgtggaggtgggaccctccctcagttcacctagctctggctgtggtgagggcagcatctcagtcggcgagaacgtgagcgacgttgcgccgacccagccatggtggcctaacactcccggtgactctgtgtccgaggagctcggacctgggcggtcaggggacacggaggacctttccccgaactggcctctgaactcccaagaagacacagctgcacaatctagcccgggtcggggggaggaagccgaagcctcagccgcagaagcccaggggggcgagcaagcgtatctagccggactcgccggccaatatcacctggaacgttatcccgatagttatgagagtatgtcagaacccccaatcgcacacctcctgcgcccagtgctacctcgtgccttcgcctttccagtggaccctcaagtccagtcagcagccgatgaaaccgcggttcagctttccgagctcctgaccctgccagtgcttatgaaacgctctatcacagccccattagctgcccatatttcactggtaaacaaggcagcagtggattatttcttcgtggaactccatctggaagcccattacgaggcactgagacacttcctgttgatggaagatggtgagttcgctcagtctctcagcgatctgctgttcgagaaactcggggcaggtcagacccctggtgaactgctaaatcctctggtgctgaactctgttctgagtaaggccttacagtgctctcttcatggagataccccgcacgcctccaatctttcactcgctctgaaatatctcccagaggtgttcgcccccaatgcaccagacgtgttgtcgtgtctggaactgagatataaagtcgattggcctctaaatatagtgataaccgagggctgcgtgagcaagtactccggggtcttcagttttctcctgcaactcaagctcatgatgtgggctctgaaggacgtctgctttcacctgaaacgcactgcgttgttatcccatatggcagggagtgtgcagtttcggcagctgcaactcttcaagcacgaaatgcagcatttcgtcaaagtgattcagggctatattgctaaccagatcctccatgtgacttggtgtgaattcagagccagactggccaccgtcggggatctcgaagagatccagcgcgcgcatgctgagtatctgcacaaggctgtattccgcggtctgctgactgaaaaagcagctccagttatgaacgtgattcactctatattctcactggttctcaagttccgcagtcagctgataagtcaagcttggggccctcctggaggcccacgcggcgccgagcaccctaacttcgcattgatgcagcagtcctataacacttttaagtactattcacatttcctgtttaaggtggtcactaagctggtaaaccggggctatcagcctcacctggaagattttcttctaaggatcaattttaacaattattatcaggacgcatag

SEQ ID NO: 22875 - DNA, 2250 bp, Artificial Sequence
  Description of Artificial Sequence: Synthetic coding sequence
atgagcggcagccacacccccgcctgcggccccttcagcgccctgactccatcaatttggccgcaggagattttggcaaaatacactcagaaggaggagagcgccgagcagccggagttctactacgacgaatttggctttcgcgtctacaaggaggaaggcgacgagccaggcagcagtctgctggcgaatagtcctcttatggaggacgcgcctcagagactgcgctggcaggcacacttggagttcacacataaccacgatgtgggggacctaacatgggacaaaattgcagtgtctctccctcggtctgaaaaactgagatccctggttctggctggtatcccacatggaatgcggccccagctgtggatgcgcctcagcggtgctctccagaaaaaacgcaacagcgaactgagctatagggaaatcgtgaaaaatagttcaaatgacgagacaatagcggctaaacagatcgaaaaggaccttctgaggaccatgccatcaaatgcatgcttcgcgtcgatggggtcaattggggtcccacgtttgcggagggtgctaagagcattggcctggctctaccctgagattgggtattgtcaaggcacaggaatggttgccgcctgtctgctgctttttctagaggaggaggatgctttttggatgatgagcgcaattatagaggacttgctgccagcttcctatttttctactaccctgctaggcgtccagaccgaccaacgtgtgctcagacacctgatcgtgcagtacctgccccgacttgacaaactgctgcaagagcatgacattgagctgagcctaatcacactgcattggtttctgacagcatttgccagcgtagtcgatatcaaattgctgctccggatttgggatctgtttttttacgaaggctcaagagtgctctttcaactgactctggggatgctacatttgaaggaggaggaactaatacagtccgagaattctgcctcaatattcaacacactctctgacatccctagccagatggaggatgccgagctgctgctgggggtagccatgcggctggcaggttcactgactgacgttgctgtggaaacgcagagacgcaagcatttggcctacctcattgctgaccaggggcagctgctgggagctggcactttgaccaatttatcccaagtcgtgcgccggaggacccagcggaggaagagcaccatcacggcccttttatttggggaagatgaccttgaggccctgaaggcgaagaacataaaacagactgagctggtagccgatctgcgggaggcaattctgcgcgtcgccaggcattttcagtgtaccgatcctaagaattgtagcgtcgaactgactccagactattctatggagtctcaccaaagggatcatgagaactacgtggcctgctctaggagccacaggagacgcgccaaagccctgctggatttcgaacggcatgacgacgatgagctcggcttcagaaagaacgatattattacaatcgtctcacaaaaggatgagcactgctgggtgggcgagctcaacggattacgcgggtggttccctgcgaagttcgtcgaagtactcgacgagaggagcaaggaatactctattgctggcgacgacagcgtcaccgaaggagtcaccgacctggtcaggggcactctgtgcccagctctcaaggccttgttcgagcacggcttgaagaagccttctctgctggggggcgcgtgccacccatggctattcatcgaggaggcagctggccgcgaagtggagcgagacttcgcatcagtatacagtagactggttctctgtaagacttttcgtcttgacgaggatggtaaggtactcacccctgaagagctgctgtacagagcagtgcagtcggtgaatgttacccatgacgccgttcacgcgcagatggacgtcaaactgcgatcgctgatatgtgtcgggctcaacgaacaggtattacacctgtggctggaagtgctttgcagtagccttcctacggttgaaaaatggtaccagccctggtccttcctgcgttcacccggttgggttcagattaagtgtgaattaagggtgctgtgctgtttcgctttttctttgtcacaagactgggagctgcctgctaagagagaggcccaacaaccactgaaggagggcgtccgcgatatgctcgttaaacatcatctattctcttgggacgttgacggatag

SEQ ID NO: 22876 - DNA, 2097 bp, Artificial Sequence
  Description of Artificial Sequence: Synthetic coding sequence
atgctgagccccaagatccggcaggcccggcgggcccggagcaagagccttgtgatgggggaacagtcacggtcccccggccggatgccttgcccccaccgcctcggcccagtccttaaagctgggtggttgaagaagcagcgttcaattatgaagaactggcagcagcgctggtttgtactgaggggtgaccagctcttttactacaaggataaagatgaaatcaaaccacaaggtttcatctcactacagggtacgcaggtcacagagctacctcctggaccagaggacccaggaaaacatcttttcgagatcagccctggaggcgctggagaacgtgaaaaggtgcccgcaaacccagaggctctgctactcatggctagtagccaacgggatatggaggattgggtccaggctatcagaagagtaatctgggcgccactgggtggggggatcttcggacaaaggttggaggaaactgtccaccatgaaaggaagtatggccctcgtctagccccgttactagtcgagcaatgcgtcgacttcatcagggaaaggggcttgaccgaggaaggacttttccgaatgcctggacaggccaatctggtaagggacctccaggactcattcgattgtggcgaaaaacctctcttcgactccactactgatgtacataccgtggcctcccttttaaagctgtatctccgcgagttgccagaacctgttgtgcccttcgccagatatgaagattttctaagttgcgcacagctgcttaccaaagatgaaggggaggggactctggaattggcaaagcaggtcagtaatttgccacaagctaattacaatctgctgcgatacatttgcaagtttctggacgaagttcaggcttattccaatgttaataaaatgagcgtgcagaacttagccacggtttttggacccaacatactgaggccacaggttgaggaccccgtgaccataatggagggcacaagcctggtgcaacaccttatgaccgtcctgatccgtaaacattcccagctctttacggcccctgtgccggaaggccctacaagccctagaggcggtctgcagtgcgctgtggggtgggggagcgaggaggttacaagggactcccagggggagcctgggggaccggggttgcccgcacaccggacctcttccctggacggcgcggccgttgctgtcctctctaggacagccccaactggtcccggatcccggtgcagtccagggaagaaagtgcagaccctgccctcttggaagagctctttcaggcagcctcgtagcctctcaggttctcctaagggcggcggatcctcactcgaagtgccgataataagctccgggggcaattggctaatgaacggcctctcctctctgcgtgggcaccgacgggcttcatccggcgatcgcctcaaagacagcggatccgttcagcgcctgagcacgtacgacaatgtgccggccccaggcctggttcccggcataccgtcggtcgccagcatggcttggagtggcgcctcatcctctgaatcttcagtggggggaagcctctctagctgcacagcgtgtcgagctagcgactcctcagctcggagctcactgcacacagattgggctctcgagccatcaccgcttccttcctcatctgaagatcccaaaagccttgatctggaccattccatggacgaagcaggggctggtgcttcaaattctgaaccaagcgaacctgactcacctacaagggaacacgccagacgctcagaagcacttcaagggctggtgaccgagttgcgcgcagagctgtgtcggcagaggaccgagtatgagcggtccgtaaaaagaattgaagaaggatcagcagatctgagaaagaggatgtccaggttagaggaggagctcgaccaagaaaaaaagaagtatataatgctggaaataaagctcaggaactccgaacgggctagagaggatgcggagaggagaaatcagcttctgcagagagagatggaggagttttttagcacactcggttcacttactgtgggcgccaagggggcccgagctcctaaatag

SEQ ID NO: 22877 - DNA, 180 bp, Artificial Sequence
  Description of Artificial Sequence: Synthetic coding sequence
atgacccggggcaaccagcgggagctggcccggcagaagaacatgaagaagcagtcggatagtgtgaaaggtaaaaggagagatgatggtctcagcgcggctgcgagaaagcagagagattctgagataatgcagcagaagcaaaagaaagccaatgagaagaaggaagagccaaaatag

SEQ ID NO: 22878 - DNA, 372 bp, Artificial Sequence
  Description of Artificial Sequence: Synthetic coding sequence
atggcccggtacgaggaggtgagcgtgagcggcttcgaggagttccatcgggctgtagagcaacacaatggaaaaacgatcttcgcttactttaccggcagcaaggatgcaggcggcaaaagctggtgcccagattgtgtccaggctgaacctgtagtgcgggaaggtctgaaacatatttccgaggggtgcgtgttcatttactgtcaggtgggcgaaaagccttattggaaggaccctaacaatgatttcaggaaaaatttaaaagtgactgccgtgccaacactcttgaaatacggcactccacaaaaactggttgaatctgagtgtcttcaggctaacctggtggagatgctgttctccgaggactag

SEQ ID NO: 22879 - DNA, 1401 bp, Artificial Sequence
  Description of Artificial Sequence: Synthetic coding sequence
atgggctggatcaccgaggacctgatccggcggaacgccgagcacaacgactgcgtcatcttcagcctggaggagttgagcctacaccagcaagagatcgagcgcctggaacacattgacaaatggtgtagggatctcaagatactgtatctgcagaacaacctgatcggtaaaatagaaaacgtcagtaagttgaagaagttggagtaccttaacttggccctgaacaacatcgagaaaattgagaatctggagggatgtgaagagctcgcaaaattggacctcacagtgaatttcatcggcgagttatcctccatcaagaatcttcagcataacattcacctgaaagaattgttcctgatgggtaatccttgcgcatcatttgaccattatcgggaattcgtcgttgctaccctgccacaattaaagtggttggatggcaaagaaatcgaaccaagtgagaggattaaggcactgcaagattattccgttatcgagccgcagatacgtgagcaagaaaaggatcattgcctcaagcgtgcaaagctcaaagaagaagcccagcgtaagcatcaagaagaggacaagaatgaagacaagaggagtaacgccgggttcgacggcaggtggtacactgatataaacgccacactgagttctctggaatcaaaagatcacctgcaggcgcctgacacagaagagcataatacaaaaaaactggacaactcagaagatgatctggagttctggaacaagccgtgcctgttcacacccgaatcaaggcttgagaccctgcgccacatggaaaagcaacgaaagaagcaggagaagctatctgagaaaaaaaagaaggtcaagccccctagaacactcataactgaggatggtaaggccttaaacgtgaacgagcccaagattgattttagccttaaagataacgaaaagcaaataattctggatctagcggtgtatcggtacatggacacttcccttatcgacgttgatgtgcagcctacatacgttcgagttatgattaaggggaaacccttccagctggtattgcccgctgaagtcaaaccagatagtagctcagctaagaggtcgcagacaaccggacacttggttatttgtatgcctaaagtgggagaagtgataacgggcgggcagagggcattcaagagcatgaagaccactagtgatcgaagcagagaacagaccaatacccgttcaaaacacatggagaaactagaggtcgatccgtctaagcactccttcccagacgtgacaaatattgtgcaagagaaaaaacacacccccagaaggaggcctgagcctaaaatcattccatccgaagaggatccaacattcgaggataaccctgaggtccctcccctgatttag

SEQ ID NO: 22880 - DNA, 1050 bp, Artificial Sequence
  Description of Artificial Sequence: Synthetic coding sequence
atggaggacccccagagcaaggagcccgccggcgaggccgtggccttagctctgctggaaagcccccggcccgaggggggggaggagcccccccggcccagcccagaggagacccaacaatgtaagttcgacgggcaagagaccaagggcagcaagtttataacctccagcgccagcgacttttctgaccctgtgtacaaagagatcgcgattaccaacggttgtataaatcggatgagtaaagaggagctgcgagccaaactgtctgaattcaaactagaaactagaggggtcaaggatgttcttaaaaaacggttaaagaattactacaaaaagcagaaattgatgcttaaggagtcgaacttcgcagatagctattacgactatatttgcatcattgatttcgaggctacatgcgaggaaggtaaccctcctgagtttgtgcacgagattattgagttccccgtagtgttgctgaacacccacacactggaaatcgaggacaccttccagcaatatgtgaggccagagatcaatacccaattgagcgatttctgtatctcgttaaccggaataacccaggaccaggtagacagggcagacacattccctcaggttctgaagaaggtcattgactggatgaaactgaaagaactggggacaaaatataaatatagcctgctcacagacgggtcctgggatatgtccaagttcctgaacatccagtgccaactaagcagactgaagtacccaccattcgctaagaaatggatcaatataaggaagtcatatggcaacttctataaagtcccacgcagccagaccaaactgaccattatgctagaaaagctcggtatggactacgatggacggccgcattgcgggctggacgattctaagaacattgctcggatcgctgtgcgtatgctgcaggacgggtgcgagctacgaatcaacgaaaagatgcacgccgggcaacttatgagcgtcagttccagcctccctatcgaaggcacgccaccaccccagatgccacatttccgaaaatag

SEQ ID NO: 22881 - DNA, 843 bp, Artificial Sequence
  Description of Artificial Sequence: Synthetic coding sequence
atgctgagcgccgtggcccggggctaccagggctggttccacccctgcgcacgcttatcagtgcggatgagttctacaggaattgacaggaaaggagtgctggcgaatagagtggctgtggtgaccggctccacctctgggatcggattcgcaattgcccggcgcctggccagagacggcgcacacgttgtcattagtagcaggaaacagcaaaatgtcgaccgggctatggctaagctacagggcgagggcttatccgtcgctggcatcgtttgtcacgtaggaaaggctgaagatcgcgaacagctagtcgctaaagcattagaacattgcggcggcgtggatttcctcgtatgtagcgcgggggtgaatccacttgtggggagcacgcttgggactagtgagcaaatttgggacaagattttgtctgttaacgtcaagtccccggctctactgctgagtcagctcctgccgtacatggaaaatcgcagaggggccgtgattctggtgtcttcaatcgccgcctacaaccccgtggtcgctctgggtgtgtataatgtaagcaaaacggccctgctgggcctcaccaggacactcgccctggagttagcccccaaagacatccgtgtaaactgtgtggtccctggtatcatcaaaaccgacttcagcaaggtttttcacgggaatgagtctctatggaagaacttcaaggagcatcatcagttacagcggattggcgagagtgaggattgcgcagggatcgtttccttcctgtgctcccccgatgcttcatatgtcaatggggagaatatagctgtcgctggctactcaacacgactttag

SEQ ID NO: 22882 - DNA, 909 bp, Artificial Sequence
  Description of Artificial Sequence: Synthetic coding sequence
atggtgaccgagcaggaggtggacgccatcggccagaccctggtggacccaaagcagcccttgcaagctcgcttcagagccctgttcacactcaggggccttgggggccctggtgccatcgcgtggatctctcaagcttttgacgacgactctgccttactcaaacatgaactggcctattgtcttggacagatgcaggatgcaagagccatccctatgctggtggatgtgttacaggatacccgacaagagcccatggtcagacatgaagcgggggaggccctaggcgcaatcggagatcctgaagtgttagaaattctcaaacagtacagcagcgatccagtcatagaggtagcagaaacatgtcaactggccgtgaggaggctcgaatggctacaacagcacggcggtgaaccagccgcaggaccatatctcagcgtggatcccgccccccccgccgaggagagggacgtgggccgattgcgcgaagcactcctcgacgagagccggccgctcttcgagcgctaccgcgcaatgtttgcccttagaaatgctggaggcgaagaggcagcactggcgctggccgagggactacactgtgggagtgctttgttcagacacgaggtcggctacgtgttaggccaattgcagcacgaagctgcggtcccgcagctggctgccgctctggcacgatgcacagaaaaccccatggtgagacacgaatgtgccgaggctctgggagctattgcacggcctgcctgtctcgctgctctgcaagcacacgccgacgaccctgaacgcgtagtgagagagtcttgcgaagtagctctggatatgtacgagcacgagacaggacgcgcgtttcagtacgccgacgggttggagcagcttaggggcgctccctcttag

SEQ ID NO: 22883 - DNA, 3384 bp, Artificial Sequence
  Description of Artificial Sequence: Synthetic coding sequence
atggaggtgcaggtgagccaggccagcctgggcttcgagctgaccagtgtagaaaagtccctgcgggagtggtcacgtctcagccgggaggtgatcgcttggctgtgcccttcaagccccaatttcatcctgaactttccgcccccacccagtgcttcttcggtgagcatggtacagcttttctcttccccgttcggctaccagagcccatccggacacagcgaagaagaacgtgagggcaatatgaagagcgccaaaccccaggtaaatcactcacagcatggagaatcacagcgagccttgtccccacttcaatccacactatcatccgcagcaagcccatcacaagcctacgagacctacattgaaaatggcctgatatgtctgaaacacaaaatcagaaacattgagaaaaagaaactcaagctggaagactataaggacaggttgaagagcggggagcatttgaatcctgatcagctggaggccgttgagaagtatgaagaggtgctgcataatctggagttcgctaaagagttgcagaagaccttctccggactgtccttagatcttttaaaggcacagaagaaggctcagagaagagagcatatgttgaaactcgaagccgaaaaaaaaaagttgaggactatcctccaggtacagtacgtccttcagaacttgactcaagaacatgtacaaaaggatttcaagggtgggctaaacggggccgtatatctaccatccaaagaactggattacctgattaaattttcaaagcttacttgtcctgaacgaaatgaaagtctttcagtggaggatcaaatggagcagtcttcactgtacttttgggacctgctggaaggcagcgagaaggctgtggtcggcacaacttataaacatctgaaagatctcctatctaaactgctgaatagcggatactttgaatccatccccgtccccaagaatgcaaaggagaaagaagttccacttgaggaagaaatgcttattcagtccgagaaaaagacgcagctgtctaaaaccgagtcagtgaaggaaagtgaaagcttaatggaattcgcccaacccgagatacaaccccaggagttcttgaataggagatacatgacggaagttgattattccaacaagcagggtgaggaacagccatgggaagctgactatgccagaaaacctaacctgcccaaacgctgggatatgctgactgagccagatgggcaggaaaaaaaacaagaaagttttaagagctgggaagccagtggcaaacaccaggaggtaagtaaacctgcagtgtcactggagcaaagaaaacaggatacaagtaagctaaggagcaccttgcccgaagaacagaaaaaacaagaaattagtaagtcaaagcctagtcctagtcagtggaagcaggatactcccaagtccaaggcgggctatgttcaggaagagcagaagaaacaggaaacaccaaagctctggcctgtccagttgcagaaggagcaggaccccaagaagcaaaccccaaagagttggacaccatcaatgcagagcgaacagaataccactaagtcctggaccactccgatgtgtgaagaacaagattccaagcagccggagaccccaaagtcatgggagaacaatgtggaatcccagaaacacagcctgactagtcagtcccagattagtcccaagtcctggggcgtggctacagcatctctgatccccaacgatcagctgttgccccggaaactgaatacagagcctaaagacgtgccgaagcctgtacatcagcccgtgggatcttcctctacactacctaaggatcctgtgctgcgaaaggaaaaactgcaggaccttatgacccagattcaagggacttgtaatttcatgcaggagagcgtgttggattttgacaagccaagttcggctattccaacaagccagcctccctccgccacccctggctcacctgtggcctctaaggagcagaatctttctagtcaatccgatttcttgcaggagccacttcaggccacatcctctcctgtgacttgttcctctaatgcatgcttggttactaccgaccaggccagtagcggcagtgagaccgaatttatgacctcagaaactcccgaagccgcaattccccccggcaaacaaccatcctccttggcctcaccaaatccacccatggcgaagggttctgaacaggggttccagtctccgccagcgagttcatctagtgtgacaatcaatactgcgccgtttcaggccatgcagacagttttcaatgtcaacgcccctctgccccccagaaaggagcaggagattaaggagagcccttacagccctggttataaccagagtttcactacggcctctacacagacccccccacaatgtcagctgccatcaattcacgtggagcagactgtccactcccaagaaaccgccgccaattatcaccccgatgggaccatccaagtctcaaatggatcactggccttctatcctgcccagacgaacgtgttcccccgacccacccaaccattcgtcaattctagaggcagcgtgagaggatgcacacgaggaggtcggttaatcaccaactcctatcgaagccccggaggctacaaaggatttgatacttaccggggcctgcccagcatttccaatgggaactactcccagctgcagttccaggctcgtgagtatagcggtgctccctactcgcaacgcgacaatttccagcagtgctacaagaggggaggtacctctggtggaccgcgagcgaattcccgggctggttggtcggatagttcgcaggtgagttcaccagagcgcgacaacgagacatttaattccggtgatagtggacaaggtgactcacgtagcatgaccccagttgatgtgccagtaacaaacccggccgctacgattctccctgtacacgtctatcctctgcctcagcagatgagagtggccttcagtgctgcaagaacgtccaatcttgctcctggaactctggatcagccgatcgtgttcgatctccttcttaataacctaggagagactttcgatctccaactgggaaggttcaattgtcccgttaacggtacgtacgttttcatttttcacatgctcaagctagcggtcaacgtgccactatacgttaacctgatgaaaaacgaagaggtactcgtgagtgcttacgccaacgatggagcccccgatcacgagactgcctcaaaccacgctatcctccagttattccagggcgatcaaatctggttgagacttcacaggggagccatctacggttcttcttggaagtactctaccttctccggctacctgttgtaccaggattag

SEQ ID NO: 22884 - DNA, 2448 bp, Artificial Sequence
  Description of Artificial Sequence: Synthetic coding sequence
atggaggtgcgggccagcctgcagaaggtgagcggcagcagcgacagcgtcgccacaatgaattcagaggagttcgtcctcgtgccgcagtacgccgatgacaacagtaccaaacacgaagagaagcctcagctgaagattgtaagtaatggtgatgagcagctggaaaaagctatggaagagatcctgagagattcagagaaacgaccatcttccctgctggttgattgtcagagttcatctgagatatctgaccactcctttggggacatacccgcaagccagacaaacaagcccagcctccagctgatcctggaccccagcaatacagagatcagcacaccccgaccaagcagtcccggaggtctgccagaggaggattctgtactattcaacaagctgacgtatcttggctgcatgaaagtcagctccccaagaaatgaagtggaggccttgagagccatggccactatgaagagctcatcccagtaccccttccccgttacactctatgtcccgaacgtccctgaaggttcagtgaggatcatcgaccagtcctccaatgttgaaatcgcctcttttcctatatataaggttctgttttgtgccaggggtcacgatggaaccactgagagtaactgctttgcgtttacagaatcctcccatggatcagaggaattccagattcacgtttttagttgtgagatcaaagaggctgtgtccaggatcctttactccttttgtacagcttttaagaggagctctagacaagtcagcgatgtgaaggactccgtcatacctacacccgactctgacgtgtttacgttctccgtttctctggaggtgaaggaggacgacggcaaggggaacttcagccccgttccgaaggacagagacaaattctacttcaaacttaagcagggtattgaaaagaaggtcgtgatcactgtccaacaactgtcaaacaaagaactagccatagagaggtgtttcgggatgcttctcagccccgggaggaatgtaaaaaattctgacatgcacttgctggacatggaaagcatgggaaaatcctacgacggacgagcgtacgtaatcacgggcatgtggaaccccaatgcaccagtgtttcttgccctcaatgaggagacccctaaagataagcaagtatacatgactgttgcagtcgacatggtcgtgacagaagtggtggagcctgtccgatttctgctcgaaactgtagtcagagtctatccagccaatgagcgattctggtatttctctcgcaaaacattcacagaaacattcttcatgaggctgaagcagagcgagggcaagggacatacaaacgccggcgatgccatctacgaggttgtgtccctccagcgggagtccgacaaagaggagcccgttacacctacctccggcgggggtccaatgtccccgcaggacgatgaggctgaggaagaaagcgacaacgagctcagttctggcacgggggatgtctctaaggattgtcccgagaagatactgtatagctggggtgaacttctaggcaagtggcactccaatctgggtgcccggcctaaagggctgtcgaccttggtgaaatccggcgtgccagaggcattgagggccgaagtctggcagttactcgccggctgccacgacaatcaggccatgttggataggtaccgcatcctaatcacaaaggactcagcccaagagtccgtaatcacgcgagacatccacagaacctttccagcacacgattatttcaaggatactgggggagatgggcaggagagcctgtataagatctgtaaggcgtacagcgtgtatgatgaagatatcggttactgccagggccaatcgttcctcgctgctgtgctgctgctccacatgcccgaggaacaggccttttgtgttctggtgaaaattatgtatgactacgggcttcgcgacctgtacaggaataactttgaggatctgcactgcaagttttatcagctggagcggctgatgcaagaacaactcccagatctgcactcccatttctcagacctgaacttggaggctcacatgtatgcaagtcaatggtttttgaccctgttcacggcaaagtttccactgtgcatggtgttccacattatcgatctactgctgtgcgaaggtctgaacattatttttcacgtagcattggcgttgctgaaaacatccaaagaggatctgctgcaggccgatttcgaaggagccctgaagttctttcgtgtacagcttcctaagcggtaccgggcagaagagaatgccaggcggctaatggaacaagcctgtaacataaaggtgcctacaaagaagctcaaaaagtatgagaaggagtatcaaacaatgcgcgagagccagctgcagcaagaagacccaatggaccgctataagtttgtgtatttatag

SEQ ID NO: 22885 - DNA, 639 bp, Artificial Sequence
  Description of Artificial Sequence: Synthetic coding sequence
atggcccagaccgacaagcccacctgcatcccccccgagctgcccaagatgctcaaggaattcgccaaagccgcaattcgggctcagccccaagacttgatacagtggggggctgattattttgaagccttgagccgtggggaaacccctccagtacgggagcgatccgaaagggtggcactctgtaactgggccgaattaactccggaactgctcaaaatcctgcactcccaggttgctggaaggctgattatccgtgccgaagaattggcccagatgtggaaggtagttaatctgccaactgatttgtttaacagcgtgatgaacgtcggcagattcaccgaggaaatagagtggctcaaatttctcgcactcgcatgttctgcactgggggtgacaattaccaaaacgctgaaaatcgtgtgcgaggtactgtcctgtgaccataatggcggcctcccccggattcccttcagtacttttcaatttctgtacacttacatcgccgaggtggacggagaaatttgcgccagccacgtatctcggatgctaaactatatcgagcaggaggtaattggccccgatggcctgataaccgtgaatgattttacacagaatccgagggtttggctagagtag

SEQ ID NO: 22886 - DNA, 1938 bp, Artificial Sequence
  Description of Artificial Sequence: Synthetic coding sequence
atggccagcctgctgcaggaccagctgaccaccgaccaggacctgttgctgatgcaggaaggcatgcctatgcggaaggtaaggtctaaatcctggaaaaaactgagatactttagactccagaacgatggtatgacagtgtggcacgcccgccaggcccgcgggagcgcgaaaccctccttctccatttccgacgtggaaacaattagaaacggacacgattcagagttattgagatctctggccgaagaactaccattagagcagggattcactattgttttccacgggaggcggtcaaatctggacctcatggctaactctgtggaagaggctcagatctggatgagaggcctccaacttctggtggatcttgtaacctccatggaccatcaggagcgactggatcagtggctcagcgactggttccagagaggtgacaagaaccaggatggcaaaatgagctttcaggaggtgcagaggctccttcatctgatgaatgttgagatggatcaggaatatgcttttagcctgtttcaggcagctgacacctcacagtccgggactctcgagggagaggaattcgtgcagttctataaagctctcaccaaaagggcggaagttcaggagctgtttgaaagtttttctgccgacggtcagaagctaaccctcctggaattcctggactttttacaagaggagcagaaggaaagagactgcacctcagagcttgcactggagttgattgaccggtacgaaccctcggatagcggtaagctgcgacacgtgttgtccatggacggattcttgagttacttgtgctccaaggatggagatattttcaaccccgcatgcctgccaatatatcaggacatgactcagcctctcaaccattactttatttgttcctcccacaacacctatctagtgggagatcagctgtgtggacagtctagtgtcgagggctacatccgtgcacttaagcgaggatgtaggtgcgtagaggtggatgtttgggatggcccaagcggggagcccgttgtttaccatggccacaccttgacgagtcgaattctctttaaggacgttgtggccaccgtagcccaatacgcttttcagacctccgattatcctgtaattctcagtctcgagacccattgttcctgggagcagcagcagacaatggctagacatctgaccgagattctcggggaacaattactgagcacaacgcttgatggggttctccccacccaacttccatcaccagaggagctgagaaggaagatcctcgtgaagggaaagaaactgaccctggaagaggatctcgagtatgaggaagaagaagccgagccagagttggaggagagcgagttagctctcgaatcccaatttgagacagagccagaaccgcaggagcagaatcttcagaacaaagataagaagaagaagtcaaagccaatcctttgtcccgctctatcctcactcgttatttacttaaaaagcgtgtcctttcggtcttttacgcactccaaagagcattatcacttttacgaaatttcttctttcagtgagactaaggctaagcggttgatcaaagaagctggcaatgaatttgtgcaacacaacacctggcagctttcaagggtctacccctccggtcttcgaacagatagcagtaattacaacccacaggaactctggaatgctggatgccaaatggtggctatgaatatgcagacagctgggctcgagatggatatctgcgacggccactttcggcagaatggcggatgtgggtatgtgctaaagcctgacttccttcgggatatacagagcagcttccaccctgaaaaaccaatcagtccttttaaggctcagaccctgagtatcccttataggcaccttcaactcatcttcccaatcaactctgtatag

SEQ ID NO: 22887 - DNA, 7554 bp, Artificial Sequence
  Description of Artificial Sequence: Synthetic coding sequence
atggtgggcgagcggcacgccggcgacctgatggtgcccctgggccctaggctgcaggcctatcctgaggaattaattagacagagacctggacacgacggacacccagagtacttgatccgctggagtgtactgaaatgtggtgaggtgggtaaagtgggcgttgaggagggaaaggcagaacacatccttatgtggttgtctgctcctgaagtgtacgctaattgccctggtcttctaggggagcgcgcccttagcaagggactgcagcatgagccagctggcgtatctggctccttcccacgggatccaggcgggttggatgaagttgcaatgggagagatggaagccgatgttcaagccctcgttaggcgcgcagccaggcagttagccgaatctggcacgccatccctgactgccgctgttttacatactatccatgtgctcagtgcctacgccagcattggccccctcacgggtgtgtttcgcgaaactggggcgctcgatttactcatgcacatgctgtgtaatcccgagccacagatccgacgaagcgcgggaaaaatgctccaagctctggccgcccatgacgctggtagcagggcccacgtgcttttgagtttgagtcagcaggacggtatcgagcagcacatggacttcgattcccgatatacgttgttggagctctttgccgagaccactagcagtgaagagcattgcatggccttcgaaggtatccatctgccgcagatccccggcaagcttctgttcagccttgttaagagatatctttgcgttaccagtctactggaccagctgaactcttcaccagagctcggagcaggagatcagagctccccttgcgcaaccagagagaaaagccgaggccagcgcgaattggagttctcgatggctgtgggaaacctgatttctgaactcgtgagatctatgggttgggcccgcaatcttagtgagcaaggaatgtcacccccacgccccacccgttccattttccagccctatataagcgggccgtcactgctgctccctactatcgtaaccactccgagaaggcaaggctgggttttccggcagaggtcagaattctcgagtagatccggatacggtgagtatgttcagcagactctccagcccggcatgagggtgcgaatgctggatgactatgaggagatttccgctggggatgaaggagagtttagacagtctaacaacggcatccccccagtccaggtcttctggcagtctactggccggacttattgggtgcactggcacatgctggagatcttgggccccgaggaggccactgaagataaggctagcgccgcggtggaaaagggtgccggagcaaccgtgctcggaacagcttttcctagttgggattggaatcctatggacggactctaccccttgccatacctccagcccgaaccgcagaagaacgagagggttggctacctcacacaggccgaatggtgggagctcctctttttcattaagaagctggacctgtgcgagcagcagccaatcttccaaaacctttggaagaatctggacgagacattgggggaaaaagctctgggggagatcagtgtcagcgtggagatggccgaatctctgctccaggtgctatcctcacggtttgaggggagcactcttaacgatctgcttaattcgcagatatacaccaagtacggcctacttagtaacgagccttcatcaagctctacttcaaggaaccattcatgcactcctgacccggaagaggagagcaagtcggaagccagtttcagcgaggaggagactgaatctctgaaagccaaagccgaagcaccaaagacagaggctgaacctactaaaactaggactgagacgcctatggcgcagtcagactcccaattattcaatcagctgttggtgaccgaaggcatgactcttccaacggagatgaaagaggcggcatccgaaatggccagggccctaagaggacccgggcccaggagttcattggaccagcacgtcgcagccgtcgtggcaactgtgcagattagttccctcgataccaatttgcagctgtctggattgtcagctctcagccaggccgtcgaggaggtcactgagcgtgatcatccacttgtccgcccagaccgctccctcagagagaagctggtgaagatgctcgttgaacttcttaccaaccaggttggggagaagatggtggtcgttcaggcactgcgtctgctttatttgctgatgaccaaacacgagtggcgcccgctgttcgccagggaaggaggaatctacgccgttctggtctgcatgcaagagtataaaacctccgtgcttgtgcagcaggccggactcgctgccctgaaaatgctggcagtggcctcatcatctgaaattcctacatttgtgactgggagagactcgattcactccttatttgacgctcagatgacacgcgaaatatttgcctctattgactctgcaacgcgacccggttctgaaagcttgctgctgacggtacctgccgccgttattctgatgctcaatacagaaggatgtagctctgccgcgcgtaatggtcttctccttctcaacctgctactctgcaaccaccatactctgggagatcagattatcacacaggagcttcgagataccctgttccggcattcaggaattgcaccaagaaccgaacccatgcctacaaccaggaccatcctcatgatgttgttgaaccgctacagtgaaccgccaggatcaccagagcgggccgccctggagactccgatcattcagggccaggacgggtcaccagaactactgattaggtccctggtgggcggtccgtcagctgaactgctgttggacctggagcgggtgctgtgcagggaagggagtccagggggagcggttcgccccctgcttaaaagactccaacaagagacccagccgttcctgctcctcctgcggactcttgatgcccccggccccaacaaaactctgctgctgtctgtgctccgcgtgatcacccgtctgttagacttccctgaggcaatggtgttaccctggcacgaagtcctagagccttgccttaactgtttaagtggcccttcttccgactctgagattgttcaggagctgacatgtttcttgcatcggctcgcaagtatgcataaagactacgccgtagtcctatgctgcctgggagcaaaagagatcctgtccaaagttttagacaaacactcagcacaactgctgttaggctgcgagctcagagatctggtgactgagtgtgagaagtatgcccagttatattccaacttgacatccagcatacttgccggatgtatccagatggttttaggacaaattgaggatcaccggcgcacgcatcagcccatcaatatcccttttttcgacgtgtttctgagacacctctgccagggaagtagcgtcgaagtgaaggaggacaagtgctgggaaaaagttgaggtgagctcaaatcctcaccgtgcatctaagctgacggaccataatcccaagacatactgggaatcgaatggctctactggttcccactatatcaccctccatatgcatcggggcgttttggtccgccagctcacccttcttgtcgccagtgaagactcttcctacatgccagcaagagtggtcgtattcgggggagacagtacgtcatgcataggtaccgagctgaacactgtcaacgtaatgccatctgctagcagggttattctgctggagaacctcaaccggttttggccaatcattcagatcaggattaagagatgccagcagggcggcatagacacaagagtacgcggggtggaagtccttggaccgaagcccaccttttggcctctgtttcgggagcagttatgcaggcgtacatgcctcttctacacaataagggcccaggcatggtctcgcgacatcgctgaggatcacaggaggttgcttcagttgtgtcctcgtttgaaccgggtcctgcgccacgaacagaactttgccgacagattcctacccgatgatgaggccgcgcaggcacttggaaaaacttgttgggaagcactggttagtccattggtgcagaacatcaccagcccagacgctgaaggggtttccgcactgggctggctccttgaccagtatctcgagcagagggaaactagtcgtaatccgctgagtagagcagcctcctttgcctctcgcgtgagacgactgtgtcatctgctcgtgcacgtagaacccccaccgggtccgtccccagagccatccacacggcccttttcaaagaactccaaaggtcgcgatcgatcccccgccccctctcccgtgctgccctctagttcactcagaaacattacacagtgttggcttagtgtcgtccaggaacaagtgagccggtttcttgccgctgcttggagagcacccgattttgttccccgatactgcaagctttatgagcacttacaacgggcaggatccgagctgttcggacccagagcggccttcatgctcgcacttcgctctggattttccggggcacttcttcagcagtcttttctgacagcagcccacatgagtgagcagttcgcccgttatattgatcagcaaatacaaggtggactcattggaggagctccgggagtcgagatgcttggccagcttcaaaggcatttggagccaatcatggtcctgtcagggttagagctggccactactttcgagcatttctatcagcattacatggctgataggttacttagctttggcagttcatggctggagggagctgtgcttgaacagattggactgtgttttcctaatcgattacctcagctgatgctgcagtccctctcaacatctgaggaattgcagagacagttccacctgtttcagctgcagagactggataagctgtttcttgagcaggaggatgaagaggagaagcgcctcgaggaagaggaggaagaagaggaggaggaagaggctgagaaggagctgttcattgaggacccgtcacctgccatatctattctggttctcagccccagatgctggcctgtgtcccccctgtgctatctctatcacccccgcaagtgcctgccgactgagttctgtgacgccctggaccggtttagcagcttctactcacagtcacagaatcacccagtcctggatatgggaccgcaccgtagactgcagtggacttggttgggccgtgccgaactccagttcggcaaacagattctccacgtgagcaccgtgcagatgtggctgctcctgaagtttaaccagactgaagaggtgagtgtcgaaacgctgcttaaggacagcgatctgtctcccgaactccttctacaggctctggtgcccttaacctccggaaatggcccgctcacccttcacgagggccaggactttccccatgggggcgtgctgcggctgcatgaaccagggccccaacgcagcggggaagccttgtggctgattccccctcaggcatacctgaatgtggagaaggacgagggtcgcacactggagcagaaaaggaacctgctgtcctgcctgcttgtgagaatcctgaaagcccacggagagaaggggctacacatcgaccagttagtgtgcttggtacttgaggcatggcagaaaggacctaacccacctggcacacttggacatactgtggccgggggagttgcctgcacatcgactgacgtgttgtcatgcattcttcaccttttaggtcaggggtacgttaagagacgcgatgataggccccagatactaatgtacgcagccccagagcccatggggccatgtcggggtcaagccgacgtgcccttttgcggttcgcagagcgagacctccaaaccatcaccggaagccgtggctacactggcttcgctgcagctgccagccgggcgcacgatgtccccgcaggaggtggagggattaatgaaacaaactgtgcggcaggttcaagagactctaaatctggaacccgatgtggcccagcatctgttggcccacagtcactggggagctgagcagttactgcaaagctattctgaggatcccgaaccacttctgcttgcggctggcctgtgtgtgcaccaagcccaggccgtcccagtgcgcccggaccattgtccagtgtgcgtctcacctctgggctgcgacgacgatctcccgtccctgtgttgtatgcattactgttgtaagtcttgttggaacgagtatttaaccaccagaatcgaacagaatctggtgctgaattgcacttgtcctatcgccgattgcccggctcagccaacaggtgcctttattagagctatcgtctctagccccgaggtgatatctaaatatgagaaagctctgctcagaggctacgtggagtcatgctctaatttgacttggtgcactaacccgcaaggatgtgatagaatcctgtgccgccagggacttggctgcggcaccacttgttcaaagtgcgggtgggctagttgttttaactgtagtttccccgaagcacactatccagccagctgtggacatatgtcccagtgggttgacgacggaggatactacgacgggatgagcgtggaggctcaaagcaaacacctagccaaattaatcagcaaaagatgtccaagctgccaagctccaattgagaaaaatgaagggtgcttgcacatgacatgcgctaaatgtaatcatggcttttgctggagatgtctcaaaagctggaaacccaaccacaaagactactacaattgcagcgccatggtgagcaaggccgcccggcaggaaaaaagattccaggattacaatgaacgctgcacttttcatcaccaggcccgtgagttcgcagtgaacttacgcaatcgggtatccgccatccatgaggtgccccctcctagaagttttacttttcttaacgacgcatgccaaggtctcgagcaggctagaaaggtgcttgcatacgcctgtgtatacagcttctactcccaggacgccgaatacatggatgtggtcgaacagcaaacagagaatctcgagttacacactaacgctcttcagattctgctagaggaaaccctactgcggtgtagagacctggcctcttccctgaggcttcttcgcgccgattgtctcagtaccggaatggaactattgcgaagaattcaggaacgactcttggccatccttcagcactcggcacaggacttcagggttgggctgcagagtccatccgtggaggcctgggaagcaaaaggcccgaacatgccaggtagtcaacctcaggcatctagcggacccgaagctgaggaggaagaagaggacgacgaggacgatgtaccggagtggcagcaggatgaattcgacgaggaactagataacgacagctttagttacgatgagtcagagaacctggaccaagagacctttttcttcggtgacgaagaggaggatgaagacgaagcctacgactag

SEQ ID NO: 22888 - DNA, 1476 bp, Artificial Sequence
  Description of Artificial Sequence: Synthetic coding sequence
atggaggagatccccgcccaggaggccgccggcagcccccgggtgcagttccagtctctggagacacaaagcgagtgcctgtcgcccgagccacaattcgtccaagacaccgacatggaacagggcctcaccggcgacggagagaccagggaggagaataagctgctgattccaaaacagaaaatctccgaggaggtccatagctataaggtccgtgtcggcaggctcaagcatgatatcacacaggtccctgagactcgggaggtgtacaagtcagaggacaggctagagcggctgcaggagatattgcgcaaatttctctacttggagcgggaattccgtcaaattaccatctcaaaagagacctttacttcggaaaagaataacgaatgccacgagcccgaaaagtcttttagcttggacagcactattgatgctgatcagagggtactgcgcatccagaataccgatgacaacgataagtacgacatgtccttcaaccagaattcggcgtccggcaagcacgaacacctgaacttgactgaggactttcagtccagcgaatgcaaggaatcacttatggatctctcgcaccttaataagtgggaatccatcccaaacaccgagaagtcatataaatgcgatgtctgtggcaagatttttcatcagagtagcgctctgacccgacaccaacggatccacactagggaaaaaccctacaaatgcaaagagtgcgaaaagagcttttctcagagctcttccctaagcagacacaagcgaatacatacccgagagaagccatacaaatgtgaggcaagcgataaaagctgtgaggccagcgataagtcttgtagcccctcctctggtataatccaacacaaaaaaatccatacacgggcaaaatcctacaaatgcagctcctgtgaaagagttttcagccggagcgtgcatttgacccagcaccagaaaatccacaaagagatgccatgcaagtgcactgtatgtggatcggatttctgtcacacttcatatctgctggagcatcaaagggttcaccacgaggagaaggcctacgaatatgatgaatacggcctggcatacattaaacagcaagggatccatttcagggagaaaccttacacatgttcagagtgcggaaaagattttcggctaaacagccatttgatccagcaccaacgaatacacaccggcgagaaagctcatgagtgcaacgaatgtggcaaagctttctcccagacatcttgtctcattcagcatcacaaaatgcacagaaaggagaaatcatacgaatgtaacgagtatgaagggagcttctcccacagctctgatctaattttacagcaggaagtgcttacaaggcagaaggcattcgactgcgatgtgtgggaaaaaaacagctctcaacgggcccacctagtccagcatcaatccattcataccaaggagaattcatag

SEQ ID NO: 22889 - DNA, 2709 bp, Artificial Sequence
  Description of Artificial Sequence: Synthetic coding sequence
atgagcgagttccggatccaccacgacgtgaacgagctgctgagcctcctcagagtccatgggggcgacggcgctgaagtgtacattgacctgttgcagaaaaacaggacaccgtacgtgacgaccactgtctccgcacatagcgccaaggtcaagatagccgagttctcacgaacgcccgaggacttcctgaaaaagtacgatgagctgaaatcgaagaacactcgaaaccttgatcctctggtatatctgctcagtaaactgacagaagataaagaaactttacagtatttacagcagaacgcaaaagaacgcgccgaactagcagctgctgcagtcggcagcagcaccacaagcatcaacgttccggctgccgccagcaagatctcgatgcaagagctggaggaattgcggaagcagctggggtccgtcgctactggctctacactgcaacagtcccttgagctgaaacgaaaaatgcttcgggataaacagaataagaagaatagcggtcagcacttgcctattttccccgcctgggtctatgagagacctgctctgatcggcgacttcctcataggcgctggtatctctaccgatactgccctgcccatcggaactttacctctcgcttcgcaggaatccgccgtcgtcgaagatttactatatgtattggttggagtggacggccgctacgtttcagcccagcccctggccgggcgacaatctagaaccttcctggttgatcccaacctggatctgtcaattagggagctcgtgcatcgaatcctgcctgtggctgcttcctactctgctgtcaccagatttatagaagagaagtcgagcttcgaatatggccaggtgaaccacgctcttgccgccgccatgcgaactttggtgaaagaacatttaattctcgtgagccagctcgaacagctgcacaggcagggacttctgtccctgcaaaagctgtggttctatattcaacccgcgatgaggactatggacatactggcatccctcgcaacaagcgtggataagggagagtgtcttggaggctctactttgagtctgctgcacgacagaagtttcagctatactggtgactctcaggcccaggagctttgcctctacttgaccaaagcggcaagcgccccctactttgaagtcctggaaaagtggatatatcgagggattatccatgacccatattctgagtttatggtcgaggaacacgagctgagaaaggaaaggatccaagaagattataacgacaagtactgggatcagcgttataccattgtccagcaacaaattccatcttttctgcagaaaatggccgacaagattctctctacagggaagtatctgaatgtcgtaagagaatgcggtcacgatgtaacttgcccagtggcaaaagagatcatctacactctgaaggaaagagcctacgtcgagcagattgaaaaagcattcaattacgccagtaaagtgttgctggactttctgatggaggagaaggagctggtggcccacctgagaagcattaagaggtatttcttaatggaccagggcgatttttttgtccattttatggatctagcagaagaagagctccgtaaacccgttgaagacatcaccccccccaggctggaggcactgctggaactcgcgttgaggatgagcaccgccaatacagatcctttcaaagatgatctgaagatagatctgatgccccatgacttaattacacagctgctcagagtattagcaatcgagaccaaacaggagaaagctatggcgcatgccgaccccactgagttggccctgtctggtcttgaagcattctcctttgattacatagttaaatggcctctgtcactcatcattaaccgcaaagccctgactcgctatcagatgctctttaggcacatgttctactgtaagcacgtcgagcggcagctttgctccgtctggatctccaacaagacagctaagcaacatagcctccactctgcccagtggttcgctggtgccttcactctgcgccagagaatgctaaattttgtacagaatatccagtactacatgatgtttgaggtgatggaacctacatggcacatcctggagaaaaacctcaagtctgcatccaatattgatgatgtccttggccatcacaccggcttccttgacacatgccttaaggattgcatgctgactaatcctgagcttttgaaggtctttagtaagctgatgagcgtttgcgtcatgttcaccaattgcatgcaaaaattcacccagtccatgaagctagatggagaacttggtggtcaaacactggaacactccacagtcctgggcctccccgccggcgcagaggagagggctcgaaaggaactagctcggaaacatctcgccgagcatgccgatacagtgcagttggtgtctggcttcgaggccacaattaataagttcgataagaacttttccgctcacctgctagatctgctcgctagactgagtatatactccacgtctgattgtgaacatggaatggcctcggttattagcagactggacttcaacgggttttataccgagaggttagagcggctgagtgctgagcgatcgcagaaggcaacgccacaggtgcccgtcctgcgcggcccccctgcccctgctccaagagtcgctgttactgcccaatag

SEQ ID NO: 22890 - DNA, 2289 bp, Artificial Sequence
  Description of Artificial Sequence: Synthetic coding sequence
atggccatgcaggagaagtaccccaccgagggcatcagccacgtgacctctccctcttcagacgtaattcagaagggctctagcctgggcacagagtggcagacacccgtgatctccgagccttttcgctcgaggttcagccgctgctctagcgtagcggactccggcgataccgcgattggaacctcgtgtagtgatatcgctgaggatttctgttcctcctccggatctccacccttccagcctattaagagtcacgtcacgatcccaaccgctcacgtgatgccatctactctaggcaccagcccagcgaaacctaacagcactccagtgggcccatccagttccaagctgcccctgtccggactggctgagtcagtggggatgacccggaacggagacttaggagcaatgaagcactcccctgggctttctagagacctcatgtatttcagcggggcgacgggagagaacggcatagaacaaagctggttccctgccgtggggcatgagagacaagaagaggcccggaaattcgatattccctccatggaatctactctaaatcagagtgcaatgatggaaacactctatagcgatccacaccacagggtgcgattccataacccaagaacatccacatctaaggaactctacagggtcctccctgaagctaagaaagcccccggatccggcgcagtgttcgaacgcaatgggccccacagcaattcctcaggcgtcttacctttgggacttcaacctgccccagggctctctaaacctctaccatcacaggtctggcagccgtctcccgacacttggcacccccgtgaacagagttgcgagcttagtacctgtaggcaacagctggagttgattcggctgcagatggaacaaatgcaactgcagaatggcgcaatttgccaccaccctgccgcatttggtccctcgcttccaatactggagccagcccaatggatttccattctgaactcgaatgagcacttacttaaggaaaaagagttgctgattgacaaacaaagaaaacacatttcccaactcgaacaaaaggtgagagagagcgaactccaggtccacagcgctttgttgggccgccccgcaccttttggagatgtgtgcctgttgaggctgcaggaactgcagcgggagaatacgttcttgagagctcagtttgctcagaagaccgaggcactgagtcgggaaaagattgatttagagaagaaactgagcgccagcgaggtcgaagtgcagctaattagagagagcctgaaggttgccctgcagaaacattctgaagaggtaaaaaaacaggaggaaagggtgaagggcagggacaaacatatcaacaacctgaagaaaaagtgccagaaggaatcggaacagaatcgcgagaagcagcagagaatagagacactggaaagatatctggcagacctgcccacacttgaggatcatcaaaagcagagtcagcagctgaaggattccgagcttaagtcaaccgaactgcaggagaaagttactgagcttgagagcctattggaggaaacccaggcgatttgccgagagaaggagattcagctggaaagcctgcggcagagggaggccgagttcagtagcgctggacacagtcttcaagacaaacagtcggtggaggaaacgagtggggagggacccgaggtagagatggaatcttggcagaagagatatgattccctgcagaagatcgtggaaaaacagcaacagaaaatggatcaactccgaagccaagtgcaatccctggagcaggaggtagcccaggaagagggaacatcacaggctttgcgggaggaggctcagagacgtgacagcgctctgcaacagctacgcactgccgtaaaggaactgtccgtgcagaatcaggacttgatagagaaaaacctgacgcttcaagagcatctgcggcaggcacagccagggagtcccccttcacccgataccgcccaactggccctcgaattgcaccaagagctcgctagctgtctgcaggacctccaggctgtctgctctattgttacccagagagcccagggccacgatccaaacctgtccttgttgcttggtatccactccgcccagcaccctgaaactcagctcgacctgcagaaaccagatgttatcaagcgcaaattggaggaagtccagcagctgaggagagatatcgaggatctccggaccaccatgtctgatagatacgcccaggacatgggagagaattgtgttacccagtag

SEQ ID NO: 22891 - DNA, 1443 bp, Artificial Sequence
  Description of Artificial Sequence: Synthetic coding sequence
atgatcgtggccgacagcgagtgccgggccgagctgaaggactacctcagattcgcccctggtggggtcggggactcgggcccgggggaagaacagagagagtccagggcccggcggggcccccgaggacctagcgccttcatcccagtggaggaggtcctgcgggagggtgccgaaagtctggaacaacacctaggactcgaggccctgatgagctcaggccgcgtggacaatttggcagttgttatgggcctgcatcctgactactttacatcgttttggaggttacattacctccttctgcatactgacggtccattggcttcctcgtggagacattacattgccatcatggcagccgctcgccaccagtgctcttacctagttggcagtcacatggcagagttcctgcagacagggggggacccagaatggttgttaggattgcaccgggctcctgagaaactgcggaagttatccgaaattaataagttgttggcacaccgcccttggctgatcacgaaggaacacatacaagccctgctaaagaccggggaacacacgtggagtcttgcagagcttatccaggccttagtactgctcactcactgccacagtctttcaagtttcgtcttcggttgcggcatcctgcccgagggggacgccgacggcagtcccgccccacaagccccgactcccccctctgaacaatcctcccccccttctcgggaccctcttaataatagcggcggctttgagtctgccagagatgtggaagccctcatggaacgcatgcagcagctgcaggaatcgttgctgcgcgatgaggggacctcacaggaggagatggaaagtaggtttgagcttgaaaagagcgagagcctgcttgtgactccgtctgctgacatcctcgagccatcccctcaccctgatatgttatgtttcgtagaggaccctacgttcggctatgaagatttcaccaggcggggtgcccaggcacctccaacattcagagcccaggattatacgtgggaagatcacgggtattccctcatccagcgtctctaccctgaagggggacagcttctagatgagaaattccaagcagcctacagcctaacctacaatacaattgcgatgcatagcggagtcgatacaagcgtcttgcgcagggctatttggaattacatccactgcgtatttggtatccgctatgatgactacgattatggggaagtcaaccagcttctagagcggaacctgaaggtatacatcaaaaccgtggcttgttacccagagaaaacaaccaggcgaatgtacaacttgttttggcgccacttcagacacagcgagaaagtgcacgtcaacttactgttactggaagccagaatgcaagccgctttgctgtacgccctgcgcgccataacccgatatatgacctag

SEQ ID NO: 22892 - DNA, 633 bp, Artificial Sequence
  Description of Artificial Sequence: Synthetic coding sequence
atgcccggcgtgaagctgaccacccaggcctactgcaagatggtgctccacggcgcaaagtatccccactgtgccgtgaacggactcctggtcgctgaaaaacaaaagcccaggaaagagcacctgccactcgggggcccaggagctcaccacaccctcttcgtggactgtatacctctctttcacggcacccttgctttggcccccatgctggaggtggcactcacactgatagactcctggtgtaaagatcactcatacgtcattgccggatattatcaagctaacgaacgcgttaaggatgccagccctaatcaggttgcagaaaaagtggctagtcgaatagcagagggattctcggatacagccctgatcatggtggataacactaagttcactatggactgcgtggcgccaactatccacgtctatgagcatcatgagaacaggtggagatgtcgagatccacatcatgattactgtgaggattggcctgaagcccagagaataagcgcgtcccttctggatagcaggtcctatgaaacccttgtcgatttcgataaccatctcgatgacatccgtaatgattggaccaatcccgagatcaacaaagctgtgctgcatctgtgttag

SEQ ID NO: 22893 - DNA, 1059 bp, Artificial Sequence
  Description of Artificial Sequence: Synthetic coding sequence
atgaccgaggccggcaagctgcccctgcccctgcccccccggctggactggttcgtgcatacccaaatgggccaactggctcaggacggcgtgccagagtggttccacggagccatatctcgcgaagacgctgagaacctcctggaaagtcagccactagggtctttcctgatcagggtttctcatagccatgtggggtatactctgagctacaaagcccagtctagttgctgccattttatggtaaaactgctggacgatggcacctttatgattcctggcgaaaaagtagcgcacacaagtctcgacgcactcgtgaccttccatcaacagaaacccattgagccacggcgtgagctgctgactcagccttgccggcagaaagacccagcaaacgtggattacgaagacctcttcctctactccaacgccgttgcggaggaagcagcctgccccgtttctgccccagaggaggcgagtccaaaaccggttctctgtcaccagagtaaggagcggaagccgtccgctgaaatgaatagaatcactactaaggaagctacttcatcctgtcctcctaagtcccccctcggagaaacccggcagaagctgtggcgatcccttaaaatgctgcccgagcgggggcaacgggtgcggcagcagctgaaatctcacctggcaacagtgaacttaagcagcctgctggacgtccgccggtcaaccgtcatatcaggtcctgggacgggcaaaggtagccaggatcactctggcgatcccacatctggagaccgcggttataccgatccgtgcgtagccactagtttaaagtctccaagccagcctcaggcccctaaagataggaaagtccctacacgcaaagcagaaaggagcgtgtcttgcattgaagttactcccggcgaccgcagctggcatcagatggttgttcgagctctttcaagccaggagtccaaacccgagcatcagggcctcgccgagcctgagaatgaccagctcccagaggaataccagcaacctcctcccttcgcacctgggtactgctag

SEQ ID NO: 22894 - DNA, 480 bp, Artificial Sequence
  Description of Artificial Sequence: Synthetic coding sequence
atgacccactgctgcagcccctgctgccagcccacctgctgccggactacttgctggaaacctactaccgtgaccacttgttccagtactccctgttgccagccaagctgttgcgtaagcagctgttgccaaccatgctgtcgacccacatgttgtcagaacacatgctgccaacccatatgcgtgacctcctgctgtcagcctagctgttgctctacaccttgctgtcaaccaacgtgttgtggacagactagctgtgggagctcttgcggacagtctagcagctgcgctccagtgtattgtcgaagaacgtgctaccaccctactacagtctgcctgcccgggtgtttaaaccagtcatgcggatctaattgctgtcagccttgctgtagacccgcttgctgcgagaccacctgctgccgcactacctgcttccagccgacctgtgtgagtagctgttgtcagccttcttgttgctag

SEQ ID NO: 22895 - DNA, 615 bp, Artificial Sequence
  Description of Artificial Sequence: Synthetic coding sequence
atggaccccaaggaccggaagaagatccagttcagcgtgcccgccccgccctctcagctggatccaagacaggtcgaaatgattcggcggagacggcctacgcctgctatgctttttaggctcagcgagcattcgtccccagaggaggaagcaagccctcaccaaagggcaagcggtgagggacatcacctcaagagcaagcgccctaacccttgtgcttatactcccccttctctgaaggcggtccagcgcatcgctgagtcccacctgcagtccatttcaaatctgaacgagaaccaggcttccgaagaggaggatgagttgggagaattacgcgagcttgggtaccctagggaagaggacgaggaggaggaggaagacgatgaagaggaggaagaggaggaagattctcaagctgaagtactgaaagtgatacgtcaaagcgcaggccaaaagaccacgtgtggtcagggcttagaaggtccatgggagcgtccaccccccctggatgagtccgagcgggatggaggttcagaagatcaggtggaggaccccgccctcagtgagccaggcgaagagcctcagaggccttccccgagcgagcctgggacttag

SEQ ID NO: 22896 - DNA, 2061 bp, Artificial Sequence
  Description of Artificial Sequence: Synthetic coding sequence
atgaccgacgccctgctgcccgccgccccccagcccctggagaaggagaacgacggctacttcaggaaaggatgcaaccctctggcccagactggtcggagcaagttgcagaatcaaagggcagccttgaaccaacagatcctgaaggcagtacgcatgagaaccggagcagagaacctccttaaggtggccaccaacagtaaggttcgggaacaggtgcggctggagctctcttttgtgaactccgacttacaaatgctgaaagaagagctggaaggtttaaacatatctgttggagtgtaccagaacacagaagaggcatttaccatccctctcatacccttggggttaaaggagacaaaagacgtggatttcgccgttgtgctgaaggactttattcttgagcattacagcgaagacggttacctctacgaggacgaaattgctgatttaatggacctccgtcaagcttgtcgaaccccctcaagggatgaggctggggtagaactcctaatgacgtacttcatacagcttggattcgtggagtcccgattctttccccccactcgccaaatgggcctcctgtttacatggtatgacagtctcactggggtaccggtgtcccaacagaacctgctgttagaaaaagctagtgtgctctttaatacaggtgctctgtacactcaaataggcacacgctgtgatcgccagactcaggcaggtcttgagagtgcaatcgacgcattccagagggctgccggggttcttaattatttgaaggatacattcacccacacaccgagctacgatatgagcccggcaatgctgtctgtgctcgtcaagatgatgctcgctcaggcccaggaatcagtgttcgaaaagatcagcctgcccggcatccgcaatgagttctttatgttggtgaaagtggcacaggaggctgctaaagtcggtgaagtgtaccaacagcttcatgctgctatgtcgcaggcgccagtgaaagaaaatattccctactcatgggcgagtctggcgtgcgtcaaggcgcaccattatgctgcccttgctcactattttaccgccattctcttaatcgaccaccaggtgaaaccaggaacagacttggatcatcaggagaagtgtttgagtcagctgtacgaccacatgccagaagggttaactcccctggccaccctcaaaaatgatcagcagcgacgtcagctcggaaagtcccatctccgtagggctatggcccaccacgaggaatcagtcagagaggcaagcttgtgcaaaaagctcagatccatcgaagtccttcaaaaggtgctgtgtgccgctcaggaacgtagccgcctcacatatgcccaacatcaagaagaagacgatctcctcaatcttattgacgcacccagcgtcgtggctaaaacagagcaggaggtggatatcatacttcctcagtttagcaagctcacagtgaccgacttcttccagaaactgggccccctgagcgttttcagcgccaataaacggtggactccacccagatcaatcaggtttactgcagaagagggtgacctaggcttcaccctgcgtggaaatgcgcccgtacaagtgcattttcttgacccttattgcagtgccagcgtggctggagcaagggaaggagactacattgtgtccattcagctcgtggactgcaagtggcttacgctgtccgaagtgatgaaactgctgaaatcattcggggaagatgaaatcgagatgaaagttgttagcctgctggactcaacaagcagtatgcacaacaagagcgccacttattcggtggggatgcaaaagacttacagcatgatctgcctggctattgatgacgacgataaaactgataagacaaagaagatttctaagaagctgagcttcctttcctggggcactaacaagaatcggcagaagagcgctagcacattgtgcctgcccagcgtcggagcagcacgcccacaagtaaagaagaaactgccatctcccttcagcctattgaatagcgatagctcatggtactag

SEQ ID NO: 22897 - DNA, 1254 bp, Artificial Sequence
  Description of Artificial Sequence: Synthetic coding sequence
atgcccctgtacgagggcctgggcagcggcggcgagaagaccgccgtggttattgacctcggggaagcttttacgaagtgtggcttcgccggggagacaggcccgcgatgtattatcccatccgtcattaaacgtgcaggcatgccaaaacctgtgcgtgtagtgcagtacaacatcaatacagaagagctgtacagttacctcaaggaatttattcatatcttgtattttagacatctcctggttaacccccgtgatcggcgcgtggtgataatagagtccgtactgtgtccaagtcattttcgcgagactctgacaagagttttattcaagtactttgaagtgccctcagtgctgttagctccttctcatctaatggctctcctgacactggggattaacagtgcgatggtgctcgattgtgggtaccgcgagtctctcgtgctacccatttatgaggggatccctgtgctgaattgctggggtgccctccccctgggcggcaaggctcttcacaaggagctggagacacagcttcttgagcaatgcacagtagacaccagtgtagccaaagagcagtcacttccttccgtgatgggctccgtgcccgagggcgtattggaagacataaaagcccgtacatgttttgtgtcagaccttaagcggggacttaagatccaggccgcaaagttcaacatcgacggtaataatgagcgcccaagccccccccccaacgtcgactacccgctcgacggtgagaaaattctgcacattttaggtagcatacgcgacagtgtggtcgagattctttttgaacaggataacgaagagcagagcgtggcaacactgatacttgatagtttaatacagtgtcctattgacaccaggaaacagttggctgaaaatctggtggtgatcggcggaaccagcatgcttccaggtttcctccacagactcttagccgagattcggtacttagttgagaagcctaagtataagaaggccctgggcaccaagacctttcgaatacacacaccgccggcaaaggccaactgcgtggcctggttaggcggcgccatctttggtgctctgcaggacatcttgggctctagaagcgtgagcaaagagtattataatcagactggaaggattcctgactggtgctcgttgaataaccctcccctggaaatgatgtttgacgtcggaaagacacagcccccgctgatgaagcgcgccttttcaaccgagaaatag

SEQ ID NO: 22898 - DNA, 2643 bp, Artificial Sequence
  Description of Artificial Sequence: Synthetic coding sequence
atgagccagcccgccggcggccggcggaagccccggaccctgggcccgcccgtgtgtagtattaggcccttcaagagctccgaacagtacttggaagcaatgaaggaggacctggcagagtggctcagagacttgtacggtctggacatcgacgccgccaatttcctccaggtactagaaactggcctggtgttgtgccagcatgccaacgtggtcacggatgcagctctagcttttctcgctgaggctcctgcccaagcccagaaaattcctatgcctcgagtgggtgttagttgcaatggcgctgctcagcctggcacattccaggcgagggacaatgtcagtaatttcatccaatggtgccgaaaagaaatgggaatccaagaagtgctgatgttcgagaccgaggatcttgtactgagaaaaaacgtgaaaaatgttgtgctgtgtttgctcgaactgggaagacgggcctggagattcggtgtcgcggctcccactctggtccagcttgaagaagagatcgaggaagaggtacggcgagaactggctttaccgcccccagacccgagcccaccagcaccccctcgccgacagccctgtcattttcgaaatcttgatcaaatggtgcagtctctcgtgagccactgcacttgtcccgtgcagttctcaatggttaaggtgtctgaggggaagtatcgggttggagattctaatacgctgatcttcatcaggatcctgagaaaccacgttatggtccgagtgggtggcgggtgggacactttaggccactacctcgataaacacgacccctgccgctgcaccagcttgagccacaaaccggggtccttcctgaagccccccgcaccccctgtgcagcatgaggtgcgcgttcaggacgggccttctcaaacccagccgaccatgactatcagcagatcacagtcaccacctcctcccgttgactggaagacctatacttcctccgacagacgactgcgcccccccaccccctcttcgcctagacccagacgggagcgaggcgcaggcacgggggcctctagggaaatggctccattcttgcgctgtcaggaaaggtctttgatcccaagctggaggcagccaacagctggagactctccaccttccccgcagtccagctcaacccagaaaggaagagatccccagtgtacaagctcggggaagcgcgaagagcggtaccctccagaactgccacgggggcgcatacctaccagctgggtgcatgaggagaccgattcctggggaaccgatgcagggaatcccaccccgcagaggctccgagcaattgaagccaccacgaagggcatcagtgctaggggtccatctccattaccgcgctcctttggcccagcggaatgtctcgggttgaggctgcctctacgagacgaggccaaaggcgcctttttccaatttagggaacccgagtccgtgaggagcccaacgcccgtgcaggggttgacaaaaattccaatcaggcttccacctgctcgtccccccacgcccggcagaagttttcccggggccactagcggaagcccccggacagagctgggtcgagaccctatccccctacgggctgtaactgtggatttggcgggctccactcatggggactgcagtgtcgaggttaggcaggaagatcagcagttagacattcaggtcatggccgaggcacgcgaatcttgggacctaggtctgcaggagcaagagggtagatatacacctctcccattgggaggaaataaagagcaggctatctattgctccctggaagaggagattctgggcaacatgaaactgttggaagtgcgatccgcctgtcctcaaggaacccgcagcggcgtcatcccacgttccggcgtttacattcctagactcgccgggcagtggcctgagccaggaggaccttatgataaggccatccaggagttggcacaggggagcccatctctgcttaaagtcgacctggaagcgtggaaggccgctcccaccgggtctccaaaaccggccgtgacccctggcccgggctcactgaagggaaaactgggcgctcgtcaaagcggtcctaggacaaaggcctctctcagcgccaaggggactcacatgagaaaagtgcctccacaaggcggacaagactgttccgctagcacggtgagcgcgtcacctgaggctccaaccccatctccgctggaccccaactctgataaagcgaaagcctgtctgtccaagggacgacggacactgcgcaagcctaaacgagttccatctatatacaaactcaaactccgaccaagaatccggcctcgtagagatcatcgccctgaaaagcagcccagtcgtattccccgccccttagcatatgtgttcctgggacccgcacgtcagcccccaaaagaccggctcttgcgggctgttctcggatccaaaggtggagaagccagtagggttgacggagcctcagttggggaggaagaggaggagggtaaggaagaaaaggaacctgctgccccccttgaaagctcaccccagccaccagaggggctgcaaccccactggctcaatcaggctccactgccaccagaagaggaatcatgggtgtag

SEQ ID NO: 22899 - DNA, 14262 bp, Artificial Sequence
  Description of Artificial Sequence: Synthetic coding sequence
atggtgcccgaggagcggcgggtgggcctgagcagcgacgagaccagctccgacagccttaaaagctggcacagcatctgcgtgctggacagtaaagagcaaccactcgcttgtcagcagaaacaacgacagtttgtaaaacctgtaactgagtccgaacaaccaaccgtgctggaattgctgctggctgaacttcgaactctgttttcagctgtgctccaggattcaagcccagccgcctggcgttatctgcatgcagttctggggctgctcccgccataccgcgaactgttggtaggacacttggatctgctcccatttcttgaacagctatactgctgggcgccttgggttcagactcaccttcacctcgaccttctaggtgctatcgtacaggcatttcctcccgacagctctctgctggacagtgcatcccatgccgattgctgtccacaaaaaagacggctccatcaccggccgccatgtcccgcctgccctttcgtacaagcccagtggtcacgtcagcaggtgaaagaggaactggccacttggctaaggcctcttaccctgccagagctgcagaggtgcttaggtatcgtgggagctcaggtcgcgctggaagaagccgtctggctcgacggcctgagcttactgccgttagccctggccgctgacatcccagtgaggtacgaaagttctgatacagataatgcagaggtggaacccgttggaaggaaagagacacgcagtcagttggactacgaggtgcccagggagaaggctttccagaaatctagcaccgggttctccccagagaccagttttctggatagccaggtgatgactgccctgaagatggaacggtacctcaaaaagattcattttctatatcttaacgtagcgccttccaggtattttcgcccttactcgctcatggtggttccacccgacaaggttaatcccgaacactatattttctccccctttgggatacttcacgttcatccagtcgaggggagcgaaaccatgaccctgggcacatggcatcaccactgtgtgctttggcagcaactacaatttatcccgtttttcaaatattgtctcctccggaaatcatttacctgctggaaaaagaacgtgcggctgcagggacttcatcggctacagaagtttctagagaatcacctgctgctggccgtgccccactttggcgcgggccttctgcacatttctagattgttacaggagctccatagtgtatcatggttgccccaggaactggaccgctgctatgagctgctggatttgcagaccgccctggcggaggaaaagcacaaggctctgcgactgcttcaccgctgcctaaacctatgcacctcaatcctgcggctcgtgcacgaggatacctaccacatgcaacagtgtctgcaagaaagagtccagaactgtgacagaattcggactggacagggatccatctatcttcagcgagtgcagcataaacaactggagcagaaactcaagcaggctgaggcatggtggctccagctgggtaagttcgccagactagtggactatatgatatgtcaatcactgatcagcgttctggaagagcagatcactagcttcgtagctaacattctgcaggctccccgtcagaagccgtttctgtcctcccaactggtatttgatgatcatggacagttatctcacgttccgtgcgtcgaaaacatgattcaaaccctgaccggggggctgcaatcagtgaagacttcagcgcttcaggtggtgcagagtgcagaccttaagacgtccagtgacagtctctattctgaggaggaagacgaggaagaagatagtaaggatgagtttcttatgcctaagttccagggccagccgtcagacgcagtgagcattttctgtggtccaaatgtgggactggtgtggccttggaagtcccatccaattgcagggatcttggaggtgagaggctgccgcctcagaggccagtattttcctcacaactacaaacagttggaagaggatctcgacaacaaccccaagattcaacaagctttgaacatccagcaagtactcttggagggagtgctgtgtaaggtccaggagttctgccgtgaacatcactggatcacaggcatttatgagttcctgcagtcctggggtccgcagaagctcgaggacatgagaggcggccctattaagaattacgtaacgcttgtctccaggctcaacgtgtggcaagctcgggttagttcgatgccaatcgaacttttgacaaaaggtggcctgctgctgctgtcatgccatgatgtccaggctgaaatggaatcaaaactcaacagtataaggaaagatatccttgcgcatgtacagaacgaatgttggaacttgtcacagcaactcatgaccgagctgacagattttatgcatattttccgcactatcaatagtgacattcacgcgatagcccagtgtacgcagaagctcaatgaggcaaacgagcaatacgtcgaactggaagaacggatggaatacgtgagagccttgcatgaactgattcgcaatcatttctccctgttctccgccgaaaacgaagcgttggatatcagcgttaggcgccagttcggggaatcacctatccctccttgccccccacctccccaaccgcacctgctccactgtcccctgctcgccccacagttgcttgacatgtgggaagccttccaatttgaaaagtcacaggccagcgagttcctcttaagcaaacgccacgcaatcatgcctaagctgcagcagctcatggccgctgccctcgctgaattggaggggctgctcgctaaggctctatcaggacccttcatggacccgacacaagatcagcgttcaactgagcatcagctggttagtttggaacgccaattccaaaacactgtttccgatctctctgagctgcaccacgcgtacgccatatttactgaggatgagactcctgtccccctgcccatttgcggaaccaggcctatagtccagcagcaaaggatctggcatctgtatagagtgatatcagagaatattagcgaatggaaatgtatggcctttgccaaattttcccccgccatggctcaggaaaaaacagaaggttggctcactgaggcagcacgtatgagcacaacactcgaattgcactctcctgtgctacagcattgtatgcggatcctcggcgaatttcgctcgtacctgcctctactcacaaagctgggatccctgcacccacagtctcttaattgccagtgccttctcagagccctggggctggggagcctgcagacgattgagctgctcacacttgggcagctcctgacttacccgctgttggagtttgctgaccggatcaaccaggtgtggcagaatgaaaacgagcgtattcacgcccaagagactattaggcgacttcagcggtattgggaggctaggcaattacgcttgttgaactttatcttgcacgtaccctacgagccgccggcttcggagaggagtaaacgccaggttctgagatcaccccaatgggaggtggtggataaagatagcgggacttttattctaagcgactactccaatctacaggattccattcaggagtctttacaggtcctaagtaagatcctggccattgaaaaatctggcgacctaaacaaaattgctctggagtgggtcgcaatcatgcacgggctgggggcgctgttggaagtctggttaaccttccagcagaaatggattttcctgaataaggtgctgcatgagatgaaaatccagtttcctaacgctgatttgaactcgaggttcaaggtaatggacgaccagtataggacactgatgaggatctccgttgccgaccccatggtgcttagcctggtggtgcccagcgccgagaggagcccttatttccagggacagcagctgcaacagttattgcaggccggttcagtggaattggaaggaatcatcatgtccttagaatccgtactatatggcgtctgcgcgcattttccccggctcttcttcctgtcggattctgaacttgtggcactgctcgccgcccgattggagtcttgtgaagcccagctgtgggtccgccgatgttttcctcacgtccacgctgtatcatttcggagttgtcccacaggggagaagaacacggacgactgggagtcgtctcctaacacacagacacaagtggaagcactggctgttctaggtgcaggtggcgaggaggttaagctgcaggggccattaccactgcatccagatctgcccaaatggctggccagtctcgaaaaatgtctccggttagccctcgtgcacatgctccaaggttgtgtcgccgctcggctagctcggggccctagccttggggaggccctaaagcagcttcctaaacagaataaattgtacctacagctgtacgtccaacactggattgatttggtccaagcatttccctggcagtgtgtgcttgtcgctgaggaggtcgtttggcgagcagagatggaagaggcactgctggaatggggcacactcgctatggtgtcgatgcacatgaggaagttggaggtgttagttaatttcatgcgcgcacagcgggctagccagggaggacaatcccttccgtccgtgcgccagacatccttgctctctgccctgctggtgatggccgtgacgcatagggacatcgctcaactgcttgagcaacatcaagtgtccgatctcacagattttcactgggttcgccaattaaagtaccatctgggatctccacacatcattccaaaatccccactccaaagtcttaagacaatcgcttcaagtgaacccagcctgtcacccgccgcctgctggatagacgtgcttggaagaagttttctctacaattacgaataccttgggccaagattgggcccgctgccatctttgctgcctgagaggcccgccttagtactgctgctagccctggaagaagtagcctgcgggaccgtattaggccccaatggggtgggcaagcgtgccattgttaatagcctcgcgcaggcacttggcaggcagctggtgatgctaccatgcagcccacaaatcgaggcccaatgtcttagcaattatctgaatggcgctctccaaggaggggcatggttgttgctggaaaaggtccaccagcttccgcccgggctcctctctgctttggggcagcgtcttggggagctgcaccatctgtacgcccccctttatcaagaggccagtaggaacaccagtactattgaccccactcagccccagctgctcggaagttccttcttcgaaaaacatcacgtgagcgtgcggctcggctacggatgcctactagttcttcgcgcccttagttctgctgtcccagccaacctccatttactcctcaggcctgtggcccttgccttgcccgacctgagacaggtggcagagctgactctgttgggggctggcatgagagacgcctttcagatggccactcgtctgagcaagtttttcagcctagaacgggagctcgtgtccggtcctctgccatgccgtctgcccctcttgaagcagatcctggaagatacaattagaacactcaacgtgaccaaggaggaaccaaagtgtcagaagcccaggagtctcgcggcaatagaggaggccgcattgctgcgtagccctttgtttagcatccttaatggcctccacctccataatctgcgcggtttgctgtgcgctctgtttcccagcgcttctcaagttctggccgaaccaatgacatacaagctgatgaaaccacttgtagttgaagaactccaacaggtgggcctggatcccagcccagacattctgggatccttagaacagctgtcacaagctctctcccgggcgtctggaatcctgctccttgggccagcgggctctggtaaaacaacttgctggcatagtctattcaaaatccagaaccgacttgcggccatggaagacacgagtacacagggttgccaaccggtggagattactcatctctacccgtccggcctgagccctcaagagttcttgggctggctggaaggcagttgctggcatcacgggatcttccccaaggttttaagagcagcgggccaatgcaacaacatgggccaaaagcgacagacggaggagtccattgggattcaacattggatcatctgcgacggggcctccaacggagcctggctggactctatcacctgcttgctgagtgaattgccgcaactgtccctccctagcggccagcagatcgctcgccctcccggtacctttttactgatggaagttgccgatactaccgggatcagtccaaccgtggtcggctgctgtgcccttgtgtggtgcggcggcgagcaaacgtggcagtgtattctaagtgctctgatggcttccctgccatacgaatatcgattgcagcaccgaacggtggccgagctcaatcacatggccgaggtgctggtgccagcaacattgagattcttaacttgccagggagttagctcattgttacaagtccatggccagcaggctgtgtgcgctggcgtcgccgaggtgacctccatggctagaatcctgcactccctgcttgatctgcacctgcgcctgaaggaggagaaagctcccggccccgaagatctaagttattctgaccccgtggctcaatcattcaggtccagcaaaagctctttcctcaatcggagccaggttgactcggacgacgtgcccgacaaatgcagagagcatctgctcgctgtgtcgagctttctctttgctcttatatggggctttggcgcgcacttgccttccaggttttggcctatcttcgacacattcatccgggatagcatctctcggctgtccaattatcccgaaccccctcccagtgccttagtgtttgacctgcacgtgtctcccgaggacgggacactggtcccctttactggacaatatctgtcctctcatattaaagggaccctgggaacctttcaccctagcattcagaccgaacgcctgctgtatgttgtggacctgctcctgtccgggggccagcctgtgctcctcgcgggagaggccgctaccggaaagtctgcatttgtggaggtactggtagagccgcaccacccctacatatactcacctattcatcccgctttttctagctcccatctacggctactcctgtcccgggggattcaaggccagacccaggcaagcccgcagcccgggcatcaccaagacagcaaaccgagcctgctgttcctgctcgaggaccttcacctagcgactagcgaccctgagaaatcctgtcaaccagtccttgaaacactcagacaagccatggatggaaccgtctatgcccatagcacgctcgaattacagactctgcaacctacggtgaactttctggccaccgtaaccgttccagggtattgcgaacgaccgctgtgcccaaggctgttcagactgtttacggtgcttgcccttgagtccatgactcaggcgactctgctggagcggcacgtccccatcatccaggcatggttagagagatttccttccgtggaacgggagcgggcactcgcccggggcttagtgcgagcttccgtagaggcatgggaagcagtgtgtaactgctttatgccctcacctcttcatcctcactaccattttagcctgcatagtgtgagccatctgctaagtagtctgcagctcttaccaaaccgaaccggcagtcgaggcttcgtcgactacccaaaccatcaggagcacctgaggagagtctcaggtctgaggggaacgtgcctgaccgttatgatggccactcgtaacgtggtaaggttgtggttgcacgaggcacagcggacattctgtgataggttggattcgcccagggagcgcagctactgtgccaagctactgctggtcgttgcccagagcgtcttttgctgtggacccggtccacagcaccttggtaaagatcaccaagagtctgaggaggaggaggaagaggagcgggtaccagaagttgagtccgagggcgaactggcacagtgggaagatttttcaaactctaatagcgagacggaggaggaggaagaaccctacggcctgcaagtcgctcgggtttctaacagccgggatccttccctcacacctagcataggccctgtgtcgaggggcatgaaggaatctatcagccacaagatccgccaggagaagggaactagggctagcaactaccgtcttcaggtgagacggtcgtttaagacgtggtggcaaaaaaagcctcaaatggatctgatctcacccttgctactcccagtactgctgcttcacccacaggaaaagccttccgacctggtgttttctcaggaattgatcttgggacccaattctgaaacgcccaatctatacttggaacggcagtgggaaaagttggaggagcaacttgctaccagcgcagctcaacttaaattaagtcctcacctagcgcgctgtcattccatggcgcagcacgtggctaggctggtccgagtgctagccaggccccgccagcatggcctgctgctgagtggcgccctgggcacaggtcgccacacagccattacgctggcaagcagcatatgccaggcccatttctttcacctcccatctggaagcgaggaagctattttacagtgcctccgcgatgcaagctggcacgcggggatgctctcccagccagtggcactgctggtcccctccggcgtagacttgaccaccctgcaccgactgctggccctggctaccagtggcagcttccctgggcagtacactgaggcagatctggaccgcatcggagagcatcttccacgggagaaccttggagtgaaacagaacatcaaaaaagagatggtgctgcagagattccatcagcaggtttgtagccatctgcatctttttttcttgatcggggacaagcaggcccacaaacagcttccttccacgctgttcctgagattgcttcaactggcaaccgcctccatcgataggtacgaaccctgggatcaggcagctctcgctaaagtggcccagcatcatctggaaggtgcccaaagcgtcccactggatgatgggagctggaagtacccggaccttcaggcatcgatcccgtccgtcgcaaaggcaatggccttaatccacctgtccgcaacccactatcatgagcacctttgccccgcacttcccctcgtcacgcccaagaccttcttagattttctcgacacattcttgatgctccagcaacaaactatcttgaaaatcaagaataaagcccagcgggttcagaatgccttggaaaatctgagaatgctgatcaaggaacatggaacacatgccaacctaatattcgatctggaacagcaattaaaggatagcggcaaatccctcagcatgttccagcaacagctggagcaaagcaagctgctgtacaagcaacagctcgaggaatgtagacatcaggaaaacctgatcgagaaccttgctaggcagagagatgcccttcaggcccagcgagaagctttcttggagcagatgagtaaggcatttttagagcccctaagtcagctgcaggtcgccgactttgaggagatccgaagctatagggccccgccagagtctgtggtgcgcgtgactgacgctatgtgtgacctatttcaccatgagacaggctgggcatctgcaaagcaattgttgtgcactgaggacttctaccaggagctggtgttcttcccaaaagagaaaatcacggacagcgagctcattaagctccacctgattctgaaggctcccggcatggacgacgccgcacttagagcggtatcacggcctgcagcttcgctggccgcctggctatgggccgttttgcactacggtctggcacattgccggggcttgcccacagaccttctgttgcagcaggtcgaggccaccctcacccgagagcaggcaaggctcggttactatcagttccaagcccaggagacgctggagcacaatcttgctttggccaaaatggtggaggatgctcaggcgagtcacaattgtgtcgctaagaccctcagtcaagcacagtgtggccagtatcacaaatggccgatgaaggccgcccttcttacacccatgagagcctggacaacccaactgcagaaactcaagggacgatgtatgactgtgttcggtgatactctactctgttccgcggcgataatctatttaggccctttccctcctctgcggcggcaggagctgctggacgagtggttagccctgtgcagagggtttcaggaggctctgggccccgatgatgtggcccaagctctaaagcggaagcaaaagagcgtgtccattcctcccaagaatcccttactagctacacatagtccatttagtattctaagtctccttagttcggagtccgagcagtaccagtgggatggaaacctcaagccgcaggccaagtccgctcatttggctggcttgcttctccggagcccgactcactacagttcttgcaggtggccactgcttttagaccccagcaacgaagcgcttatctggttggacccccttcctttggaagagaaccggtcgttcgctccagccttaacagaaggccggggcaagggcctaatgcgaaatcagaaacgcgaaagcaagacagacatgaaggaagaagacgacgagagtgaggagtcaaacgaggccgaggatcagactaaggaacagaaagctgaagagcgcaaaaatgagcaagaaaaagagcaagaagaaaacgaggagaaggaagaagagaaaacagagagccaggggtccaaacctgcttatgagacccagctcccatcccttccctacctgagtgttctgtccggcgccgaccctgagctgggctcccagctccaggaggcagctgcctgtggcctgccggtgctgctcacaaatgtggaactgggtctgggatgcgaggaactgcagtggctgttacagagagaacaactgtctcctccgcaggtgcaacccggattttgcctttatctttcgaccacgttgagcctgtgcgccatggaaaaagtgctaggatgcgaattactcaaaggcctcaatgtgttagacctcggactaaatatggagatcctggaggagcagatgttgcacgagatcttatgtagggagtatcctgaactggagactcggtggcaggacctcaaaattagggcacttgacacatgcaaagccgttgaggctgctgaagagcgcctgcttaccatgctgcttttccagaaccctaagcggcaaaagccggctaagtttctgagaaatattgttcgggctcagggcaaattgtgccagctgcgtgcccactgtgaagagctggagggacagaagctccaggaaatggtgctctgggctccatataggccagtggtgtggcatggcatggcaatggtgaaggctctgtctcagctacagaacctcctcccactattctgtatgagcccagagaattggcttgccgttacaaagcaggccctggatagcatgaagccacgggagatcaatcatggagaggacctcgcctcgcacttgcttcagctgagggcacatcttacccgacagttgctgggatctaccgtgactgccctgggactgacacaggttcctttagtaggggccttgggtgcactggccctgcttcaggccaccggcaaagcctctgaactggagcggctagcgctgtggcccggcttggcagcttctccatccactgttcacagcaagccagttagcgatgtggctcggcctgcttggttggggcctaaagcatggcacgaatgcgaaatgcttgaactccttccccctttcgtcggcctgtgcgcctcgctggctggccactcttctgcttggcaggcttacttgtccctcagctcaacagtcctgggtcccgcccccggccccggtccagagcctctctctttactgcagaaactgattctctggcgggtgctgcggcccgagtgcttagccggagccttagccgactttacgacatcccttctcggcagaccactcgatgaaaacacctacgccccaacaatgccatttaaacactcacaggctacccagccaatgctgatcttgttgcccccaccaggtcacccttctgcaaccctgcatcctctgaccgttatccaaaagctggcagctaaatatcagcagggacagaagcagttacaggtgattgctttgggaagcgaagcgtgggaccccgtgtctgttgtcgtaagtaccctgtctcaagctatgtatgaagggcactggctggtcttggataattgccacttaatgccacactggccaaaggagctgctgcagctcttactagaattacttggccgagccaaagtggtcgctgatttggaatctgagcagctccttgatcaacctgaatcaagaaatgtcagcaccgtgcatcgggactttcggctgtggctaattgttccagccgaaagttctgcctccctgccagctgtgttgacacagcacagtatgcccgtgttctggaaccagtctctcgaactgggccacgttttgatcgattcagtggaacttgctcaacaggtgttatacatgcagccccctactcaggccctgcctctactgctactccacggcctcctgcttcaccgacagctgtatgggacaaggctccaggctcacaggggcaggtggtcacaagtgacactgactcaggtgctgcagacccaggaccagctttgggccagcttgagcaacccccgggccgccatgcaagaactagccgcttccgtcttttatggcggaccactgggcgatacagaggacagagaagctctcattagtctcacacaggcctgcttatcaccttcctctggatcctgggttcagccccatacaccacaatccctgctggcaactctcatgcctctacccgagctgagagaactggacgcaatggccgaatgtaaggcccagatgcatctgctcccttctccacctgaaccccgactgtgtggcctgagtgaggggcctcaggcctggcttctaaggaggcagtctcgcgctcttctctctgccctccaacggagcagcccagtatgggtgccagaatctagaaggggtgcacagctcgccgagaggcgcctccgacagaggctggtgcaggttaaccgaagactggagagcttgcaggatctgttgacccacgttatccgacaggatgagtccgacgcaccctggagtgtattagggcctaatgcgcggagacctttagaaggtgttctggagaccgaggctctggaactgtcacaactggtcggcacactgcagcgcgatctggactgccttctccagcagttgaaaggggcgcccccctgtccctctagacgctgcgccgccgtcgcacatgcactctggacaggacgcctgcccctgccgtggcgacctcatgccccggccggaccccaacccccttggcactggttgaggcagttaagtagacgggggcaactgctggtgcggtatctgggggtcggagcagacgctagctctgatgtgcccgaacgggtgtttcacctaagcgcctttagacaccccagaagactattactagcgttgcgcggggaagcggcccttgaccagaatgtgccaagttcaaactttccgggatctcggggctctgtttccagccaactgcagtacaagagactcgagatgaatagcaatcccctccacttccgagtcgaaaacggcccaaatccaactgtgcccgagcgtgggctgctcctgatcggcctgcaggtactgcatgcggagtgggaccctatcgccggcgccctccaggatagtccatcttcgcagccctctccactgcccccagtatcaatctccacacaggcgccaggcaccagtgacttacccgcccccgctgatctaacagtgtattcatgtcctgtatatatgggtgggccattggggaccgctaaactccaatccagaaacatcgtgatgcaccttccactcccaacaaaattgactcccaacacctgtgttcaacgacgggtgcacgtgtgttccccaccgctgagttag

SEQ ID NO: 22900 - DNA, 1179 bp, Artificial Sequence
  Description of Artificial Sequence: Synthetic coding sequence
atggacctgttcggcgacctgcccgagcccgagcggagcccccggccagccgccggtaaagaagcccaaaagggcccactgttgttcgacgatttaccacctgcaagttcaacagatagcgggagtggcggccccctgttatttgacgatctgccccccgcaagttcaggcgacagtgggtccttggctacttccatcagccaaatggttaagacagagggcaagggagcaaaaaggaagaccagcgaagaagaaaagaatggctcagaggagctggttgaaaagaaggtgtgcaaagcctcctcagtcatttttggtttgaagggttatgtggctgagcggaaaggtgagagggaggaaatgcaagacgcccatgtgattctgaatgatatcactgaagagtgccgaccaccttcttccctgatcacccgggtgagctattttgccgtctttgacggccatggtgggatcagagccagcaagtttgccgcccagaacctgcaccagaacctcatccgaaagttccctaaaggcgacgtcataagtgtcgagaaaacagtcaagagatgtttgttagatacatttaaacacactgatgaagagttcctgaagcaggcgtcctcccagaagcccgcctggaaggacggctccacggcaacatgtgttctggcggtagataatattctttacatagccaatctcggggacagtagagccatcctctgccggtacaacgaggagtcccagaagcatgccgcccttagcctgagcaaagagcataaccccactcagtatgaagagagaatgagaattcagaaggctggggggaacgtgagggatgggcgtgtgctgggcgtcctcgaagtgtcccgatccatcggggatggccaatacaagaggtgtggggtgacttctgtgcccgatataagaagatgtcagttaaccccaaacgatagattcatccttttagcctgcgacgggctatttaaagttttcacccctgaagaagctgtgaacttcattctgtcatgccttgaagacgagaaaatacaaacgcgcgaaggcaaaagcgctgcggacgcccgctatgaagccgcttgtaaccgacttgcaaacaaggcagtccaaagagggagcgctgataatgtgactgtgatggtagtgagaattggccattag

SEQ ID NO: 22901 - DNA, 2193 bp, Artificial Sequence
  Description of Artificial Sequence: Synthetic coding sequence
atgttcggccggaagcggagcgtgagcttcggcggcttcggctggattgacaagacgatgctggctagcctgaaggtgaagaaacaggaactagcaaattccagtgacgcgactctgcccgaccggcccttatcacctcccctgacagctcctcccaccatgaagagctctgagttttttgagatgctagaaaaaatgcaggggatcaaactggaggagcaaaaacctggaccacaaaagaataaagacgactatattccatatcccagtatcgatgaagtggtcgagaagggggggccttacccccaggtgattcttccccagtttggcggatattggatcgaagatcctgagaacgtaggcacccctacctcactaggatcatcaatatgcgaagaagaagaggaggacaacttgtcccctaacactttcgggtacaagctggagtgtaagggtgaagcccgggcttatcgtagacacttcctgggcaaagatcatttaaacttttactgtacgggtagctcactaggtaacctgattctctccgtaaagtgtgaggaagctgaagggattgagtatcttcgcgtgatactgcggagtaaacttaagacggtacatgagagaattcctctcgcaggcctcagcaaacttccctccgtccctcagatcgccaaagcgttttgcgacgacgcggtcggacttagatttaacccggtgttatatcccaaggcctctcagatgattgtgtcctacgacgaacatgaggtgaataacacgtttaagttcggtgtaatttatcaaaaagcccggcaaacactcgaggaggagctttttggcaacaacgaggagtctcctgcatttaaggaattcctcgacctgttgggtgacacaattactctgcaagactttaaggggttccgcggcgggctagatgtgacccacgggcagacgggagtcgaaagcgtttacaccacattcagggatcgcgagataatgttccacgtgtctaccaagctgccctttacggatggcgacgcccagcagctgcagcgcaaaagacacatcggcaacgacattgtggccattatctttcaggaggagaacacaccttttgttcccgacatgatcgcttctaattttctccacgcatatatcgttgtccaggtagagacccccggaacagagaccccctcttacaaggtgtctgtcacggcgagagaggatgtgcccacgtttggaccgcccctgccttcaccgccagtattccaaaaaggccctgagttccgagaattcctgctcaccaagcttacgaatgccgagaacgcatgttgtaagtctgataagtttgccaagcttgaggaccggacccgcgccgccttactggacaacctgcacgatgagctgcatgcccatacacaagccatgctgggtttgggtcccgaggaggacaagtttgaaaacgggggccacggtgggttcctggagtctttcaagagggccattcgcgtgcggtctcacagcatggagacgatggtgggtggtcaaaagaagtcgcattcaggaggaatcccgggaagcctcagcggcggtatatcacacaactcaatggaggtcacaaaaactaccttctcgcccccagtggttgcagccacagtgaaaaatcaatcgagatcaccgataaaacggcgcagcggcttgtttcctcgtctccacaccggatctgagggccagggagactcccgtgctcgttgtgactcaacctccagtactccaaagactcccgatggagggcacagctctcaggagatcaagagcgagacgtcaagcaatcctagctcccctgaaatctgccccaataaggaaaaaccatttatgaagttaaaggagaacggcagggctatctccagaagttcttcctccacatccagcgtgagcagcacagcgggcgagggcgaggccatggaagaaggagactcgggcgggagccagccgagcacaacctctcccttcaagcaggaggtgtttgtctattcaccatcaccctctagcgaaagtcctagcctcggagccgcagcgacaccaataatcatgagccggtcgcctacagacgccaaatccaggaactcacctcgctccaatttaaaattcagattcgataaactgtcacacgctagtagtggcgctggtcactag

SEQ ID NO: 22902 - DNA, 1110 bp, Artificial Sequence
  Description of Artificial Sequence: Synthetic coding sequence
atgtggagcggccggaagctgggcagcagcggcggctggttcctgcgggttttgggccctggcgggtgtaacactaaggctgcccgtccgcttattagctcggccgtgtatgtgaagaatcagctaagcgggaccctgcagataaagcctggtgtattcaacgaatatcgaacaatctggttcaagagctaccgcactatcttcagctgtctaaatcggatcaagagcttccgctatccttgggcccgactctatagcacttcgcagaccactgttgatagtggcgaggtcaaaacctttctggctctggcccacaagtggtgggacgaacagggcgtatatgcgcccctgcattcaatgaacgacctgagggtgccattcatcagggacaatctgctgaagactatccccaaccaccagcccggcaaacctctgcttggcatgaagatcctggacgtgggttgcggcggcgggcttcttacagagcccttgggacgattaggagcaagcgtaatcggaattgatcctgtggacgagaacattaagacagcacagtgccacaagtcattcgatccagtgctggacaaaaggatcgaatacagagtctgctcgctcgaggagatagtggaggagaccgcagagactttcgacgccgtggtagcatccgaggtcgtcgaacacgtgatagaccttgaaacctttcttcagtgctgctgccaagtgttgaagcctgggggtagtttgtttatcactactatcaacaaaactcagctgagctacgcattaggtattgtctttagtgaacagatcgcaagcatcgtcccgaaggggactcatacctgggagaaattcgtttcccctgaaaccctggaatccatcctcgaaagcaatggcctgtccgttcagacagtcgtcggtatgctgtacaatccttttagcggctattggcattggagtgagaatacaagtctcaactacgccgcttacgctgtgaagtctcgtgtgcaggaacatcccgcgtccgctgaattcgtgctgaaaggggagacggaagagctgcaggccaatgcttgcaccaaccccgcagttcacgagaagttgaagaaatag

SEQ ID NO: 22903 - DNA, 1782 bp, Artificial Sequence
  Description of Artificial Sequence: Synthetic coding sequence
atggagggctgcatgggcgaggagagcttccagatgtgggagctgaatcgacggctagaagcttacctggcccgagttaaagcactcgaggagcagaacgaactacttagcgcagaattaggcggtctcagagctcaaagcgccgacacttcttggcgggcccacgctgacgatgagcttgctgcgctgcgggctttggttgaccagcggtggcgtgagaaacatgcggcagaagtcgcccgagacaacctcgctgaagaactcgagggcgttgccggacggtgccaacaacttcggctggcaagagagcggaccacggaagaggtggcccgcaataggagagccgttgaggccgaaaagtgcgcacgggcctggcttagttcacaggtcgccgagcttgaacgagaactggaagcccttcgcgtggcccacgaagaggagcgggtcggcctgaatgctcaagcagcctgtgcaccacgctgtccagcccctccccgggggccacctgctccagcgccagaagttgaggagttggcaagaaggctcggagaagcctggcgtggagcagtccgtggctatcaggaacgcgtcgcacatatggaaacctctctgggccaggcccgggagcgactgggcagagccgtacaaggcgcccgcgaaggtagacttgagttacagcagctacaagccgaacggggtggccttttggaacggagggccgccctagagcagagacttgaaggtaggtggcaggaacggctgagagcaaccgaaaaatttcaactggctgtggaggcccttgagcaggaaaaacaggggctgcagtcacagattgctcaggtgctggaaggacggcaacaacttgcacacctgaaaatgtccctgtcgcttgaggtggccacatacagaactctgctcgaagctgagaacagtcggctgcaaacccccggcggtgggagcaaaacctcactatcttttcaggatcctaagctagaactgcagttcccccggactccagagggacggagattgggatcgctccttcctgttctgagtcccacctccttaccatccccattgcctgcgacactggagactcccgtgccggcatttttgaagaatcaggaatttctccaggctcggaccccaacactggcatccacccccattcccccaaccccgcaggctccatcaccagccgtggacgccgagatccgagcgcaggacgcccccttgtctctgctccagacacagggcgggagaaagcaggctcccgagccactgcgtgcagaggcccgggttgctatacccgcgtcagttttgccgggaccagaagagccaggaggtcaacgccaagaagcatctacaggccagtcgccagaagatcacgcttcactagcacccccactcagtcctgatcacagcagcctggaggctaaggacggggagtccggcggctctagggtcttctccatttgtcgtggggagggggaagggcagatttggggccttgtggagaaagagacggccattgaaggtaaggtcgtctcctccctccagcaggagatctgggaagaagaggacctaaataggaaagaaatacaggactcacaggtcccattggagaaggaaaccttgaagtctttaggcgaggaaattcaggagtccctaaaaactcttgaaaaccaatcacacgagactcttgagcgggaaaaccaagagtgtcctcgtagcttggaagaagaccttgagactctaaaaagtctggaaaagaaaaagtag

SEQ ID NO: 22904 - DNA, 3456 bp, Artificial Sequence
  Description of Artificial Sequence: Synthetic coding sequence
atgatggccgccgccctgggcccccccgaggtgatcgcccagctggagaatgccgcaaaagtgctgatggcgccgccatccatggtaaacaacgagcagaggcaacatgcagagcatatcttcttgtcgtttagaaaaagtaagtcgccttttgcagtgtgcaagcacatcctggaaaccagcaaggtggactacgtcctgttccaggccgctacagctatcatggaggcagtggttcgtgagtggattctgctcgagaaaggctctatcgagtctctgcgcaccttcctgcttacttacgtcctgcagagaccaaacctccagaagtacgtccgggagcagattctcctggccgttgcagtgatcgtaaaacgggggtcgctggacaagtctatcgattgtaaatctatcttccacgaggtgtcacagttaatcagtagcggcaaccccactgtccagacactagcctgtagcatcctgactgccctgctatccgaattttcctccagctcaaaaacaagcaatatcggcctcagcatggagtttcacggaaactgcaaacgagtgttccaggaagaagacctgagacagatttttatgcttactgtggaagtccttcaagaattcagccgaagggagaacctcaacgctcagatgtcaagcgtgttccagcggtacctagctctcgccaaccaggtcctcagctggaacttcctgccaccgaatctgggccgtcactacattgccatgttcgagagctctcagaacgttctgttaaagccaacggaatcgtggagggagaccttgctcgactctcgcgtcatggagttattcttcacagtgcatcgtaagataagggaagattctgatatggcccaggactcactgcagtgtttggctcagttagcaagcctgcacggccctatctttcccgatgagggcagtcaggtggactaccttgcgcacttcatcgaaggcttgctgaatacaattaacgggatcgagattgaggatagtgaagccgttggcatatcctccatcatctcaaatctcataacagtgttcccaagaaacgtattgaccgccataccctcagaacttttttctagtttcgtgaattgtctcacccatctcacatgcagctttggtaggagcgcggctctcgaggaagttctggacaaggacgatatggtgtacatggaagcatatgataaactgcttgaaagttggctgaccttagtccaagatgacaagcacttccacaaagggttcttcacccagcacgctgtccaggtgtttaattcctacatacagtgtcatttggccgccccggatggaacccgcaaccttacggcaaatggggtggccagcagagaagaggaggagatttccgaactgcaagaggatgatagggaccaattctctgaccaactcgcctccgttggaatgctgggacgcatcgccgccgagcactgtatcccactgctcacctcccttttggaggagcgggtgaccagactccatggacagctccagagacatcagcagcagcttcttgccagtcccggctcgtcgacagttgataacaaaatgttggacgatctctacgaggatatccattggctgatcttggtcactgggtatctgcttgccgacgatacccagggtgagacacctctcattcccccggaaattatggaatactccataaagcacagctctgaagttgatattaacaccacgctacagattctgggctcaccaggggaaaaagctagcagcatcccagggtacaatcggacagactccgtaatccggctgttgtccgccatcctgagagtgtccgaagtggagtcacgcgccatcagagcggatctgactcatctattgagcccccaaatgggcaaagatatagtctggttcctgaagagatgggccaaaacatacctgttagtggacgagaagctatatgaccagattagcctgcctttttcgacggctttcggtgctgacaccgagggatctcagtggatcatagggtacctcctgcagaaagtgatcagcaacctatccgtctggtcctcagagcaagacctggcaaacgatacggtacagctcctcgttactttggtggaacgacgcgagcgcgccaatctggtcatacagtgtgaaaactggtggaatctggcaaagcagtttgcgagtaggagcccgccgcttaacttcctaagttcccccgtgcaacgcaccctaatgaaagcccttgtactgggcggcttcgcccatatggataccgagaccaagcagcagtattggacggaggtgctacaacctctccagcagcggttcctccgggtcatcaaccaagagaatttccaacagatgtgccaacaagaggaggtgaaacaggagattactgccacccttgaagccctgtgcggtatcgcggaggcgacccagatagataacgtggcgatcctcttcaacttcttgatggacttcctgacaaactgcatcggtctgatggaggtatataagaacacaccagagacagtgaatctgataattgaagtctttgtggaggtggcacataagcagatttgctacctgggggagagtaaggcaatgaacctgtacgaagcatgcttaacccttcttcaagtctatagtaaaaataacctaggccgccaacggatcgatgtcaccgctgaagaggagcagtaccaggacctgcttctcattatggaacttttaacaaacctgctcagcaaggaatttatagatttttctgatacagacgaggtctttcgtgggcatgaacccggacaagcagcgaatcggtcagtctccgctgccgacgtagtactgtatggggtcaacctgatacttccgctgatgtcgcaagacttgctgaagttccctacgctgtgtaaccaatattacaaactgatcactttcatttgcgagatttttcctgagaagatcccacagctgcccgaggacttgtttaaaagcctgatgtacagcttagagctcgggatgacgtccatgtcttccgaggtctgtcagctttgtctggaagccctgacacctctcgcggaacagtgcgccaaggctcaggagaccgattccccactgttcttggccacgagacactttctaaagttggtgtttgatatgctggtgttacagaagcataacactgagatgacaacagcagccggtgaggctttttacactcttgtttgtcttcatcaggcagaatactctgaactggtggagacgctgctgtcgagccagcaggatccggtgatttatcagagacttgccgacgctttcaacaagctgactgcttcttccactccccccaccttagaccgaaagcagaagatggccttcttgaagagtctcgaggagttcatggctaatgtcggcggcctattgtgtgtgaaatag

SEQ ID NO: 22905 - DNA, 1578 bp, Artificial Sequence
  Description of Artificial Sequence: Synthetic coding sequence
atggccgccggcggcagcggcggccgggccagctgcccccccggcgtcggagtgggacccgggactggcgggagccccggcccctccgctaacgcagccgcaaccccagcccccggcaacgcagctgctgccgcggcagctgcagcagcagctgctgcagcgccaggacctacacctcctgccccaccggggccgggcaccgatgcacaggccgcaggagctgagcgggcagaggaggccgctgggcccggggcagcggctctgcagagggaggccgcctataattggcaggcctccaagcctacagttcaagagagatttgctttcctgttcaataacgaagtcctgtgcgatgtacacttcctggtgggaaaaggtctgtccagccagcgtatccctgctcaccgcttcgtgcttgccgtgggtagcgcggtatttgatgctatgttcaacggtgggatggcgaccaccagcactgagatcgagctgccagacgtcgagccagctgcgttcctcgccctgctgaagttcttgtacagtgatgaggtacagatcggacctgagacagtaatgacaactttgtacaccgccaaaaagtacgctgtgcccgctctggaagcccactgcgtggaattccttaagaagaacttgagagctgataacgctttcatgctgctaactcaagcgcggcttttcgatgaaccccagttagcctccctgtgcttggaaaacatcgacaaaaatacagcagacgccatcacagccgaaggctttacagatatcgatctggatacacttgttgccgttcttgagcgagatacgctggggatacgagaagtaagactgttcaacgccgtggtgcggtggtcggaggccgagtgccaacggcagcaactgcaggttaccccggaaaaccgccggaaagtccttggaaaggcccttgggctgatcaggttcccgttgatgaccatcgaggaatttgctgccggccctgctcagtccgggatcctcgtcgacagagaggtagtgagcctctttctccatttcaccgtaaaccctaaaccaagggtggagtttatcgataggccacgctgctgtcttagaggaaaagaatgctctatcaaccggttccagcaggtcgagagtaggtggggttatagtggcacctccgataggattcggttctccgtgaacaagcggatcttcgtggtcgggtttgggttgtacgggagcattcacgggccaactgattaccaggtaaacattcagatcatccacactgacagcaatactgtactgggacagaatgataccggcttttcatgtgatggctcagcctccacctttagggttatgttcaaggagcctgtggaagtgctgccgaatgttaactacaccgcctgcgccactcttaagggcccggattctcattacggcacgaagggcttgcggaaagtaacacacgagagccccactacaggggctaaaacgtgcttcaccttttgctacgccgccggaaataataacgggaccagcgtagaagacggccaaatccccgaggtaatattctacacctag

SEQ ID NO: 22906 - DNA, 525 bp, Artificial Sequence
  Description of Artificial Sequence: Synthetic coding sequence
atggccaccgtggccgagctgaaggccgtgctgaaggacaccctggagaagaagggggtgctaggccacttgaaggcacgaatccgggccgaagtttttaacgcactggacgacgacagggagcccagaccaagcctttcccacgaaaacctgttaatcaacgagctcatccgcgaatatcttgagttcaacaagtacaagtacacagcttccgttttgatcgccgagagcgggcaacctgtggttccactggacaggcaatttctcatacacgagcttaatgctttcgaagagtccaaagacaacactattccattgctgtatgggatcctggctcacttcttaaggggtactaaggacggcatacagaacgcctttctcaaaggcccttcattacagcctagcgatccttcgctcgggagacagccttcccgcagaaagcccatggacgaccatctgagaaaggaggagcagaaatccacaaacatagaggatttgcacgttagtcaggccgtgaatcgttag

SEQ ID NO: 22907 - DNA, 1257 bp, Artificial Sequence
  Description of Artificial Sequence: Synthetic coding sequence
atggccggcagcctgcccccctgcgtggtggactgcggcaccggctacacaaaactgggatacgccggaaacactgagcctcaattcattattcccagctgtatagccatcagggaaagcgcaaaagtggtcgatcaggcgcaacgtagggtgctgcgtggagttgatgatctcgattttttcattggcgacgaagccattgacaagccaacctacgctacgaaatggccaattcggcacggtattatcgaagactgggatctgatggaaagattcatggagcaagtagttttcaagtatctgagggccgagccagaagaccactactttctgatgactgagcctccattgaataccccagagaatcgcgagtatttagctgagattatgttcgaatccttcaacgtgcctggcttatatattgccgtccaggccgtgctcgccctcgcagcttcgtggaccagccgccaagtcggagaacgtactttgaccggaatcgtcatcgactctggggacggagtgacacacgtgataccagtggctgaggggtatgtaattggatcctgtatcaagcatattccaatcgctggtagagatattacatatttcattcaacagctgttacgggaaagagaggtgggcattccccccgaacagtctctggaaaccgcgaaagccatcaaggagaagtattgttatatttgtcccgacattgtcaaagagtttgctaagtatgatgtagatccccggaaatggatcaaacagtacaccggcataaatgcaattaaccagaagaagttcgttatagacgtcggatacgagcgtttcctaggccccgaaatctttttccaccctgaattcgctaatccagattttatggaatcaatcagcgacgtcgtcgacgaggtaattcaaaattgtccaattgatgtgcgccgccctctgtataagaatgtggtgttgtccggcggctccaccatgttcagggattttggccgcaggctgcagagggacctgaagcgtgtcgtcgatgcccggctcagactgtccgaggaactttccggaggccgcataaaaccaaagccggtcgaggtgcaagtggtaacacatcatatgcagcggtacgccgtctggtttggaggaagcatgctggcgagcactcccgagttcttccaggtgtgtcacaccaagaaggactatgaggagtacgggccctcaatctgccgacacaacccagtgttcggagtgatgagctag

SEQ ID NO: 22908 - DNA, 1044 bp, Artificial Sequence
  Description of Artificial Sequence: Synthetic coding sequence
atggccgccgccgagcccgccagcagcggccagcaggcccccgccggtcaaggccagggacagcggccccccccccaacccccgcaggcccaggcccctcagcctccaccccccccacagttgggcggggccggtgggggctcaagtcgccacgagaaaagcctcgggctgctcaccacgaagttcgtgtcactgctgcaggaggctaaagatggtgtcctggacctaaaagccgccgcggatacactggcagtccggcaaaagagacgcatttatgatattacaaatgttctggagggcattgatctgattgaaaaaaaatccaaaaactccattcagtggaagggggtgggagcagggtgcaacaccaaagaagtaattgacagacttaggtatttaaaagcagaaattgaagacttggaacttaaggagcgggaactagatcaacagaaactttggctgcagcagtcaataaagaacgtcatggatgactccataaacaatagaactttctcctacgttactcatgaggatatttgcaattgtttcaatggggatacgctgctcgccatccaggccccttctggcactcagttggaagtaccaattcctgaaatggggcagaatggtcagaagaaataccagattaatcttaagtctcattctggtcccatccatgtgcttctcatcaacaaagagtctagtagctccaagcccgtcgtgtttcccgttcccccaccagatgatcttacgcaaccctcctcccaaagcttgacaccagtgacaccgcagaagtctagtatggcaacacagaacctccccgaacagcatgtatccgagagaagccaggcgcttcagcagacatccgccaccgatatttcttctgctggatctatcagcggagacattattgatgaattaatgagcagtgatgtctttcccctgctgagactcagccccacccctgcagacgattacaattttaatctagatgacaacgaaggagtgtgtgatcttttcgatgttcagatattaaattactag

SEQ ID NO: 22909 - DNA, 636 bp, Artificial Sequence
  Description of Artificial Sequence: Synthetic coding sequence
atgtgccccggcaactggctgtgggccagcatgaccttcatggccagattttccagatcttccagtcgcagccccgtgcgtactaggggcacgctggaggagatgcccacggttcagcacccattcctgaatgtgtttgagctggagagactgttgtacacaggaaaaaccgcctgtaaccatgcagacgaggtatggccaggcctgtacctgggggatcaggatatggccaacaaccgaagggaacttcggcggttgggcattactcacgtgctgaacgcatctcactccaggtggaggggcacacccgaagcctacgaagggttgggtatccggtacctgggagtggaggctcacgactcaccagctttcgatatgtcaatccacttccagacagcagcagattttatccatcgcgcgctctcccaaccggggggaaaaattttagttcactgtgcagtcggcgtgagtcggagcgcaactttagtgctggcctacctgatgctgtaccatcatctgaccttggtggaggccatcaaaaaagtcaaagatcatagaggaatcatccccaatcgtggcttcttaaggcagctgttggctttagatcgtaggctgaggcagggactagaagcttag

SEQ ID NO: 22910 - DNA, 948 bp, Artificial Sequence
  Description of Artificial Sequence: Synthetic coding sequence
atgcccggcctgagctgccggttctaccagcacaagttccccgaggtagaagacgtcgtgatggtgaacgtgagatcaatcgccgagatgggagcctacgtgtccctcctggaatacaataatatcgagggaatgatcctgctgagcgagctgagtcgccggcgcattcgctccattaacaagctgatcaggattggtcgaaacgagtgcgtggtggttattcgggtagataaggaaaagggctacatagatctgagtaagcggcgcgttagcccagaggaagctatcaagtgcgaggacaaattcacaaagagcaagactgtgtacagtatcttgcgccacgtggcagaagttttggagtacaccaaggatgagcaactggaatctctgttccagcggaccgcatgggtattcgacgacaagtacaaaagaccaggatacggagcatatgacgcattcaagcatgccgtgtccgatccgagcattctcgattcattggacctaaacgaggacgagcgtgaggtgctcattaataatattaataggcggctcacaccacaggcagttaaaataagggccgacatagaagttgcctgttacggctacgaaggtattgatgcggtcaaggaagctctgcgagctggactcaattgctctactgaaaatatgccgattaaaatcaaccttattgcccccccccggtacgtgatgacgacaacaaccctggagcggaccgaagggctctctgtcttgtctcaggccatggccgtaataaaagagaaaatcgaggagaaaaggggggtgttcaacgtgcaaatggagcctaaggtcgtcacagataccgatgagaccgagttggcccgacagatggaaagactggagcgagagaatgccgaagtcgacggtgatgatgacgctgaagagatggaggccaaggcagaagattag

SEQ ID NO: 22911 - DNA, 318 bp, Artificial Sequence
  Description of Artificial Sequence: Synthetic coding sequence
atggccggccaggaggaccccgtgcagcgggagatccaccaggactgggcaaatagggagtatatcgagatcattacctcaagcataaagaaaattgcagatttcctgaactcctttgacatgtcgtgcagatcaaggctcgctactctgaatgagaagctgaccgctttggagaggcggatcgagtacatcgaggctcgcgtgacaaagggagaaacattgagaacggttccttgctgctgctgggaagtggccctacacaatactgggcacatgggtaaggcccctgccgccttctcctccttcctgtctccctag

SEQ ID NO: 22912 - DNA, 1902 bp, Artificial Sequence
  Description of Artificial Sequence: Synthetic coding sequence
atggccgccgccgccgccgccgccaccaccgccgcctgcagcagcgggagcgcgggtactgacgccgccggggcgagcggcttacaacagccaccaccccagcctcagccccagcctgccgcagccgctccagcccagcctccccctgagccaccacgcaaaccccggatggaccctcgtcgaagacaggcggctcttagttttttgactaatatctccttggacgggagacttcctccccaggatgcagaatggggcggtggggaagaaggaggggcagctaagccaggtgccggtggtgcttgtggtgcccgtaccaggttttctctcctggctgccgctgagagagggggttgcatcgccctcgcagcaccaggcacgcccgcggcaggcctggctgcggggtcaggcccctgcctgccccagccctccagtctgccccctttaattccaggcggccacgcaacggtcagcggccccggggtcgcccgcggctttgcaagccctctgggtgccggtagagcaagcggtgagcagtggcagccgccaagacccgccccccttgcagcatgtgctcagctacagctccttgacggctcaggtgcagctggtcaggaagagttggaagaggatgatgccttcatcagcgtacaagtccctgccgctgccttcctgggctcaggcactcctggatccgggtctggttcaagaggccgcctgaatagcttcacccagggcattctgccaatcgctttcagtcgcccgacttcacagaactactgcagcctagagcagcctggtcagggcggaagtactagtgccttcgagcaacttcaacgctcccgtagaagattgatctctcagcgttcatccttggaaacattggaagatatcgaagagaatgctcctctcaggagatgtagaacactgagcgggagtcccagaccaaagaacttcaaaaaaatccacttcataaaaaatatgcggcagcacgatacccgaaatggacgtattgttctgatttctggtcgccgatctttttgctccatctttagcgtcctgccctaccgcgactcgacacaagtgggggatctgaagctcgacggggggcgtcagtcgacaggtgccgttagccttaaggagataattggactcgaaggagtcgagcttggggctgatgggaaaacagtctcttacactcagtttcttctccctaccaacgcctttggagcccgccggaacaccattgattccaccagctccttttcccagttccgcaatttgtctcataggtcgttgtctatcggcagagccagtgggacccagggctccctggataccggaagtgatctgggagattttatggattatgaccctaatctcctggacgatccacagtggccgtgcggaaaacacaagcgggttctgatcttcccttcatacatgactaccgttatcgattatgtcaagcccagcgatctgaagaaggatatgaatgaaacatttaaggagaaattccctcatataaaactcaccctgtccaaaatccgttctcttaagcgtgagatgcgcaagctcgcgcaggaggattgcggcctggaggaacccactgttgccatggcttttgtctattttgagaagttggcactaaaaggcaaacttaacaagcagaataggaagctgtgtgctggcgcctgcgtgttgctcgccgctaaaataggcagcgatctaaagaaacacgaagtgaaacacctcatcgacaaacttgaggagaaatttcggttgaaccggcgggagttgattgccttcgaatttccagtgctggtcgccctagagtttgctctgcatctccccgaacatgaagtgatgccacactacaggcggttggtccagtcctcctag

SEQ ID NO: 22913 - DNA, 3423 bp, Artificial Sequence
  Description of Artificial Sequence: Synthetic coding sequence
atgaccaccgccgtggagcggaagtacatcaacatccggaagcggttagaccagcttggctaccgacagactctgaccgtcgaatgcctgccattggtagaaaagctcttttcagacctggtccacacaaccgagtcactgcggcagtccaagctatcggctgtgaaagcagagaaggagtctgccaatttcgactttgtcctagagccatacaagctcgagaatgctcgcctttcacgggagaataacgaactttacttggagctgatgaaattgagagaacactcagatcagcacgttaaggagctcaaaacctccctgaaaaaatgcgcgcgggagacagctgaccttaaatttctcaacaaccagtatgcccacaagttgaagctgttagaaaaggagtccaaggctaagaatgaacgaatccagcagctccaggagaagaatctgcacgcagttgtccagactccaggtggaaaaaaacgctctatcgccttccggcgtcagcgcatgcagatcgacgagcctgtcccaccttctgaggtgtccagttacccagtgccccaacccgatgatccctacatcgcggatctgctacaggtggctgataatagaatacaggagctgcagcaggaggttcaccagctgcaagaaaaactcgccatgatggaatctggggttcgcgattactcaaagcagattgaactgagagagcgcgaaattgagcgcctgtcagtggcgttggacggaggcagatcacccgacgtgcttagtttagagtccaggaataagacgaacgagaagctaattgcgcatctgaacatccaggttgatttccttcagcaggcaaacaaggatctggagaaacgcataagagagctcatggagactaaggagacggtgacaagcgaggttgtcaatttgagcaataagaacgagaagctgtgccaggagctgaccgagatcgaccagctggcccagcagctggagcgacataaggaagaggttctggaaacagctgataaagaactgggtgaggccaagaaggaaataaagcgcaagctctctgagatgcaggacttagaggagaccatggcaaaactccagctcgagctgaacttgtgtcaaaaggaaaaagagcgtctttctgatgaactgctcgttaaaagtgacctggagacagtggttcatcagctcgagcaggaaaagcagcgtctgtcaaagaaagtagagagtttcgcagttaccgagcgccagctgacattagaagttgagagaatgcggcttgaacacggaattaaaaggcgtgaccggtcaccctcacgactcgacacttttctcaagggcatagaggaagaacgagattattacaagaaggagctcgaaaggctacaacacattatccagcgtagatcgtgttccaccagttactccgcccgggagaaatcaagtatctttcgtacccccgagaaaggagattacaactccgaaattcatcagatcactcgggagagggatgaactccagagaatgttggagcgatttgagaagtacatggaagatattcaaagcaatgttaagctgctcacagcagagcgcgataagttgtcagtcctttataacgaggctcaggaggagctgtcggctttacgcaaagagtcaactcagacaaccgctccccacaacattgtaagtctgatggagaaagaaaaagagcttgcgttgtcagacctccgtagaatcatggcggaaaaggaagccttgcgcgaaaaactggaacacattgaagaggtgtctctatttggcaagtctgagttggagaagaccatcgagcaccttacatgtgtaaaccatcagcttgaaagcgagaagtatgaactgaagtccaaagtcctgatcatgaaagaaacaatcgagagtttggagaacaagctgaaggtacaagcccagaaattcagccatgttgcgggcgactcatcccaccaaaagaccgaagttaattcgctgcggattgtcaacgagcagcttcagcgatccgtggacgattaccagcataggctgagcatcaagcgcggagagcttgaatccgctcaggcccagatcaagatcctggaagagaagatagacgagctgaatctcaagatgacaagccaggatgaggaagctcacgtcatgaagaagacgattggtgtcatagacaaagaaaaggatttccttcaagagaccgttgacgagaagactgagaagatcgccaatctccaagagaatctggctaataaggagaaggctgtggcccagatgaaaataatgattagtgaatgtgagagctccgtcaaccagctgaaggaaactcttgtgaatcgagaccgggagattaatagtttgaggagacagctggacgccgcacacaaggagctggatgaggtcggaaggagtagggagattgccttcaaggagaaccggcgtctgcaagacgaccttgctaccatggcccgtgagaaccaagagattagcctagagctagaggctgcagtccaggaaaaagaggaaatgaagagcagggtgcacaagtatattaccgaggtgagtcgttgggagtctctgatggcagccaaggaaaaggagaaccaggaccttctggacaggttccagatgttacacaaccgggcagaagattgggaagtcaaggcacatcaggcagagggggagagctcctctgtcagattggaactgttgagcattgataccgagaggagacacctccgggagcgggttgagctgctggaaaaggagattcaggaacacatcaatgctcatcatgcctacgaaagccaaataagcagcatggcaaaggccatgagccgactggaggaagagttgcggcaccaggaggatgagaaggctaccgtactaaatgatctttctagcctaagagagctgtgtattaaactggacagtggtaaagacataatgacgcaacagctaaattctaaaaacctggagttcgagagggtagtcgttgagctcgaaaatgtgaaatccgaaagcgacctgctgaagaagcaactatccaacgagcgtcacacagttaaaaacttggagtcactgttagcaaccaatcgggacaaggaatttcacagccacctgaccagtcatgagaaggacaccgagatacaattgctcaaagagaaacttacactttccgagtctaaacttacatctcagtcacgggaaaatacaatgctccgtgccaaggttgcccagttgcagactgattatgacgctttgaaaagacagatctctaccgagcgctacgagcgggaaagagccatccaggagatgagacggcacggcctcgcaacaccccctctgtcctccaccctccggtccccctcacacagccctgagcacaggaatgtgtag

SEQ ID NO: 22914 - DNA, 1512 bp, Artificial Sequence
  Description of Artificial Sequence: Synthetic coding sequence
atgcccaacgtggccgagaccgagcggagcaacgacagcggcaacggggagcacaaaagtgaaaggaagtctccggaggaaaatctgcagggggctgtaaaatccttttgtacatccgcatcaggggctccattgggccccaaaggcgatggccactacccatggtcttgccccgtgacacacactagagagaagatctatgcgatctgtagcgattatgcctttctgaaccaggccaccagcatctataagactcctaacccaagtcgatcaccctgcctccctgattcgaccagcttgtcagccggtaataacagctcgcgatacatcggaatccctacaagtacatcagaaatcatctacaacgaggagaactctctggagaacctgagtaacagcctggggaaattgccactggcttgggaaatcgataaatcagaattcgacggcgttaccacaaactccaaacataagagtggtaatgccaaaaagcaggtgagcaagaggaagacttccgataagaaaggaagatatcaaaaggagtgtccacagcactcgccgcttgaagacatcaaacagcgtaaggtgctggaccttaggcgctggtattgcatctcacgtcctcagtataaaacttcctgcggaatttcctcactgatatcctgctggaacttcctgtactcaacaatgggagccgggaacctgcctcctattacccaggaagaagccctgcacattttgggctttcagccaccctttgaagacataagattcggaccgttcactggaaatactaccctgatgcgatggtttcgccaaataaatgatcattttcacgtaaaagggtgctcctacgttctgtacaagcctcatgggaaaaacaaaacagcgggcgagactgcctctggcgccctaagtaaactgaccagagggcttaaggacgaatccttggcctatatttaccactgccagaaccattacttctgccccattggctttgaggccactcccgtgaaggcgaacaaagccttctctcggggcccactgtcgccacaagaagtagagtattggatcctaattggagagtcgtctagaaaacaccctgccatccactgcaaaaagtgggcggacattgtgaccgatctcaacacccagaatccagagtaccttgatatccggcatttggagcgcggactccagtatcggaagaccaaaaaagtggggggcaacttacactgtatcatcgctttccaacgactgaactggcaacggtttggcctttggaactttccctttggcacgatccgccaggagagccagcccccaacacatgcccaaggaattgccaaatctgagagcgaagataacatcagtaaaaagcagcatggcagacttgggaggtcatttagcgcttcctttcatcaggactccgcctggaaaaagatgtcctcaatacatgagcgtcgcaacagtggctatcaaggctactccgactatgatggaaacgactag

SEQ ID NO: 22915 - DNA, 813 bp, Artificial Sequence
  Description of Artificial Sequence: Synthetic coding sequence
atggaggccgaggagctggagcaggagcgggagcagctgcggctgcaactgtgggaggcgtattgccaggtccgctacttgtgctcccacctgagaggcaatgacagcgctgacagtgccgtttctactgattccagtatggatgaatcaagtgagacctccagtgctaaagacgttcctgctgggtctctgagaacagccctcaacgagctaaagcgcctgatacagtcaatcgtagatggcatggagccaactggttctagaagactcgacgatgattcacttgaggagcagatcagacagacaagtgaagattcacgagcattaagggaattaatggaaggggaaaggggcaagctccggcagagcctcgaggaattgcagagactgcactcccaggtgacactgctgagcgttgaaatgaccgcccttaaagaagaacgggatcggttgagagtgacctctgaagacaaggaacctaaggagcagctccaaaaggctatcagggatagagatgaggcgattgctaagaagaatgcagtggagctcgaactggctaagtgccggatggatatgatgtccctcaatagtcaattactcgacgctattcagcagaaactgaacctgtctcagcagcttgaagcctggcaggacgatatgcaccgcgttatagacagacagctaatggatactcatttaaaggagcgatcccagcccgcagccgccctctgtagagggcattccgccggtagaggcgacgagccatccatcgcggaggggaagcggctctttagtttctttcggaagatttag

SEQ ID NO: 22916 - DNA, 2379 bp, Artificial Sequence
  Description of Artificial Sequence: Synthetic coding sequence
atgctgcccgccggcgagatcggcgccagccccgccgccccctgctgttcagaaagtggcgacgagaggaagaacctggaggaaaagagcgatataaacgtgacagtgctcattggctcaaaacaggtgagtgagggtactgacaatggggatcttccctcttacgtgtccgcattcattgaaaaggaagtggggaacgacctgaaatccctgaaaaaactggacaagctgatagaacagagaacagtgtccaagatgcagctggaggaacaggttttaactatttcgtcagagatccccaagagaatccgctccgctctcaaaaacgccgaagaatccaagcagttcctcaaccagtttttggagcaggaaactcaccttttctctgccatcaactctcatctccttaccgcccagccctggatggacgatcttggaacaatgatatcccagatagaagagatcgaacggcatctagcgtatctcaagtggatctctcaaatagaggagctttccgacaatatacaacaatacctgatgaccaacaacgtacccgaagctgcttcaacacttgtctcgatggccgaacttgacatcaagttacaggaatcgtcatgtacccacttactcgggtttatgcgcgctacggttaaattttggcataagattttaaaggacaagctcacttcagatttcgaagaaatcttagcccagttgcactggccattcatcgctcccccccagagtcagacggtgggtttgtcaaggcctgcctccgcaccggaaatttactcttacctggagacattgttctgccagcttctaaagttacagacatcagatgagcttttgactgaacctaagcagctcccagagaagtattctctcccggccagcccttccgtaatcttgccaatacaagttatgttgactcctctgcaaaagcgttttagatatcatttccggggcaatcgacagaccaatgttctgagcaaacctgaatggtacctcgcccaagtactgatgtggatcggcaaccacaccgagttcctggatgagaaaattcagcccattttggataaggtgggctcactggttaatgctaggctagagttcagccggggcctgatgatgctggtcctcgagaagcttgccactgacatcccttgcctgctgtacgatgacaatttgttctgtcacttggtagatgaggtgctcctgtttgagagggagctgcattccgttcatggctacccggggaccttcgcatcttgtatgcatattctcagtgaggagacatgcttccagagatggctgacggtcgaaaggaaattcgctctgcaaaaaatggacagcatgctgagtagtgaggccgcttgggtgtcccagtataaggatatcactgacgtcgacgagatgaaagtgcccgattgtgctgagaccttcatgactctgctcctggtaatcactgatcggtataagaatctccccacagcctctcgaaagttgcagttcctcgagttgcagaaagacctagtggacgatttcaggatcagactcacccaggtcatgaaagaggaaacccgagcctctctaggatttcggtactgcgctattctgaatgccgtcaattacatctccacagtgctcgccgactgggctgataacgtgttctttctgcagttacagcaggctgccctggaggttttcgccgagaataatacattatccaagctacaacttggccaactggcctcaatggagagttccgtgttcgacgatatgatcaatctgttagagaggctgaaacacgacatgttgacccgccaggtagatcatgtgttccgcgaagttaaagacgccgcaaagctgtacaagaaggaacgatggctcagtttgccatctcagtctgagcaggctgtgatgagtctgtcctcctccgcttgccctttgctcctaactctgcgggatcatctgctccagttggaacagcagctttgctttagcctgttcaaaatcttctggcagatgctggtcgaaaagctggacgtgtacatctaccaagagatcatcctcgctaaccactttaatgaaggaggggccgcccagctgcagttcgatatgacaaggaatctgtttccactgttctcccattattgtaaacgccccgaaaactacttcaaacatataaaagaagcttgtatcgtactcaacctcaatgtagggtccgctttactgctgaaggatgttcttcagagtgctagcggccaactgcctgcgactgccgctttgaacgaggtggggatctataaactagctcagcaggatgtggagatcttgctgaacctgcgcacaaattggcccaacacaggcaaatag

SEQ ID NO: 22917 - DNA, 1068 bp, Artificial Sequence
  Description of Artificial Sequence: Synthetic coding sequence
gtgcggggcgtgcgggccgccaccgccgccgccgtggccgccaccgccgcaagcggtctgtccagacgcgaggctggtggtagagcaggagccgctgccgcggtggtccgcccacccggcagaaagtgtgggcgctgtcgacggctggccaatttccctggtcgcaagcggcggcgacgccgccggaaagggttgggggcgacgaccggtgggtgtggtgaagccgtctcgtccctgcacccggctccccattcacccagttcagtgcgcccagcgggcagaagagcccgccgccagagacgcggtgctggctctgctgagcgccctatgagtggagccggcgaagcactcgccccagggccagttggcccccagcgggtggctgaggccggcggcggtcagcttggctccacggcccaggggaaatgtgataaagataacactgagaaggatataacccaggctactaatagccacttcacccacggagagatgcaggatcagtctatttggggaaatccatcagacggcgaactcatcaggacccagccacagaggctaccccagttgcagacatctgcgcaggttcccagcggggaggagataggaaaaatcaagaacggccataccgggctttccaatggtaacggcatccaccatggggccaagcacgggagcgcagataaccgtaagcttagtgctccggtttcccagaaaatgcatcggaaaatccaatcttccctgagtgtgaattctgatatcagcaagaagtcaaaagtcaatgccgtattctctcagaaaaccgggtcatcacccgaggattgttgcgtgcactgtatcctcgcatgcctgttttgcgagttcctcacattgtgcaacatcgtcctgggacaggctagttgtgggatttgcactagcgaggcctgctgttgctgttgcggagatgaaatgggagacgattgtaactgtccctgcgatatggactgcggcattatggacgcatgctgcgaatcctccgattgcctggagatttgtatggagtgttgtggcatttgtttcccctcttag

SEQ ID NO: 22918 - DNA, 378 bp, Artificial Sequence
  Description of Artificial Sequence: Synthetic coding sequence
atgctgagccggctgctgaaggagcaccaggccaagcagaacgagcgtaaagagctgcaggagaagcggcggcgggaagccatcactgccgctacgtgtttaacagaggccctggtcgaccatcttaatgtcggggtcgcccaggcttacatgaatcaaaggaagctggatcatgaagtgaagacgctgcaggtgcaggcagcacaattcgccaagcaaaccgggcagtggattggtatggtcgaaaatttcaaccaggcgctgaaagagattggggatgttgaaaattgggcgcgaagtattgagttggacatgagaaccattgccacggctctggagtatgtctataagggtcaactccagtcagccccctcttag

SEQ ID NO: 22919 - DNA, 2337 bp, Artificial Sequence
  Description of Artificial Sequence: Synthetic coding sequence
atgaccacccggcaggccaccaaggaccccctgctgcggggcgtgtctcccacgccatcaaagattcccgtcagaagtcaaaagcgaacccccttccccactgtcacgagctgcgctgtggaccaagaaaaccaggatcctcggaggtgggtacagaagcccccacttaacatccaaagaccactggtcgatagtgccgggccgaggcctaaggcgaggcatcaggctgagaccagccagcggctcgtgggcatcagtcagcctaggaacccactggaggaacttaggccaagccctagggggcagaatgtcggccctggaccgcctgcccagactgaggcacccggcaccattgaattcgtcgcagatcccgccgccctggccacaatactttctggggagggcgtgaaatcctgtcacctggggcggcagccgtcgctggccaagcgggtgttagtccgcgggagtcaggggggaaccactcaacgagtgcagggagtgcgcgcttcagcttacctggctccaagaacacctactcaccgcctggaccctgctcgcgcatcatgcttctcgaggttggagggccccgggcccagaggcaggaccctatgccctcagcgactgcaggctctgatctctccatctggcccctcctttcatccctctacgagaccctccttccaggagctgcgacgagaaacagcaggctctagtaggacgtctgtaagccaggcttctggcctcctcctggaaactccagttcagcctgcattctccctccccaaaggggagagagaggtggtgactcatagcgacgaaggaggtgtggcctctttgggactggcgcaaagggtgcccctgcgggaaaaccgagagatgagtcatacaagagactctcacgatagccatcttatgccgagccccgctcctgtggcccaacccttaccaggccatgtggtgccttgcccttctccatttggaagggcccagagggtgcctagtccaggcccccctacgcttacatcttatagcgtgcttcggcgtttgaccgttcaacctaagaccagattcacccccatgcccagcaccccccgggtgcagcaggcccaatggctccgaggcgtatctccccagagttgtagtgaggatccggccctgccctgggaacaggtcgctgtgcgtctctttgaccaggaatcttgtatccgatctctagagggtagtgggaaaccaccagtcgccacacccagcggtcctcactccaaccggaccccctcgttgcaggaagtcaagatccagaggataggcattctgcagcagctcctgagacaggaggtcgaggggcttgtggggggccagtgcgtgcctctgaatgggggaagctccttggacatggtcgaactccagcccctgctcaccgaaatcagcagaacactgaatgccactgaacacaacagtggaacgtctcacttgccgggtttacttaagcactctggcctgcctaagccatgccttcctgaagagtgcggagagccccagccttgcccacccgccgaaccaggacctcctgaagcgttctgccgaagcgaacccgaaatcccggagcccagccttcaggaacaattggaggtgccagaaccctaccccccagccgaacctcgccctcttgagagctgttgccgttctgaacccgaaataccagagtcgagccgacaagaacagttagaagttcctgaaccatgcccccccgccgagccgcggcctcttgaatcttactgtagaatagagccggagatccccgagtcctccaggcaggaacaactggaggtgcctgagccctgcccacccgctgagcccggacccctgcagccaagcacacagggacagtctggcccccctggcccttgcccaagagtggaattgggagcgtctgagccatgcacactggaacatcgatcgctagaaagcagtctgccaccttgttgttcacagtgggcccctgccacaaccagccttatcttctcaagtcagcaccccctgtgtgcaagtcctcccatctgtagtcttcagagtctgcgtcctcccgccggtcaggccggtctatctaatctagcgccgcgcaccttagccttgcgcgagcggttgaagtcatgtctgacagccatccactgcttccacgaggcacgcctcgacgatgagtgtgctttctatacctcaagggctccaccgagcgggcctactcgcgtctgtactaatccagttgcgacactcctggaatggcaggatgccctttgcttcattcccgtgggaagcgcggcccctcaggggagtccttag

SEQ ID NO: 22920 - DNA, 1803 bp, Artificial Sequence
  Description of Artificial Sequence: Synthetic coding sequence
atgagctgccggagctaccgggtgagcagcggccaccgggtgggcaatttttctagctgcagtgctatgacaccccagaacctcaaccggttcagagcaaattccgtgtcctgttggagcggtcccggcttccgtggactggggtctttcgggtcccgcagcgtcatcaccttcggtagctacagtcctcgcattgctgccgttggatcccggccgatacactgtggggtacgtttcggcgccggttgcggcatggggttcggggatggacgaggagtgggcttgggaccgcgagcggatagttgtgtgggattgggttttggtgccggatctgggatcggatacgggtttggtggaccggggttcggatatagggtgggcggtgtgggggtgcctgccgccccctccatcactgcagtgaccgtcaacaagtccctcttgacccccttgaacctcgaaatagaccctaacgctcagagagtaaaaaaagacgagaaggagcagatcaagacattgaataacaaatttgcttccttcattgataaagtgaggtttctcgaacagcagaataaacttctggagaccaagtggagctttcttcaggaacagaaatgcatccgatccaacctcgaacctctgttcgaatcgtatatcaccaacctccgtaggcagcttgaggtcctcgtcagcgaccaggcccggctccaggccgaacggaaccacttacaggatgttctcgaagggttcaaaaaaaaatatgaagaagaagtcgtgtgtcgagctaatgctgagaatgaatttgttgccctcaagaaggatgtagatgcggcctttatgaacaaatctgacctggaagctaacgtcgataccctgacccaggaaatagatttcctgaaaaccctgtatatggaggagattcaactgctgcagtcccacatcagtgagacgtccgttatcgtcaagatggacaactcacgcgaccttaacctcgatggaattatagccgaggtgaaggcccagtacgaggaagtcgcgcgacgctcacgtgcggatgctgaggcttggtatcagaccaaatacgaggagatgcaggtcactgccggacaacactgtgacaatttgcgtaacattcgtaatgagatcaatgaactgactaggttgattcagcggctgaaggccgaaatcgagcatgctaaggcccagagggccaagctagaggcagccgtggcagaggccgagcaacagggcgaagctaccttatctgacgcaaaatgtaagttggcagatctggaatgcgccttgcagcaagctaaacaggacatggcccgccagctatgtgagtaccaggaactcatgaatgctaagctgggactcgatatcgaaatcgcaacttatcggcgcttgttggagggagaagaaagtagactgtgtgagggagtgggccccgtgaacatcagcgtgagttcgagcagaggcggtctggtctgtgggccggagccactcgtcgccggaagcacactgagccggggaggagtgacattctctgggtcaagctcggtctgcgcaactagcggcgtccttgcctcttgcggcccatccctgggcggcgcgcgcgtggcccccgcgaccggagatcttctgtcaactggaaccaggagcggctccatgttgatatcagaggcctgcgtacctagtgtaccgtgtcccctgccgactcagggaggcttttcatcttgtagcggtggacgtagctcatctgtgcgatttgtttccactacgacatcgtgcaggaccaagtattag

SEQ ID NO: 22921 - DNA, 1542 bp, Artificial Sequence
  Description of Artificial Sequence: Synthetic coding sequence
atgagctaccacagcttccagcccggcagccggtgcggcagccagtccttctcatcctactcggccgttatgccacgaatggtgacccactacgctgtttcaaagggcccctgcagacctggaggtggcaggggcctccgcgctcttggctgtctgggctcgcgatcgctgtgcaatgttggtttcggccgccccagggtggcctcccgttgcggaggaaccttacccggctttggctaccgactcggtgctacctgtggcccttccgcttgcatcacccccgtgacaattaacgaaagcctactcgttccattggcccttgagattgatccaacagtccagagagttaaacgcgatgagaaggagcaaatcaagtgccttaacaataggtttgcctcgttcattaacaaggtgcgcttcttggagcaaaaaaataagctgctggagacgaagtggaacttcatgcagcagcagcgatgctgccaaacaaatatcgagccaatcttcgaggggtacatctcagctctgaggcggcaactggattgcgtttctggcgatagagtccggctcgagagcgagttgtgcagtttgcaggccgccttggaaggatacaaaaagaagtatgaggaagagcttagtcttagaccatgcgttgagaacgaatttgtcgccttgaagaaggatgtcgacactgcatttctgatgaaagcggaccttgagacaaacgcagaggctctagtgcaagaaattgattttttgaaaagcctatatgaggaagaaatctgccttctccagtcgcaaatctctgagacttcggtcatcgtgaaaatggacaatagccgggagctggacgtcgatggtattattgctgaaattaaagcccagtacgacgacattgcctcccgtagcaaggctgaggcagaagcttggtaccagtgtcggtacgaggaacttcgagtgactgctggaaaccattgcgacaatctgaggaatcgaaaaaatgagattcttgagatgaacaagttgattcagcggctgcagcaggaaacagaaaatgtgaaggcacagagatgcaaactggaaggagctattgcagaggctgaacagcagggcgaggcagccctaaatgatgccaaatgcaaactggctggactggaagaggctctgcagaaagctaagcaggatatggcatgtctccttaaagaatatcaagaggtgatgaatagtaagcttggccttgatattgagattgcaacctatagaaggctgctggaaggcgaagaacacaggctgtgcgagggcattggccccgtcaatattagcgtgtcaagcagtaagggcgcctttctgtacgaaccatgtggtgtgtctactcccgtgctctccaccggtgtgcttaggagcaacggagggtgctctatcgtgggtacgggggaactgtacgttccctgtgagccccaggggcttttgagctgtggatcaggcagaaagtcttctatgaccctcggcgccgggggcagttcaccctcccacaaacactag

SEQ ID NO: 22922 - DNA, 1632 bp, Artificial Sequence
  Description of Artificial Sequence: Synthetic coding sequence
atgatgcccacccccgtgatcctgctgaaggagggcaccgacagctcacaggggatcccgcaacttgtgtccaacattagcgcatgccaagttatcgcagaggctgtgcgaaccacactagggcctagaggcatggataagctcatcgtcgatgggcggggaaaggccactatatcaaacgatggcgcaactattttaaagctactggatgtggttcatcctgcagccaaaactctggtggacattgctaaaagtcaagacgcagaagtcggagatgggaccacatctgttactctgttggccgccgagtttctcaagcaggtgaagccatacgttgaggagggtctgcacccccagataatcatccgcgcattccgcactgctactcagctcgcggtcaataaaatcaaggaaattgctgtgaccgtcaaaaaggccgacaaggtggaacagcggaagcttctggagaagtgtgcaatgacagctctgagttcgaagctgatatctcagcaaaaggcattcttcgccaagatggtggttgacgctgtgatgatgctagatgacctactgcagttgaagatgattggcattaaaaaggtccagggtggcgcgctcgaagactcacagttagttgccggtgtggcctttaaaaagaccttcagctatgctggctttgaaatgcagcccaagaaatatcacaacccaaaaatcgccttgctgaatgtcgaactggaacttaaggctgaaaaggacaatgctgagatccgcgtgcacaccgtggaggactaccaggcaatagtggatgcggaatggaacattctctacgacaaactagagaaaatccaccacagtggggcaaaagtagtgctgagtaaactccctatcggcgatgtggccacacaatactttgctgaccgtgacatgttctgcgctggaagagtgccagaagaggatctgaagcgtaccatgatggcatgtggagggtctatccagacttcggtaaatgccctgtcggctgacgtgctgggacgctgtcaggtgttcgaggagacccaaatcggaggtgaaagatacaatttcttcacaggctgcccgaaagcgaaaacttgcacgtttattctacgtgggggggccgaacagttcatggaggagacagaacggagcttgcatgatgctattatgatcgtgcgtcgggccatcaaaaatgacagcgtcgtcgccggggggggagctatagagatggaacttagcaaatacctgcgcgactacagcaggacaatcccaggcaaacaacagctgctgattggcgcttacgctaaggcactagaaattatcccgagacagctgtgcgataacgcaggattcgatgctactaacattctcaataagttaagggcacggcatgcccagggcggaacatggtacggcgtggatattaacaacgaagatatcgccgacaatttcgaagcattcgtatgggaacccgccatggtaagaatcaatgccctgacagccgccagcgaagccgcctgcctgatagtatccgtcgatgagacgatcaagaaccccagatccaccgtggacgccccgacggctgccggcagaggccggggcagaggtaggccgcactag

SEQ ID NO: 22923 - DNA, 1479 bp, Artificial Sequence
  Description of Artificial Sequence: Synthetic coding sequence
atggcccccgtgggcgtggagaagaagctgctgctgggccccaacggtcctgcggtcgctgcagcgggagaccttacaagtgaggaagaagaaggtcagtcgctatggtctagcatactcagcgaggtgtcaacccgtgccagatctaagctgccatcgggcaagaatattctcgtgttcggagaagatgggtccggcaagaccacattgatgacaaaactccagggcgccgagcatgggaagaagggaagaggcttggaatatctgtacttgtccgtccacgatgaagatcgagatgaccacactcggtgcaatgtgtggatcctcgatggagacttgtatcataagggactgctcaaattcgcagtctcggctgagtctctccctgagactctcgttatctttgtggcagatatgagccgaccctggacagtgatggaatctctccaaaaatgggcatctgtcctgcgcgaacacatagacaaaatgaaaataccacccgaaaaaatgcgcgaactggagcgcaagtttgtaaaggattttcaggactatatggaaccagaggaagggtgtcagggcagtccacagagaagggggccgctgacgagcggcagtgacgaggagaacgtggcactgccgttaggggacaatgtgctgacccataacctcggaatcccggtgttggtggtgtgcacgaaatgcgatgccgtctctgtactcgaaaaagagcacgattaccgcgatgagcatctcgattttattcagtctcacctgcgcaggttttgtcttcagtatggggcagctcttatctatacgtcagtgaaggaggaaaagaatttggatttgctgtacaaatatatcgtgcacaagacatacggatttcactttaccactccggccctggtggttgagaaagatgccgtctttatcccagcaggatgggacaatgagaaaaagattgctatcttgcatgagaattttactaccgtgaagccagaagatgcttacgaagacttcattgtgaaacctcctgtcaggaagttggtgcacgacaaagagctggccgccgaagatgaacaggtatttctgatgaagcagcaatcacttctcgcgaagcagcccgccacaccaacacgggcctccgaatcccctgccagaggcccctctggctctccccgcacacagggcaggggaggacccgccagtgtgccctccagctcaccgggaactagcgtaaagaagcccgatccaaacataaagaacaatgccgcctcagagggcgtgcttgcatctttcttcaatagcctactgagcaaaaagacagggagccctgggtcaccgggggccgggggcgtccaatcaacagccaaaaaatctggtcaaaagacggtactgagcaacgtccaggaggagttggacagaatgacaagaaagcctgacagtatggtgactaatagttctactgagaacgaggcatag

SEQ ID NO: 22924 - DNA, 540 bp, Artificial Sequence
  Description of Artificial Sequence: Synthetic coding sequence
atggacaaggacttcgacaagctgcacgagttcgtggagatcatgaaagaaatgcagaaagatatggacgagaagatggatattttaattaatacccaaaaaaactataaacttccacttagaagggcgccgaaggaacaacaggaactgcggctcatgggtaagactcaccgagagccgcagttgcgccctaaaaaaatggatggtgcctctggggtgaatggggcaccgtgcgccctgcataaaaaaaccatggctccacaaaaaacaaagcaaggatctctcgacccattacaccactgcggcacttgctgcgagaagtgcctcctatgcgcactcaaaaacaactacaatcgcgccgcacccttgaaagaagcgcgccacctcctgaccgccaacagcatcgatcctagtgccgctttggttctgctgatcgagttcttgttactgaccctggtgactggggcagccgcaccagggcttgacgcttgtggccatcaaagaaacatgagggatgagataaacagcgagcgtcgctag

SEQ ID NO: 22925 - DNA, 3600 bp, Artificial Sequence
  Description of Artificial Sequence: Synthetic coding sequence
atggccagcgccggcacccagcactacagcatcggcctgcggcagaagaattcattcaaacaaagtggccctagtgggactgttcccgcaaccccccctgagaaaccctccgaggggagagtgtggccccaggcccatcagcaggtaaaacccatttggaagcttgaaaagaaacaggtggaaactctgtctgcggggttgggccctgggctacttggcgtgcccccgcagcctgcttatttcttctgcccaagtacgctgtgcagctccggaacaaccgctgtcatcgcaggccatagctcttcttgttacctccatagcctgccagatctcttcaattcaactcttctgtacaggagatcctcttatcgccaaaaaccgtaccagcagctggagtctttttgcctaaggagcagtccaagtgagaaaagtccattcagcctcccccagaagagccttcctgtaagcctgaccgccaataaagcaacatcatccatggttttttccatggctcaaccaatggcttcatccagcacagagccctacctgtgcctggccgctgccggagagaatccatctggaaagtcactcgcgagcgcaattagcgggaagattccatccccactgagctcgagttataagccaatgctaaataacaactcttttatgtggcctaacagcacccctgtccccctgctgcaaactactcagggtcttaaacctgtgtccccacctaagatccagcccgtgtcttggcatcactcaggtgggactggtgactgtgcaccccaacccgtcgatcacaaggttccaaaatctattgggactgtccccgcagatgcctctgcccacattgcacttagtactgcaagtagccatgacacgagcacaactagcgttgcctcatcctggtacaacagaaacaacctcgccatgcgcgccgagcctctgtcttgcgcattagacgactcctcagattcacaggacccaaccaaggaaattagatttactgaggcagtccgcaaacttacagcccgagggtttgagaagatgcctcggcaggggtgtcagcttgagcagtcttccttcctgaaccctagcttccagtggaacgtgctgaaccgctcaagaagatggaaaccacctgcggtgaatcagcagttcccccaggaggatgccggcagtgtgcgccgcgtgttgcctggtgcctccgacacattaggactagataataccgtattctgtactaagcgaatttcaattcatctgctcgcttcccatgcatctggcttgaatcataaccccgcttgtgaaagcgtgatcgatagcagcgctttcggagagggaaaagcaccgggccccccattcccccagaccctgggaatcgccaatgtcgccacaagactgtcttctattcagcttggccagagtgagaaagagaggcccgaagaggcgagggaactcgatagttccgatagagatataagtagcgccacagacctgcagcccgatcaagctgagacagaagatactgaggaggagctggtggacgggttagaggactgctgctctcgggatgagaatgaggaagaagagggagattcagagtgcagtagcctgtctgctgtgtctccatcagagtcagtcgccatgatcagtaggtcttgcatggagatccttacaaaacccctttcaaaccacgagaaagtggttagacccgccctcatctattcgctattccccaacgtgcctcccacaatttacttcggcacgcgagatgaaagagtagagaaactcccctgggaacaacgcaagctgcttcgctggaaaatgagtaccgtgacgcccaacattgttaaacaaacaatcggaagaagccacttcaaaatcagtaaacgcaatgatgattggcttggctgttggggccaccatatgaagagcccgagcttcagatccatccgagaacaccagaaactgaatcatttcccaggctctttccagatcggccgcaaggacaggctgtggaggaacctgagcaggatgcagtcgcgcttcggaaaaaaagaattctctttttttcctcagagcttcattcttcctcaggacgccaaactgctcagaaaagcctgggagagctcatcaaggcagaaatggatcgtcaaacctccagccagtgcacgggggataggcattcaggtgatacataaatggtcccagctgcccaagagacgaccgctgctcgtgcagaggtaccttcacaaaccatatttaatttcgggaagcaaattcgatctgcggatttatgtatatgtaacttcttacgaccccttgcggatttatctgttttccgatggattggtgcgctttgcttcttgtaagtattctccttccatgaaaagtctgggaaacaaatttatgcacctcacaaattactcagtgaataaaaagaacgccgagtaccaagcaaacgcggacgagatggcatgccaggggcacaagtgggccctgaaggccttgtggaattacctctcacagaaaggagtcaatagcgatgctatctgggagaaaatcaaagacgtagtagttaagactattatatccagtgaaccctatgtgacctcccttctgaagatgtatgttaggcgtccttatagctgtcatgagctttttggatttgatataatgctggatgagaacctgaaaccttgggtgcttgaggtaaatatctccccatctctgcattcttcaagccccctggatatcagtataaaggggcagatgattcgggacttgctcaacctggcaggctttgttcttcccaacgccgaagatattatttcaagccccagcagctgcagcagctctaccacaagcctgcctacttcgccaggcgacaaatgcaggatggcccctgaacatgtcacagcccagaaaatgaagaaagcttactatttaactcaaaaaatcccggatcaggacttctacgctagcgtactagatgtgttaacgcctgacgacgttcgcattctggttgagatggaggacgagttcagtcggcgcgggcagtttgaaagaattttccctagccacatttcatcacgttaccttcggttttttgagcagccgcgatattttaatattctcaccacacagtgggagcagaaatatcacggaaacaaattaaagggcgttgacttgttgcggagctggtgttacaaaggcttccacatgggcgttgttagcgattccgctcccgtgtggagcttgcctactagtttacttacaatttctaaggacgatgtgatactgaatgccttctctaaaagcgagaccagcaaactgggtaaacagagctcctgtgaggtgtccctgctgctgtctgaagatggaaccacaccaaaaagtaagaaaacccaggcgggcttgtccccctacccccagaagccctcatcttcaaaggactccgaggacacttcaaaagaaccctctctgtccactcagaccctgccagtgattaagtgttcagggcagacaagtcgcctcagtgcaagcagcacctttcagtccattagtgatagtctgttggccgtcagcccatag

SEQ ID NO: 22926 - DNA, 2772 bp, Artificial Sequence
  Description of Artificial Sequence: Synthetic coding sequence
atgctgcggcggggcagccaggccctgcggcggttcagcaccggccgggtgtattttaaaaacaagctgaagctcgccctcatcggtcagagcttattcgggcaggaagtctactctcacctgcggaaggaaggccatagggtggtcggtgtgtttaccgtgcccgataaggacgggaaagcagatcctctggccctggccgcagagaaagatggcactccagtcttcaaactgccgaagtggagggtcaaggggaagacaatcaaagaggtcgctgaagcttacaggagcgttggggccgagctgaacgtgctccccttctgtactcagtttatcccaatggacattatcgactcccccaaacatggatccatcatttatcatccctctatcttgcctcggcaccgcggtgcctctgctattaactggaccctgatcatgggagacaagaaagccggcttctctgtgttttgggccgatgatggactggacaccggtccgattttgctgcaaaggtcgtgcgatgttgaacctaatgatacagtggatgccttgtacaatcgttttcttttccctgagggaattaaagccatggtggaggccgtgcagttgattgcagatgggaaggccccccgcattccgcagcctgaggaaggggcaacatatgagggaatccagaaaaaagagaacgctgagatctcctgggatcagtccgccgaggtgcttcataattggattagaggtcatgataaagtgccgggtgcatggacagaaatcaatggacagatggtgacattttacggatcaacactgctgaactctagcgtccccccaggcgagcctttggaaatcaagggtgcgaagaaaccaggactggtaacaaagaatggcttagtgctttttggcaacgacggcaaggcgctgacggtccgcaaccttcaatttgaggacggcaagatgatacccgccagccagtacttttctaccggggagacaagcgttgttgaacttaccgcagaagaggtcaaagtcgcagagactatcaaagttatttgggccgggatcttaagcaatgtccccatcattgaggattccacggacttctttaagagtggcgcctcttctatggacgtcgccagactcgtggaggaaattaggcagaagtgcggcggcctacagctgcagaatgaggacgtgtacatggcgacaaagtttgagggttttattcagaaggtcgtgcggaagctgcgtggagaggaccaagaagtcgagctggtagtggactacatatccaaggaagtcaacgaaatcatggtgaagatgccttaccagtgttttattaatggacagttcaccgacgcagacgatggaaaaacttatgacacgatcaatcccacagacgggagcacaatttgcaaagtgagctacgcaagccttgccgacgtcgataaggccgtcgctgcagccaaggacgctttcgagaatggtgagtgggggcgaatgaacgcacgtgagcgggggcgcctgatgtataggctggcagacctgctggaggagaaccaggaagagctggcaacaattgaagccttagacagcggagccgtgtacacactggctctgaaaacacatattggtatgagtgtacagacctttaggtacttcgccggttggtgtgataagattcagggctctacaatccccattaaccaggcccgccccaaccgcaatcttacatttactaagaaggagcctctcggtgtgtgcgccatcattatcccttggaattaccctctgatgatgctggcatggaaatcagccgcttgcctagcggcagggaacacgctggttcttaagcccgcccaagttacccccctgactgcattgaagtttgccgagctgagcgttaaagctggcttccccaagggtgttatcaacattattcccggatcagggggcattgctggccaacgcctgtcagagcatccagacatccgaaaactgggcttcacaggatctactcccatcggtaagcagataatgaaatcttgtgccgtctctaacctgaagaaggtgtctctagagttaggcggcaaaagtcccctgattatttttaacgactgtgagcttgacaaagcagtccggatgggcatgggcgccgtgttcttcaataagggcgagaactgtatcgcggccggtcggttgtttgtcgaagagtctatacatgatgagtttgtcacaagagtcgttgaagagataaagaaaatgaaaattggcgaccccctggacaggtcaactgaccacggcccacagaatcataaagcccacttagaaaagctgcttcagtactgcgaaacgggggtcaaagaaggtgcaaccctggtgtacggcggcagacaggtgcagagacccggcttcttcatggagcccacagtcttcacagacgttgaagattacatgtacttggcgaaggaagagtcctttggccctatcatggtcattagcaagtttcagaatggcgacattgatggagtgcttcagcgcgctaatagcactgaatacggcctggccagtggcgtgttcacacgagatattaataaggccatgtatgtttccgagaagcttgaggcaggtacggtttttatcaatacatacaataaaacggacgtagcggctcctttcggtggagtgaagcagtccggtttcgggaaggatctgggtgaggaggccctcaacgagtacttgaaaaccaaaaccgttacactggagtactag

SEQ ID NO: 22927 - DNA, 1323 bp, Artificial Sequence
  Description of Artificial Sequence: Synthetic coding sequence
atggagggcgtgctgtacaagtggaccaactacctgagcggctggcaacctcgatggttcttactctgcggtggaattctgtcttactacgattctcctgaggatgcctggaaagggtgcaaggggtctatacagatggccgtgtgtgaaatacaggttcactccgttgacaatacccgcatggatctgattatcccaggggagcaatatttctatcttaaagcgagatccgtggctgagaggcaacgatggttggtggccttggggtcagcaaaggcttgccttactgactcccgtactcagaaggagaaagagtttgctgagaacacagagaatcttaaaaccaaaatgtcggagctcaggctttactgcgacctcttagttcagcaggtcgataaaactaaggaagtcaccaccacgggagtgtctaacagtgaagaaggtattgacgtcggcactctactcaaatccacatgcaatacttttctcaaaaccctggaggaatgtatgcagatcgcgaacgcggcttttacttctgaactcctgtaccgtacacccccaggctctccccaacttgccatgctgaaatcctctaagatgaaacatcctattatcccaatccacaattccctcgaaagacaaatggaactgagcacatgcgaaaatggaagcttgaacatggaaataaatggtgaggaagagatactgatgaaaaataagaactccctgtatttgaagagcgccgagatcgattgctcaatctcctcagaagagaacacagacgacaacatcaccgtgcagggcgagatccggaaggaagacggcatggaaaatctaaagaaccatgacaataacttgactcagtccggcagtgactcgagctgttcgcccgaatgcctatgggaggaggggaaggaagtgatccccacctttttttccactatgaacacgtctttttctgatatcgagctcctggaggatagcggcatcccaaccgaggcctttctggcttcatgctacgctgtcgttccagtgctagacaagcttggtcctaccgtctttgcacccgttaagatggacctcgtcggtaacatcaagaaagtgaaccagaagtacatcactaacaaagaagagttcacaacgttacagaaaatagtattgcacgaggtggaagccgatgtggcccaagttcggaacagcgccaccgaggcccttctgtggctgaagcggggacttaagtttctgaaggggtttctgactgaggtgaaaaacggggagaaggacatacagaccgctctccgcaatcccaccgagaacacatag

SEQ ID NO: 22928 - DNA, 1272 bp, Artificial Sequence
  Description of Artificial Sequence: Synthetic coding sequence
atggccatctgccagttcttcctgcagggccggtgccggttcggcgatagatgctggaacgaacatccaggggctagaggggccggaggaggtagacagcaacctcaacagcagccgtccggaaataatagaaggggctggaataccacaagccagcggtatagtaacgttattcagccatcaagcttttcaaaatccactccctggggagggagtagggaccaagagaagccgtactttagctcttttgactcaggagcgtcaaccaacagaaaggaggggttcggtctcagcgagaacccatttgcttcactgtctcccgacgaacaaaaggacgaaaaaaaattactcgaaggcatcgtcaaggacatggaggtgtgggaatccagcgggcaatggatgtttagtgtgtacagtccggtaaagaaaaaacctaatatcagcggttttaccgatatcagtcccgaggaactccggcttgaatatcataatttccttacttccaataatctacagtcttacctgaatagcgttcaacggctgatcaaccagtggaggaaccgtgtcaatgagttgaagtcgcttaacatcagtacaaaagtggctctgttaagcgacgtaaaggacggcgtgaatcaggcggctcctgcattcggcttcggctcttctcaggcagccactttcatgtcacctgggtttccagtcaataattcttcctccgacaacgcccagaacttctcatttaaaaccaactccggcttcgctgccgcgagttcaggttcccccgccgggttcggcagttcacccgcattcggtgccgctgcatccacaagttccggaatatctactagcgcccctgcctttggctttggaaagcctgaagtgaccagcgcagcgtcattctcttttaaatcgccagccgcctcaagtttcgggtctccgggattttctggactgcccgctagtctggctaccgggcctgttagagcacctgttgcacctgctttcggcggcgggagcagcgtggcgggcttcgggagccccggatcccacagccacaccgcattctccaaaccttcctcagatacatttgggaattcctccattagcacatcccttagtgccagtagctcaataatcgcaacagacaatgtgctattcactccccgagataagctcacagtggaagagttagaacagtttcagagcaagaagttcactttggggaaaattccgctgaagcctcctcctcttgagctgcttaatgtgtag

SEQ ID NO: 22929 - DNA, 1323 bp, Artificial Sequence
  Description of Artificial Sequence: Synthetic coding sequence
atgatggccgacgaggaggaggaggtgaagcccatcctgcagaagttacaggagctcgtcgaccagctatattcctttagggattgctactttgaaactcactcagtggaagatgcaggcaggaagcagcaggacgtgcagaaggaaatggagaagaccctccagcagatggaagaggtggttgggagcgtacaaggaaaggcacaggttctgatgctcactggaaaagcattaaacgttacacctgattattctcccaaagctgaagagctgctttccaaggctgtgaaactcgaaccggagttagtggaggcttggaaccagctcggagaagtgtattggaagaagggcgatgttgctgctgcccacacatgttttagtggcgccctcacacactgtcgtaataaggtcagtttgcagaatttatcaatggtgctgcgccagctacgtaccgatacggaagatgagcacagccaccacgtgatggactccgtgaggcaggcaaagcttgccgtgcaaatggacgtgcacgatggaagatcctggtatatccttggaaactcctatctttctctatactttagcacaggacagaaccccaagatttcccaacaggcccttagcgcatacgcccaggcggaaaaggtagaccgaaaggcttcaagtaaccccgaccttcatttaaaccgggccacacttcacaagtatgaggaaagttacggagaggcactggaaggcttcagtagagccgccgctcttgaccccgcctggcctgagccaaggcagagggagcagcagttgctagaatttttggatcggttaacttccctgctggagagcaaaggaaaagtcaagacaaagaagctacaaagcatgctgggctccctccgacctgcacacctggggccttgcagcgatggccactaccagtctgcaagcgggcagaaagtgacccttgagctgaaacccctgtctaccttgcagcccggcgtaaactccggtgccgttattcttggaaaagtcgtattctccttaactactgaagagaaggtccctttcacctttggcctcgtggatagcgatggcccatgctacgcagtaatggtgtataatatcgtccagagttggggagtgttaatcggggatagtgttgctatccctgagcccaacctgcgtttgcaccgcattcagcacaaagggaaagactacagcttcagctcagtgagagtcgaaacaccactgctgttggttgtgaacggcaagccccagggctctagcagccaggctgtggccacagtggcctctcgcccacaatgcgagtag

SEQ ID NO: 22930 - DNA, 1341 bp, Artificial Sequence
  Description of Artificial Sequence: Synthetic coding sequence
atggaggagaccatcaaggacccccccaccagcgccgtgctgctggatcactgccacttttcacaggtgattttcaatagcgtggaaaagttctatattcctggcggcgacgtcacatgccattatacatttacacagcacttcatccccaggaggaaggactggattggcatctttcgagtgggctggaaaaccactcgcgagtattatacgttcatgtgggtcactcttcccattgacctcaataacaaatccgctaagcagcaagaagtgcagtttaaggcctactatctgcctaaggacgatgagtactaccagttctgctatgtggacgaagatggtgtagttcgcggtgcctctataccattccagtttcgccccgaaaatgaggaggacatcctggtggtcacaacacagggcgaggtagaggaaattgaacagcataataaagagctctgcaaagagaatcaggagctgaaggactcatgcatatcactgcagaaacaaaacagcgatatgcaggccgaacttcagaaaaaacaggaagagctcgagacactccagtcgatcaataagaaactcgagctgaaggtgaaggagcagaaggactactgggagactgagttgttgcagcttaaggaacagaatcagaaaatgagttcagagaacgaaaaaatgggaatcagagttgatcaattgcaagcacaactgtccacccaggagaaggaaatggagaaactcgtacagggcgaccaggataagacggagcaattggaacagcttaagaaagagaatgatcacctttttctctctcttaccgagcaacgcaaagaccagaagaaattggaacagaccgtggaacagatgaaacagaatgaaacaactgctatgaaaaagcagcaggaattaatggatgagaacttcgatctttcaaagcgtctgagcgagaacgaaatcatatgcaacgctttacagcggcagaaggaacgtttggagggggaaaacgatcttctgaagcgggagaattctagattactttcctacatgggtctggactttaacagtctgccgtatcaggttcctactagtgatgaaggcggcgccaggcagaaccctggtttggcttatggcaacccctactccggtatacaggagtcctctagtccatcccccctgtccattaagaaatgtcccatttgcaaggctgatgacatttgcgatcatactctggaacagcagcagatgcaaccgctgtgttttaattgcccgatctgcgacaagatttttcctgccacggagaagcagattttcgaggaccatgtgttttgtcactcactgtag

SEQ ID NO: 22931 - DNA, 1329 bp, Artificial Sequence
  Description of Artificial Sequence: Synthetic coding sequence
atggccctgcccggcgcccgggcccggggctgggccgccgccgccagagctgcgcagcgacggcgaagggtagaaaatgctgggggatctcccagccctgagccagcgggacgacgagcagccttgtatgttcactggccgtattgcgaaaagcgatgctcctattgcaacttcaacaaatacattcccagaaggctcgaggaagccgctatgcagaaatgtctagtgacagaggctcagacactgctgagactgtcaggcgtgcagcgcgtggagtcggtgtttttcggcggggggaccccctcactcgcctccccacacaccgtggccgcagtcctcgaagcagtcgcacaagctgcccatcttccagcggatctcgaggtgaccctcgaagccaacccgacatctgcccccggctcccgactagctgagttcggtgctgccggtgtgaaccgactctctattggcttacagtccttggatgacaccgagcttaggctgctaggccggacccattctgcttgtgacgccctacggactctggccgaggctcgacgtctttttccaggccgggtttccgttgacctgatgctcggactacctgctcagcaggtaggcccatggcttggccagctgcaggagcttctgcatcactgcgacgaccacctgtctctgtaccagctgtcacttgagcggggaacggcactctttgcccaagtgcagaggggcgccctccctgcccccgacccagaactggccgcagaaatgtaccagcgcggacgagctgtacttcgagaggcaggatttcaccagtacgaggtgtcaaacttcgccagaaatggcgccctctccacccacaattggacgtactggcagtgtggccagtacctgggcgtgggccctggcgcccatgggcgctttatgccacaaggcgcgggggggcatacccgagaagcgcgcatccagactctagagcctgacaactggatgaaggaggttatgctctttggccacggtaccaggaagagggtcccgcttggccgcttggaactgctcgaagaagtcctcgccctgggtttgaggacagacgtgggaataactcaccagcattggcagcagttcgagccccagttaacactctgggacgtttttggggctaataaggaggtacaggagctgctggaacgagggctgttacagctggatcaccggggactcaggtgttcctgggagggattagccgtgctggacagtctgctgttgactctcctacctcagcttcaggaggcatggcaacagcggacaccttcaccagttccgggcggatag

SEQ ID NO: 22932 - DNA, 1278 bp, Artificial Sequence
  Description of Artificial Sequence: Synthetic coding sequence
atggacaagaacatcggcgagcagctgaacaaggcctacgaggccttccggcaggcctgtatggatagggactctgctgtcaaagaattacagcagaagacagaaaattatgagcagcggatcagggaacagcaggaacagctgtccctgcagcaaaccatcattgataaacttaaatctcagctcttgctggtcaacagcacgcaagacaacaattatgggtgcgtccccctgttagaggacagcgaaactcgcaagaacaatcttaccctggatcagccacaggacaaggtgattagcggaattgctagagaaaagctgcctaaggtgcgaaggcaagaggtgagttcacctagaaaagaaacaagtgctaggtcactggggtccccgttgctccacgaacgaggcaatatcgagaagactttttgggacctgaaggaggagtttcataagatttgcatgctggccaaagctcaaaaggatcacttatctaaacttaacataccggataccgctactgaaactcaatgctccgtccccatacagtgtacggataagacagataaacaagaagccctttttaagccccaggctaaagatgatatcaacagaggtgccccaagtatcactagtgtgacacccaggggactgtgtagggatgaggaagacacctccttcgagtccctcagcaaatttaacgtcaagtttccacccatggacaatgatagtacttttctccactctactccggaaagaccaggaattctaagtcccgccacttcagaggccgtctgtcaggagaaattcaatatggagttcagggacaatcctgggaactttgtgaaaacggaggagacgcttttcgaaatacaaggaatagacccaatagcctccgcaattcagaacctgaagacaaccgacaagactaaaccaagcaacctcgttaatacatgtatccgcactactctcgaccgtgcagcttgcctgccaccaggagaccataacgcactgtacgtaaatagttttccactattggatccttccgacgcgcccttcccgagcctagacagcccaggcaaggctattagaggaccgcagcagccgatttggaagcctttccccaaccaggactccgatagcgtagtcctgagtggcacggactccgagctgcacatccctagagtgtgtgaattctgccaggctgtcttccctccttcgataacgagcaggggagactttttgagacacctcaacagtcattttaacggggaaacttag

SEQ ID NO: 22933 - DNA, 2055 bp, Artificial Sequence
  Description of Artificial Sequence: Synthetic coding sequence
atggagaacctgcagaccaacttcagcctggtgcagggcagcaccaagaagctcaacggaatgggggatgatggtagccctcccgcgaagaagatgattacagatattcatgctaatggcaaaactattaataaggtgccgacagttaaaaaggagcacctagacgattatggcgaagctccagtggagactgatggggaacacgtgaagcgcacctgtacctccgtgccagagacactgcatctaaacccttctctgaagcatacgttggcccaattccacctgtcgagtcagtcatctctgggcggaccagcggccttttctgcccgacattcgcaggaatctatgtcacccaccgtgtttctgcccttaccatcaccacaggtgctgccaggacccctgctgatcccctccgatagctctactgagctgacacaaactgtcttggagggggagagcatcagctgtttccaagttggaggggagaagcgcttatgcctgcctcaggtgttgaattcagtgcttcgagagtttacacttcaacaaattaacactgtgtgcgacgagctgtacatatattgttccagatgtacctcggatcagttgcacatcttgaaggtccttgggatactgccgttcaacgcaccgtcatgtggactgatcaccctgaccgatgctcaaaggctttgtaacgcccttctcaggcctcggacatttccgcagaacggtagcgtccttccagccaagagttcgcttgcccaattgaaagagaccggctccgcttttgaggtggaacacgaatgcctgggaaagtgccaaggcctttttgctccccaattctatgtccagcctgacgctccctgtatccagtgcctggagtgctgtggcatgttcgcccctcagacctttgtgatgcactcacatagaagtccagataagagaacttgtcattggggatttgaatccgccaagtggcactgctatctgcatgtcaatcagaaatacctaggcacccccgaagaaaagaaactgaaaattattctggaggaaatgaaggaaaagttctctatgcgttccgggaagaggaaccagtctaagactgacgcccctagtggtatggaactacagtcctggtaccctgtgattaaacaggagggtgatcacgtgtcccagacccattctttccttcacccgtcttactacctgtatatgtgtgacaaggtcgtagcccctaacgtttccctcacgtccgctgtgtcccagtcgaaagaactcacaaagactgaggcttctaagtctatatcccgacaatctgagaaagcacatagcagcggaaagctgcaaaaaactgtgtcataccccgacgtgagtttggaggagcaggaaaaaatggatctcaagaccagccgggagctgtgctctcgtctggatgcctcgatttctaacaattcaacgtctaagcgaaaatcggagagtgcgacatgtaacctcgtgagagatatcaacaaagtggggataggcctcgtggccgcagcctcctcccccctgcttgttaaggacgtgatatgcgaggatgacaagggaaaaatcatggaagaagtcatgagaacctacctgaaacaacaggaaaagctcaatcttatccttcagaagaagcaacaattgcagatggaggtcaaaatgctgtcctcttccaagtccatgaaggaattgacagaagaacagcagaacctccagaaagaacttgaaagcttgcagaacgagcatgcccagcggatggaggagttttatgtggaacaaaaagaccttgagaaaaaactcgagcagataatgaagcagaaatgtacgtgtgactcaaatttggaaaaggataaagaggctgagtacgcagggcaactcgccgaactacggcagcggctggatcatgcggaggcagatcgtcaggagctacaggatgagctcaggcaagagagggaggccaggcagaagctcgagatgatgataaaggaactcaagctgcaaatcctgaagtcctccaaaaccgctaaggagtag

SEQ ID NO: 22934 - DNA, 1080 bp, Artificial Sequence
  Description of Artificial Sequence: Synthetic coding sequence
atgagctaccggcgggagctggagaagtaccgggacctggacgaggatgagatcctgggtgccttgactgaggaagagctgcggactctcgagaacgagttggacgagcttgaccccgacaacgcattgctgccggctggccttcgtcaaaaagaccaaacgactaaagcccctaccggtcctttcaagcgcgaagaactcctagatcacttagagaagcaggcgaaggagtttaaggacagggaagacttagtcccttacactggcgagaaaagggggaaagtctgggtcccgaaacagaagcccctggaccctgtgctagaaagcgtcacactagagccagagctcgaagaggctcttgccaacgcatctgatgccgagctgtgcgacatcgctgccatattaggaatgcacacactcatgtccaaccaacagtattatcaggccctatcttcctcctccataatgaacaaggaaggcctgaactctgtaattaaacccacacagtataagccggtgcctgacgaggaaccaaatagcactgacgtagaggagaccctcgagcgaatcaagaataatgaccccaaacttgaagaggtgaacttgaacaatattagaaacattcccattcccacactgaaggcctacgcggaagctctgaaagaaaattcctatgtgaagaaattcagcattgttggcacaagaagcaacgacccagtcgcatacgccctggcagagatgttgaaagaaaacaaggtgttgaagactttgaatgtcgagtcaaacttcatttctggagccggaatactccgtctcgtggaagccttgccctacaatacaagcctcgtcgagatgaaaatagataatcaaagtcagcccttaggcaacaaggttgagatggaaatagtatccatgctggaaaaaaacgcaaccctgctgaagttcgggtaccactttacccagcagggccctaggctacgagcctccaatgcaatgatgaataataacgatttggtccgcaagcgtcgcctggcagacttaaccggccctataattcccaagtgtagaagcggggtttag

SEQ ID NO: 22935 - DNA, 1941 bp, Artificial Sequence
  Description of Artificial Sequence: Synthetic coding sequence
atggaggagcggggcagccccgacggcgacctggcccggagcctggagcagggtcccgaagggcctgaaaccccgattcaggtagtgctccgcgtgaggcctatgagcgctgcagaacttaggagaggccagcagtctgtcttgcactgttcgggtacgcgcactctgcagggcggtcccgaggtagcattcagatttggtgctgtgctggatgccgcaagaacacaggaggatgtgttcagggcatgtggggtgcggcggttaggggaactggctctgaggggcttctcatgtacagtcttcacctttggtcagacagggtccggcaagacttacacactgaccggacccccaccacagggtgagggggtcccggtaccgcccagcctagccggcatcatgcaacgcaccttcgcatggcttctggatcgggtccaacacctgggagctccggttactctacgggcatcctatctcgaaatttataacgagcaagtgcgggatctcctgtctttaggatcgccaagacccctgcccgtgcgctggaataaaacaaggggcttctacgtggaacaactaagagtcgtggagtttggctctctggaagcattaatggagctgttacagactggactgtcaagacgtcgaaattctgctcatactcttaatcaggcctccagcagaagccacgctctattaaccctttacatctctcggcaaactgctcagcagatgccctccgtggaccctggcgagcccccggtaggtggaaaactttgctttgtagacctcgccggctccgagaaggtggccgctacagggtccagaggagagctcatgctggaggcaaacagcatcaatcgctccctcctcgctcttggacactgcatctccctccttctggatccccaacgcaagcagtctcatatcccttttcgggactcaaaacttaccaagctgctggcagactctctgggcggccgaggcgtcaccctgatggtggcctgcgtgagtccttccgctcagtgtttacctgagactttatcaactcttcggtatgcttccagggcacaacgcgttaccacgcgaccccaggccccaaaatcacctgtagcaaaacagcctcaacgccttgagaccgagatgctgcagttacaggaggagaatcgaaggttgcagtttcaactggaccagatggactgtaaggcttctggcctgtctggggccagagttgcctgggcacagcgcaacctgtacggtatgctgcaggagttcatgttggaaaacgagcggctgaggaaggaaaagtcgcaactgcaaaattccagggatctggcccagaatgaacaaagaattctcgcccagcaggtgcacgcacttgagcgccgccttctgtccgcatgttaccatcatcagcaaggccccgggctaacacccccttgtccctgtctgatggctccagccccaccttgccacgcactgcccccgctctactcctgcccctgttgccacatctgcccgctatgtcgcgtgcccctggctcactgggcatgcctgcccggtgagcaccacttgccgcaggttctcgatccggaagcttctggtggccggcctccatcagcaaggccgcccccatgggccccgccatgcagcccaggttccgctaaatgtcccagagaacggtcccatagcgattggacacagacaagggtgcttgcagagatgctaacagaggaagaagtcgttccttctgcgcctcctctgccagtcagacctccgaagacatcccctgggctccgcggaggcgcaggagttccaaacttggcacaacgcctggaagccttgagggatcagatcggaagttccttgcgccgcgggagatctcagcctccctgttcagaaggagcgaggagccccggacaggtgctgcctcctcactag

SEQ ID NO: 22936 - DNA, 462 bp, Artificial Sequence
  Description of Artificial Sequence: Synthetic coding sequence
atggcccggaacaccctgagcagccggttccggcgggtggacatcgatgagttcgacgaaaacaaattcgttgacgagcaggaggaggccgctgctgctgcagctgaacccggcccagaccccagtgaggtagacggactcctacggcaaggcgatatgctgcgggctttccacgctgctctccgtaattctcctgtgaacaccaagaaccaggctgtaaaagaacgagctcagggggtcgtactcaaagttttgaccaactttaaaagctccgagattgaacaggcagtgcaatccctggacaggaatggcgtggacctgttgatgaaatatatctataagggctttgaaaagcctaccgagaactccagcgcggtgctgctccagtggcacgagaaggcgctcgccgtaggcggactgggatcaattattcgcgttttaactgcccggaagaccgtttag

SEQ ID NO: 22937 - DNA, 3318 bp, Artificial Sequence
  Description of Artificial Sequence: Synthetic coding sequence
atggccgccaccgccagcgccggcgtgcccgccaccgtgagcgagaagcaggagttctatcagctgctgaagaatctgattaatccttcctgcatggttcgccgccaggccgaggaaatctatgagaacatccccggcctgtgtaaaacaacttttcttctggatgccgtgcgcaaccggcgagctggatacgaggttcgacagatggccgccgccctgttacgacggcttctgtcatcagggtttgaggaggtctatccaaacctacccgcagatgtgcaacgggatgtgaagatcgagctcatacttgccgtgaagttggagacacacgcgtccatgcgcaaaaagctgtgtgacatatttgccgtgctggcaagaaatttaatagacgaggatggcacgaaccactggcccgaggggctaaaatttctcatagactcaatttactcaaagaatgtggtcctctgggaggtggctctgcatgtcttttggcattttccaggcatttttggtacacaagaaaggcacgatttagatattattaagcggcttctcgatcagtgcatccaggatcaggaacacccagccatcagaacgctgtcagccagagctgccgcagcctttgtgctggctaacgagaacaatattgcactgtttaaggatttcgccgaccttttgcctggcatcctccaagctgtgaacgattcttgttatcaagacgatgacagcgtcctggagagcctcgttgagatcgcggatacagtcccaaaatacttagggccctacctcgaagacacattgcaactcagcctcaaactgtgcggcgatagccgcctctctaacctccaaagacaactggcactggaggttattgtgacactttccgaaacagccacccctatgctcaagaaacataccaatatcattgcgcaggccgtgccacacatacttgcaatgatggtcgacctgcaggatgacgaggactgggtcaatgcggatgaaatggaggaagacgatttcgattccaatgcggtcgcagctgagtcagctttagataggcttgcttgtggtctgggtggcaaggttgtgctccctatgactaaagagcacattatgcagatgctgcagtctccagattggaagtatcgccatgccgggctgatggcactgtccgctatcggcgagggttgtcatcagcagatggagtcgatcttggatgagaccgtgaactcagtgttgttgttcctgcaggatccccatccaagagtccgagccgctgcatgcaccacactcggtcagatggccacagatttcgcaccaaattttcagaaaaagttccatgaaactgtgattgcagccctgctgaggactatggaaaaccagggcaaccagcgggtgcagtcacatgccgcctccgccctgattattttcatcgaagattgtcctaaaagcctgctagtgctttacgtggacagcatggtgaagaatctgcactcagttctagtaatcaagttacaagaactcataaggaatggcactaagctggctctggagcagctcgtcactacaattgcgagcgtggctgacactatagaggagaaatttgtaccatattacgatatttttatgccgtcactcaaacatattgtcgaactcgcagtgcagaaagagttgaagctcctgcggggcaaaactattgagtgcatatcccacattggcctcgcagtgggaaaggagaagtttatgcaagacgcttccaacgtcatgcaactgctccttaaaacgcaaagcgacctcaacaacatggaggatgacgacccccagaccagctatatggtcagtgcgtgggcaagaatgtgcaagattcttggcaaggatttccagcaatacttgcccttagtgatagagcccctgatcaagaccgcttctgcaaaacctgatgtcgctcttctggatacacaggacgttgaaaatatgtctgatgatgacggttggcagttcgtaaatcttggcgatcagcagtccttcggcataaagaccagtgggctggaagctaaggcaacagcttgccagatgttggtatattacgccaaagagttgcgcgagggatttgtggaatatacagagcaagtcgtgaaactgatggtcccacttctcaagttctactttcacgataacgttagagtggccgccgccgaaagcatgccattcctgctggaatgtgccagaatacggggccccgagtatctcgctcaaatgtggcagtttatttgcgaccccctcatcaaagctattgggaccgagcccgacacagatgtcctcagtgaaattatgaatagttttgcaaagagcatcgaggtcatgggagacgggtgcctgaatgacgaacacctggaagaactgggaggaatcttgaaggcaaagctcgagggtcactttaaaaaccaggaactcagacaagtaaagcgacaggaggaaaattacgaccagcaagtggaaatgagcctccaggatgaagacgagtgcgacgtgtacatactgacgaaagtcagcgatattttgcactctctgttttctacttataaggaaaagatacttccatggtttgagcagctgttacccttgatcgtcaatctgatctgctccagcagaccttggcccgatcgccagtggggcttgtgtatttttgatgatataatagaacattgttcacccacctcatttaaatacgtagagtatttccggtggccaatgctcctgaatatgagggacaataaccctgaagtgcgccaggccgccgcgtacggtctcggcgtaatggctcagttcggaggtgacgactatcgttccctttgttcggaggccgtgcctctgttggtgaaagtgattaaatgcgccaactctaaaactaaaaaaaatgtcatcgctaccgagaactgcatatctgcaatcggtaaaatcctcaaatttaagccaaactgtgtgaacgtggacgaagtcctgccccactggttgagctggcttcctctacacgaggataaggaagaagctattcaaacactgtcgttcctgtgtgacttgatcgagtctaaccaccctgtcgtcatcggccccaataactcaaacctgccaaagattatttcgattattgcggaaggcaaaattaatgaaacaatcaactatgaggatccctgcgccaagaggctggctaatgtggtgaggcaagtacaaacctctgaagatttatggctggagtgtgtgtcccagttagatgacgaacagcaggaggccttacaagagctgttaaactttgcttag

SEQ ID NO: 22938 - DNA, 1914 bp, Artificial Sequence
  Description of Artificial Sequence: Synthetic coding sequence
atggaggtgaccggcttcggcgtgacccggcccggcaaggtgccccaggccaggatgagcgggttggttttgggtcagcgggacgagcctgccggccatagactgtcccaggaagagatcctaggatctacccgactcgtgagccaggggctggaagccctgagatccgagcatcaggccgttctccagagccttagtcaaacgattgagtgcctgcagcagggaggccatgaagagggactcgtgcacgaaaaagcgagacagttgagacggtctatggaaaacatagaactgggtctttctgaggcacaagtcatgctcgcacttgccagccacctgagtactgtagagtccgagaagcagaagttgcgggcgcaggtgcggagattgtgtcaggaaaatcaatggctgagagacgaactggccggaacccagcaaaggctccagcggtccgagcaagccgtcgctcagctcgaagaggagaaaaaacacttagaattcttaggccaactccggcaatatgacgaagacggccatacgagcgaggagaaagaaggggatgcaacaaaagactccctcgatgacttattccccaacgaagaggaagaagatccctctaatggactatcacgcgggcagggcgccactgccgcgcagcagggcggatatgagatcccagcgcgactgcgcacgttgcataatctggttatccaatatgccgcgcaggggagatacgaagtggcagttcctctctgtaaacaggcactcgaggacctagaaagaacttccggtcgggggcacccagatgtcgccacaatgctgaacattttagcactcgtctaccgggaccagaacaagtacaaagaagccgcccatctcctgaatgatgccctttctatacgggaaagcacactgggaccggatcaccctgccgtggcagccactctcaataacctggctgtgttgtacggaaaaagggggaagtataaagaagccgaaccgttgtgtcagcgagccctggagatccgggaaaaagttcttggcacgaaccaccccgacgtcgcaaagcaactgaacaatctggccctcctctgccagaaccagggaaagtacgaggctgtcgagaggtattaccagcgcgccctggcgatctacgaagggcagctaggcccggataatcccaacgtagcccgaacaaagaacaacctcgcttcttgctatctgaaacagggtaaatatgcagaggcagagactctttacaaagagatcctcactagagctcatgtacaggagtttgggagtgtggacgacgatcataagcccatttggatgcacgcggaagaaagggaagagatgtccaagagtcgccatcacgagggcggcacaccctatgccgagtatggtggatggtacaaagcttgtaaggtgtcttcgcctactgtgaacacaaccctgagaaatttaggtgccttataccgtagacagggtaaattggaggccgctgagactctggaggaatgcgcactcagaagccgccggcaaggaaccgatcccataagccagaccaaggtcgctgagttattgggcgagtctgatggtagacgaacatcacaggagggccctggtgacagcgtcaaattcgaaggtggtgaggacgcgtccgtggcagtggagtggtccggcgatgggagcgggacactccaaagaagcgggtcactgggaaagatccgcgacgtcctgcggcggtccagcgaactgctggtccgcaagctccagggcacagaaccacggcctagctctagcaatatgaagagagccgctagtctcaactacctgaaccagccgtccgcagctcccttgcaggtgtctcgcggactgagcgcctccactatggacctctctagtagctcatag

SEQ ID NO: 22939 - DNA, 3966 bp, Artificial Sequence
  Description of Artificial Sequence: Synthetic coding sequence
atgcagtgcctggccgccgccctgaaggacgagaccaacatgagcggaggaggagagcaggccgatatactgccagccaattacgtggtgaaggatcggtggaaagtgctgaagaagattgggggcggcggtttcggcgagatctacgaggctatggacctgcttactcgtgagaatgttgccctcaaggttgaaagtgcacagcagcccaagcaagttcttaaaatggaggtggccgtgcttaagaaattgcagggtaaagaccatgtatgtcgcttcatcggctgtggccgcaatgaaaagtttaactatgtggtgatgcagctccagggacggaacctagccgacctcaggcgaagccagcctagaggaacctttacactcagtacaaccttaagactggggaagcagattctcgaaagcatagaagcaattcattccgtggggtttctgcaccgagacatcaaaccatctaatttcgcgatgggaagattgccctccacatatcggaagtgctacatgctagactttggtcttgcccgccagtacactaacaccacgggcgacgttcggccacccaggaacgtcgcaggattcagggggaccgtgaggtatgcttctgtgaacgctcacaagaatcgagaaatgggcagacatgacgatttgtggtcactcttctatatgctggtggaattcgcagtgggccagttgccctggcgcaaaatcaaggataaagaacaggtcgggatgattaaggagaagtacgaacatcgaatgctactgaagcacatgccatccgaatttcaccttttcctggaccacatcgccagcctcgattactttaccaagcctgactaccagttgatcatgtctgtttttgagaacagtatgaaggaacgaggtatcgccgaaaacgaggcttttgattgggaaaaagcggggacagatgctctgctgagcacctccacttccacacctccccagcagaatacccgacagaccgccgcaatgtttggtgtggtaaacgtgacaccggtccctggtgatctgctgagggagaataccgaagacgtccttcagggtgaacacctgagcgaccaggaaaatgcccccccaatcctgcctgggcgtccaagcgaagggctcggtccgtctccacatctggtgcctcacccagggggccccgaggccgaagtatgggaggaaaccgatgtcaaccgcaataagctgcgtattaatatcgggaagagcccatgcgtggaagaggagcagtccagggggatgggtgtcccgtcctcccctgttcgagcaccgccagacagcccaacgactccagtgaggagcctcagatatcgccgagttaactcaccagagtccgaaagactttccaccgcagatggacgcgtcgagttgccagaaaggaggtcaagaatggacctgcctggctccccctctagacaggcctgcagtagccagcctgcacaaatgctgtctgtcgacactggacacgcggacagacaggcgagcggcaggatggatgtaagcgcttctgttgaacaggaagctttatcaaatgcttttcggtcagtccctctggctgaagaagaggacttcgactctaaggagtgggtcatcatcgataaagaaactgaattaaaggattttccacctggcgctgagccaagtacatccggcaccacagatgaagaacccgaagagttgcgcccattgcctgaggaaggcgaggagaggcgccggcttggcgcggaaccaacagttcggcctaggggacgttcaatgcaggcgcttgccgaggaggacttgcagcacttaccaccccagcctcttccaccacaactgtcacagggtgacggtaggagcgagacgtcccagccaccgacaccggggtctccaagccacagtcccctccactccggccctaggccgaggaggcgggagagcgacccgactggcccccagcggcaggtttttagcgtggcgccgccgtttgaagttaacggcctgccccgggccgttccactcagcctcccttatcaagacttcaaacgcgatctttctgattatagggagcgagcgcggctcctgaatagagtccgacgggttggtttctcccacatgttgctgactacgccacaggttcctctggctccagtgcagcctcaagccaacggcaaggaagaggaagaggaagaagaagaggacgaagaggaggaggaggaagatgaagaggaggaggaggaggaggaagaagaagaagaggaggaagaggaggaagaggaagaagaggaggaggctgcagcagcggtggctctgggcgaggtgcttggccccaggagcggaagtagctctgagggttcagaacggtcaacagacagatctcaggaaggcgctccctctacactcctcgcagacgaccaaaaagagtcgaggggccgggcgtcgatggccgacggagatcttgagccagaggaaggaagtaagacactagtgctcgtttcgcctggggatatgaaaaagtctcctgtcacggccgagctcgcgcctgatccagacctgggaactctcgcagctctcacaccacagcatgagagaccccagccgacgggttcacagttggacgtgtccgagccgggaaccctgtcttccgtcctgaagagtgagcccaaaccccccgggcccggagctggcctcggagccggaaccgtgaccacgggagtgggaggggtcgctgtcaccagtagtccgttcaccaaagtcgagaggacatttgttcacattgctgagaagacccatctaaacgtcatgagttcaggcggtcaagctctgcggtccgaagagttttcggctggcggagagttggggctggagttggcctccgacgggggagccgtggaggagggcgctcgagctcccctcgagaatggcctcgccctgagcggactcaatggtgctgagattgaaggatcagccttatcaggggccccccgggaaacccctagtgagatggccacaaacagtcttccaaatggcccagccctggcggacggccctgcccccgtcagccccctggagcctagccccgaaaaggtggccactatcagccccaggcggcatgcgatgccgggctcacggcctagatccagaattcccgtactcctatcagaagaggacacaggctctgaaccttctgggagcctgagcgccaaggagaggtggtcaaaaagggccagaccccagcaggatttggcaagactggtgatggagaaacgtcagggccgtctgctgctaagattagccagtggagcttcaagctcctcctctgaagagcagaggcgggcctctgagactctgagcgggacgggctccgaggaagatacccctgcctccgaacctgcagccgcactgccgagaaagtctggcagggccgccgccacacggagcagaattccccggccgataggcctgcgcatgccaatgccagttgccgcccagcagcctgcttcccggagtcacggagctgcgcctgccttggacaccgccatcacttctaggttgcaacttcagaccccaccggggagtgccactgctgccgacctgagacctaagcaacctcccggaaggggactaggacctggccgggcccaagctggagcgcgtccccccgcaccgaggtcgccccgtttgcccgccagtactagcgccgcacgaaatgcaagtgcttctcctcgcagccagtcattaagcagaagggaaagtccttcacctagtcaccaggcgcggccgggagtacctccaccacgtggggtccctccagccagggcccagcccgacggaacgccttcccctggcgggtcaaaaaagggccccagggggaagctgcaggcgcagagggccaccactaaggggagggcaggtggcgcggaggggagggcaggagctcggtag

SEQ ID NO: 22940 - DNA, 1818 bp, Artificial Sequence
  Description of Artificial Sequence: Synthetic coding sequence
atgagccagctgagcagcaccctgaagcggtacaccgagagcgccaggtatacagatgctcactacgctaagtccggttacggagcttatacgcccagtagctacggggctaacctggccgcgagcctccttgagaaagaaaaactgggtttcaagccagtacctacttcctcttttttaacccgtccccggacatatggcccatcaagcctgctggactatgatagggggcgcccgttattgcgacctgatatcacaggtggaggtaagcgcgcagagagccagacacgcgggacagagcgtccgctgggttcgggacttagcggcgggagtggcttcccatatggggtaactaacaattgtctaagctaccttcctattaatgcgtatgatcagggcgtgacactgacacagaagctggattctcagagtgatttggcacgcgatttttcgtctctgcgcacgtccgactcttaccgcattgatcctaggaatctgggacgctcgcccatgctcgcgagaacgcggaaggagctctgtaccctgcagggactgtatcaaaccgcctcatgtcctgaataccttgtcgattatctcgaaaactatggccgcaagggtagtgcatctcaggtaccatcacaggccccaccaagcagggtgccagagatcatttcacctacatacaggcccattgggcgatatacactgtgggaaaccggcaagggccaggctcccggtccttcccgctcctccagtcctggcagggatgggatgaattctaagtccgcccaggggctcgccggacttagaaacctgggaaatacttgtttcatgaacagcatcctccagtgtctatcaaatacaagggagcttagggattattgcctccagcggctgtacatgcgggatttgcatcatggttccaacgcacacacagccctagtggaagaatttgcgaaactcattcagactatttggacctcttcgcctaatgatgtggtttctccttcggagttcaaaacccagattcagagatacgcacctcgatttgtggggtacaaccagcaggacgctcaggaattcctgcgctttcttctggacggcctgcacaatgaagtgaatagggttactttgcgcccaaagagtaacccggagaatttggatcatttgcccgacgatgaaaaggggagacaaatgtggcggaagtatttggaacgggaggatagcaggattggggatctgtttgttgggcagctcaagtctagcttgacttgcacagattgcgggtattgttccaccgtgttcgaccctttctgggacctgagcttacccattgctaagagaggttaccccgaggtgactttaatggactgcatgaggctgttcactaaagaggacgtgcttgatggggatgagaaacccacatgctgccggtgcagaggtcggaagcgctgcatcaaaaaattcagcattcagcgcttcccaaagattctggtcctgcatctcaagagattcagtgaatctcgaatccgaacatcgaagcttactacgttcgtgaatttcccgctcagagacttggacctccgagagttcgcctcagagaacacaaatcacgctgtgtataatctgtacgcagtgtccaaccactcagggacaaccatgggagggcactatactgcatactgccgaagcccagggaccggtgagtggcacaccttcaacgatagcagcgtgacccctatgagttccagtcaggtccggacctccgacgcatatcttcttttctacgagttagcgtctccgcctagtagaatgtag

SEQ ID NO: 22941 - DNA, 1353 bp, Artificial Sequence
  Description of Artificial Sequence: Synthetic coding sequence
atggtgcccctggtggccgtggtgagcggcccccgggcccagctgttcgcctgtctcctccgactgggcacgcagcaggtgggcccattgcaattacatacaggagccagccatgcagccaggaaccattatgaggtgctcgtgctaggaggtggaagcggagggatcaccatggcagccaggatgaagaggaaggtgggcgcggaaaacgtcgctatagtggagccatcagagaggcacttctaccaacctatatggaccctggtaggggccggggccaaacagttaagcagctctggacgacctactgccagcgttatcccatctggagtggaatggattaaagctagagtgaccgagctgaatcctgacaagaactgtattcacacagacgacgatgaaaagatttcctacagatatctcataatcgccctgggaattcagttagactacgagaagattaaagggttacccgaaggctttgcacatcccaaaatcggcagtaattattccgtcaaaaccgtagagaagacctggaaggccttacaagactttaaagaaggaaatgcaatatttaccttccccaatacgccagtgaagtgtgccggtgccccacagaagattatgtacttatccgaggcctactttcgcaagacagggaaacggtcgaaagcaaatattattttcaacactagcctcggcgccatctttggcgtaaaaaaatacgcagacgccctgcaggagatcatacaggaaaggaatctcactgtcaattacaagaaaaatctgatagaagtgcgggcagataaacaggaggccgtgttcgaaaacttggataagcctggagaaacccaagtgataagctatgagatgttgcacgtcacccccccaatgtccccccccgatgtcctgaaaacctctccggtggctgacgccgcgggttgggtggacgtggataaagagacactgcagcaccggagatacccgaatgttttcgggatcggagattgcactaatcttccaaccagcaaaactgccgccgccgtggccgcacaaagtgggatcctagatcgcaccatctctgtgattatgaaaaaccagacccccaccaagaagtacgacggctatacaagctgccctctggtgactggatacaacagagttatcctggcagaattcgattacaaagcagagccattggagacctttccctttgaccagtctaaagaacgactctcaatgtacttgatgaaagcagatctcatgccctttttgtattggaacatgatgctgagaggatactggggcgggcctgccttcttgaggaagctgtttcatctcggcatgtcttag

SEQ ID NO: 22942 - DNA, 5244 bp, Artificial Sequence
  Description of Artificial Sequence: Synthetic coding sequence
atggacggcgtgagcagcgaggccaacgaggagaacgacaacatcgagagacctgtcaggcgacgccatagttccatccttaaaccaccacggagtcccttacaggatttgcgtggcggcaacgaaagggtgcaggaaagcaatgcactgaggaacaagaagaactccaggcgggtgtctttcgccgacactataaaagtgttccagactgaatcccacatgaagatcgttagaaagagcgagatggaagagactgaaacaggcgaaaatttactcctcattcagaacaagaaactggaagataattactgtgaaataactggtatgaatacattgctcagcgcaccaatccatacccagatgcagcagaaggaattctccatcattgagcatacaagagagcgaaaacatgctaacgatcagactgtgatattttccgacgaaaatcaaatggaccttacctcgtcacacaccgtcatgataacaaagggcttgctggacaaccccatcagtgaaaagtcaaccaaaatagatactacctctttcctcgcaaatctgaaactgcatacggaagacagccgcatgaaaaaagaagtaaacttttcagtcgaccagaatacttccagtgaaaacaagatcgattttaacgacttcatcaagcggttaaagaccggtaaatgtagtgcgtttccagacgtaccagataaagagaattttgagatcccaatttactccaaagagcccaatagcgcatctagtacccatcaaatgcatgtgtcacttaaggaggacgaaaataactccaacatcacccgccttttcagagagaaggatgatgggatgaatttcacccagtgccatactgctaacatacagactcttatcccgacatcctctgaaaccaactctcgcgaatctaaagggaacgatataacaatctatggtaatgacttcatggatctcacgttcaaccatacacttcagattctgcctgccaccggtaacttttccgagattgagaaccagacacagaatgccatggacgtcaccaccggctacggcaccaaagccagtggcaataagacagtttttaaatctaagcaaaacactgccttccaggacctgagtattaattccgcagacaaaatacacataacccgatcacacatcatgggcgcagaaacccatattgtgtctcagacgtgcaaccaggacgcccgcatacttgccatgacaccagagtcaatttactctaatccgtcgatccagggttgcaagaccgttttctactcaagctgtaatgacgcgatggagatgaccaaatgcctctctaatatgcgcgaggaaaaaaatctgcttaagcatgattccaactacgctaagatgtactgtaatccagacgccatgtcatctctcaccgaaaaaactatctatagcggagaagaaaatatggatattaccaaaagccacaccgtggctatagataaccaaatttttaaacaggatcaatccaatgtgcaaatcgccgcggcacctactcccgagaaagagatgatgcttcaaaatctgatgaccacaagcgaggacggaaagatgaatgtgaactgcaacagtgtgccgcacgtgagtaaagaacggatccagcagtccttaagcaaccccttgagcatctccttgactgatcgcaaaactgagttactttccggagaaaacatggatttaaccgaatcccatacatcaaatctggggtcacaggtaccactcgccgcttacaatctggccccggagtctacaagtgagtcccactctcagagcaagtcatcgagcgatgagtgcgaagagataacaaagtcgaggaatgagcctttccagaggagcgatattatagctaaaaatagcctcacagacacatggaacaaagataaggattgggttctcaaaattctcccgtatctggacaaggactctccccagagcgccgattgcaatcaagaaatcgcgacgtcacacaacatcgtgtactgtggaggcgtgctggacaagcagatcacgaaccgcaataccgtgtcctgggagcaaagcctgtttagtacaacgaagcctcttttttcttccggccaattttcaatgaagaatcatgacacagccatcagttcacataccgtgaaatccgttctcggacagaacagcaaacttgcagagcccctcagaaaaagtttgagtaaccctacccctgattactgccacgacaaaatgattatttgttccgaggaggaacagaatatggatcttactaagtcgcacacagtggtgattggcttcggccccagtgagctgcaggagttagggaagaccaaccttgagcatacaaccggccagctcaccacaatgaatcgccagattgcagtcaaggtcgagaaatgcgggaaaagtcctatcgaaaaatccggcgtgctaaagtccaactgtatcatggatgtgctggaggatgagtctgttcagaagcctaaattcccaaaggagaaacagaatgttaaaatctggggaagaaaatcagtcggtggccccaaaattgataaaacaatagttttcagcgaggacgacaaaaacgatatggacatcacaaagtcgtacacgatcgagattaaccatcgccctctcttagagaagagagactgccacttggtgcctctcgctgggacatccgaaactattctgtatacatgccgccaggacgacatggaaatcacccgctctcatacaactgctctggaatgcaagactgtgtctccggatgaaattactacaaggcccatggacaaaacggtggtctttgtcgataatcacgtggagctagaaatgacagagagtcataccgtgttcatagactatcaggagaaagagagaaccgatagacccaattttgagcttagccagcggaaatctttagggacacctaccgtgatttgcacgcccacagaggagagcgtcttctttccagggaatggggaatctgaccgacttgtggccaatgattcccagctaaccccactggaggaatggagcaataaccggggccccgtggaagtagctgataatatggagttgtctaagagtgcgacttgtaaaaacataaaggacgtgcaatccccagggttcttaaatgagccactctcaagcaagagccagcggcgtaaatctctgaagctgaagaatgacaagacaattgttttctctgagaaccacaaaaatgacatggatattactcaatcttgtatggtggagatagacaacgagtctgctctggaggacaaagaggattttcaccttgccggtgcctccaagacaatcctctacagctgcggccaggatgatatggagatcacacggtctcatacaacggcccttgagtgtaaaacacttctgcccaacgaaattgccatccggcccatggacaaaaccgtactcttcacagacaactatagcgatctggaggtgaccgacagccacacagttttcatcgactgtcaggccaccgaaaaaatcttggaggaaaatcctaagttcggaattgggaaaggtaagaatctgggtgtgagttttcccaaggacaactcctgcgtgcaagagattgcagagaaacaggctcttgccgttggcaacaagattgtgttacatacagaacaaaaacagcagctgttcgccgcaaccaaccggaccaccaatgaaatcatcaagtttcactccgctgccatggacgagaaagttatcggaaaggtcgtcgatcaggcctgcaccctggagaaggcccaggtggagtcgtgtcagctcaacaatcgcgacagacgaaatgtcgattttacttccagtcacgcgaccgcggtgtgtggatcttcagacaactatagttgtctacccaacgtcattagttgcaccgataatctggaaggctctgccatgttgctgtgcgataaggacgaggagaaggccaactactgtccagtgcagaacgacctcgcatacgctaatgactttgctagtgaatattatctggagtcagaaggtcagccgctgagcgcaccctgtccgctcctggaaaaagaagaggttatccagacaagtaccaaggggcaattggattgcgttattacgctgcacaaagatcaggatctcattaaagatccaagaaacctgttggccaatcagaccctggtgtatagccaggacctgggagaaatgaccaaattgaactccaagagagtttccttcaagttacctaaggatcagatgaaggtctatgtcgatgacatttatgtgattcctcagccccatttcagtactgatcagccccctctgccaaaaaaggggcagtcaagtatcaacaaagaagaagttatcctgtccaaagctggaaacaaatccctaaatattatcgaaaacagttccgcgcctatctgtgagaacaaacctaagattttaaacagtgaagaatggtttgccgccgcatgtaaaaaggagctgaaggagaatatacagaccaccaactacaacactgcactcgacttccatagcaacagcgatgtcactaaacaggttatccagacccacgtgaacgctggcgaagcccctgatcctgttattacctctaacgtgccctgtttccattcaattaaaccgaacctgaataacctgaacggaaagactggggagttcctcgcttttcaaactgtgcatttgcctcctctccctgaacagctcctagagctggggaacaaggcacacaacgacatgcatatagtgcaggctacggagatacacaacataaatatcatcagttccaatgctaaagactctcgcgacgaggagaataagaaaagccataacggggctgaaactacctccctcccccccaagaccgtctttaaagacaaggtcaggcggtgctctttaggtatattcctacctagacttcccaacaaaagaaactgctcagttaccgggatagatgatctagaacagatccctgccgacactacagatatcaaccacttggagacccagccggtctcctccaaggactccgggatcggttctgtggctggcaaactcaacctttctcccagtcagtatattaacgaagagaacctccctgtctatcccgatgaaattaactcatcagacagtataaacatcgagactgagccgaagaaaaacgttggtacccggagaaggcggtactcctag

SEQ ID NO: 22943 - DNA, 2061 bp, Artificial Sequence
  Description of Artificial Sequence: Synthetic coding sequence
atgatccccggcaagtaccggagcgtgagcggccgggccgccaacaatgtcaattgtggcctgcatctggtgatccagactagctcacttccagaaaagaataaggtcgaattcaaacttaacaaggacacctcctcatttcctggccgactcctgcagcacgacctcgagaggaactattcaagccggcaaggtgatcatattaatctcgtgtcgagctctctgagcagcttccccatacttcaaagaagctcagaggaaaaaatcctctactcagacagattaagcttagagcgccagaaattgactgtgtgtccaatcatcaatggtgaagatcacttgcggctcctgaactttcagcacaacttcatcacccgcatccaaaacatatcaaatctgcagaagctgatctccctggatctgtacgacaatcagatagaggaaataagcggcctgagcacactgagatgtttgagagtgctcttgttgggtaagaacagaatcaagaagatcagcaacctcgagaacctaaagagtctggatgtgctggatctccatggcaaccagataacaaagatcgagaacatcaatcatctgtgtgaactgcgcgtgctcaatctggcaagaaactttttgtcacatgtagacaacctgaatggactcgacagcctaacagagctgaacctgcgccacaatcaaatcacctttgtgcgagacgtcgataatctgccatgccttcaacacctctttctgagcttcaacaacatcagctcctttgacagtgttagctgcctggccgactcaagttccctgagcgatattacgtttgacggtaatcctatagcccaagaaagttggtacaaacataccgtgctgcagaatatgatgcagttacggcaactggatatgaagaggatcacagaggaagaaaggcgtatggcttctgtgttggcaaaaaaggaggaagagaagaaacgggaaagccacaaacagtctctgctgaaagagaaaaaaaggctcactataaacaatgtagcccgccagtgggatttacagcagcagcgggttgcgaatattgctactaatgaggaccgcaaggactctgacagtcctcaggacccatgccagattgatgggagcacactgagtgcctttcccgaggaaactggccctctggactcggggctgaataatgccttgcagggcctgagtgttatcgatacataccttgtggaagtggacggagacaccctttccctctacggatctggcgcactggagagtctagacaggaattggtccgtccagaccgccggcatgattaccacggtgtcctttacgtttattgagttcgacgagatcgtccaggttctacccaaactcaaaatcaagttccccaacagtctccacctgaaatttaaagaaaccaacttggtaatgctccagcaatttaatgcactcgcccagctgagaagaatcgaccagttgaccatcgatccccagggcaaccctgtcgtgaatttcactctgtggaagtattacgtgctcttccgactttcacatttcagtatgcaaaaaataaatggcacggaagtgacccaaaacgacatgattatggcggagaggctgttcggcatcctggcacatgtggccagctccgaactgccccagtataggctgatcagcatcctgggagacgccagaaagaaacaatttcgatacttacttgagagtaaaggcaagaagcccgggattatcaatgaagaaaacaatgatagtaaaagactagtgggcgaaaatactaacagggccaccctcaactacacaacccgagacttctataatgaaaaacttgaagaaataaaagagaaaaaaaagttctgcaagacttacatcgaagacttggtcaaagaggcaaccgaaattaacatgaaaaatgaggcgctccagaaactctggccccagatgttcatagaactagtaagggatgctgttattgagattagaaataagaactcctacatgaagttgtgcctccaacagatcacagatcagaaatag

SEQ ID NO: 22944 - DNA, 255 bp, Artificial Sequence
  Description of Artificial Sequence: Synthetic coding sequence
atgccctacctgctgatcagcacccagatccggatggaggtgggccccaccatggttggagacgagcagtctgatcctgaactgatgcaacatcttggagctagcaagcgacgcgcactgggtaacaatttctacgagtattatgtcgacgacccgccacggatagtactggacaagctggagagaagaggcttccgcgtgctgtcaatgaccggggtcggccagacactggtctggtgcctccataaggagtag

SEQ ID NO: 22945 - DNA, 2664 bp, Artificial Sequence
  Description of Artificial Sequence: Synthetic coding sequence
atgcccagcctgccccaggagggcgtgatccagggccccagccccctcgacctcaataccgagctaccataccaatccaccatgaaaagaaaagttaggaaaaagaagaaaaaaggtaccatcaccgccaatgtagctggtaccaaatttgaaattgtgagactagtgatcgatgagatgggtttcatgaagacacccgacgaagacgagacatccaatctcatttggtgtgactccgccgtccagcaggagaagataagtgagcttcagaactatcagcgaatcaaccacttccccggcatgggagagatctgtaggaaggattttctggcccgcaacatgacaaagatgattaaatctcggcccctcgattatacgtttgtgcctcggacctggatctttcctgctgaatatacacagttccagaactacgttaaggagctgaagaaaaagcgcaaacaaaagaccttcatcgttaagcctgccaatggcgcaatgggacacggtatctctcttatccgcaacggagataaacttcccagtcaggatcatctgattgtacaagagtatatcgagaaaccattcctaatggagggctataagtttgacctgaggatctacatcctggtgacttcatgcgaccccctgaaaattttcctctaccacgatggactcgttaggatgggcactgagaaatatattcccccgaatgaaagcaatctcacacaactgtatatgcaccttactaactacagcgtgaataaacataacgagcatttcgagcgggacgagaccgaaaataagggaagcaagcgctccattaaatggtttactgagttcctgcaggctaatcagcacgacgtcgcaaagttctggtccgatattagtgagctggtggtcaagacgttaatcgtagccgagcctcacgtgctgcatgcctatagaatgtgtcgccccggccagcctcctggaagcgagagcgtatgctttgaagtactggggttcgacattttactggacagaaagttaaagccatggctgctcgagataaatcgggcgccatccttcgggaccgatcagaaaatcgattatgatgtgaaacgcggagtgctgcttaacgctctaaaattgctgaatatcaggacaagtgacaaaagacggaacctagctaagcagaaagctgaagcccagaggaggctctacgggcagaatagcattaagaggctgctgccgggttcctccgactgggagcagcagcgacaccagctcgaacggcgcaaagaagaacttaaggagagactggcacaggttaggaagcagatctcacgggaggaacacgagaatcgccacatgggcaactatcggagaatctacccacccgaggacaaagccctgcttgagaagtacgaaaacttgttggccgtcgcctttcagacattcctgtccggtagagctgcttcttttcaaagggagttaaacaacccccttaagaggatgaaggaggaggacattctggatttgctggaacagtgtgagattgacgacgaaaaactcatgggcaagacaacaaagaccagagggccgaagccattatgttccatgcccgagtcaacagaaatcatgaaacgtccaaagtactgtagtagcgattcatcctacgatagctcatcttcatcttctgaaagcgacgaaaacgaaaaggaagaatatcaaaacaaaaaaagagagaaacaggtgacctacaatctcaaacctagcaaccactacaaactgatacaacagccatctagtatccgccgctctgtgagttgtcccagaagtatttcagctcagtctccatcatcaggcgatactaggccattcagcgctcaacagatgataagtgtctcccgccccacttcagcctctagatcacattcactgaatagagcttcttcatatatgaggcatttaccccatagcaacgatgcttgctcaacgaatagtcaggtctccgaaagcctgcgtcagctgaaaacaaaggagcaagaggatgacctgacgagccagactctcttcgttttaaaagacatgaagattagatttcctggcaaaagtgacgccgagagtgaacttctcattgaggacattattgataactggaagtaccataagaccaaagtggccagctattggctgattaagttagatagtgtcaagcagaggaaagtgctggacatagttaaaacctccatccggactgtgctgcccagaatatggaaagttcccgatgttgaggaggtgaatttataccgcattttcaaccgtgtttttaaccgcttgctttggtcccgcggtcagggtctgtggaactgcttttgcgatagcggctctagttgggagtctatcttcaataaatctccagaggtggtgacgcctttgcagctgcagtgttgtcaacgactggtggaactgtgcaagcagtgtctgctcgtagtgtacaaatatgctactgataaaaggggcagcctgtccggtatcggccccgattggggcaactcccgttacctgctgcctggaagcacgcagtttttcctccgaactccgacctataaccttaagtataacagccccggcatgacaaggagcaacgtcttattcacgagcaggtatggacacctctag

SEQ ID NO: 22946 - DNA, 1140 bp, Artificial Sequence
  Description of Artificial Sequence: Synthetic coding sequence
atggccggcccccgggtggaggtggacggcagcatcatggagggcggagggcaaattttgcgggtctccaccgccctcagctgtttactgggtcttcctttacgggtgcagaaaattagagctggaagatcaacccccgggttatcgagcggcggatggaagagcaagattaaagtgctcacccgccctcaacatctctccgggctggaaatgatccgcgacctgtgcgatggtcaactggagggggccgaaattggaagcaccgagattacgtttacaccggaaaagatcaagggaggcatacacaccgccgataccaaaactgcaggctcggtctgtctcctcatgcaggtctccatgccttgtgtccttttcgctgcatcaccaagtgaattacacttaaaagggggcacaaatgctgaaatggccccccaaatcgattacactgtcatggtttttaaacctatagtggaaaagttcggctttatattcaattgcgacattaaaacccggggatactacccgaaaggcgggggagaagttatcgtgagaatgtcgccggtgaagcaactcaacccaatcaatctcacagaaaggggttgtgtcactaaaatctatggtcgggcctttgtggccggtgtcctcccgtttaaggttgccaaagatatggcagcagcagccgtccgatgtatccggaaggaaatccgggacttgtacgttaacattcaaccagtccaggagcccaaagatcaggccttcggcaacggaaatggtatcattatcatagccgagacctccactggctgtcttttcgccgggagttcgcttggtaagcgcggcgtaaacgccgacaaagtagggattgaggcggctgagatgttgttggctaacctccgacatggtgggaccgtggatgagtatctccaggatcagttgattgtcttcatggctttagctaatggagtttctcgtattaaaaccgggcctgtgactctgcacacccaaacagccatccattttgctgagcaaatcgctaaggcgaagttcatcgtgaaaaagtcagaggatgaagaagacgctgccaaagatacttatattattgaatgccagggcattggcatgaccaacccaaacctttag

SEQ ID NO: 22947 - DNA, 1056 bp, Artificial Sequence
  Description of Artificial Sequence: Synthetic coding sequence
atgcccagcgagaccctgtgggagatcgccaaggccgaggtggagaagagaggcattaatggctcagagggggatggagcagagattgcagagaagttcgtgttctttataggatccaagaacgggggtaagactaccatcattctgagatgtctggaccgcgacgaaccccccaaaccaacattagcgctggaatacacatacgggcggcgggccaagggccacaatacccccaaggacatcgcacatttctgggaacttggcggtggcacttccctgctggatttgatttctattccaattactggtgatacgctgcgtacattcagcttggtgttagtcctcgacctgtcgaaaccgaacgatctatggcccacgatggagaacctgctccaggctaccaagagccacgtggataaagttatcatgaaattgggcaagaccaatgcaaaggcagtgagcgagatgcggcagaaaatatggaacaacatgcccaaagatcacccagatcatgaactgattgaccctttcccagtgccgctcgtgattatcgggagcaaatatgacgtgttccaggacttcgagagcgagaagcgtaaagtgatttgtaagactcttcgcttcgtagcccactactacggcgcctctcttatgttcaccagcaagtctgaggccctgttgctgaaaatcagaggtgtcatcaatcagctggcattcggcattgacaaaagtaagtcgatttgtgtagaccagaataaacccctgttcattacagctggtcttgactccttcggccaaataggcagcccgcccgtgccggagaatgatatcggcaagctgcacgctcattcccccatggagctgtggaagaaggtgtacgaaaagctgttccctccaaaaagcattaataccctgaaggatattaaagatccggcccgggaccctcagtacgccgaaaacgaggtggacgagatgcggatccagaaggacctggaactggagcagtacaaacgctcatcatctaaatcttggaaacagattgaactagactcctag

SEQ ID NO: 22948 - DNA, 798 bp, Artificial Sequence
  Description of Artificial Sequence: Synthetic coding sequence
atgtgcaccagcgagaccttccaggccctggacaccttcgaggccagacacgacgatatagtgttggcttcctaccctaagtgcgggagcaattggattcttcacatcgtgagcgaattaatctacgctgttagtaagaaaaaatacaagtacccagagttccctgtactggagtgcggggacagcgaaaaatatcagagaatgaaaggatttccctctccgagaattctggctacacacttacactatgacaaactcccagggtcaatctttgaaaataaagccaaaatcctcgtaatttttcgcaacccgaaggatacagctgtgtcttttttgcattttcacaatgacgtccctgacatcccttcgtacggcagctgggacgagttctttagacaatttatgaaaggccaagtctcttggggccgatacttcgatttcgccattaattggaataaacacctggacggtgataacgtcaagttcatcctttacgaagacctcaaggaaaacctggcggccggcattaaacagatcgccgaatttcttggattcttcttaactggtgagcagatccagacgatttcggtgcagagtaccttccaagcgatgcgagctaaatcacaggacacacatggcgctgtggggccattcctttttcggaaaggagaagtgggcgattggaagaacctgtttagtgaaattcaaaaccaggagatggacgaaaaattcaaggagtgtttggccggcacaagtttgggcgctaagctcaagtatgaaagctactgtcagggctag

SEQ ID NO: 22949 - DNA, 5343 bp, Artificial Sequence
  Description of Artificial Sequence: Synthetic coding sequence
atggagagcaacttcaaccaggagggcgtgccccggcccagctacgttttttctgccgaccctattgcccgacccagcgagatcaattttgatggcatcaagctagacctgagccatgagttctccctggtggcaccaaacacagaggccaatagtttcgagtctaaggattacctacaggtctgcctgcgcattcgcccattcactcaatccgagaaagagttggaaagcgagggatgcgtacatattctggactcccaaaccgttgtgttgaaagaacctcagtgcatactgggaaggttatccgaaaaatcctctggccagatggctcaaaaattcagcttctccaaggtcttcggacctgccaccacgcagaaagagttctttcaaggctgtatcatgcagcctgtcaaagatctgctgaaagggcagagccgcctgattttcacatatggcctcactaactcaggcaagacttatacgttccagggaaccgaggagaacatcggtatactccctagaaccctaaatgtgctattcgacagcctgcaagagcggctgtacacaaaaatgaacttgaagccgcatcgatcaagagagtatctgaggctgtccagtgagcaggaaaaagaggaaattgcttccaaaagcgcgctgcttcgccaaatcaaggaagtaacagtccacaatgactccgatgacacgctttacggatctctgaccaacagtctcaacatcagcgagtttgaggagtccatcaaggattatgaacaggccaaccttaatatggccaattcgatcaagttctccgtttgggtatccttcttcgaaatatacaacgaatatatttatgacctttttgtgcctgttagcagcaagtttcagaagagaaagatgctacgcttgagccaggacgtaaagggctactcattcatcaaggacctgcaatggatccaggtgtctgactccaaagaagcttacagactgcttaaacttggcattaagcaccagtcagtcgcttttaccaaacttaataacgcatcttcaaggagccatagcatcttcactgttaagatccttcagatcgaggactcggaaatgagccgcgtgatcagagtctccgagctgtctctctgtgatctcgccggcagcgagcgcacaatgaagacccagaacgagggcgaaaggctgcgcgagaccggaaacatcaacacttctttgttgactctagggaagtgcatcaacgtcctgaaaaattctgagaaatccaagttccagcagcacgtccccttcagggaatctaagctgacacactattttcagtccttcttcaatggcaagggcaaaatatgcatgatagtcaacatttcacaatgctacttagcatatgatgagaccctgaacgtgctcaaattcagcgcaatcgcacagaaagtgtgcgtccctgacacactgaactcgtcacaagaaaaactgtttggccccgtgaaaagtagtcaggacgtgtccttagactccaactctaacagtaagattctgaatgtgaaaagggctaccattagctgggaaaactcgctcgaggaccttatggaagacgaggatttggttgaagaactggagaacgccgaagagacacagaatgtggagacaaagctgctggatgaagatctggacaagaccctggaagagaataaggccttcatcagccatgaggaaaaacgaaagctgttagatctgatagaggacctgaaaaagaaactcattaacgagaagaaggaaaagcttacgctcgagtttaagattcgcgaagaggtcacgcaggagtttacacaatattgggcccagcgagaagctgatttcaaagagaccctgctgcaagagagggagatcctcgaggagaacgcagagaggagactggccatcttcaaagacctggttgggaagtgcgataccagggaggaagctgcgaaggatatttgtgctactaaggttgaaaccgaggaggcgacggcatgcctggaactgaagtttaaccagatcaaagctgagcttgccaagactaaaggcgaactgatcaagaccaaagaggaactcaaaaagagggaaaacgaaagcgactccctgattcaggaacttgaaacttctaataaaaagatcataacacagaaccaacgtatcaaagaactgataaatatcatcgatcagaaggaggatacaattaacgaatttcagaatcttaaatcccacatggagaacaccttcaagtgcaacgacaaggccgatacatcaagcctgatcatcaacaacaagctcatctgcaatgagaccgtggaagtgcctaaggactctaagtccaaaatctgttccgagcgtaaaagggtcaatgaaaatgagctccagcaggacgagcctcccgctaagaagggatctatacacgtgtcgtctgccataactgaagaccagaagaagtccgaggaagtgagaccaaatatcgctgagatagaagatattagggttttgcaggagaacaacgagggacttagagccttcctgcttacgatcgagaatgaactcaaaaacgagaaagaagaaaaagccgaacttaataagcaaatcgtgcatttccagcaggagctctcgctctctgagaaaaagaacctgacattgagcaaagaggttcaacagatccaatctaactatgatattgcaatcgcagagctccacgtgcagaaatccaaaaaccaggaacaagaggagaaaatcatgaaattgagtaacgaaatcgaaaccgccactagatccattactaacaacgtttcccaaataaagcttatgcacaccaagatcgacgagctaagaactctggatagcgtgagtcagatctcaaatatcgacctcctaaatttaagagatctgagcaacggctccgaggaagataaccttccaaacacacagctcgatctactgggtaacgactacctggtatctaaacaggtgaaggagtacaggatccaggagccaaatagggaaaatagtttccactcctccattgaagccatatgggaggagtgcaaagaaatagtcaaagcctcctctaagaagagccatcaaatagaggagctggagcagcagattgaaaagctacaggccgaagtcaagggttataaggatgagaataatcggctgaaggaaaaagaacacaagaaccaggatgacctgctaaaggagaaggagaccctgatccagcagttgaaagaagaactgcaggagaaaaatgtgacactggatgtccaaattcagcatgtggtggaaggcaaacgcgccctttccgaactcacccagggtgtgacttgctataaggcgaaaatcaaggagctcgaaactattctcgagacccagaaggttgaatgttcacactctgcaaaactggagcaagacatcctggagaaggagtcaattatcttgaaactggagcgtaacctgaaagagtttcaggaacacttgcaggactctgtcaagaacaccaaggatctgaacgtcaaagagctgaagttgaaagaagagattacccagttgacgaacaacttgcaggacatgaagcatttgttgcaattgaaggaggaggaggaggagactaacagacaagaaacagagaagctgaaggaggaactgtcagcgtccagcgccagaacacagaatctgaaagccgacctgcaacgcaaggaggaggactacgctgaccttaaagagaagctgaccgatgctaagaaacagatcaaacaggtgcaaaaagaggtctctgtaatgcgtgatgaagacaagctacttcgtattaagatcaatgaactggagaaaaagaagaatcaatgctctcaggagctcgatatgaagcagcgaacaatccagcaactcaaagaacaactgaacaaccaaaaagtggaagaagcaatacaacagtatgagcgggcatgcaaagacctcaacgtgaaagaaaagataattgaagacatgcggatgacccttgaagaacaggagcagactcaggtcgaacaggaccaggttctcgaggcgaagttagaagaggtggagcggctggctacggaactcgaaaagtggaaggaaaagtgcaatgacctggaaacaaaaaacaaccagaggtccaacaaggaacatgagaacaatacagacgtgttgggcaagttaacaaatctccaggatgaactgcaggagtctgagcaaaagtacaatgctgatagaaaaaagtggctggaggaaaaaatgatgctgatcacacaggccaaggaagctgagaacatacgaaacaaggagatgaaaaaatacgctgaagaccgcgagcggttttttaagcaacagaacgaaatggagatccttacagcccagctgacggagaaagattcggatctgcagaagtggcgggaggaacgcgatcagctggtcgctgctctggaaattcagctcaaagcactcatatcttcaaatgttcaaaaagacaacgagatcgagcagctgaaacgcataatcagcgaaacctcaaaaattgaaacccagataatggacatcaaaccaaagagaataagcagtgcggaccctgataaactgcagactgaaccattgtccacgtcgtttgagattagtcgaaacaagatagaggatggatcggttgtgttggattcttgtgaagtcagcaccgagaatgatcagagcaccaggtttccaaaacctgaactggagattcagttcaccccactgcagccaaataaaatggccgttaaacaccctggctgtacgacccctgttactgtgaagatacccaaagctaggaaaaggaagagtaacgagatggaggaggacctcgtcaagtgtgagaacaagaaaaacgcaacaccaaggacgaatcttaagttccccatcagtgatgataggaatagctcggtgaaaaaagagcagaaagtagccattcgcccttcttctaaaaagacctacagtctgaggtcccaagcctctatcataggcgtgaacctcgcaaccaagaagaaggagggcacactgcaaaaatttggggatttcctgcagcactccccgtcaattttgcaatccaaggccaagaagataatcgagaccatgtcatcttctaagctgtccaatgtggaggcctctaaggagaacgtttcccagccaaagcgagccaagcgaaaactgtatacatctgagatctcatctcctatagacatctcaggccaggtgattttaatggaccagaaaatgaaagaatctgaccatcagatcattaagcgaagactgcggacgaagaccgccaaatag

SEQ ID NO: 22950 - DNA, 1371 bp, Artificial Sequence
  Description of Artificial Sequence: Synthetic coding sequence
atgaacagcagcgacgaggagaagcagctgcagctgatcaccagcctgaaggagcaggccatcggggagtacgaggatctgcgagcagaaaatcaaaagaccaaggagaagtgcgataaaatccggcaggagagagacgaggcagtgaagaagctagaagagttccagaagataagccatatggtcattgaagaggtcaatttcatgcagaaccacctggaaatagagaagacctgcagggagtcagccgaggcccttgccactaaattaaacaaggaaaataagaccctgaaaagaatttcaatgctttatatggccaaactagggccggatgtgatcacagaggagatcaacattgacgacgaggattcaacgaccgacacagatggcgccgctgagacttgcgtctcagtccagtgccaaaaacagatcaaagaactcagggaccaaattgtgtctgtgcaggaagaaaaaaagatattggccatcgagctggagaatcttaaatctaagctggtagaggtgatagaagaggtcaataaagtgaagcaggagaaaacagtcctgaattcagaggtattggagcaacgcaaagtgctggagaaatgcaaccgcgtttccatgcttgctgtcgaagagtacgaggagatgcaggtgaatctggagctggagaaagacctcaggaagaaggccgaatctttcgctcaggaaatgttcatagagcagaacaagcttaaaagacagtcacacctgcttctgcagagcagcatccctgatcaacagctgctgaaggcgctggatgagaacgctaaactgacacagcagctagaggaagaacggatccaacaccagcagaaggtcaaggagttagaagagcagctggaaaacgagactctgcataaggaaatccacaatctgaagcaacagctggagcttttggaggaagacaaaaaggagctggagctgaagtaccagaactcagaggaaaaagctcgaaatctgaaacactcagtggatgaactgcaaaagagagtaaaccagtcagaaaactctgtcccccctcctccgccccctcctccccccttgccgccacctccccctaatcccataaggagcctgatgtccatgatccggaagaggtcacatccgagtgggtcaggtgccaagaaagagaaggcaacccagccagagaccaccgaagaggttacagatttgaagagacaagctgtggaagagatgatggaccgcatcaaaaagggggttcacctccgccccgtcaaccagactgctcggccgaagacaaaaccagagagctctaagggctgcgagagcgctgtggatgaacttaaggggatccttgcctctcagtag

SEQ ID NO: 22951 - DNA, 630 bp, Artificial Sequence
  Description of Artificial Sequence: Synthetic coding sequence
atgaagaaggtgcggctgaaggagctggagagccggctgcagcaggtcgacgggttcgaaaaacccaagctgctcctggagcaataccccaccaggccacacattgccgcgtgcatgctgtataccatccacaacacttacgatgatatcgagaacaaggttgtcgctgacctgggctgcgggtgtggcgtgttgtccatcggcacagccatgctgggcgctggtctgtgtgtgggtttcgatatcgatgaggatgccctggagatctttaacagaaatgccgaagagttcgaacttacaaacatagatatggtgcaatgtgatgtctgtctcctgtcaaatagaatgagcaagtcctttgacaccgttattatgaatcctcccttcggcaccaaaaacaacaagggaaccgacatggcttttctgaagacagccctggagatggcccgtaccgccgtgtacagcctacacaagagcagcaccagggaacatgtgcagaagaaggccgccgagtggaaaataaagatagacatcatagcggagcttcggtatgatctccccgcctcttataagtttcacaagaagaaaagtgtagacatcgaggtggatctgatacgattttcattttag

SEQ ID NO: 22952 - DNA, 4719 bp, Artificial Sequence
  Description of Artificial Sequence: Synthetic coding sequence
atggccagcagcgcccgggagcacctgctgttcgtgcggcggcggaaccctcaaatgcgctatacactttccccggaaaatctacagtcacttgcagcccaaagctcgatgccagaaaatatgactctgcagcgcgcgaattccgatacagacctggtgaccagcgagagccgaagcagcttaactgcttccatgtacgagtatacccttggccaggcacagaacctgattatattttgggacatcaaagaagaggtcgaccccagcgattggatcgggctttaccatattgacgaaaattcgccagccaacttctgggactctaaaaacagaggagtcaccggaacacagaagggacaaatagtgtggcggatcgaaccagggccatattttatggagcccgaaataaagatctgcttcaaatactatcatggtatatccggggccctccgagctacaactccatgcattaccgtaaagaaccctgctgtcatgatgggcgcagagggcatggagggaggagcctccggcaatctgcacagccgcaagctggtgtcattcactcttagtgatctgcgggccgtgggcctgaagaaaggcatgttttttaaccctgatccttatctaaaaatgagcattcagcccggtaaaaaatccagcttccccacgtgtgcgcaccacggccaagagcgacggtcaaccataatatccaatacaaccaaccccatatggcaccgagagaaatactccttcttcgcgctgcttactgatgtcttagagatagagattaaggacaagttcgcgaaatccaggcctatcatcaagcgcttcttgggtaagctcactatacccgtccagaggctactggaacgacaggcgatcggtgaccagatgctgtcctacaacctgggccggaggctgccggcggatcacgtgagtggctacctgcagttcaaagtcgaagtaaccagctctgttcatgaggacgcgtccccagaggctgtaggcacaatcctgggtgtgaacagcgtgaacggagacctcggctctccttctgatgatgaggacatgcctggatcccaccacgatagtcaggtttgcagcaacgggcccgtcagcgaggactccgctgccgatgggacaccaaaacattcctttcggacgtcgtccacactggaaatcgatacagaggaactgaccagtacctcttctcgcacctccccacctcggggcagacaggattccctcaacgactatttagatgctattgaacacaatggacactcccggcccggaactgctacctgctcagagcgttcaatgggggcctctccaaagcttaggagcagtttccccacagacaccaggctcaatgcaatgctccacatcgactctgacgaggaggatcacgaatttcagcaggatctcggatacccatcctccctggaagaggaaggtgggctcattatgttctctagagcatcacgcgcagatgacggctctcttacatctcagaccaaactcgaggataaccctgttgaaaacgaagaagcatctacccacgaggcagcgtctttcgaggacaaacccgagaacttaccagagttggccgaatcaagcctccctgccggacctgcacctgaagagggagagggcgggccagagcctcagccgtctgccgatcagggaagtgcagaactctgcggtagtcaggaagtggaccaaccaacaagcggcgcggacaccgggactagcgatgcctccggagggtctcggcgagcggtatctgagacagagtcccttgaccagggctccgagccctcccaggtgagctctgagactgagccatccgacccagcgagaaccgagagtgtcagcgaggcctctacccgccctgagggggagagcgatctggaatgcgccgactccagttgcaacgaatccgtaacaactcagctgagctctgttgatacaaggtgtagctcactcgagagtgctcggtttccagaaacgccggccttctcatcccaagaggaggaggatggcgcttgcgccgccgaaccaactagctccggacctgcagaggggtcccaggaaagcgtgtgtacagccggaagtcttcctgtcgtgcaagttccatccggagaggatgaaggacccggagccgagagtgctactgttcctgatcaggaggaactgggggaggtgtggcaacgacgaggaagcctcgaaggagccgctgcagccgccgaatcccccccacaggaggaaggttctgcaggagaggcacagggcacctgcgagggcgccacggcccaggaggagggtgcgacaggcggatcccaggccaacggacaccagccccttcggtctttgccttctgtcagacaagacgtgagccgctatcagagggtggatgaggctctgccacctaactgggaggcacgaatagactcccacggcagaatcttctacgtggaccatgtaaacaggacaacaacttggcagaggccaactgctccgccagctcctcaggtcctgcagcgctccaactccatacaacagatggagcagctgaacaggcggtatcagtccattcgccgtacaatgacaaatgaacgccctgaggaaaatacaaatgctatagatggggccggcgaggaggccgatttccatcaggcgagtgcagatttcaggagggaaaatattctgccgcacagtacttcacgcagcagaatcacactgcttttgcagagcccccccgtgaaatttctgatatcccctgagttctttaccgttttacatagcaatccatcagcttataggatgtttacgaacaatacctgtctcaagcacatgattacgaaagttcggcgggatacccaccacttcgagaggtaccaacataaccgggacctcgtaggattcctgaacatgtttgctaacaagcagctggaattaccccgcggatgggagatgaaacatgaccaccaggggaaagcctttttcgttgaccataatagccgcaccaccacattcatcgatccacgcctcccgcttcagagcagccgccccacctcagcacttgttcaccgacaacaccttactagacagagatcgcacagtgcaggggaggtcggagaagatagtagacacgccggcccaccagtgctccccaggccttctagtaccttcaatacggtgtctaggcctcagtaccaggacatggtccctgtggcatataacgacaaaatagtggccttcttgaggcagccaaacattttcgagatacttcaggagaggcagccagacctaaccaggaatcactcgctccgggagaaaatacagtttattagaactgagggtacccccgggctggttaggttgagctcagatgccgatctggtgatgttgctttcactttttgaggaagagatcatgtcctacgtcccaccacacgccttgttgcacccctcctattgccaaagcccaaggggctctccggtatcttccccccaaaactcacctggaacccagagggctaacgctagggcacctgctccatacaagcgtgattttgaggcaaagctcagaaacttttacaggaaactggaaaccaaaggctacggccagggccccggcaagctgaaactgattatacgacgcgaccatttgctcgaggacgcttttaatcagatcatgggatactctaggaaagatttgcagagaaataagttatatgtgaccttcgttggtgaagagggactggattacagcggccctagtcgagaatttttctttcttgtgagtagagaattgttcaacccatattacggcctatttgaatattcagcgaatgacacctataccgtgcaaattagtccgatgtctgcatttgtggataatcaccacgagtggttcaggttctcaggccgaattctcggactggctttaatccatcaatatctgctggacgcattctttactcgccctttctataaagctctgctccgcatcctctgcgacttgtcagatctcgaataccttgatgaggagtttcaccaaagcctgcagtggatgaaagacaacgatatacacgacattttggatttaacatttactgttaatgaagaagttttcggtcagataactgaacgggaattaaagccggggggcgccaatataccggtaaccgagaaaaacaagaaggagtatatcgagcggatggtgaagtggcgtattgaacggggcgttgtacaacagacagagtcgctggtaaggggcttttacgaggtggttgacgccagactggtgtcggtcttcgacgcccgagaactggagctggtgatcgctggcactgctgaaattgacctgagcgactggcgcaataatacagaatatcgcggcggttaccacgataaccatatcgtgatccgctggttctgggccgccgtggaaagattcaataatgagcagcggctgaggctgcttcagttcgtgaccgggacaagctctattccctatgagggctttgccagcctcaggggctctaacggaccaaggagattctgtgtggagaaatgggggaagatcacggctcttccaagggctcacacctgctttaataggctcgacctccctccctacccctctttctcaatgttgtatgagaaactgctaaccgctgtggaggagacctccaccttcggactggaatag

SEQ ID NO: 22953 - DNA, 1206 bp, Artificial Sequence
  Description of Artificial Sequence: Synthetic coding sequence
atgagctgccggtgctggatcagccggcaccccagctacgagggctggaatctgcagtcaattatctttcataaacaaatcaggggcgtggacctggagtccacctttgtcacaaaattcgggaataactgcagtctccgcctgaatgaaacagtggatatccataaggagaaggttgcaagacgcgagatcggcattctgaccacgaataaaaacacctctagaacacacaaaatcatcgccccagctaacttagagcgccctgtccgctatatccggaagcccattgattacacaatcttggacgatatcggtcacggcgttaaggtgagcactcagaacatgaaaatgggcggattaccaagaactactccccccacgcagaagcccccttcgccaccgatgtctggtaaagggactctcggccgacactcgccctatcggacactcgaacctgttcggcctcctgtggtacctaatgactacgtcccaagtcccacccgcaacatggcacccagccagcagtctccggtgcgcacagcatcagtgaatcagcgaaacagaacgtactcttcttctggctcctctggtggttcacatcccagtagccgctccagctctagggaaaatagtgggagtggttccgtgggcgtgcccatcgcggtcccaacacccagcccacctagtgttttccctgggcaccccgtgcaattctactcaatgaacaggcccgccagccgccacaccccccctacaatcggcggtagcctcccttataggagacccccctcaatcacatcccagacgtcgcttcaaaatcagatgaatggaggtccattctactcccaaaacccggtgtctgacacaccccctcctccacccccggtggaagaacctgtctttgacgagagcccaccacctcccccccctcctgaggattatgaagaggaagaagccgctgtggtcgaatatagtgacccttacgcggaggaggatccgccctgggcgcctcgcagttatcttgagaaggtggtcgctatttatgactataccaaggataaagaagacgagttaagcttccaggaaggcgcgatcatttacgtgatcaagaagaacgatgacgggtggtacgaaggagtcatgaatggcgttacgggactgttccccgggaactacgtcgagagtatcatgcattatagcgagtag

SEQ ID NO: 22954 - DNA, 1428 bp, Artificial Sequence
  Description of Artificial Sequence: Synthetic coding sequence
atggccgagctgcagatgctgctggaggaggagatccccggcggccggcgcgctctgtttgatagctatacgaatctggagagggtggcagattactgtgagaataactacattcagagcgcagataagcaacgtgccctggaggagaccaaggcctacactacacagtcacttgccagtgtggcatatctcattaatactctagccaataacgttctccagatgctggatattcaggcatctcaactccggcggatggagtcatcaataaatcatatttcccaaaccgtggatatccacaaagaaaaagtggcaagaagggagattggcatcttgacaacgaacaaaaacaccagcaggacacacaagataattgccccagcaaatctggaacgccccgtgagatacatccgcaagccaatagattataccatcttggacgatataggacacggagtcaaggtatcaacacaaaatatgaagatgggaggactgccccgaactacgccccctactcagaaacccccgtcaccgccaatgtccggaaagggcactctgggacggcacagtccctatcggacactggagcccgtcaggccccccgtggtcccgaatgactacgtccccagccctaccaggaacatggccccgtctcaacagtctcccgtccggaccgcctcagtcaaccagagaaacaggacgtacagttctagcggttcttccggaggcagccacccctcctcccgaagttctagcagagaaaacagcgggtccggctctgtaggggttcccattgctgtgccaacaccaagccccccaagcgtatttccgggtcatcccgtccagttctactctatgaatagaccggctagtaggcatacaccccctactatcggtggtagtctgccttaccggcggcctccatcgatcaccagtcaaacatcattgcagaatcagatgaatggaggccctttctactcacaaaatcccgtctccctggctccaccacccccgagcatccttcaggtgacaccccagctcccactgatgggattcgtcgctagagtacaggagaacatttctgacacgccgcccccaccacctccggtcgaggaacccgtttttgatgaatcaccccctcctccaccgccccctgaggattacgaggaagaggaagcagcagtggttgaatattctgacccatatgctgaagaagaccctccctgggctcccagaagctacctggagaaagttgtggcgatctatgactacaccaaggacaaggaggacgagctgagcttccaggaaggagccattatttacgtgatcaaaaagaacgatgacggatggtacgaaggagtgatgaatggtgttaccggcttatttccagggaactatgtcgaaagcattatgcactacagtgagtag

SEQ ID NO: 22955 - DNA, 900 bp, Artificial Sequence
  Description of Artificial Sequence: Synthetic coding sequence
atgaagatgggcggcctgccccggaccaccccccccacccagaagccccccagtccacccatgagtggcaaaggtacactaggcagcagcggaagctcaggcggatcgcatccctcctcaaggagctcatctagggaaaattctggctctggatccgtgggcgtgcccatcgcagttccaaccccatcacctccctcggttttccccgcacccgcaggatccgccggtacgccaccactgccagcaaccagtgcgtcggctcctgccccgctcgtgccagccacggttccttcctccacagcacctgacgcggctgctggcggagcccaaacgctggccgatggcttcactagccccacacccccggtagtgagctcaaccccccctaccggccaccctgtgcagttctactctatgaaccgcccagcctccaggcatacacctcccactattggcgggtcccttccctacagaagaccaccctcgataacgtcccagacatcgcttcaaaatcagatgaatggcggccccttctacagccaaaatcccgtttcagacactccaccccctccaccacccgttgaagaacctgtctttgatgaatctccgccccctccccctccccccgaggattacgaagaagaagaagccgctgtggtggagtactcagatccctacgctgaggaggatcctccttgggccccccgatcatacctggagaaagttgtggccatctatgactatactaaggacaaggaagacgagctctccttccaggaaggggccattatctacgtcataaagaagaacgatgatggatggtacgagggagtgatgaacggtgttactggactctttccagggaactatgttgaatctatcatgcattatagtgaatag

SEQ ID NO: 22956 - DNA, 1926 bp, Artificial Sequence
  Description of Artificial Sequence: Synthetic coding sequence
atgggccggcggagcaccagcagcaccaagagcggcaagttcatgaacccaactgaccaggctcgtaaggaagccagaaagagagaattaaaaaaaaacaagaaacagcggatgatggtgcgggcggctgttctgaagatgaaggaccccaagcagatcatacgagatatggagaaattggacgaaatggagttcaatcctgtgcagcagcctcagttaaacgagaaagttctgaaggacaaacggaaaaagcttcgagagactttcgaaagaatccttcgcctgtatgagaaggaaaatcccgatatttataaagagcttcggaagcttgaagttgagtatgagcagaaaagagcccagctttcccagtattttgacgccgtgaaaaatgcacaacacgtggaggtagaaagcatcccactgcctgatatgccacatgctcccagtaacatcctgatccaggatattcccttgcccggtgcccaaccgccgtctatactgaaaaaaacctctgcttacgggcctcccactagggcagttagtatcctgccactcctgggccacggtgtgcctcggctgcctcctggcagaaagcccccagggccgcctccagggccccctcctccacaggtcgttcagatgtatggccgcaaagtaggattcgcactggatctcccgccccgaagacgggatgaggatatgctctatagccctgaactcgctcagaggggtcacgatgacgatgtgtcatctaccagtgaagatgacggctatcctgaggatatggaccaggacaagcatgatgactcaactgatgattccgacaccgacaaatcagatggtgaaagtgatggagatgaattcgtccatcgggacaatggcgagagggacaataacgaggagaaaaaaagtgggctgtcagtgagatttgcagacatgccgggaaagtccaggaaaaaaaagaagaacatgaaagagctcaccccattgcaggcaatgatgttgcgcatggctggccaggagatccctgaggaaggccgcgaggtggaggaattttctgaagatgatgatgaagacgatagtgatgacagtgaagccgagaagcagagccagaagcagcacaaggaagagtcgcatagcgacggcacctcaaccgcatcatcgcagcagcaggcaccaccacaatccgtgccaccatcgcagattcaggctccccctatgccaggtccgcctcccctgggtcccccccctgcaccccccctgcggccccctgggcctcccactgggctccccccagggcccccccctggtgctccgccctttctccgccctcctggtatgcctgggctcaggggaccacttcctaggctgttacctccaggcccaccccccggtagacccccagggccgccccccggcccccctcccgggctgcctcctggaccaccaccccgcgggcctcctcctaggctgccaccaccagcgcccccaggaatcccgccacccagaccgggaatgatgcggccccctttagtgccccctttgggccctgcccctccgggcttgttccctccagctcccttgcccaatcccggggtgctcagtgccccccccaaccttatccagcggccaaaagcagatgacaccagtgccgctaccatcgagaagaaggccacggcgactatctccgcgaaacctcagattaccaaccctaaagctgaaatcacaaggttcgtacccactgccctgcgagtccggagggagaataagggggcaacagctgccccccagaggaagtctgaggatgattctgccgtgcccttggccaaagccgctcccaaaagcggcccaagtgtgcccgtctccgttcagaccaaagatgatgtatatgaggctttcatgaaagaaatggagggattgctctag

SEQ ID NO: 22957 - DNA, 4419 bp, Artificial Sequence
  Description of Artificial Sequence: Synthetic coding sequence
atgaagggcagcgaggtgagcctggagaagaagaagaagatcaagatgcccgtgaagcgccttcgggaggttgtctcccagaatcatggagaccatcttgttctcctgaaagacgagctcccttgcgtgccccccgccttgtctgctaacaaacgtttgcctgttggcacaggtaccagtctcaatggtacttcccggggctccagcgacctcacaagcgcgagaaactgctaccagccccttctagagaaccccatggtgtccgagagcgacttttccaaggatgtcgctgttcaggttctccctctggacaagatcgaggaaaacaacaagcaaaaggctaatgacatatttatttcccagtataccatggggcagaaggatgcactgcgcactgtcttgaagcaaaaagctcagagcatgcctgtctttaaggaagtgaaagtacacttattggaagacgctgggatcgaaaaagacgctgtcacacaggaaacgaggatatcaccctccggcatcgactccgctacgactgtggccgcagcaacagcagccgctatcgccaccgctgcccccttgatcaaagtacagagcgacttggaggcgaaggtgaatagtgtcaccgagctgttgagtaagcttcaggagactgacaagcatctgcagagagtgactgagcagcagacatccatacagagaaaacaggaaaagctccactgccacgaccacgaaaagcagatgaatgtgttcatggagcaacacattagacatttagaaaaactccaacaacagcagattgatatccagactcactttattagtgcggccttaaagacttctagtttccagcctgtgtcaatgccgtctagccgtgccgttgaaaagtacagcgtgaagcccgagcatcctaatctcggttcttgcaaccccagcctgtacaacacatttgcatccaaacaggccccattgaaggaggttgaggatacatccttcgacaagcaaaaaagcccgcttgaaacaccggcacctcgtcggtttgccccggtacctgtatcccgtgacgacgagttgtctaagcgcgagaatcttctcgaagagaaagagaacatggaagtgagctgtcaccggggcaacgtgcgccttcttgaacaaattttaaacaataacgactctctgaccagaaaaagcgagagtagtaataccacatccctgacacggagtaaaataggctggacccccgagaaaacgaatagatttccttcctgtgaggaactcgagactacgaaagtcactatgcaaaagtcggacgacgttttacatgatctcggacagaaggaaaaagaaaccaattccatggtgcagcctaaagaatccttgtccatgttgaaactgccagatttgcctcagaactcagttaagctgcagaccacaaataccacaaggagcgtgctaaaagatgcagaaaaaattttgaggggggtgcagaataacaaaaaggtgctagaggagaacctggaggctatcataagagccaaggacggtgccgccatgtattccctcataaacgccctttccaccaatcgcgagatgtccgagaagattcgaatccgcaaaacggtagacgagtggatcaagacgatctccgccgaaattcaaggtttgctgaaagcaaccacagtgatacaggacgaggactacatgctgcaagtgtatggcaagcccgtgtatcagggccatagatctacgttaaagaaaggcccctatttacgctttaacagtccctctcccaaatcccgacctcagaggcctaaggtaattgaacgcgtcaagggcaccaaggtgaagtctatcagaacccagaccgatttctacgctaccaaaccaaagaagatggatagtaaaatgaaacatagtgtgcccgtgctgccacacggggatcagcaatacctcttcagcccatccagggagatgccaaccttctccggaactctagaaggacatctgatcccaatggccattctgctgggtcaaacacaaagtaactctgataccatgccaccagcaggggtcattgtgagtaagcctcaccctgtgacagtaacaaccagcattcctcccagcagtaggaaagttgaaactggggtgaagaagccgaatatagctatcgtggagatgaagtccgaaaaaaaggatcccccacagctgactgtgcaggtgctcccctctgtcgatatcgactctatctccaattcttcagcagacgtgctgagccctttgtccagtcctaaggaagcctctttgccccctgtccaaacctggattaagacccctgagattatgaaggtggacgaagaggaagtgaagttccccggtacaaattttgatgagattatcgatgtaattcaggaggaggaaaagtgtgacgaaatacctgacagcgaaccaatcctggagttcaacagaagtgtgaaggcagacagtaccaaatataacggccccccctttccacctgtggccagcacttttcagccaactgccgatattctggacaaagttatcgagaggaaagagaccctcgagaatagtctcatacagtgggtagagcaggaaattatgtccaggattataagcgggttgtttcccgtgcagcaacagattgctccgagcatttcagttagtgtctcagaaactagcgaacccctcaccagcgatatagtggaagggacctcatcaggcgctctacagctgtttgttgatgcaggtgtgcccgtcaacagtaatgttatcaagcactttgtgaacgaagccctcgccgagacaatagcagttatgctcggtgatagagaagcaaagaagcaggggccggtcgccaccggcgtcagtggcgacgcctctactaacgaaacctacctgcctgctcgagtttgtacccccttacccacaccccagcccactccgccgtgctcaccaagcagtcctgcaaaggagtgcgtgcttgtgaagacacctgacagcagtccatgcgacagcgaccacgacatggcttttccggtgaaggaaatctgcgccgagaaaggcgatgatatgccagccatcatgctggtgaacactcccacggtgaccccgactaccacccccccgccggcggctgcagtgttcactcctaccctcagtgatattagcatcgacaagctcaaggtgtccagccctgagctgcctaagccctggggagatggagaccttccgctcgaagaggaaaatccaaattcgccacaggaggaactgcacccacgggccattgtcatgagtgtggccaaggacgaggaacctgaatcgatggattttcctgctcagccacctcctcctgagcctgtcccttttatgcctttccccgccgggaccaaggccccttctccgtctcagatgccagggtctgattccagtaccttggaatcaacactgtccgtgacggtgaccgagaccgagacccttgataagccaatttcagagggcgagatactgttcagttgtggacagaagttggcacccaaaatccttgaggatattgggctgtatctgactaatcttaatgacagcctgtccagcacactgcacgacgcggttgagatggaggacgaccccccgagcgaaggacaagtgattcgtatgagtcacaagaaattccatgcagatgccatcttgagcttcgcaaaacagaaccaggagagcgctgtttcacagcaagccgtatatcattcagaggatctggagaactctgtcggtgaattatccgaaggccagcgccctcaactcaccgccgccgcagagaacattctcatgggtcatagtctctacatgcagcctcctgttacgaatacacagtctctggaccaacaatgcgaccccaagcccttgtcccgacaatttgacaccgtgtctggctcgatatatgaggacagttgtgcatcccacgggccaatgagcctcggggaactggaattggagcccaattccaagctagtgctcccaaccactctcctgacagctcaagagaacgatgttaatctgcccgtggcggcagaggatttttctcaataccagctgaaacagaatcaggacgtgaagcaagtcgaacataagccctcacagagctacctccgcgttaggaataaaagtgatatcgccccttcacagcaacaggtttcacctggggacatggaccgcacacaaatagaattgaacccttaccttacttgtgtgttctctggcggcaaggccgtaccactgagtgcatctcagatgccacccgcaaaaatgagcgtcatgttgccttctgtaaacctggaagactgttctcagagtctgtcgctttccaccatgcaggaggacatggagtcctcaggggcggataccttctag

SEQ ID NO: 22958 - DNA, 1986 bp, Artificial Sequence
  Description of Artificial Sequence: Synthetic coding sequence
atggagggcgccgccgcccccgtggccggcgaccggcccgacctgggacttggggcgccaggcagcccgagagaagcggttgcaggagcaactgctgccctggagcctcgcaaaccgcatggagtcaagcgccaccatcacaaacacaacttgaaacatcgttacgaattacaggagacgctgggcaaaggcacctatggtaaggtgaaaagggcaaccgaaaggtttagtgggcgggtggtggctatcaagtccatacgcaaggataagattaaagatgagcaggatatggtacatatcagacgcgagattgagataatgagcagtctgaaccaccctcacatcatctccatttatgaggttttcgagaacaaggacaagatcgtgataatcatggaatacgccagtaagggagagctgtacgactacatcagcgagaggcgccggctaagtgaaagggagacccgccacttctttaggcaaattgttagtgccgtgcactactgtcacaagaatggtgttgtgcacagggaccttaaactggagaatatactcctggacgacaattgtaacattaagattgctgattttggccttagcaatctgtaccagaaagacaagttcttgcagaccttctgcgggagcccactctacgcctctccagagattgtgaacggaaggccatatcgaggacctgaagtggacagttgggcgctgggcgttttactttacaccctggtttacggcaccatgccgttcgacgggttcgaccacaaaaatctaattcggcagatcagctctggcgagtacagggagcctacacagccttcagatgcccggggtctgatcaggtggatgctgatggtcaatccggacaggcgcgcaactattgaagatatcgctaaccactggtgggtgaactggggatacaaaagcagcgtgtgtgactgcgacgccctacatgatagcgaatctcctctgttggcaagaatcatcgactggcatcacagatccaccgggctgcaggcagatacagaggctaagatgaagggcctagccaagccgacaacatcagaagttatgctggagagacagcgcagcctcaagaagtccaagaaagaaaacgactttgcgcagagcggccaggacgccgtgccagaaagccctagtaagctgtcttccaagaggccaaagggtattctgaagaaacggtctaactccgaacaccgaagccattcaacgggcttcattgagggcgttgtgggcccggcactgccttctacctttaagatggagcaggatctatgtcggaccggggtgttgcttcctagcagccccgaggccgaggttcccggcaaactcagcccaaagcagagtgctacgatgccaaaaaaaggtattctgaagaagactcagcagcgcgagagtggatattacagctcacccgagcggtctgaatctagcgaactgttggattccaatgatgttatgggctctagcattccctcccctagcccaccggatcccgcgcgtgtgacttcacatagcctttcttgtcggagaaaggggattctcaagcactcttccaagtacagcgcaggaaccatggacccagccttagtgtcacccgaaatgccaaccctcgaatctttgagcgagccaggagttccagccgagggacttagcaggtcctatagtagaccctccagtgtaatcagtgacgattctgtactttcaagcgatagttttgaccttctggatctccaggagaaccgccctgccagacagcggatccgatcatgcgtgtccgctgagaattttctgcagatccaggactttgagggtttacagaatagaccccgtcctcaatatctgaagcggtatcggaaccgactagcagactcttcattcagtcttctaactgacatggatgatgtcacccaggtgtacaaacaggccctggagatttgctccaaactgaattag

SEQ ID NO: 22959 - DNA, 603 bp, Artificial Sequence
  Description of Artificial Sequence: Synthetic coding sequence
atggccaacatcgccgtgcagcggatcaagcgggagttcaaggaggtgctaaaaagcgaggaaaccagcaagaatcagataaaagtggacttagttgacgaaaactttaccgagctgaggggggagattgcaggcccacccgataccccctacgagggcggccggtatcagcttgaaatcaagattcccgagacataccccttcaatccacccaaggtccgctttattacaaagatttggcacccaaacattagcagcgtcaccggtgccatttgtcttgacattctcaaggatcaatgggccgcagctatgaccctgcggactgtccttctaagcttgcaagctttgctggccgcggcggagcccgacgaccctcaggatgctgttgtcgccaatcagtataaacaaaatcctgaaatgtttaagcagacagcgcggttatgggcccatgtgtacgcgggagcacccgtttcctcccccgaatatacaaaaaaaatagagaacctgtgtgccatgggattcgaccggaacgccgtgatagtggccctgtctagtaagagttgggacgtggagacggcgactgaactgctgttaagcaactag

SEQ ID NO: 22960 - DNA, 5313 bp, Artificial Sequence
  Description of Artificial Sequence: Synthetic coding sequence
atgccccggcggcggaagaacctgggcggcaaccccttccggaagaccgctaaccccaaagaagtggtcgtgtctagcgtggccagtagggaggaacccacaacgacactaccatccatgggagagacgaaggtcgaccaggaagagctgttcacctctatatctgaaatattctccgacctagacccggatgtcgtgtacctcatgttgagcgagtgcgatttcaaggtggaaaatgcaatggactgtctgctggagttgagcgcaactgacacaaaaatagaagaaagcagctctcagtcgttcgtcgcatccgaaaatcaagtgggcgccgccgagagcaagatcatggagaaaaggcctgaggaagaaagtgaggactcaaagatggattctttcctggatatgcagctcacagaagacctcgactctctgatacagaacgcattcgagaaattaaatagcagtccagacgaccaggtgtattccttcctcccctctcaggacgtcaattcttttaacgattcatcggaattcatcaatccagattcttccaatatgactccaatcttctccacacagaatatgaacctaaatggcgaaaaccttgagaattcaggaagcaccctttccctgaaccctctgccatcacacagcgttctcaatgaatcgaagtgcttcataaaggacaacacactcgcactcgagtccaactatcccgaggatagcttactttcttcgtcgcttaacgtggccagtgactctatcgctggttgctcgtcactaaaccagaaacagaaagaactcttggagagtgagtgcgtagaggctcagttttccgaagctccagttgatctcgacgcatccgaaccccaggcatgtcttaacttgccggggctggacctgcccgggaccgggggagatcagaagtccacccgagtctctgacgtcttcctgcctagtgagggcttcaactttaagccacacaaacacccagagctgcccacaaagggcaaggacgtgtcttactgtccagttttggccccgctcccactgctcctcccgccaccacctccgcccccgatgtggaatcctatgattcctgcttttgacctgtttcagggaaaccatggtttcgtggcacctgtggtgactacagcggctcattggcggtccgtcaattatacattccctcccagtgtgatctcacacacatctccgacaaaggtgtggcgtaataaggatggaacctcagcatatcaggtccaagagacccccgttagtcaggtcgtgaggaaaaagacaagctacgttgggctggtgttggtgctgctcaggggtctcccgggttccggaaagtcgtttctggccaggacactccaggaggataaccccagcggggtgattctgagcactgatgactacttctacatcaatgggcagtatcagttcgacgtgaaatatcttggcgaggcacatgaatggaatcagaatcgggcaaaagaggcctttgaaaaaaaaatcagtccgattatcatcgataataccaatctacaagcttgggagatgaaaccttacgtcgccctctcccaaaaacacaaatacaaggtactgttccgggagcccgacacatggtggaaatttaagcccaaggagctggctaggcgaaatattcacggcgtgtccaaggagaaaattacgcggatgctcgaacactatcaacggtttgtttccgtacccatcatcatgagcagctccgtgcccgaaaagatcgagcgtattgagctgtgcgcttactcatgtgaggacaggtccacctctccccgcgatgacgaagatatcatctctgagaaggaggagaatatactcagtctgagcctaaaacacttagaattcactgaagagaaaaatctggatgtgacaaaagagaccatgctgccagaaaatgttgcgtatttgtctaacgccgacctgaataagaggcgtaaggaaatcagtgacatgaatccttctattcagtcagctttaattctggaaacccctcacatgtacttcagcgattcagaatctaagctgcaagctacggacaaaagtgaaaatgagcaaattgaaatggttgcagtgaagggctattccaaaacggatacagactcctctatggaacgagtgtcaccttctacgtgctgctccgaaaacaaccaagaggattgcgacttggccaattcgggacctcttcagaacgagaaatcctcaccgggcgagatcgtggaggagcgggccacggtcaccaaaaaggcgtttggaaagcagaaaagtaagagcaccctggaaaagttccctagacacgaattatccaacttcgtgggggactggcctgttgataaaaccattggccagagaacgaagagaaatcgaaagaccgaaaagacctcctccgtccaatccgataagaaatacaattacccccagtcccataagctggtgaacagcgtttccgtcaacacagactgcgttcagcagagaggtagccctcacgagagtgtggaagacggccggaagtctcagtgcgacgacgcctccgagcccctgaactcttacaagtatgatgcatacaaaaatatcgacaagaatagcttcaatatcatgggcgattggcccagtagcgactctctagctcaaagggagcatcgaagccggatgcccaagacgggcttgagtgagcccaatctcgaaattgggaccaatgataaaatgaacgaaataagcttgagtactgcacatgaagcttgttggggcaccagctcacaaaaattgaagacacttggctcctccaacttaggtagctctgagatgctcttaagcgaaatgacctgcgaatcgcaaacgtgcttatccaaaaagagtcatgggcaacacacctctttgcccctgacctttacgaactctgccccgacagtatcgggagtagtggagccgcagacactggccgagtgccaagagcaaatgccaaagagggaccccgggaaagaagtgggtatgtgcacacagactgagccacaggacttcgccctgctctggaagattgagaagaacaaaatcagcatctccgatagcataaaggtgctcacagggcgcctggacggatttaaacccaaggtcttcaacattaatacaaaatccgacgttcaggaggcgatcccgtaccgggtgatgtatgacaaatcaacctttgttgaggagtctgagctgacatctgcagatgagtcagagaacctcaacatactgtgcaaattatttgggagcttctctctcgaggccttgaaggacttgtacgagagatgcaacaaggatatcatctgggctacgtctctgctgctggattccgaaacaaaactctgcgaagacactgaattcgagaactttcagaagagctgcgacgggtcccagattggccccttcagcttggggctgaatctgaaagagatcatttcacagcgaggcacccttgagaatagtaactctccagtgccagagttttctcatggaatcggaatatctaatgctgactctcagagcacgtgcgacgctgaacgggggaactccgaacaagccgaaatgcgggccgtcactcccgagaaccacgaaagcatgaccagcatttttccaagcgccgccgttggcttaaaaaataacaacgatatcctgccgaatagtcaggaagagctattgtattcatccaaacagtcattcccagggattctcaaggccactacacctaaggacatgagtgagacggagaagaatctggtggttacggagaccggggataatatccatagcccgagccacttttcagatattttcaacttcgttagctcaacatccaatctggaactaaacgaagagatttacttcacagattctcttgagattaaacgcaacgagaacttccctaaagactacgtcaagttctcagacgaagaggagttcatgaacgaggatgagaaggaaatgaaagagattctcatggctggtagttctctatcggcgggtgtctcaggggaggataaaacagaaatcctgaatccaaccccagctatggccaagtcgctgactatagactgtcttgaattagccttaccccctgagttggctttccaactgaacgagctgttcggaccagttggtatcgatagcggttcactcacagtagaggactgtgtggttcacatagatctgaacctcgctaaagttattcacgaaaaatggaaggagagcgtgatggagcggcaaaggcaggaagaagtgtcttgcggaaagtttatgcaagatccctccttagttgggcacaccgggctggacaaccccgagcagaagagcagtcaacggacagggaagaagctgctcaagacccttacggccagcgagatgctgcccctccttgaccactggaacacacaaacaaagaaagtgtctctgcgagaaatcatgtccgaagaaatcgcactccaggagaaacataacctaaagagagaaaccctgatgtttgagaaagactgcgccaccaaactcaaagagaaacagctgttcaagattttccctgctataaaccaaaattttctagtggacatcttcaaagaccataactattctctggagcatacagtccagttccttaattgcgtacttgaaggcgatcccgtgaagactgttgttgcgcaggagttcgttcaccagaatgagaacgtgaccagtcacacagggcaaaaatcaaaagaaaaaaaaccaaaaaaactgaaagaaacagaggaaactccatccgaactaagcttccaggacttcgaataccccgactacgatgactatagagccgaggctttcctgcatcaacagaagaggatggaatgctacagcaaagcaaaggaggcataccggataggcaagaagaacgtagccactttctatgcacagcagggcaccttgcacgaacagaagatgaaagaagctaaccatctggcagccattgaaattttcgagaaggtcaacgcaagtttgctccctcagaacgtgctcgaccttcacggcctccacgtagatgaagcactggagcatctgatgcgcgtcctagagaaaaagaccgaagaattcaagcagaatggggggaagccttacttgagtgtgataacaggcagaggtaaccactcacagggtggtgtagctcggattaaacctgccgttattaagtacttgatttctcactccttccgtttctccgaaatcaagcccggctgcctcaaggtaatgctcaaatag

SEQ ID NO: 22961 - DNA, 1362 bp, Artificial Sequence
  Description of Artificial Sequence: Synthetic coding sequence
atggactggaaggaggtgctgcggcggcggctggccacccccaacacttgccctaataaaaagaagtcagaacaggagctgaaggatgaggagatggacctttttactaaatactattctgaatggaaggggggcaggaagaacaccaacgagttctataagacaatacctagattctattacagactgccagctgaggacgaagtgctacttcagaaactgcgggaggagtcaagggccgtgttcctacagcgtaagagccgggagctcctggataatgaagagttgcagaacctctggtttctgctggacaagcatcagacgccacccatgatcggagaggaggctatgatcaattacgaaaactttctgaaggtgggggagaaagctggggccaaatgtaaacaattctttactgcgaaagtgttcgccaagctgttgcatactgattcatatggcaggatcagcataatgcagtttttcaattacgtgatgcggaaggtgtggctccaccagaccaggattggattaagcctttacgacgtggccgggcagggatatctgagagagagtgatctagagaactatatcctcgaactgatccccactcttcctcagctggacggactagagaaatctttctactcattttacgtgtgcacagctgtcaggaagttcttcttcttcttggaccctctccggactggcaagatcaagatccaggatattctcgcctgtagctttctggacgatcttctggaacttagggatgaagaactgtcaaaggagtcacaggagactaattggttctccgctccaagtgcactgagagtctatgggcagtatcttaacctggataaggatcataacggcatgctgtccaaggaggaactgagccgttacggaacggcaacaatgacgaatgtgttcctcgaccgcgtgtttcaggagtgcctgacctatgacggcgaaatggactataagacctacctggatttcgtgctggcactcgagaaccgaaaggagccagcggcactgcagtacattttcaagcttttggatatagagaataagggttatctgaatgtgttctcgctgaactattttttccgggccatacaggaactgatgaagatccatgggcaggacccggttagctttcaggacgtgaaggatgaaatcttcgacatggtcaagcccaaagacccattgaaaatctcactgcaagacctgattaactccaaccagggggatacagtcacaacgatactgatcgacctaaacggcttctggacttatgaaaaccgggaggccctggtagcaaacgactccgagaattctgctgatctcgatgatacatag

SEQ ID NO: 22962 - DNA, 3348 bp, Artificial Sequence
  Description of Artificial Sequence: Synthetic coding sequence
atgcccgaggaccaggtgggcaagctggaggccaccgagaacaccattagcgccatggccgccgctgctgccgaacaacagcagttctacttgctgttgggtaacctgctgagccctgataatgtggtgcgcaagcaggcagaggaaacttacgaaaacatcccaggacagtcgaaaatcacgttcctcttgcaggccattcgtaacactactgccgcggaagaggcacggcagatggctgctgtgttactgcggcgcctcttaagcagcgctttcgatgaagtttatcctgccttgccctccgatgtgcagaccgctattaaatccgaactcctaatgatcatccaaatggagacgcagtcttcaatgcgcaagaaggtgtgtgatatcgccgcagagctggctagaaaccttattgacgaggatggcaacaatcagtggccagagggtcttaagttcctgttcgatagtgtgtcatctcagaacgtcggcctgcgcgaagccgccctgcatatattttggaattttcccggcatctttggaaatcagcagcaacactatctggacgtgataaagcgaatgctggtacagtgcatgcaggaccaggagcatccgagcatcaggaccctgtctgctagagccacggcagcgttcattctggccaatgagcataacgtcgccttgttcaaacacttcgccgatttattacccggatttctgcaagcagtcaatgattcttgctaccagaacgatgactcggtgctgaaatctctggtggagattgccgacactgttccaaaatacctgcgccctcacctcgaagcgacattgcagctatccctgaagctgtgtggagacacttccctcaataatatgcagcgacaactggccttggaagttattgtcaccttgtcagagaccgctgcagcaatgctaagaaaacacaccaatatcgtggcccagaccattccccagatgttggccatgatggttgatctcgaagaggacgaagattgggctaacgccgatgagttggaagacgacgatttcgactcgaacgctgtcgcaggagaaagcgctctggacagaatggcctgcggtttagggggcaagctcgtgctgcccatgatcaaagagcacatcatgcagatgcttcagaatcccgattggaaatatcgccacgctgggctgatggcactcagcgcaatcggtgaaggctgccatcagcaaatggaaggaatcttaaacgaaattgttaacttcgtcctcctgtttttacaagacccccatccccgtgttcgatacgcggcttgtaacgccgttggacaaatggctactgacttcgcgccaggattccaaaagaaatttcacgagaaagtaatcgccgcgttgctccagacaatggaggatcagggaaatcagagagtacaggctcacgctgccgccgctctgattaacttcacagaagattgccctaaatccttactgattccctacctggacaacctagtgaagcatctccattccataatggtgttgaaactccaagagttgatccagaaaggaacaaagcttgtgctcgagcaagtcgtgaccagtattgcctcagtcgccgacaccgccgaggagaaattcgtgccctactatgatctcttcatgccatccctgaagcatattgtcgagaacgcggtacagaaggagttacgactactcaggggaaaaaccatcgaatgtattagtcttatcgggctggccgtgggtaaggagaagtttatgcaggatgcaagtgatgttatgcagctcttgctgaaaacacagaccgacttcaacgatatggaagacgatgacccccaaatctcttatatgatcagcgcttgggccaggatgtgcaaaattttgggtaaagaatttcagcagtacttacccgtcgttatgggcccactgatgaaaacggccagtatcaagcctgaggtcgccctgttggatacacaggacatggagaacatgagtgatgacgacggctgggagttcgtgaacctgggcgaccaacagagtttcggaatcaagaccgcggggcttgaagaaaaatctaccgcttgtcaaatgctcgtgtgttacgctaaagaactgaaggaggggttcgtcgagtacactgagcaggttgtcaaactgatggtgcctctgttgaagttttactttcacgacggggttagagtagccgcggctgagtctatgcctcttctcttggaatgtgctcgtgttcgaggccccgagtaccttacgcagatgtggcactttatgtgtgatgctctgatcaaggccattgggacggagccagacagcgatgttctttccgagataatgcattccttcgccaagtgtattgaagtcatgggtgatggctgcctgaacaatgagcatttcgaagaactgggcggcattttgaaggccaagcttgaggagcatttcaagaaccaggagcttaggcaggtgaagagacaggatgaagattacgacgagcaagtggaggagtccctccaggacgaggatgataacgatgtatacatcttgacaaaagttagtgacatcttgcacagtatctttagctcctacaaggaaaaagtactgccatggtttgagcagctcctaccactaattgtgaaccttatctgcccgcaccggccctggcccgatagacagtgggggctatgtatctttgacgacgtcatcgaacattgttcccctgcctcattcaagtatgccgagtactttctcaggcccatgctccagtacgtgtgtgataattctcctgaggtgcggcaggcggccgcatacggtttgggcgtgatggctcaatacgggggggataattaccggcccttttgtacggaggccttgccactccttgtgagggtcatccagtctgccgactcaaaaactaaggaaaatgtgaatgccactgagaattgtattagtgcagtgggcaaaatcatgaagttcaagcccgactgtgtgaatgtcgaggaggtgctaccacactggttgtcgtggctccctctccacgaggataaggaggaggcagtgcaaacttttaattacttatgtgacctgatcgagagcaaccaccctatcgttctgggtccgaacaacactaatctgcccaaaatttttagcatcattgcagagggagaaatgcatgaagccattaaacacgaagacccgtgcgcaaagagactcgctaacgtagttaggcaggtacagaccagtggcgggctgtggaccgaatgtatagcccagctttcgccagagcaacaggcggccatccaggaactgctgaactctgcatag

SEQ ID NO: 22963 - DNA, 1929 bp, Artificial Sequence
  Description of Artificial Sequence: Synthetic coding sequence
atgaagcggagcagcgtgagcagcggcggcgccggccggctgagcatgcaggaactacgaagtcaggatgttaataagcagggactgtacactccacaaaccaaagaaaagcccacctttgggaagctcagtatcaacaagcccacaagtgagaggaaggttagcctgttcgggaagcgcacatccggacacggtagtaggaatagccaacttgggattttcagctcaagtgaaaagattaaagaccccaggcctctgaatgacaaggccttcatccaacagtgcatccggcagctatgcgaattcttgactgaaaacggttacgcccacaatgtgagcatgaagagtttgcaggccccaagtgttaaagattttctgaaaatcttcactttcctgtatggttttctgtgtcccagttatgaactcccagatacaaagttcgaggaggaagttccgcgcatctttaaggatctcggataccctttcgcattgtcaaaaagcagcatgtatacggtaggcgcccctcacacatggccacacattgtggccgcactggtatggttgatcgattgtattaagatccacactgcaatgaaggagagttcacctttattcgacgatggccaaccctggggggaagaaacagaggatggtattatgcataataaattgtttctggattacaccatcaaatgctacgaaagcttcatgtcaggagccgattcattcgacgagatgaatgccgaacttcagagcaaactgaaggatctctttaatgtagatgccttcaaattagaatcactggaagcaaagaatcgcgcacttaatgagcagattgccagactggagcaagagcgtgaaaaagaaccaaatcggctggagtccctgcgcaaactcaaggcaagcctccagggggacgtgcagaaatatcaggcatatatgagtaatctggaatcccattcagctatactcgaccaaaagcttaatggcctaaacgaagagatcgcccgcgtcgaactggaatgtgaaacgatcaagcaagagaatactcgcctgcaaaacataattgataatcagaaatattccgtggccgatattgaacgcatcaatcatgaaaggaacgaactgcagcagactataaataaactcacaaaggaccttgaggccgaacagcagaaactgtggaatgaggagcttaaatacgctcgggggaaagaagccattgagactcagctagctgaatatcataagctcgccaggaagctgaaactgatccccaagggcgccgaaaattcaaagggttatgatttcgaaatcaagtttaatcctgaagcaggcgccaactgtctggtgaaatatagggcgcaagtgtatgttccactcaaggagttgctcaacgagactgaggaggaaatcaacaaggcactgaacaaaaagatggggctggaggatacattggagcagctgaatgcgatgattaccgaatcaaaacgatcagtgagaacgctgaaagaggaagtccaaaagctggacgatttatatcaacagaaaatcaaagaggctgaagaagaggacgagaaatgcgcttctgaattggagtctcttgaaaaacacaaacatttgctagagtccaccgtgaaccaaggattgtcagaggccatgaatgagctagatgctgtgcaaagagagtaccaactggtcgtccagaccaccacagaagagagaagaaaggttggaaacaatctccaacgactcttggaaatggtggcgactcacgtgggctctgtggagaaacatcttgaagaacagatcgcaaaggtggatcgggaatacgaggaatgtatgtccgaggacttatcagaaaacatcaaggagatcagagataaatatgaaaagaaggcaactctgatcaagtctagtgaagagtag

SEQ ID NO: 22964 - DNA, 4770 bp, Artificial Sequence
  Description of Artificial Sequence: Synthetic coding sequence
atgagcctgcccttctaccagcggtgccaccagcactacgacctgagctaccggaataaagatgtgaggagcacggtcagtcactaccaaagggagaaaaaacgatctgctgtttacacccaaggctccactgcctacagcagcagaagtagtgcagcccatagacgtgagtccgaggcgtttagacgtgctagtgcctcctctagccagcaacaggctagccagcacgcactcagcagtgaagtgagcagaaaagctgccagtgcctacgactacggctcctcccatggtttgaccgacagctcactgctgctagatgactatagcagtaagttgtcccctaagcccaaaagggcaaagcactctctcctgtctggggaggagaaggaaaacctcccgtccgactacatggtcccaatcttctcaggccgccaaaaacacgtctccggcatcaccgacaccgaggaagagcgtatcaaagaggccgctgcttacatcgcgcagcgcaatctgttagcaagtgaggaaggaattacgactagcaagcagagcactgcatcaaaacagacaacagcttcgaagcagtctaccgccagtaagcagtccacagcctccaaacaatccaccgcctccagacagtcgactgctagccgtcagagtgtagtgtctaaacaagctacttctgcactgcaacaagaggagacaagcgagaagaagagtagaaaagttgtcatccgcgaaaaagccgagaggttgtccctccgcaaaactttggaagaaaccgagacctaccacgcgaagctgaacgaagaccacctgctacatgcaccggagttcataataaagcccagaagccatacagtgtgggaaaaggagaacgtcaagctgcactgctccattgcaggttggcctgagcctcgggtgacctggtataaaaatcaggtgccaattaatgtacacgccaacccgggaaagtacatcattgaaagcagatatgggatgcacacgcttgagattaacggctgtgacttcgaggatactgctcagtatcgggccagtgcaatgaacgtcaaaggcgaactgtcagcctacgctagtgtcgttgtcaagcgctacaaaggcgagtttgatgaaaccaggtttcatgccggcgcaagtactatgcccctttcgttcggagtgacaccctatggatacgcttcacgatttgagatccactttgacgacaagttcgatgtctctttcggtagggaaggcgagacgatgagcttaggctgccgagtggtcatcacccctgagatcaagcacttccaaccggaaatccaatggtacaggaacggcgtccccctcagcccttctaaatgggttcagacactctggagtggcgagcgagctaccctgacgttttcccatctgaataaggaggacgaaggactgtataccattagagttaggatgggagagtactatgagcagtactcggcctatgtcttcgtgagagatgccgacgccgagattgagggtgccccagctgcccctctggacgtcaagtgccttgaggccaacaaggactacatcatcatcagctggaagcagccagccgtggatggcggctcaccaattctgggatacttcatagataaatgcgaggtgggtacagactcctggtcccagtgcaacgatacccctgtgaagttcgctcgctttccagtcacgggcttgatcgaaggcaggagttatatctttcgagtgcgggctgtcaacaagatggggattggttttccctccagggtgtcagaaccggtcgccgccctggaccctgccgaaaaagcgagactgaaatcacggccatctgctccctggacaggacaaataatagtaacagaagaagaaccatccgaagggatagtgcctggaccccctacagatttgtccgtcacggaggcaactagaagctacgttgtgctaagttggaaacctcccggacagcgcggtcatgagggaatcatgtacttcgtggaaaagtgcgaagcaggtactgaaaattggcagagagtcaacacggaacttccggtcaagtcacctagatttgcgctctttgatctcgcggaaggaaaatcttattgcttcagagtgaggtgctctaatagcgccggcgtgggtgagccttccgaggccacagaagttacagtggtgggagataaactggatatccctaaggcaccagggaaaatcataccttctaggaatactgatacctctgtggttgtgtcatgggaggagagtaaagacgcaaaggagttggtggggtattacatagaagcaagtgtcgccgggtctggcaaatgggaaccttgtaataataacccagtgaagggctctcggttcacatgccatggcctagtgactggccaaagctatatcttcagagtaagggccgttaacgctgccgggctttccgagtattcgcaggattctgaagcaatcgaggttaaggccgctattgcaccccctagcccaccatgcgatataacatgtcttgagagtttcagggactcaatggtcttgggatggaagcaaccagataaaatcggaggcgctgaaatcaccggatactacgttaactaccgggaggtgatcgacggagtacctggaaagtggcgggaagccaatgtgaaggccgtgtctgaggaagcttacaaaatttcaaatctcaaggaaaacatggtgtatcagtttcaggtggccgccatgaacatggcgggtctcggtgccccatctgctgtctctgaatgtttcaaatgtgaagagtggacaatcgctgtgcctggtcctccccactcacttaaatgttccgaagttcgcaaagatagcctggtcctccaatggaagcccccggtccactccggacggacacccgtcacaggatacttcgtcgatttgaaggaggcaaaagcaaaggaagaccaatggcgcgggctgaatgaggctgctatcaagaacgtctacttaaaggttaggggccttaaggagggtgtgtcttatgtgtttagggtaagggcaatcaaccaggccggcgtggggaaaccctccgacctggctggtccagtcgtggcagagaccagacctggcacaaaagaagtggttgtgaatgtggacgatgacggggtgatttccctaaattttgagtgtgacaaaatgacgcccaagtccgaattcagctggagcaaggactatgtatcgactgaagactcgcctcgcctagaggtcgagtcaaaaggtaataagactaaaatgactttcaaagaccttggtatggatgacctggggatctatagttgtgatgttacagacaccgacggcattgccagttcatacctgattgacgaggaagagttgaagaggttgctggccttaagtcacgaacataaattcccgaccgtcccagttaagagcgaacttgcggtggagattcttgagaagggccaggtgaggttctggatgcaagctgagaagctgagtgggaatgccaaggtcaactacatttttaatgagaaagaaattttcgaagggccgaaatacaaaatgcacatcgaccggaacaccggcattatcgagatgtttatggaaaagttgcaagatgaagacgagggaacttatacattccagcttcaggacggaaaagcgaccaaccactctacagtggtgctggttggggacgttttcaagaaacttcagaaagaagccgaattccagcgacaagagtggatacggaagcagggaccacacttcgtggaatacctcagttgggaagtgactggggagtgtaacgttcttttaaaatgcaaggttgccaacatcaagaaggagacgcacattgtttggtacaaggatgagcgggagatctccgtcgatgaaaagcacgacttcaaagacggaatctgcaccctcctgataactgagttttcaaagaaagacgctggcatctacgaggtgattctgaaggatgacagagggaaagataagtcacgtctgaaactagttgacgaggccttcaaagagctaatgatggaggtttgcaagaaaatcgcactgagcgccactgatctgaaaatccagagtactgcagaaggcattcagctgtactcattcgtgacatattacgtggaagacctgaaggtcaattggagccataacggatccgctattaggtactctgaccgcgtgaaaaccggggtgacaggcgagcaaatttggttgcaaatcaatgagccaactccaaatgacaaaggcaaatacgtgatggagttgtttgatggtaagacaggccaccagaaaactgtggacctttccggccaggcctacgatgaagcatatgccgagttccaaagactgaaacaggctgccattgctgagaagaaccgggcgagagtgttgggtggacttccagatgtggttacgatacaggagggaaaggccctcaatctgacctgcaacgtgtggggtgacccaccacctgaagtctcttggcttaagaatgagaaggctctggccagcgacgatcactgtaatctgaagttcgaggctggacggacagcgtacttcaccattaacggtgtctccacggctgattccgggaagtatggcctcgtcgtgaaaaataagtacggtagcgaaacatccgacttcaccgtttctgtcttcatccctgaggaagaggcccgaatggccgccttggagtctctgaaaggtggaaaaaaagcaaagtag

SEQ ID NO: 22965 - DNA, 546 bp, Artificial Sequence
  Description of Artificial Sequence: Synthetic coding sequence
atgggcggcttcttcagcagcatcttcagcagcctgttcggcacccgggagatgagaatccttattctgggcctggatggagcgggaaaaacaactatcctgtaccggttgcaggtgggcgaggtggtgacaactattcctacaatcgggttcaacgtagaaacagtgacgtacaagaacctgaaattccaagtgtgggacctaggaggacagaccagtattcgcccttattggcgatgttactactccaacaccgacgcagtgatttacgtcgtggattcctgtgacagggaccgtattggaattagcaagtctgaactcgttgcaatgctcgaagaggaagagctccgcaaagccatccttgtggtttttgccaacaagcaggacatggaacaagccatgacatctagtgaaatggcgaattcccttgggctgcccgctcttaaggatcggaaatggcagatctttaagacatccgccaccaagggaaccggactcgacgaggccatggagtggctggtcgagactcttaagagtcgacagtag

SEQ ID NO: 22966 - DNA, 1269 bp, Artificial Sequence
  Description of Artificial Sequence: Synthetic coding sequence
atggccgccgccgccgtggtggagttccagcgggcccagagcctgctttccactgacagggaggccagtattgatattctccacagcatcgtcaaacgggacatccaggagaacgacgaggaagcagtgcaggtcaaggagcagtcaatcctagagctgggaagcttactggctaagaccggccaggccgctgagctgggaggtttactcaaatacgtgaggcctttccttaattccatttctaaggctaaggccgcccggctggtgcgctccctcctggatctgtttttagacatggaagccgcgacgggtcaagaggtagagctctgtctcgaatgcatcgaatgggctaagtcagaaaagcgtacattccttcggcaggcccttgaggcccgccttgtgtctctttacttcgatacaaagagataccaggaagcattgcacttgggctcacagttattgagagagctgaaaaaaatggacgataaagctctgctggtggaagtgcagcttctggaatccaaaacctatcacgccctgagcaacctccctaaggctcgtgctgctctcacctcagcgcgcacgactgctaatgcgatatactgtccaccgaagcttcaggcgaccctggacatgcaaagtggaataatacatgctgccgaagaaaaggattggaagaccgcctactcatacttttatgaagccttcgagggatacgactcaatcgatagcccaaaagccatcacttctctcaaatacatgctgctctgcaagataatgctcaacaccccagaagatgttcaggcccttgtgtctggaaagctggcccttcgttacgcaggcaggcagacagaagctttgaaatgtgtggcccaggcctcaaaaaaccgcagcctcgcagactttgaaaaggccctgacggattaccgggccgagttgcgagatgatcccattataagtacacacttggcaaagctttacgacaacctcttggagcagaaccttatccgagtgattgagccattctccagggtgcagatcgaacatataagtagtctcatcaaacttagtaaggctgacgtggaaagaaagctgagtcaaatgatattggacaagaaatttcacgggatcttggaccaaggggagggggtgctgatcatatttgatgagccaccagtggacaaaacttatgaggcagccctcgaaacgatacagaacatgtccaaggtggttgactccttgtataacaaagccaaaaagttgacttag

SEQ ID NO: 22967 - DNA, 1449 bp, Artificial Sequence
  Description of Artificial Sequence: Synthetic coding sequence
atggccagcctgggccccgccgccgccggcgagcaggccagcggcgccgaagcggaacctggccccgcgggtccaccacctcctccttccccgtcaagcctgggtcctctgctccctctacagcgcgagcccctgtataactggcaggccacaaaagcctcattaaaggaacgctttgcatttctctttaacagtgagttgctgtccgatgtgcgctttgtgttggggaagggtaggggcgccgctgctgcaggcgggccccagcgcatccccgctcaccgctttgtgttagcggctgggagtgccgtgttcgacgccatgtttaatggcgggatggccactacatccgctgaaatcgagctgcccgacgtcgagccggcagcattccttgcgcttctgcgatttctgtattctgatgaagtacagataggacccgagactgtaatgactacactgtacactgcgaagaaatatgcagtgcccgcactggaggctcactgtgtggaatttttgaccaaacacttgcgcgctgacaacgcttttatgttgctcacacaggcccggttattcgacgagccacagctggccagcctctgcctcgatacaatagacaaaagtactatggacgctatatccgctgaaggttttacagacattgacatcgataccctgtgcgctgtgctagagcgagataccctctccattagagaaagcaggctgttcggtgccgtcgttcggtgggccgaggcagagtgtcagcggcaacagctgccggtcacattcggtaataaacagaaggtgttggggaaagccctgtcgctgatccgctttcctctgatgactatcgaagaatttgccgcaggtcctgcacagtcaggtatactgagcgatcgggaggttgtgaatctttttctgcacttcacagttaacccaaagccgcgcgttgaatatattgataggcctcgttgctgtttgcggggaaaggagtgttgtatcaatcggttccagcaggtcgagtcacggtggggctattccggaactagcgatagaatccggtttaccgtgaacagacgcatctctatcgtgggctttgggctttacggttccatccacggccctacagattatcaagtaaacatacagattatcgagtacgagaagaagcagactctgggtcagaatgatactggcttttcatgcgacggaacagcgaataccttcagggtgatgtttaaggagcccatcgaaatcttgcctaatgtgtgttacacggcatgtgcaacactcaaagggccggactctcattacggcactaagggactcaaaaaggtcgtgcacgagaccccagccgcaagtaagaccgtcttctttttctttagttctcccggaaataacaacgggacatccatagaggacgggcaaatacctgaaatcatcttttacacatag

SEQ ID NO: 22968 - DNA, 2883 bp, Artificial Sequence
  Description of Artificial Sequence: Synthetic coding sequence
atgagccggctgatcgtgaagaacctgcccaacggcatgaaggaggaacggttcagacagctttttgccgcttttgggactctgacagattgtagtctgaagttcactaaggacggaaaattcagaaagttcgggttcattggattcaagtctgaggaggaagctcagaaagcccaaaagcacttcaataagtctttcatcgacacgagtaggattacagtggaattctgcaaatcatttggagaccctgctaaaccacgtgcatggtccaagcatgcacaaaaaccatcccaaccaaaacagccccctaaagactccacaactccagagattaagaaggacgagaagaaaaagaaggtcgcgggtcagttagaaaaactcaaggaggacaccgaattccaggagttcctctcagtacaccagcggagggcccaggcagccacatgggccaatgatggtcttgatgcagaacccagcaagggaaagtctaagcctgcctctgactacctaaacttcgactccgatagcggccaggagagtgaggaagagggcgccggcgaagacctggaggaagaggcctcccttgaacccaaagctgccgtacagaaggagttgtccgacatggactatctgaaatccaagatggtgaaagcgggatcttcctcttcatccgaggaggaggaatccgaagacgaagcagtgcactgcgatgagggcagcgaagccgaagaggaggacagctcagccacacccgttctacaggaacgcgactctaaaggtgcgggacaggaacaaggtatgcctgccggcaagaagcggccgcccgaggcaagagccgagaccgagaagcctgctaaccagaaagagcccactacgtgccacaccgtgaagctccggggcgctccctttaacgttacagagaaaaacgtgatggagttcctagctcccctgaagcccgtagcaatccgcatcgtgaggaacgcccatggaaacaaaacaggctatatcttcgtggattttagcaacgaggaagaggtcaaacaggctctcaaatgtaaccgcgaatatatgggagggaggtatattgaggtatttagagagaagaatgtccccacaacaaagggcgctcccaagaacaccacaaaaagttggcagggacgaatcctgggagagaatgaggaagaagaggatctagcagaatccggacgactcttcgtccgcaacttgccctatacgtctacagaggaagatttggagaagcttttctcgaaatatgggccactaagcgaattgcactaccctatagactcacttacgaagaagccaaaaggtttcgcatttattacttttatgttccccgagcacgccgtgaaagcttattccgaggtggatggacaggtgtttcagggcagaatgctgcatgtattgccgagcactatcaaaaaggaagcctcggaagatgcaagcgcactgggcagctcatcctataaaaaaaagaaggaggcacaagataaagctaattctgcaagctcccataactggaatacacttttcatgggaccaaatgccgtagctgacgccattgctcagaaatataacgccacaaagtcccaggtcttcgatcatgaaactaagggctcggtggccgtgcgtgtcgcattaggcgaaacgcagctggtacaggaggtgcggcgcttcctgatagataacggagtctcattggatagcttttcccaggcagccgccgagcgatcaaagacagtgatcctcgttaagaatctgcccgcaggaaccctcgcagcccaactgcaagaaacattcggacactttgggagccttgggcgcgtgcttctgcccgaagggggtataacggctattgtggagttccttgagcctcttgaagcccgcaaagccttccggcacctggcctactccaagtttcatcacgttcctctgtacctggagtgggcaccggttggagtgttttctagcaccgcaccccagaagaagaaattacaggacacgccaagtgagcctatggagaaggacccagctgaacccgaaaccgtgcccgatggagagaccccggaggacgagaaccctacagaagaaggcgctgacaactctagcgcaaagatggaagaagaagaagaagaagaagaagaagaagaggagtccctgccaggatgtactctgttcattaagaacctgaatttcgacacgaccgaagagaaactgaaagaggtattctcaaaagtaggcacagtgaagtcatgctctatcagtaagaagaaaaataaagctggggtgctgctctctatgggattcggctttgtagaatacagaaaaccagaacaagcccaaaaagctcttaagcagctgcaagggcatgtcgtcgatggtcataagttggaagtgcggatttctgagcgcgcaaccaagcccgctgtgacactagccagaaaaaaacaggtgcctaggaagcagacaacctcaaagatcttagttcgcaatattcctttccaggcgcattctcgcgagatacgcgaattattctccactttcggagaattgaagaccgtgcgcttacccaaaaaaatgacgggcacaggcactcaccggggcttcggcttcgtggacttccttacaaagcaggacgctaaacgcgctttcaacgctctctgccactccacccacctgtacggacgccgcctcgtgctggagtgggccgatagtgaggttacactgcaggccctccggaggaaaactgccgctcacttccatgaaccccctaaaaagaaacggtcagtggtgcttgatgagattttggagcagctcgagggatccgactctgactccgaagagcagaccctccagttgtag

SEQ ID NO: 22969 - DNA, 2919 bp, Artificial Sequence
  Description of Artificial Sequence: Synthetic coding sequence
atggccacccggggccacgtgcaggaccccaacgaccggcggctgcggccaatatatgattatctagataatgggaataataagatggccattcagcaggccgacaaattgctgaagaaacataaggacctgcactgcgcaaaagttctaaaggccatcgggctacagcggaccggcaagcaggaggaagctttcacccttgcacaagaggtggctgccctcgagccaaccgacgataacagcttgcaagcactgacaattctctatcgcgaaatgcacagaccggagcttgtgactaaactgtacgaggcggcggtgaagaaagtgccaaacagcgaagagtatcactcccatctgtttatggcttacgcacgggtaggtgaatataagaaaatgcagcaggctgggatggccctgtacaaaattgtgcccaaaaatccctactatttttggagtgtgatgtccctaatcatgcagtccattagcgcgcaggatgaaaatttgagcaagaccatgtttctgcccttggccgagagaatggttgaaaagatggttaaagaagataagattgaagccgaagctgaggtggaactgtattacatgattctagagcggctgggcaagtatcaggaggctctggatgtgattcgggggaaactgggcgagaaactgacaagcgagatccagagtcgcgagaacaaatgcatggcgatgtataagaagctcagtagatggcccgaatgtaatgctctgtcccgccggctgcttcttaagaactcggatgactggcagttttatctcacctactttgattccgtgttcaggttgatcgaagaggcatggtcccctccagcagaaggcgaacactcattggagggcgaggttcattattctgctgaaaaggccgtgaaatttattgaggaccgaattacagaagagtcaaaatcaagtcgtcatctgcgcggtccccacctggctaaactagaacttatacgccgtctgcgctcccagggctgtaacgacgagtataagcttggcgaccccgaagagttgatgtttcaatactttaagaagttcggcgataagccttgctgctttactgacctcaaggtgttcgtggacctactaccagcaacacagtgtaccaagtttatcaaccagctcctcggagtggtgcccctttccaccccaaccgaggacaagttggcactgcctgctgacatccgagcactccaacagcatctgtgcgtggtgcagctgaccaggctgttaggtctgtaccataccatggacaaaaaccagaaactttcggtcgttagggaactgatgctgcgctatcagcacggactcgagtttggaaagacatgcctgaaaactgaattgcagtttagtgattattactgcttactggctgtacacgctttgatagacgtttggcgggagactggcgacgaaaccactgtttggcaggccctgactctgctggaagaaggcctgacccactcaccaagcaacgcccagtttaaacttttgctggtccggatttactgtatgctgggtgcatttgagccggtggtggacctatacagctccctggacgccaaacatatacaacacgatactatcggctatttgcttactcggtatgccgagtcactggggcagtacgctgctgcatctcagtcctgcaattttgcattgcggtttttccatagcaatcagaaggacacatcagaatatattatccaggcgtacaagtacggagccttcgagaagattcccgaattcatcgccttccgaaatcggctcaacaattctctccactttgcgcaggtccgaacagaaaggatgttgttagacctgcttcttgaggccaacatctccactagtctggccgagagtatcaaatctatgaacttgaggcctgaggaagacgacatcccctgggaagatctacgtgataacagagacctgaacgtcttcttcagctgggatcctaaagaccgtgatgtctcagaagaacataagaagttgtccctcgaggaggaaaccctgtggctgaggatacggtcacttacactgaggttaatttcaggccttccatcactgaatcatccagtagagcctaagaacagtgaaaaaactgccgagaatggtgtttcatcacggattgatatactccgtcttttactacagcagttagaagccacactcgaaacaggtaagcgcttcatagaaaaggacatccaatacccattccttggtccggttcccaccagaatgggtggcttctttaactcagggtgttcccagtgtcagatctcttctttttatctggttaatgacatctatgaactcgatacctcaggtctcgaggacactatggagatccaggaaaggattgagaatagtttcaagtctctgctggatcagctgaaggacgtcttcagcaaatgcaaaggtgatctcttagaggtgaaggatggtaatctgaagacccaccctactcttctagagaacttggtgttcttcgtggaaactatctcagtgattttgtgggtgagttcatactgtgaatccgtcctgcggccatacaaactgaaccttcagaaaaaaaagaagaaaaaaaaggagacctccataattatgccccctgtctttacctccttccaggattatgtgaccggtttgcaaaccttgatcagcaatgtggtggatcacatcaaaggcctggaaacacacctgattgccctcaaattggaggaactgatcttagaagacacatcactcagtcccgaggaaagaaagttctctaagacagtacagggcaaagtccaatctagttacctgcattcccttctggagatgggagaactcctcaagaaaagactcgaaaccacgaagaagctaaaaatttag

SEQ ID NO: 22970 - DNA, 2166 bp, Artificial Sequence
  Description of Artificial Sequence: Synthetic coding sequence
atggccgagaagttcgagagcctgatgaacatccacggcttcgacctggggtctcgatacatggacctgaaacccctgggctgcggcgggaatgggcttgtgttctcggccgtagataatgattgcgataaacgagtcgccattaaaaagattgtcttgacagatccgcagtcagtgaaacatgctctgagggagattaaaattatcaggcgcctcgaccacgataacatcgtcaaggtcttcgaaattctggggccctccggtagccagctcaccgacgacgtgggatccctgacagagctcaatagtgtctatatcgtgcaggagtacatggagactgaccttgctaacgtgctggagcagggccccctcctggaggaacacgcccgactgttcatgtatcagctgcttcgcggtctgaaatatattcactccgccaatgtgctgcatcgcgacttgaaaccagcaaacctattcataaatacggaagacctggtgctcaagattggagacttcggcctggctcgtataatggaccctcactacagtcataaaggccatcttagcgagggactggttacaaagtggtataggagtccaaggcttctgctgagtcccaacaattataccaaggcgatcgatatgtgggccgcaggctgtatcttcgctgagatgttgacgggtaaaaccctgttcgccggagcacatgagctggagcaaatgcagctgatccttgagtcgattcctgtggttcatgaggaagaccgacaggagctgttgagtgtgatccctgtgtatattcgcaacgacatgacggaaccacataagcccctgacgcagctcctgcctggcattagcagagaggccctggatttcctggagcaaattctaaccttctcacctatggaccgcctcactgctgaagaagccttaagccatccttacatgagcatatacagcttcccaatggacgagcccataagttctcatccgtttcacattgaagatgaggtcgacgatattctgttaatggatgagacacactctcacatttataactgggagaggtaccacgactgtcagttttcagagcacgactggcctgtccacaataacttcgatattgacgaggttcagcttgatcctcgtgccctctccgacgtcaccgatgaagaagaggtccaggtggatcctcgcaaatacctagacggggaccgggaaaagtatcttgaagacccagcttttgacacaaactattctacagagccttgctggcagtatagtgaccaccacgagaacaaatactgtgacctagaatgctcccacacatgcaactacaaaacccgctcaagctcttatctagacaacctggtctggcgggaatccgaagtaaatcactattacgaacctaagcttatcattgacttgtcaaattggaaggagcagagcaaagaaaaatccgacaagaaaggcaagtcaaagtgcgaacggaatggtctggtgaaagctcaaatcgcgttagaagaagcatctcagcagctcgccggcaaggagcgcgagaaaaaccagggatttgatttcgactcgttcatcgctgggactatccaactgagcagccagcatgaaccaactgacgtcgtcgataagctcaatgatctcaattcttccgtgtcccagcttgagctgaagagcctcatctcgaaaagcgtttctcaagaaaagcaggagaaggggatggccaaccttgcccagttggaggctctttaccagtcctcctgggattctcaatttgtgtccggaggtgaggactgtttttttattaaccagttttgtgaggtgcggaaggatgagcaggtggagaaagaaaatacatacaccagttaccttgacaaattcttctcacgtaaagaagacaccgaaatgctggagacagaaccagtagaggatggaaagttgggcgaacggggccacgaggagggcttcttgaataactctggcgaatttttgttcaacaaacagcttgagtcgatcgggatcccacagtttcactcccccgtggggagcccattgaagagcattcaggctaccctaactccatccgctatgaagtcatccccacagataccacatcagacatacagctctatcttaaaacatctgaactag

SEQ ID NO: 22971 - DNA, 948 bp, Artificial Sequence
  Description of Artificial Sequence: Synthetic coding sequence
atggccgccggcgtgccctgcgccctggtgaccagctgcagcagcgtgttttctggagaccaattggtccagcatattcttggtactgaggacttgatagtcgaagttacctccaatgatgcagtcaggttttatccgtggacaatcgacaacaagtattacagcgctgatataaacctgtgcgtggtgccaaacaaatttctggtaactgcggagatcgcggagagtgtgcaggcatttgtggtgtattttgactccacacagaagtctggtcttgatagcgtgtcctcatggctgcctctggccaaagcctggctgcccgaggtgatgatcctggtctgcgaccgcgtaagcgaggacggaattaatagacagaaagcccaggagtggtgcattaagcacgggttcgagcttgtcgaactgtcccccgaggagctgcccgaggaagacgatgactttcccgagtcaaccggggttaagcgtattgtccaggcgttgaacgcaaacgtgtggagcaacgtcgtgatgaagaacgacagaaatcagggcttcagcctgctgaactccctgaccggaacaaaccatagtatcggcagcgccgatccctgccaccctgaacagccccacctacctgctgccgactccactgagtcactgagtgatcaccgggggggggcctccaacacaactgatgcccaggtggacagcattgtggatccgatgctcgacttagacattcaagagctggcttccctcaccactggtgggggggacgtggagaactttgagaggctgttttcaaagctgaaagaaatgaaagacaaagctgccacattgccccacgaacagcgcaaagtgcacgccgagaaagtcgctaaagccttttggatggctattgggggggatcgggacgagatcgagggactgtccagcgacgaggaacattag

SEQ ID NO: 22972 - DNA, 1338 bp, Artificial Sequence
  Description of Artificial Sequence: Synthetic coding sequence
atggccgcccccgaggagcgggacctgacccaggagcagaccgagaagcttctgcaattccaggatctcaccggtattgaatcaatggatcagtgccggcacacattggaacagcataattggaatatcgaagctgccgtacaagatcgactgaacgaacaggagggtgtgccaagcgtgttcaacccgccccccagcagaccccttcaggtgaatactgccgatcaccgtatttactcctatgtggtgagtcgtccacaacctaggggcctcttggggtggggttattacctgatcatgctgccctttaggttcacctattataccattctggacatatttagattcgccctgaggttcatacggccagatccaagaagccgcgtaacggacccagtgggcgatatcgtgagcttcatgcacagtttcgaagagaagtatgggagggcccacccggtattttaccaaggaacttattctcaggcattaaacgacgctaagcgcgaattgaggttcctacttgtgtacttacacggcgacgaccaccaggactcagacgaattctgccgtaacaccctttgtgcccccgaggtgatctctctaattaatactagaatgctattttgggcttgttcaaccaataagcctgaaggctaccgtgtgtcacaggctcttcgggagaacacctatccattcttggccatgatcatgttgaaagatcgtcgcatgactgtggtggggcggttggaaggactgattcagcccgacgatttaattaatcagttaacctttattatggatgccaatcagacatatttggtgagcgaacggctggaacgagaggagcggaaccagactcaggtgcttcgccaacagcaggacgaggcctacttagctagcttgagagctgatcaggagaaggaaaggaaaaagagggaggaacgtgaaagaaagcggcgaaaggaagaagaggtgcagcagcaaaaactggccgaggaacggagacgccagaatctacaggaggaaaaggaacgcaagctcgaatgtctaccgcctgagccctcaccagatgatcctgaaagtgtgaaaataatctttaaactacccaacgacagccgagtggaacggcggtttcactttagtcaatccttaacagtaatccacgattttctttttagccttaaagaatccccagaaaagtttcaaatagaggccaactttccaagaagagtgcttccgtgcattcccagcgaggagtggccaaatccccctacacttcaggaagcgggactgagtcatactgaagtgttgttcgtacaggacctaaccgatgagtag

SEQ ID NO: 22973 - DNA, 2724 bp, Artificial Sequence
  Description of Artificial Sequence: Synthetic coding sequence
atggccacccccgaccagaagagccccaacgtgctgctgcagaacttatgttgccggatactggggagatccgaggcagatgtggcacagcaattccagtacgccgtgagggttatcgggtctaattttgcccccacagtggaaagagacgaatttctggtggctgaaaagataaagaaggagctcattaggcagaggcgcgaggcagacgctgccttgtttagcgaactgcaccgaaagcttcactcccaaggcgtgcttaaaaacaagtggtccatactctacctgttgctgtctttaagcgaggacccgaggcgccaaccatccaaggtctccagttacgccacactattcgcccaggctctcccaagagatgcacacagtacaccatattactatgctaggcctcagaccttgcccctttcttaccaggatcgttctgcccagtcagcccagtcctccggttctgtgggtagttctggcatttcgtctattggcctgtgtgccctgtccgggcctgctcccgccccccagagccttctccctggccagagcaaccaagctcctggcgttggggattgcttgcggcagcagctgggatctagactggcatggacacttacagccaatcagccatcaagccaagccactacgagtaagggcgttccctctgccgtgtcccggaacatgacgcggtcaagaagggaaggggacacaggcggaacaatggagattactgaggccgctctggtccgagacatcttgtacgtgtttcagggcattgatggaaagaatattaaaatgaataacaccgagaattgctacaaggtagagggaaaggcaaatctgtcgcgttctctgagagatactgccgtccgtttgagtgagctcggttggctccacaataagatacgccgatataccgaccaaagaagcctggacaggtcattcggcctggtggggcagtccttctgcgctgcacttcatcaggaactccgggaatactaccgactgctatctgttctccatagccagcttcagctggaggatgatcagggggtgaatctgggattggagagctcccttaccctccggcgcttactcgtttggacctatgaccctaaaatcaggctgaaaactctggcagctcttgtcgatcactgtcaggggagaaagggaggggagttagcgagtgccgtgcacgcctataccaaaacaggggatccctatatgcgatcactggttcaacacatactgagtctcgtatcccatcctgtgctgagctttctgtacaggtggatttacgacggagaattggaagacacttaccacgagttcttcgtcgcttccgacccaacagtcaaaaccgacagattatggcatgacaaatatacactcagaaagtccatgatacccagttttatgaccatggatcagtccagaaaagtcctactgattggtaaaagcattaacttcctacatcaggtgtgccacgaccagacaccaactacaaaaatgattgccgtgacgaaatctgccgaaagccctcaagatgccgccgatctctttaccgatctggaaaatgcatttcaaggtaaaattgacgcagcatacttcgagacttccaagtacctgttggatgtgcttaacaagaaatactcactgctcgaccacatgcaagccatgagaagatacctgttgctcggtcagggtgattttatccggcatctgatggaccttctgaaaccagagttggtgaggcctgctacaacactctaccagcacaatctaacaggaatactcgagaccgctgtgcgagctactaacgcgcagttcgactcacctgaaatactccggcggctggacgtcaggttgcttgaggtgagccccggagatacaggctgggatgtgtttagtcttgactatcacgtggatggaccgatagccacagtgtttaccagggaatgcatgagtcactatctccgagtttttaacttcctttggcgtgccaaacgtatggagtacatcttgaccgatatcagaaaaggtcacatgtgcaatgccaagctgttgagaaatatgcccgaattctccggtgtgttacatcaatgtcacattctcgccagcgaaatggtgcatttcatacaccagatgcaatattacatcacctttgaggtgcttgaatgcagttgggacgagctctggaataaggttcaacaggctcaggatctggatcacattattgctgcacatgaggtattcttggatacaatcataagccgctgtctcctggactcggatagccgggccttgttgaatcagctgagagccgtattcgaccaaattatcgagctacagaatgcgcaggatgccatctaccgggccgcattggaagagttgcagcggagactacagtttgaggagaaaaagaagcagagggagatagaggggcagtggggggttaccgctgccgaagaagaagaagaaaataaaaggatcggcgaatttaaagagagtattcccaaaatgtgtagccagctgaggatactcactcacttctatcagggcattgtccagcagtttctggttctgctgacaacatctagcgacgaaagcctccgatttctgtcttttaggttggatttcaatgaacactacaaagcccgtgagcctaggttgcgggtttcgctgggcactcgcggtcgaagaagctctcacacatag

SEQ ID NO: 22974 - DNA, 1086 bp, Artificial Sequence
  Description of Artificial Sequence: Synthetic coding sequence
atgaccggcaaggccggcgaggccctgagcaagcccaagagcgagaccgttgccaagtccacatccggaggagcgcccgccagatgcaccggctttggtatacaggaaatcctcggactgaataaagagccaccaagttctcacccgagggctgctctcgatggactggccccaggacacctgctcgccgccagatcggttctaagcccggcgggtgtaggaggaatgggacttctcggcccgggtggattacctggattttacacccaaccaacctttcttgaggtattgtccgacccccaatccgtgcatctacagccactgggaagagctagtggccctctggacaccagtcagactgcgtcatctgacagcgaagacgtgtcaagcagcgatcggaagatgagtaaaagcgcactgaaccagaccaaaaaaaggaaaaaacgccggcaccggacgatctttacttcctaccagcttgaagagctcgagaaggcttttaacgaggcccactatcccgatgtatatgctagagagatgttggctatgaagacagagctgcctgaagatcgaattcaggtttggttccagaatcggagggccaagtggagaaaaagggaaaagtgctggggcaggtctagtgtgatggccgagtacggattgtacggagctatggtgagacacagcattcctctgccagagtccatcctgaagtctgccaaggacggcattatggacagctgtgcgccatggttgctagggatgcacaaaaaatccctagaagcagccgcagaatcaggaaggaagccagaaggggaacggcaggcactgccgaaactggataagatggaacaggacgagagggggccagacgcacaggccgctataagccaggaggagctcagagagaacagtatagctgtgttacgtgctaaggcccaagaacactcaactaaggttctcggcactgtgtcaggaccggatagccttgcccgctccaccgagaagcccgaggaggaagaggccatggacgaagaccggccagccgagcggctgtccccacctcaattggaggacatggcatag

SEQ ID NO: 22975 - DNA, 2073 bp, Artificial Sequence
  Description of Artificial Sequence: Synthetic coding sequence
atggaggagagccccctgagccgggcccccagccggggcggcgtgaactttctgaacgtcgccaggacttatataccaaacactaaggtcgaatgtcattatacactcccacccggcaccatgccaagcgcatccgattggatcggtatcttcaaggtggaagcggcctgcgtgagagactaccacaccttcgtgtggtcttccgttcctgagtctaccacagatggctcgcccatccacactagcgtccagtttcaggccagctatctgccgaagcctggcgcccagctgtatcaatttagatacgttaatcgtcagggccaggtgtgtggtcagtcccctccattccagttccgcgaacctcgcccgatggacgagctcgtgacacttgaggaagcagacggtgggtccgatatcttattggtagtaccaaaagctactgtacttcaaaaccaacttgatgagtcgcagcaggagcggaatgatttgatgcagctcaaactgcaactagagggacaagtcaccgaattacgttctagagtgcaggagctcgaacgtgcactagccactgctagacaagaacataccgagttgatggaacagtacaaaggaatctctcgtagccacggcgagatcacagaggagagagacattctgtccagacaacagggtgaccatgtggcgcgcattttagaactggaggatgacattcagaccatctcagaaaaagtcttgacaaaggaggtcgagctggaccgacttcgcgatacagtcaaagctctcacaagagaacaggaaaagctgctaggtcagttgaaggaggtgcaagcggacaaggagcagagcgaggccgagttgcaggttgcccagcaggaaaaccatcaccttaatctcgacctcaaggaggccaagtcctggcaagaagaacaatcagctcaagcccagcggttgaaagacaaagtggctcagatgaaggataccctcggacaggctcagcaacgcgtcgccgaactcgagccccttaaggagcaactcagaggtgcacaggagttggccgcatcatcacagcagaaggctaccctgctcggggaggagttggcctccgctgcagcagcacgggataggaccattgcagagttgcaccgcagcaggttggaagttgccgaggtgaatgggcgcctcgccgaattggggctccatctgaaggaggagaaatgtcaatggagcaaagagcgggctggtctcctgcaatcagtagaggcggaaaaggataagatactgaagctgagtgccgagattcttaggctggagaaggctgtccaagaagaacgcacacagaaccaggtgtttaaaaccgagcttgcccgagaaaaagacagcagcctcgtgcagttgtccgagtccaaaagagagctgacggaattgcggtctgccctcagagtacttcaaaaggaaaaagagcagctacaggaagagaaacaggaattgctggagtacatgagaaagctagaagcaagattagagaaggtggcagacgaaaagtggaatgaggatgctactactgaggacgaagaagccgctgtggggctgagctgcccagccgccctgacagacagcgaggacgagagtcccgaagatatgcgcctgcctccatacgggctctgtgagaggggggacccaggtagttctcctgctggcccacgggaggcctctcctcttgtggtcatcagccagccagcccctatcagtccgcacctgagtggccctgctgaagattcaagttcggattctgccgaggacgagaaatcagtcctgatggcagccgtgcagagcgggggcgaagaagcaaatctgcttctcccagagctggggtcagcgttttacgacatggcctcaggtttcactgtaggtaccctttctgaaacctcaaccggtgggcccgccacccccacctggaaagaatgtccaatttgcaaagaaagatttcccgctgagtctgataaagatgccctcgaggatcacatggacgggcattttttcttttcaacccaggaccccttcacgtttgaatag

SEQ ID NO: 22976 - DNA, 1980 bp, Artificial Sequence
  Description of Artificial Sequence: Synthetic coding sequence
atgagcctgccccccgagaaggccagcgagctgaagcagctgatccatcaacagctgtccaaaatggacgtgcacggaagaattcgggagattttggccgagacaatacgggaggaactagcgccggatcagcagcatctgtcgaccgaggacttgattaaagccctgagaagaagaggcatcatcgacgacgtcatgaaggaactgaatttcgttacggatagtgtggagcaggaacttcccagtagccctaagcagcccatctgcttcgaccgtcagagcactctgaaaaagaccaacatcgacccgactagacgatacttgtatctgcaggtactgggagggaaggcttttctcgagcatctccaggaaccagagccattgcccgggcaggtctgctcaacgtttacgctttgccttcactataggaatcagagatttagatctaagccagtcccctgcgcctgcgaacctgacttccacgacggcttcctgctagaagtccacagagaatccctgggcgatggtacaagaatggcagactctactactatgctttcgattagtgacccaattcacatggtgttgatcaagaccgatatcttcggtgagacaaccctcgtggcctcctattttctggaatggcggtccgtccttggctcagagaacggagttacctcattgacggtcgaactgatgggtgtgggcacggagagcaaggtgtccgtgggcatcctgaatataaaattagagatgtaccctcctctcaaccaaaccctgtcccaggaagtggtaaatacccagctcgccctagaaaggcaaaagaccgcagagaaggagcgcctttttttggtatacgcaaaacagtggtggagagaatatctccagattagaccatcacataatagccggttggtgaaaatttttgctcaggacgagaacggaatcaaccggcctgtatgtagctacgtaaaacctttgcgggccggtcgcctgctcgatacacccagacaggcagcaaggttcgtaaacgtgttgggatacgaacgggcccccgtcatcggagggggggggaagcaggagcagtggtgcacgctcctggcctttctttgtcgaaacaaaggcgattgcgaagatcatgctaacctgctctgctcactattactcgggtacggcctagaggcgttcgtttgcgtgggcaccaaggctaaaggggtaccccacgcctgggtgatgacctgtggcaccgacggcgctattacattttgggaatctctcacggggcacagatacatacacaagcccacaaatcccgacgaacctcccgtcgccgaacagcccaaacctctttatccataccgtactatcggttgcgtgttcaatcatcaaatgtttctcggaaattgccagccctctgatgcagtcgagacctgcgtctttgatcttaatgatgagagcaaatggaagccaatgtcagaggaagcgataaagtccgtttgcgcccctggcgccaccacctccttacctccattccctcccctctgcgctagtacaatcgacgctagtgttacatcgaacgagattgagatgcagctgaggctgcttgtttccgaacatcgcaaggatctagggctgactacagtgtgggaggaccagcttagctatctcctttctcctgctctcgctagttacgagtttgagcggacaacctccatcagcgcaggaaacgaggagttccaggatgctatacggcgagcagtgcccgatgggcacaccttcaaaggatttccaattcacttcgtgtaccggaatgccaggcgagccttcgcaacgtgtctgaggtcacctttctgcgaggagatcatttgttgcaggggtgatcaagtgaggttagcagtgcgggtgcgagtgtttacgtatccagagtctgcttgcgccgtttggatcatgtttgcatgcaagtacagatctgttctgtag

SEQ ID NO: 22977 - DNA, 1500 bp, Artificial Sequence
  Description of Artificial Sequence: Synthetic coding sequence
atgctggagcggccccccgccctggccatgcccatgcccaccgagggtaccccacctcctctgtctggaacacccatcccagtcccagcatactttaggcatgccgagcccggattttcgctgaaacggccccggggcctcagtcgctccctgccaccgccaccccctgccaaggggagtataccgattagtagactgttccctcccagaactccaggttggcaccaattacagccccgaagagtgtcgttccgcggagaagcttccgagactctccagtccccgggatacgatcccagccgcccagagagcttttttcagcagtccttccagaggctcagcaggcttgggcatggctcatacggcgaagtctttaaggtacggagtaaggaggacgggcgcctctacgctgtgaagcgctccatgagcccctttcgagggcccaaagacagagcacggaagcttgcagaggtagggagtcatgagaaggttggccagcacccctgttgcgtaaggttagaacaggcctgggaggagggcggcatactttacctgcagaccgaactgtgcggcccttctttacagcagcactgtgaggcatggggagcaagcctcccagaggcccaggtgtgggggtatctcagagatactcttctggctctggctcatttgcactctcagggcctggtccatctcgatgtcaagcctgcaaatatctttttgggacctaggggaagatgtaagttgggtgatttcggcctcctcgtcgagctgggaacagccggggccggggaggtccaagagggtgatcctcggtatatggcgccagagctcctgcagggaagctacggaactgccgccgacgtgttcagcttagggcttacgattttggaagttgcttgtaatatggagctgccacacggaggcgagggctggcagcagctcaggcaggggtacttgccccctgagtttactgctggcctctcctctgagctccgctccgttctggttatgatgcttgaaccagacccaaagctgagggcaacggcagaggctcttctggccttacccgtgctgcgtcagcctcgcgcatggggcgttctctggtgtatggcggcagaagccctgtcccgggggtgggccctgtggcaggctctcttggccctcctgtgttggctgtggcacggtctggcccacccagcaagctggctgcagcctttggggccgcctgcgacacccccaggaagcccgccctgcagcctgttgttggacagcagcctatccagcaattgggacgacgacagcctcggccccagtcttagcccagaggctgtcttagcacgtacggtggggtccacatccactccccgctccagatgcaccccccgggatgcgctggacctgtctgacatcaactcagagcctcccagaggatctttcccgtcctttgagcctcgaaacctcctgtccctcttcgaagatacccttgatccgacttag

SEQ ID NO: 22978 - DNA, 486 bp, Artificial Sequence
  Description of Artificial Sequence: Synthetic coding sequence
atggacgtgttcctgatgatccggcggcacaagaccaccatcttcacggatgctaaagagtcgtctacggtcttcgaactgaagagaatcgttgaaggtatactcaagcggccacccgacgaacaacgactctacaaagacgatcagctcctggatgatggcaaaacactgggagaatgcgggtttacctcccagaccgcgagaccacaagccccggccacagtcggtttggcatttcgcgccgatgacaccttcgaggccctgtgcattgaaccattttcatctccacccgagctcccagatgtgatgaagcctcaagatagtggctcctcagctaacgagcaggccgtgcatctccacgtccacagtcagacgatggctaaatcaaggaatacaagctggagtcaatgtccaggattaactgcctgctccactagggaaccacaggacggcccaacccaggtccaccccagatggggcttgtag

SEQ ID NO: 22979 - DNA, 1521 bp, Artificial Sequence
  Description of Artificial Sequence: Synthetic coding sequence
atgaccggcgagaagatccggagcctgcggcgggaccacaagccctccaaggaggagggggatctactagaacccggggatgaagaggcggcagccgctctggggggcacctttacccggagtcggatcggcaaaggaggcaaagcgtgccataaaatctttagcaaccaccatcatcgcctgcagctgaaggcggcccccgctagctcaaatccacccggcgctccagcgttgccactgcacaactcctctgtcactgctaactcccagtcccccgccctgctggcaggtaccaacccggtggctgtagtcgctgacggtggttcgtgcccagcgcattatccggtgcacgaatgcgtctttaaaggggatgttaggagactttcaagtttgattcggactcacaatatcggccagaaggacaatcacggcaacacaccactgcacctcgctgtgatgctcggaaacaaggtcactgcgttgctgaggaaacttaagcagcagtcaagggaatcagtggaagagaagcgtcctcggctcttaaaggctctgaaggaattgggggacttttacttggaacttcactgggacttccaaagttgggtgcctttactgtctagaattttgccctctgatgcgtgcaagatctacaaacagggtatcaatatcagactggataccactctgatagatttcaccgatatgaaatgtcagaggggggatttaagcttcatttttaacggagacgctgctcccagtgagtcgttcgtggtgctcgataatgaacaaaaagtttatcaacggattcaccatgaagagtctgagatggagaccgaggaagaggtggacattctcatgagctcagatatctacagcgcaacattgagcacgaagtcaatatcatttactagggcccagactggctggcttttccgggaagacaaaaccgagagggttggcaactttctcgccgatttctacctggtaaacggcctcgtacttgaatcccggaagcgccgagagcatctgtctgaagaagatatattgcgtaacaaggccatcatggagagtctgagcaagggaggcaacatcatggaacagaacttcgaaccaatccggcggcagagcctaacaccaccacctcagaatactatcacatgggaggaatatatttccgccgaaaacggcaaagctccccacctgggtagggaactggtttgcaaagagtccaagaaaacgtttaaggcaacaatagcaatgagccaagagttccccctggggatcgagttattgctgaatgtacttgaggtggtggccccttttaagcactttaataagctgagagaattcgtgcaaatgaaactgccccccggctttccagtcaaactggatattcctgtgtttccaacgatcactgctaccgtaaccttccaagaattcagatacgacgagtttgacggatccatctttacaatccccgatgactataaggaggacccatcccgcttccctgatttgtag

SEQ ID NO: 22980 - DNA, 699 bp, Artificial Sequence
  Description of Artificial Sequence: Synthetic coding sequence
atgcagccccccgccccccccgccgagctggccgcccccctgcccagccccctacccgagcagcctctggacagtcccgctgctcccgccttaagcccaagtggtctcggacttcagcctggccctgagagaactagcaccacaaaatcaaaagaactcagtccagggtccgcacagaaaggctcccctggaagcagccaagggaccgcctgcgctggaacacagccaggggcccagcctggtgcccagcctggcgctagcccatccccctcccaaccaccagcagaccagtcacctcacaccctgcggaaggtgagcaaaaaactcgcgcctatcccgccaaaagttccattcggccaacctggcgctatggcagaccagtccgcgggccaaccatcccctgtaagcctgtccccaacgcccccatctacccctagtccttacggtctgagctacccacagggctatagtctagcctctggccagttaagccctgcagctgctcctcctctggcttctcccagcgttttcaccagcaccctgtctaaaagtcggcccacccctaaaccgcgtcagcgccccaccctgccacctccacagccacccacggtgaatctctctgcttcctctccccagtcgaccgaggcgcccatgctggacggcatgtccccaggagaaagcatgtctaccgcagtctag

SEQ ID NO: 22981 - DNA, 1221 bp, Artificial Sequence
  Description of Artificial Sequence: Synthetic coding sequence
atgcaccccgccgtgttcctgagcctgcccgacctgcggtgcagcttactgctgctcgtgacatgggtgtttacaccagtaactacagagattacgtctctagataccgaaaacatcgatgaaattctgaacaatgcagacgttgccctggtgaacttttatgccgattggtgtcgattctcacaaatgctgcatcccatcttcgaggaagcctctgatgtaattaaagaggagtttcccaacgaaaatcaggttgtgtttgctcgggtggactgcgatcaacacagcgatatcgcacagagatatcgcattagcaagtaccctaccctcaagctcttcaggaacggcatgatgatgaagagagaatatcggggccagagaagcgtcaaagccctggccgactacataaggcaacagaaaagcgatccgattcaggaaatcagggatttagccgaaataacgacactggatcgttcaaagcgaaatatcataggatatttcgaacaaaaggacagtgacaattatagagtgtttgaacgagtcgccaacatcttgcacgacgactgcgcgtttctgtcagcattcggagatgtatctaaacctgagcggtacagcggggacaatatcatttacaaaccccctggtcacagcgctcccgacatggtatacctgggggccatgacgaacttcgatgtaacttacaattggattcaggacaaatgcgtgccgctggttcgggaaataacatttgaaaatggagaggagctcactgaggagggtctaccctttctgatacttttccatatgaaggaagatacagaatctctggaaatatttcaaaatgaggttgcccgtcaactcatttccgagaaagggaccatcaactttttacacgccgactgtgacaagttccgtcaccctttgttacatattcagaagacccccgcagactgcccagtgatcgcaatagacagcttcaggcacatgtatgtcttcggcgactttaaagacgttctgattcccggcaagctcaaacaattcgtgttcgatctccattcaggaaagctgcacagagagtttcatcacggccctgatcccaccgacaccgctcccggggaacaggcccaggacgtagcctccagtccccctgaatcgtcattccagaaactggctccctctgaatacaggtacaccctgttgagagaccgcgacgaactgtag

SEQ ID NO: 22982 - DNA, 5601 bp, Artificial Sequence
  Description of Artificial Sequence: Synthetic coding sequence
atggaccccgtgggcctgcagctgggcaacaagaacctgtggagctgcctcgtgcgactgctcaccaaggatcctgagtggctgaatgcgaagatgaaattctttctgccaaacaccgatctggattcaaggaacgagacacttgacccagagcaaagagtgatcctgcagcttaataagttgcacgtgcaaggaagtgatacatggcagagcttcatccactgtgtctgtatgcaactggaggtgccactcgaccttgaagttctgctgctgagcaccttcggctacgacgacggtttcacctctcagttaggcgccgagggaaagagccagcccgaatctcagcttcaccatggcttaaagcggccacaccagtcatgtggtagctcccctcgccggaagcaatgcaagaagcaacagttggaactcgctaagaagtatttacagctcctgcggacatccgctcagcagcggtaccgtagccaaatcccaggcagcgggcaaccccatgctttccaccaggtctacgtgccaccaatccttaggcgggctactgcatctctggatacaccggaaggtgctattatgggcgacgtcaaggtggaggacggggccgacgtgtccatttctgacctgtttaatacaagggtcaacaagggcccccgcgtcaccgtcttgctgggaaaggcaggcatggggaaaaccaccttggctcaccgcttgtgccagaaatgggccgaagggcacctgaattgtttccaagccctcttcctctttgaattcaggcagctgaacctgatcacacgtttcttgaccccctcggaattgttgttcgatctgtatttgtctccagagtcagatcacgacactgtattccagtacctcgagaagaatgccgaccaagtactgctgatcttcgacggcctggatgaggcactgcagccgatggggccagatggtcctggacccgtgttgacattgttttctcacttgtgcaatggaacacttctgcctggctgcagagtgatggctacctctagacccggaaaattgcctgcttgcctccctgctgaggccgctatggtccacatgctcggcttcgatggcccgcgcgtcgaggaatatgtcaatcacttcttttccgcccagccctcccgcgaaggagctctggttgaactccagaccaatggaagactccggagcctttgcgctgtgcccgcgctttgtcaggttgcttgcctctgccttcaccacctcttgcccgaccacgcacctggccagtctgtggccttgttgccaaatatgacccagctctacatgcagatggtgttggccttgagcccacctggtcacctgcccacaagctcactgctcgacctcggagaggtggctctgcgtggtctggagacaggtaaagtaatcttctatgcaaaagacatcgccccccccctgatcgccttcggagcgacacactccctgctgaccagtttctgtgtatgtaccgggccaggtcaccaacagactggttatgcctttacgcatttgtcactgcaggagttcctagccgccctacacctcatggcatccccaaaggttaataaggacacactaacccagtatgtcaccctacactccaggtgggttcagaggacaaaagccagactagggttgagcgatcacctgcctacttttctggcaggtttggcctcctgcacctgtcggccgtttttgtctcatctagcacagggcaacgaagattgcgtgggggctaaacaggccgctgtggttcaggtgttaaaaaagttggcgactcgcaagctcaccgggcctaaagtcgtagagttgtgccactgtgtcgacgagacccaggagccagagctggcttcgctcactgcacagagcttgccttaccaactaccgttccataattttcctctgacctgtacggacctcgcaacacttacgaacatccttgagcatagagaagcgcctatacacctggattttgacgggtgcccgctggagccgcattgtcccgaggctctggtggggtgtgggcagatcgagaatctctcgtttaaatctagaaaatgcggggatgctttcgctgaggctctttcccgaagcttacctacaatgggtaggctacagatgttgggtctggcagggtcgaagataaccgctagaggcatctcccacctcgtgaaggcactgccactgtgtccacagctcaaggaggtcagctttcgcgacaaccagctatcagatcaggtggtactcaatattgtggaagttctgccccaccttccacggttacgtaaactggatttgagtagtaatagtatatgtgtctctaccctcctctgtttggctcgtgttgcagtgacttgccccacggtacgtatgctccaggcacgcgaggcagacctgatatttctcctctcacctccgaccgaaactaccgccgagctgcaaagggcacctgatctacaggaaagtgatggacaacgcaaaggcgcccaaagtcgaagcctgactctgagactccaaaaatgccaattgcaggtacatgatgccgaagcactcatcgctctcctgcaggagggcccacatctggaagaagtggacctttccggtaatcagttggaagatgaggggtgtcggctgatggccgaagcagcctcgcaattacacatagcccggaaactggacctatcaaataacgggttatcagttgccggggtgcactgtgtactccgggctgtgtctgcctgttggaccctggccgagctgcacatcagtcttcagcacaagactgtcatattcatgtttgcgcaagagccagaggagcaaaaaggacctcaggagcgggccgctttcctcgactcacttatgctacagatgccttccgaactaccattgtcctcccgccgtatgcggctgacccactgtggactgcaagagaagcacttggaacagctttgtaaagctctcggcggcagctgccacctgggacatctgcacctggacttctccggtaacgcactgggggatgagggagccgcccgtctggcccagctgcttcctgggctgggagccctccagagcctcaatctttcggagaatgggctctcgctggacgccgtgttgggcctggtgagatgtttttcaactctccagtggttgttcaggctcgatatcagctttgagtctcagcatattctgctacgaggtgacaagacatcccgggacatgtgggctactggcagtctgccagattttcctgctgctgccaagttcctgggattccgtcagcgttgtatccctcgatctttatgcctgagtgaatgtcccctagagccccccagccttactagactgtgtgcaactttaaaagattgccctggccctctggagcttcaattaagctgcgaattcctgtccgatcagtccctcgagacactgctcgactgcctgccccagttaccacaactcagcctgctgcagctctcacagaccgggttgtcgcctaaatccccgttcctgctggccaataccttgtccctatgcccgcgagttaaaaaggtggacctaagaagcttacatcatgctacactccattttcggtcaaacgaagaagaagagggcgtgtgctgtggccgctttaccggttgctcactgtcgcaggaacacgtcgaatccctatgttggttgctgagcaagtgcaaagacttgtcccaggttgacctgagcgctaatctgctcggagatagtggactgcgatgcctgctcgaatgtttacctcaggttcctatatcaggtcttctggatctttcccacaactcaatatcccaggaatcagcactgtacctgctggagaccctgccttcctgtcccagggttagagaagcttcagtgaatctcggcagtgagcagtccttccggattcatttctcaagagaggatcaagcgggtaagaccttgagactgagcgagtgctcgttcaggccagaacatgtgagccgtcttgccacaggtctgtccaagtctctccaactgaccgagttgaccctgactcagtgttgcctgggacagaagcaactcgcaattctgctgagcctggttggacggcctgcagggttgttctccctgagggttcaagagccatgggccgacagggctagagtgctatccctgctagaggtgtgcgcgcaggcaagcggatcagtgaccgaaatcagtatttctgaaacacagcaacagctttgtgtacagcttgagttcccacggcaggaagagaatcctgaagctgtggccttgcgactcgcgcattgcgatttaggagcacatcactccctcctggtgggccaactcatggaaacctgtgcccggctgcaacagttgagcctctcacaagtcaacctgtgcgaagacgacgatgctagtagcctcctgttacagtcgcttcttttaagcttgtcggaactgaaaacattccgtctaaccagcagctgcgtctctacggaaggactcgcgcacctggcctccggcctgggccactgtcatcacttggaggagctggatctgtcaaataaccagttcgacgaggagggtacaaaagccttgatgagagccctcgaagggaagtggatgctaaagcggctggacttgtcgcacctgctcctgaattcttccaccctagcccttttgacccaccgcctaagccaaatgacatgtctgcagtccctcaggctgaacaggaactctataggggatgtcggttgctgccacctgtccgaggcgctcagggccgccacatcccttgaggaactggacctttctcataaccagattggagacgccggagtccagcatctcgcaacaattctgcctggacttcctgagctgagaaagattgatctcagtggtaactccatttcaagcgccggcggggtgcagctggcggaaagccttgtgttatgcagacggcttgaggagttgatgttaggctgtaacgctttgggagatcctacagcgcttggactggcccaggagctgccgcagcacctgcgagtattgcaccttccattcagccacctagggcccggtggagccctgtccttagctcaggcgctcgacggctcaccacatctggaagaaatctccttagccgagaacaacctcgccggcggagtactgcgcttctgtatggaacttcccctgctccgccaaatcgacctggtttcgtgtaagatcgacaaccagactgccaaactccttacctcatcttttacatcctgtccggcgctcgaggtgatcctcctgtcctggaatctgctgggcgacgaggctgcagccgagctggcccaggttctgccccagatgggtaggttgaagagagttgacctggagaagaatcaaatcacggctctaggtgcttggctgttagcagaaggactggctcaggggtcaagcatacaggtcatccgcctctggaataaccccattccctgcgatatggcacagcatcttaagagtcaggagccacgtttggacttcgccttctttgataaccagccacaggcaccttggggcacttag

SEQ ID NO: 22983 - DNA, 897 bp, Artificial Sequence
  Description of Artificial Sequence: Synthetic coding sequence
atgatgaacgtgaacacccggggcacctacctggccagcaaggcctgcatcccgtacttgaagaagagcaaggtggcacacatactgaacatctccccccccctaaatttgaatccagtgtggttcaagcagcactgtgcttacacaatcgcaaaatacggaatgtcaatgtatgtactggggatggcagaagaattcaaaggcgagatcgccgtgaatgccttgtggcccaagaccgccattcacaccgccgccatggacatgctcggaggacctggcattgaatctcagtgcagaaaagtcgacattatcgccgacgccgcctactctattttccagaaaccaaagagcttcaccgggaactttgtaattgatgagaatatccttaaggaagaaggcattgagaacttcgacgtttatgccatcaaacctggtcacccgctgcagcctgacttcttcctggacgagtatcccgaggccgtgagtaaaaaagttgagtctacaggcgcagttcccgagtttaaggaggagaagctccaactacagccaaagcctcggtcaggagccgtggaggaaacgttccgtatagtcaaagactcgctttctgacgatgtagtcaaagccacccaggccatttacctgttcgaattgtcaggcgaagacgggggaacttggttcctagacctcaagtcaaaaggtggcaatgtaggctacggggagcccagcgatcaagcagatgtagttatgtcgatgaccaccgatgattttgtgaagatgttctctggtaagttgaaaccgacgatggcgttcatgagtggaaagcttaaaattaaggggaatatggctctggccattaagctggagaagttaatgaaccagatgaacgccaggttatag

SEQ ID NO: 22984 - DNA, 4026 bp, Artificial Sequence
  Description of Artificial Sequence: Synthetic coding sequence
atgtggcggcggaagcacccccggaccagcggcggcacccggggcgtcctcagcggcaatagaggtgtggaatatggttccggccgtgggcatctcggaaccttcgaaggtcgatggaggaaactgcctaaaatgcccgaagccgtaggaaccgatccaagtacctctaggaaaatggccgaattagaggaagtcactctggatggtaagccgttacaggcactacgcgtcacggatctcaaggccgccctggagcagcgtgggctcgcaaaatccggacagaagagcgccttagtgaagcggctgaaaggagcattgatgctggagaacttgcaaaagcattccacgccacacgcggcctttcaaccgaatagtcagatcggggaagaaatgagtcagaactcttttattaagcagtaccttgagaagcaacaggaacttttgcgtcagaggctggagcgagaagcccgcgaagctgcagaactagaggaagccagcgctgagtctgaggacgaaatgatccatccagagggcgtggcctccctcctgcctcctgactttcagagtagcctggaaaggccagaactcgagcttagtcgccatagcccccggaaatcatcctccatcagcgaggaaaagggcgatagcgatgatgaaaaaccccggaaaggagaaagaaggagctctcgggttagacaagctcgcgcagccaaactgtcagaggggtcacagcccgcggaggaggaagaggatcaggagacccctagtaggaacctgagggtgcgtgctgaccggaatcttaagactgaggaagaggaagaagaggaagaggaagaggaagaggatgacgaggaggaggagggtgacgacgaagggcagaaaagtcgtgaagcccccattcttaaagagtttaaagaggagggcgaggaaatcccacgggtgaagcctgaagagatgatggacgaaaggccaaagacgcgcagccaggagcaggaagtgttggagcgtggcggccgctttacacggagtcaggaagaagctagaaaatcacacctggcacggcaacagcaggagaaagagatgaagaccacttccccacttgaagaggaagaacgcgaaataaaatcctcccagggcttgaaggagaagagcaagagccccagcccccctagacttacagaagatcgcaaaaaggcctcactggtagccctgccagagcaaaccgcctcggaggaagagacacctcccccactgttgactaaggaagcctcctcgccgcccccccatcctcagcttcacagcgaagaggagatcgaacctatggagggtcctgctcccgccgtgctgattcaactctcccccccaaatacagatgccgacacacgggaattgctggtgagtcagcacactgtgcaactggtgggtggacttagtccactttcatcaccctccgataccaaggccgagtcccctgcagagaaagtgcctgaggagtcagttcttccgcttgtacagaagtccacattggccgactactccgcccagaaagaccttgaaccagaatctgatcgatcagcgcaacccctgcccctcaagatcgaggagcttgctttagcgaagggcattaccgaggaatgcctgaagcaacctagcctggaacaaaaagagggccggagagccagtcacactctcctgccaagccatcgcctgaaacaatccgctgatagttcatcttcaaggtcaagcagctcatcatcttcatcttccagatcccgcagccggtcccccgacagcagcgggtcccggtcccattctcccctgagaagcaaacagagagatgtcgctcaggcacggacgcatgccaacccaagaggcaggccaaaaatgggcagcaggtcgacctctgaaagcagaagtagaagccggtcgaggtctcgttcggccagcagtaactctagaaagtcactgtcaccgggggtttctcgggactccagtactagctatactgagaccaaagacccttcttcgggccaagaggtagcaacaccgcctgttccgcagctccaggtgtgcgagcccaaagaacggacatccacgagtagcagcagtgtccaggcaaggcgtctgtcccagcctgaaagcgctgagaaacatgtcacccagaggctccagcccgaacggggtagccctaagaagtgtgaggccgaagaggcagagccacctgcagccactcagcctcagacctcagaaacacagacctcgcatctgcctgagtctgaacggattcaccacacagtcgaggaaaaggaggaggtgactatggataccagcgagaacagacccgaaaatgacgtaccagaaccacctatgcctatcgccgatcaagtcagcaacgacgaccggccggaggggtccgtcgaagacgaagagaagaaagagagctcgctccctaagtctttcaagcgcaaaatcagtgtcgtgagcgcgacaaagggtgtccccgccggcaattcggacacagaaggaggtcaacctggccgtaagcgacgctggggcgcttccacagccaccacacagaaaaaaccgtcaatcagtattacaaccgagagcttaaagagcctgatcccagacatcaagcccctggctgggcaggaagctgttgttgatcttcacgctgacgattcaagaatctctgaagacgaaacagaacgcaatggcgatgacgggactcatgacaagggcctgaaaatatgccggacagtcacccaagttgtccctgcggagggccaagaaaacggacagcgcgaagaggaagaggaggagaaagaaccggaagctgagccccctgtcccgccacaggtgagcgtcgaagtcgcgctgccgccgccagccgaacatgaggtgaagaaagtcacactcggcgatacattgactcggaggtccatcagtcagcagaaatcgggggtcagtatcacaatcgatgacccagtgaggaccgcccaggttccgagtcccccacggggtaagataagcaatattgtacatatctcgaatctggtgcgaccgttcaccctggggcagcttaaggaactgctggggaggactggaacactcgttgaggaagctttctggattgacaagattaaaagccactgcttcgttacgtactcaacggtggaagaagcagtcgctactcgtacagcgcttcacggcgtgaagtggccgcaaagcaaccctaaattcctctgtgccgactacgcagagcaggacgaactggactatcatcgcggtctgctcgtcgacagaccttcagagacgaagactgaggaacaggggatcccacgcccgctccatccacccccaccccctcccgtgcagcctccccagcaccccagggccgagcagcgagaacaagaacgtgctgtccgggagcagtgggcggaacgtgagcgcgaaatggagcgacgggaaaggacacgctcggagcgcgaatgggaccgagataaagtacgggaggggccaagatctaggtctcgatctagggacaggcggagaaaggagcgtgctaaatccaaagaaaaaaagagtgagaagaaggagaaggcccaagaggaacccccagctaagctcttggacgatcttttccggaagacaaaggccgccccttgtatctactggcttcctctgacagattcccagatcgtccaaaaagaggccgagcgggcagagcgcgcaaaggagagagaaaagcgaagaaaagagcaggaggaagaggagcaaaaggaacgggaaaaagaggcagagcgcgagagaaacaggcagctagaacgggaaaaaaggcgggaacatagcagggagcgagacagagagagagagcgggaaagagaaagagaccgaggcgatcgagaccgggacagagaacgcgatagggagcgagggagggagcgcgacagacgggatacaaagaggcacagtagaagccgtagccgcagcacgccagttcgggaccgggggggaagacggtag

SEQ ID NO: 22985 - DNA, 600 bp, Artificial Sequence
  Description of Artificial Sequence: Synthetic coding sequence
atgagcagcggcaacgccaagatcggccaccccgcccccaacttcaaagctaccgctgttatgccagatggccaatttaaagacatttcactcagcgattataaaggtaaatatgtcgtatttttcttctaccccttggacttcactttcgtgtgtcctacagaaatcatcgcatttagtgaccgcgccgaagagtttaaaaaactgaattgccaggtgattggagcctctgtcgactcacacttctgtcacttggcctgggttaatacccctaagaaacagggcggtctcggtcccatgaatattcctttagtgtctgatcctaagcgaaccatcgcccaagactatggggtgttgaaagctgatgaaggcatttctttcagaggactctttataattgacgacaaggggattctgcggcagatcacagttaatgatctgcccgtgggccgttcagtcgacgagaccctgcggctggtgcaggcatttcagttcaccgacaagcacggcgaagtgtgtcctgccgggtggaagcctggaagcgataccataaagccagacgtgcagaagagcaaggaatactttagcaaacagaagtag

SEQ ID NO: 22986 - DNA, 1077 bp, Artificial Sequence
  Description of Artificial Sequence: Synthetic coding sequence
atggagaagaagaagatggtgacccagggcaaccaggagcccaccacaacccccgatgcaatggtgcagccgtttaccaccatcccattccctccccccccacagaacgggattcccacggagtacggggtcccccacactcaagactacgcaggacagactggggagcacaatctaaccctttatgggtctacacaggcccatggtgaacagagcagcaacagcccgtcaacacagaatgggtccttgaccaccgaaggcggggcgcagactgacggacagcagtcccaaacccaaagctcagaaaactccgagagtaagtctactccgaagaggctgcatgtaagcaatatcccctttaggtttcgagatcctgatctgcgccagatgttcggaggatttggatttgtgaccttcgagaattctgccgacgctgaccgcgcccgggagaagttgcatgggaccgtggttgagggcaggaagattgaagtgaataatgccactgccagagtgatgactaataaaaagatggtcactccatacgctaatgggtggaaacttagtccggtcgtgggcgcggtgtatggacccgaactgtatgcagcgagctcctttcaggccgatgtctccctggggaatgacgctgcagtacccctttcagggaggggagggatcaacacatacattcctctaatcattccaggcttcccttacccaaccgccgccaccacagctgccgctttcaggggcgcccacctacgggggaggggccgaactgtctatggcgcagttagggcagtaccccctacagccatacccgcctaccccggcgtggtataccaggatggattctatggtgccgacctgtatggaggctacgccgcctaccgatacgcacagcctgccacggctactgctgctacggccgcagcggccgccgccgctgcatatagtgatgggtacggaagggtgtatactgctgacccatatcacgcattagcccctgcagcctcttatggcgtgggagctgttgcgtccctttaccggggggggtactcccgattcgccccttactag

SEQ ID NO: 22987 - DNA, 1596 bp, Artificial Sequence
  Description of Artificial Sequence: Synthetic coding sequence
atgagctaccccgccgacgactacgagagcgaggccgcctacgacccttacgcgtacccttcagattacgacatgcatacaggcgacccaaagcaggatctagcctatgagcgacaatacgagcagcagacttatcaggtgatccctgaagtcatcaagaacttcattcagtacttccacaagaccgtgtctgatttgattgaccagaaagtgtacgaactccaagcatctagagtcagttccgacgtgatcgaccagaaggtgtatgaaattcaagatatttatgaaaacagctggacaaagctgaccgagagattcttcaagaatactccctggcccgaggctgaggctatcgcccctcaagtgggaaatgacgctgtcttcctcatattgtataagatccttcaggcccacggccccgctcccctggagttaccaaatcagtggctttgggatatcatcgatgagttcatttaccagtttcagtccttttcacagtacaggtgtaagacggctaagaaaagtgaggaggagatcgatttccttaggagcaatcccaagatttggaacgttcactctgtattgaatgttttgcattctctggttgataagagcaacattaaccgacagctggaagtctacacctcgggaggtgatcccgaatcagtagctggggagtatggacgccactccctgtacaagatgctgggctacttctctctggtgggactgctccggctccactcactgctgggagactactatcaggctattaaagtattggagaatatcgagttaaacaaaaagagtatgtactcgcgggtgccggagtgccaggtgactacatactattatgttggattcgcttacctgatgatgagacgctaccaggatgcaatccgggtgttcgccaatatactgctgtatatacaaaggacaaaaagtatgtttcagcgcacaacatacaagtatgagatgatcaacaaacaaaatgagcagatgcatgcattactagcgatcgccctgaccatgtatcccatgcgaattgacgaatctatccatctacagctgagggaaaagtacggggacaaaatgctcaggatgcagaagggcgatccacaggtctacgaggagctgttctcttacagttgccccaagttcttatcccccgtggttccaaactacgataacgtgcacccaaattatcataaggagccatttctgcaacagcttaaggttttctctgatgaggttcaacaacaggcccaactgagtactatcaggtcctttctgaagttgtacactacaatgcccgtggccaagctcgccggctttctagacctgacagagcaggagtttaggatacaactcttagtgttcaaacataagatgaaaaacttggtttggaccagcgggatatccgccctcgacggtgaatttcagtctgcttcagaagtggacttctacattgacaaagacatgattcacattgcagatacaaaggtggccagacggtatggagacttcttcattagacagatacacaagtttgaggaattaaacagaactctgaagaagatggggcagcggccatag

SEQ ID NO: 22988 - DNA, 5952 bp, Artificial Sequence
  Description of Artificial Sequence: Synthetic coding sequence
atgagcggcaacaagcggggcagccgggccagctgcccccaccggggcgcggagtgtttactaccttgggcagccctgaatctgcagggcttccaactgttgctcctccacccatcagccacagccatgatggacgtgtcagaattgggcgagtccgctagatacttaaggcagggatatcaagagatgaccaaagtgcacactattccttgggacggcaagaagagggtttgggtgcctgacgaacaggatgcctatgtagaggcagaagtgaagagcgaagccaccgggggccgggtaacagttgagaccaaagatcagaaggtgcttatggttcgggaggctgagctccaacccatgaatccacctaggttcgaccttcttgaagatatggccatgatgacgcatctgaacgaggcttctgtgctgcacaacttgcgccaacgatatgcccgatggatgatctatacgtacagtgggctgttctgtgtcaccattaacccttacaagtggcttcccgtctataccgcgagcgtggtcgccgcttataaaggtaaaaggagaagcgactctcccccccacatttacgccgttgctgacaacgcctataacgatatgcttagaaatagagataatcagtctatgctgattaccggggaatcaggtgcaggcaaaacggtaaataccaagagggtgatccagtacttcgcaatagtcgccgcattgggcgacggtccgggaaaaaaagcacagtttctggctaccaagacaggcggtactctggaagaccagattatcgaggctaaccccgccatggaagctttcgggaatgctaagactctccggaacgacaatagcagtcgcttcggtaagtttatccgcatccatttcgggcccagcggcaagctcgcgtcggccgatatcgacagctacctcctagagaagtcacgtgttatcttccagctgcccggcgaaaggagctatcacgtgtattaccaaattctgtccggacgtaaacccgagcttcaggatatgctactgctctccatgaatccttacgattatcatttttgctcccagggagttattaccgtcgataacatgaacgacggagaagagctcatcgcaacggatcatgccatggatattctcgggttttcagtagacgagaaatgtgcctgctataaaattgtgggagctctgctccattttgggaacatgaagttcaaacagaaacagcgggaagaacaggctgaagccgacggaactgagtctgctgataaagccgcatacctcatgggcgtatcatccggggacctcctgaaaggcttgttgcatcccagagtgagggtaggtaatgaatatgtgactaagggtcaaagcgttgagcaggttgtgttcgcggtgggggccttggcaaaagcaacatatgacagacttttccggtggttggtgagccgcattaaccagactttagataccaagctccctagacagtttttcatcggcgtcctcgatatagctggatttgaaatattcgagtttaatagttttgagcaactctgcatcaatttcaccaatgagaagctgcagcagttctttaatcagcacatgtttgtgctggaacaggaggaatacaaacgggagggcattgattgggtattcatagacttcggcttagatctgcagccttgcattgatctgatcgaaaagccgttaggaattttaagtatcctggaggaagaatgtatgttccctaaggcctcggacgctagcttcagggcaaaactttacgataatcacgccgggaagtccccaaacttccaacaacctcgacctgacaagaagagaaagtatcaggcacattttgaagttgtgcattatgccggagttgtcccctatagcatcgtgggttggctggaaaagaataaagaccctctgaacgaaacggtggtgccaatcttccagaagagtcagaatcggttgttggccacgctttacgaaaactacgctggcagctgtagcaccgaaccaccaaaatctggagtgaaggagaagagaaaaaaagccgcgtcctttcagacagtgagtcagttgcacaaggagaatcttaataaactcatgacgaatctgcgagccacccagcctcatttcgtgaggtgcattgtgccaaacgagaacaagacccccggagtgatggacgcgttcctggtgctgcaccaactgcggtgtaacggggtcctggaaggtattaggatatgcagacaggggtttccgaatcgcctactgtacacagacttccgacagcgatacagaatactcaatccctcagctatcccagacgacacctttatggatagcagaaaggccactgaaaagttgcttgggagtctggacttggaccacactcaataccagttcggtcatacgaaggtttttttcaaagcaggcttgttgggggttctggaagagctccgagaccaaaggctggcaaaggtgctcaccctcttacaagcccgttctcgcggccgccttatgcgccttgagtatcagagattgctgggcggtagggacgccttatttacaatccagtggaatatccgcgcgtttaacgctgtcaaaaactggtcctggatgaagttgtttttcaaaatgaagccactacttcgtagtgcacaggccgaagaggagctggccgccttgagagctgagttaaggggattgcgcggtgctctcgcagcggccgaggctaagaggcaggaactcgaggaaacccacgtgtcaatcacacaggagaagaacgacctggccctgcagcttcaggctgaacaggataatctcgctgacgcggaggagcgctgccacctgctgataaaaagcaaagtacagctggagggaaaagtgaaggagctgtccgagcgcctcgaggatgaagaggaagtgaacgccgaccttgctgcacgccggcgaaaactggaggacgagtgtaccgaattgaaaaaagatatcgatgatctcaaattgaccctggccaaagctgagaaggagaaacaggccacagagaacaaagtcaagaacctgactgaagagatggcggctctggatgagtctgtcgcccgcctcacaaaggagaagaaggccctacaggaggcccaccagcaggctctgggagatcttcaggctgaggaggatcgtgtgtcagctctgacaaaggctaagctgagactggagcagcaggtggaggacttggagtgcagcctggagcaggagaagaagcttaggatggacaccgaacgggccaaaaggaagctggagggcgacctgaagctgacccaggagtcagttgccgacgccgcccaggacaagcaacagttggaagaaaagctgaagaagaaggacagcgagcttagtcagctgagcttgagagtggaggacgagcagctgcttggcgcccagatgcagaagaaaattaaagaactgcaggcccgcgctgaggaattggaggaggagctcgaggctgaaagagctgcccgggctcgagtggaaaaacagcgagcagaggcagcccgtgagctggaggagcttagcgagcgactggaggaggctgggggcgcttctgccgggcagagggagggatgccgcaaaagggaggccgaactcggaaggctgcggcgggagctggaggaggccgctctacggcacgaggccactgttgccgccttacggcgcaaacaggccgagggcgcagctgaattgggcgagcaggtcgactccctgcagagggtgcggcagaagcttgagaaggaaaagtctgaactgcgaatggaggtcgacgatttggcagccaatgtggagactctcacccgcgccaaggctagcgcagaaaaattgtgtcgaacatatgaggatcagctttcagaggccaagataaaagtggaagaactacagcggcagttagcagacgcttctactcagcggggaaggctccaaaccgaatcgggcgagctctcaaggctgctggaggagaaagagtgcctaatttcacaactgtccaggggaaaagctctggcagctcagtcactggaggagttgaggcggcagctggaggaggagtctaaggctaagtctgctttggcccatgctgtgcaggctcttcgccacgactgcgacctgctgcgcgagcagcacgaggaggaggcagaggctcaggccgagttgcagcgcttgctgagtaaagctaacgctgaggtagcacagtggaggtctaagtacgaagccgatgcaattcaaagaaccgaggaactggaagaagccaagaagaagttagccctgcgactccaggaggccgaggaaggtgtcgaagcagccaacgcaaagtgttcaagtctggaaaaagccaaattaaggttgcagaccgagtccgaagatgtgacactggagcttgagagggccacttcggctgcagcggccctggacaaaaaacagcgacatcttgagcgcgcactggaggagaggcgcagacaggaggaagagatgcaacgggagctggaggccgcccagagagaatcccggggcctcggtacagagctgttcaggcttagacacgggcatgaggaagcactggaggcactcgagaccctcaaacgcgagaacaagaacttgcaggaggagattagtgatctgaccgaccaagtgagcctgagcggcaagagtatccaggagctggaaaagaccaaaaaagccctcgaaggcgaaaaaagtgagatccaggcggctcttgaagaggccgaaggtgccctggagctagaggagaccaagaccctgaggatacagctcgagttatcacaggtcaaagctgaagtagacagaaaactggcagagaaagacgaagaatgcgcgaacctcaggagaaatcatcagcgtgccgtggagagtctacaggcaagtctcgacgctgaaaccagggcccgaaatgaagccctccgactgaagaagaagatggagggtgacctgaatgatcttgagctccagctcggccacgccactcggcaagctaccgaggcacaggccgctactcgcttaatgcaggcacaactcaaggaagaacaggccgggagggatgaagagcagcggttggcagccgagcttcacgagcaggcacaggccctcgagcggcgggcttcgctactggccgccgaactcgaagaactgcgcgctgccttggagcaaggagagcgaagcagacgattagccgagcaagaactgcttgaggctacagaacggctgaatctgctccactcccagaacacgggcctgctgaatcaaaagaagaagctcgaggccgatttggcgcagttgagcggggaggtcgaggaagccgcccaggagaggagagaagcagaggaaaaagcaaaaaaggctatcacagatgcagctatgatggctgaagagctaaagaaggaacaggacacctctgctcacctggagagaatgaagaaaacccttgaacagaccgttagagaactgcaggcccgcctggaagaggccgaacaggctgcacttagagggggaaagaagcaagtgcaaaagctggaggccaaagttcgggagctggaagccgagttagatgcagaacagaaaaaacacgcagaagccctcaaaggcgtgagaaaacatgagcgccgcgttaaagagctggcttatcaggccgaggaggatcgaaagaacctcgctcgtatgcaagatctggttgacaagttgcagtctaaggtgaagagctataagaggcagttcgaggaagcagagcaacaggccaacacaaatctggccaagtataggaaggctcagcatgagttagacgatgctgaggagcgagctgatatggctgagacacaggccaacaaactacgtgcccgcactagggacgccctgggtccaaaacataaggagtag

SEQ ID NO: 22989 - DNA, 2730 bp, Artificial Sequence
  Description of Artificial Sequence: Synthetic coding sequence
atggagcgggccatggagcagctgaaccggctgacccggagcctgcgcagggctcggacagttgagctgcccgaggacaacgagaccgcagtctataccctgatgcccatggtgatggccgaccaacacaggagtgtaagcgagctgttaagcaactctaagttcgacgtgaattacgcgttcggccgcgtgaagcggtctctcctgcacattgcagcaaactgtggctctgtagagtgccttgtcctcctgctgaaaaagggtgcgaacccgaactaccaagacataagcggttgtaccccactgcatctggccgcgagaaatggacagaagaagtgtatgtcaaagttattagagtattcagctgatgttaacatttgcaacaacgaggggttgacagcaatccactggttagcggttaatgggcggaccgagctccttcacgatctagtacaacacgttagcgatgtggacgtggaggacgccatgggtcaaacggccctgcacgttgcatgccaaaatgggcataaaactaccgtgcaatgtctgctcgacagtggcgcagatataaacaggcccaatgtcagtggagcaactcctctctatttcgcgtgttctcacggccagcgggacactgctcagatactcctcctccgtggagccaaatatctccctgataaaaacggggtcactccgttagatctctgtgttcagggtgggtatggagagacttgcgaggtcttgatccagtatcatcctcggttgtttcagaccataattcaaatgacgcagaacgaagacctaagagaaaatatgctccgccaagtcctcgagcacctgtctcagcaatccgaatcccaatatctaaaaatattgaccagtctggcagaggtggctacaaccaatggccacaagttacttagcctttcgagtaattacgacgctcaaatgaagtccctactaagaatcgtgaggatgttctgccacgtttttcgtattggtccatccagcccctcaaatggcattgacatggggtacaatggaaacaagacacctaggtcccaagtgttcaagcctctggaactactgtggcactccttggacgaatggctggtactgatcgcgacggaacttatgaagaataagagagatagtacagagataacttcaattctgctgaagcagaagggccaggaccaagacgcagcttccatccctcccttcgagccacctggacccgggagctacgagaatctttcaactggcacccgcgagtccaaacctgatgcccttgccggccgacaggaggccagcgcagactgtcaggatgttatcagcatgaccgctaaccggctcagcgcggttatacaggctttttacatgtgttgttcatgtcaaatgcccccaggaatgacaagtccaagatttatagaatttgtgtgcaaacacgacgaggttctgaagtgctttgtgaatagaaatcctaaaattatctttgatcacttccattttctgctggaatgtccagagcttatgtctagattcatgcacattattaaggcccaaccctttaaggaccggtgtgaatggttttacgaacatcttcactccgggcagccagactcagatatggtccaccgccctgtgaatgagaacgatattttactcgtgcatagggactccatctttcgatcctcatgtgaggtagtgtccaaagcaaattgcgctaaactgaaacagggcatcgccgttcggtttcacggggaagaaggcatgggacaaggggtggtgagagaatggttcgacatactgtctaatgaaattgtgaatcctgactacgccttatttacacagtccgccgacggcaccacattccagccaaacagcaattcatatgttaacccagaccaccttaactatttccgcttcgcaggccagatcctaggactggctttgaaccaccggcagctggtgaatatatactttacacggagcttctacaagcacattctcggaatcccagtgaattaccaggatgtggcctccattgaccctgaatatgctaagaacttgcagtggatcctggacaacgatataagtgacctgggattggagctgacattctctgtggagacagacgtgttcggtgcaatggaggaggtgcctcttaaaccaggaggcgggtctattcttgtgacacaaaacaataaagccgaatacgtccaactagttaccgagctgcgcatgactcgtgccatccagcctcagataaacgcttttttgcaggggttccacatgttcattcccccttccctgatccaacttttcgatgagtatgagctggagctcctgctctcaggtatgcctgagatcgacgtgagcgattggataaaaaataccgagtacacaagtggttacgagcgtgaagaccctgttattcagtggttctgggaggtggttgaagacatcacgcaggaagagcgtgtgcttctgctgcagttcgtcaccgggagtagccgggtgccgcatggcggatttgcaaatattatgggaggtagcggcctgcagaactttacgattgctgctgtgccatacacccccaaccttttacctaccagctccacatgcatcaatatgttgaagttacctgaatacccatctaaagagatcctgaaggataggttgctggttgctctccattgcggcagttacggatacactatggcatag

SEQ ID NO: 22990 - DNA, 2679 bp, Artificial Sequence
  Description of Artificial Sequence: Synthetic coding sequence
atgcggaaggtgaagaagctgcggctggacaaggagaacaccggctcgtggcgcagttttagtctgaactcagaaggggctgagcgcatggccaccacaggaacaccgacagccgataggggggacgccgccgccaccgacgaccctgctgcgcgattccaggtgcagaagcacagctgggatgggttacgcagtataatccacggaagtagaaaatactcaggcctgattgttaacaaggctccccacgatttccaattcgtgcagaagacagacgaatctggcccacactcccaccgcctgtattatctagggatgccttatggatcccgggagaatagtttgctgtacagcgagattcctaaaaaggtgagaaaggaagcactgctcctcctctcttggaagcagatgctcgaccactttcaggctaccccccatcatggtgtgtactcacgagaagaggaactgctgcgggaacgcaagagactcggcgtatttggcattacgagctacgacttccatagtgaaagcggactgtttctctttcaggctagcaattccctctttcactgtcgggatggggggaagaatgggttcatggtgtctcccatgaagccactcgaaattaaaacccagtgcagtgggcctagaatggaccccaagatttgccctgccgaccctgcatttttcagctttattaacaactctgatttatgggtggccaatatagagactggcgaagagcggcgcctcactttttgccatcaaggactgtctaatgtgctggacgaccccaaaagcgctggagttgcgacatttgtgatccaggaggagttcgaccgcttcacgggttactggtggtgcccaaccgcttcctgggaaggtagcgagggcctcaaaaccttgcggattctgtacgaggaagtggatgagtccgaggttgaagtcatccacgtgcctagccccgctctcgaggagagaaagaccgattcctatcgttatccaaggacaggttcaaaaaaccccaaaatcgctttaaaactcgccgaattccagacggattctcagggtaagatagtgagtacgcaggaaaaagagctggtgcagccattttcaagtctgttccccaaagtggagtatatcgctcgagccggctggacgcgagacggaaagtacgcgtgggctatgttcctggacagaccacagcagtggctccagttggtgctactaccccctgctctttttattccatccaccgagaacgaggaacaaaggttggcatccgcccgagccgtgccccggaatgtgcagccttatgtggtatatgaagaggttactaatgtgtggatcaatgtccatgacatcttctacccctttccacaaagcgagggggaggatgagctatgctttctgagggctaacgagtgtaagacggggttctgtcatttatataaggtgaccgccgtcctgaagtcacagggttatgattggtctgagccattttcacccggcgaggatgagttcaagtgcccgataaaggaagagattgccctgacctcaggcgagtgggaagtgcttgcccgtcacggctcgaagatatgggtaaacgaggaaacaaaactggtctattttcagggcaccaaggatacaccactggagcaccatctgtacgtagttagctacgaggctgccggtgaaatagtcaggttgacaaccccaggcttttcccactcctgctccatgtcccagaattttgacatgttcgttagtcattactcaagcgtttcaacacctccttgtgtccatgtgtataagttgagcggaccagatgatgatccactccacaagcaacccaggttttgggcaagcatgatggaggcagcctcttgtccccctgactacgtcccgccagagatttttcattttcatacaagatctgacgtgcgcttgtacggaatgatttacaaaccacacgccctacagcctggcaagaaacaccccacggtcctgtttgtctacgggggaccacaggtgcagttggtaaataattccttcaagggcatcaagtacctccgccttaacaccttggcctcgttgggttacgcggttgtggtcatcgacggacgggggtcatgccagaggggcctgagatttgaaggcgctctcaagaatcagatggggcaagtagagatcgaggatcaggtggaggggctgcaattcgtggccgagaaatacggtttcattgatctctccagggtggccatccacggctggtcctacggagggtttcttagtctgatgggattaatccataagcctcaggtatttaaggttgccattgcgggcgcacctgtgaccgtgtggatggcgtacgacactggttacactgagaggtatatggatgtgcccgaaaataatcagcacggctacgaagccggctctgtcgccttacatgtggaaaaactgccaaatgagcccaacaggctgctcatccttcatggatttttagacgagaacgtgcatttcttccataccaacttcctggtctctcagctcatccgtgccggaaagccatatcagttgcaaatctatccaaacgagcgacactccatccgctgcccggaaagtggagaacactacgaagtgacactgctgcactttctgcaggagtatctttag

SEQ ID NO: 22991 - DNA, 1533 bp, Artificial Sequence
  Description of Artificial Sequence: Synthetic coding sequence
atggccgccgagctggtggaggccaagaacatggtgatgagcttccgagtgtcagacctgcaaatgctccttggctttgtcgggaggagcaagtcaggtcttaaacacgaactggtgacccgtgccctgcagctggtgcagtttgattgctctcctgaactctttaaaaagataaaagaattgtacgaaaccaggtacgctaaaaaaaacagcgagcccgccccacagcctcatcgtccactggaccctctgaccatgcacagcacatatgatagggccggagccgtgcccagaaccccactggcaggtccaaacattgactatcctgttttatatggcaagtacctaaacggccttggcagactccccgcgaaaaccttgaagcccgaggtaagactggtgaagttgccgtttttcaatatgctcgacgagctactaaagcctaccgaactggtgccacaaaacaacgagaagctgcaggagtcaccatgtatttttgcgttgacaccacggcaggtcgagctcatacgtaactctcgggagctccaaccaggagtgaaggcggtccaggtggtgctgcggatctgttattcagatacttcctgcccccaggaagatcagtatcccccaaacattgccgtcaaagtgaaccattcgtactgttccgtgcccggatattatccatccaataaacccggggtagagccgaagcggccctgcagacccattaacttaactcatctgatgtatctgagttccgcaaccaacagaatcaccgtgacgtggggaaattatggtaaatcctacagcgttgccctgtatctcgtccgccagctgacgtcttccgagctgcttcaacgactgaagactattggggtcaaacatccagagctgtgcaaggctcttgtgaaagaaaagcttcgccttgaccccgactccgaaatcgccacaacgggggtgcgagtgagtctgatttgccccttggtgaagatgcggttatccgtcccatgtagagccgaaacctgtgcccaccttcagtgctttgatgcagtcttctatctacaaatgaatgagaagaaacccacttggatgtgcccagtttgcgacaagcccgcaccctacgaccaacttattatagatggactcctgtcgaaaatcctgagcgagtgcgaggatgctgacgagatcgaatatctggtcgatggttcctggtgcccaatccgtgcagaaaaggagcggagttgctcccctcagggggcaatcctcgtgctgggcccgtccgatgctaatggcctcctcccggcacctagtgttaacggctctggtgccctcggttctacaggcggcgggggcccagtcggttcaatggaaaacggcaaacccggcgcggacgttgttgatctcaccctcgatagctccagctcaagtgaggatgaagaagaggaggaagaggaggaggaggatgaggacgaggagggacctcgccctaaacgcaggtgtccattccagaagggcttggtccccgcttgctag

SEQ ID NO: 22992 - DNA, 684 bp, Artificial Sequence
  Description of Artificial Sequence: Synthetic coding sequence
atggccgcccagcggcccctgcgggtgctgtgcctggccggcttcaggcagtccgagaggggattcagggagaagaccggcgccctgcgaaaggccctgcgcggcagggcggaactagtttgtttgtccggcccccatcctgtgccagaccccccaggacccgaaggggccaggtccgatttcggttcctgcccaccggaggaacaacccaggggctggtggttttccgagcaggaggcagatgtcttctcagcgctcgaggagcctgccgtgtgccggggactggaagagtcactgggaatggtggcccaggcacttaaccggctgggccccttcgacggactacttggattcagtcagggtgccgcactcgccgccctggtgtgtgccctggggcaggcgggggaccctcggtttcccttgccccggttcatcctcctggtcagcggtttttgtccacgaggcatcgggtttaaagagtctattctgcagcgcccactgtcgctacctagtctgcacgtgttcggagatacagataaggtcatcccatcccaggaaagcgtccagttggcctctcaattcccaggggcaataacattgacacattctggcggccactttatccctgccgctgcccctcagagacaggcttacctgaagttcctggatcagtttgcggagtag

SEQ ID NO: 22993 - DNA, 1656 bp, Artificial Sequence
  Description of Artificial Sequence: Synthetic coding sequence
atggaggaggccgagctggtgaagggccggctgcaggccatcaccgacaaaaggaaaatacaggaagagatttcccagaaaagacttaagattgaggaggacaagctgaaacaccagcacctgaagaagaaggcccttcgggaaaagtggctgttggacgggatatcgtccgggaaggaacaggaggaaatgaagaagcaaaaccagcaagatcagcaccagattcaggtgctggagcagtctatcctccgtttagaaaaggagattcaagacttggaaaaggcagaacttcagatttccacaaaggaggaggccatcctcaagaaactgaagtccattgaaagaacgaccgaagacattattcggtcggttaaagtggagcgagaggagcgcgccgaagagagcatcgaggatatctatgcaaacatccctgacttgccaaaatcttatatcccaagtcgcttgagaaaagagattaatgaagagaaagaagatgacgagcagaatcgcaaggccctttacgcaatggagatcaaggtggaaaaggacctaaagacgggggagagcaccgttctctccagtatccctctgccttctgatgactttaagggtacaggaattaaagtgtatgacgacgggcagaagagtgtgtacgccgtgtcatccaatcactctgctgcatacaatgggacagacggactggcccctgtcgaagtagaagaactgcttaggcaggcctccgagcggaattccaagtcaccgacagaatatcacgagcccgtctacgcaaacccattttacaggcctacaactccacaaagagagaccgtgaccccggggcctaacttccaagagaggatcaagatcaagacaaatggcctaggtatcggagtaaacgaatctatccacaacatgggcaatggcctgtctgaagaacgaggaaacaatttcaatcacatatcccctatcccaccagtgccccatccgcggtctgtgatacaacaagcagaagagaaactgcatacaccccaaaagcgactgatgaccccttgggaggagtccaatgtgatgcaggataaagacgcgccttccccgaagccacggctctccccccgcgaaactatctttggaaaaagcgaacaccaaaactcctctccaacctgtcaagaagatgaggaggatgtgcgctacaacatcgtgcatagcttgccccctgatattaacgatacagagccggtgaccatgatctttatggggtaccaacaggccgaagatagcgaagaggacaaaaagttccttacagggtatgatggcatcattcacgccgagcttgtggtgattgacgatgaggaggaggaggatgaaggcgaggcagaaaaaccctcctaccaccccatcgcaccacattcacaggtataccaacccgcaaagcctacccctctccctcggaaacggtctgaagctagtcctcacgagaatactaaccacaaaagcccgcataagaatagtatttccttaaaggagcaggaggagtcacttggttcccccgtgcaccactcaccctttgatgctcagacaaccggcgatggtaccgaagacccgtctcttaccgcactcagaatgcgcatggcaaaactggggaagaaagtgatttag

SEQ ID NO: 22994 - DNA, 1701 bp, Artificial Sequence
  Description of Artificial Sequence: Synthetic coding sequence
atgttcgtgagcgacttccggaaggagttctacgaggtggtgcagagccagcgagtgttactgtttgtcgcctccgacgttgacgccctctgcgcctgtaagatactgcaagctcttttccagtgcgaccatgtgcagtatacgctcgtccccgtgtccggatggcaggagctggagactgccttccttgagcacaaggagcagttccattactttatcctcattaattgtggtgccaatgtggatctcctggacatcctacaacccgatgaggacacgatcttcttcgtctgcgacacacacaggcctgtcaacgtcgtgaatgtgtacaacgacacccagattaaattgctgatcaaacaagacgatgacctggaggtccccgcctacgaggatatctttagagacgaagaagaggacgaggagcactcgggaaacgactccgacggttccgaaccctctgagaagcggacgcggctggaagaggaaatcgtggaacagaccatgagacgccgccagaggcgggagtgggaagccagaagacgcgatatcttgtttgactacgaacagtatgaataccacggcactagttccgcaatggtgatgttcgagcttgcctggatgctgtctaaagacctaaatgatatgttgtggtgggccattgtggggcttaccgatcagtgggttcaggataaaatcacacagatgaagtacgtgaccgacgtgggcgttctccaacgccacgttagtcggcacaaccaccgtaatgaagacgaagagaacactctgtcggttgattgcactagaatttccttcgagtacgatctgcgacttgtgctctatcagcattggagcttgcatgattctctatgtaatacaagctacactgccgctagatttaagttgtggtcagtgcacggccaaaagaggctccaagaattcttggctgacatgggcctgcctctgaagcaggtgaagcaaaagtttcaagccatggatatcagtctgaaagaaaacttaagggagatgatagaggaaagtgccaacaaattcggcatgaaagacatgagagtgcagacattcagcattcacttcgggtttaaacataaattcctggcgagcgacgtcgtctttgccaccatgtcattgatggagtcacccgaaaaagacgggagtggaactgatcacttcattcaggccttggacagcctatcaagatcaaatctggataaactctatcatggtcttgagctcgccaagaaacagcttagggcgactcagcagactattgcatcttgcctgtgcacaaatctagtcatcagtcagggacctttcctttactgtagcttgatggaaggtacacccgatgtaatgctgttttctaggccagcttcactatcgttactatccaagcatctgttgaagagtttcgtgtgttccaccaagaatcggcggtgcaagctgctgcccctggtcatggcagctcctcttagtatggagcacgggaccgtgactgttgtgggaattccgcctgagaccgacagttccgatagaaagaatttcttcggacgcgcattcgaaaaagccgctgagtcgacatctagcaggatgctccataatcacttcgacttgagcgtcatagaactcaaggctgaggacaggagcaaattcctcgatgccttgatcagccttctgtcctag

SEQ ID NO: 22995 - DNA, 1461 bp, Artificial Sequence
  Description of Artificial Sequence: Synthetic coding sequence
atgagcgtgacctacgacgacagcgtgggcgtggaggtgagcagcgactcattctgggaggtggggaactacaagagaaccgtcaaaaggatcgatgacggccacaggctgtgtagtgatctgatgaactgccttcatgagcgggcgcgcattgagaaggcatatgcccaacaactgaccgaatgggcaagaaggtggaggcagctggtcgaaaaaggaccacagtacggaactgtggagaaggcttggatggcttttatgtcagaggctgagcgagtctctgaacttcatcttgaagtcaaagccagcctaatgaacgatgactttgagaaaatcaaaaactggcagaaggaagcctttcacaagcagatgatggggggttttaaggaaaccaaggaagctgaagacggctttaggaaagcgcagaagccgtgggctaagaagctgaaggaggtagaggctgcaaagaaagcccaccatgcagcctgcaaggaggagaagctcgccatctctagagaagcgaacagcaaagcggaccccagtctgaaccctgagcagcttaaaaaactgcaagacaagattgaaaagtgcaagcaggacgtattaaaaaccaaagagaaatacgaaaagtcgttaaaggagttggatcagggcaccccccagtatatggagaacatggagcaggtgtttgaacagtgccagcagttcgaggaaaagcgtctgagatttttcagagaggttctcctcgaggtacagaagcacttggatctttccaacgtggctggttacaaggctatctatcatgacctcgagcagtcgataagggcagctgacgctgtggaggacttgagatggttccgggccaaccacggacccggtatggccatgaattggccccagtttgaagagtggtcagcagacctgaatcgaaccctgtcccgccgggagaaaaaaaaggccactgatggcgtcacgctcacagggataaatcagacaggggaccaaagtctgccttctaagccttctagcactctaaatgtcccatccaatcctgcgcaatctgcccaatcccagtcatcatataatcccttcgaagatgaggatgacaccggtagcacagtttcggaaaaggacgatactaaggctaaaaacgtaagttcgtacgagaaaactcagtcttacccaaccgactggagcgatgacgaaagcaataatcctttcagcagcacagatgctaatggagacagcaatccatttgacgatgatgccacaagcggcactgaggtaagggtgagggccctatatgattatgagggtcaggaacacgatgaattatcttttaaagctggtgacgagctcaccaagatggaagacgaagacgagcaagggtggtgtaagggccgtctggataacggccaagtaggcctgtacccagcgaactatgtggaggccattcagtag

SEQ ID NO: 22996 - DNA, 2262 bp, Artificial Sequence
  Description of Artificial Sequence: Synthetic coding sequence
atgatggaggagcgggccgccgccgccgtggccgccgccgccagctcatgtaggccactgggctcaggggctggacccggtcccaccggggcggcccccgtcagtgctcccgccccggggccggggccggcgggaaaggggggtggtggaggtggctcacctggacctaccgcagggccagagcctctttccctaccaggcattttgcacttcatccaacacgagtgggcgcgttttgaggcagagaaggcccggtgggaagctgagcgtgctgaactccaggctcaggtggcgttcttgcagggcgaaaggaaaggacaggaaaacctgaaaactgacctggtgcgaagaattaagatgctggagtacgctctcaaacaggaaagggccaagtaccacaagctgaagttcgggacagacttgaaccaaggtgagaagaaggctgatgtgtccgagcaggtgtctaatggccccgtcgaatccgtgacactcgaaaattcacccctcgtctggaaggaaggaaggcagctgctgcgccagtaccttgaggaagtcggttataccgataccatactcgatatgcgctctaaaagggtcagaagtctcctgggaagatccctagaactcaacggtgcagtggagccctccgagggcgccccaagggctccccctgggccagccggcctgagtggcggcgagagtctgctcgtcaagcagatagaagagcagataaagagaaatgccgctgggaaggacggcaaagagcggctcggaggctccgtactgggccagatccctttcctccagaattgcgaggatgaggatagtgatgaggatgacgagctggattccgtccagcacaagaagcagagagtgaagttgccttcgaaggccctcgtgcccgaaatggaagacgaagatgaagaagacgactcagaagacgctatcaatgaatttgactttcttggctctggagaggatggggagggggctcccgacccaaggcgctgtactgtagacgggtcacctcatgagttggagtcacgacgtgtaaaactgcagggtatcctcgccgacttgcgggacgtggacggtctgcctcctaaggtaacaggtccgccaccgggtacaccccagccacgtccacatgaagacgtgttcataatggatactatcgggggaggagaagttagtctgggggatcttgcagatctcactgtgaccaatgataacgaccttagctgtgatctgagtgacagcaaagacgctttcaagaagacctggaaccccaagttcaccctgaggtcccactacgacggaatccgatcactggcctttcaccacagccagagcgcgctgctgacagccagcgaggatggcacgctgaagttgtggaacctgcagaaggcagtcacagccaaaaagaacgctgctctggatgtggaacccattcacgccttcagagcgcacagggggcccgtgttggccgttgcaatgggatcaaactccgagtactgttacagcggtggtgccgacgcttgtatccactcttggaagatccccgatctgtcgatggatccttacgacggatatgatcctagtgtgttgtctcacgtccttgaaggccatggtgatgccgtgtggggcctagcctttagcccaacctcacaacgtctcgcttcctgcagcgctgacggcacagtgcggatttgggacccatcttccagttcaccagcctgtttgtgtactttcccgacagcctcggaacacggcgttcctacgtcggttgccttcacgtctactgagcctgctcacatagtggcttcctttaggtccggcgacacggtcctttacgatatggaggtgggaagcgcactgcttactctcgaatctcgaggcagcagtggacccacccaaatcaaccaggtggtctcccaccctaaccagccacttacgataacagctcatgatgacagaggcattaggttcctggataaccgcactggtaagccggtgcattctatggttgcccatctggacgctgtgacctgtcttgctgtggacccaaatggggcattcctgatgagtggaagccacgattgttcgctgcgcctgtggtcactcgacaacaaaacttgcgtccaggagataaccgcccatcggaaaaagcatgaagaagcaatccatgccgtcgcatgtcatcccagcaaagcgctcatagcgtcagcgggtgccgatgccctcgccaaagtttttgtgtag

SEQ ID NO: 22997 - DNA, 1596 bp, Artificial Sequence
  Description of Artificial Sequence: Synthetic coding sequence
atgcggatgcacacccggctgagcctgcccggccccccccaccacgtgggtgcggcttatccacctgctggcggaaatcgaagcgaaaacgcaggctcttggggaggagcgggagcctcgagcgtcgagcctttggccaggagggtcgccagcggcgaagccaccttagccatggaccagcctgctggactgcaggtcgattatgtgttccggggggtcgaacatgcagtaagggttatggtgtcaggccaggtgctggagcttgaagtcgaggaccggatgaccgctgatcaatggcggggggagttcgatgccggctttatcgaggacttgacacacaaaacaggtaactttaaacagttcaacattttttgccacatgctggaaagcgctttaacccagagctccgaatctgtgacattggacctcctcacatacacagacttggagagtttaagaaatcgcaaaatgggaggtcggcccgggagcttagcaccccggtccgcccagctaaacagtaaacgttacctaatcctcatctatagcgtggagtttgatagaattcactaccccttgcccctcccttaccagggaaaacccgaccccgtggtcttgcagggtataataagatcactgaaggaagagctcgggcgtttgcaggggctggacggacaaaacactagggacacacgggagaatgagatctggcacctccgtgaacaggtctcacgactggcttcggagaaaagggagctcgaagcgcagttggggcggtcccgggaagaggccctcgccggccgagctgcccgtcaagaagctgaagccctcaggggacttgtacgcggtctcgagctggagctgaggcaagagcgtggcctgggacatcgagtggcaggaagacgagggcaagactgccgccggctcgctaaagagctggaagaggccaaggcgagcgaacggtctctccgtgccaggcttaagactcttactagcgagctagcgttgtacaagcgtgggggtcgaggttcccgcgggagagggaggcccgctcgcccaagcccaagtccaaccgggggacgggctctgcggttcgaccccactgccttcgttaaggcaaaagaacgaaaacagcgggaaatccagatgaaacagcagcagcgcaataggttaggtagcggtggatccggcgatggtccgtccgtctcatggtctagacaaacacagccgccggccgccctcacaggccgaggtgacgcccccaaccgctctaggaacaggagctcttctgtagactcgtttaggtctagatgctcatccgccagcagctgctctgacttggaagactttagtgagtctttaagccgaggcgggcacagacggaggggaaaaccaccctctcctactccatggtcggggagtaacatgaaatcgcctccagtggagaggtctcatcaccagaagtccttggcgaatagcgggggttgggtaccaatcaaagagtactcatctgaacatcaggccgcagacatggctgaaattgatgctcgcctgaaagctctgcaggagtatatgaatcggttagatatgcggagctag

SEQ ID NO: 22998 - DNA, 1452 bp, Artificial Sequence
  Description of Artificial Sequence: Synthetic coding sequence
atggccagcctgctgtggggcggcgacgccggcgccgccgagagcgagcgcctaaacagccactttagcaacctttcacagcctcggaagaacctatggggcatcaaatctactgccgtccgtaacattgacgggagcatcaataacataaacgaggatgacgaggaagacgtggtggaccttgcagccaacagtttgttgaataagctcattcaccagtccctcgtggagagctctcacagagtagaggttctgcagaaagacccctcgtcacccttgtacagcgtaaaaacctttgaagagctgagactgaaggaggagttactaaagggaatttatgcaatgggcttcaataggccgtctaaaatccaggagatggcacttcctatgatgcttgcccacccacctcagaatctcatcgcacagtcacagtctggaacaggaaagaccgctgcgttcgtgttggctatgctctccagagtgaacgctcttgaacttttccctcagtgtttatgcctcgcacccacctatgagcttgcactgcaaaccggtcgcgtggtcgagcagatgggtaagttttgcgtggacgtgcaggttatgtatgccataagaggaaaccgtatacccagagggacagatataaccaagcagattataatcggtacaccaggcacggtcttggattggtgttttaagctaaagctgatcgacttgactaagatccgtgtcttcgtcctcgatgaggcagacgtgatgattgatacccaaggattctccgatcattctatcaggatccagagggccctgcctagcgagtgccagatgctgcttttttctgccacatttgaagacagtgtttggcatttcgccgaaaggatcattcccgatccaaatgtgataaagcttcggaaggaggaactgactctcaataacattcggcaatactacgtgctttgcgagcatcgcaaggacaagtaccaggccctatgcaatatctatgggagtatcactattggacaggcgatcatattctgtcaaactagacgcaatgccaagtggttaacagtggagatgattcaggacggacaccaggtgagcttgctcagcggtgagctcactgtagagcaacgggcaagcatcatacagcggtttagagatggaaaagaaaaagtgctgattacgaccaatgtctgcgcacgtgggatagacgtgaagcaagtgacaattgtcgtgaatttcgacttgcctgtcaagcaaggcgaggaacctgattacgagacctacttgcatagaattggtaggactggaagattcggaaagaaaggcttggcattcaacatgatagaagtggatgaactgccctctctcatgaaaatccaggaccactttaatagctccatcaagcagctgaatgcagaggatatggatgaaatagagaagattgactattag

SEQ ID NO: 22999 - DNA, 1014 bp, Artificial Sequence
  Description of Artificial Sequence: Synthetic coding sequence
atggccgacgccgccccccagctgggcaagcggaagcgggagctggacgtggaagaggcacatgccgcgagtactgaagaaaaggaggctggggtgggcaacgggacatgcgcccctgtgagactcccgttctctggttttcggctccaaaaggtgctgagggagagcgcccgggataagattatattcttgcacggtaaagttaacgaggcaagcggagacggagatggcgaagacgccgtcgtaatcctggaaaagactccattccaagtggagcaggtggctcaacttctgaccggatcccctgagctccagctgcagttttcgaacgatatttactcaacttaccatttgtttccaccccgccagttgaatgacgtaaagacaactgtcgtgtatcctgctacagaaaagcacttacagaaatacctccggcaggatctcagactgatccgcgaaaccggggacgattaccggaacatcacactcccacacctggagagtcaaagcctctctatacagtgggtgtataatattctggataagaaagccgaagctgacagaatcgtttttgaaaatcccgacccgagcgatggattcgtccttattccggacctcaagtggaaccaacaacagcttgatgacctgtatcttattgccatctgccatcgtaggggcatcagatccctgcgagacctgacacccgaacacttgccattattgagaaatattttacatcagggtcaggaagcaatcctgcagcggtacaggatgaaaggagatcaccttcgggtctatctgcattatctgccatcttactaccatctccacgtccactttactgccctggggtttgaagcccctgggtcgggggttgaacgagcacatctgcttgctgaagtgatagagaaccttgaatgcgatccccggcactatcaacagaggactctcacctttgcccttagggcagacgatccactcctgaaactgctacaggaagcacagcagtcttag

SEQ ID NO: 23000 - DNA, 1782 bp, Artificial Sequence
  Description of Artificial Sequence: Synthetic coding sequence
atgaagctgcaggccgtgatggagaccctgctgcagcggcagcagagagcgagacaggagctcgaagcccgccagcagctgcctcccgaccctcccgctgctccacccggccgtgcccgagcagctcctgatgaagacagggagcccgagtccgcaaggatgcaaagagcccagatggcagcccttgcagccatgagagcggccgctgcaggcctggggcaccccgcgagtccaggaggatctgaagacggtccccctggtagtgaggaagaagatgcagctagggagggtaccccaggatcccctggtagggggcgagaaggccccggcgaggaacacttcgaggatatggccagcgatgaggatatgaagcccaaatgggaggaagaggagatggaagaggacttgggcgaggatgaggaggaagaggaagaagactacgaggacgaggaggaagaggaagacgaagagggcctaggaccacccggccccgcaagtctgggcactacagcgctgttcccccggaaagcccagcccccccaagctttccgaggggatggggtgccgcgggtgttgggaggccaggaacgccctggtccgggacctgctcaccctggcggtgccgctcatgtcgctcctcagctccagcccccagatcacggcgactggacatatgaggaacaattcaaacagctgtacgaactggacggagaccctaaaaggaaagagtttttggatgatctgttctcgttcatgcagaaaagagggaccccagtaaaccggatacccattatggccaaacaggttcttgaccttttcatgctgtacgtgctcgtcactgaaaagggaggtctggtagaggtgattaacaaaaagttgtggagggagataacaaaagggctcaatctccccacttccataacaagcgccgcctttactctgcgaacccagtatatgaagtacttgtacccttacgagtgcgaaaaaaggggactttctaatccaaacgagctccaggcggccatcgactcaaatagacgggagggtcggaggcaaagcttcggtgggtctcttttcgcctactcccctggaggggctcacggaatgctgtcctccccaaagctgcccgtttcgtccctgggactcgccgctagtactaacgggtcctctatcacacccgccccgaagatcaagaaagaggaggatagcgcgattccaataacggttcccggccgcctgcctgtgtctctcgccgggcaccccgtagttgcagctcaagcagcagctgtccaggctgccgcagctcaggctgccgtggccgcacaggccgctgctctcgagcagctccgcgaaaagctcgaatctgcagagccccctgagaaaaagatggccctggtggcagatgagcagcagcgcctaatgcagcgggccctccaacagaattttttggctatggccgcccagttgcctatgtcaatcaggatcaacagccaagcatcagaaagccgccaggatagcgctgtgaatctgactggaaccaacggctctaactctataagtatgagtgtggaaatcaacggaataatgtacacaggcgtcctattcgctcagccgcctgcaccaactcccacctctgccccgaataaaggtggaggcgggggaggtgggtcgtcatcaaacgctggcgggcgcggcgggaacacaggaacatccggaggtcaagccggacccgccggcctttcaaccccttccactagcacctctaataatagccttccctag

SEQ ID NO: 23001 - DNA, 6192 bp, Artificial Sequence
  Description of Artificial Sequence: Synthetic coding sequence
atggccgacggcgccccccggccccagctgtaccggagcgtgagcttcaaattgctggaacgctggtccggcgggcccggattacgggaggaagacacagacacacccggtctgcgccgtagagcttcatgccgacccacaactgccgctcgcggacagcctagtcgccgggtgagtaagctggcatctggaccgctggccgccccagctcaaccacgaccactcaggagcctgagcccttcagtgaggcaactcagtagaagatttgacgctccccggttagacgatgggtcggccggaactagggatggaggtgttctgccagcggccgcagaagaagccgcggaagggcccgccaggggtgcctggccatctgttactgagatgcgaaagttgttcggaggacctggcagtcgaaggccctctgccgacagcgagtcccctggcaccccatcccccgatggcgccgcgtgggaaccaccagcccgggaatcacgccaacctccgactccccccccacggacttgctttcccctagcaggcttgaggtccgcgaggccactgaccggcccagagaccgagggcaggttacggaggccgcagcagcaacaagagagagctcaaaggcctgcagatggcctgcattcttggcacatcttttctcagccacaagccggtgccagggcttcttgcagttcctcttctattgcagcatcgtacccagtctctaggagtcgcgccgcttcatcctctgaagaggaagaggaaggtcccccacagctgcctggagcccagtcccccgcctatcacggcggccacagcagtggaagcgacgacgacagagacggagagggtggccacaggtgggggggccgtcccggcctccgcccaggctcatccctcttggatcaagattgtaggcctgattccgatgggttgaacctctcatcaatgaatagcgccggggtatctggttcacccgaaccaccgacatctcctcgcgccccgagagaggaagggctgcgcgagtggggcagtggaagcccgccttgcgtgcccgggccacaggaggggctgcgtcctatgtcggactcagttgggggggccttcagggtcgctaaagtttctttcccttcttacttggcttctccggctggctctaggggctccagcagatactcaagcacagagaccttgaaggacgacgacctttggagcagccgggggtcaggtggttggggggtatatcggtccccctcttttggtgccggggagggtctcctacgtagccaggccagaacgagagctaaaggaccaggtggcactagtcgcgccctccgcgatggaggtttcgagccagagaagtccagacagcggaaatccctatcaaatccagacatcgcctcggagactttaaccctactcagctttcttcgttccgatttatctgagctacgggtaaggaagcctggcggatctagtggtgataggggcagcaatccgctagatggacgagacagccccagtgcagggggtccggtggggcaacttgagcctattcccattcctgcaccagcttcaccgggcactcgcccaactctcaaggatctaactgcaaccctgagaagggccaaaagtttcacatgtagtgaaaagcccatggccagaaggctgcccaggacctcagctctgaagagcagcagcagtgagcttcttctaaccgggcccggggcggaggaggatcctctgccccttattgttcaggaccagtacgtccaggaggccagacaggtgttcgagaagatccagagaatgggcgctcagcaggatgatggaagcgacgcaccaccgggctcaccagactgggctggcgatgtgaccagaggccagcggtcccaggaagaactcagtggtccagagagctcactcacagacgaaggaattggtgcagaccctgagccgcctgttgccgctttctgcggactgggcactactggaatgtggaggcccctctcttcatcgtcagcacagaccaaccaccacggacccggcactgaagatagcctcggcggttgggctctggtcagcccagagactccacctacccccggagcactgaggcgacggcggaaggtgcccccatctgggagtggagggtctgagcttagcaacggcgaggccggggaggcttacaggagtttgagcgatccaattcctcaacggcacagggcggccacaagtgaggaacccacaggtttctcagttgacagcaatctgctgggcagtttgtcaccgaaaacgggactgccagctacgagtgctatggatgaagggttaaccagtggccacagtgactggagcgttggctcagaggagtctaaaggataccaagaggtgattcaaagtatcgtacagggccctggcaccttagggagggtggtggacgataggatcgctggcaaggcccccaaaaaaaaatcactttctgatccctcacgaaggggggagctggccggcccaggctttgagggccccggtggcgaacctatccgagaagtggagcccatgttgccacccagttcttccgaacccattttggttgaacagagagctgagcctgaggagcccggagcaacacgctctagggctcaatcagaaagagcacttcccgaagctctcccgcctcccgccaccgcacatcggaattttcatctggacccaaaattagccgatattctgtctcctaggctgattcgacgcggctcaaagaaaagacccgccagatcaagccatcaggagctgaggcgggatgaaggttctcaggaccaaaccggctccctgagccgtgccagaccctcaagccgccacgttaggcacgcctccgtccctgctacattcatgcccatagtggtgcccgagccacctacttctgtgggccctccggtcgccgttccagagccaatagggttccccactcgggcccatccaacccttcaggcgccctcactcgaagatgtgacaaagcagtatatgctcaacttgcactccggcgaggtgccagcacccgtacctgtcgacatgccgtgtctcccgttggcggcccccccatcagctgaagccaaacctcccgaagccgctcgacccgctgatgagccaaccccagcatcaaaatgctgcagtaagccccaagtagatatgaggaagcacgtcgcaatgacattactcgatacagagcagagctacgtggaaagcctgcgaacattaatgcagggttacatgcagcctttgaagcagcctgagaactcagtgctctgtgatccttcactagtcgacgaaattttcgatcagatcccagagctgcttgagcatcacgagcaattcctggaacaggtccgccactgcatgcagacctggcacgctcaacagaaggtgggggccttgcttgtccaaagctttagcaaagatgtgctggtaaacatctatagtgcttatatagataacttccttaatgcaaaggacgccgtcagagtggctaaggaagcccgcccggctttcctgaagtttttggaacaatcaatgcgtgagaacaaggagaagcaggctctttccgatcttatgatcaagccagtgcaaagaatcccacggtatgagcttctggtgaaggacctgctgaaacacacgcctgaggaccatcctgaccaccccctcttactggaagcacaacggaacattaaacaggtcgcagagaggatcaataagggggtgcgatccgctgaggaggcggagagacacgcccgggtgcttcaggagatagaagctcatattgagggtatggaagatctccaggctccgctccgccggtttctgcgccaggaaatggtcatcgaagtcaaggcaataggtggaaaaaaggaccggagtctgttcctgtttacagacctgattgtgtgtacaacactgaaacggaaaagcggcagcctgcggagatcttcgatgtccctttacaccgctgcctctgtgattgacactgccagtaagtacaaaatgctctggaagctgccattggaggatgccgatatcataaaaggcgcctcccaggccaccaatagagaaaacattcagaaagcgatcagccggctggatgaggatttgactaccctggggcaaatgagtaagttgagcgagtcgctagggttcccgcaccagtccctcgacgacgctctgcgtgacctgtcagcagccatgcaccgggatctctcagaaaagcaagccctctgctacgccctttcattcccgcccaccaaactggaactctgtgctacccgaccagagggaacagactcgtacatattcgagtttccacatcccgatgcccgtcttggcttcgagcaagcctttgatgaggcgaaaagaaagttggcatcatcaaaatcatgcctggaccccgaatttctcaaggctatcccaatcatgaagacacgctcagggatgcagttcagctgtgcagctcccaccttaaattcttgtccagagccttctcctgaagtttgggtgtgcaattcagacggctacgtgggtcaggtgtgtctgctgtcacttcgagctgaacctgacgtcgaggcatgcatcgctgtttgttccgcacggattctctgcattggagcagttcccggactgcagccacggtgccatcgcgaacctccgccctccttaaggtccccacctgagactgcccctgagcccgccgggcctgagcttgacgtggaagcagctgcagacgaggaagcagcaaccctcgccgaaccaggtccgcaaccatgccttcatatcagcattgccgggagtgggttggagatgaccccaggtttgggggaaggtgatccccggcccgaactggttccttttgattcagactcagatgatgagagctctccatcgccttccggcactcttcaatctcaagcttcacgcagcacaatttcttcatcttttggtaatgaagaaaccccttcgtcgaaggaggccaccgccgagaccacatcgtccgaggaggagcaagagccagggttcctgcccctgtccggttccttcgggccaggcggcccctgtggaacatcaccaatggacggcagagctttacggagatctagccacggctcctttactcggggtagcttggaggacctgctgtctgtggatcctgaggcatatcagtcgagtgtatggctgggcaccgaagacggatgcgtgcatgtataccagtcttcagacagcattcgtgataggcgtaacagcatgaaattacagcacgccgcaagtgtaacatgcatcttgtacctcaacaatcaggtgttcgtctcgctggctaacggagagctggtagtttaccagagagaggccggacatttttgggaccctcagaactttaagtctgtgacattaggtactcaaggaagcccaattaccaaaatggtttctgttggtggtaggctctggtgcggatgccaaaaccgggtgctagtgctaagccctgacacactgcagctggagcatatgttctacgtggggcaagattcctctcgctgtgtggcttgcatggtagattccagcctgggggtttgggtcacactgaaggggtcggcgcacgtgtgtctgtatcaccccgatacctttgagcagttagcagaagtggatgtcacccctcccgtacacaggatgcttgcaggcagtgacgctattatccggcaacataaagctgcttgccttcgtataaccgccttgcttgtctgtgaggaactgctatgggtgggcacgagtgcaggagtagtcttgacgatgcccacgtccccggggacagtgtcatgcccccgcgctcccctgtctcctaccggcttgggccagggccatactgggcatgtgagatttttggccgccgtgcaactgcctgatgggtttaacctcttgtgccctaccccaccgcccccaccagatacaggtcctgaaaaactgccttcactggagcatagggattcgccttggcacagagggccggcgcccgctcgaccaaagatgctggtgatctctgggggcgatgggtatgaagatttccgactgtctagcggaggagggtcatcatctgagactgtgggcagggacgacagtacaaaccaccttctattgtggagggtgtag

SEQ ID NO: 23002 - DNA, 2499 bp, Artificial Sequence
  Description of Artificial Sequence: Synthetic coding sequence
atgagcgaggccggcggcgccggccccggcggctgcggcgccggcgccggggcaggagccggtcccggggccctccccccccagcccgcagcactgccgcctgcacccccacaaggctccccctgtgcggctgccgcaggaggctccggcgcctgcgggcccgccacagccgtggcagccgctggcaccgctgagggtcccggcggcggcggtagcgcacgaattgccgtgaagaaagcccagctccgttctgcacccagagccaagaaactggaaaagctgggagtgtatagcgcatgcaaagcggaagaatcgtgcaagtgcaatgggtggaagaatccaaatccatcccccaccccgcctagagctgatctccagcagattatagtgtcactgacagaatcttgcaggagctgctcacatgctctagccgctcacgtgagccacctggagaatgtctccgaagaggagatgaacaggctgctgggaatagtcttggatgtcgagtatctgtttacatgcgtccacaaagaagaagatgccgacaccaaacaagtgtatttttatctcttcaaactcctgcggaaaagcattctccagcgcggcaagcctgttgtcgaaggtagcttagagaaaaagccgccatttgaaaaaccttccatcgagcaaggagtaaacaatttcgtccagtacaagttctctcatctccctgccaaggagcgacaaacaattgtggagctcgccaaaatgtttctcaatcggatcaactactggcaccttgaggctccgtcgcaaaggagactgcgctcacctaatgacgacataagcggatataaagagaattacactaggtggttatgttactgcaacgtcccccagttttgcgacagtttgcccaggtatgaaaccacccaggtgtttggtcgaactctgctgaggtcagtttttactgttatgcggcggcagctgttggaacaggcacgccaggagaaggataagctgccactggaaaagcgtacccttatactcacccacttccctaagtttttgtccatgctggaggaagaggtgtatagccagaatagccctatatgggaccaagattttttatccgcctcaagcaggactagtcagttagggattcaaaccgtgatcaaccccccccctgtcgccggaactatctcttataactctacatctagctccctggagcagccaaacgcaggcagtagctctcctgcttgcaaagcttccagcgggctagaggcaaacccgggcgagaagagaaaaatgacagattcccacgttttggaggaggccaagaagccccgcgtaatgggcgatatccctatggagctgataaacgaagttatgagtacaattaccgaccctgcagctatgctaggccccgaaacaaatttcctgtcagcacactctgcaagagatgaggctgctagactcgaggaacggcggggcgtcattgaattccacgtggtcggtaactccctgaatcaaaaaccgaacaagaaaatcctgatgtggctggtaggactgcaaaatgtattcagtcatcagcttccgcgaatgcctaaggagtacatcacgagattggtttttgatccaaagcacaagactctggctcttataaaggacggccgggtaatcggcggaatatgttttcggatgttcccttcacagggattcaccgagatagtcttctgcgccgtgaccagcaatgaacaagttaaggggtatggtactcacctgatgaaccaccttaaggagtaccacatcaagcacgatatcttaaatttcctgacatatgctgatgagtatgcaattggatattttaaaaagcagggtttttccaaggagattaagatacccaaaaccaaatacgtcgggtatatcaaagattacgagggcgctactttgatgggctgtgagctgaatccaaggatcccgtatactgagtttagcgtgatcattaaaaagcagaaagaaattattaagaaactgatcgaacgcaaacaggctcagatcagaaaagtgtaccctggcctgagttgtttcaaggacggggtgcgccagataccgatcgaatccattcccggtattcgcgagaccggctggaaaccttcaggcaaggaaaagtcaaaagaacctcgcgatccggatcagctctacagtaccctgaagtccatcttacagcaggtcaagagtcaccagtccgcttggcctttcatggagcccgtgaaacggacggaagctccaggttattatgaagtgatccgcttcccaatggatttaaaaacaatgtctgagcgtttgaagaaccgctactatgtaagtaaaaagctgttcatggcagacctgcagagggtctttacaaattgcaaggaatacaacccaccagaatccgaatattacaagtgcgctaatattctggaaaaattcttcttcagcaaaatcaaagaggcaggtctgattgataagtag

SEQ ID NO: 23003 - DNA, 4950 bp, Artificial Sequence
  Description of Artificial Sequence: Synthetic coding sequence
atggccggcggccggggcgcccccggccggggccgggacgagcccccagagtcttacccccaacgacaagaccatgaactccaggctttggaagctatatatggagctgacttccaagatctgcgccctgatgcctgtggcccagtgaaagagccgcctgagatcaatctggtgttgtatccccaggggctcacaggggaggaggtttatgtgaaggtggatttgcgcgtcaaatgtcctcctacctaccccgacgttgtacccgaaatcgagctgaagaacgccaaaggcctctctaacgagagcgtgaatctcctgaagtcgcgcctggaagaacttgctaagaagcattgtggcgaggtcatgatcttcgagcttgcgtaccacgtgcagagttttcttagtgagcacaacaagcctccacctaagtccttccatgaagaaatgctggagaggagagcgcaggaggaacagcaaagactgctggaggctaaacgtaaggaggagcaggaacaaagggagattttgcacgaaattcagagaaggaaggaagagattaaggaggaaaagaagcggaaggaaatggctaagcaggagcgcctggaaattgcctccctgtccaaccaggatcacacatccaagaaagatccaggcgggcataggacagccgccatactgcatgggggatcacctgacttcgtgggaaacggcaaacaccgcgcaaatagcagtgggagatcacgtagagagcgtcagtacagtgtgtgcaatagcgaggatagtcccgggtcatgcgaaatcttatatttcaatatgggtagcccagaccaactgatggtgcacaagggcaagtgtatcggcagcgacgaacaacttggaaaactggtctataacgccctggagactgctacaggcggattcgtcctgttatacgagtgggtgctacagtggcagaaaaaaatgggaccgtttcttaccagccaggagaaagaaaaaatagataagtgcaagaaacagattcagggtactgagaccgaattcaacagtttagtgaaactgtcgcatcctaatgtagtacgttacctggctatgaatctgaaggagcaggatgattctatcgtggtcgatatattagtcgagcacattagcggagtgagtctggctgcccatctgtcccactccgggcctattcccgtacatcaattgaggagatacactgcacaactcttaagtggcctggattacctccattccaactccgtcgttcacaaagtcctgtctgccagcaacgtgctggtcgacgctgaaggaaccgtgaagattaccgactacagcatttccaagaggctggcagacatttgcaaggaggatgtttttgaacagaccagggtccgcttcagtgacaacgccctgccatacaagactggtaagaagggggacgtttggagactcgggctcctgctcctgtcactgagtcagggccaggagtgtggtgagtatccggtcacaattcccagcgacctcccagctgacttccaagactttcttaaaaagtgcgtttgtcttgacgataaggagagatggagcccacagcaactgcttaagcactcatttattaatccgcagccaaagatgccccttgtggaacagagccctgaggacagcgaggggcaagactatgtcgagactgtgattccaagcaatagactgccctctgccgcctttttctcggagacccaaagacagttcagcagatattttatcgagttcgaagagttacagttgctgggaaaaggcgcctttggcgccgtgattaaggtgcaaaacaaactggatggatgttgctatgctgtgaagcggatccctattaaccctgccagtagacagttccgtcggattaaaggcgaagtcactctgctgagccggttgcaccatgaaaatattgtccggtattacaatgcttggatagaacggcacgagcgtcctgcgggaccggggacccccccacccgactctgggccccttgccaaggacgatagggctgcacgcggccaacccgcttcagataccgatggcctggatagcgttgaggcggctgcccccccccccatcctttcctctagcgtggagtggagcacttccggcgaacgctcagcctctgcgcgcttccccgctactgggccaggctcaagtgatgatgaggacgacgacgaagacgagcatgggggtgtgttcagccagagcttcctgcccgcctctgactccgaaagtgacatcatattcgacaatgaggacgaaaactccaaatcacagaatcaggatgaggattgtaatgaaaaaaatgggtgccatgaatcagaaccaagcgttacaactgaagccgtgcactatttatacatacagatggaatattgtgagaaatccaccttgcgggacaccatagatcaggggctctaccgtgacacagtcaggctgtggagactgtttcgcgaaattctcgacggactagcctacatccacgagaaaggcatgatccaccgggatctcaagccagtgaacatttttctggactcagacgatcacgtgaaaatcggggacttcggcttggcaaccgaccatctggctttttcagctgacagtaaacaggatgaccagactggagacctgattaagagcgatccgtctgggcatctcacaggcatggtcgggacggccctctacgtttcaccagaagttcagggatccaccaagagcgcatacaaccagaaagtggacctcttttctctgggaatcattttctttgaaatgtcctatcacccgatggtgaccgcctctgaaaggatcttcgttctgaatcagctgcgggatcccacttctccaaaattccccgaggacttcgacgacggagaacatgccaaacagaagtccgtgatttcctggttattgaatcatgaccctgcaaaacgtcccacagccacggaacttctgaagagcgaactcttgccccctccccagatggaggaaagcgagctgcacgaagttctccatcacactctgaccaacgtggacgggaaggcctacaggactatgatggctcagattttttctcagaggatctctccagccattgactatacctacgactctgacattctaaagggtaattttagtatccgtacggccaagatgcagcagcatgtctgcgaaaccattatacgtatcttcaagcggcacggtgctgtccagctgtgtaccccactgttgcttcctcggaaccgacagatttacgagcataacgaagccgcactgtttatggatcactcaggaatgctcgttatgctcccttttgatctgcggatcccgttcgcacgctacgttgcacgaaataacatcctcaacttgaaaagatactgtatagaacgggtgttccgtccaagaaagctggacaggttccaccccaaggaattgctggaatgcgcattcgatatagtgacgagcacaaccaacagcttcctgccgaccgcagaaattatttacacaatctatgagatcatccaggaatttccagcgctgcaggaacgtaactattcaatatacctaaaccataccatgctgctgaaggccattctgcttcactgcgggattcccgaggacaagctttcccaggtgtatataatcctgtacgatgccgtgacagaaaagcttacaagacgggaggttgaagcgaaattttgtaacttgtcactctcatcaaatagcctgtgcagattgtacaagttcatcgagcagaaaggagatcttcaggacctgatgcccaccattaatagcctgattaaacaaaagactggcatcgcccaactggtgaaatacggactcaaggatctggaggaggtcgtcggcctgcttaagaaattggggattaagctgcaagttctgattaatctcggcctcgtttacaaggtacaacagcacaacggaatcatcttccagttcgtagcatttataaagcgtaggcagcgggccgtgcctgagattttagctgcgggcggccgatacgatttgctgataccgcagttccggggtccgcaggcactcggcccggtgcctaccgcaatcggcgtctcgattgcgatagataagatatcagcggccgtgctcaacatggaagagagcgtcaccatcagctcatgtgacttactggtggtctcagtgggccagatgagcatgtcacgggctatcaacctcacccagaagctctggactgcaggaattacggccgaaattatgtacgactggtcacaaagccaggaagagctgcaggagtactgtagacaccatgaaattacgtacgtggccctggtgagcgataaggagggctcgcatgtaaaagtgaagtcatttgaaaaggaacggcaaaccgagaagagagtgctcgagaccgaattggtggatcatgtccttcagaaactgcggactaaagtgacggacgaaaggaacggacgcgaagctagtgacaatttagccgtacagaacttgaaaggcagcttctccaatgcatccgggctgttcgagatacacggtgctaccgtggttcccatcgtttcggtgttggccccggagaaattatccgcatccactcgccggcggtacgagactcaagtacagacccgtcttcagaccagcctggctaaccttcatcagaagtctagtgagattgaaatcctcgcagttgatctgccaaaggaaacgatcctgcagtttttatccctggaatgggacgccgacgagcaggcttttaatacaactgtcaagcaactgcttagccggcttcccaagcagagatacctcaagctggtatgcgacgagatctacaacatcaaggttgagaaaaaggtgagtgtgttatttctttattcctatcgggacgattactatcgaatcctcttctag

SEQ ID NO: 23004 - DNA, 5652 bp, Artificial Sequence
  Description of Artificial Sequence: Synthetic coding sequence
atgcccgtgggccggatcgagtgccccagcagccccagcttcccccgagatatttcccatgaatgcagggtttgtggggttaccgaggtgggcctgagcgcctatgccaaacacatcagcggccagttacataaagataacgttgatgcacaagagcgggaagatgacggcaagggggaagaggaggaagaagactacttcgataaggaactcattcagcttataaaacagaggaaggagcaatcgaggcaggacgagccatcaaatagtaatcaagagatcaactcggacgatcggaggcctcagtggaggagggaggacaggatcccttatcaggatcgagaaagctattcgcaacccgcctggcaccatcgagggcctcctcagagggactggaagtgggagaaggatggatttaataacacacgtaagaattcttttccccactctctcagaaatggcggaggccctcgcggtcgatctgggtggcacaaaggtgtggccggagggtcttcaacctggttccataaccattcgaacagcggaggcgggtggctcagcaacagtggtgccgtcgactggaaccataacggtacggggcggaactcaagctggctgtccgagggcacaggaggcttcagctcatggcacatgaacaatagcaatgggaactggaagagttcggtacggtctacgaataactggaattacagtgggcccggagataaattccagccaggtcgaaatagaaattctaactgtcagatggaggatatgactatgttgtggaacaaaaaaagcaataagtccaacaaatacagccatgaccgttacaactggcagcgtcaggagaacgataagctcggaaccgtcgccacctatcggggtccgagcgagggctttacatcagataaattcccttctgagggactgctcgacttcaatttcgagcagttggagagccagactactaaacaagctgacaccgcaaccagcaaggtatcaggaaagaatggttcagctgcccgggagaagccccgcagatggaccccatacccctcacagaagaccctggatttgcagtcaggactgaaggacatcactggaaacaaatccgaaatgatcgagaagccactgttcgatttctcccttatcacaacgggaatccaagagcctcagaccgatgagacgcggaactctcccacacagaaaacccagaaggagattcacaccggcagcctgaaccacaaagcctcctccgacagcgccgcatctttcgaggtagtccggcaatgcccaaccgccgaaaagccagagcaagaacatacccctaataagatgcctagtctaaagtccccgttgcttccctgtcccgctacaaagtcgctctctcagaagcaggaccccaaaaatataagtaagaacactaagacgaatttcttcagtcccggagagcactccaatcctagtaacaaaccaactgtcgaggacaaccacggcccctacattagtaagctgaggtcttcatgcccgcatgtcttgaaagggaataaaagcacctttggttcccagaagcagagtggcgataacctgaatgacacactgcggaaggccaaggaggtcctacagtgccacgagtctctgcagaaccctttgttatccacctccaagtctactcggaattacgctaaggcctcccgcaatgtagaagaaagtgaaaaaggatcactgaagattgagtttcaggtacatgccttggaagatgagtcagacggcgagaccagtgacacagagaaacatgggaccaagattgggaccctaggatccgctactacagagttgctgtccggatcaacccgcacagctgatgagaaagaagaggacgacaggattctgaagacatcacgggaactgtctacatcaccctgcaaccccattgtccgccagaaggaatcggaacttcaaatgacctctgccgccagcccacaccctgggttgctgctggacctgaagaccagcctggaggatgcccaggttgatgatagtatcaaaagccacgtcagctacgagacggaaggcttcgagtctgcttcactcgacgcagagcttcagaagtccgacatctcccagccatctggacctcttctgcctgaactgagcaaactgggctttcctgcttcacttcagcgtgacctgactaggcatatttctctgaaaagcaaaaccggcgtgcacctgccagagccaaatttaaactctgcccggcgtattcggaacatttctggccacagaaaaagcgagaccgaaaaagagagcggactcaagcccaccttgcggcagatcctgaatgctagccgccgcaacgtcaactgggaacaggtcatccagcaggtcacaaaaaaaaaacaggagctaggcaaggggctgccgcgctttggcatagagatggtgcctctagtacagaatgagcaggaagcccttgacttggatggtgagccagatctctcttctctggaaggtttccaatgggaaggggtctccattagctcttcccccggtctggcccggaagagaagtctgtcagaaagtagtgttataatggaccgtgccccttctgtctactcttttttcagcgaggaagggacaggtaaggagaatgagccacagcagatggtctcccctagtaacagcctgagagccgggcagtcccagaaggcgacaatgcatctgaaacaagaggtcacacccagggcagcctcattgcggaccggtgaaagggccgagaacgtggcaacccaacgtagacactccgctcaactgagttctgaccacatcatccccctgatgcaccttgcaaaggatctgaactcgcaggaaagatcaatacccccctccgagaaccagaattctcaagagtctaacggcgagggaaattgcctgtcttctagcgctagctccgctctagctatttcctccctcgcagacgctgccaccgacagcagttgcacgagcggcgccgagcagaacgatggccagtccattcgtaaaaaaagaagagcgacgggtgacggcagtagcccggagctgccttcactggaacggaagaacaaaaggcgaaagatcaaaggtaaaaaggagcgctcccaggtggaccagctcctgaatattagccttcgagaggaggagctgtctaaatccctccagtgtatggataataacctgctgcaggccagggccgcattacaaactgcatacgtggaggtgcagagactgctgatgctcaaacagcagataactatggagatgagcgctttgcgcacgcaccgaatccagattctccagggcctccaagagacctatgagccaagtgagcacccagaccaggtgccttgcagtctcactcgggaaaggcgtaactctagatctcagacgtcgatcgacgctgctctgctcccgactccctttttccctcttttcctggagccacccagctcccatgtgtcaccttctcctaccggagccagtctgcaaattactacaagccctactttccaaacacacggaagtgtgcccgccccggattcatctgttcagataaagcaagaacctatgtccccagagcaggatgagaatgttaatgccgtccccccctctagtgcctgcaacgtctccaaagaattgctcgaagctaaccgggagataagtgatagctgccccgtgtatccagtcatcacggcaagattgagcctgcccgagtcaacggagagctttcatgaaccgagccaggaattgaaattcagcgtggagcaacggaacacaaggaatagagagaacagtccaagctcccagagtgcagggctgtcatccatcaataaggagggagaagaacccaccaagggaaacagcgggtccgaagcttgtacaagctcgtttctgcgcctttcatttgccagtgaaacacccctggaaaaggaaccacatagtcccgctgatcagccagaacagcaggccgagtcgaccctgactagcgcagaaacacggggcagcaagaaaaaaaaaaaacttcgtaagaaaaagtcgctcagagcggctcatgtaccagaaaacagcgatactgagcaggacgtgctgactgtgaagccagtgcggaaggttaaagccggcaagctgatcaaagggggtaaagtcactacctctacatgggaggatagcagaaccggaagggaacaggaatctgtgagggatgagcccgattcagatagcagtctggaggtgctagaaataccgaatcctcagttggaggttgtggcaatagattcctctgagtcaggcgaggagaagcctgactcccccagcaaaaaggacatatggaactccactgagcagaaccccctggagaccagtcgttcaggctgtgacgaggtctctagcactagtgaaatcggcacaaggtacaaagatgggatccccgtctcggtggcggaaactcagactgttatcagctcaatcaaagggagcaaaaactcttcggagatctcatcagagcctggagatgatgatgaacctactgaaggctcctttgagggccaccaagccgcggtgaatgccattcagatcttcggcaatttgctgtacacctgctccgcagataaaaccgtcagggtgtacaacctggtcagtcgaaaatgcattggcgtcttcgaaggccatacctcaaaagtcaattgcctcctggtaacacagacttcaggcaaaaatgctgcactttacacaggatctagtgatcacactatccgttgttacaatgtgaagtccagagagtgcgtggagcagctgcagctggaggaccgcgtcctgtgtcttcactctcggtggcggatactgtacgccggactcgccaatggaactgtcgtgacgttcaatatcaaaaataacaagagactcgaaatcttcgagtgccatggcccacgggccgtgagctgcctcgctaccgcgcaggagggcgccaggaaactgctagttgtcggcagttacgactgcaccattagcgtacgcgacgctagaaatggcctccttttacgaacattggagggacacagcaagacaattctgtgcatgaaagtcgtgaatgaccttgtgttttcaggcagctcagatcagtctgtgcatgctcacaacatccatacgggcgaactggtgagaatctacaagggccataaccacgccgtcaccgtcgttaatattctgggcaaggtcatggtgacagcctgtctcgataaatttgttcgggtgtatgagttgcagtctcacgatagacttcaggtctacggagggcataaagacatgataatgtgcatgacgatacacaaatcaatgatttacacaggatgctatgacggctccatacaggccgtgagacttaatctcatgcagaactacagatgttggtggcacggctgcagtctgatttttggcgtcgtcgaccatctgaagcagcacctgttgaccgaccacacaaatccgaactttcagaccctaaaatgtcgctggaaaaattgtgacgccttcttcacagcgcggaagggatcaaagcaggacgcagccggtcacatcgaacggcatgccgaggacgatagtaaaatagactcatag

SEQ ID NO: 23005 - DNA, 588 bp, Artificial Sequence
  Description of Artificial Sequence: Synthetic coding sequence
atggccgagcccgtgcaggaggagctgagcgtgctggccgccatcttttgtcggcctcacgagtgggaggtactgagtcgttccgaaaccgacggtacagtcttccgtatacacacaaaggctgagggctttatggatgtggacattcccttagagcttgtttttcacctacccgtgaactacccttcgtgcctgcccggaattagtatcaatagcgaacagctcaccagggctcaatgcgtcaccgtgaaagaaaacttattggagcaagccgagagcttgctttcggagccaatggtccacgagctggtactctggattcaacaaaacctacggcatatactaagtcagccggaaaccgggtctggaagtgagaaatgtacattctctacaagtacaacaatggatgacgggctgtggataactctgctccacttggatcacatgagggcaaaaactaagtatgtaaaaatagtagaaaaatgggctagtgatctccgcctgaccggaaggctgatgttcatgggaaaaatcatcttaattcttcttcagggggacagaaacaatttgaaagtcccaaaaagttag

SEQ ID NO: 23006 - DNA, 1119 bp, Artificial Sequence
  Description of Artificial Sequence: Synthetic coding sequence
atgagccggcggcggttcgactgccggagcatcagcggcctgctgactacgacaccacaaatacctattaagatggagaacttcaataacttctatatcctcactagcaaggagctgggcagaggaaagtttgccgtcgtccggcagtgtatcagcaaaagcacaggacaagagtacgccgccaaattcctgaaaaaaaggcggcgcgggcaggattgtagagctgaaattctgcacgaaatagcggttctggaacttgccaagtcttgtcccagggtcatcaacctccatgaagtgtacgagaacacaagcgaaataattctcatcctagaatacgctgccggaggcgaaatctttagcctttgcttaccagagctggcagaaatggtgtcagagaacgacgtgatccggttgatcaaacagatcctggagggagtgtactatctgcaccagaacaatattgtgcacctagacttgaaaccccagaacattcttctctcatctatttatccactgggagatatcaagatcgtcgacttcggcatgagtagaaagatcggccacgcatgcgagttgagagaaatcatgggtacaccagagtatttggcccccgagattttgaactatgaccctatcactacagccaccgacatgtggaacataggaataattgcgtacatgctacttacacatacaagccctttcgtgggagaagataatcaagagacatatttgaatatctcgcaggtgaatgtggattactcagaggagacgttttcttctgtttcacagctggccacggactttattcagtctctcctggtcaagaatccggaaaagaggccgactgctgaaatatgccttagccattcatggctacagcagtgggactttgaaaacctctttcaccccgaggaaacctcatcctcctctcagactcaggatcacagcgtaagaagtagcgaggacaagacatccaagagctcatgtaacggaacctgtggggatcgagaagataaggagaatattcctgaagattccagcatggtgtctaaacggtttcgatttgacgattccctgcctaaccctcacgagcttgtatcagacctcctgtgctag

SEQ ID NO: 23007 - DNA, 930 bp, Artificial Sequence
  Description of Artificial Sequence: Synthetic coding sequence
atggaggccgcccggaccgccgtgctgcgggtgaagcggaagcggtctgctgaacccgccgaggcgctggtgcttgcctgtaagaggctccggtccgatgccgttgagagtgcagcccagaagactagcgaaggccttgagcgcgctgcggaaaacaatgtatttcaccttgtcgcgacagtctgctctcaggaggaacccgtgcaacctctactccgcgaagtactgaggccctcgagggactcacaacagcgggtgcgaaggaacttgcgcgcatctgctcgggaggttcgtcaagagggtcgctaccgggtgctgtcttcccggcgtagcctggggaccacatctagtggacaagagagcgagtatacaccagggaatcccgaggccgctgggaactctggcttccagctgctggacctggtccacgaggagggcgagcccgaggccgctagtgccggaagctgtaagaccagcgatcccgatgttattctgtgcaactctgtcgagctcatcagggagagattgacagtctcagaagacggaccaggggtgaggcggcaggaggaacaaaaacatgatgattacgtctacgacatctattacctggaaaccgcaacccctggttggatcgagaacatcctgagcgtgcagccctacagccaagaatgggagctggtcaatgatgaccaggaacccgaggatatttatgacgatgaggatgacgaaaactcagagaacaattggcgtaacgagtacccagaggaagagagtagcgatggggacgaagattctaggggcagtgccgactacaactctctgagcgaagaggaaaggggcagctcgcgccagcgcatgtggtctaagtacccactggacgtccagaaggagtttggatacgactcgccccacgatctggattcagattag

SEQ ID NO: 23008 - DNA, 1068 bp, Artificial Sequence
  Description of Artificial Sequence: Synthetic coding sequence
atggccgacaacagcagcgacgagtgcgaggaggagaacaacaaggtcctcagagaaggaatgcctcaagcaccgggacaccgggggaaagatatggacccggtgcctccagcccctgcaagcctcaagtgtcaccaaactcccagtcacgtgctggagagagtgggatggtaccgtgaatcacagaagcaccgcaaagaaaagaagaagacgtctcaattgaccccccagcggggcttcagtgaaaatgaagatgatgacgatgacgatgatgacagctccgagaccgactcagactctgatgacgacgatgaggagcacggcgctccattggaaggtgcctacgacccggcagactacgagcatttacctgtctccgctgagatcaaagagctcttccagtatatctcccgttacacaccccagctgattgatctagatcataagcttaaaccctttatccccgactttattcccgctgtgggcgatatagatgccttcctaaaggtgccacgccccgatggaaagccggacaacttaggtcttctcgtactcgacgaaccatctacaaagcagagcgatcctaccgtgctcagcttgtggctgacagagaatagcaagcaacacaatatcactcagcacatgaaggtcaagagtctggaggacgccgagaagaaccctaaggcaatcgacacctggatcgagagcatctcagagctgcacaggagcaaaccgccagcaactgttcattacacgcgccctatgcccgatattgataccctcatgcaagagtggtctcccgagtttgaggagctgctgggcaaggtgtcactccctacggccgagatcgattgcagcctggcggagtacatagatatgatctgcgccatcctggacattccagtgtataagtcacgtatccagtcattgcatctgttattttcgctgtactcagagtttaagaattcccagcactttaaggcactggctgagggtaagaaagcatttaccccaagctctaattctacctcgcaagctggcgatatggagacactgaccttttcgtag

SEQ ID NO: 23009 - DNA, 915 bp, Artificial Sequence
  Description of Artificial Sequence: Synthetic coding sequence
atggccgacaacagcagcgacgagtgcgaggaggagaacaacaaggagaagaagaaaaccagccagctgaccccacagcgcggattctctgaaaacgaggacgatgacgacgatgacgacgactctagtgagacagatagcgactcagatgacgacgacgaggagcacggagccccactggagggggcctacgaccctgctgattacgaacacctacccgtgagcgccgaaataaaggagctgtttcagtatatatcccgatatacaccccaactcatcgacctagatcacaagttaaagcccttcattccggatttcatcccagccgtgggagacatagacgccttcctaaaggtacctcgaccagacggaaaacctgacaacctcgggttgctggttctggatgaaccctctaccaaacagtctgatccaaccgtcctgagtctgtggttaacagaaaattccaagcagcataacattactcagcacatgaaagtgaaaagcctcgaggacgctgagaaaaatccgaaggcgatcgatacctggatagagagcatctccgaactccataggtcaaagccccctgccactgtccattatacacgcccaatgcccgatatagatactctcatgcaggagtggtccccagaatttgaggagcttctggggaaagtctccctgcccacagcggagatagattgttcactggctgaatacatagatatgatttgtgcaatcctggacatacccgtctataagtctagaattcagtcacttcatcttctcttcagcctatacagcgagtttaagaattcacagcatttcaaagccctagcagaagggaaaaaagcattcactccctccagcaactctacgtcacaggcaggtgatatggaaacattgaccttttcatag

SEQ ID NO: 23010 - DNA, 1335 bp, Artificial Sequence
  Description of Artificial Sequence: Synthetic coding sequence
atgcgggagatcgtgcacctgcaggccggccagtgcggcaaccagattggggcgaagttctgggaggtgatatctgacgagcatggtatcgacccaaccgggacttatcacggagacagcgacctgcagctcgagcgcatcaatgtctactataacgaggccaccggtgggaattatgttccccgggccgtcctggtggacctggagccaggcactatggactcagtgaggtctggccctttcggacagatatttcgcccagacaatttcgttttcgggcagtccggcgccgggaacaattgggccaaaggccactacacagagggtgctgaactggtcgatgctgtgctggacgtcgtgcggaaggaggccgaatcttgtgactgtctacagggattccagctaacccactccctgggtggggggacaggtagcggcatgggtaccctactgattagcaagataagagaggaatttcccgaccgaatcatgaatacatttagtgtggtgccctctccaaaggtgtccgacaccgtggtggagccctacaacgcaactttatccgttcaccaactagtcgaaaatacagacgaaacctactgcatagataatgaagctttgtatgacatctgtttcaggacgctgaagcttaccactcccacatacggcgatttaaaccaccttgtgagtgccaccatgtccggggtcacaacctgtctgagattccccgggcagcttaacgccgaccttaggaaactcgccgtgaacatggttccctttcctcgtctgcacttctttatgccagggtttgcacccctcacctccagggggtcccaacagtacagagcccttactgtccccgagctgactcaacaaatgttcgacgcgaagaatatgatggctgcctgcgaccccaggcacgggaggtatcttaccgtagctgctgtgttccgcggccgcatgtcaatgaaggaggtcgatgagcaaatgttgagcgtgcaatctaagaactcaagctatttcgtagagtggattccaaacaacgtcaagaccgctgtgtgcgacattccgccaagaggtttaaagatggctgctaccttcatcggcaattctactgcaattcaggaactgttcaaacgaatctccgagcagttcactgccatgttccgcagaaaggccttcctccactggtacacgggagagggcatggatgagatggagttcactgaggctgaatctaacatgaacgatttggtgagcgagtatcagcagtatcaggacgctactgctgaagagggagagtttgaagaggaagccgaggaggaagtagcatag

SEQ ID NO: 23011 - DNA, 1398 bp, Artificial Sequence
  Description of Artificial Sequence: Synthetic coding sequence
atggagcccagcagcctggagctgcccgccgacaccgtgcagcggattgctgccgaactgaagtgccatccgaccgatgagcgcgtggcgcttcaccttgatgaagaggacaaattgagacatttccgagagtgtttttatattccaaagatccaggacttgcccccagtggacctctccctcgttaataaggacgagaatgccatctacttcctgggcaatagcttgggcttgcagccaaagatggtgaaaacctatctggaggaggaattggataaatgggcgaaaattgcggcatatggccacgaagttggcaaaagaccgtggatcacgggtgatgagtctattgtgggcttaatgaaagacatagtcggagcgaacgaaaaagaaatcgcactgatgaatgccctgaccgtgaatctccatttgcttatgctgagcttcttcaagcccacaccaaagaggtataagatcctgctggaggctaaggcctttccttcagaccactatgctattgagtcccagctgcagcttcacggactgaatattgaggagtctatgagaatgatcaagccccgggagggcgaggagactctgcggatcgaggacatcctggaggtgatcgagaaagagggagacagtattgcagtaatactgttctccggtgtgcatttttacactggccagcacttcaacatccccgcaattaccaaagctggccaagcaaaggggtgttacgttggattcgatctggcgcatgccgtgggtaacgtggaactgtacctccatgactggggtgtggatttcgcgtgctggtgctcctataagtacttaaacgctggggctggaggtatcgccggcgccttcattcacgaaaagcacgcacacactattaagcccgctctagtcggatggtttggtcatgaactgtcaacaaggtttaagatggacaataaactccagcttatacccggtgtctgtggctttcgaatatctaatcctccgatcctgctcgtctgtagtctgcacgcgtctctagaaattttcaaacaggccactatgaaagctctccggaagaagtccgttttgcttacaggctatctggagtaccttatcaaacacaactatggaaaagataaggcagcaacaaaaaaacccgtagtcaatatcattacgccaagccacgtggaagagagagggtgtcagctgaccataacgttttcggtgccaaataaagacgtgttccaagagctggaaaaacggggggtggtgtgcgacaaaagaaacccaaatggcattagggtggctccagtaccgctgtacaactccttccacgacgtctataaattcaccaacctgcttacctcaatactggatagcgccgagaccaaaaattag

SEQ ID NO: 23012 - DNA, 4758 bp, Artificial Sequence
  Description of Artificial Sequence: Synthetic coding sequence
atgaacagccagccccagacccggagccccttcttccagcggccccagattcagccacctcgtgcgacaatccctaactcctcgccctctattcgccctggtgcccagactcccaccgccgtttatcaggctaaccagcatatcatgatggtcaaccatttgcctatgccgtacccagtgccccaagggccccagtattgcattcctcaataccggcatagcggccccccgtacgtcggcccacctcagcagtaccccgtgcagccccccggccccggccctttctatcctggacctggtcctggcgattttcctaatgcctatggaacgcccttttatcctagccagcccgtgtaccaatccgctcccatcattgtacctactcagcagcaaccgccacccgctaagcgcgaaaaaaagactattaggataagagacccgaaccagggcgggaaggatatcacagaagagattatgtctggaggcgggagtcggaaccccactcccccaatcgggaggccaacgtctaccccgacccccccccagcagctgccctcacaagttccggaacactctcctgtcgtgtacggcacagttgagtccgcccacctggcggcatctacgcccgtgaccgctgccagcgaccaaaaacaggaggaaaagcctaaaccagatcccgtcctgaagtctcctagcccagttctccgccttgtcttgtctggcgaaaaaaaggagcaagagggccagacctccgaaaccaccgccattgttagcatcgcagagttacctctgccaccaagtcctaccaccgtgagctcggtggcccggtccaccatcgcagccccaaccagcagcgccctctcatctcaaccaattttcactacagccatcgacgaccgatgcgagctgtcaagtccccgagaggacacaattccaatcccaagtctgaccagctgcactgagacaagtgaccccttacccaccaatgaaaatgacgacgatatttgcaagaaaccttgcagcgttgctcctaatgatattcctctggtttcctcgaccaacctaatcaatgaaatcaacggcgtgtccgaaaagttatccgctaccgagtctatcgtggaaattgtgaagcaagaagtgcttcctctcaccttggaactcgaaatcctagaaaacccccctgaggagatgaaactcgagtgtattcccgctcctatcaccccttcaaccgtgccctcctttccccccaccccacctacccctcctgcatcaccacctcatacccctgtgatcgtgccagccgcagccacgactgtgagttccccaagcgccgcaatcacagtgcaacgcgtcctcgaagaggacgagagcattagaacctgtttgtcggaagacgcgaaagaaatccagaataagatcgaggtagaggccgacggacagacggaggaaattctagattcccaaaatcttaactctcgccgctcaccagtccccgcccagattgctatcacagtacctaagacttggaagaagcccaaggaccgcacaagaaccactgaagagatgttagaggcagagctggagctgaaagctgaggaggaactatctattgacaaggtcctcgaatctgagcaggataaaatgtcgcagggcttccaccctgagagggatccatcagacctgaagaaagtcaaggcagtagaagagaacggcgaagaggcggagcccgtacgaaatggcgctgagtcagtctctgaaggggagggaattgacgctaatagcggatccaccgattcctccggcgacggcgttacttttccattcaagccggaaagttggaaaccgacagacaccgaaggcaagaagcagtatgatagggaattcctgttggacttccagtttatgccagcctgcattcagaaacctgaagggctacccccaatctccgacgtggtgttggacaagattaaccaaccaaagctcccaatgcgtacactcgatccccgcattctgcctcgcgggccagattttacacctgcattcgcggatttcggacgacagacccccggtgggaggggtgtcccactgctcaatgtgggctcaagaagatcccagcctggccagcgaagggagcccagaaagataatcaccgtgtccgtgaaggaggatgtgcacttaaaaaaggccgagaacgcctggaagccctcacaaaaacgcgattcccaggccgatgaccctgaaaacataaagactcaggagctgttccgcaaggtgagatcaatactgaacaaactgacacctcagatgttcaatcagctcatgaagcaagtttccggccttacagtggacacagaggagcgcctcaagggcgtgatcgacttggtgtttgaaaaggctattgatgaaccctcatttagcgtcgcctacgcaaatatgtgtcgctgcctggtgacgctcaaagtcccaatggccgataaacctgggaacacagtgaattttcggaagcttttacttaaccgttgtcaaaaagaattcgagaaagacaaagctgatgacgacgtcttcgagaaaaagcagaaggaactggaggcggcgagcgctccggaagaacgcactcgactacatgacgagctcgaggaggccaaagacaaagcacgcaggaggtcaattggcaacattaagttcatcggcgagctgtttaagctcaagatgctgacggaggccattatgcatgactgcgtggttaaactgttaaaaaatcatgacgaggagagccttgagtgtctatgcaggctgcttactacgatcggtaaggatctggatttcgaaaaagcaaaaccaagaatggaccagtatttcaatcagatggaaaaaatagtgaaagagaggaaaaccagttcacgcatccggttcatgctgcaggatgttattgatttacgactctgtaactgggttagtaggagagcagaccagggccccaaaactatcgagcaaatccacaaagaagccaaaatcgaagagcaagaagagcaaagaaaggtgcaacagctgatgaccaaggagaagaggcggcccggagtccagagggttgacgaggggggttggaataccgtccagggagccaagaatagtcgcgtccttgacccctctaagtttctaaaaatcactaaacccacaatcgacgagaagatccagctggttccaaaagcccagttggggtcttggggcaagggatctagcggcggagccaaagcgtccgagactgatgctctgcggtctagtgcttctagtttaaacagattttcagcactccaaccccccgctccttcaggctccactcccagcacgccagtcgagtttgatagtagaaggaccttgacgagccggggctccatggggagagagaaaaacgataagcctctgcctagcgcaaccgcccgtcctaatacgttcatgcggggcggcagttcaaaagatctcctggacaaccagtcccaggaggaacagaggagagaaatgctggagacagttaaacagctcacgggtggggtagacgtagaacgtaattccactgaagctgagcggaacaaaactcgggaatcagccaaacccgagataagtgcaatgtctgcccatgataaagctgccctgagcgaagaggaactcgaaagaaaaagcaagtcaataatagacgaatttttacacataaacgactttaaggaagctatgcagtgcgttgaagagctgaacgcacagggccttctccacgttttcgttagggtcggtgtcgagtcaaccctggaacggagccagattaccagggaccatatgggccaactgctgtatcagctcgtgcagagtgagaagctgtcaaagcaggacttttttaagggttttagcgagaccctggagctagcagatgatatggctatcgacattccccatatttggctttatctggccgagctggtcacgccgatgctgaaagagggcggcatctctatgagagagctgacaattgagtttagcaagccccttctcccagtgggacgagcaggcgtgctgctctcagaaatactccatctgctctgtaagcagatgagccacaaaaaggtgggagcactctggcgagaagccgacctatcttggaaggacttcctccccgaaggggaggatgttcataattttctgctagagcagaagctcgacttcatcgaatctgattctccgtgcagcagcgaggctctgtcaaaaaaggaactgtcagctgaagaactctacaaacgcctggaaaaactaattatagaagacaaagcaaacgacgaacaaatcttcgactgggtagaggccaacctagatgaaattcagatgtcatcaccaaccttcctgagggctctcatgactgcagtgtgcaaagcagcgattatcgcggactcctctactttcagggtggacacagcagtgatcaagcagcgcgtccctatccttctgaaatatctggacagtgacacagagaaagaactccaggccctatacgctttacaggcctccatcgtcaaattggatcagcctgccaacctcctgcgcatgttttttgactgtttgtacgatgaggaagtgatcagcgaggatgctttctataaatgggagagctcaaaggaccctgctgagcagaacggcaaaggagtcgcattaaaatccgtgaccgccttcttcacctggctccgtgaggcagaggaggagtctgaagacaattag

SEQ ID NO: 23013 - DNA, 378 bp, Artificial Sequence
  Description of Artificial Sequence: Synthetic coding sequence
atggcccccgccaagaagggcggcgagaagaagaagggccggagcgctataaacgaggtggtaactagagagtatactattaacatccataaacgcatccatggcgttgggttcaaaaagagggccccgagagccttgaaagaaatacgtaagtttgcaatgaaggagatgggaacacccgatgtgagaatcgatacaaggctgaacaaagccgtctgggcaaaaggcatcaggaacgtcccatatcgcattcgagtgaggctttcaagaaaacggaatgaggatgaagacagcccaaataaactgtatacccttgtaacatacgtacccgttactacttttaagaacctacagaccgtaaacgtggacgagaattag

SEQ ID NO: 23014 - DNA, 1590 bp, Artificial Sequence
  Description of Artificial Sequence: Synthetic coding sequence
atgctggtgctgttcgagaccagcgtgggctacgccatcttcaaggtgttgaacgagaagaagttgcaggaggtcgattccctttggaaagagtttgaaacacccgagaaagccaacaaaatcgtgaaactcaaacatttcgagaagttccaagatacagcggaagccctggccgcttttaccgcactcatggagggaaagatcaacaagcagctgaaaaaggtcctgaagaaaattgttaaagaagcacatgagcctctcgccgtggccgatgcgaaacttggtggcgtaattaaggagaaattgaacctctcttgtatacactcccccgttgtaaatgagttgatgagaggaatcagatcccaaatggatggcctgattcccggggtagagccccgggagatggcggccatgtgcctcggtcttgcacactcgttgtcccgctaccggctgaaatttagtgctgacaaggtggataccatgatagtccaggctatcagcctcctggacgacttagataaggagctgaacaattacatcatgcgatgcagggaatggtatgggtggcacttccctgagctggggaaaatcatttctgacaacctgacatactgtaaatgcctacagaaagtgggggacagaaagaattacgcttcagcaaagctgtcggagcttttacctgaagaagtagaagctgaagtgaaggccgctgccgagattagcatgggaaccgaggtgtctgaggaagacatttgcaatatcctccatctgtgtactcaggtgattgagattagcgaatatagaacgcagctttacgagtatcttcaaaacagaatgatggcaatagcaccaaacgtcactgtcatggttggagagctcgttggtgcgcgtctgatcgctcacgccggctcattgctcaatctggctaagcacgcagcatccaccgtgcaaattctgggcgctgagaaggccttatttcgggcactgaaatcccgacgggatacccctaagtatggccttatttaccacgcaagcctggtgggccaaacgtctcctaaacacaaaggtaaaattagtcgcatgctggctgcgaaaacggtgctagccattaggtatgacgccttcggggaggactcgtcttctgcgatgggggttgagaaccgggcgaagttagaagccagattgcgaacgctggaggaccgtggaatcagaaagatctccggtacagggaaagcacttgctaagaccgaaaagtacgaacacaaatccgaggtgaagacatacgatccctctggcgatagcacgctgccaacgtgctccaagaaacggaaaattgaacaggtggataaggaggacgagatcaccgaaaaaaaagctaagaaggctaagatcaaagtgaaggtggaggaagaagaagaggagaaggtcgccgaggaggaggagacctcggttaaaaagaagaaaaagcggggcaaaaagaagcatatcaaagaggagcctttgtccgaggaggaaccgtgtacgtccaccgctatcgcatcacctgaaaagaagaaaaaaaagaaaaaaaagcgggaaaatgaggactag

SEQ ID NO: 23015 - DNA, 738 bp, Artificial Sequence
  Description of Artificial Sequence: Synthetic coding sequence
atgaacggccgggccgacttccgggagcccaacgccgaggtgccccggcccatcccacatattgggccagattacatcccaaccgaggaggagcgcagagtgttcgcagaatgtaatgacgaatctttctggtttaggtcagttcctctcgccgctacctccatgctcatcacgcagggattgatctcgaaagggatcctgtcatcacatcctaaatacggatctatcccaaagttgattctggcttgcattatgggttacttcgctgggaagttgtcatatgttaagacgtgtcaggagaaatttaagaaactggagaattcaccattaggtgaggctcttcgttctggccaggccagacggagttccccccctggccattactaccagaagagtaagtatgattcttctgtcagtggccaatctagcttcgtcaccagtcccgctgctgacaacatcgagatgcttccccattatgaacctattcccttctcctcatccatgaatgaatcagccccaacaggcataaccgaccacatcgttcagggtcctgacccaaacctggaggagagtcctaaaaggaaaaatatcacttatgaggagttaaggaataaaaatagagaatcctatgaggtcagcctaacccagaaaactgatccttcggtgaggcctatgcacgagcgggtccctaagaaggaagtcaaggtcaacaagtacggagacacatgggacgagtag

SEQ ID NO: 23016 - DNA, 1746 bp, Artificial Sequence
  Description of Artificial Sequence: Synthetic coding sequence
atggaggacgtgaacagcaacgtgaacgccgaccaggaggtgcggaagctgcaggagctcgtgaagaagttggaaaagcaaaacgagcagctgcgatcccggtcaggggctgtgcagggtgccggaagtcttggaccaggaagccccgtgagagccggcgccagcatcccaagctccggcgcggcatctcccagaggcttcccccttgggctaagcgccaagagcggcggaggacccggaagtgggccacggcgcactagctctgaagagttacgggacgcaacgagtctgctggccgctggagaaggcggactgctagacgaagtagagcctctccgccccgacgagctggaaagactttctggttgggaggaggaggaagaatcctggctgtacagctcgcctaaaaaaaaactcacccctatgcaaaagtctgtaagtccactggtttggtgccgacaggtgctggattaccctagccctgatgtggaatgtgcaaaaaagagtcttatccacaagctcgaccaaacaatgagtgcccttaaacgccagaatctctacaacaatccttttaacagcatgtcctacaccagcccctatagtcccaacgcctctagtccctacagcagcggctttaactctccctcgagcacccccgttagacctcccatcgtgaagcagctgattttacccgggaatagcggcaacttgaagagttcggatcggaatcctccactgtctccccaatcctctatagactcggaactgtctgccagcgagctggacgaggatagcatcgggtctaactacaagctcaacgacgtgaccgacgtgcagatcctcgcacgtatgcaagaagagtccctgcggcaggaatacgcggcaacgacctcacggaggtcttccggaagcagctgcaattcaacgagacgcggtacttttagcgaccaggagctggacgctcaatccctggatgatgaggatgataacatgcaccacgcagtgtatcctgccgtgaaccgtttttcgccaagcccacgcaattctccaaggccctcaccaaagcagtctccacgaaatagccccagatctcgctcgcccgcccgagggatcgaatactctcgagtcagcccccagcccatgatctctcggctgcaacaacctcggctatcgcttcagggacaccctaccgatctgcagacctccaatgtgaaaaatgaggagaagctcaggaggagcctgcctaacctgtcaagaacctcaaacacccaggtagattccgtcaagagtagtaggagcgatagcaactttcaggtccccaatggtggaattccccgtatgcagccccaagccagtgcaatccccagccctgggaagttccgcagtcctgctgcaccatcacccctggctctacgccaacccgtcaaggccttctctaatcacggaagtggaagccctggtagccaggagattacacaacttactcagacgaccagctcacctggccctccgatggtgcagtccacagtctctgccaacccaccttcaaacattaatagtgctacattaacaaggccagccgggaccactgcaatgcggtccgggctgccgaggcccagcgccccttctgctggcggtattccagtgcctagatcaaagctggcccagcccgtgcggcggtctctgcctgctcccaaaacctacggaagcatgaaagacgattcctggaaggatggctgctattag

SEQ ID NO: 23017 - DNA, 3153 bp, Artificial Sequence
  Description of Artificial Sequence: Synthetic coding sequence
atgctgtgctggggctactggagcctgggccagcccggcatcagcacaaacctgcagggcatagtagctgagccgcaggtttgtggtttcatcagtgatcgatctgtcaaagaggtggcctgtgggggcaaccattctgtgtttctgttggaggacggggaagtctatacatgcggcctgaatacgaaggggcaacttggacatgagcgggaggggaacaagcccgagcagatcggagccctagccgatcagcatatcatacacgtcgcatgtggggagtcccatagcctggccctgagtgacagggggcagttgttttcttggggagccggaagcgacggacagctgggtctgatgaccaccgaagatagtgtggccgttcctcggctgattcagaagctgaatcagcaaaccattctgcaggtgtcatgtggcaactggcattgccttgcgttggccgctgatggccagttctttacttggggtaagaattcccacggccagctgggactgggcaaagagttccctagtcaggcatctccccagcgggtgcgcagcctggagggcatccccctggcacaggttgccgccggaggagctcattctttcgctctgtctttgtcaggggctgtcttcgggtggggcatgaacaatgccggacaactgggcctcagcgacgagaaggaccgggagagcccttgtcacgtgaaactgcttagaacccagaaggtggtctatatttcctgcggggaggagcatacggctgtcctgaccaagtccggcggggtatttactttcggggccggctcgtgtggccagctaggccacgacagcatgaatgacgaagttaatcccaggagggtactcgaattgatgggaagcgaggtaacacagatcgcctgtggccggcagcacacactggcctttgtgccaagttctggactcatctatgcctttggttgtggtgcaaggggacagctaggtactggtcacacctgtaacgtgaagtgtccgagccctgtcaaaggttattgggccgcccacagcggacagctgagcgcaagagccgataggttcaaatatcatatcgtgaagcagatcttctcaggaggcgaccagacctttgtgctgtgtagcaaatacgagaactactcacctgctgtcgacttcaggactatgaatcaggcacactacacctctttaatcaatgatgagactattgcagtttggcggcagaaactcagcgagcacaataatgctaacaccatcaatggcgttgtgcaaattctctcatctgcagcttgttggaacggatcattccttgaaaagaaaatcgacgaacattttaagacttctccaaaaatccctggaatcgacctgaactctacccgagtgctctttgagaagctcatgaattctcagcactctatgattctggagcagatcctcaatagctttgaaagttgcctgatccctcagttatctagcagccctcctgatgtagaagcaatgaggatctatctgatattgcccgagttccctctcctgcaggactccaagtattacataacgctgaccattcctctcgcgatggctatcctgaggttggatacaaatccttctaaggtgttggataactggtggagccaggtctgtcctaagtacttcatgaaacttgtgaatctgtataagggggcagtcctgtacctgctccgaggcagaaagaccttcctcatccctgtactgtttaataactatattaccgctgcccttaaactcctggagaagctctacaaggtcaatctgaaggtcaaacacgtcgaatacgacacattctacatccccgagatatcgaacttggtagacatccaagaagactaccttatgtggtttctgcaccaggcggggatgaaggctaggccgtcaatcatccaggatacagtcacactttgctcttacccctttattttcgacgctcaggccaagaccaagatgttgcaaaccgacgctgaactccagatgcaggtcgcagtaaatggagcgaatctgcaaaatgttttcatgctgttaacactggaaccattactggccagatctcctttcctggttttgcacgtccgcaggaataatttggttggagacgccttacgcgaactctcaatccactcggatattgacttgaagaagccattgaaggtgattttcgacggggaagaagccgtcgatgccggaggtgtaaccaaagagttcttcttactgctgctgaaggagctcctgaatccgatttatggaatgttcacctactaccaggatagcaatctgctgtggttctcagacacttgttttgtagaacataattggtttcatctgatcgggatcacctgtggcctggccatctacaattccacagttgtggacctgcacttcccactagcactctacaagaaacttctcaacgtgaagcctggattggaggatctgaaggagctctcacccacggagggacgatccctacaggaactgctggactaccccggtgaggacgtagaggagaccttctgcctaaatttcaccatctgccgcgagtcctatggtgtcatagaacaaaagaagttaatacctggcggcgacaacgtaactgtatgcaaagataatcgccaggagttcgttgatgcctacgtcaactacgtgtttcagatatcagtccacgagtggtacaccgcattctcaagcggcttccttaaagtctgcggcggaaaggttctagaactttttcagccttccgaactgcgggccatgatggtcggcaactccaactacaactgggaggaattggaggagactgcgatatacaagggcgactacagcgccacacaccctacggtaaaattattttgggagacgttccacgaattccctctggaaaagaagaagaagtttttgttatttctgacaggcagcgatcgaatacccatatacgggatggcgagcctacagatcgtgatccagagcaccgcttctggtgaagagtatctgcccgtggcccacacatgttacaatttactggacctacctaaatattcatctaaagaaattctgtctgccagactgacgcaagcccttgataattatgaggggttttccctggcctag

SEQ ID NO: 23018 - DNA, 3069 bp, Artificial Sequence
  Description of Artificial Sequence: Synthetic coding sequence
atgtacttctgctggggcgccgacagccgggagctgcagcggcggcggactgcaggatcgcccggagcagaactgctgcaggcagcatctggagagcgtcattccctgctgcttttaactaaccacagagtgttgtcatgcggcgacaatagcagagggcagttgggcaggcggggagcccaacgcggcgagttacccgagcccattcaggccctcgagaccctcatcgttgatctggtcagctgcgggaaagagcattcgctcgctgtgtgtcacaagggaagggtgttcgcgtggggggctggaagcgaggggcagctgggtattggcgagtttaaagagatcagcttcactcccaaaaaaattatgacacttaacgatattaaaatcatccaggtatcctgcggacactatcactcactcgctctgtccaaggattctcaggtcttctcttggggaaagaacagccacggacaactcgggctgggcaaggagtttcctagccaagcgtcaccacagcgggtgagaagcctggaggggattccccttgctcaggtcgcagctggcggcgctcactcttttgcacttagtctttgtggcaccagtttcggctggggctcaaattccgccggccaactggccctctctgggagaaatgtgcctgttcagtcaaataaacctctgagcgtgggggctttaaaaaatctgggtgtggtgtatattagttgtggagacgcccacacagcagtgctaacacaagatggaaaagtctttactttcggtgacaaccgatctggacagctggggtacagtccaacgcccgagaaaaggggtccacagttggtggagcgcatagacggactggtgagtcagattgactgtggctcttaccataccttggcctatgttcacacaaccggacaagtcgtcagcttcggccacggtccttccgatacatccaaaccaacacacccggaggcactgacagagaattttgacatctcgtgcctgatcagcgccgaggattttgtcgacgttcaggtaaagcacatctttgccggcacgtacgcaaactttgtaaccacccatcaggacacttcttccactcgcgcacccgggaaaactttgcccgaaatctcccgcattagtcagtctatggctgagaaatggattgccgtaaagaggcggtccacagaacatgaaatggccaagagcgaaattaggatgattttcagctctccggcatgtttgacagcttcatttcttaaaaaacgggggactggggagaccacctcaatcgacgtcgacctcgagatggcgagagacactttcaagaaattgacaaaaaaagagtggatctccagtatgattaccacatgtttagaagacgatttgctccgggccttaccctgccattctccacaccaagaagctctgtctgtctttctccttcttcccgaatgcccggtgatgcatgatagtaaaaactggaaaaacctggtggtaccatttgcaaaggcagtgtgcgaaatgagcaagcagagtctgcaagtccttaagaaatgctgggcttttctccaggaatcctccttgaacccgctgatccagatgcttaaagccgcaatcatcagccagctgctccatcagactaaaaccgagcaggatcactgcaacgtgaaagccctgctcggaatgatgaaggagttacacaaagtcaacaaagctaattgtcgactgcctgaaaacactttcaatattaacgagttgtcaaacttgttgaatttttacattgatagggggaggcagctcttcagggataaccacttaattccagcagaaaccccttcaccagtaatattttcggatttccctttcatatttaattcactctctaaaatcaaactccttcaggcagactctcacattaaaatgcagatgtcagaaaagaaggcctatatgctgatgcacgaaaccatcctgcagaaaaaggacgaatttcccccaagtcctcgctttattctcagagtcaggcgcagcaggctggtcaaggacgcattaagacaactaagtcaggcagaggccacagacttttgtaaggtgctggtggtcgagtttatcaacgaaatctgccccgagtctggcggcgtgtcttccgaattcttccactgcatgttcgaggagatgaccaagcccgagtacggtatgtttatgtaccctgaaatgggatcatgcatgtggttcccagccaagccgaaaccagaaaagaaacgctattttctgtttggtatgctctgtggtttgagccttttcaacctcaatgtcgcgaacttgcccttccccctggccctgtacaagaagctgctggaccagaagccatccctggaagatctcaaagaattgagccctcgcctcgggaagagtctccaagaggtgctagacgatgccgctgacgacatcggggacgcattgtgtatccgattctccatccattgggaccagaacgatgtggatcttattcctaacgggatcagcattcctgtcgatcaaacgaacaagagagactatgtgagcaagtacattgattacatcttcaacgtttccgtgaaggccgtctatgaggaatttcagagagggttctaccgggtgtgtgaaaaagagatcctcagacacttttaccctgaagaactgatgacagccattattggcaacacagattatgattggaaacagttcgagcaaaattccaaatatgagcaggggtatcagaagtcccatcctaccatccaattgttctggaaggcttttcataaacttacacttgacgagaaaaagaagttcctgttctttctcaccggccgtgaccgattgcacgccagaggcatacagaagatggaaatcgttttcagatgcccagagaccttcagcgaacgggaccatccgacgagcattacctgtcacaacatcctgtccctccccaagtactctaccatggagaggatggaggaggcgctacaagtggccataaataataaccgggggtttgtgtcccctatgttaacacagagctag

SEQ ID NO: 23019 - DNA, 1221 bp, Artificial Sequence
  Description of Artificial Sequence: Synthetic coding sequence
atggccgccgccgtgcggcaggacctggcccagctgatgaacagctctggttcccataaggatctggcgggtaagtaccgacaaatactcgaaaaggctattcagctcagcggtgctgaacagttggaggcccttaaggcattcgtggaggccatggtcaacgagaatgtatcattggtgatcagcagacagttgctcactgatttctgtacccacctccctaacctcccagacagcaccgccaaggagatatatcactttactctggagaagattcagcctagggttatctcttttgaggaacaggtagcctcgatcagacagcacctggcgtcaatctatgagaaagaggaagactggcgaaacgccgcccaggtgcttgttggaattccgctcgagaccggccagaagcagtataacgtggactataaactggagacgtacttaaagatcgccaggttatacttggaagacgatgaccctgtgcaggcggaggcctacatcaatcgggcctcactgctgcagaatgaatctactaacgaacagctgcagatccactacaaggtgtgttatgcacgggtcttagactatagaaggaagtttattgaggccgcccagcgatacaacgaactgtcgtacaagactatcgttcatgagtctgaaaggttggaggccctcaaacatgctttacactgtaccatactagccagtgccggccagcaacgctccaggatgttagccaccctcttcaaagacgagagatgccagcaattagcagcgtatgggatcttagagaagatgtacctcgaccggatcatccgcgggaatcaactgcaagagtttgccgctatgctgatgccacaccagaaagccactactgcagatggttcatccatcctggatcgggcagtgattgagcacaatctgctgtccgcttccaagctctacaacaatattacgtttgaagagctgggggcgttgctggaaattcctgcggccaaggcagagaaaattgctagccagatgataacagaggggagaatgaatggatttatcgatcagatagatggcatagtccacttcgagacccgggaagcactgccgacatgggataagcaaatacagtctctgtgctttcaggtaaataacctcctcgagaaaatcagtcagacggcccccgaatggacagcccaggcaatggaggcccagatggcccagtag

SEQ ID NO: 23020 - DNA, 1578 bp, Artificial Sequence
  Description of Artificial Sequence: Synthetic coding sequence
atggccgccggcctgctgggcagcgaggaccccccctggagctggaatctgacatgccgcgctctgagaacatgccaggtgagaaatattagggtcttacagctcctgttgaagccctggtgtatctctcgtgctgtctatcaaatgacagagggccgtaggtgccaggtgcatctactggacgatagaaagctggagctactcgtccagcccaaactgctggccaaggaactgctggacctggtggcaagccacttcaacctgaaggagaaagagtatttcggcatagcatttaccgatgagacaggacaccttaactggctccagttagataggcgcgtcttggaacatgattttccaaaaaaatccggacctgtggtcctgtacttctgcgtccgtttctacattgaatccataagttatctcaaggacaacgctacgattgagctgtttttccttaacgccaagagctgcatttataaggagcttattgacgtagattcggaagtggtctttgaactggcatcatacatcctgcaggaagccaaaggagatttcagctcgaatgaagttgtgcggagtgacttgaaaaaacttccagctctgcccactcaggctctgaaggaacaccctagcctcgcctactgcgaagatagagttatcgagcactacaagaagcttaatggacagacacgaggacaggccatcgttaactatatgagcatagtcgagtcattgccaacttatggtgtccactattatgcggttaaggataaacaggggattccatggtggctggggctgtcctacaaggggattttccagtacgactatcacgataaggtaaagcctcggaaaatatttcagtggcggcagctcgagaacttatatttccgcgaaaagaaattttcggtggaggtacacgacccaagacgggcttctgtgacacgcaggaccttcggccacagcggtatcgcagtccacacatggtacgcctgccccgctctcatcaaatctatctgggcgatggccatcagtcagcaccagttctacctggaccgtaaacagtccaaaagcaagattcacgcagccaggagcttaagcgaaattgcaatcgatttaacggagactgggactctgaagacttctaagctggccaacatgggtagtaaggggaagatcatctctggatcatccggtagcctcttaagctcgggctcccaggaatcagactcttcccagagcgccaagaaagacatgctggctgccctgaagtcacgacaggaggcactagaagagactctccggcaacgcctggaggaacttaagaagctctgcctgcgagaagcagagctcacaggaaagctgccagtcgagtaccccttggacccaggagaggaaccccccatcgtgcggaggaggatcggtaccgccttcaagctggatgaacagaagatacttcctaagggcgaagaagccgagttagaacgccttgaacgtgaattcgcaatccagtcccaaatcaccgaggcagcgcgacgcttggcaagcgacccaaatgtcagcaagaaactctag

SEQ ID NO: 23021 - DNA, 1605 bp, Artificial Sequence
  Description of Artificial Sequence: Synthetic coding sequence
atgaagcaggagggcagcgcccggcggcggggcgccgacaaggccaaacccccacctggcggcggagaacaggagcctcctcccccaccagccccccaggatgtcgagatgaaggaagaagcagccacaggtggggggagcactggagaggcagacggtaaaacagccgcggctgccgccgagcactctcagagagagttggatacggtgacactcgaagatatcaaagaacatgttaagcaactcgagaaagctgtaagcggcaaggaacctcgtttcgtcctgcgggccttacggatgttgccctctacctcacggagattaaaccactacgtcctgtacaaggctgtccaaggcttcttcacctcgaacaacgctacacgggacttcctgctgccgtttttggaggagcccatggacacggaggctgatttacagttccgtccccgaaccggaaaggccgcctctactcccctgttacctgaagtggaggcatacttgcaacttctcgtggtgattttcatgatgaattctaagagatataaagaagcccagaaaatctctgatgatcttatgcagaaaatctcaactcagaataggcgagcgctggatctggtggctgcaaaatgctactattaccacgcgcgcgtgtacgaattcctcgataaattggacgtggtacgaagctttctgcatgctagattgcgcacagcaacccttcggcacgacgctgatggacaggctacgctgcttaacctgctcctccgtaattatctgcattactcactgtacgaccaggccgagaaattggtcagcaaatctgtgttcccggaacaggccaacaataacgaatgggcaaggtatctgtactacacaggacggatcaaggctatccaacttgagtactcggaggcgcgcagaacaatgaccaacgcacttaggaaggcgccgcagcacactgcagtcgggtttaagcagacggtgcacaagctgctgattgtggtcgaactcctcttaggtgaaatacccgaccgactgcagttcagacaaccaagtttaaagcggtcacttatgccttacttcctgcttacccaggcagtcagaactgggaacctggcaaagtttaatcaggtgctggaccaattcggtgagaaattccaggccgacggaacatatactttgataattcgactgcgccacaatgtgattaaaacgggggtgcgcatgattagtctgagctacagccggatttctcttgctgacattgcacagaagctccagcttgactccccagaagacgccgaatttatcgtcgctaaggcaatccgcgacggtgtgattgaggcatccatcaaccacgagaaaggatatgtgcagtccaaagagatgatagatatatatagtaccagagaaccccagctcgcattccaccagcgaatttcattttgtctggatatccacaacatgagtgttaaagccatgcgcttcccacccaaatcgtacaacaaggatttggaatccgctgaagaaagaagggaaagggagcagcaggacctggaatttgccaaggagatggccgaggacgacgatgatagcttcccttag

SEQ ID NO: 23022 - DNA, 1311 bp, Artificial Sequence
  Description of Artificial Sequence: Synthetic coding sequence
atgcggcgggacgtgaacggcgtgaccaagagccggttcgagatgtttagtaactctgatgaggctgtcataaacaaaaaactgcccaaggagcttctgctgagaattttcagttttttggacgtcgtgaccttatgcagatgcgcacaggtctcccgcgcttggaatgtcctcgctctagacggatcaaattggcagcgcattgacctttttgatttccagcgtgacatcgagggcagagtggtagaaaacatctcaaaacggtgtggggggttccttcggaagctctcgcttaggggatgtctaggcgtgggcgataacgctctcagaactttcgctcaaaattgcagaaacatagaggtactcaacctgaatgggtgcactaagacgacggacgcaacatgcacaagcctgtcaaaattttgcagtaagttgcggcatctggacctcgcatcttgcacatctattacaaacatgtcccttaaggctctgtctgagggctgccctctactggaacagttaaacatatcatggtgcgaccaggtgacaaaagatggaatacaggccttggtcaggggctgtggcggactgaaagcccttttcctgaagggctgtactcaattggaggacgaagctctgaaatacattggtgctcactgccccgagcttgtcacactcaacctccagacatgtctgcagattacagatgaagggctgattacgatctgccgcgggtgccacaagctgcagtcactgtgcgcttccgggtgttctaacatcacggacgctattcttaacgccttaggtcagaactgtccaaggctcaggattctggaggtcgccagatgttcccagctgacagacgtcggatttactacactggcacggaactgccacgaactggaaaaaatggatctcgaagagtgtgttcagattaccgatagcactctgattcagctgagtattcactgccctcggctgcaggttctgtccttgtcacactgcgagctaattacggatgacggaatcaggcatctcggaaacggggcctgtgcacacgaccagctggaggtcatcgagttggacaattgccccctgatcaccgatgccagcctagagcatctcaaatcctgccactccctggagaggatcgaattatatgactgtcagcaaatcactcgggctggcatcaagcggcttcgcactcacctgcccaatattaaggttcacgcttattttgctcccgtgactccacctccaagcgtcggtggtagccgccagagattttgtcggtgctgcataatactgtag

SEQ ID NO: 23023 - DNA, 1167 bp, Artificial Sequence
  Description of Artificial Sequence: Synthetic coding sequence
atgcggtgcctgtacggccgggtgggcggcgcccggcggaagatggctgcctccgccgcggccgctgagctgcaggcctccggtgggcccaggcaccctgtttgccttttagtgctgggaatggctgggtcaggcaaaactacctttgttcaacggctgaccggccacctgcacgctcagggtacccccccctacgtcataaatctagatcccgctgtgcatgaggtaccattcccggcgaatattgatattcgcgacactgttaaatataaggaagtaatgaagcagtatggcctcgggcctaacgggggtattgtgacaagcctcaacttgttcgcgactcgattcgaccaggtcatgaaatttatcgaaaaagcgcaaaatatgtctaagtatgtgctcattgacacaccgggacagatagaggtattcacctggtccgcttctggcacaatcattacggaggcgctggcctcatccttccctaccgttgtaatatacgtcatggataccagtcggtctactaatccggtgacctttatgagcaacatgctttacgcatgctcaattctgtacaaaacaaagctgccctttattgtggtgatgaataaaactgacattattgaccattcctttgccgttgaatggatgcaggatttcgaggcctttcaagatgctctgaaccaggaaaccacctatgtgtctaacctcacaagatcgatgtccttggtgctggacgaattctactcttccttaagggtggtgggcgtgtctgctgtacttggcactggcctggatgaactattcgtccaggtaacatcagctgctgaggaatatgagagggagtatcggccagaatacgaacggctcaaaaagagcctggctaacgctgaaagccaacaacagcgggaacagctggaaaggctgagaaaagatatgggctctgtcgccctagacgcggggactgccaaggattcactgtcacctgtgctacaccccagtgacctcattttgacacgagggacgctcgatgaggaagacgaagaagccgatagcgatacagacgacatagatcaccgcgtcaccgaggaatctcacgaggaacctgcattccagaactttatgcaggaaagcatggctcagtactggaagcgtaacaacaaatag

SEQ ID NO: 23024 - DNA, 1668 bp, Artificial Sequence
  Description of Artificial Sequence: Synthetic coding sequence
atgcggctgatcggcatgcccaaggagaagtacgacccccccgaccctcggcgtatatatactattatgtctgctgaggaagtggcaaacgggaagaaaagtcattgggctgaactcgaaattagtggccgcgttcggtcactctcaacctcgctatggtcgttaactcatctgacggccctccacctgaacgacaattatctctctagaatcccccccgacatcgccaaacttcataacctggtatatctcgatctgtcctcaaacaagttaaggtcactgcctgctgagctgggcaatatggtgtccttacgggagttgcttcttaacaacaatctgctgcgggtgctgccatatgaactgggccgtctttttcagctgcaaaccttgggccttaaaggtaatccactgagccaggacatccttaacctgtatcaagatcccgatggtactagaaagttgctgaacttcatgttggacaatctggccgtgcatccagaacaacttccacccaggccttggatcacattgaaagagcgcgaccagattctcccatcagccagttttaccgtcatgtgctataatgtgctgtgcgacaagtatgctactcgtcaactttacggttactgtcccagctgggcattgaactgggagtataggaaaaaagggatcatggaggaaattgtgaactgcgacgccgatataatctccctacaagaagtggaaaccgaacagtattttaccctgttcctgcccgctctcaaagagaggggatacgacggattcttctcccctaagtcaagggcaaaaatcatgtctgagcaagaacgaaagcacgtggatggctgcgcaatttttttcaagactgagaaatttacactggtccagaagcacaccgttgagttcaatcaagtggcgatggccaacagcgacgggtccgaggcaatgcttaatagggtcatgacaaaagacaacattggcgtggccgtggtgctggaggtgcacaaagagttatttggtgcaggcatgaagcccattcatgcagccgataagcagcttctgattgtggccaatgctcacatgcactgggaccctgagtatagcgatgtgaagcttatccagactatgatgttcgtcagcgaagtgaagaacatcctggagaaggcatcaagtcggcctggtagcccaaccgctgaccctaattcaatccccctagttctctgtgcagaccttaattcattgcccgactcaggcgtcgtcgaatacctgagcaacggtggtgtggcggataatcacaaagacttcaaggaactaagatacaacgaatgtctgatgaatttcagctgcaacggcaagaacggctcaagtgagggtcgcatcactcatgggttccagctcaaaagtgcctacgagaacaaccttatgccttatactaactataccttcgacttcaagggagtgatcgactacatcttctacagcaaaactcatatgaacgtcttgggtgtgttgggccccctggatccccagtggctggtggagaacaacattacggggtgtccgcaccctcacataccctcagatcacttcagcctgctgacacaattggagctccatccacctttactccctctcgttaacggcgttcacttaccaaatagacggtag

SEQ ID NO: 23025 - DNA, 2673 bp, Artificial Sequence
  Description of Artificial Sequence: Synthetic coding sequence
agcagcgacagcgagatcatcggctacgccctggacaccctgtacaatataatcagtaatgaagaggaggaggaggtggaggagaactcaaccaggcaatcagaagacctcggatcgcagtttacggaaattttcatcaagcagcaagagaatgtaacacttctgctaagcctgctggaggagttcgacttccatgtgcgatggcctggcgttaagttgcttacctcgctgttgaagcaactgggtccgcaggtgcagcagataatcctggtttcacccatgggtgtctccagattgatggacctgcttgccgatagtagggaagtgataagaaacgacggcgtcctgctccttcaagccctcactcgttccaatggggccatccagaaaattgtggcgttcgaaaacgcgtttgaaaggctgctggatattatctcagaagagggcaatagtgacggagggatagtggttgaagactgcctcattctcttgcagaatctccttaagaacaataacagcaatcagaactttttcaaagaaggatcttacatccagcggatgaaaccctggtttgaggtgggcgacgaaaatagcggatggagcgcccagaaggtgacaaacttgcaccttatgctccagttggtaagagtgctggtctctcctacgaacccgcccggggccaccagcagctgccagaaggctatgtttcagtgcgggctgctgcagcagctgtgcacaatccttatggcaacaggcgtgcctgccgatatcctcactgaaaccatcaacacagtatcggaggttattagagggtgccaagtgaatcaggattacttcgcgagtgtcaacgcaccaagtaatccacctaggcctgcaatcgttgttctgctgatgtcaatggtgaacgaacgacagccattcgttctcaggtgcgctgttctttactgtttccagtgcttcctgtataaaaaccagaagggccaaggcgagatcgtctctacgctgctcccgagcaccattgatgccacagggaacagcgtgtccgcaggacagctcttgtgtggtggcttgtttagcacagatagcctgagcaactggtgcgccgctgtggccctggcgcatgcgctgcaagaaaatgcaactcaaaaagaacaactcctgcgcgtccagctggctaccagcattggcaaccctccggtgtccctgcttcaacaatgtacaaacatcctgtcccagggatccaagatccaaaccagagtgggcttgctgatgcttctttgtacttggctcagtaattgccctatagccgtgacccactttctgcacaatagtgctaatgtcccattcttgaccggtcagatcgctgagaaccttggagaggaagagcagcttgtccaaggcctgtgtgctctgttactgggaatctctatctactttaacgacaactctctggaaagctatatgaaagagaaacttaaacagctgatagaaaagcgaatcggcaaggagaatttcattgaaaagctcggttttatttccaaacacgagctctattcacgcgcctcccagaagccacagcccaacttccctagccctgagtatatgatatttgaccatgaatttactaagctcgtgaaggagctcgagggggtcattaccaaagctatttataaatcttctgaggaggataagaaggaggaagaagtgaagaagacgctggaacaacacgacaatatcgtaacccactacaaaaatatgatcagggagcaagatttgcagcttgaggagctgcggcaacaggtgagtacgctcaaatgtcaaaatgagcaattacaaactgccgtgacacagcaggtctcgcagattcaacaacacaaagatcagtataacttgctcaagattcagttgggaaaggataatcagcatcaggggagttatagcgagggcgcgcaaatgaatgggatccaaccagaagagattggccgactaagagaagagattgaagagctgaagcggaaccaggagctgttgcagagtcaactcaccgagaaggactccatgattgagaacatgaagtcctcccaaacctctggcacaaatgagcagagcagtgccattgtaagcgcaagagactcggagcaagtggccgaattgaaacaagaactcgccacactgaagtctcagctgaactctcagtccgttgagataactaagctgcagacagagaagcaggaactcctccagaaaactgaggcctttgcaaagagcgtggaagttcagggggagaccgagacaattatagcaacaaagacgaccgatgtggagggcaggctctctgcgctcttacaagaaacaaaagaactgaagaacgagatcaaagctcttagcgaggagagaactgcaatcaaggagcagctcgactcctccaacagtactatagccatcttacaaactgaaaaggacaaactagagctagagataaccgatagcaagaaagaacaggacgatctgttagtcttattagcggaccaagatcaaaaaatcctctcgttgaagaataaattaaaggatctcggacatcccgtagaagaggaagatgagctggagagcggggatcaggaagatgaggatgacgagtcagaggacccaggaaaggatctagaccacatctag

SEQ ID NO: 23026 - DNA, 1944 bp, Artificial Sequence
  Description of Artificial Sequence: Synthetic coding sequence
atggcccgggccggcccccggctggtgctgagcgaggaggccgtgcgcgctaaatccggactcggcccccaccgggaccttgccgagcttcagagtctctccatacctggaacctaccaagaaaagatcacccacctaggtcacagcctgatgtctttgaccggattaaaatcgctggacctctcgaggaactcactcgtgagcctcgaggggatccaatacctcactgctctggaatccctgaatctgtattataactgcatctcctccctagcagaggtctttcgacttcacgctctgacagagctggtggatgtagactttcgcctcaatccagtcgtaaaggttgaaccagactacagactcttcgtggtacacctcttgccaaagctccagcagctggacgatcgccctgtgagagcatcagagaggaaggcctcccggctgcactttgccagcgaagacagtctcgactccaaggagtcagtccctgcctcgctgaaagaggggagaccacaccacccgcgcgccaagtgtaccgaagccctggctaaacaaagcctggtgatggatgccgacgatgaagccgttttgaatctgatcgcagagtgcgaatgggacttgggcaggcctcccggcagtacatccttttcccagaagggtagggaggccgactcccggggctcccaagagagccgccacctcttatctccgcagttggttcagtaccaatgcggagactcaggaaagcagggacgcgaaacacgcagatcctcttgccgaggttgttgtctggaaaagatgccctggagtcagctgtgtggtgaacttccacccctatacggcgcagagcccgaggcctcgagggctcctcgtccacatacatactttacaccacatcctgattccatggacaccgaggatagcgcatcatctcaaaagctggatctgtccggtgaaatggtccctggccctctaccagctcccggcaaatgtcgcaagcgcagaatgcctgtgggtcgcttccagactttttccgatcaggagggattgggttgtccggaacgaacacacggcagtagcgtcccgaaggagtcactctctagacaagatagctcagaaagtaggaacggtagaaccctttctcaacccgaagcatcggagacagaagaacagagatctcgcggcgtcactgatactcgtgagccatccccaggctcccactccgctctccctggaaagaagacagcgctgcaggccgcactactggaaaccctcttagatctggtggatagaagctggggtggctgccgatctctgcacagcaatgaagcttttctcgcccaggcaagacatatattgagcagtgttgaggagttcactgctgcccaggactcctctgccatggtcggcgaggatgtggggagtctggcccttgaaagcaaaagcctacagtctagacttgcagagcagcaacaacagcacgcccgcgagatgagcgaagtgacagctgaactgcaccacactcataaggaacttgacgatttgagacaacatcttgataagtctcttgaggaaaatagccgactcaaatcccttctactcagtatgaaaaaggaggttaaaagcgctgacactgctgcgacactcaacctgcagattgccggactacagacctcagtgaagaggctgtgcggggagatcgtcgagctgaaacagcatctggaacattatgacaaaattcaggaactcacacagatgctgcaggagtcccactcttcactggtcagcaccaacgaacacctgctgcaggagttgtcacaggttagagcccagcacagggccgaagtcgagcagatgcattggtcttaccaagagcttaaaaaaaccatggcactcttcccacatagtagcgccagccacggggggtgccaggcatgttag

SEQ ID NO: 23027 - DNA, 777 bp, Artificial Sequence
  Description of Artificial Sequence: Synthetic coding sequence
atggccgagaccgaggagcggagcctggacaacttcttcgccaagcgggataaaaagaaaaaaaaggaacgaagcaatagagctgctagcgccgccggagctgccgggagcgccgggggatcttctggcgcagccggagccgcaggggggggcgcgggggctggcactagacctggcgatggtgggaccgcatcagcgggtgctgcaggccctggtgccgctacaaaggcagtgacgaaggacgaagatgaatggaaggagctggaacaaaaggaggtggattactccggactcagagtgcaggcaatgcagataagctctgagaaagaggaggatgataatgagaagcggcaggaccctggggacaactgggaggagggtggcggaggcggcggcggcatggagaaatcttcagggccctggaataagacagcgcccgtacaagctcctcctgcccctgtgatcgtgacagaaactcctgaacccgccatgacatctggagtgtaccgcccaccgggtgcccggctgacgacaacccgcaagacacctcaggggccacctgaaatttattccgacacgcagtttccttcattacagtcaacggccaaacacgtagaatctaggaaagataaggagatggagaagtcgtttgaagttgtgcgacacaagaatagaggtagagacgaggtctctaagaaccaggccctgaaacttcagctggacaaccagtatgccgtactcgagaatcagaagtcgtctcatagccagtataactag

SEQ ID NO: 23028 - DNA, 1077 bp, Artificial Sequence
  Description of Artificial Sequence: Synthetic coding sequence
atggccccccagaacctgagcaccttctgcctgctgctgctgtacttaatcggagctgttattgcaggtagagacttttacaaaatcttaggagttccacgatcagcttccataaaggacattaagaaagcctaccgcaaattggccctgcaactgcaccccgaccgcaaccccgacgatcctcaggcccaagagaagttccaggatcttggggccgcctacgaagtgctgagcgatagtgagaaaagaaagcagtacgacacctacggagaagaagggttaaaagacggacatcagtcttcccacggggacattttttcccattttttcggggactttgggttcatgtttggggggacaccacggcagcaggaccgaaatatacctcgcgggtccgacattatcgtggatctggaggtcacacttgaagaagtatatgcaggcaattttgtggaagttgtaaggaataaacccgtcgctcggcaggcccctggcaagagaaaatgcaattgtaggcaggagatgcgtactacacagcttggaccaggcagatttcagatgacacaagaagtcgtgtgtgatgaatgccctaacgttaaactcgtgaatgaagagagaacgctggaagtagaaattgagcccggagtccgggatggcatggagtaccctttcatcggagaaggggagccgcacgttgatggggagcctggagacctacgatttcgaattaaggtagttaagcatcctatcttcgagcgtagaggtgacgatctgtacaccaacgtgaccatttcgctggtggagtctcttgtagggtttgagatggatatcacacacctggatggacataaggtccatatcagccgtgacaaaatcacaaggcccggggcgaaactgtggaagaagggcgaaggcctcccgaacttcgacaataacaatatcaagggctcactgatcatcacattcgatgtggacttcccaaaggaacagcttacagaggaagcccgcgagggcattaaacagctgctgaagcagggaagcgtacagaaggtgtacaacggcctgcagggttactag

SEQ ID NO: 23029 - DNA, 624 bp, Artificial Sequence
  Description of Artificial Sequence: Synthetic coding sequence
atgaccagccggaagaaggtgctgctgaaggtgatcatcctgggcgattctggggtgggcaaaacctccctgatgaaccagtacgtcaacaaaaagttctcaaatcagtacaaggcaacaatcggggcagactttttaactaaggaagtcatggtagatgatcggttggtgacaatgcaaatttgggatacggccggtcaggaacgcttccagtctctgggcgtggcattctatcgcggagcggactgttgcgtgctggtgttcgacgtgaccgcccccaatacctttaaaacactggactcatggcgggatgagttcctgattcaggcatctccgagagaccccgagaacttccccttcgtagtgctcggcaataaaattgacttagaaaaccggcaggtcgctacaaagagagctcaggcatggtgttattccaaaaacaatataccctacttcgaaacgagcgccaaggaagctattaacgttgaacaggccttccaaacgatagcacgtaatgctcttaagcaggagaccgaagtggagctgtataatgagttcccggagccgatcaaattggacaagaatgaccgggctaaagcttccgccgaatcatgttcttgctag

SEQ ID NO: 23030 - DNA, 3225 bp, Artificial Sequence
  Description of Artificial Sequence: Synthetic coding sequence
atgatccccatctgccccgtggtgagcttcacctacgtgcccagccgattgggggaagacgccaagatggctacaggcaactactttggatttacacactcaggcgctgcagccgcggccgccgccgcccaatacagccagcagcctgcatctggagttgcttattcccaccctaccacggtcgcaagctacactgtgcatcaggcgcctgtggccgcccacacggtcacagcggcctatgcaccagccgcggccactgtggcggtcgccagaccggctccagtggctgtggcagccgccgctaccgctgcggcttatgggggatatccaacggcccacactgctacggattacggctatacacaaagacagcaggaggcccctcctcctccgccccctgctacgacacagaattatcaggatagttattcctatgtcaggtccaccgcccctgctgtcgcttacgatagcaaacagtactatcagcaacctacagcaaccgccgccgccgtggcggctgcggcccaaccccaaccaagtgttgctgaaacttattaccagaccgctcctaaggccggatacagccagggggctacccagtacacccaggcccagcagacgcgccaggtgaccgctatcaagcctgcaacccccagtcccgcaaccacaactttttcaatataccccgtgtcttctaccgtacagccagtggccgctgctgcgactgtggtacccagctatacccagtctgctacctactctacaaccgcagtgacctactcgggtacctcctatagcggctacgaagcggctgtgtattccgccgcctcttcatactatcagcaacagcagcagcagcagaaacaggccgccgcggccgccgcagcggctgcagctacagcagcgtggaccggcaccaccttcacaaagaaggcaccattccaaaacaaacagctgaagcccaagcagccaccaaagcccccccaaattcactattgcgacgtctgcaagatctcttgtgcaggtccacaaacatataaagagcacctcgaaggtcaaaagcacaagaagaaagaggccgcactgaaagcatcccagaacacaagctcctccaacagctccacccgcggaacccagaatcagcttagatgtgaactgtgcgacgtgtcatgcacaggagcagatgcatacgctgcccacatcaggggcgccaagcatcagaaagtggttaaactacatactaagttgggcaaaccgatccctagcaccgagcctaacgtggtttcccaagcaacaagttctacagctgtttcagcgtcaaaacccactgccagcccctcatcaatcgctgctaacaattgcaccgtcaacacgtccagtgtggctacttcttcaatgaaggggctgactacgacgggcaactcaagtctcaactccacatccaatacaaaggtctctgcggtgcctacaaatatggctgccaagaaaacttctacccccaaaatcaacttcgtgggtggcaataaactgcagagtactggaaacaaggctgaggacatcaaaggcacagaatgcgtgaaatctacacccgtgacaagtgccgtccaaatccctgaagtgaagcaggacacagtctccgagcccgtcacaccagcgagcttagccgcactacaatccgacgtgcagccagtgggccatgactacgtggaggaggttcgcaacgatgaaggaaaggtgattcgtttccattgtaaactttgcgaatgcagtttcaatgacccaaatgccaaagaaatgcacttgaaaggcagacggcatcgtctgcagtataagaaaaaggttaaccccgatctccaagtggaagtcaaaccgagcatccgggcgagaaaaatacaggaggagaaaatgcgaaaacagatgcagaaggaagagtactggcgccgaagagaggaggaagagaggtggcgcatggagatgcgaagatacgaggaggatatgtattggagacggatggaagaggagcagcaccattgggacgatcgccgccgaatgcctgacggcggttatccacacggccctcctggacctctgggactcctgggagttcggcccgggatgcctccacaacctcagggaccggctcctctgcgtagaccagattcctctgatgaccgctatgtcatgactaagcacgccactatctaccctaccgaagaagagttgcaagctgtccagaaaattgtgtccattactgagagggccctcaaacttgtctccgatagcctcagtgaacacgagaaaaacaagaacaaggagggggacgacaagaaggagggaggcaaggatcgggcccttaagggtgtcttgcgcgtaggggtgcttgcaaagggactgctcctgaggggtgacagaaacgtcaacttggttctgctgtgctccgaaaaacccagtaagaccctactctcacgaattgccgagaatttgcctaaacagttagcagttatctcccctgaaaaatatgacattaagtgcgcggtgagtgaagcagctattatcctgaattcttgtgtcgagcctaagatgcaggtgaccataacccttactagccccattatccgggaagagaatatgcgggaaggcgatgtgacatccggcatggtaaaagacccacccgatgtgctggatcgccagaaatgtctggatgcactcgccgccctgcgtcacgcgaaatggtttcaagcgagagctaacggactgcagagctgtgtcatcatcattcgcattctgcgggatctttgccagagggtgcccacctggagtgatttcccctcatgggccatggaattgctggtcgagaaggccatatcgtctgcctctagccctcagtctcctggcgatgcactgagacgggtgtttgagtgtattagctctgggatcattctcaaaggttccccaggcctgttggacccctgtgagaaggatccctttgacacattggcaactatgaccgatcagcaacgtgaggatatcacctcttccgctcagttcgccctaaggcttttggcctttcgacagatccacaaggtacttggcatggacccactccctcagatgagtcagcggttcaatattcataacaatagaaagagaagacgcgatagcgacggcgtggatggcttcgaagcagaaggcaaaaaggataagaaggattacgataacttctag

SEQ ID NO: 23031 - DNA, 438 bp, Artificial Sequence
  Description of Artificial Sequence: Synthetic coding sequence
atgaagttcaaccccttcgtgaccagcgaccggagcaagaaccggaagagacacttcaacgcaccatcccacgttcgcaggaaaattatgtcatcccccctgagcaaggagcttaggcagaaatacaacgttcgcagcatgcctataaggaaagatgatgaagtccaggtcgtaagaggacactataagggtcagcagattgggaaggtcgtgcaggtatacaggaaaaagtacgttatttatatcgagcgagtgcaaagagaaaaagcgaacgggacaactgtgcacgtgggtattcatccatcaaaagtagtgattacccgactgaaattagacaaggataggaagaagatcctggagcgcaaggccaaaagcagacaggtgggtaaggaaaagggtaaatataaagaagagctgattgagaaaatgcaagaatag

SEQ ID NO: 23032 - DNA, 3177 bp, Artificial Sequence
  Description of Artificial Sequence: Synthetic coding sequence
atggaggacggcacccccaagcacatcatccagatgaccggcttcaagatggaggaaaaggaggcactcgtgaaactcctgttgaagctggattgcaccttcattaagtccgagaagtacaagaactgcacccacctaattgccgaacggctttgtaagagtgagaaatttctggctgcttgtgcagcaggaaagtggattctgaccaaggattacattatacatagcgcaaagagtggccggtggctggatgaaaccacatacgagtgggggtacaaaatagagaaggatagccgctactccccccaaatgcaaagcgcgcctaagcgctggagagaggagctcaagcgcactggagcccccggcgctttccaccggtggaaggtggttctactcgtcagaaccgataagcgtagcgatagcttaatacgggttttagaggcagggaaggcaaacgtaattctgcccaaaagctcacctagcgggatcacacacgtcatcgcatcaaacgctagaattaaggcagagaaggagaaggataatttcaaagcccccttctatcctattcagtatctgggggacttcctcctggagaaagagattcagaacgatgaagacagccagactaatagcgtttggaccgagcacagcaacgaggaaacgaacaaagatttccgtaaagacgccggttttctggagatgaaaggcgctctgcgggaaaccatgtatcggacccagaaggaaatgcagaaccacgaggacgtgaacgtcgggtccattctcattcagcatcacaaaaaggagaaattcagcggcagctctaaagacctaaagtttgtgaagatgaggaacacattcggttcccatacctatgagaatcagaaggaaataaaaaaaaaagacgaagacattcaacgttcgtatacccttcgccgaaagcggaaaaagggaaaagagtccaattgcaagaagggggttgaacacgaaaagataaaatccacactgaggaggcatatttacaatagagaccagaaggagatgaaaaacagcatttttgctgaatacgccaaagagtctaaggcaatggcaataaaaacagatgtggatgtcgtagagattaagaacactctgcggaaacacatctatagggcgcaggctgtgcgttataactgtatccggatcgacaaacagcccgtgtataacgtcgaagtgaagaacgctgagtttccacgtggcgtgctgaatttgatcgagtccctgatcgagggacactttttcaaggaggcaatcgaagagctctctaccctgcaggcacattacattccacccgtgtgtgtgttacacgccctcctggagaacgtattgcaggacaatatcgacacattttctggccgatattttcacattctctcagctctcctacacctgcaccctccctggaaaagcccagctatgagtcggtattatctggagctcttccagtgcccaacctgtatgaaaggggcctggagccttgtagaagtgcttattaggtcatgcctgttcaatgagtctttttgccaccagatttccgaaaacatagggagcaaggtcctgcacctgaccctcctgaagttcttcttcaatctgattgaatccgaggtccagcatctgtcacagaagttgtatgattggtcggatagtcagaatctgaagatcacaggtaaggcaatgctgctcgagatcttctggagcggtagtgagaccagcgggctgctgacaaagcccgtgaatatgctgttagaatggactatttacagccacaaagagaagtttaagtcaaacgacgtgtttaagcacgagctcgcatacctgcttgccggaattctgggggctgcgatcgactattggattttcttaggcctgaagatgggaagaaacgtaatgagacatatgagcgacgatctcggttcctacgtgtccctgtcatgtgacgacttcagctcacaggagcttgagatctttatctgcagcttttcgtcatcatggctgcagatgtttgtggctgaagccgtctttaagaaactgtgcctacaatcaagtgggtcggtttcatcggaacctttatcgttgcagaagatggtctatagctatttgccagctttgggaaagaccggggtactgggatctggtaagatccaggtgagtaagaaaattggccagaggccttgctttgactctcagcgtacactgctcatgctcaacgggactaagcaaaaacaggtcgaaggactaccagaattattagacctcaacctagccaagtgctcttcctcattgaagaagctgaagaaaaagagcgagggggaactgtcttgtagcaaggaaaactgccccagtgtggtcaagaaaatgaattttcataaaacaaatctgaagggtgagaccgccctgcatcgagcctgcattaacaaccaggtcgagaagctgatcctactgctgtctcttcccggaattgacatcaatgttaaagataacgccgggtggaccccccttcatgaggcatgtaactacgggaacacggtgtgcgtgcaggagattctccagagatgtccagaggtggatctcttaacgcaggtggacggcgtgactcccctccatgatgccttgtccaacggccacgttgagattggcaaattgctgctgcagcacggggggcctgtcttactgcagcagcgcaacgccaagggggagttgccactggactacgtggtcagcccccaaattaaggaggaattgttcgccataacgaagatcgaagataccgtcgagaactttcacgcccaggcagagaaacatttccactaccagcagctggagtttggatcatttcttctgtcccgtatgcttttaaacttctgctcaatttttgatctgtctagcgagtttatcctggcgtccaagggtctcacccatttgaacgagctgctgatggcctgcaagtcacacaaagagacaacatctgtccacacggactggctgttggacctgtacgccggtaacattaaaacattacagaaactaccccacattttgaaagagctccccgagaatctgaaggtctgccctggcgtccacactgaagcccttatgatcacattggagatgatgtgtcggagcgttatggaattctcgtag

SEQ ID NO: 23033 - DNA, 660 bp, Artificial Sequence
  Description of Artificial Sequence: Synthetic coding sequence
atggagcccaaggaggccaccggcaaggagaacatggtgaccaagaaaaaaaatttggcattcctgagaagcaggctatatatgcttgaacgacgaaagacagataccgttgttgagagctcagtgagcggggatcactccggcacactccgccgaagccagtctgacaggacagagtataatcagaaactccaagagaaaatgactccacagggcgaatgtagcgtggctgagaccttgaccccagaagaggagcatcacatgaaaagaatgatggccaaacgagagaaaatcatcaaggagctgatccagacggagaaggactacctcaacgatctcgaattatgcgtacgcgaggtggtccagccactccggaacaagaagaccgataggttagacgtggatagcctcttctcaaatatcgagtccgttcaccagatcagcgccaagctgctatcactcctggaagaagccaccacagacgttgaacctgctatgcaggttattggagaggtgttcctgcagatcaaagggcccctggaagatatatacaaaatttattgttaccaccacgacgaggctcacagcatcctggagagttacgaaaaagaggaagagctgaaggagcacctcagccactgtatccaatctctgaagtag

SEQ ID NO: 23034 - DNA, 3183 bp, Artificial Sequence
  Description of Artificial Sequence: Synthetic coding sequence
atgctgatcgaggacgtggacgccctgaagagctggctggccaagctgctagagccaatctgcgatgccgacccatcggcactcgccaactacgtggtggcccttgtgaagaaggacaagccagaaaaggaactgaaggcattctgtgccgaccagctggacgtatttcttcagaaggaaacatctggatttgtggacaaattgttcgaatcactgtatactaagaactacctgcctctgttggaacccgtgaagccagaacctaagcccctcgtacaagagaaagaagaaatcaaagaagaagtgttccaggagcccgcggaggaggagagggacgggaggaagaaaaaatacccatcacctcagaaaactcggtctgaaagctcagagcgccggaccagggagaagaagagggaggatggaaaatggcgagattacgaccgctactacgagcgcaatgaattgtatagggagaaatacgactggcggaggggacggagcaaaagccgctcaaagtcaaggggtcttagtcgctccagaagtcggtccaggggacggtccaaggatagagacccaaataggaatgtggaacaccgggagcgtagcaaatttaaatcagagcggaatgacctggagtcttcatacgtgcccgtttccgctcctcctcccaatagctccgagcaatacagcagcggcgcccagtctatcccttccacagtgaccgtgatagctcctgcccatcactccgagaacacgactgaatcctggagcaactactacaataaccactcatcatctaactcctttggacgcaatttaccccctaaacgccgctgcagggactatgatgaaagaggcttttgtgtgctcggcgatctatgccaattcgaccatggcaacgaccctctggttgtcgacgaagtagcccttcccagcatgatcccattcccaccaccccccccaggactgcctcccccacctccgcctggcatgcttatgcctcctatgcctggtccgggaccagggccaggtcccggccctgggccgggacccggccctgggccaggtcctggacattccatgaggctgccagtcccacaggggcacgggcagcctcctcctagtgtggtcttgcccatcccaaggcctccaattacccagagctccctcattaactctcgcgaccagcctgggacatctgcagttcctaatcttgctagcgttgggacaaggcttccccccccgctgccccagaacctgctatatacggtgtccgagcgccaaccgatgtacagcagggagcatggtgcagccgcctcagagcgcctccagctggggactccaccacccttactcgccgctagattagtgccaccccggaatctgatggggtcctcaatcggttatcataccagcgtgtctagccctactcctctggttccagacacctacgagcctgatggctacaatccagaagctcctagcatcacatcctcaggcagatcacaataccgacagttcttcagccgcacccaaactcagcggcctaatctgataggacttacctccggagacatggacgttaatccaagggccgccaacatcgtgattcaaactgagcccccagttcctgtgtcaattaattccaacattactcgcgtcgttcttgaacccgattcccgcaaaagggctatgtcgggactagagggccccctcacaaagaaaccttggctagggaaacaggggaataacaatcagaataagcctggcttcctgaggaaaaatcaatatactaatacgaagctggaggtgaaaaagatacctcaggaattgaacaacatcactaaactcaatgagcactttagcaagttcggcactatcgtgaacatccaggtggcctttaagggcgatcccgaggcagcgctgattcagtaccttacgaacgaggaagctagaaaggctatttcttcaaccgaggccgtgcttaacaataggtttatccgggtactgtggcatcgagagaacaacgaacagcccacactccagtccagcgctcagctcctgctacagcagcagcaaacgctctcacacttgtctcagcagcaccatcacctgccccagcacctccatcagcagcaggtcctggtggcccagagcgctcccagcactgtgcatggcggaattcagaaaatgatgtccaaacctcagaccagcggagcttacgtgctgaacaaggtgccagtaaaacacagactcggtcatgccgggggcaaccaatcggatgccagccatctcctgaatcaatctggcggggctggggaggactgccagatcttttctactcccgggcatccgaagatgatctactcctcttcgaacttgaaaactcctagtaaactctgttccggctcaaaatcccacgatgtgcaggaagtacttaagaaaaagcaggaagcaatgaagctccaacaggacatgaggaaaaagcgacaggaagtcctcgagaagcagattgagtgtcagaagatgctcatttctaagctagagaagaataagaacatgaagcccgaggagagggccaacatcatgaagacgctcaaggagcttggcgagaagatcagccagctcaaggacgagctgaagaccagctcggcagtgagcactccaagcaaggtcaaaaccaagaccgaggctcagaaagagctcctggataccgagctcgacctccacaagcgcctgtctagcggggaggataccaccgagctccgcaagaaactgtcacagttgcaagtggaggccgcccggctcgggatccttcctgttggacgggggaaaacaatgtctagccagggcaggggccgaggcagagggcggggaggcagaggacgggggagcttgaatcacatggtggtggaccaccgcccaaaagcgctgacggtgggtggatttattgaagaggaaaaggaggatctcctgcagcacttctctaccgctaaccagggccccaagttcaaggacagaaggctgcaaattagttggcataagcccaaggtgccctctatctcgaccgagacagaggaggaagaagtgaaagaggaggagacagaaacttctgatctgttcctgcctgacgacgatgacgaagacgaggatgagtatgagtctaggagttggagaaggtag

SEQ ID NO: 23035 - DNA, 1818 bp, Artificial Sequence
  Description of Artificial Sequence: Synthetic coding sequence
atggaggccgacatcatcaccaacctgcggtgccggctgaaggaggcggaagaggaacggctgaaagccgctcagtatggccttcagctcgtggagagccaaaatgagctgcagaatcagctggacaagtgcagaaacgagatgatgaccatgacggagagctatgaacaagagaagtataccctccagcgggaggtcgaactgaaaagccgcatgcttgaaagcctgtcatgtgagtgtgaggcgatcaagcagcaacagaagatgcatttagagaaacttgaggaacagctcagtcgctcccacgggcaggaggtgaatgagctgaaaacaaagattgaaaaattgaaggttgagcttgatgaggccaggctttctgaaaagcagttgaagcatcaggttgatcatcagaaggagctgctctcctgtaagtccgaggagcttagggtcatgtctgagagggttcaggagagcatgtcgtccgagatgttggcattacagatcgaactaaccgaaatggaatcgatgaagaccacactgaaagaagaggtaaatgagctgcaatatcggcaggagcagttagagttgctgattacaaatctgatgagacaggtggaccgtcttaaagaggaaaaggaggaaagagaaaaggaagctgttagttattacaatgcactcgagaaagccagagtggctaatcaggatctgcaggtccagttggatcaggcgctccaacaggccctcgatcctaacagcaagggcaatagtctgtttgctgaagttgaggacaggcgggccgccatggaacgacaactgattagcatgaaggttaaataccagtctctgaagaagcagaatgtgtttaacagagaacagatgcagcgcatgaagctccagatcgccaccctgctgcagatgaaaggatcacaaaccgaattcgagcagcaggaacgccttcttgccatgttggagcagaaaaacggtgagatcaagcacctcttaggcgaaatcaggaatctcgaaaagtttaagaacctctacgacagtatggaatcaaaaccatcagtggattcaggcactcttgaggacaacacctattacacggatctgttacaaatgaagctggataacttgaacaaagaaatcgagagcaccaaaggcgagttgtctattcagagaatgaaggcattattcgaaagccagcgggccttagatatagagcgtaagcttttcgctaacgagcgatgcctccagctgagcgaaagtgaaaacatgaaactgcgagctaaattggatgagctaaagctgaaatatgagccagaggagacagtcgaggtcccggtcttgaagaagagaagagaagtcttacctgtggacatcacgacagctaaggacgcatgcgtgaataactcagccttaggaggggaggtgtataggttaccaccccagaaagaggagacgcagtcctgtcctaattcactcgaagacaacaatcttcagctggaaaagtcagtctctatatacacacctgtagtgtcactcagtccccataagaatctcccggtcgacatgcagcttaaaaaagaaaaaaagtgcgtgaagctaattggcgttccagcggatgctgaggcactgtcagaacgctccgggaacacacctaactcaccccggctagcagccgagtcaaagctgcagacagaggtcaaggaaggtaaggaaacctcctcaaaattagagaaggaaacttgtaagaagctgcatccaatcctgtatgtttcttccaagtctactcccgagacacagtgcccccaacaatag

SEQ ID NO: 23036 - DNA, 888 bp, Artificial Sequence
  Description of Artificial Sequence: Synthetic coding sequence
atgatggccaagaagccccccaagcccgccccccggcggatcttccaggagaggttgaaaattactgccctgccactctactttgagggctttctgctgataaagcggagtggataccgggagtacgaacactactggacagagcttcggggtacaaccctgttcttctatacggataaaaagtccatcatctatgtcgacaagctagacattgtggaccttacctgcctcaccgaacagaacagcaccgaaaaaaactgtgcaaagtttaccctggtgctgccaaaggaggaagtccagctgaaaactgagaacacagaatccggggaagagtggagaggattcatcttaactgttacagaattgtccgtgccgcagaatgtttctttgctgcctgggcaggttatcaagctccacgaagttctagagagagagaagaagcgaagaatcgagactgagcagagtaccagcgtggaaaaggagaaagagcctactgaggactacgtagatgtgcttaatccgatgcccgcgtgtttctacaccgtatctaggaaggaggcaactgagatgctgcagaaaaacccaagcttaggcaacatgattttgaggcccggctcggattcgagaaattactccataacaatacggcaggagatcgacataccaaggatcaagcactacaaggttatgtccgttgggcagaactatacaatcgaactcgaaaagcctgtcacactgcccaacttattcagtgttattgactacttcgtgaaggaaactcgaggtaacctgcgcccctttatctgttccacagatgaaaacaccgggcaggaaccaagcatggagggccggtctgagaaactgaaaaaaaatccacacatagcctag

SEQ ID NO: 23037 - DNA, 4821 bp, Artificial Sequence
  Description of Artificial Sequence: Synthetic coding sequence
atgttccacatctgccccgccgagaacctgtaccagaaccggttcctgggacttgccgcaatggctagcccgagccgcaactcccagtcccggagaaggtgcaaggagccactgaggtactcttacaaccctgatcagtttcacaatatggatttgcggggaggaccccacgacggggttactatccctcgctcaacgagcgacactgacttagtaacttctgactctcgctccacccttatggttagtagttcttactactctataggccattctcaggatctagtcattcactgggacatcaaagaggaggtggacgccggagactggatagggatgtatctgatcgatgaagtgctttctgaaaattttcttgactacaaaaatcgcggagtaaatgggtctcaccgtggccaaattatatggaaaatcgacgctagttcttatttcgtggagccagaaacaaagatctgcttcaaatactatcacggggtaagcggggccttgcgggcaacgacccccagtgtaacggtgaagaattcagccgcccctatatttaagtcgatcggcgccgatgaaactgtccaaggacaagggagccgaagactcatttcattttctctgtccgacttccaggccatgggcctgaagaaaggaatgtttttcaatccagacccgtatttgaagattagcatccagcccggaaagcactccattttcccggccttgccccaccatgggcaggagaggcgatcaaaaattatagggaacactgtcaaccctatctggcaggctgaacagtttagtttcgtctcacttcctaccgacgtcttggagattgaagttaaggataaatttgccaaaagtagaccaataataaagaggttcctgggtaaactgagcatgcccgttcaaagactccttgagcgtcatgccataggagacagagtggttagttatacactcggccgccgtctgcctacagaccatgtgagtggccagttgcagttcaggttcgagattactagcagcatacacccagccgatgacgaagagatctctctgtccactgaacctgaatccgcacagatccaggacagccccatgaataacttgatggaaagcggcagtggcgagccccggagcgaggctccagaaagttctgaatcatggaagccagagcagctaggggaaggctctgtgcctgacggccctggtaaccagagcatcgagctgtcgaggccagccgaggaggctgcagtcatcactgaggctggagaccaggggatggtcagcgtggggccagaaggggccggcgagctcctcgcccaagtgcagaaagacattcagcctgcgccttcagccgaggagctggcagagcaacttgacttgggagaggaggcaagtgcactgctgttggaagacggagaggcccccgcttcaaccaaggaggaaccactagaagaggaggccacaacacagtcaagagctggaagggaagaagaggagaaggaacaggaggaggaaggtgacgtgtccacactggaacaaggcgagggtcgactgcaactgcgcgcctcagttaagagaaagtcacgaccgtgctcacttcctgtctcagagctggaaacggtgattgcctcagcgtgcggcgaccccgagacgccacggacgcactacatcaggatacataccttactccattcaatgccgtccgcacagggaggaagcgccgctgaggaagaggacggggcagaagaagaatctacacttaaggactctagcgagaaagacggactgtctgaggtagacaccgtggccgctgacccttccgctcttgaggaggatagggaagaaccagaaggcgctactcctggaaccgctcaccctgggcactctgggggacactttcccagcctggctaacggagctgcgcaggatggcgatacacacccgagtactggttcagagtctgactccagccccaggcagggaggtgaccactcatgcgaggggtgtgatgcaagctgctgtagtccctcttgctatagctcatcttgctactccaccagctgctatagttcttcctgctattcagctagctgctatagtccatcctgctacaacgggaataggttcgctagccataccaggttctcaagcgttgacagtgctaaaatatccgagagcaccgtgttctctagtcaggatgatgaagaggaggagaatagcgcgtttgaatctgtgccagatagtatgcaatcgccagagttggatcccgagtccaccaatggtgccggtccatggcaagatgagcttgcagcccccagcgggcatgttgagcgaagccccgaaggtctcgagagccccgtcgctggtccctcaaacagacgggagggagagtgtcccatattgcacaattcccagcctgtgtcccagctcccgtcactgcgtcctgagcaccatcattaccccactatcgatgagccacttcctccaaattgggaagctagaattgatagtcacgggcgggtgttctacgtggaccacgtgaaccgaaccaccacctggcagaggcccactgctgccgcaactcctgacgggatgcggagatccggtagcatacagcagatggaacagttgaacagacgatatcagaacatccagcgtaccatcgctacggaacgaagcgaggaggatagcggaagccagagttgcgaacaggctccagccgggggtgggggcggagggggatcggacagtgaggcagagagtagtcagtcttctttggacctgaggcgggagggcagcttgtcacctgtgaattcccagaagatcactctcctcctgcagtcccctgccgtgaagttcatcacaaaccccgaattcttcaccgtccttcatgctaactactccgcctaccgcgtcttcacgagcagcacctgtctcaagcacatgatattaaaggtccgaagagacgcccgaaatttcgagcgctaccagcacaacagggacctggtgaattttatcaacatgttcgcagataccaggctggaactgccaagaggttgggaaatcaagaccgaccagcaaggcaagtctttttttgtggatcataactccagggccaccacattcatagaccctaggattcctttacagaacggccggttacccaatcacctgacacacaggcaacacctccagcgactgcgaagttattccgcgggagaggcatccgaggtcagcaggaatcggggggccagtttgctcgcccgccccgggcacagcctggtggcggccattcgtagccagcatcagcacgagagtctacctttagcctacaacgacaagatcgtagcctttctgcgtcagcctaatatcttcgaaatgctacaggagagacagccctccctggcaaggaatcacaccctcagagagaaaatccactacattcggacagaggggaaccatgggctagagaagctgtcttgcgatgccgacctggtgatacttttgtcgctgttcgaggaagagattatgtcctacgtcccacttcaagcagcgtttcatccggggtactccttttcacccaggtgttccccctgtagttcgccccagaactcccccgggctccaacgcgcttcagctagggccccatccccatatagaagagatttcgaggcaaagctgcgcaacttttacaggaagctagaggccaagggattcggccaggggcccggcaagatcaagcttatcatacggcgcgatcacctgttagaaggtacgtttaatcaagtgatggcctactccaggaaagagttacagagaaataagttgtatgtgaccttcgtgggcgaagaaggcctcgattattcaggacctagccgagaattcttctttctgctatcccaggagctctttaacccctattatggcctgtttgagtactccgcgaacgacacttacaccgtacagatctcacctatgagtgcttttgtcgagaaccatctggagtggtttaggttctctggtaggatcctgggcctcgctctcatccatcagtatctgttagatgccttttttacacggccattctataaggccctacttagactgccctgtgacctttcagatttggaatacctggacgaagaattccatcagagcttgcaatggatgaaggacaacaacatcactgatatcctggaccttactttcactgtgaacgaagaagtgttcggccaggtcaccgaaagggaattaaagtccgggggggcaaacacccaggttactgagaaaaataagaaagagtatatcgagcgtatggttaaatggagagttgagcgaggcgtggtgcagcagacggaggccctagtaaggggcttttacgaagtggttgactctagactggttagtgttttcgacgctagggagcttgagctggtcatcgccggaacagctgagatagacctgaacgactggcgtaataataccgagtataggggaggataccacgatgggcacttggtcatccgctggttttgggccgcagtggagagatttaacaacgagcagcgcttgagattgctacagttcgtgactgggacaagcagtgtgccctatgagggtttcgccgcactgcgtggctcaaacggactacgccgattttgtatcgagaaatggggaaaaattacctcactcccaagggcacacacctgttttaacaggctggatctgccaccctatcctagctactccatgctgtacgaaaaactgctcactgccgtcgaagaaacttccactttcggcctggagtag

SEQ ID NO: 23038 - DNA, 2373 bp, Artificial Sequence
  Description of Artificial Sequence: Synthetic coding sequence
atgggcacccggaagaaggtgcacgccttcgtgcgggtgaagcccacggatgactttgctcacgagatgatccgctacggcgacgataagaggtcaattgacatccacttgaagaaagacatacgacgcggcgtcgtgaacaatcagcagactgactggagtttcaagctggacggagtccttcacgatgcttctcaggatctggtatacgaaactgtagccaaagatgtcgtaagtcaagctctggatgggtataatgggaccatcatgtgctacggtcaaacgggcgcagggaagacctacactatgatgggcgccactgaaaactacaaacatagaggcattctgccccgcgcgcttcaacaggtttttcgcatgatcgaagagcgacccacacatgcaatcacagtaagggtgtcatatctggagatttacaatgagtccctgtttgacctcctttctactctcccttacgtgggtccctccgtaacgccgatgactattgtagagaatccacagggggtgtttatcaaagggctgtccgtgcacctgacctctcaggaagaagacgcattttcactgctattcgaaggggaaactaacaggattatcgctagtcataccatgaacaagaactctagtcgctcacattgtatatttacaatttacctcgaagctcattctcgcacgttgtccgaagaaaagtacatcactagtaagattaacctcgtggatctagctggatctgaaagactcggaaaatccgggtctgaaggtcaggtgttgaaggaagccacctacattaataaatccctgtccttcctggagcaggcaatcattgctctcggcgaccagaagcgggatcatattccattccgccagtgcaagttgacccatgccctgaaggacagtctgggggggaattgcaacatggtcctagtgactaacatctacggagaggccgcccagctggaggagactctgtctagcctgcgcttcgccagcaggatgaaactggtgacaactgagcctgcaattaacgagaagtatgacgccgagaggatggtgaaaaatctggaaaaagagttggccctccttaagcaagaattagcaatccatgacagcctaaccaatcggacgttcgtgacttacgatcctatggacgagatccagatcgcagaaataaatagtcaggtgcggcgctatctggagggtacccttgatgaaatcgacataatttcactgcgccagattaaagaggtttttaaccaattcagggtagttctgtctcagcaggagcaggaagtggagagcacattgcgacgcaagtacaccctcatcgataggaatgattttgcagctatcagtgctatccagaaagctgggctggttgacgtggacgggcatctcgttggcgagcccgagggtcagaactttggactgggggttgcacctttctccaccaagcccggaaaaaaagcaaagtcgaaaaagacattcaaagagccactgtcatcgttagccagaaaagaaggagctagttccccagtcaatggcaaagatcttgactacgtatccacttctaagactcaactggtcccttcctcaaaagacggagatgtgaaggatatgctgagtcgagatagggaaacaagttcaatcgaaccgcttccctcagactctccaaaggaggaacttaggccaattcggcctgataccccgccctcaaaacctgtggcctttgaggagttcaaaaatgagcagggctcagaaatcaacagaattttcaaggaaaataaatcaattctcaacgagcgaaggaagcgtgccagcgaaacaacacagcatattaacgcgattaaacgggagatcgacgtgacaaaagaagccttgaatttccaaaaatccttacgggagaaacagggaaaatatgagaataagggcctaatgatcattgacgaggaggagtttctacttatactgaaactcaaagacctgaagaagcaataccgctcggaatatcaggatctgcgtgacttaagggctgagatccaatattgtcagcatctagtcgaccagtgtcgtcataggctgctgatggaattcgatatctggtataatgagtcttttgtgattcctgaggacatgcagatggcattaaaaccagggggctccatcagacccggaatggttcccgtaaaccggatagtctctttgggagaggacgaccaggacaaattctcacaattgcaacagagggtgcttccagaaggtccagacagcatctctttttataacgctaaagtcaaaattgagcagaagcacaattacttaaagacgatgatgggcctgcagcaggcccacagaaaatag

SEQ ID NO: 23039 - DNA, 876 bp, Artificial Sequence
  Description of Artificial Sequence: Synthetic coding sequence
atggccagcgtgaccctgagcgaggccgagaaggtgtacatcgtgcacggcgtccaagaagatctgcgtgttgacggaagggggtgtgaggattaccggtgcgtggaggtagagaccgatgtggtcagtaacacgtccggttccgcacgtgtgaaactaggacatacggacatcttggtcggcgtgaaggctgagatggggactccgaaactggagaagcctaatgaaggatatcttgaatttttcgtggattgttccgcctccgccacccctgaattcgagggacgaggtggggatgacctcggcacagaaattgccaacactttatatcgcatctttaacaacaagagcagcgtcgaccttaagaccctgtgcatctcccctcgcgagcattgctgggtcctctatgttgacgtgctgcttctggagtgcggcggtaatttattcgacgccatctctatcgcagtgaaggccgctttattcaacacacggatcccccgcgtcagggtactcgaagacgaggaaggttccaaggacatcgagctttccgatgacccctatgattgcattcggctgagcgtagaaaatgtaccatgtattgtgacactgtgcaaaatcggctacaggcacgtggtggacgctacactccaggaagaggcctgctccctggcttctctccttgtaagcgtcacctctaaaggcgtggtaacgtgcatgcggaaggtcggaaaagggtctcttgacccagaatctattttcgaaatgatggagaccggaaaacgcgtcggcaaggtcctccatgcgtccctgcagtccgtggtccacaaagaggagagcctggggcctaagaggcagaaggtgggcttcttgggctag

SEQ ID NO: 23040 - DNA, 2382 bp, Artificial Sequence
  Description of Artificial Sequence: Synthetic coding sequence
atgttctggaagttcgacctgcacagcagcagccacatcgacaccctgctcgagcgggaggacgtcaccctcaaagagctgatggacgaggaggatgtgctgcaagagtgcaaggcacagaacaggaagctgatcgaatttctgctgaaggctgagtgtcttgaggatttggttagcttcataatcgaagagcctccccaagatatggatgaaaaaataaggtacaagtacccaaatattagctgtgaactgttgacatctgatgtgagccagatgaatgaccgactcggcgaggacgagagcctgctcatgaaattatacagctttcttctgaatgattctcccctcaaccctctgcttgcatccttcttttcaaaggtgctgtctattctcatcagcagaaaacctgagcagatagtggatttcctcaaaaaaaaacatgacttcgttgacctaattattaaacatattggcacctctgcgataatggacctgctgctgagactcttgacctgtattgagccaccccaaccccgacaggacgttcttaactggctgaacgaagaaaaaatcatccagcgactggtcgaaatcgtgcatcccagccaggaagaggatcggcacagcaacgccagccaatctttatgcgagatcgtcagactctctcgggatcagatgttgcaaatccagaatagtactgagccagaccctctactagccactctggagaaacaggagatcatagaacagctactctcgaacatttttcacaaggaaaagaatgaaagtgccatcgtctccgctattcagatcctgcttaccctgctcgagacacgcaggcccacgtttgaggggcacattgagatttgccctcccgggatgtcacattccgcctgtagcgtaaataagagtgtgctggaagcgataagagggaggttagggtctttccatgagctactcctggaaccacccaagaacatgttctttaagtacacgtggaataattttctgcatacacaggtagagatttgtatcgcactaatattggcaagtccattcgagaataccgagaatgctactatcacggatcaagattctaccggagataacctgctgttgaaacacctgtttcagaaatgtcagttaattgaacgaatacttgaagcctgggagatgaacgagaagaagcaggcggagggaggcaggcggcacggttacatgggacacttaactcggattgccaattgtatagtccattctacggacaagggcccgaactccgcccttgtgcagcagctgataaaggatctccccgatgaggtgcgagaacgttgggagaccttctgcacatccagcctgggggagactaacaagaggaacaccgtggacttagccttcagcgattaccagatgcagcaaatgactagcaatttcatcgaccagtttggctttaacgatgagaaattcgcggatcaggacgacataggcaacgttagtttcgatcgagtgagcgacataaactttaccctcaatacaaatgagtccggaaatattgccctttttgaggcttgttgtaaagaaagaattcaacagttcgatgacggcggtagtgacgaggaggatatatgggaggagaaacatattgcctttaccccggagtcccagcggcgaagttcttctgggtctacagactctgaggagtccacagacagtgaagaggaagatggagcaaaacaagacctgttcgagccgtctagtgccaataccgaggacaaaatggaggtcgatctctcagagcctccgaattggtctgcgaacttcgacgtccctatggaaactactcacggagcccccttggacagcgttgggtctgacgtctggtcaactgaggaaccgatgccaactaaggagaccggctgggcctctttctccgagtttacatcttctctgtcgacaaaggatagtctgcggtcaaatagccctgtagagatggagacgagcactgaacctatggacccgctgactccctcagccgcagctctggctgtgcagccggaggctgctggttcagtcgcaatggaggcatcatcggatggcgaagaagatgctgagagcacggataaagtcacagagactgtcatgaacggcggcatgaaggaaaccctctccctgactgtggacgctaagactgagaccgcagtctttaagtcagaagagggaaagctctccacaagccaggatgcggcctgcaaggacgccgaagagtgtccagagacagctgaggcaaagtgtgcggcccctcgaccccccagttcatctccagagcaacgaaccggccagccgagtgcaccgggtgacacctcggttaacgggcccgtgtag

SEQ ID NO: 23041 - DNA, 3375 bp, Artificial Sequence
  Description of Artificial Sequence: Synthetic coding sequence
atggaccccttcaccgagaagctgctggagcggacccgggcccggcgggagaacctgcagcgcaagatggccgaacgccccacagcagccccaagatcaatgacacatgctaaaagagcccgacagcccctgagcgaagccagcaaccagcagccattaagcgggggcgaagaaaagagttgcaccaaaccttctccgtctaagaagaggtgttccgataacacagaagtggaggtgtccaatttggagaataagcagccggtggagtctacatcagccaagagttgctccccttctccagtgagcccacaggttcagccacaggcagctgacacaatatctgacagtgtggccgtccctgcgtcactgctgggtatgcgtcggggattgaattctcgcttagaggccactgctgcctcgagcgttaaaacccgaatgcagaaactcgccgagcagcgacgacggtgggataacgatgacatgacagacgacattcctgagtcgtcacttttctctccaatgccctccgaagaaaaagccgcctcgccacctcgcccactactctcaaacgcgtctgccacgccggtggggaggagaggcagactggcaaatctggccgccacaatttgctcgtgggaggacgacgtcaaccacagcttcgcgaagcagaatagtgtccaggaacaacctgggactgcctgtctgagtaagttctcatctgcatcgggagcaagcgcaagaatcaattcaagctccgttaaacaggaagccacattttgtagccagagagatggcgacgctagcctgaataaggccctctcctcatcagccgacgacgcatccctcgtgaacgcctcaattagcagctccgtgaaagctaccagtcctgtcaagtccaccacttcgatcactgacgcaaagtcgtgcgaaggacaaaatcccgagttgttacctaaaacccctatctcccccctgaaaaccggtgtcagcaagccaattgtgaaaagtaccctgagtcaaacagtcccaagcaaaggtgagttgtctcgcgaaatctgcttgcagtcccaaagcaaggacaagagtactacccctggcggtaccgggataaagcccttcttagagcgatttggggagcgatgccaagagcatagcaaggagtccccagcgagatcaacgcctcaccgcactccaatcatcacacctaacaccaaggccattcaagagcgtttatttaagcaggatacatcctcatccaccactcatttggcccagcagctgaaacaggagcgccagaaggagctggcctgtctgcggggccggtttgacaagggtaatatatggtccgctgagaaggggggcaactcgaagagtaagcagctggaaacgaagcaagaaacacactgtcagagtacccccctgaagaagcatcagggtgttagtaagacccagtcgttgcctgtcaccgagaaggtgaccgaaaatcagatccccgcaaagaatagcagcacagagcctaagggcttcactgagtgtgagatgactaagtcgagtcctctgaaaatcacattgtttctggaggaagataaatccttgaaagtgacttctgaccccaaggttgagcaaaaaatagaagtgatcagggaaatcgagatgtccgtcgacgatgacgacatcaatagctctaaggttatcaatgatttgttttcagatgtgttggaagaaggcgagctggatatggagaaatcacaggaagagatggatcaagcactcgccgagtccagcgaggagcaggaggacgcactgaatatatccagcatgtccttgctggctcctctagcccagactgtgggcgtggtatccccagagtctctggtatccactccgagattagagctcaaggacacctcacggtctgacgagtcccctaagccagggaaattccagagaacgcgagtgcctcgcgcagaatctggcgactccctagggagcgaggatcgggacctgctctacagtatagacgcatatcgatcccaaaggtttaaagaaacggaacgacctagcatcaagcaggtaatagttagaaaagaagacgttacttccaaactggatgagaaaaacaatgctttcccttgtcaggtaaacattaagcaaaaaatgcaggagctgaataacgagatcaacatgcagcaaaccgtgatttaccaggcctcccaagccctgaactgttgcgtggatgaagaacacggaaaagggtccctggaagaggccgaggccgagaggctgttgctgatcgctacaggcaagcgcaccttacttatcgatgagctgaacaagctgaaaaacgaaggaccccagcgcaagaacaaggcctccccacagtccgagttcatgcctagtaaggggtctgtcacattgtctgagattcgtctgccactcaaggctgatttcgtctgcagcacagtgcagaaaccagatgctgctaactattattacctgatcattcttaaagccggagccgagaacatggtcgctactccactggcatctacctctaattcccttaatggcgatgccctgacttttacgactacctttaccctgcaggacgtgtctaacgattttgaaattaacatcgaagtgtattcgctggtgcagaagaaggatccttctggacttgacaaaaaaaaaaagacctctaagtccaaagctattacccccaagcggctgctcacttccatcaccactaagtcaaacatccactcatctgttatggcttcacccggcgggctaagtgctgtcagaacaagcaacttcgcattagtgggctcttacactctttccctctcctcagttggcaacactaagttcgtactagacaaggtcccctttctctcaagtctcgagggccacatctacctgaaaatcaagtgccaggtgaacagttctgttgaagagcgtggcttcctgaccattttcgaagacgtgtccggatttggagcctggcatcgtcgttggtgtgttctgtctggcaattgtatttcctactggacatatcccgatgatgaaaagcggaaaaatccgatcggaagaattaacctggccaactgcacctcgcgccagatagaacctgctaacagggagttttgtgctcgccggaacaccttcgaacttataacggtacgcccccaacgcgaggatgatagagaaactctggtatcacagtgccgcgatacgctgtgtgtcacaaaaaactggctgagcgcggatacaaaggaggagagagacttatggatgcagaagctcaatcaggtgctggtcgatatccgcctctggcaaccagatgcatgctacaagcctataggaaagccctag

SEQ ID NO: 23042 - DNA, 1365 bp, Artificial Sequence
  Description of Artificial Sequence: Synthetic coding sequence
atgctgaagcagatcctgagcgagatgtacatcgaccccgacctgcttgcagaactatcagaggaacagaagcagatcttgttcttcaagatgcgggaggagcagataaggagatggaaggaaagggaagcagccatggaaagaaaagagagcttgcctgtgaagccacgtcccaaaaaggagaacggtaagtccgtccactggaagctgggagcggacaaagaagtctgggtgtgggtcatgggagaacatcatctggataagccatacgatgtgctttgcaacgagataattgcggaacgcgctcgtctgaaagctgaacaggaggccgaggaacctaggaaaacccattcggaggagttcaccaattctctgaagacaaagtcccagtaccacgacttacaagctcccgataatcagcagaccaaagacatttggaaaaaagttgccgagaaggaggaactcgagcaaggcagcagacctgccccaactctggaggaggagaaaattagatcactgagctccagttctcgtaacatccaacaaatgttggccgattccatcaaccggatgaaggcgtatgcttttcatcagaagaaggagtccatgaaaaaaaagcaggatgaagagatcaaccaaattgaggaagagagaaccaaacagatttgtaagtcttggaaggaggattctgaatggcaggcttcgctgcgaaaaagcaaagcagcagacgaaaaaagacgatccctagctaagcaggcccgcgaggactacaagcgcctgtccctcggtgcccagaagggtcgagggggagagcggctgcagtcacctctgcgggttccgcagaagccggagcgcccccccctcccacccaaaccccagttcctcaactcgggagcttatcctcagaaaccactcagaaaccagggagtggtcaggacactttcctctagcgcacaggaggacatcattcgatggttcaaggaagagcaactgcctctgcgagcaggctatcagaagacatcagacacgatcgccccatggtttcacgggattctcacattgaagaaggccaacgagctcttactctctactggaatgccgggatcctttctcatcagggtgtccgagaggattaagggatacgcactctcttacctgtccgaagacggctgcaaacacttcctgattgacgcaagtgccgacgcttattccttcctgggcgtggatcagctacagcacgcgaccctcgccgacctggtagagtaccataaggaagagcccattacctcacttggtaaagagctcctgttgtacccttgcggccagcaggaccaacttcccgattatctcgagctttttgaatag

SEQ ID NO: 23043 - DNA, 1497 bp, Artificial Sequence
  Description of Artificial Sequence: Synthetic coding sequence
atggacgagaccgagtggatccaccggcaccccaaggccgaggacctccgggtgggcctgatttcctgggccgggacatatctcacttttgaggcatgtaaaaataccgtcacagcgactgccaagagtctcggtagacgtcagacctgggagatcctcgtgtctaacgaacacgagacacaggcagtggtgcgcttgaagagcgtccagggcctttacttactgtgcgaatgcgacggtaccgtatgctacggacgtcccagaacctcacatcatggttgttttctattgcggttccataggaattcaaaatggaccttgcaatgtttgatctcaggccgctaccttgaatctaatggaaaggatgtgttctgtaccagtcacgtattgagcgcgtatcatatgtggacgcctcggccagccctgcatgttcacgttattttgtactcaccgattcatcgctgctatgcgagagcagaccccactatggggaggatctgggtcgacgcagctgtgccatgcctggaggagtgcgggttcttgctgcatttccgtgacggttgttatcacctagagacctccacccaccacttcctgtcccatgtagacaggcttttctctcagccatcttctcaaactgcgttccacatgcaggtgcgccctggcggattggtggcactctgtgatggtgaggggggtatgttgtacccacagggaacccaccttcttctgggaatgggttgtaacccgatgagaggcgaggaatggttcatcctccagcactgccccacatgggtgagtctgagaagcaaaaccggtcgctttatctcagtaatctacgatggtgaagtgagggcagcctccgagcgcttgaatcggatgagtttatttcagtttgagtgcgactctgagtcccctaccgttcagctgcgatccgcaaatggctattacctcagtcaacgcagacacagggccgtcatggctgatgggcacccactggagagcgataccttcttcagaatgcactggaactgcgggcggatcatattgcagtcgtgtcgaggccgctttctgggaattgcgcctaacagtctcctcatggctaatgtaatcctccccgggcccaacgaggaatttggaatcctgtttgcgaataggtcctttctggtgttgagggggcggtacggttatgtgggatcgtcttctggtcacgatctgatccagtgcaatcaagatcagcccgaccgaatccatctccttccctgccgccccgggatctaccacttccaggcacagggcgggtcattctggtccatcactagtttcggaacctttcggccatggggcaaatttgccttgaacttctgtattgagttgcagggctccaatctgttaacggtcctggccccaaacgggttctacatgcgcgcagaccagtccggcaccttactcgcggattccgaggatattaccagagagtgtatatgggagttttag

SEQ ID NO: 23044 - DNA, 1377 bp, Artificial Sequence
  Description of Artificial Sequence: Synthetic coding sequence
atggagcgggagcccagcgccagcgaggccgcccccgccgccgccgccttgtttgcttggggggcgaactcctatggccagttaggactgggccataaagaagacgtactcctgccccagcagctgaatgacttctgtaagccaaggtcggtacggcggatcaccggtggcggaggtcattctgccgtggtgaccgatgggggagacctatttgtctgcggccttaacaaagacggacaactgggtctgggccatactgaggacattccctattttaccccctgcaaaagcctgtttggatgccccattcagcaggtggcctgtgggtgggactttacaatcatgcttaccgagaatggacaggtcttatcctgtggaagcaactcttttggtcagctgggtgttcctcacgggccgcggaggtgtgtggtcccgcaggctattgagctgcataaagagaaggttgtctgcattgccgccggacttcggcacgctgtggcggctacagccagcggaatcgtttttcagtggggcaccggactcgcctcatgtggcagacgcctgtgtccaggccagaccctgcccctgttttttacagctaaggagccgtctagagttactggacttgaaaattcaaaggctatgtgtgtgctggccggtagtgaccactccgccagcctgaccgacgccggggaggtgtacgtgtggggatctaacaagcacgggcaactcgctaacgaagccgcttttctgcccgtaccacagaagattgaagcgcattgctttcagaacgagaaagtcaccgcaatttggtcaggatggacgcatctggtggcccagacggaaactggtaagatgttcacctggggacgagcagattacgggcaactgggcaggaaactagagacttacgaggggtggaagttagaaaaacaggattcttttctgccttgctcccggccgcctaactctatgcctagctctcctcattgtctgaccggcgcaacagaagtctcttgcgggagtgagcacaatttagccataattgggggggtgtgttatagctggggctggaacgagcacggaatgtgcggagatggaaccgaagcgaacgtgtgggcccccaagcctgttcaggccctgctctcctcttcaggcctcttagttggctgcggtgctggtcacagtctggcgttgtgtcagcttcccgctcaccccgctctggtgcaagacccaaaggttacttatttgtcacccgacgccattgaggataccgagagccagaaagctatggataaggagagaaattggaaagaaagacagagtgaaacaagtacacaatcacagtcggactggagcagaaacggaggcctgtag

SEQ ID NO: 23045 - DNA, 2961 bp, Artificial Sequence
  Description of Artificial Sequence: Synthetic coding sequence
atggagcggatgaactggctgagccggctggccagccggggccccggccatcgaatccctcaaggcgcgaatctgcagactcccgtgatggcagaccccgaaacatgcttaatggtgttcaaaaatcactggtcccaagtggtgagaattctggagagacaggggccaagggctgccccaggtggggccgacgatctgagcgcagtacgcaaccacacgtaccagatgttaaccctcctcgctgaggaccgggcagtcccgtcggccccaactggacctggcccattactggaatttgctctgcatgaggacttgctaacccgcgtactgacttggcaactgcaatgggacgagctaggagacggtgttgaagagcgtcgggccgagcaactcaagctgtttgagatgctggtgtctgaagcgcggcagcctctcttgcggcacggacctgtgcgcgaggcactcctgacactgctggacgcttgcggccgtccagtcccctcgtcacctgcccttgacgagggcctggtgttgctattgtctcagctgtgtgtctgcgtggcacaagagccgtccctattagagttctttctccagcctcccccagagcccggcgctgctccgcgactcctgctgtttagcagacttgtgccattcgtgcatcgcgaggggactcttggccaacaggccagagacgcactgttacttctgatggcgctgagtgcaggctcccctaccgtgggtcgatatatcgccgaccatagttacttctgccctgtcctcgcaaccggtctgtccgcgctgtacagctccctgcctagaaaaattgaagtccccggagacgattggcactgccttaggagagaggactggcttggcgtgcccgccctggctctcttcatgagctctctcgagttttgcaacgccgttatccaggtagcccatccccttgtgcagaaacaactggttgattacattcataacggttttctggtccccgtgatgggccctgccttgcacaagacctccgtggaagagatgatagcttctaccgcgtacttggagctttttctccggtccatcagtgaacccgcgcttctgcgcacatttctccgtttcctgcttctgcatcgccacgatactcacaccatccttgataccttggtggcccgaattgggtctaactcacgcctttgcatggtctccctgagtttgtttagaaccctgttaaacctttcctgcgaagacgtattgttacagctagtgttgcggtacctagtgccctgcaaccatgtgatgctttcgcaaaaaccagcggtgcgggacgtggatctttatggccgagccgctgataaattcttaagtctaattccacgatgttgtaggcatcatgcaccatctccaccacgccccgagcacgcctcctgggcccgtggaggaccgagccgcgagaccggccggagggaggatatcacaggccctggcagcccatcggtcgacagctcatctgtcacgacagtcccccgacccagtacgcccagtcgcctggcgctatttctgcggcagcagagtctggggggtagcgaatctccaggacctgctccttgctcaccaggtctaagcgccagcccggcgtcttcacctggcaggaggcccacacctgctgaagagcccggcgaactggaggacaattacctcgaatacctcagagaagcacgaagaggagtggaccgctgtgtaagggcctgcagaacgtggtctgcaccctacgatggtgagaggcctagtcccgaaccaagtcccttcggaagtagaactaagaagcggtcacttttaccagaagaggataggaataacgtgggagaaggtgaggaggaggagttaggcaggaggggccgggctgggggagcgggcgaggggcccggacatttgccacctccacaactgaatggcgtaccaggttcttggcccgaaggagctaaaaaagttcgtcttgtgcctaaggagggagcgggagagctcttagaaggcatcagcgagggcatggcgggcctcgaagggtttgggcaggagttaagagagctggaagtcgctctgtcaaacggcggcaccgggtcagagagcccattagagcctcctctgcctctggaggaggaagaggcctacgaatcgttcacttgcccgcctgaaccgccaggtccctttctgagctcccccctgagaacgctgaatcaactcccctcacagccctttacgggaccctttatggcagtgcttttcgcaaaacttgagaacatgctgcagaattccgtctatgtgaatttcctcctaaccgggctggtcgcccagctcgcttgtcaccctcagcccctgttaagatcattcctgcttaataccaacatggtcttccagcctagcgtgaaaagcttgctgcaggtgctgggctctgttaagaacaagatcgagaattttgcggctagccaggaggactttcctgcgttgttgagcaaggctaaaaagtacctgattgccaggggcaagttggattgggccgagggtcccgccgccggacctgcaccccgacgcagcgacccactagtgaaatcaagacgtccaagcctcggggaactcctgttgcgtcacgcacattcgccaacgcgcgctcggcaggcggcgcagctcgtgttgcagccagggagggacggagccgggctaggactgtccggcggcagcccgggggctagcacgcccgtgttgcttacgcgggggggagctcccgagcgccagggggaagccctaagggtaaaaaacgcagtttattgtgccgtgatttttcccgagttcctaaaggaactggctgccatatcccaggctcatgccgtgacctctccgttcctcttagagacctctgaagaggggtccgggcctttgatcagtggctgtggccctctcaatccgtag

SEQ ID NO: 23046 - DNA, 6723 bp, Artificial Sequence
  Description of Artificial Sequence: Synthetic coding sequence
atggacgacaagggcgaccccagcaacgaggaggcccccaaggccattaagcccaccagtaaggagtttcgcaagacatggggattcaggcggacaacgatagccaagcgcgagggagcgggggatgccgaagcagaccctctcgagccccccccaccacagcagcagctgggactgtctctccgccgcagtggacgccagcctaaacggactgagagagtagagcaattcctgactatcgcaaggcgacgcggtagacgctcaatgcccgtgtcacttgaagacagcggagagccgacgtcctgccccgccaccgacgccgagacggccagcgaaggctctgtcgagtctgcaagtgaaaccaggagcggtccgcagtccgcctctacagcggtgaaagaacgccccgcttcgtcagagaaagtgaaagggggtgatgatcacgacgatacttctgactctgacagcgacggacttaccctgaaggaactacagaacagattaagacgcaagagggagcaggagcccaccgaacggccactgaaaggcattcagagtaggctgcggaaaaaacgcagagaggaaggtccggcggagactgtcggaagcgaagcctccgacaccgtggagggagtgctcccaagtaagcaggaacctgaaaatgaccaaggcgtagttagccaggccgggaaagatgaccgcgagagtaagcttgaaggtaaggcagcccaggatattaaggacgaggaacctggagaccttggcaggcccaagccagaatgtgaagggtatgatccaaatgcgctgtattgcatctgccgtcagccccacaataatcgattcatgatttgctgcgaccggtgcgaggagtggttccacggggattgtgtcggtatcagtgaggcacgcggcagactgttggagagaaatggcgaagattacatatgtcctaactgtaccatccttcaagtccaggatgagacgcatagcgaaaccgcagatcaacaggaagccaagtggagaccgggcgatgccgacggtaccgactgcacaagtatcggtacaatcgaacagaaatcctctgaggaccagggaatcaagggacggatcgagaaagccgcaaacccatcaggtaagaagaaactgaaaatcttccagcctgttattgaggcacctggggcatcgaaatgcatcggcccggggtgttgccatgttgcccaacctgactccgtgtactgttcaaacgattgtatcttgaagcatgctgcagccacaatgaagttcctttcctccggcaaggagcaaaagcccaagccaaaagaaaaaatgaaaatgaagcctgaaaagccatccttaccaaaatgtggggcacaggcagggataaaaatatcatccgtccataagcgaccagctcctgagaagaaggaaacaaccgtgaagaaagccgtggtcgttcccgcccgttccgaggccctgggaaaagaggcggcttgtgagagcagcaccccttcatgggcctcagaccacaactataatgcagtaaagcctgagaagactgccgcgccctcaccctctttgctctataaaagcaccaaagaggatcggaggtctgaagagaaggctgcagcgatggcagcctccaagaagactgcaccacctggctcggcagtcggaaaacagcccgccccacggaacctggtgcctaagaaaagttcattcgctaacgtcgcagccgccacacccgccatcaaaaaacctccgtccggattcaaaggcacaattccaaagagaccttggctgtcagctacacccagctcaggggcctcagccgctcggcaggccggtccggctccggctgctgctacagcagcctcaaaaaagttccctggctccgccgcgcttgtcggcgccgtgagaaaacctgttgtcccaagcgtgcccatggcaagcccagcccctggcagactcggcgcgatgtcagctgcgccgtcacaaccaaacagccagattcggcagaacatcagacgctccttgaaggagatcttgtggaagcgggtcaatgattcagatgacctaatcatgaccgaaaacgaagtagggaagatcgccttgcacatcgaaaaagagatgttcaatctatttcaggtcacagacaataggtacaagagcaagtaccggagcatcatgtttaacttgaaggaccccaagaaccagggactgtttcacagggtgcttcgggaagagatctcgcttgcaaagctggtgaggctcaagcccgaggagctggtgagtaaggagctttcaacttggaaggaaaggcccgcacggtcggtcatggagtctcggaccaagcttcataacgaatctaaaaagactgcgccgagacaggaggctatcccagacctagaggactcccctcctgtttctgacagcgaggaacagcaagaatcagctagggccgttccggaaaagtccaccgcccccttattggatgtgttctctagcatgttgaaggataccacttcccaacatcgcgcacacttattcgatctgaactgtaaaatttgcactggacaggtaccctccgctgaagacgagcccgcccctaagaaacagaagctcagtgcttctgtgaagaaggaagatctgaagtccaagcacgattcttcagccccagatccagctcctgacagtgcagacgaggttatgcccgaagccgtgccagaagttgcctcagaaccagggctggagagcgcatctcatccaaatgttgaccgaacctacttcccagggcctcccggggacggtcacccagaaccttctcctctggaggatctctcaccctgccccgcttcctgcggatctggggttgtcaccaccgtgaccgtttccggaagggatccccgaacggctccatccagttcatgcaccgccgtggcctcagctgcatcaaggcccgacagtacccatatggtggaagctcgacaagatgttccgaagcccgtgctgacaagcgtcatggtcccaaaaagcattttggctaagccaagttcttctccagacccacgatacctcagcgtgcccccgtctcccaacatctccaccagcgagtctagatctccaccggagggcgacactactttgtttctaagcagactcagcacaatttggaagggcttcataaatatgcaaagcgttgcaaagttcgtgacaaaggcttatcctgttagtggttgttttgactacctgagcgaggacctccctgatactatccacatcggcggacgtatcgccccaaaaaccgtgtgggactacgtgggcaagctcaagtcctcagtgtcaaaggaattgtgcctgatacggtttcatcctgctaccgaggaagaggaagttgcatacatttctctctactcttatttcagttcccgtggtcgttttggcgtggtagctaataataaccgccatgtaaaggatctttacctaatacccctgtcggcacaggacccggtcccgagtaaattgcttccgttcgaagggcccggattggagtcacccaggcccaatatcattctgggacttgtgatctgtcagaaaatcaaaagacccgccaactctggggaactagataaaatggatgaaaagcgcacccggctgcagcccgaggaagccgatgtgccggcctacccaaaggttgcaacagtgcctcagtccgaaaagaagcccagcaagtaccccttgtgcagtgccgacgcggccgtcagcactactccgccaggcagcccgcccccacctccaccgttacccgaacctcccgtcctgaaggttctctcttccctgaaacccgccgccccctcacctgcaaccgctgctactaccgctgccgcggcatctaccgcggcatctagcaccgctagtagcgcgagtaaaacagccagtccgctggagcacatcctgcagacactctttggaaaaaaaaaatcctttgacccctcagccagagagcccccaggctcaacagctggactgcctcaggagccaaagacaacagccgaagacggggttccggccccacccctcctcgatcctatagtgcagcagttcggacaattcagtaaggataaggcacttgaggaagaggaagatgaccgcccttacgatcccgaggaggaatatgacccggagagagccttcgatacgcagctcgtggaacgggggcggagacacgaggtggaaagagcccctgaagcagccgcagccgagagggaggaggttgcttatgatccggaggacgagaccatccttgaagaggccaaagtgacagtcgatgacctacccaatcgaatgtgtgccgacgtgcgtcggaactccgtagaaaggccggccgagcccgtcgccggggccgctaccccctcactggtcgaacagcagaagatgcttgaagagctaaataagcaaattgaggagcagaaacgacagcttgaagagcaagaggaggcactgcgacagcagagagcggccgtgggagtttctatggcacacttctctgtgtccgatgcgctgatgtctccccccccgaaaagctctttacccaaggctgagctctttcaacaggagcagcagtccgccgacaaaccagcctccctgccccctgcgtctcaagcctctaaccaccgagatccgcggcaggcacggcgcttggcaactgagacaggggagggagagggggagcctttgagtcgactgagcgcccgtggcgctcagggcgccctaccggagcgggatgccagtcgcggtggtttggtcggacaggcgcctatgcccgtgcctgaggaaaaagagcctgcctccagcccttgggcatctggagaaaagccccctgcgggaagtgagcaggatggctggaaggctgagcccggagaaggcacacgccccgccactgtgggagactccagcgcccgaccggcaaggagggttctgctgccaaccccaccatgcggagctctccagcctgggtttccactgcagcatgacggagaaagggatccgtttacctgtcctgggttcgcatcgcaagacaaagctttgggaagtgcccagtacgaggatcctaggaacctacactctgcgggacgaagttcgtcacccgctggggagaccgaaggagatcgggaaccccaagcccgccctggcgaaggcactgcacctctgcctcctcccgggcagaaggtgggggggagtcagcctccgtttcaggggcagcgagaaccgggtccgcacgctcttggaatgtccggcttgcacggaccaaactttccaggccctcgcggtccggcccccccattccctgaggaaaatatcgccagcaacgatggcccccgcggaccgccaccagcccgatttggcgcacagaagggaccgataccatcgctgtttagcggccaacacggaccgcccccgtatggagattcgaggggcccatcaccgagttacctaggagggcctcgaggagtggccccatctcagttcgaagaacgcaaggacccccatggcgagaaacgagaattccaggacgccccatataacgaggtgacaggagctcctgcccagtttgagggtaccgagcaggctccatttctcggatcccgcggcggtgctcccttccaattcggagggcagcgtagaccccttctgtctcagctgaaagggccccggggtggcccacccccctcacaattcgggggacagaggggtcctcctccaggccatttcgttgggcctaggggccctcacccgagtcagtttgaaacagccagaggcccgcatcctaaccagtttgaaggcccaagggggcaggccccaaacttcatgccaggccctagagggattcagcctcaacagttcgaagatcagcgagtgcactctcctcccagattcaccaatcagagagcgcctgctcccctgcagtttggcggacttcgagggtcagcgccattctctgagaagaacgagcaaacaccctcgcgttttcactttcagggccaggctccacaggtcatgaaaccaggaccgagacctcttctggagttgcccagtcacccacctcagcataggaaagaccgatgggaggaagccggtccaccatccgctctttcttcgtctgctcctggccaggggccggaggctgatggccagtgggcgtcagccgacttcagagaaggaaaagggcatgagtacaggaaccagacgttcgaagggagacagagagagcgatttgacgttggacctaaggagaagcctctggaagaacccgacgcccagggcagggcctccgaggatcggaggcgtgagagagagcggggacggaattggtcacgagaaagagactgggatcgcccaagagagtgggaccgacatagggataaggattcaagtcgagactgggataggaacagagagaggtccgccaatcgggatcgtgaacgagaggccgatcggggcaaagagtgggaccgtagtcgggagagatcccgtaacagggaaagagagcgcgacaggcggagagaccgtgatcgatctagatccagagagcgcgacagagacaaggcacgcgaccgggaacggggcagggacagaaaagatagaagcaagtctaaggagagtgctagggacccgaaacccgaagcctcacgggcttccgacgccgggaccgcaagccaggcatag

SEQ ID NO: 23047 - DNA, 1635 bp, Artificial Sequence
  Description of Artificial Sequence: Synthetic coding sequence
atggacgacaagggcgaccccagcaacgaggaggcccccaaggccatcaaaccaacatcgaaagaattcaggaagacttgggggttccgcaggacaacgatcgccaaaagggagggggctggtgacgccgaggccgatccactggagccaccaccccctcaacaacaactgggtctgtctttgagacggagtggccgacagcctaaacggacagagagagtggagcagttccttacgattgcccgacggagaggcaggagatcgatgccagtgtcacttgaagacagtggagaacccacatcttgcccagcaactgacgccgagaccgctagcgaaggcagcgtggagagcgcctccgaaacacgttccgggccccagagcgcgagcactgccgtcaaggaaagacctgcctccagtgagaaggtcaaagggggggatgaccatgatgatacgagtgacagcgactcagacggacttacccttaaagaactccaaaatcgcctgcgacggaaaagagaacaggagcccaccgaaagaccgctgaaagggatccaatctcgcctgcgcaagaaacgcagagaagaagggcccgctgaaacagtcggaagtgaagcgtccgatactgtggaaggagttctccctagtaagcaggaacccgaaaacgatcaaggggtggtgtcacaggcaggaaaagacgacagggagagtaagttagaaggaaaggcggctcaggacatcaaggatgaggagcccggggacctgggacggcctaagcctgaatgtgaaggatacgacccgaacgctctgtactgtatctgtagacagccgcataataatcggttcatgatttgctgcgacaggtgtgaagaatggttccacggggactgtgtgggcattagtgaggcgcggggacgtctcctggaaaggaacggtgaagattacatttgccccaactgcaccattctgcaggtccaggatgaaacacacagcgaaactgccgaccagcaggaggcaaagtggcgtcctggcgatgccgacggcacagattgtactagcatcggtaccattgagcagaagtcctcggaagaccaagggataaaggggcgaattgaaaaagccgctaatcccagcggcaagaagaagctgaaaatatttcaacctgtcatcgaagcccccggtgcctcaaagtgcatcgggcccggctgttgccatgttgctcaacctgatagtgtctactgtagtaatgattgcatcctgaagcacgccgccgctaccatgaagttccttagtagcggcaaggagcagaagcccaaacccaaagagaagatgaagatgaaacccgaaaagcccagcctccctaagtgtggagcgcaggcggggataaaaattagcagtgtgcataagagaccagcacctgagaagaaagaaacgacggtaaaaaaggccgttgtggtccccgccagatccgaagctctgggaaaagaagctgcgtgcgaaagcagtactccctcgtgggcctccgatcataactataatgcggtcaagccggagaaaactgctgcccctagtccatcccttctgtataaatgcagcggcaagtactcttactccttacacccctccctgatagcatag

SEQ ID NO: 23048 - DNA, 1164 bp, Artificial Sequence
  Description of Artificial Sequence: Synthetic coding sequence
atggagcggccccccccccgggccgccggccgggaccccagcgccctccgcgccgaagcgccatggctccgcgctgagggcccgggccctcgagcagccccagttaccgtgcctacacccccccaggggagctctgtcggaggaggctttgcggggctcgagttcgctcgacctcaggagagtgagccacgagctagcgatcttggggctcccagaacttggacaggagcggcagctgggccgcgtactccctcagcccacattcctgtgcccgctcagagggccacaccgggaaaggcaaggctcgacgaggtcatggccgccgccgccctgacctcattgagcacgtccccgctgctccttggagctcccgttgcggccttcagcccagagcctgggttagaaccctggaaggaggcactggtaagaccacctgggagttacagcagctctagcaactccggagactgggggtgggatctcgcgtcggaccagagctcaccctctacaccgagtccacccctgcctcctgaggctgcccacttcctgttcggcgagccgaccctcagaaagaggaaaagtccagctcaagttatgttccagtgcctgtggaagagttgtgggaaggtgcttagcacagcctcagccatgcagcggcatatacgattggtccatctgggcaggcaggccgaacctgagcagagcgacggggaagaggatttctactacacggaactggacgtgggggtggatactctgacagacggcctgagcagcctgactcccgttagtccgacagcaagcatgccacccgcctttccgcgcctggagttaccagagctgctggagccccccgccctcccctcccccctgcgacccccagccccgccattgccacccccaccagttctgtcaaccgtggctaatcctcaatcatgccactcggatcgcgtttaccagggctgcctgacccctgctagacttgaacctcagcccaccgaagtgggtgcttgcccacctgcactcagctctcgcatcggtgttaccctccgcaagcctcgtggtgatgccaagaaatgccgcaaagtctatgggatggagcgccgtgacttgtggtgcaccgcctgcagatggaagaaggcatgccagcgcttcctcgattag

SEQ ID NO: 23049 - DNA, 414 bp, Artificial Sequence
  Description of Artificial Sequence: Synthetic coding sequence
atgctgcggttctgcgccggcctgagcgacttcgcccccgtggccgtgcggagtctccaggatcttgcacgtatcgccatccgcgggaccataaagaagatcattcatcaggaaacagtgtccaagaacggaaacgggctcaaaaacacgccacgcttcaagagacgtcgggtcagacgtcgacgtatggagaccattgtgttcttggataaagaggtatttgcttccaggatcagcaatcctagcgacgacaactcttgtgaggacctcgaggaggagaggagggaggaagaagagaaaaccccccctgaaacaaaacccgatcctccagttaatttcctccgtcagaaagtgctgtcgctgcctctgcccgaccctttgaaatattatctcctctactatagggagaaatag

SEQ ID NO: 23050 - DNA, 2505 bp, Artificial Sequence
  Description of Artificial Sequence: Synthetic coding sequence
atgcggctgctggacggcaagcagaccagccggtacagcgagaacgcctgtgaaaaaaagattttttctatatatggccattaccccgtagtccgagcagctctgcgacgtaaagggtgggtagaaaaaaagtttcacttcctgcccaaggtgatcccggacgtggaggatgagggcgcaagagttaacgatgacacctgtgcaaaagtaaaagagaaccaggagatggccctggaaaagactgacaacattcacgacgtcatgagtcgcctggtgaagaatgaaatgccatacttgttatggaccataaaaagagatatcatcgattatcacagcctgacatacgatcaaatgcttaaccactatgccaagacagctagttttactaccaagattgggctgtgtgtaaatatgcggtccctgccttggtacgtccccgccaaccccgattcattctttcccaggtgttactctttgtgcaccgagagtgagcagcaagaatttctcgaagacttcaggcgaacaatggccagctccatccttaagtgggtcgtgtcgcaccagtcctgcagtagaagctccagaagtaagccacgtgatcaacgggaggaagctggatcttcagatctctctagtaggcaagatgcagaaaatgctgaagccaaactgcgcggcctccctggccagctggtcgatatcgcatgtaaagtctgtcaagcttaccttggtcaactagaacatgaagatatcgacacttcagcagacgcagtcgaggatctgaccgaggcagagtgggaggacttaactcagcagtactattctctcgtgcaggtgccactagggtccagtattgtgctgtgcatttttaagattcagaaggtgatgatgtcgttcgaacctccaaccgcccgcgatcgccagtgtcaggcactgctgaatcggattacctctgtgaatccccaaacagacatcgacggactcagaaacatctggatcataaaaccagcagcaaagagccgggggagaggtgagagcccagatattgtatgcatggatcgagtagaagagatcctcgaactcgcggcagctgaccacccccttagtcgggacaataaatgggttgtacaaaaatacatcgagacacccctgctgatctgcgacaccaagttcgacattaggcaatggtttctcgtgaccgactggaatcccctgactatatggttttacaaggagagttacctcaggttctctacccagaggttttcccttgacaaactcgacagtgctattcacctttgcaataacgctgtgcaaaaatatctcaagaacgatgtgggacgaagtcctctcctccccgcccacaacatgtggacttcaactcggttccaggagtacctgcagagacagggacgtggagccgtctgggggagtgtgatctatcccagcatgaagaaagctattgcacatgccatgaaggttgcacaagaccatgtggagccgagaaaaaactccttcgagctgtacggggctgatttcgtgctcggccgtgactttcgcccatggctgatcgaaataaactctagtcccactatgcaccctagtacccccgtcacagcccagctgtgcgcacaggtacaggaagataccattaaggtggctgtagacagatcatgcgacatcggtaacttcgagttgttatggcgacagcctgttgtggagccacctccgttcagtggatccgatctgtgcgtagcaggagtctccgttaggagagccaggcggcaggtgctgccagtgtgcaatctaaaggcctcggcttccttgttagatgctcagcctctgaaggcgagggggcctagtgccatgcccgatcccgcccaaggtccaccaagccctgcactgcaaagggatttaggcttgaaggaagagaagggcctccccctggctctgctggctccacttaggggagctgccgagagcggtggcgcagcccagcccaccagaacaaaagcagccggcaaggttgaattgccggcatgtccctgtcgccatgtagacagccaagcccccaatactggtgtgccagttgctcagcccgctaagtcatgggaccccaaccagttgaatgctcaccctctggagcccgtgctccgtggattgaaaaccgccgagggcgctctccgacctcctcccggagggaaaggtgaggggacagtttgtagcaggctgccccatcacggtcaccacgtagccgcgtgccagactaccggaaccacctgggacggaggaccaggcgtatgtttcctgagacagctcttggcgagcgaactacctatgggccctggactgcctagggacccccgtgccccaccttgtctagtgtgtcgcgggctgcttccccccgccgggccatgcaagcgatgtcgttctttctgcgctgccgtgctgcaaggagcctcattcgtgcggctcggcggtcgtagctgttctcctaggactccttag

SEQ ID NO: 23051 - DNA, 759 bp, Artificial Sequence
  Description of Artificial Sequence: Synthetic coding sequence
atgtgcagcaccagcggctgcgacctggaggagatccccctggacgatgacgatctcaacactatagaatttaaaatcctggcctattacacaaggcatcacgtgttcaagtctactcccgctttattttctcccaagcttctccggaccaggagcttgagtcaacgaggcctaggcaattgtagcgctaacgaatcttggaccgaagtatcttggccatgccggaattcacagagtagcgaaaaggcaattaatcttggcaaaaagaagagttcttggaaggctttctttggtgtcgtggagaaggaggattcacagagcacccccgcaaaagtgtcagcacaaggccaacgaaccctggaatatcaagattctcactctcaacaatggagcaggtgcctctccaatgtcgaacagtgccttgaacacgaggctgtggatcccaaagttatatccatagccaatcgcgtcgctgagatcgtgtactcctggccccctccacaggctactcaggcgggcgggtttaaatccaaagagattttcgttacagaaggtctgtccttccagttgcaggggcatgttccagtcgcgtcgagcagtaagaaagatgaggaggaacagatccttgcgaagattgtcgagttgttgaagtatagcggtgatcagttagagaggaaggataccgcctttatccccattcctttagttgatacatcaattcagggctttccacaggatggtctgatggcctgcatttag

SEQ ID NO: 23052 - DNA, 261 bp, Artificial Sequence
  Description of Artificial Sequence: Synthetic coding sequence
atgagcctgcccctgaaccccaagcccttcctgaacggcctgaccggaaagcccgtcatggttaaactgaagtggggcatggaatacaaaggatatctggttagtgtcgatggctacatgaacatgcagctggctaataccgaggagtatatcgatggagcactgtccggacacttgggcgaggtgctgattagatgtaataatgtgttgtatatcagaggcgtggaggaagaagaggaagatggcgagatgagagaatag

SEQ ID NO: 23053 - DNA, 1281 bp, Artificial Sequence
  Description of Artificial Sequence: Synthetic coding sequence
atggccagcggccacagcctgctgctggagaacgcccagcaggtggtgctcgtgtgcgcacgcggagaaagatttttggccagggatgctcttcgatcgttggcagtcctagaaggggcctcccttgtagtcggaaaggacggctttatcaaggccatcgggccagctgacgtcattcagcgacagttctctggagagacatttgaggaaattatcgactgcagtggaaaatgcatcctgccaggtctagtggacgcccatactcatccagtatgggccggggagagggttcacgaattcgccatgaaacttgccggcgcaacttacatggagatccatcaggccggcggtggcatccactttactgtggagagaaccagacaggccaccgaagaagaactgtttaggtctctgcaacagcgtttgcagtgcatgatgagagctggcacgaccttagtcgaatgcaagagcggctacgggctggatctcgagaccgagctgaaaatgctccgcgttatcgagagagcccgcagggagctggacattggaattagtgccacgtactgcggagcgcattccgttccaaaaggcaagacagctactgaggctgctgacgatattatcaacaaccacctccctaagctcaaggagcttggccgcaatggcgaaatccacgtcgataatattgacgtgttctgcgagaagggcgtgttcgacttggactctacccgccggattctgcaacggggcaaagacatcgggctgcagataaacttccacggggacgaactacacccaatgaaggcagcagaacttggggcggaactgggcgcccaggcaataagtcacctcgaagaagtctccgatgagggtatagtagcaatggcaacagctcgatgttccgcaattctattgcctactactgcttatatgctacgcttaaagcaaccccgggcacgaaagatgctagatgagggggtaattgtcgccctgggctccgactttaatccgaatgcttactgtttcagtatgcctatggtgatgcacctcgcctgcgtcaatatgcggatgagcatgcctgaggcccttgcagccgctactattaatgccgcatatgccctgggaaagtcacacacacacggtagccttgaggtgggtaagcagggagacttgataattattaactcctcgcgatgggaacatttgatctatcagtttggtgggcaccatgaacttatcgaatacgtcatcgccaagggtaaactaatctacaaaacctag

SEQ ID NO: 23054 - DNA, 1263 bp, Artificial Sequence
  Description of Artificial Sequence: Synthetic coding sequence
atgttcagccccggccaggaggagcactgcgcccccaacaaggagccagtcaaatacggtgaactcgtggtgctgggctataatggtgcccttcccaacggggaccgagggcgccgaaaatctcggttcgcgctttacaaacggccaaaggccaacggagtcaaacccagtaccgtgcacgttatatctactccccaagcctcgaaagctatctcctgcaaaggccaacactcgatcagctacaccctgtccaggaaccagacagtcgtcgtcgaatatactcacgataaggatactgacatgtttcaagtcggcaggtccaccgagtcaccgattgattttgtcgtgactgacacaatcagcggatcacagaatacggatgaagcacagattacccagtctaccatatcgagatttgcctgtagaatcgtctgtgaccgaaatgaaccatacaccgcaaggatcttcgcggctgggttcgacagtagtaaaaacattttcctaggcgaaaaggccgctaaatggaaaaatcccgacggccatatggatggactgactacaaacggcgtactcgtgatgcatcctcgcggaggctttaccgaggagagtcaacccggcgtgtggcgggaaatctccgtgtgcggcgacgtatataccttaagggagacacgctccgctcagcagcgcgggaaactggtggaatccgaaactaacgtcctgcaggatgggagccttatagatctctgtggagcaacactgctctggaggaccgcagatggactgttccatacaccgacccagaaacacatcgaggcactgcggcaggagattaatgccgctagaccccagtgccctgtgggtctgaacactctcgcttttcccagcattaaccgcaaggaggtggttgaggagaaacagccttgggcctacctctcttgcggacatgtgcacggctatcacaactgggggcacaggtccgatacggaagcaaacgagcgcgagtgccccatgtgccgaactgtcggaccttatgtaccgctgtggctcggctgcgaggcagggttctacgttgacgctggtcctcctacccacgcttttactccatgtggacacgtgtgctccgagaagtctgctaagtactggtcccagatcccactcccacacggcacccatgccttccacgctgcttgtcccttctgtgcgacccagctcgtgggcgagcaaaattgcattaagcttatctttcaaggaccaattgactag

SEQ ID NO: 23055 - DNA, 1056 bp, Artificial Sequence
  Description of Artificial Sequence: Synthetic coding sequence
atgatcgtgcagcgggtggtgctgaacagccggcccggcaagaacggcaaccccgtcgccgagaactttaggatggaggaggtgtatttgccagacaatattaacgagggccaagtccaggtgcgcacactttatcttagtgtggacccctacatgcgctgtagaatgaacgaggacacaggtacagactacataacaccctggcaactgtcgcaggtggtggacgggggcggaattggcattattgaagaaagcaaacacacaaacctgaccaagggtgacttcgtgacatccttctattggccatggcaaaccaaagtgatactcgacggaaacagcctagaaaaagtcgaccctcagttagtagacggacacttaagctactttctaggagcgatcggcatgccagggctcacatccctgataggtattcaagaaaagggccacattacagcgggctccaataaaacaatggttgtttctggcgccgcaggggcttgcggatcggtggcaggacagattggccactttttggggtgcagccgcgtcgtcggcatctgcggaacacacgaaaaatgcatcctgctcacgagcgaactgggctttgatgctgccatcaattacaagaaggacaatgtggcagagcagcttcgcgaatcctgtccagcaggagtcgacgtgtacttcgacaacgtaggcggaaacattagcgacacggtgatttcccagatgaatgagaacagtcatataatcctttgcggtcagatatctcagtataacaaggatgtcccctaccctcctcctctaagcccagctattgaggcaatccaaaaagagcggaacattactcgagagagatttctcgtccttaattataaggacaaattcgaacccgggatcttacaattgtctcagtggtttaaagaaggcaagctgaaaatcaaagagactgtaatcaatggccttgagaacatgggagcagctttccagtccatgatgactggcggaaacataggaaagcaaatcgtctgtatttccgaagaaatcagcctctag

SEQ ID NO: 23056 - DNA, 2172 bp, Artificial Sequence
  Description of Artificial Sequence: Synthetic coding sequence
atggccgaggaggaggagaccgccgccctgaccgagaaggtgatccggacacagagagttttcatcaatttactcgactcatattctagcggcaatatcggcaagttcctgtccaactgcgttgtgggcgccagtctcgaggaaattacagaagaagaagaagaggaggacgaaaataagagcgcgatgctggaggccagcagcaccaaggtgaaagagggcacctttcaaatcgtgggtacattaagcaaacctgacagtcctagaccggatttcgcggtggaaacctatagcgccatttcacgggaagacttactgatgaggctgctagaatgtgacgtgattatctacaatattaccgagtcgtcacaacaaatggaggaagcaatttgggcagtgtcagctttgagcgaggaagtgagtcactttgagaagcgtaagttgttcattctgctatccacagtcatgacgtgggcaaggtcgaaagctctggaccccgaagattcagaggtgccatttactgaggaagattataggagacggaaaagccatcctaacttcctggatcacataaacgccgaaaagatggttctgaagtttggcaaaaaggctagaaagttcgctgcctacgtcgtggcagctggcctccagtacggggccgagggaggcatgctgcacacattcttcaaaatggcgtggctgggcgaaattccggccttgcccgtctttggggacggaaccaacgtgatcccaaccatccacgtgctcgatcttgccggtgtgattcaaaatgtcatcgaccatgttcccaagccgcattacttggttgccgtggatgagagcgtacatacactcgaggacattgttaaatgtattagtaagaatacaggacccggcaaaatacagaaaataccccgggagaatgcttatctgaccaaagacctgacacaagattgtttggatcacctgttagtgaaccttcgcatggaagccttgtttgtaaaagaaaacttcaatattaggtgggccgcccaaactggattcgtcgagaatatcaataccattctgaaagagtacaaacagtcccggggtttaatgcccatcaaaatttgcattctcggcccaccggccgtgggcaagtcctcaatcgccaaggagcttgccaactattacaaactgcaccatatccagctcaaggatgtcatctctgaagcgatcgccaagctcgaagctattgtcgctcccaacgatgtcggagagggcgaggaggaagtggaagaggaggaagaggaggagaatgttgaggatgcccaggaattgcttgatgggatcaaagaatccatggagcagaacgccgggcaactggatgaccagtatattatccggttcatgaaggagaagctgaagtcaatgccctgccgcaatcaggggtatatcctagatggcttccccaagacctatgatcaagccaaagacctctttaaccaggaggatgaagaggaggaggatgatgtgcggggtcgcatgttcccattcgataaattgattatccccgagttcgtgtgcgccctcgacgctagtgacgagttcctgaaggaaagggtgattaacctacccgagtccatcgttgctggtactcattacagccaggatcggttcctccgggccctttccaactacagggatataaacattgatgatgagactgtgttcaattactttgacgagctcgaaattcacccaatccatatcgacgtgggcaagttggaagacgcacagaaccggcttgcaattaaacaacttattaaagagattggagaacccaggaactacggtctgacagacgaggaaaaagctgaagaagagcggaaagcagctgaggagaggctagcccgagaggccgcagaggaagccgagcgagaacatcaggaagcagttgagatggcagagaagattgcaaggtgggaggaatggaataagcgattggaggaagtcaagagggaagagcgcgaattactggaggctcagtcaatcccactgaggaactatctcatgacatacgttatgccaactctcattcaaggcctcaacgagtgctgcaacgtcaggcctgaagatcctgtcgactttctcgctgaatacctgtttaaaaataacccggaggcccaatag

SEQ ID NO: 23057 - DNA, 1245 bp, Artificial Sequence
  Description of Artificial Sequence: Synthetic coding sequence
atgcagaccttcctgaagggcaagcgggtgggctactggctgagcgagaaaaaaattaaaaagttgaactttcaggcattcgcggagttatgtcgaaaaaggggaatggaagttgtccagttgaatcttagtcgccccatcgaggagcaggggccactggacgtgattattcacaagttgaccgatgtgatacttgaggctgaccagaatgattctcagtctctggagctcgtacaccggttccaggagtatatcgatgcacacccagaaactatcgtactggacccgttgccagccatcagaacactcctggaccggagtaaatcttatgagctaattagaaaaattgaggcttacatggaggacgatagaatttgctctcccccctttatggagctaacttcactttgtggggacgacaccatgcgcctcctggaaaagaatggcttgactttccccttcatctgcaagacacgggtcgcccatggcaccaactcccatgagatggctatcgtgtttaatcaggaaggactgaatgccatccagcccccttgtgtggtgcaaaatttcatcaaccataatgcagttctctataaggtcttcgtagtaggcgagtcttataccgtcgtgcaaagaccttctctgaagaattttagtgccgggacgagtgatcgcgagtccattttcttcaactcccacaacgtgtcaaagccggaatcttcatccgtgttgactgaactcgataagatcgagggggtatttgagagaccctctgacgaagtgattagggaactgtctcgtgccctcagacaggcccttggggtgagcctgttcggaatagacatcatcattaacaatcagaccggacagcacgcagtgatcgatattaacgcgtttccaggatatgaaggcgttagcgaatttttcacagatctcttaaaccatattgcaactgtcctccagggccagtccaccgcaatggctgccaccggcgatgtggcgttgctgcggcactcaaagctgctggccgaaccagccggcggactagtgggcgagcgcacttgctccgcatcccctggctgctgcggtagcatgatgggacaggacgccccgtggaaggccgaggcagacgccggaggaactgcaaagctgccccaccaacggttagggtgtaatgccggcgtctccccttcattccagcagcattgcgtcgcgagcttggctactaaggcaagctcccagtag

SEQ ID NO: 23058 - DNA, 600 bp, Artificial Sequence
  Description of Artificial Sequence: Synthetic coding sequence
atgcggttccggttctgcggcgacctggactgccccgactgggtgctcgcagagataagcactcttgcaaaaatgagctcagtcaagctccggttgctctgcagtcaagtgcttaaggagttgctggggcaggggattgactatgagaaaattctgaaacttacagcagatgccaaattcgagagcggtgatgtgaaagccactgtggctgtcctctcttttatactgagctctgccgccaagcactccgtggatggcgagagcctaagctcagaactccagcagttgggactgcctaaagaacatgcagcaagcctttgcagatgctacgaagaaaaacaatccccgcttcagaagcacctgcgggtgtgcagcctccggatgaatcgcctggctggcgtcggttggcgcgtcgattacacgttgtcgtcttccctcctgcaaagtgtggaagaaccaatggtccacctgcgtctggaggtagcagcagcgcccgggacacccgcacagcccgtagccatgagcttgagtgcagacaagttccaggtattgctggcagaactgaaacaggcacaaaccctcatgagttctcttggatag

SEQ ID NO: 23059 - DNA, 1224 bp, Artificial Sequence
  Description of Artificial Sequence: Synthetic coding sequence
atgagccaccggaagttcagcgccccccggcacggccacctgggcttcctcccacataaacggagccaccgtcaccgtggcaaggttaaaacctggcctagggacgacccgtctcagcccgtgcatctgacggcgtttttgggctataaagccgggatgacgcacactttaagagaggtccatcgaccgggcctcaaaatctctaagcgggaagaagtcgaagccgtaaccatcgtcgagacacctccgctggtcgttgtcggcgtcgtagggtacgtagctacccctagggggctaaggagctttaagacgatttttgcagaacacctgtctgatgagtgccgcagaaggttctacaaggactggcacaagtctaaaaagaaagctttcacgaaggcctgtaagcgatggagggacaccgacggcaagaaacagctgcagaaagacttcgcagccatgaagaagtattgtaaagtgatcagagtcatagtgcacacccagatgaaactcctgccttttcggcagaaaaaggctcatatcatggagatccagctcaacggaggcaccgtcgctgaaaaggtcgcgtgggcgcaggcccggctcgagaaacaggttccggtccattcagttttttcccagtcagaggtcatagatgttatcgccgtgactaagggacgtggcgttaagggcgtgactagtaggtggcacaccaagaaactgccgaggaagactcacaaaggtctgcggaaggttgcctgcataggcgcttggcacccggcccgggtcggctgctcaattgctagagccggacagaagggataccatcatcgcacagaactgaacaaaaaaatatttagaattggtcgtggtccccatatggaagacggtaaactggtcaagaataacgcctccaccagctacgatgtgacagcgaagtctattacaccactgggaggatttccccactatggtgaagtgaataatgactttgtgatgctgaaaggctgcattgccggcactaagaagagggtcattacgcttaggaaaagtctgttggtccaccatagtaggcaggcagtagaaaatatagaactgaaattcattgatactaccagcaagtttggacatggacgctttcaaactgctcaggaaaagagggcctttatgggtccacagaagaagcacctagagaaagagactcctgagacgtcaggagacctctag

SEQ ID NO: 23060 - DNA, 7323 bp, Artificial Sequence
  Description of Artificial Sequence: Synthetic coding sequence
atgagcagcagcggctacccccccaaccagggcgccttcagcaccgaacagagccgctaccctccacactcagtccagtatacatttcctaataccaggcatcagcaagagtttgccgtgccagactatcgttccagtcatcttgaagtctcgcaggcaagccagttactccagcagcaacagcagcaacagcttcggcgcaggcctagcctgctgtctgaatttcatccaggatccgaccgcccacaagagcgcaggacttcttatgagccatttcacccgggtccaagccctgtcgaccatgactcactggagtctaagagaccccggctggaacaggtgtctgattctcattttcagagggtgtccgccgctgtcttacccctagtgcaccctcttcctgagggcctgagggctagtgctgacgccaagaaggatccggcattcggaggaaaacacgaggccccctcaagccctatctctggacaaccctgcggcgatgaccagaacgcctccccatctaagttaagtaaggaagaactcatccagagtatggacagggtggatcgcgagatagctaaggtggagcaacaaattttgaagctgaagaagaagcagcagcagctggaggaggaggcagccaaacctccagaaccggagaagccggtaagtccccccccagtggaacagaagcacagaagtattgttcagatcatctatgacgagaaccgtaaaaaggcagaggaggcccataaaattttcgagggtctcgggcccaaagtcgagctgccactgtacaatcagccttccgacacgaaggtatatcacgagaacatcaagactaaccaggtcatgcggaaaaaactcatcctttttttcaagaggagaaatcatgcccgaaaacagagagagcaaaaaatctgccagagatacgaccagctcatggaagcatgggaaaagaaggtagaccggattgagaataacccaaggcggaaagctaaggaatccaagacgagggagtactacgaaaagcaatttcctgagatacggaagcaacgggaacagcaagagcggttccagagggtgggacagcgtggagctgggctgagtgctaccatcgcccggtccgagcatgaaatctctgagattattgatgggctcagcgagcaggaaaacaacgagaagcagatgagacagctttccgtgatcccaccaatgatgtttgatgccgaacagagaagggtgaagtttataaacatgaacgggttgatggaagatccaatgaaggtgtacaaagacaggcagttcatgaacgtgtggacagaccacgaaaaggaaattttcaaggacaagttcatccagcacccaaagaacttcggcctgatcgcgagttacctggagcgtaagtctgtgccggattgtgtgctctactactacctgaccaaaaagaatgaaaactataaagcgctcgtgcgccgaaactacggaaagaggcgtggccgcaatcagcagatagcaaggcctagccaggaagaaaaggttgaagagaaggaggaggacaaggccgagaagacagagaaaaaggaggaagagaagaaggacgaagaggagaaagatgagaaagaagattcaaaagaaaatactaaggaaaaggacaagatcgatggtactgctgaggagaccgaagagagggagcaggctactccaagggggagaaaaactgccaacagtcaagggcgaagaaaaggccgcatcacgcggtcaatgactaacgaagctgcagctgccagcgctgccgccgccgccgctaccgaagagccccctccaccactgcccccccctccggagccaatttcaacagagcccgtagaaacatcccggtggacggaagaggaaatggaggtggctaagaagggcctggtggagcatggtaggaactgggcagccattgctaagatggtgggcaccaagagcgaggcccagtgcaaaaatttctatttcaactataaaagacgtcacaaccttgacaatctgctccagcagcacaagcagaagacaagccgcaaaccccgagaggagagggatgtttctcagtgcgagagcgtggcttccaccgtttcagcccaggaggatgaagacattgaagcatctaatgaggaggagaaccccgaagacagcgaagtggaagctgtgaaaccgagcgaggactcaccggagaacgcaaccagtcgcggtaatactgagcccgcagtggagcttgagccaacgaccgaaacggctccaagcacgagcccttcacttgcggttcctagtaccaagccagccgaagacgagtcagtggagactcaggtgaatgactccatctccgccgaaaccgcggaacagatggacgtggaccagcaagagcacagcgccgaagaggggagcgtttgtgatccaccgccagccaccaaggctgactccgtggatgtggaagttcgcgttcccgagaatcatgctagcaaggtcgagggagacaatactaaggagcgagacttggatagggctagcgagaaggtggagcctagggacgaagacttggtcgtggcccagcagattaatgcacagcgacccgagccacagtcagataacgatagctccgccacgtgttcggcagacgaagacgtcgacggggaacccgagcgtcagcgcatgtttcctatggatagcaagcctagccttctcaacccgacaggctccattcttgtgagtagcccgctgaagcctaatcctctggatctgccgcagctgcagcatagagctgctgtgattccacctatggtgtcttgtactccctgtaacatccccatcggaactcccgtgtccggatacgcattgtaccagcgccacatcaaagcaatgcacgagagcgctttactggaggaacagaggcagcgtcaggagcagattgacttggagtgtaggtcctctacatccccttgcggtactagtaagagtccaaatcgggagtgggaagtactccagccagccccgcaccaggtgattaccaatttgcccgagggagtacggttgccaacaacgcggccaactaggcccccgcctcctctgatcccttcttctaaaacaacggtcgcctctgaaaagcctagcttcattatgggcgggagtatctcccagggcactcccgggacatatctcacttcccataaccaggcaagttatacacaggagacgcctaaacctagtgttggctccatctcactcgggcttccacgacaacaggaatcagccaaaagcgcaaccctgccttatattaaacaggaagagtttagcccacgtagccagaactcacagcccgagggcctgctcgttagggctcagcacgagggagttgtgcggggaacggcgggtgctattcaggaagggtcaataaccagaggtacaccaacctctaaaatctcagtagaatctattccgagcctacggggaagtataacacagggtacacccgccttaccccagacaggcattccaactgaagcactggttaaggggtctattagcagaatgccgattgaagatagcagccccgaaaagggccgagaagaagctgcctccaagggccacgtgatctatgaggggaagtcagggcacattctttcttacgataacattaaaaacgcacgggaaggaaccagaagccctcggacagcccacgagatatctttaaaacggagctacgagagtgtcgaggggaacattaagcaggggatgtctatgcgagaaagcccagtgagcgcacccctggagggcctgatctgcagggccttgccgcgtggtagcccgcactccgatttgaaggagcgaacggtgctctcaggctccatcatgcagggcaccccccgagccacgaccgagagctttgaggacgggcttaagtaccctaagcagatcaaacgggaatctccaccaattcgggcctttgagggagcaattaccaaaggaaagccttatgatggcattaccactataaaagaaatggggcggtctattcacgagattccacgacaggatattctgactcaggaatccaggaagacccctgaggtggtgcagtctactcgtccaattatagaaggatctattagccaggggacccctataaagttcgacaataattccggccagtcagcaatcaaacacaacgttaaaagtcttattactgggccctctaaactgagccgggggatgccacctcttgaaatcgtgcccgagaacatcaaggtggtcgaacggggcaaatacgaggacgtgaaagccggtgaaaccgtgagaagcaggcacacatccgtggtaagttctggcccctccgtcttaaggagtaccctgcatgaagcaccaaaggcccagttgtcgcccggcatctacgacgacaccagcgccaggaggacaccggtttcttaccagaatacaatgagtagaggatcccctatgatgaaccgcacttccgacgttaccatatcgagtaataagtccactaaccatgagagaaagtcaactttgactcccacacaaagagagtcaatccccgccaaatcccctgtgcctggagtggacccagttgtctcacactccccattcgaccctcaccatcggggctcgacggccggggaggtgtacagaagccatctcccgactcacctagaccccgccatgccattccacagagccctggatccggctgccgccgcctatctttttcaacggcagctctcacctacgcctggatatccaagccagtatcagttgtacgcgatggagaatacccgtcagaccatcctcaacgactacataacctctcagcaaatgcaagtgaacctgcggcctgatgtcgctagaggtctttcgcctcgtgagcaaccgcttggcttgccataccccgccactcggggtattattgatctgactaatatgccaccaaccattttagtgccgcacccaggaggaactagcaccccacccatggaccgcattacctatatccccgggacccagataacgttcccacccaggccatacaactcggcctcaatgtccccaggacacccaactcacctggccgctgccgcttcggccgagagagaaagagagcgtgaaagagaaaaagagagggaacgtgagaggatcgctgccgctagtagcgacctgtatctgcggcctgggtccgagcagccaggccggcctgggtctcacgggtacgtacgcagccccagtccctccgtgcggactcaggaaacgatgttacaacaacgtccttccgtgtttcaagggacaaacggaacgagcgtgattacccctttagatcctacagctcagcttagaatcatgcccctgcccgcaggaggtccaagcattagccagggcctgcccgcaagcagatataacactgctgccgatgcccttgcagcccttgttgacgccgccgcatccgccccccagatggacgtgagcaagaccaaggagtccaagcacgaagccgctcggctcgaagaaaatctgcgctcccggtccgctgcggtgagtgagcagcagcaactagaacagaagaccctcgaagtggaaaaacggtctgtacagtgcctctacacttcatctgccttcccttccggcaagcctcagcctcacagctctgtggtgtatagtgaagccgggaaggataaagggccccctcccaagtctagatacgaggaagaacttcggacgagggggaaaacaacgattaccgcagcaaactttatcgatgtgattattacgcgtcaaatcgcttctgacaaagatgcccgggagcggggttcccagtcttctgactcttcttcaagtctatcaagtcatcgctacgagaccccttcggatgccatagaggtgattagtccggcttctagccctgcccccccccaggaaaaactccagacataccaacccgaggtggtcaaagccaaccaggccgagaatgaccctactcgccagtacgagggccctctacaccattatcgaccccaacaggagagcccctcgccacagcagcagctgccacctagttctcaagccgaagggatgggccaggtcccacgtacacacagactgattacactggcagatcacatctgccaaattattacgcaagactttgccaggaaccaggtgagctcccagaccccacagcaaccccccacctctaccttccaaaatagccccagtgcactggtgtccacccccgtcagaaccaaaacctctaacagatactcgcctgagtcccaggctcagagtgtacatcatcaacgacccggttctagggtgtcccctgagaacctggtcgacaagagccgggggtcgcgccccggtaagtcccctgagcgaagccatgtttccagtgagccttatgagccaatttcacccccccaggttcctgtcgtacatgagaagcaagacagtttacttcttttatcccagcgaggagctgagcccgctgagcagcgaaatgacgctagatccccaggttccataagttaccttcctagctttttcacaaagttggaaaacacaagcccaatggttaaatccaagaaacaagaaatcttccggaaattgaactcctctggcggaggagactccgatatggctgccgcccagcctggaacggaaatcttcaaccttcccgcagttactaccagcggttcagtgtctagtcgcggccactcctttgcagaccctgcatctaatctggggctcgaagatatcataaggaaggcactgatgggttctttcgatgacaaagtggaggaccacggggtggtgatgagtcagccaatgggagtggtccccgggaccgccaacacatccgtggttacttctggcgagacaaggagggaagagggagatccctccccgcattctggaggtgtgtgcaagccaaaactaatcagcaaatccaactctcgtaagtcaaaaagccccattccaggacaaggttacttgggaacggagcgtccgtctagcgtgtcatccgtgcacagcgagggcgattaccaccggcagacccctggatgggcctgggaggaccgaccatcatctacaggtagcacccagtttccatacaaccctctgaccatgcgtatgttatcatcgaccccccctacccccattgcatgtgcccccagcgccgtgaaccaagcagcgcctcatcagcaaaatcgaatctgggaaagggagcccgcgcccttactgtctgctcagtatgagactctctccgattctgacgactag

SEQ ID NO: 23061 - DNA, 2313 bp, Artificial Sequence
  Description of Artificial Sequence: Synthetic coding sequence
atgctgcagcaggtgaacggccacaaccccggcagcgacggccaggctcgcgagtatctgagggaggacctgcaggagtttcttggcggcgaagtgcttctctacaagttggatgacctgacgagagtcaatccagtgacattagagactgtcctgcgctgtctgcaggcccgctacatggccgatactttttacaccaacgccggctgcaccctcgtggctctgaatcccttcaaacccgtgccgcaactttacagccctgaacttatgcgggagtaccatgcagcaccccaaccccagaagttgaagcctcacgtgttcaccgtgggggagcagacctacaggaacgtgaagtccctgattgagcccgtgaatcagagcatcgtggtttcaggagagtcaggagctggaaagacgtggacaagccgctgcctgatgaaattttatgccgtagtggccacatctcccgcatcctgggagtcccataagatcgcagaaagaatcgaacagagaatcctgaattccaatcctgtgatggaagccttcggcaatgcctgcacccttcgaaataacaattccagccgcttcggcaagttcatccagctgcagctcaatcgggcgcagcagatgactggcgccgctgtacaaacttacctgctcgagaagaccagggtggcttgtcaggcgagtagcgagcggaacttccatatcttctaccagatctgcaaaggcgcaagcgaggatgagcgtctgcaatggcatctccctgagggggctgctttctcctggctgcccaatcctgaacgcagcctcgaggaagactgcttcgaggtgaccagagaagccatgctccacctggggatcgacactcctacccagaacaacatcttcaaggtactggccggtctactccatctgggcaacattcagttcgctgctagtgaggacgaggcccagccatgccagcccatggatgatgctaagtattctgtccgcacagctgctagccttctgggactgccagaagacgttctccttgagatggtgcagattcgcaccatccgcgccggtaggcagcaacaggtgttcaggaagccttgcgcacgggcagaatgcgataccaggcgggactgtctcgctaagcttatatacgcacgcttattcgattggctggtgtctgtcataaactcgtctatctgcgcagacaccgatagctggactacatttattggccttcttgacgtatatgggtttgagagctttccggacaattcccttgaacagctctgcattaattacgctaacgagaaattacagctggaagcctgcggcctcgtcgagacaattcatataagtgcagcaggatttccgatccgggtctcccataggaattttgtggaaaggtacaagctcttacggagactccacccatgcacctcctccggacccgatagcccttaccccgccaaggggctgcctgaatggtgtccgcactccgaggaggctactctggaacctctaatacaggacatcctgcacaccctgcctgtgttgacacaagccgccgccattaccggggactcagcagaggcaatgccagcccctatgcactgcggccgtactaaggtattcatgactgattctatgttggagctgctggaatgtggtcgggcaagagtgttggaacagtgtgcaaggtgcattcagggcggctggcggagacatagacatagggaacaagaacggcaatggagagctgtgatgctgattcaggccgctatacgctcctggctaacacggaagcatatccagagacttcatgcggccgccacagtgatcaagcgcgcatggcagaaatggcgcatccggatggcatgcttggctgctaaagagctggatggagtagaggagaagcatttctcccaggccccatgttccctttccacctcaccactccagacccggctcctcgaagccattattcgcctctggccgctggggctggtgctcgcgaacaccgccatgggagtaggatcatttcagcggaaactagtggtgtgggcctgtcttcagttgccaaggggttccccctccagctataccgtccagactgcccaggaccaggctggagtgacatctatccgtgctctcccgcaaggctcaatcaaattccattgtcgcaagagtccattgcgctacgcggacatatgccctgaaccatcaccctactccatcactggcttcaaccagatattgttagagcgacacaggctgattcatgtcacaagcagtgctttcactggtcttggatag

SEQ ID NO: 23062 - DNA, 2796 bp, Artificial Sequence
  Description of Artificial Sequence: Synthetic coding sequence
atggccgaggtggaggccgtgcagctgaaggaggagggcaaccggcacttccagcttcaggactacaaggcagccaccaacagttactcccaggctctcaagctgacaaaggataaggccctactcgccactctgtatagaaaccgggccgcctgtggtctgaagacagaaagctacgtgcaggccgctagcgacgctagccgggctatcgatattaattcttccgatatcaaagctttgtatcgccggtgtcaggccttggagcatttaggtaaactcgaccaggcattcaaagatgtccagcgctgcgcaaccctggagcctagaaatcaaaattttcaggagatgctccgtaggttaaacaccagcattcaggagaagttgcgggtacagttctctaccgactctcgagttcagaagatgttcgaaatccttctggacgagaactcggaagccgacaaaagagaaaaagcagccaataacctgatcgtgctcggaagggaggaagctggggctgaaaaaatcttccaaaacaacggcgtggctctgctccttcagctgctcgatacgaagaagccagagctggttctggccgcggttcgcacattatcgggcatgtgttccggtcatcaggcacgagctaccgtgatcctgcacgccgttcgcattgaccggatatgctcactgatggcggttgaaaacgaggagatgtcactggctgtgtgtaatctgctgcaggccataatagactctttatctggtgaagataagagagaacaccgaggaaaagaagaggcattagtgcttgatactaaaaaagatctcaagcagatcacaagccacttactagacatgctagtaagcaaaaaggtctcgggccagggcagggaccaggccttgaatttgctcaacaagaacgttccaagaaaagacctggccatacacgacaactccagaacaatctatgtggtggacaatggactccgcaaaatactcaaggtagtgggccaggttccagaccttcctagctgtctacctcttacggataatacaagaatgttggcctccatactgattaacaagctatatgatgatctgcgatgcgatccagaacgagatcactttcggaagatctgcgaggagtacatcactggaaaatttgaccctcaggacatggacaagaacctgaatgctatccagaccgtaagcgggatcctgcaggggccgttcgacctcggcaatcaattgctgggtcttaaaggggtgatggagatgatggttgcactctgcggctcagagagggagactgatcagctggtggccgtggaggctcttattcacgcatctacaaaactgagtagagccacgtttataatcacaaacggagtctctctcctgaagcagatttataaaaccacaaagaatgagaagattaaaattagaacgctggttgggctctgcaagcttggatctgcaggcgggaccgactacgggctgcggcagtttgccgaaggctctacggaaaaactggccaagcaatgccggaagtggttgtgcaacatgtccatcgatactaggacacgccgatgggccgtcgagggtcttgcctatctgaccctggatgcagacgtgaaggatgacttcgtacaggatgtccccgctctccaggctatgtttgagctggctaaagccggtacaagtgacaagaccattctgtacagcgtcgccaccaccctagttaactgcaccaacagttacgacgtgaaagaggtcattccagaattagtacagctggccaagttttccaagcagcacgtaccagaagaacatcccaaagataagaaagattttatcgacatgcgagtgaaaagactgcttaaggccggggtgatcagcgccctcgcctgtatggtgaaggccgacagcgcgattctcacagaccagactaaggaactgttagcccgcgtcttcctcgccttgtgtgataatcctaaagatcgtgggacaattgtggctcaggggggcggcaaggcattaatcccattagccctggaaggcacagatgtcggtaaagtcaaagccgcccacgcgttagcaaagatcgctgcagtgagcaatcccgatattgcctttcctggagaacgagtttacgaggtggtacggcccctagtgcgtctgctcgacacacagagagacggactacagaattacgaggcactgctagggctcaccaacctgtctggcaggtctgacaaactgcggcagaagatctttaaagaaagggctctccctgatatcgagaattacatgtttgagaatcatgaccaactgcgccaagctgcaacggagtgtatgtgtaatatggttctgcataaagaagtgcaggaacggttcttggccgatggcaacgatcgcctcaaactggtggtgttactgtgcggagaggacgacgacaaggtgcagaatgccgctgcgggcgccctagcaatgctaaccgcagcacataagaagctgtgcctaaagatgacgcaggtcactacgcagtggctggaaatcttgcagaggctgtgccttcacgatcagctgagtgtgcaacaccgcgggttggtcatcgcctacaaccttctggccgccgatgcggagttggctaagaaattggtggaaagtgagctgctggaaattctgacggttgttgggaagcaggagccagacgaaaagaaagctgaggtagtccaaaccgccagagaatgcctgattaagtgtatggattacgggttcataaagcccgttagttag

SEQ ID NO: 23063 - DNA, 2022 bp, Artificial Sequence
  Description of Artificial Sequence: Synthetic coding sequence
atggccagccagttctgcctgcccgagagcccctgcctgagccccctcaaaccacttaagcctcactttggcgacatccaggaggggatatatgtagccatccagcgttcagacaagcgtattcatctcgccgtagttaccgagattaaccgagaaaactattgggtgaccgtagaatgggttgagaaagccgtcaagaaggggaaaaagattgacctggagaccatcctcctcctcaatcccgccctcgactcagcagagcatcccatgccccccccacctttgtcgcccctggcccttgccccctcatcagccatccgagaccagcgcacggcgacgaagtgggtggcaatgattccgcagaaaaaccagaccgcgtctggcgacagtctcgatgtcagggtgccctccaaaccatgccttatgaagcagaagaaatccccttgcctctgggaaatccagaaactccaagaacaaagagaaaagaggaggcgcctccaacaagagattcgggctagaagggccttagacgtgaacactagaaacccaaactatgaaataatgcacatgattgaagagtatcggcgccatttggacagctccaagattagcgtcctggagcctcctcaggaacaccgaatatgcgtctgtgtacgtaaaagacccttgaatcagcgtgagaccacactgaaggacttggatatcataactgttccctcagacaatgttgtgatggtgcacgagtcaaaacagaaggtggatttgacgcggtaccttcagaaccagacgttctgttttgaccatgcattcgatgataaagctagtaatgagcttgtttatcaatttacagctcagcccctggtcgagtccatcttcaggaaaggtatggctacttgtttcgcctatggtcaaacaggctcagggaagacctacaccatgggaggcgatttttccgggacggcacaggactgctctaaaggaatatacgcactggtggctcaggacgtgttcctgctactgcggaactctacctacgagaaattggatcttaaagtatacggcacgttcttcgagatttacggaggcaaggtgtacgatctcctgaactggaagaagaaactgcaagtgttggaggacggcaatcaacagatccaggtggtcggcctccaggaaaaggaggtgtgttgtgtggaggaggtcctgaacctggtcgagattgggaatagctgcaggacaagcagacagaccccggttaacgctcactcttcccggtcccacgcagtgttccagatcattctcaaatctggaagaattatgcatggcaagttcagtttggtggatctggccgggaacgaaagaggggccgataccactaaagctagtagaaaacgccagctcgaaggtgctgaaattaacaaatcattacttgcactgaaggagtgcatactggctcttggtcaaaataagccacacacgccatttagggcatccaagctgacactcgtactccgagatagcttcattggccagaactcctcaacctgtatgatcgccaccatctctcctggcatgacatcttgcgaaaatacactgaacacacttcggtatgcaaatcgggtgaagaagttaaacgtggatgtgcgtccataccaccgcggtcactacccaatcggtcacgaagcaccccgcatgcttaagagtcatatagggaatagcgagatgagcctgcagagggacgaatttatcaaaatcccctacgttcagtctgaagaacagaaagagattgaagaggtggaaacactccccactctgctgggcaaagacacaacaatttctggtaagggaagctcccaatggcttgaaaacatccaagaacgtgccggcggtgtccatcatgatattgatttttgtatagcgcgctccctctccatccttgagcagaaaattgatgcgctcactgagatacaaaagaagctcaagctgttgctcgccgatttacatgtaaaatccaaggtggagtag

SEQ ID NO: 23064 - DNA, 1236 bp, Artificial Sequence
  Description of Artificial Sequence: Synthetic coding sequence
atggccaccaccgccaccatggccaccagcggcagcgcccggaagcgcctgctgaaggaggaggatatgacaaaggtagagtttgagacgtccgaggaggttgacgtcacccccactttcgatacaatgggcttaagagaagatctgctcagagggatttacgcatatgggtttgagaaacccagcgccatccagcagcgggccataaagcagatcatcaagggtcgtgacgtgattgcgcagtctcaatccggcactggaaagaccgcaactttttcaatttctgtgctgcagtgcctggatattcaggtgcgggagacacaggccctcattctcgctccgacccgggagctggcagtacaaatccaaaaaggacttctggctcttggcgattatatgaatgtgcagtgccacgcctgtatcggtgggacgaacgtaggagaggatatcaggaagttggattacgggcagcatgtggtggccggtactccaggacgggtgttcgacatgattagacggaggagcctgagaacaagggctattaaaatgttggtgctagacgaggcagacgagatgctgaataagggtttcaaggaacagatttacgacgtatatcgttatttgccacccgcgacacaagtggtccttatcagcgccactctgcctcacgagatcctcgagatgacaaacaaattcatgacggatcctatccggattctcgtcaaaagggatgaactgacccttgaagggattaagcagttctttgtggcagtggaaagggaggagtggaagttcgataccttatgcgacctgtacgatacactgaccattactcaggccgtgattttctgcaatacgaagaggaaggttgactggctgaccgaaaaaatgagggaggctaattttactgtcagtagcatgcacggggacatgccccagaaagagagagagagtataatgaaagagttcaggtccggtgcctcacgcgtgctgattagcactgacgtttgggcccgcgggctcgacgtcccccaagtttctctgatcatcaattacgatctgcccaacaatagggagctgtatattcaccggataggcaggagcggcaggtatgggagaaaaggagtcgcgatcaacttcgttaagaacgatgacatccgaattctgcgtgatatcgagcaatattactcaacgcagatagatgaaatgccaatgaatgtcgccgaccttatttag

SEQ ID NO: 23065 - DNA, 1683 bp, Artificial Sequence
  Description of Artificial Sequence: Synthetic coding sequence
atggagctgcccgccgtgggcgagcacgtgttcgccgtggagagcattgagaagaagcgcatccgaaaagggagggtagaatacctggtgaaatggaggggctggtcgcctaaatataatacttgggaacccgaggagaatatcttggatccccggcttctgattgctttccagaaccgcgaaagacaagagcagctcatggggtacagaaaaagagggccaaaacccaagccgctggttgtccaggtgcctacattcgctagaagaagtaacgtgctaacgggactgcaagacagctccacagacaaccgggcgaagctggatttaggcgcccagggcaagggtcaggggcaccaatacgaacttaactcaaagaagcatcaccagtatcaaccacacagcaaggagagagctggaaaacctccgccacctggcaagtctggaaaatactattaccagctcaactctaagaagcatcatccttatcagccagatcccaaaatgtacgacctacagtatcagggagggcacaaggaggccccaagtcctacctgccctgatttgggagccaaatcgcatccccctgataaatgggcccagggcgcgggcgcaaaagggtacttaggggctgtgaaacccctcgctggggcagccggggcacctggcaaaggctctgagaaagggcccccaaatggaatgatgccagccccgaaggaagccgtgaccggtaacggcatcggtgggaaaatgaagattgtaaagaacaagaataagaacggccgaatcgtaatcgtaatgtcgaaatacatggagaacggaatgcaggctgtgaaaattaagtcaggtgaagtcgcggagggagaggctcggtcaccctctcataagaaaagagcggctgatgaaagacacccacctgccgatcgcacctttaagaaggctgcaggcgccgaggaaaagaaggttgaggcccctcctaagaggagggaagaggaagtgtccggggtgtccgacccgcagccacaggatgcagggtcacggaaactcagccctaccaaagaggccttcggagagcagcctctgcagctgacgactaaacccgacctgctggcgtgggacccggctaggaacacacaccctcctagtcaccaccctcacccccatccccatcatcaccaccatcaccaccaccatcaccaccatgctgtgggcttgaacctatctcatgtcagaaagcggtgtttatcagagacacacggcgaaagagaaccctgcaagaaacggctcactgccagaagtatctcaacgccaacttgtctgggaggaagccccgctgcagagcggccagccgacctgccacctgccgctgccctaccccagcccgaggtcatactgctcgacagcgacctcgacgagcccattgacctgcggtgtgtcaaaaccaggtcagaggcaggtgagcctcctagttctcttcaggtaaaacctgagacgcctgcaagcgctgctgttgctgtcgctgctgccgctgcgccgacgactactgccgagaagccccccgccgaagcacaagacgagcctgctgaatcactttcagagttcaaacccttctttgggaatatcataattaccgacgtcaccgccaactgtttgaccgtgacatttaaagagtacgtgaccgtctag

SEQ ID NO: 23066 - DNA, 1218 bp, Artificial Sequence
  Description of Artificial Sequence: Synthetic coding sequence
atggacagcctggtgaccgccaacaccaagttctgcttcgacctgtttcaggagatcggtaaggatgatcgacacaagaacattttcttctccccgcttagtttgtctgcagctctaggcatggtacgactgggggctcgttcagactctgcccaccaaatcgacgaggtgttacattttaacgagtttagccaaaacgagagcaaggagccagatccttgcctgaaatctaacaagcagaaggccggctctcttaataacgaatctggactggtgagctgctatttcggccagttactgtctaagctagacagaatcaagaccgattacaccctttctattgccaatcgactctatggggagcaggagttcccgatctgtcaggagtatctggacggagtgatccagttttatcacaccacaatcgaatcagtggactttcagaagaaccctgagaagagtagacaggaaatcaacttctgggtggagtgtcaaagccagggaaagattaaagagctgttcagtaaggacgccatcaacgcagagactgttttagtgctcgttaacgccgtgtactttaaggctaagtgggaaacttattttgaccacgaaaacactgtcgacgctccattctgcctcaacgctaatgagaacaaatccgtgaaaatgatgactcagaaaggcctgtaccggatcgggttcatcgaagaagtgaaagcccagattctggagatgcgatatactaaagggaagctgtccatgttcgtattgttgccgtcccattccaaggacaatctgaaagggctcgaggaactcgagcgtaagattacctacgaaaagatggttgcttggtcaagtagcgagaatatgtccgaggagagcgtcgtgctctcatttccacggtttacgctggaagatagctacgaccttaactctatcttgcaggatatgggcatcactgatatcttcgacgaaacccgggcagacctcaccggcatatcaccatctccaaacttatatctctccaagatcatccataagactttcgttgaggtggatgagaacggaacacaggctgccgccgccactggcgccgtggtctctgaacgatcactgaggtcttgggttgaattcaatgcaaatcacccctttctattctttattcgacacaacaaaacgcaaaccatcctgttctacggcagagtctgctctccatag

SEQ ID NO: 23067 - DNA, 3537 bp, Artificial Sequence
  Description of Artificial Sequence: Synthetic coding sequence
atgctgcggatgaagctgcccctgaagcccacccaccccgccgagcccccacccgaagctgaggaacctgaggcggatgcaagaccaggagctaaagccccaagccgcaggcggagggactgtcgacccccccctcctccgccccctcctgcggggccttccagaggcccactcccaccccctcccccgccccgaggtctgggtccccctgtggcagggggcgccgcagccggcgccggtatgccaggcggggggggcggaccatctgctgctttgcgtgagcaggagagggtctacgagtggtttggccttgtgctgggttcagctcagaggctcgagttcatgtgcgggctgctggacctgtgcaacccactggaattgcgctttctgggtagttgtcttgaagatctggccagaaaggactaccattacctccgggattccgaggcgaaagcaaatggattatccgatccaggacctctcgctgacttccgggagcctgcggtacggtctcggctaatcgtctacttagccctgttggggagcgagaacagggaggccgcggggcgcctgcataggttgttacctcaagtcgatagcgttctgaagagcctgagggctgctcgcggtgagggaagccgaggaggtgcagaggacgaacggggcgaagacggcgacggtgagcaggacgctgagaaagacgggtctgggcccgagggcggaatcgtggagcctcgtgtcggtgggggcctcggttcaagagcgcaagaggaacttctgctgttatttacgatggcctcattacacccagcattcagcttccaccagcgtgttaccttacgtgagcatctggagaggctgcgcgccgctctgcgcggggggccggaagacgctgaggtcgaggttgaaccctgtaaattcgccggccctcgggctcagaacaactcggcgcacggtgattacatgcagaataatgagagcagcttgatcgagcaggcacctataccccaggacgggctcacagtggccccacacagggcccaacgcgaggccgtccacatcgagaaaatcatgctgaagggagtccaacggaagcgggccgacaagtattgggaatacacttttaaggtcaattggtctgacttaagcgttactacagtgactaagacacaccaggaattacaggagtttctgttgaaactaccaaaagagttgtcatcagaaacgtttgataagacgatccttcgcgccctgaaccagggcagtttgaaacgagaggagcgacgccatcctgatctcgagccgatcctgcgacaactgttcagttcctctagccaggcctttcttcagagtcagaaagtgcattcatttttccagtccatctcctcagacagtctccactccattaataatctgcagagttccctgaaaacttcaaagatcctcgagcacctcaaggaggattcctccgaggcgagcagtcaggaagaagatgtgctgcagcacgcgatcatccataaaaagcacaccggaaagagtcctatcgtgaataatattggtacttcctgttccccccttgatggactgacaatgcaatacagcgagcagaacggtatagttgattggagaaaacagtcctgcacaacgatacaacatcccgaacactgcgtaactagcgccgaccaacactcggccgaaaaacgttctctctcctctatcaacaaaaaaaagggcaagccacagaccgaaaaagagaagattaagaagaccgacaacaggttaaattctcgtattaatggaatccgactgagtactccacagcacgctcacggaggtactgtaaaggatgttaatctcgatattggaagcggtcacgatacatgtggcgagacctccagcgagagttactcctccccctccagtccgcgtcacgacggtcgagaatcatttgagagtgaggaggagaaagatagggatacagattccaacagcgaagactccgggaatccttccaccactcgcttcaccggatacgggtccgtcaatcagaccgttacggttaaacccccagtccaaatcgcaagtcttggaaatgagaacggcaaccttcttgaagatccactaaactcaccgaagtatcaacacatttcatttatgcccactctgcactgcgtcatgcacaacggtgcacagaaatcagaggttgtggtccccgcccccaaacccgctgatggcaagacaattgggatgctcgtgccatcccccgtggccatttcagcaatccgcgagagtgccaattcaaccccggtgggcatcctgggcccgactgcctgcacgggagaatctgaaaagcacctcgaactacttgctagtccgttacctattccttcaaccttcttaccccacagctctactccagctcttcacctgactgtgcagcggttaaagctcccaccaccacagggctccagcgagagctgtaccgtaaacatcccacagcagccccccggcagcctgagtatcgccagtcctaacaccgcattcatccccatccataatccaggatcgttccctggatcccctgttgctacaactgaccctataacgaagtcagcatctcaggtggttggacttaatcaaatggtgccacagatcgaggggaacaccgggaccgtcccccagcctactaacgtgaaggtggtgctcccggccgccgggctgtcggcagctcaaccacctgcttcttatccattaccaggcagcccactggctgctggcgtcctcccctctcagaacagcagtgtgttgtctactgcagccacatctccccagcctgctagcgctggaattagccaagcccaggcaactgttcctcccgctgtgcctacccacactccaggaccagcccccagcccctctccagctctgactcacagcaccgcccagtctgatagtacctcctatattagcgccgtcggaaatacaaacgctaatgggaccgtcgttccaccccagcagatgggatccggaccctgtggcagctgcggccgcaggtgttcctgcggcaccaacggcaatctgcagctgaacagctactattatccaaatcctatgccaggcccaatgtacagggtccctagtttttttactctgccatctatttgcaacggcagttatttgaatcaagcccatcagtccaatggcaatcagctgccgttcttcctcccacagactccctacgcaaatggattggtgcatgaccctgtcatgggctcacaagccaactacgggatgcagcaaatggcaggcttcggccgtttttatcctgtctaccccgcccctaatgtggtggctaatacgagtggcagcggtccaaaaaagaacggaaacgtttcttgctacaactgcggcgtttccggacactatgctcaggactgcaagcagtcctcaatggaggccaaccagcagggaacctaccgccttcggtatgcccctcctttgccccccagtaatgacacccttgattccgctgactag

SEQ ID NO: 23068 - DNA, 411 bp, Artificial Sequence
  Description of Artificial Sequence: Synthetic coding sequence
atgcccggcaagaaggcccggaagaacgcccagcccagccccgcccgggcccccgctggccccgctgggacagccggcacagccagggatcaggctggctttgccatcggtatgcagctcaggtttacccgcggcaagaaactactgtctagctcactgtcctcctccccacttgccctacctcggggccatgaggagcaagttcaggttgcggggagccgggtatgctactccactcaggagatctggaggcagaccgagctcccggcagagacatcagagtctgacattcagactttgttgttacgcaaccttaccgctagtaagacgtgcatgagggggctattacagaaatcattcctgagaagatgtactttccatcagttcgaggaaaggctccattgcaactag

SEQ ID NO: 23069 - DNA, 879 bp, Artificial Sequence
  Description of Artificial Sequence: Synthetic coding sequence
atgaaggccaccgtgctgatgcggcagcccggccgggtgcaggagatcgttggggcactgaggaaggggggaggtgaccgactgcaagtaattagcgattttgatatgactttatctagattcgcctacaacggcaaacgctgcccatcttcctataatatactcgacaattccaagattatatctgaggagtgcagaaaggagttgaccgccctcctgcatcattattatcctatcgaaatcgaccctcacagaacggtgaaagaaaagctgccccatatggttgaatggtggaccaaggcgcataatctgctttgtcaacagaaaatccagaaattccaaatcgctcaagtggtgcgagagtctaacgccatgttaagggaggggtataaaacctttttcaacaccctgtaccataataatattcccctatttatctttagcgctgggattggagacattcttgaagagatcatccggcagatgaaagtgtttcatcccaatattcacatagtttctaactacatggacttcaacgaggatggattcctgcagggcttcaagggtcagctgattcatacctataacaaaaacagctcagcctgcgaaaacagtggatatttccagcagctcgaaggaaaaaccaatgtcattcttctcggcgacagtattggcgatctgacaatggccgatggggtgccgggcgtccagaatattctcaagatcgggtttttgaatgataaagtggaagagaggcgcgagaggtacatggactcgtatgatatcgtcctggagaaagacgagacactagatgtcgtgaatgggctgttacagcacatattatgtcagggggttcagttggaaatgcagggcccctag

SEQ ID NO: 23070 - DNA, 2010 bp, Artificial Sequence
  Description of Artificial Sequence: Synthetic coding sequence
atggacctgcggaccgccgtgtacaacgccgcccgggacggcaagctgcagttactccagaagcttctatctggacgttctcgggaagaattggatgagctgacaggcgaggtagccggaggcggcacaccactgcttatcgctgcgcggtacggccacctggatgtcgtagagtatctggtcgatagatgcggcgcttctgtggaagccggggggtctgtacacttcgacggggagacgattgagggcgcacccccactatgggccgcttccgctgctggacacctggatgtcgtgcggagcctgttaagacggggcgcaagcgtaaaccgcacgacccgaacaaattccacaccattgagggcagcgtgctttgacggtcatttggaagtggtgaggtacttggtgggcgagcatcaggctgatctggaagtggcgaatcggcatggacacacgtgcttgatgatttcctgttataaggggcaccgggaaatcgctcgctatctgctagagcagggagcacaggttaatcggagaagtgccaagggcaacacagccctgcacgactgtgcggaatcaggatcattagaaatccttcagcttttactgggctgtaaagcacggatggaacgcgatgggtacggaatgaccccactgcttgccgcatccgtgaccggccacaccaatatagtggagtacctaattcaggagcagccagggcaggagcaggtggcaggtggagaagctcagcctggactcccacaagaggatccctcaacatcccaggggtgcgcgcagccccagggagctccatgttgctctagcagccccgaggagcctctgaacggcgagagttacgagagctgctgccccacaagccgggaggctgccgtggaagcactggagctcctcggcgctacgtacgtggataagaaaagggatttattgggagcactcaaacactggagacgcgcaatggagctgagacaccaaggcggggagtatctgccaaagcccgaaccaccacagctggtgctcgcatatgactactctcgtgaagttaacactacagaagaactagaagcactgattactgatccagatgaaatgcgcatgcaggcactgctgatacgtgagagaatcctgggcccaagccatcctgatactagttattatatccgctaccggggcgcagtgtatgctgactccggcaacttcgagagatgtatccgactctggaagtacgccttggacatgcaacaaagtaacctggaacctctatctcccatgaccgcttcatcttttttaagtttcgcggagctattttcgtacgtgctccaggacagagctgcaaaaggaagtctaggcacccagattggctttgccgatcttatgggggtattaactaaaggggtgagagaagtcgaacgtgccctccagctgccgagagaaccaggtgacagcgctcagtttacgaaagccctcgccataattttgcacctgctctacctgttagaaaaagtcgagtgtacgccaagccaagaacacctgaaacaccaaactgtgtacaggttgctgaagtgtgccccgcgcggaaagaacgggttcacccctcttcatatggcagtcgataaggatactacgaatgtcggccggtaccctgtgggccgattcccctctctccacgtggtaaaggttctgctggattgcggtgcggaccccgactcccgcgattttgataataacaccccgctgcacatcgccgcccagaataattgtccagccatcatgaatgcgttgattgaggccggggcccacatggatgccacaaatgctttcaaaaagacggcttacgagctgctggacgagaagttgctggcgcgggggactatgcagcctttcaattacgtaactctccagtgtctggccgccagggccctggacaaaaataaaatcccatacaagggcttcatcccagaggacctggaggccttcatagaactccactag

SEQ ID NO: 23071 - DNA, 720 bp, Artificial Sequence
  Description of Artificial Sequence: Synthetic coding sequence
atggccgccaccctgctggccgcccggggcgccggccccgcccccgcttggggcccagaggcttttactcctgattgggagagcagggaagtgagcacgggtactacaatcatggccgtccaatttgatgggggggtggtgcttggtgcggatagccgcacaaccaccggaagctacattgctaatagggtcacagacaagctgacgcctatccatgaccggatattctgctgccgctcaggatccgccgctgacacccaggccgtggccgacgcagtcacctatcaactggggttccattcaattgaactgaacgagcccccactagtacacactgcagcctctctcttcaaggagatgtgctaccgatacagggaggaccttatggctgggattattatcgcgggatgggacccacaagaaggaggccaagtttactctgtccctatgggcggaatgatggtgcggcagagcttcgccataggagggagcggaagtagctatatatacggctacgtggacgctacctaccgggagggtatgactaaggaggaatgccttcagtttacagctaacgcgctcgccctcgccatggagcgagacggatcttcgggaggcgtcattcgtctagccgccattgctgagtccggtgtggagagacaggtgcttctcggtgaccagataccaaaattcgccgttgcgactctgcctccagcttag

SEQ ID NO: 23072 - DNA, 1383 bp, Artificial Sequence
  Description of Artificial Sequence: Synthetic coding sequence
atgaacttcagcgaggtgttcaagctgagcagcctgctgtgcaagttttctcctgatggcaaatacttagcctcatgcgtgcagtaccgcctggttgttcgggacgttaatacgctccagatattacagctgtatacttgtttggaccagattcagcatatcgagtggtccgccgatagcctctttatcctctgtgctatgtacaagcgcggactagttcaggtgtggtcgctggagcagcctgaatggcactgtaagattgacgaggggagcgctggactggtggccagctgctggtcccccgatggaagacatatcctcaatacgaccgaatttcatctaaggatcaccgtttggtctctgtgcaccaagtcagtgtcttacattaagtatcccaaggcctgccttcagggcattactttcacacgggatggaagatatatggccctagccgagagaagggactgtaaggactatgtcagcatcttcgtgtgcagtgactggcaactgctgagacacttcgatactgatacccaggatctcaccggcatcgagtgggcacccaatggttgtgtgctggccgtgtgggatacatgtttggagtataaaattttgctgtattcactggacggtaggctgctgtctacttattcggcttacgagtggtcactcggaattaagtccgtcgcttggagcccctcctcgcagttcctggcagtaggcagttacgacgggaaagttcgcatacttaatcatgtgacttggaaaatgattaccgaattcggacatcccgctgcaatcaacgacccaaagatcgtagtttacaaggaggctgagaaaagcccacaactgggcctgggttgtctgagctttccgccgccacgagccggcgccggccccctcccctcctccgaaagcaagtatgaaattgcttcagtgcctgtgtccttacagacactaaagccagtgaccgatcgggccaaccctaagattgggataggtatgctggccttctctcctgatagctatttcctcgccacccgaaacgacaatatccctaatgctgtatgggtatgggatatccagaaactgaggctcttcgcagtgttggagcagttgtccccggtgcgcgcgtttcaatgggacccacagcagcccagactggctatatgtacaggggggagcaggttgtatctgtggtctccagctggatgcatgagtgtgcaagtccccggagagggggacttcgcagtgctcagcctatgctggcacttaagtggtgacagcatggcgctgctatcgaaggaccacttctgcctgtgttttctcgagaccgaggccgttgtcggaacagcttgtcgccagctgggcggccatacatag

SEQ ID NO: 23073 - DNA, 282 bp, Artificial Sequence
  Description of Artificial Sequence: Synthetic coding sequence
atgagcggcctgcgggtgtacagcaccagcgtgaccggcagccgggagataaaatctcagcagtccgaggtgacaagaatcctcgacggaaagcggatacagtaccagctggtcgacatttcccaggataacgcactgagggatgaaatgcgagccctggctggaaaccccaaggccactccccctcagatagtaaatggcgaccagtattgtggagactacgagctgttcgttgaggccgtggaacagaacacgctgcaagaattcttgaagcttgcatag

SEQ ID NO: 23074 - DNA, 1920 bp, Artificial Sequence
  Description of Artificial Sequence: Synthetic coding sequence
atgaacctggagaagctgagcaagcccgagctgctgaccctgttcagcattctggagggagagctcgaagcacgggatctggtcatagaggcccttaaagcccagcatcgcgacacattcatcgaggaaagatatgggaaatacaacatctccgaccctctgatggctctgcaaagggactttgagacacttaaagaaaagaacgatggggagaagcagcccgtctgcaccaaccccttatccatactcaaggtggttatgaaacaatgtaaaaacatgcaagagagaatgctgtcacagctggctgccgctgagagcagacacagaaaagtgatactggacttagaagaggagagacagcggcacgctcaggacacagcagaaggcgatgacgtcacctacatgctagaaaaggagagggaacgacttacccagcagctcgaattcgagaagagtcaagtgaagaaattcgagaaggagcagaagaagctttcctcccagctggaagaagagcggagccggcacaaacagctgtctagcatgctagtgctagaatgtaagaaggccacaaataaagctgctgaggaaggtcagaaggcgggggaactgtcactgaagctggaaaaggaaaagtcgcgcgtgtcgaagcttgaggaggagctcgcagcagaacggaaacgcggcttacagacggaggcccaggtcgagaagcagctgtctgagttcgacatagagagagagcagctgagggcaaaactcaatagggaagagaaccggaccaagacgctgaaggaagagatggagagtctgaagaaaattgtgaaggatctggaggcatcccatcagcactcgtcacctaatgaacagctcaagaaaccagtgaccgtctccaaggggacagcaactgagccactgatgttgatgtccgtcttttgccagacagaaagtttcccagctgagagaacgcacggaagcaacatcgcaaagatgactaacaccggcctccctggtcccgcgacccctgcatactcatatgccaaaactaatggtcattgtgaccctgaaattcagacgacgcgggaattaacagccggtaataacgtcgagaaccaggtccctcctcgcgaaaagagcgtggcattagcgcaggaaaagcccgttgagaacggcggctgcccagtggggattgagacacccgttcccatgccttcgcccctctcgagctcaggctccagcctcagcccaagttccactgccagctcctcactcaccagcagtccctgcagttctccggtgctgacaaaaaggctcctgggttcttcagccagtagccctggctatcagagttcctatcaggtcggtattaatcagaggtttcatgccgcacggcataagttccaaagccaggcagatcaggaccaacaagccagcggattgcagtcccccccaagccgcgatctgtccccaaccttaatagataacagcgctgcaaagcagctcgcccgcaataccgtaacgcaggtgctgagccggttcacatcgcagcaaggacctattaagccagtgagtcccaactccagtccttttggcactgattaccgcaacctcgctaacaccgccaacccccgcggcgacacctcccattcgccaactcctggaaaggtaagttcccccctgagtccactgtccccaggaattaaatcacctaccattcccagggccgaaagagggaacccccccccgattcctccaaagaagcccggcctgaccccatcccccagcgcaactactccattaactaagacccattcgcaagctgcctcattgaccactgctgaggacctggcaagctcgtgcagcagcaatacggtcgtggccaacggaaaagacgtcgaactactgcttcccaccagctcttag

SEQ ID NO: 23075 - DNA, 2487 bp, Artificial Sequence
  Description of Artificial Sequence: Synthetic coding sequence
atgcggttcctggaggcccggagcctggccgtggccatgggcgacaccgtcgtcgaacccgccccgcttaaaccaacctcggagcccacatcaggaccaccaggcaataacggggggagtctgctttcagttattaccgaaggggttggagagctatccgtcattgatcctgaggtagcccaaaaggcctgccaggaagttctcgagaaggttaaacttctgcacggaggtgtcgcagtgagttcaagaggcactccgcttgagctggtcaatggtgacggggtcgactcggagatcaggtgtctagatgacccgccagcccagataagagaggaggaagacgagatgggcgcagctgtcgcctccggaactgctaagggggcccgccggagaaggcagaataactctgccaagcagagctggctgctgcgtctttttgagtcaaaactgttcgatatctcaatggccatttcctacctgtataactcaaaggaacccggtgtgcaggcctacatcgggaatcgactgttctgtttcaggaacgaggacgttgacttctatttgccacagctgctgaacatgtacattcacatggatgaggacgtcggcgacgcaatcaagccatacattgtacatagatgcaggcagagtattaacttcagcttgcagtgcgccttgctattgggagcttactcttccgacatgcacatttcgacacagaggcactcacgaggcacaaagctccggaaattaatactgtctgacgaactcaagcccgcccaccgaaagcgcgaattaccctcactatcaccagccccagacacaggcctatccccgagcaaacgcactcaccagaggagcaaatctgatgctaccgctagtataagtctctcatctaacctcaagcgaactgcctcaaacccaaaggtagagaatgaggacgaagaactgtcaagctctacagaatctattgataactccttcagctccccggttcgactggcacccgagcgagagttcattaagagcctgatggccatcggaaagcgtctggctaccctgccgaccaaggaacagaagacacagagactcatctccgagttgtcacttctcaatcacaaattaccagcacgagtgtggttgccaaccgccggattcgaccaccacgttgtccgtgtgccccacacacaggccgtcgtacttaactccaaggacaaggctccatatctgatttatgtggaggtgctggagtgcgagaactttgacacaaccagcgttcccgctcgcatcccagaaaacaggatccggagcaccagaagcgtcgagaatctgcccgaatgcggaatcacacatgagcaacgcgctggaagtttcagtacggtgcccaactatgacaacgatgacgaggcttggagtgtggatgacataggggagcttcaagtggagctgcccgaggtccacactaatagctgtgacaatatctcccaattcagcgttgattccattaccagtcaagagtccaaggagcccgtctttattgctgcgggcgatattaggcgtaggcttagtgaacaacttgcccacacccctacagcttttaagagggacccggaggacccttcagcagtcgcattaaaggagccatggcaagaaaaggtgaggcgcattcgggaaggctcgccgtacgggcatctgcccaactggcgcctactctcagtgattgtgaaatgcggcgacgatctgcgccaggagcttctagcttttcaggtactgaaacagttgcagtcaatctgggagcaggagcgcgtgccactttggatcaaaccttataagatacttgtcattagtgccgattctggcatgattgagccggtcgttaacgctgtgtccattcaccaggtgaagaagcagagtcagctctcactcctagattattttctacaggagcatggaagctacacaacagaggcttttctgtctgcccagaggaacttcgtacaatcatgtgcaggatactgtcttgtctgttatcttttgcaggtcaaggacaggcataacgggaatatcctgctggacgccgagggacatatcatccacattgattttggattcatactgagctctagtcctcggaatcttggctttgaaacttccgcattcaagttgactaccgaattcgtagatgttatgggagggctggatggggacatgttcaattactataaaatgctcatgctccagggcctcattgccgctcgcaagcacatggacaaagtcgtgcaaatcgtggaaattatgcagcagggatctcagcttccatgcttccacggctcatccaccatccggaaccttaaagaacgcttccacatgtccatgacggaagagcagctgcaactcctggtggagcagatggtcgatgggagcatgcgtagtattacgaccaaactgtacgacggctttcaatacttaaccaatggcatcatgtag

SEQ ID NO: 23076 - DNA, 4233 bp, Artificial Sequence
  Description of Artificial Sequence: Synthetic coding sequence
atggccgacaccgacctgttcatggagtgcgaggaggaggagctggagccctggcagaaaataagtgacgtgatcgaggacagcgtcgtcgaggactacaactcggtcgacaaaactactaccgtgagcgtctcccagcagccagtctctgctcctgtccccattgcggcacacgcatctgtcgctggccacctcagcacttccacaacggtctctagcagtggggcgcagaattctgactcaacaaaaaaaaccctggtaacccttattgctaataataacgccggcaatcctctggtgcagcagggcggacagcctctcatcctcacacagaatcctgcaccaggactaggtaccatggtaacacagcccgtgctacgaccagtccaggtcatgcaaaacgctaaccacgtgacctcctcccccgtggcttcacagcccatatttattaccactcaggggttccccgtgcgaaatgtacgtccagtgcagaacgccatgaaccaggtcggcattgtgctaaacgtgcaacagggacagacagtgcgtcccatcacccttgtgcctgcaccgggcacccagttcgtgaagcccacagtgggagtgccacaggtcttttcacagatgactcctgtgcgaccaggttctaccatgccagtgaggcccactaccaacacatttaccactgtaatcccagctacgctcacaatcagatcaaccgtgcctcagagccagagtcagcagaccaagagtacccctagtacaagtaccacaccaactgcaacacaaccaaccagcctgggtcagctggccgtgcagagccctggtcaaagcaaccaaaccacaaatcctaagttggccccaagtttcccctcgccccccgctgtgtctatagcatccttcgtgacggtcaaacgtcctggagtgaccggcgaaaacagtaatgaggtggccaaactggtcaacacccttaacaccatcccgtccctggggcagagccctggaccagtggttgtgtccaacaactcatctgcacacgggagccaaagaacgtccggccctgaatcaagtatgaaagtcactagctccatccccgtttttgatctacaggacgggggcagaaagatttgtccacggtgcaacgctcagttcagagttactgaagctctgagaggccacatgtgttactgttgccctgagatggtcgaatatcagaagaagggtaagtcacttgactctgagccgagcgttccgagcgcagccaaacctccaagccctgagaaaaccgcccctgtagcctctaccccctcgtcaacaccaataccagccctttcgcccccaacaaaggtccctgaaccgaacgagaacgtcggcgatgccgtccagacgaaactgataatgctggttgatgacttttattacgggagggatggtggcaaggtggcgcaactcactaatttccccaaagtggccactagttttcggtgcccacattgtactaaacgcttgaaaaataacattagatttatgaatcatatgaagcatcacgtagaattggaccagcagaacggggaggttgatgggcatacaatctgtcaacattgctatagacagttctcaacgccattccaactgcagtgtcatctggaaaacgttcactcaccttacgagtctaccacgaaatgcaaaatatgtgagtgggcatttgaatcagagcccctcttcctccaacatatgaaggatactcacaagcccggtgagatgccctatgtctgtcaggtttgtcagtaccgttcttccctctactcggaagtagatgttcacttccggatgattcacgaggatacaaggcacctactttgtccttactgtctgaaagtcttcaaaaatggcaatgctttccagcagcactacatgcggcatcagaagcgcaacgtgtaccactgtaacaaatgtaggcttcaattcctgttcgccaaggacaaaatagaacataagctccagcaccataaaaccttcaggaagccaaaacaactagagggacttaagccaggaacaaaggtgaccatccgagcctcccgtgggcagccacgaactgtgccagtatcctcaaatgatactccaccctctgccctgcaagaagccgcacccctcacttctagcatggacccacttcctgtgtttctatatcctccggtgcagagaagtatacagaaacgcgcggttcgcaagatgagcgtgatggggaggcagacctgcctggagtgctctttcgagatcccagactttcctaaccacttccccacctacgttcattgctcactttgcaggtacagcacttgttgcagtagagcctatgcaaaccatatgatcaacaaccatgtgcccaggaagtctcccaaatatttggcactgttcaagaattcggtatccgggatcaaacttgcctgcaccagctgtactttcgtcacttcagtgggggacgccatggcaaagcaccttgtgttcaaccccagccaccgcagctctagcattttgccccgcggacttacctggatcgcacattccaggcatgggcagactagagacagagtgcatgaccggaatgtgaagaatatgtacccccctccatcgttccctactaataaggccgccactgtgaaaagtgccggcgcgactcccgctgaaccagaagagctcttgactccattggctcccgcactgccatcgccagcgtctacggcaacaccgccacctacacccacccacccacaggcattggccctgccccccttggcaaccgagggcgctgaatgcttgaacgtggatgatcaggatgaagggtctccagtaacgcaagaacctgagcttgccagcggaggcggcggctctggcggtgttggcaaaaaggagcagttgagtgtgaagaagttgcgtgtcgtgttgtttgccctgtgctgcaatactgaacaggctgccgagcattttcggaacccgcagcgacggatcaggagatggctccgacgctttcaagcatctcaaggagaaaacctggaagggaaataccttagctttgaagctgaagagaaactggcggagtgggttctaacccaacgcgaacagcagttgcctgtgaacgaggagaccctgttccagaaggccacaaagatcgggaggtcgctggaaggaggtttcaaaatcagctacgagtgggctgtgcggtttatgctgagacatcatctgacaccacatgcccggagagccgtcgcacatacccttcccaaggatgtggcagagaatgctgggctgttcatcgattttgtgcagcggcagatccacaatcaggacttacctctctccatgatcgtggccatcgacgagatttccctgtttttggacaccgaggtcttgtccagcgacgatcgcaaggaaaatgccctccaaacagttggcactggagagccttggtgcgatgtggtgctggcaatcctggcagatgggaccgtgcttccaactctcgtcttctaccggggccagatggaccagcccgcaaatatgcctgattctatcctccttgaggcaaaggagtccggctacagcgacgacgagatcatggagctgtggtccactagagtctggcagaaacacactgcatgtcagcgcagtaaaggcatgttggtcatggactgccatcggacccacctctcagaagaggttttagctatgctgtcagctagttctacccttccagcagttgttccagccggctgcagcagtaaaatacaaccattagacgtgtgtattaagcggactgtgaagaatttcttacacaaaaagtggaaggagcaggctagagaaatggctgatacagcctgcgatagcgatgtcctgctccaattggtgttagtttggctgggtgaggtgctgggcgtgatcggagattgtcccgaattagttcagaggtcatttctggtcgcaagtgtgttacccggccctgacggaaacataaacagtccgaccaggaacgccgacatgcaagaagagctcattgcctccctcgaggaacagttgaagcttagcggagaacactcggaaagttcaacgcctcgaccccggtcttctcctgaggagaccatcgagcccgagtctcttcaccagctgttcgagggggagagtgaaaccgagagtttctacggctttgaagaggcagatctcgacctcatggaaatctag

SEQ ID NO: 23077 - DNA, 1488 bp, Artificial Sequence
  Description of Artificial Sequence: Synthetic coding sequence
atgccccagctgctgcagaacatcaacggcatcatcgaggccttcagaagatacgctaggacagaggggaactgcacagcgctcactcgaggagagctgaaacgcttgcttgaacaggaatttgcagacgtgatcgttaagccacatgacccagctactgttgatgaggtcctgagattactggatgaagaccatactggcactgtggaatttaaggaattcctcgtcctcgtgtttaaggtggcacaagcttgcttcaagacactgtcggagagtgccgaaggggcatgcggatcacaggaatctggttcactccacagtggagcatcccaagagcttggagagggacagcgatctgggaccgaagtggggagagccgggaaggggcagcattacgagggttcctctcaccggcaatcccagcaggggtctcgggggcagaatcgtcctggtgtgcaaactcaaggccaagccacaggatctgcttgggtgtcatcttatgacaggcaggccgaaagccaatcacaggaaagaatttcccctcaaattcagttgtcaggccagactgaacagacacaaaaggcaggtgaaggaaagcgaaaccagaccaccgagatgaggcccgagcggcaacctcagacccgcgagcaggatagagcccatcaaactggtgagacagtgaccgggtcagggacccagacccaggccggagcaacacagacggttgaacaggattctagccatcagactggaagaacctcaaaacagacacaagaagccactaacgaccagaatcgcggcacggaaacacatggccagggccgctctcagaccagtcaagctgtgacaggtggccacgcgcagatccaagccggcacacatacacagacccctacacagaccgtcgagcaggactctagccaccaaacgggctcaacaagtacccagactcaggaatctaccaatgggcagaatcgtggcactgagatccacggccagggaagaagtcagacatctcaggcagtgacaggtgggcatacccagattcaggccggctcacacaccgagaccgtggaacaggatcgatcccaaacggtttcacatgggggagcccgcgagcagggtcagacccagactcaacctgggtctggacagcgatggatgcaggtctctaacccggaggctggcgaaacggtcccaggaggccaggcgcaaaccggcgctagcaccgagagcggtagacaggagtggtcatccacacaccccagacgctgtgttactgaggggcagggcgacaggcagcccacagtagtgggtgaagagtgggttgacgatcacagccgcgagaccgtcatcttacgtctggaccaaggtaaccttcatacttctgtctcttccgctcagggccaggacgccgctcagagcgaggagaaacgtggtataactgccagggagctgtattcttatcttagaagtacgaaaccatag

SEQ ID NO: 23078 - DNA, 1233 bp, Artificial Sequence
  Description of Artificial Sequence: Synthetic coding sequence
atgaacatgcccagcacccccctggcccccaccaccggcaccgccacctgttcctggtccgcgagcacctgcacaactacacgacctgccgtccggcctcctagtttcccacaccgcccacctggcaatgccgctctccctagcctgatgccatcacggccaacacaggtcgctggtcagtgcggggcgggaaataattgggcaaaaggtcactacactgaaggagctgagctaatggagtcggtgatggacgtggtgcgtaaggaggccgaaagttgtgattgccttcaggggttccaactcacacacagtctgggcgggggcactggatccggcatggggaccctccttctgtccaagatccgtgaggagtaccccgatcggattattaacaccttttccatcctcccaagccccaaggtctctgacacagtcgtggagccctacaacgccaccctatctgtgcaccagctcatcgagaacgccgatgagacgttctgtatagataatgaggccttgtatgatatctgctccaaaaccctgaagctccccacacccacctacggagatttgaatcacctcgtctccgctacaatgtcaggggtgactacctgcttacgatttcctgggcaacttaacgcagatcttcggaaactggccgtcaacatggtgccctttccacgcctacactttttcatgcccgggtttgcccctttgacaagccgcggtagccagcagtatagggccttgaccgttgccgaactgacacagcagatgttcgacgctaaaaatatgatggcagcctgtgaccccagacacgggcgctacttgactgccgcagcgatttttcgagggcggatgcctatgcgggaagttgatgaacagatgtttaacattcaggacaagaattcctcatactttgctgactggcttcctaataacgtgaaaactgccgtgtgtgatatcccccctagagggcttaagatgagcgcgactttcatcggtaataataccgccatccaagaattgtttaaacgggtctcggagcaatttaccgccatgttcaggcgcaaggcatttttacactggtatacaggggaaggcatggatgaaatggagttcactgaagccgaaagcaatatgaatgatctcgtctcggaataccagcagtatcaagatgctactgccgaggaggaagaggatgaagagtatgctgaggaggaagtggcatag

SEQ ID NO: 23079 - DNA, 2106 bp, Artificial Sequence
  Description of Artificial Sequence: Synthetic coding sequence
atgggcagcgccgccgacgtgcggttcagcctgggcaccaccacccacgcacctcctggcgttcacaggaggtattcggctctccgagaggaatctgccaaagactgggaaacgagtcccttaccaggcatgctggcacctgccgcggggcccgcgtttgactccgaccctgaaatatcagatgtggacgaagatgagcctggtggactcgtgggcagcgcagatgtggtgagcccatcaggtcactccgatgcacagacacttgccatgatgctgcaggagcagctcgatgcaatcaacgaagagatccgaatgatccaggaggagaaggaatccacagagctgcgagcagaggaaatcgagacccgcgtgacgagtgggtctatggaagcactaaacctcaagcagctcagaaaacgaggatctatccccacctctttaacggccctgtctctcgctagtgcctcaccccccctctcaggcaggagtactcccaagttaacttctcgaagtgccgcccaagacttggacaggatgggggttatgacgcttccaagcgatctcagaaaacatcgaagaaaactgctcagtcctgtgagcagagaagagaaccgagaggataaagcaaccataaagtgtgagacctcccccccatcaagtccgcgaacactgaggttggagaaattgggtcacccagctttatcccaagaggaaggcaaatcagctctggaagatcaaggatccaacccgtcctcctctaattcctcacaggatagcctgcacaagggcgctaaaagaaaaggaataaagagctctatcggtcgcctgttcgggaaaaaggagaagggccggctcatccaactgtcacgggatggcgccactggccacgtgcttctgaccgactcagagttttcaatgcaggagcccatggttcctgcaaagttgggaacacaggccgaaaaggaccggagactgaaaaaaaaacaccaactcctagaggacgctaggcgcaagggcatgccgtttgcccagtgggacgggccgacggtggttagttggttggagctctgggtgggaatgccagcctggtacgtggctgcctgtagggctaatgtgaaatccggggctatcatgtctgccctgtccgataccgagattcagcgcgagataggaatcagtaacgccttgcatcgtctgaagctgagattagctatacaggagatggtgagtctgacctcgccgagcgccccccctactagtcgcacttcatccggaaatgtctgggttacgcacgaggagatggagacactagagacgagcacgaagacagatagcgaggagggttcctgggcgcagaccttagcttacggagatatgaatcacgaatggatcgggaacgaatggttgccttccttagggctaccccaatatcggtcctacttcatggaatgcctcgtggacgctagaatgttggatcatctaactaaaaaggacctgagagtccacctgaagatggtagactccttccaccgaacgagcctgcagtacggcatcatgtgtctgaagcgcttgaactacgacaggaaagaactggaaaagaggcgagaggaatcacagcatgaaattaaagatgtcctagtttggaccaatgaccaagtggtgcactgggtgcagtcaatcggcctgagggattatgctggaaacctgcacgaaagtggggtacacggcgcactgctggcactcgatgagaatttcgaccacaacactcttgccctgatcctgcagatcccaacgcagaatacgcaggcccggcaagtaatggagagggagttcaataatcttcttgccctcgggactgatcggaagctggatgatggagatgacaaggtgttccggagggcaccctcttggcgaaagcgtttcaggccccgggagcaccatggtcggggcggaatgctgtctgcttccgctgagactcttccggccgggttccgcgtgagcacccttggaacgctgcagcctcccccagcaccacccaaaaaaattatgcccgaggcccattcccactacctttacggacacatgctttccgcctttagagactag

SEQ ID NO: 23080 - DNA, 1029 bp, Artificial Sequence
  Description of Artificial Sequence: Synthetic coding sequence
atggccagcgtgacccgggccgtgttcggcgagctgcccagcggcggcggaacggttgagaaattccagctgcagtcagacttactacgagtcgacatcatctcatgggggtgtacaatcaccgccctcgaggttaaggatcgtcagggccgggccagtgacgtcgtgttgggctttgcagaactggaaggttatttgcagaaacagccctactttggggcggtaatcggcagggtggccaaccggattgcaaaaggcacctttaaggtcgatggaaaggagtatcacttggccattaacaaggagccaaattctctacacggtggcgtacgggggtttgacaaggtgttgtggaccccgagagtactgagtaatggagtgcagtttagccgcatctctcctgacggagaggagggatatcctggggaactgaaggtgtgggtcacttatacacttgatgggggtgagctaatcgtgaactatcgcgcacaggcatctcaggccacgcctgtgaacctgactaatcattcatattttaatctggcagggcaagcgtcccccaacattaacgaccatgaggtgactatcgaggcggacacatacctgcccgtagatgagaccctgatcccgacaggagaagtggctccggtacagggtaccgcctttgacctcaggaagccagtggagcttggtaagcacctccaggacttccacctgaatgggtttgaccataatttctgccttaagggtagtaaggagaagcatttctgcgccagagttcatcacgccgcctccgggcgcgttttagaggtttacactactcagcccggagtacagttctacactgggaatttcttggatggtacactcaagggtaaaaatggggccgtgtatcctaaacatagcggtttctgcctggaaacccagaattggcccgacgccgtcaatcagcctagattcccccccgtcctgctgcgccccggggaggaatatgaccacaccacatggttcaaatttagcgtggcatag

SEQ ID NO: 23081 - DNA, 2295 bp, Artificial Sequence
  Description of Artificial Sequence: Synthetic coding sequence
atgagcgacacccggcggcgggtgaaggtgtacaccctgaacgaggacaggcaatgggatgatcgaggcaccggccacgtgtcaagcacttatgttgaagagctgaagggcatgtccctgctggtgagagctgaatccgatgggagtttactgctggaatcaaagattaatcccaacacagcataccagaagcagcaggatactcttattgtctggagcgaggcagaaaactacgacctggcactgtcctttcaggaaaaagctggttgcgacgagatctgggagaagatttgtcaggtgcaggggaaagacccttcagtggaggtgacgcaggacctcatcgacgagagtgaagaggagcggttcgaggaaatgcccgagacctctcacctgattgatttgccaacgtgtgagctcaacaaactcgaagagattgccgatctggtgacatccgttctttccagcccgatcaggcgcgagaagctggccctggcactcgagaacgaaggatacataaaaaagcttctgcagctttttcaagcatgcgagaatcttgagaacaccgagggcttgcatcacctgtatgagattatcagaggtattttgttcctcaataaggcgaccctttttgaggttatgtttagtgacgaatgcataatggatgtggtcggctgtcttgagtatgatcccgcccttgctcagcccaaaaggcatagagaattcctgaccaaaaccgcaaagttcaaggaggtcatccctattacagattcagagctgaggcagaagatacatcagacctatcgtgtccaatacatccaggacatcattctgccaacccccagtgtgtttgaagagaactttcttagtacattgacctccttcatcttttttaataaggttgaaatcgtgagcatgttgcaggaagatgagaaatttcttagcgaagtctttgcacagttgacagatgaagccaccgacgacgacaaaagaagagagctggtcaatttctttaaagagttttgtgctttttctcagactctgcaaccacaaaacagagatgcttttttcaagacgctggccaagctcggaatcttgccagctctcgagatcgtgatgggcatggatgatttgcaagttagaagtgccgccacagacattttttcctatctggtagaattttcaccatctatggtacgagaatttgtcatgcaggaggcccagcagtcagacgacgacattctcctgattaacgtagtgatcgaacagatgatttgtgataccgacccagaactgggcggcgccgtacagttaatgggactcctacgcaccttgatagaccctgagaatatgctggcaaccactaacaaaactgagaaaagcgagttcctcaactttttttacaatcactgcatgcacgttctgacggccccacttctcaccaacacgagtgaggacaaatgtgaaaaagacaatattgtgggctctaataaaaataacaccatatgtcccggtgctctccggtttatgagaaggattattggactcaaggacgaattttacaatagatacatcactaaaggcaatctcttcgagcccgttatcaacgcgctcctggataatgggacacgctacaatctgctgaactctgcagttatcgaactgtttgaatttatcagggtcgaggatatcaagtcacttactgctcacatcgtggagaacttttacaaagccctcgagtccattgagtacgtacagactttcaaaggtcttaagaccaagtatgagcaagagaaagacagacagaatcagaagcttaatagtgtgccaagcatactgcggtccaatcgattccgcagggacgccaaggcactcgaggaggatgaggaaatgtggttcaatgaagatgaagaggaagagggaaaggccgtggttgcccctgtggagaagcctaagccagaggacgacttcccggataattatgaaaagtttatggagaccaagaaggcaaaagagtcagaagacaaagaaaaccttccaaaaagaacctcacccggtggctttaaattcacattctcccactcagccagcgcagctaatggcacaaacagcaaatcagtggtggcccagattccacccgccacttctaatggctcttcctctaagacgacaaacttaccgacctccgtcaccgcaaccaagggcagtcttgtcggactggttgattatccggacgatgaggaagaggacgaggaggaagaaagctctcctaggaaacgaccacggttgggctcctag

SEQ ID NO: 23082 - DNA, 231 bp, Artificial Sequence
  Description of Artificial Sequence: Synthetic coding sequence
atgagcaaggcccacccccccgagctgaagaagttcatggacaagaaactgtctctgaagcttaatggcggtcgtcacgtgcagggcattctccggggattcgacccttttatgaacctcgtcattgacgaatgtgtcgaaatggcaacttccgggcagcaaaataacattggcatggtggtgatccgaggtaattccattataatgttagaagccctagagcgcgtgtag

SEQ ID NO: 23083 - DNA, 528 bp, Artificial Sequence
  Description of Artificial Sequence: Synthetic coding sequence
atgcagctgacccaccagctggacctgttccccgagtgccgggtgaccctgcttctgtttaaagacgttaaaaatgccggcgacttgagaagaaaagcaatggagggaaccatcgacggttccctgattaatcccacggttattgtggaccccttccagattttagtagccgccaataaggctgtacacctttataagctgggtaagatgaaaactcgaaccctgtctacagaaattatattcaacttgtctccgaacaataatatttcagaggccttgaagaaattcggcatctcagccaatgatacgtctatcctgatcgtgtacatagaggagggtgagaagcagattaaccaggagtacctcatctcccaggtggaggggcaccaggttagtctcaaaaacctgcctgagattatgaacatcaccgaagtgaaaaagatttacaaactgtcctcacaggaagagagcattgggaccctacttgacgcaatcatctgtcgtatgagtaccaaagatgtcctttag

SEQ ID NO: 23084 - DNA, 909 bp, Artificial Sequence
  Description of Artificial Sequence: Synthetic coding sequence
atggccctgcacgacatggaggacttcaccttcgacggcaccaagaggttatctgtgaactacgttaaggggattcttcagccaaccgatacttgcgatatctgggataagatatggaacttccaggccaagcccgatgatctgctgattagcacataccccaaggccggaacgacgtggactcaagaaattgtggaactgattcagaacgagggcgatgtggagaaaagcaaacgggccccgacccatcagcgttttccgtttttagaaatgaagatcccttctctagggtcaggactggagcaagcccacgctatgccctctccccgtatactgaaaacccatctaccctttcacttgcttccacccagtctactggagaagaattgtaaaattatctacgttgcccgcaaccccaaggacaacatggtttcatattaccactttcagaggatgaacaaggctcttcccgcccccgggacttgggaagagtacttcgagaccttcttggccggcaaagtctgctggggaagttggcacgaacatgttaagggttggtgggaggccaaggataaacataggatcctgtatttgttctacgaagatatgaagaaaaacccgaagcacgaaatccaaaagctcgcagagttcattgggaagaagctggacgacaaagtcctggataaaattgttcattatacgtcctttgatgtcatgaaacagaacccaatggccaactactcttctattcccgccgagatcatggaccatagtatttcaccgtttatgagaaaaggagccgtgggagactggaaaaagcattttaccgttgcccaaaatgaaagattcgacgaagactacaaaaagaaaatgactgacactagacttacgttccatttccagttttag

SEQ ID NO: 23085 - DNA, 2892 bp, Artificial Sequence
  Description of Artificial Sequence: Synthetic coding sequence
atgtggtgcctgcactgcaacagcgagcggacccagagcctgctggaactggaactggactccggggtcgagggtgaagctccctcatccgaaaccggaacgtccctggactctccttctgcctacccacaggggcccctggtgccaggctccagcctatcaccggaccattatgagcataccagtgttggagcctacggattgtactctggaccacccggtcagcagcaaaggacccgccgacccaagttgcagcactccaccagcattttgcgcaaacaggccgaggaggaggccatcaagaggtcccggagcttgagcgaaagctacgaactgtctagtgatctccaggacaaacaggtcgagatgttagaacggaagtatggggggcgattagtcaccaggcacgctgcacggacaatacagacagcattccgccagtatcagatgaacaagaattttgagcggttaagaagctccatgtctgaaaatcgaatgtcccgccgcatagttctgtctaacatgagaatgcaattctccttcgaaggacccgaaaaagtgcattcctcttactttgaggggaaacaagtgtccgttacgaacgatggtagccaactcggagcgctggtcagtcccgagtgcggggacctttccgagcccacaacattaaaatcacctgccccctcatctgatttcgcggatgcgattactgagctggaggacgccttctcacggcaggtcaaatccttggctgagtcgatcgatgatgctctgaattgccgctctctgcacaccgaagaggcacctgcccttgatgcggctagagccagagacacagagcctcagacagctctgcacggtatggatcaccggaaactcgacgagatgactgcttcgtattcagatgtcacactttatatagacgaagaggagctgtccccaccattgcccttgtcacaggccggggataggccttccagtactgagtcagatctcaggctgcgggcaggcggagcagcgccagactattgggccctggcacacaaggaagataaagcagacaccgatacatcatgcaggtccactccctctctggaacggcaggaacagcggctccgagtcgaacacctacctctgctcacaatagagccaccaagtgattccagtgtcgatttaagtgatcggtccgagcggggcagcctcaaacggcagtccgcctatgaaaggtcattgggagggcaacagggctctcctaagcatgggcctcatagtggggcacctaagagtctgccacgggaggagcccgagcttcggcctagacctccaaggccactggattcacacttggccattaacggcagcgcaaaccgccagtctaaaagcgaatccgactatagtgacggtgacaacgattctatcaattctacttctaattcaaacgacaccatcaattgctcatcagaatcgtcctccagagactccctgagagagcagacgcttagcaagcagacataccacaaggaggctcgtaactcttgggactcccctgcgtttagcaatgatgtcattcgaaaacgccactaccggattgggctaaatctgttcaataagaaaccagagaaaggcgtccagtatctgatcgaacgagggtttgtgcccgacacacctgtcggcgtggcccactttttgttgcagcgaaagggcctcagcagacagatgatcggcgagttcctggggaacaggcaaaaacagttcaaccgcgacgtcctcgattgcgttgttgacgaaatggactttagtacgatggaattggacgaggctctgcggaaattccaggcccacattagagtccaaggcgaggcgcagaaggttgagcggttgatcgaagccttctcccaaaggtactgcatttgcaatccaggggtcgtgcggcagttcaggaatccggacaccattttcatcttggccttcgccataattttgctcaacacagatatgtatagccctaacgttaagccagaacgtaagatgaagttagaggactttataaagaacttgcgtggggtcgacgacggcgaggatattccgcgcgaaatgctgatgggcatatacgagaggatcagaaagcgggaactgaaaacaaatgaagaccacgtttcccaagtccagaaagtggaaaaattgatcgtcggtaagaaacccatcgggtccctgcatcccggtttggggtgtgttctgagcctgcctcaccgaaggcttgtctgttactgtaggttgttcgaagtccccgatccaaacaagcctcaaaaactgggcttgcaccagcgtgagatttttctattcaacgacctgctagtggtcaccaaaatttttcagaagaagaaaaatagcgtaacttacagtttccggcagtccttctctctgtacgggatgcaggtgctgctctttgagaatcaatattatcctaatggaatcaggctgacttcctccgtgccgggcgccgatattaaggtgctcatcaactttaatgcccccaacccacaggaccggaagaaatttacagatgacctacgcgagtctatcgccgaggtgcaggagatggagaagcatcgcatagaatcagagctcgagaagcagaaaggtgtggtgaggccttcaatgagtcagtgttcttcacttaagaaagagtccgggaacggcaccctgtcacgggcttgtctcgatgactcatatgctagcggagagggcctgaagagatctgctctatcatcatccctacgggacctctccgaagcgggcaagcgcggacgacgatcatccgctggaagccttgaaagcaatgtcgaattccagccttttgaaccactgcaaccaagcgtgctatgcagttag

SEQ ID NO: 23086 - DNA, 711 bp, Artificial Sequence
  Description of Artificial Sequence: Synthetic coding sequence
atggccagcctggaccgggtgaaggtgctggtgctgggcgacagcggagtcggcaaaagtagtttggtgcacctgctgtgtcagaaccaagtgctcggaaatccatcttggactgtggggtgcagtgtcgatgtgcgggtccatgattataaagaaggcacccctgaggagaagacctactatattgagctgtgggatgttggcggctctgtcggatcggcgtcttcggtgaagagtaccagggcagttttttacaactccgttaatggtattatctttgttcatgatctgactaacaagaagtcctcccaaaatttacgacgatggagccttgaggcgctgaaccgcgatctcgtccctacaggcgtgttagtgaccaatggcgattatgaccaggagcagttcgctgataaccagatccccttgttggtcattggaaccaagctcgaccagatccatgaaacgaaacggcatgaggtcctgacaaggaccgccttcctcgccgaggacttcaaccctgaggagatcaatctagattgcaccaacccgagatatcttgctgctggtagcagcaatgcagtgaagctctcgagattctttgataaggtgatcgaaaagcgctacttccttagagaaggcaatcagatccctggcttcccggaccgcaagcgctttggggctggcacgctgaaatctttgcattacgattag

SEQ ID NO: 23087 - DNA, 2784 bp, Artificial Sequence
  Description of Artificial Sequence: Synthetic coding sequence
atgcagagcatcctgtaccacggcctgatccgggaccaggcctgccgcaggcagaccgactactggcagttcgttaaagacatcaggtggttatccccccacagcgcccttcatgtggagaagtttatatccgtccacgagaacgatcagtctagcgccgacggagcatccgagcgtgccgtagccgagctttggctgcaacactcgctgcagtatcattgcctgagtgctcagctcaggcctctgcttggggaccgccaatacattagaaaattctacaccgatgcagcgtttctgttatcagatgctcacgttaccgcaatgcttcaatgtctggaagccgtggaacagaataatccccgcctcctggcgcagatcgatgccagcatgtttgcacggaagcacgaatcccccttgttagttacgaaatctcagagcctcaccgcgctgccttcctctacatacactcctccaaatagctatgcccaacattcttattttggctcgttcagttctctgcatcaaagcgtgcctaataatggatctgaacgtaggagtacatcttttcccctgagcggtcctcctcgaaagcctcaggaaagtcgcggccacgtcagtcccgcagaggatcagacgattcaggcccctcccgtttctgtgagcgctctggcccgtgacagccctctcacgcccaacgaaatgtcttcctccaccctgacctcccctatcgaggcaagttgggtcagctcccaaaatgactccccgggagacgccagcgagggccccgagtacctcgccatcgggaacctggatcctagagggcgaaccgcaagctgtcagagccatagctccaatgcagaaagttcctctagcaatctgttcagctctagtagctcccagaagccagactctgccgcctccagtctgggggatcaggaaggcggaggcgaatctcagctgagttctgttctccgaagatcgtccttctcagaagggcagaccctgactgtaacctcaggagccaagaaatcacatatcaggagccattccgacactagcatagccagccgaggtgcacccggcggaccaaggaacataacaatcattgtggaggacccgatcgccgaatcctgcaacgacaaggccaaattgagaggcccgcttccttattcaggccagtcatcagaagtgagtactcctagcagtctgtatatggagtacgagggagggcgttacttgtgttctggcgagggaatgtttaggcgcccctcggaaggacagagtctgatatcctatctgtctgaacaggactttggcagctgcgcggatctggaaaaggagaatgcacacttcagtatctccgaaagccttatcgccgcgatcgagctaatgaaatgtaacatgatgagtcaatgtcttgaagaggaagaggtagaggaggaggactccgaccgcgagatacaagagctcaagcagaaaattcgactaagacgccaacagatcaggactaaaaacttactccccatgtaccaggaagccgaacacggatccttcagagtcacatctagtagtagccagttctcctcccgcgactcagcccagctttcagacagtggaagcgccgatgaggttgatgagtttgagatccaagatgctgacataagaaggaataccgcttcttcgtctaagtcttttgttagttcccagtctttctcgcattgcttcctgcacagtaccagcgccgaggccgttgctatggggctgctgaaacagtttgaggggatgcaactgcctgccgccagcgaactcgagtggctggtccctgaacatgacgccccacagaagctgttgccgatccccgactcactgccgatatcacccgacgacggacaacacgctgatatatacaagctgcgaatcagagttaggggcaatcttgaatgggcacctcctaggccgcagattatattcaacgtgcatcccgcccccactagaaaaatagccgtcgctaagcagaactaccgatgcgcaggttgcggaatccggactgatcccgattatattaagaggttaagatattgtgagtacctggggaaatatttctgtcagtgctgccatgaaaatgcccagatggctattccatcaagagtgctccggaagtgggacttctctaaatattatgtgtcaaatttcagtaaagacctcctgattaagatatggaacgacccattgttcaatgtgcaagatataaatagcgccttatataggaaggtcaaactcctcaatcaggtgcggctcttacgcgtgcagctctgccatatgaagaatatgtttaagacatgcaggctcgcaaaggagctgctggactcgttcgacaccgtcccaggccatcttaccgaggatctccacctatattcactgaacgacctaactgcaacaaggaaaggagagctgggaccccgccttgccgaactaactagagctggagccactcatgtggagcgatgtatgttgtgtcaagcaaagggtttcatttgcgaattttgtcagaacgaagacgatattattttcccatttgagctccataagtgcaggacatgcgaagagtgtaaagcttgctaccataaggcgtgttttaagagtgggtcctgtcctagatgtgagcggctgcaggctaggcgggaggccttagccaggcagtctctcgagagttacctgtccgattatgaggaggagcccgcggaggcactcgcactcgaggctgcagtgttggaggccacctag

SEQ ID NO: 23088 - DNA, 300 bp, Artificial Sequence
  Description of Artificial Sequence: Synthetic coding sequence
atggccagcgccagcgcccggggcaaccaggacaaggacgcccactttcctcccccaagtaagcagtcactcttattctgccctaaatcgaagttgcacattcaccgcgccgagatctccaagatcatgcgagaatgtcaagaagagtccttttggaagcgtgctttaccatttagcctggtttccatgctggttacccagggcttagtctatcaagggtatctggctgcaaattcgaggttcggctcattgccaaaagttgctcggacagcgtccctgccagtaaggaacgcaaagtag

SEQ ID NO: 23089 - DNA, 786 bp, Artificial Sequence
  Description of Artificial Sequence: Synthetic coding sequence
atggtggtgctgagcgtgcccgccgaggtgaccgtgatcctgctggacatcgaagggaccactacgcctatcgccttcgtgaaagacattttgttcccctacatcgaagagaatgtgaaagagtacctccagactcactgggaggaagaggaatgtcagcaagacgtcagcttactgcgcaaacaagccgaagaggatgcccacttggacggtgctgtgcccatccccgccgcatctggaaatggagtggatgaccttcaacaaatgatccaggcggtagtggacaatgtgtgttggcagatgtccctcgaccgtaagaccaccgccctgaagcaactgcaggggcatatgtggcgggcggcctttactgcagggagaatgaaggcagagttctttgccgacgtcgttcccgccgttcgtaagtggcgtgaagccggtatgaaagtctacatctatagcagtggttctgtagaggcacagaaacttctattcggacacagtacggaaggagatatcctcgagctagtcgacgggcatttcgataccaagattgggcataaggttgagtcagagtcataccggaagatagccgatagcataggctgtagtactaataacatactctttctgaccgacgtcaccagggaggctagcgcagccgaggaggccgacgtgcacgtggcagttgttgtgagacctgggaatgctggcctgactgatgatgagaagacatactattcccttataactagctttagcgaactgtaccttccatctagcacctag

SEQ ID NO: 23090 - DNA, 1188 bp, Artificial Sequence
  Description of Artificial Sequence: Synthetic coding sequence
atggccgaggacggcctgcccaagatctacagccacccccccaccgaatctagcaaaacacctaccgctgctaccatttttttcggcgccgataatgccatccctaaatctgagactaccatcactagcgagggcgaccacgtgacgtctgtcaacgagtacatgttagaatctgattttagcacaacaacagataataaactaacggccaaaaaggaaaagcttaagtccgaggatgacatggggaccgacttcatcaaaagcaccactcatctccagaaagaaatcacctctctgaccgggaccacaaactccatcacaagggattctataacggagcacttcatgcccgtgaagatcgggaacatttctagtcctgtcaccactgtgtctctgatcgacttttccacagatatcgccaaggaagatatcctcttagccaccattgacactggtgacgccgagataagcatcacgagtgaggtgtcaggcactctgaaagatagctcagctggggtcgccgatgcccctgctttccccagaaaaaaggacgaggctgacatgagcaactataattcttcaatcaaaagtaatgtcccagctgatgaagccgtccaagtgaccgattcaacgattcccgaggccgagatcccgcctgcgccagaggagagttttaccactatcccagacattactgcattagaggaagaaaagatcactgagatagatttgtctgtgctggaggatgacacaagtgcagtggcaactttgacagatagtgacgagaagtttattaccgtgttcgagctcacaacatccgctgaaaaagacaaagacaagagggaggacacactgctgactgatgaagaaactactgagggcgcctcaatctggatggaaagagatacagccaatgaagccgagactcactctgtcctgctcaccgctgtggagtctagatacgatttcgttgttccagctagcatcgccaccaacttagtcgaagagagttctacggaggaggacctgtcagagaccgacaatacggagaccgtgcctaaaataaccgaacccttttctggaacgactagcgtgctggatactccagattataaagaagatacctccactacagagaccgatatattcgagctcctcaaagaggagccagatgaattcatgatttag

SEQ ID NO: 23091 - DNA, 921 bp, Artificial Sequence
  Description of Artificial Sequence: Synthetic coding sequence
atgtacttctgctggggcgccgacagccgggagctgcagcggcggcggacggccggttcacctggagctgagctgctgcaggctgcctcaggtgagcgacattcactgctgttactgactaatcaccgcgtgctgagctgtggcgataattccagagggcagttaggtcgcagaggcgctcagcgcggagaattgcccgaacctatccaggccctggagaccttgatagtagatcttgtctcgtgcggcaaggaacactctttggcagtgtgccataagggcagagttttcgcctggggcgccgggtctgagggacagttgggcatcggagagttcaaagaaatctcttttacccctaagaagatcatgacactcaatgatatcaagatcatccaggtgtcttgcgggcattatcactccttggctctgagtaaagattcccaagtcttctcctggggtaagaactcacacggtcagttaggattgggaaaagagttcccctctcaggcctctccacagcgtgtaagaagcttggaaggcatcccactcgcccaggtagctgctgggggagcccacagttttgcgctgtcactgtgcggcactagctttggatggggcagtaactctgcagggcagcttgccctcagcggccgcaacgtgcccgtccagtccaacaagccactgagcgttggggccttgaagaatctgggagtggtttatatctcttgcggagatgcccacaccgccgtgctcactcaggatggaaaagtctttacgtttggcgacaaccggtccgggcaactggggtactcaccaacacccgagaagagaggaccacagttggtggaaagaattgacggccttgtaagccagatagactgcggacgtaactcaaagcacgggttcatgacattcttctag

SEQ ID NO: 23092 - DNA, 909 bp, Artificial Sequence
  Description of Artificial Sequence: Synthetic coding sequence
atgggcaactgctgctggacccagtgcttcggcctgctgcggaaggaggctggtcggctacagagggtggggggggggggagggtccaaatatttccgcacatgttcccgcggagagcatttgactatcgagttcgaaaacctggtggaatctgacgagggcgagtcacctgggtcttctcatcgtccactgacagaggaagagattgtggatctgcgggaacggcattatgacagtatcgcagagaaacagaaggatttggataagaagatccaaaaggagcttgcccttcaggaagagaaactgagactggaagaagaggctctctacgcagcgcagcgagaggcggcaagagccgctaaacagaggaagctgcttgagcaggaaagacagagaattgtccagcagtaccaccccagtaacaatggcgaatatcaatcctcgggccctgaagacgacttcgagtcctgcttacgtaacatgaagagtcaatacgaagtgtttcgaagcagccggttgagctctgacgccactgtgttgaccccaaacacagagtcctcttgcgatctgatgaccaaaaccaagagtacctctgggaatgacgatagcacatccttagatctggagtgggaagacgaggagggtatgaatcggatgcttcccatgcgagagaggtctaaaacggaagaggatatcctccgtgctgcactcaagtactcaaataaaaaaaccggatctaatccaacttccgccagcgacgacagcaacgggctcgagtgggagaacgattttgttagtgccgagatggacgacaacgggaacagtgagtattccggctttgttaatcccgtgctggaactgagtgactctggcattagacactcggataccgaccagcagacacggtag

SEQ ID NO: 23093 - DNA, 1641 bp, Artificial Sequence
  Description of Artificial Sequence: Synthetic coding sequence
atggccaccctggtggtgaacaagctgggcgccggcgtggacagcggccgccagggaagtaggggcacagcagtggtaaaggtgctggaatgcggggtgtgtgaagatgtgttttcgctgcagggcgacaaagtgccgcggttactcctatgtggccacacagtgtgccacgattgtctcacgagactcccactgcacgggagagcaatccggtgcccctttgatcggcaggtcactgatttgggggatagcggagtttgggggctcaaaaaaaactttgccctcctcgagcttcttgagcgcttgcagaacggcccaataggccagtatggggcggccgaggagtccatcggaatctcaggagagtccattatccgatgtgacgaggatgaggcccatcttgccagcgtttactgtactgtgtgcgctacacacctgtgtagtgaatgtagtcaagtcacccatagtaccaaaactctggccaagcacaggagggttcctcttgccgataagcctcacgaaaaaactatgtgcagccagcatcaggtacatgccatagagttcgtctgccttgaggaaggctgtcagacttcgcccctcatgtgttgtgtgtgtaaagagtacggcaagcaccagggccacaaacacagtgttttggaacccgaagcaaaccaaattagggctagcatcctggatatggcacattgtatcagaacattcacagaggagatctcagactatagtcgcaagcttgtgggaatcgtccagcacattgagggtggtgagcagattgtcgaagatgggatcggcatggcacacactgagcacgttccgggtacagctgaaaatgccagatcttgcataagagcttacttttatgacctgcatgaaaccctatgcaggcaggaggagatggcactatccgttgtggatgctcacgtccgggagaagttgatctggctccggcagcagcaggaggacatgacaatcctgttatctgaagtgtccgccgcttgtctgcattgtgagaagactctgcagcaggacgactgtcgcgtggtgctagccaaacaagaaataacaaggctgctagaaacactgcagaaacagcagcagcagttcaccgaagtcgccgatcatatacagctggatgcttcgatcccagtcactttcacgaaagataacagggtccacattggcccaaaaatggagatacgtgtcgtgacactcggactggatggtgcaggcaaaaccaccattctgtttaaactgaaacaggatgaatttatgcagccaattccaacaattgggttcaatgtggaaactgtcgaatacaagaatttaaagttcacaatctgggatgtcgggggtaagcataagctgcggccactgtggaaacactactatctgaatacacaggcagttgtgttcgtggtcgactcttctcaccgtgaccgcatctcagaggcccattctgagctggcaaagctccttacagaaaaagagttaagagatgctctgcttttaattttcgccaataagcaagacgtggctggagccctgagcgtggaagaaattacagagctgttgagcctgcacaagctctgttgtgggagaagttgcttttccgacaatatgtag

SEQ ID NO: 23094 - DNA, 609 bp, Artificial Sequence
  Description of Artificial Sequence: Synthetic coding sequence
atggccgtgcccgccgccctgatcctgcgggagagccccagcatgaagaaggccgtaagtctgatcaacgccattgatacaggacgcttccctcggcttctgacaagaattctccagaaactccatctgaaagcagagagctcattttccgaggaggaagaagagaaactccaggcagccttctctctggagaagcaggacttacatcttgtccttgagaccatttctttcatcttggagcaggctgtgtaccacaatgtgaaaccggcagccctccagcagcaactcgagaatattcaccttcggcaagataaggcagaagcttttgtgaacacctggagctcaatgggacaggaaacagtggaaaagtttaggcagagaatccttgccccctgcaagcttgaaacggtgggttggcagctgaatttgcagatggcccatagtgctcaggccaaactgaagtcgcctcaggcagtactccaacttggcgtgaacaatgaagactccaaatccctggagaaggttctagtcgagtttagtcataaagagctgtttgacttttataataaactcgagacaattcaggcacagctggatagtctcacatag

SEQ ID NO: 23095 - DNA, 1521 bp, Artificial Sequence
  Description of Artificial Sequence: Synthetic coding sequence
atggaggccgacatcatcaccaacctgcggtgccggctgaaggaggccgaagaggagcgtctgaaggccgcacagtacggacttcaactggtggaaagccaaaatgaattgcagaatcaacttgataagtgtcgaaacgagatgatgactatgaccgaaagctacgagcaggagaagtatactcttcaaagggaggtggaactcaaatcccgcatgctggaatctttgtcatgtgagtgtgaggctatcaaacaacagcagaaaatgcatctcgaaaaacttgaggagcagctatcccgcagccacggccaagaggtgaacgaactgaaaaccaagatcgaaaagctaaaggtggaattggatgaggccaggctgtcagagaaacaacttaagcaccaggtggatcaccagaaggaactgctgagctgtaaatctgaggaattgagagtcatgtccgaacgagtccaagaatctatgtcatctgaaatgctcgccttgcagatcgaactgactgagatggagtcgatgaaggtgaagtaccagagtctcaagaagcagaatgtttttaatcgagaacagatgcaaaggatgaaattacagatcgccaccctcctgcaaatgaaggggtctcagacagagttcgaacagcaggaacgtctgctggcgatgctggaacagaagaatggtgagatcaagcacctcttgggggagatcagaaatctcgaaaaattcaaaaacctttacgatagtatggagtcaaaacctagcgttgatagcgggaccctggaagacaacacatactatacggacttgctgcagatgaaactggacaatttgaataaggaaatcgaaagtaccaaaggtgagctgtcgatccagcggatgaaagctctattcgaatctcagagagcactggatatagagagaaagttattcgccaacgagcggtgcctgcagctctctgagtcagaaaacatgaagctgcgagccaaattagatgagttgaagctgaagtacgaaccggaggaaactgtggaagtaccggtgcttaaaaaaagacgggaggtattgcctgtcgatataacaacagctaaggatgcgtgtgtcaataactcagctctcggcggtgaagtctatagacttccacctcaaaaggaagaaacacagagctgccctaattcactcgaggataacaatctgcagctggagaagagcgtcagtatttatacaccagtcgtgtccctttcaccccacaagaatcttccggttgacatgcagctgaagaaagagaagaagtgtgttaaactcattggcgtccctgccgatgcagaggctctctccgagaggtctggcaatacaccaaactcaccgagacttgccgccgagagcaaattgcagactgaagtgaaagagggcaaggagacatcgagtaaactggagaaggaaacatgcaaaaagctccatcctattctttatgttagtagcaagagtacccctgagacccagtgcccacagcagtag

SEQ ID NO: 23096 - DNA, 1842 bp, Artificial Sequence
  Description of Artificial Sequence: Synthetic coding sequence
atggccaccatccccgactggaagctgcagctgctggcccggcggaggcaggaggaagcatccgtgcgggggcgagaaaaggccgagcgagaacgcctaagccaaatgcccgcttggaaacgggggctcctcgaacgccgaagagcaaaactgggcctgagccccggggagccctcccctgtgcttgggacagtggaggcaggtccccctgatccagatgaaagcgctgtgttgctggaagcaattgggcctgttcaccagaacagatttatcagacaggagagacagcaacaacagcagcagcaacagcgctcagaggagttattggctgaacggaagccgggaccgctggaggctagggaaagaaggccttcgcccggcgagatgcgggatcagtcccccaaaggccgcgagtcaagagaggagcgattatctccgagggaaactcgcgagaggcgcttgggtattggtggtgcacaggagctgagtttacgcccacttgaagctcgcgactggaggcagtcacccggcgaagtgggagacaggagcagcagactttcagaagcgtggaagtggaggctcagccccggagaaactcccgaaaggagccttcgtctggcggaatcacgagaacagagcccgaggaggaaggaggtagaaagccgcctcagtccgggagaaagtgcctatcagaagctgggacttactgaggcgcacaaatggcgtcccgactcccgtgagagccaggagcagtcactggttcagttagaagctaccgagtggcggttgcgatcaggcgaagagaggcaggactattccgaagagtgtggtaggaaggaggaatggccggtaccaggggtggctccaaaggaaacagctgaactcagtgaaacccttaccagagaagcacagggaaattcttcagctggcgtagaggcggccgaacagagacctgtggaagacggagagcgggggatgaagcctactgagggttggaagtggacgctaaactctggcaaggcccgagagtggacaccgagggacatagaggcccagacacaaaagcccgagccccctgagtcagcagagaagctattggaatctcccggggttgaggcgggcgagggtgaggcagaaaaggaagaggctggggcccagggccgcccactgagggcccttcagaattgctgtagcgttccaagtccattgccccccgaggacgctggaacgggggggctcagacagcaggaagaagaagcggtggagctccagcccccgccaccagcgcccttaagcccacccccgcctgctcctaccgcccctcagcctcccggcgatccccttatgtcacggctgttttacggcgttaaagccggccctggtgttggggccccaaggcgtagtggacataccttcactgtgaacccacgacgatctgtgccgcccgcgacaccggcaacccccactagccctgccaccgtggatgcagcagtgcctggggccggtaagaaacgataccccactgctgaggaaatcctggtactgggcgggtacttgagattgagtagatcctgcctcgccaagggctccccggagcggcaccacaagcagctgaaaatctccttctccgagacggcgttagagacaacttatcagtacccgtctgagtcgagcgttctggaagaactgggcccagagccagaggtacccagcgctccaaacccacccgccgcacaaccagatgatgaagaggacgaagaggaattactgctgctgcaacccgaattacagggcggactgagaactaaggctctcatcgtagatgaatcttgcagacgttag

SEQ ID NO: 23097 - DNA, 654 bp, Artificial Sequence
  Description of Artificial Sequence: Synthetic coding sequence
atgagctggacctgcccccggtgccagcagcccgtgttcttcgccgagaaagtttcatcattgggaaaaaattggcacagattttgtcttaagtgtgagagatgtcattcaattttgagtccgggcgggcacgcagaacataatgggaggccttactgccataagccatgctacggggcactcttcggtccccggggcgttaacatcgggggggtaggatcttacctctacaatcccccgaccccctcacctggctgtaccacgcccctttcaccctcctctttctctcctccgaggcctcggacagggctccctcagggaaagaagagcccacctcatatgaaaacttttaccggcgaaacgagtctctgccctggatgcggtgaacccgtctatttcgcagagaaggtgatgagcctcgggaggaattggcatcggccctgtctaagatgccagcggtgtcataaaacattaacagcagggagtcatgccgagcacgatggggttccatattgccatgttccgtgctatggctatcttttcggcccaaaaggaggacaaccccatcctaggcactgggacgggatgtacatgcctgaggtgtggcatgtgcacggcctatgggtgtgtgtggacaatttcccatgcgggtag

SEQ ID NO: 23098 - DNA, 1503 bp, Artificial Sequence
  Description of Artificial Sequence: Synthetic coding sequence
atgaaccagcggcggagcgagagccggcccggcaaccaccggctgcaggcatacgctgagccagggaaaggcgattctggcggcgccgggcctctcagtggatccgcccggcggggccggggcggagggggagcgatccgcgtgcggcgtccttgctggtcagggggggcaggccgcgggggaggccccgcctgggctgtgcgtctgccgacggtcacagccgggtggacctggccagcactgaggacattgtcttctctgagagctgggccttccgaacctcacagtcctggcaggaggccacctcgggctgggagacccttatgccaggcagatccccagcccggtaaggcagctagaagatctctcgagccggacccggcacagacaggtccccggcccgcgcgcgccgccggtatgagtgaggcacggaaggggccagacgaagctgaagagtcacaatacgactcaggcattgaaagcctccgatctttaagatctcttccagagtctactagcgctccggcttcaggtcccagcgacggaagccctcagccatgcacacatccccccggccctgtaaaagagccacaagaaaaagaagacgcagacggagagcgggcggactcaacatatggcagctcttccttaacttacacactgtccttgctaggtggtccggaggcagaagacccagcacctcgactgcctttgccacacgtgggcgccttgagtcctcagcagctggaagctctgacatatatctcagaggatggtgataccctcgtacatcttgccgtgattcacgaggcaccagccgtcctgttgtgctgtttggcattgctacctcaggaagttttggatatacagaataatctgtaccaaaccgcactccatctggccgttcacctcgatcagcctggagccgtccgggctctcgtactgaagggagcgagcagagcactccaagaccggcacggggatactgcgttgcatgtggcatgccagcgccaacatctagcatgtgctagatgtcttttagaaggccggcccgagccaggtaggggaacatcacatagcttagatctgcagctccagaattggcagggactcgcttgtctacatatcgctacactacagaaaaaccagcctctcatggaactcctgcttcgcaatggggccgatattgacgtccaagaaggaacgagtgggaaaactgcactccatcttgccgtcgagactcaggaacgcggcctggtacagttcctgctgcaggccggtgctcaggtggacgcaaggatgctcaacggctgcactcctttgcatctggccgccggcaggggtctgatgggcattagttccaccctctgcaaggctggtgctgactcattactaaggaacgttgaggatgagactccacaggacttgaccgaagaatccctggtcttactcccctttgatgatttgaagattagtgggaagctgctgttgtgcaccgattag

SEQ ID NO: 23099 - DNA, 1881 bp, Artificial Sequence
  Description of Artificial Sequence: Synthetic coding sequence
atggagggcccccgggagaaccaggacccccccccccggagcctggctcggcatctctccgacgcggaccgcctgaggaaagtcatccaggaattggtggacacagagaagtcgtatgtgaaagacctcagttgtctttttgaactgtacctggagccactccagaatgagaccttcttgactcaggatgaaatggagagtctttttgggtctctgccagaaatgctcgaattccaaaaagtgttcctagagacacttgaggatgggatctccgcttcatccgatttcaacacacttgagacgcccagccagtttcggaaactcttgttttcccttggagggtcctttctctattatgctgatcattttaagttgtattcaggtttctgcgccaaccatattaaagtgcagaaggtacttgagagagcgaagacagacaaggcgtttaaggcttttctcgacgcccgcaatcccacaaaacagcatagcagcacccttgagtcgtatttgatcaagccggtgcagcgtgttctgaaatatcccctgctgcttaaggagcttgtgtctctaacagaccaggaaagtgaggagcactaccatttaacagaagctttgaaggcaatggaaaaggtggcctctcacattaatgaaatgcagaagatctacgaagattacggtacagtgtttgatcagctcgtggcagaacaatccggcactgagaaggaggtcacggagcttagcatgggggaactgctcatgcatagtaccgtgtcctggctgaacccattcctgtcacttggcaaggcacggaaggatctcgaacttactgtcttcgtatttaaacgggctgtgatattggtgtacaaggaaaattgcaaattgaaaaaaaaactgcccagcaattccaggccagctcacaattctacagatctggacccattcaaattcagatggttgattccaatttcagcgctacaggttcgcctgggcaatcctgccggtacagaaaacaacagtatctgggaattaatccacaccaagtcagagatcgaaggaaggcctgagaccatcttccaattgtgttgcagcgattctgagagcaagaccaacattgtgaaggtgatcaggtccattctgcgcgaaaacttcaggcgacacattaagtgcgagctgcccctcgaaaagacctgcaaggataggttagttcctctgaaaaatagggttccagtttctgctaagctggccagctccagatcactcaaggtgcttaagaactcgtcgagtaatgagtggacaggagaaactggtaaaggcactctcctcgacagcgacgagggctctttgtctagcggcacacagtcgtcaggttgcccaacggccgagggccggcaggattcaaagtccacctctcctggaaagtacccccaccccggactggcagacttcgcagacaacttgatcaaggaatccgacattctttctgatgaggacgatgatcatcgccaaacagtgaaacaaggctcacctaccaaggacattgagatccagttccagcgattaaggatctcggaggatccagatgtgcaccctgaagccgaacagcaacccggtcccgagagcggggaagggcagaagggaggggaacaacccaagctcgtgcgagggcacttctgccctatcaaacgcaaggccaacagtaccaaacgcgacagagggactctcttaaaggcacagattcgacaccaatccttggacagtcaatctgagaatgctaccatcgacctcaattcagtgctcgaacgggagttttcagtgcagagccttacctccgtggtgtccgaagaatgcttctacgagactgagtcccatggtaaatcctag

SEQ ID NO: 23100 - DNA, 1596 bp, Artificial Sequence
  Description of Artificial Sequence: Synthetic coding sequence
atggccgccgtgaagaccctgaaccccaaggccgaggtggcccgggctcaggccgcgctcgccgtcaacataagcgccgcaaggggactgcaagatgtactgcggacaaatctgggccctaaaggaaccatgaagatgttagtgagtggcgcgggcgatataaaactgacaaaagatgggaatgtgctgctccatgagatgcagatccagcaccctacagcctccctgattgccaaagtcgctacagcccaggatgatattacgggcgatggaacgacatccaacgtgctcatcatcggggagctcctcaagcaggccgacctttatatttctgagggactgcaccccagaatcatcacggaaggatttgaagccgccaaagagaaggcgctgcaattcctggaagaagtgaaggtgtctagggagatggatagggaaacgttgattgatgtagcccgcacatcactccgcactaaggtgcatgccgagctggccgacgttctaactgaggccgtcgtggacagcatactggcaatcaagaaacaagatgagcccatcgacttgttcatgattgagatcatggaaatgaaacacaagtctgagaccgataccagcttgattcgcggccttgtcttagaccatggagctcgacacccagatatgaagaagcgcgttgaggatgcgtacatcctgacgtgcaacgtctctctggagtatgaaaaaacagaggtgaatagtggattcttttataagagcgctgaagagcgtgagaaactcgtcaaggctgagagaaagtttatcgaagaccgcgttaaaaagatcatagaattgaagcgaaaagtctgcggggacagtgacaaggggtttgtggttattaatcagaaggggattgacccattttctcttgatgctttgtctaaggagggaattgtggcgctcaggagggccaagaggagaaacatggaacgactaactctagcatgcggaggggtggctctaaacagtttcgacgacctatcaccagattgcctggggcatgcgggactggtgtacgagtacactcttggggaggagaaattcacctttatcgagaagtgcaataacccacgatctgtcactcttttgatcaaagggcccaataagcatacgctgactcagatcaaagatgccgtgagggacggactgcgggccgtcaaaaatgctattgacgatggctgtgtggtgccaggggcgggagctgtcgaagttgcgatggctgaggcgttaatcaagcacaaaccaagcgttaaaggcagggcacagctgggagtccaggcctttgccgacgcgttgctcattatccccaaagtgttagcccagaacagcggctttgatctccaggagacactcgtgaagatccaggccgaacacagtgaaagcgggcagctggtgggggttgatctgaatacgggcgaaccgatggtggccgcagaggtgggcgtttgggataattattgtgtcaagaaacagctattgcactcgtgcactgtgatagctacaaacattttgttggttgacgaaatcatgcgcgcaggcatgtcaagcctcaaaggctag

SEQ ID NO: 23101 - DNA, 666 bp, Artificial Sequence
  Description of Artificial Sequence: Synthetic coding sequence
atgagcgccttcggccacgacgaggcctggatggaggccggcggctttggactagaggccgccgagcggactgaataccagtctctctgtaagtcgaagctcctttttctgggagagcaaagtggtaaaacttccatcatctcccgctttatgtataactcattcggatgcgcctgtcaagcgacagtcggaatagactttctctcaaaaactatgtacttggaggaccagattgtgcaattgcagctgtgggacacagctgggcaggaacgctttcactcgctgataccctcttatataagggacagcacaattgccgtcgtcgtttacgacatcactaacatcaactcatttaaggagacagataagtgggtcgagcatgtgcgggccgaacggggagatgatgttgttatcatgttactcgggaacaagattgacctggataacaagagacaggtgactgccgagcagggagaagagaagtctaggaatctcaatgtgatgttcatagagacctctgcaaaaaccggatacaatgttaaaaaactgtttaggcgggttgcaagtgccttgctgtccactcgaacttcaccaccccctaaagaagggacggtggaaattgagctagagtccttcgaagaatcagggaaccggtcctactgttag

SEQ ID NO: 23102 - DNA, 6222 bp, Artificial Sequence
  Description of Artificial Sequence: Synthetic coding sequence
atggccgaggtgcggaagttcaccaagcggctgagcaagcccggcaccgccgcagagttgcgacagtcagtgtctgaggccgtgcggggtagcgtagtcttggagaaagctaaagtggtagagcccctggattacgaaaatgtaatcgcccagaggaagactcagatctatagcgatcccctgagagacttgttgatgttccctatggaagatatttcaatcagcgttatcggtcgacagagacgcactgtacagtcgacggtgccagaggacgcagagaaacgcgcacagagcctcttcgtgaaggagtgcataaagacctactcaaccgattggcatgtcgtcaattataaatatgaggatttcagcggtgactttcgcatgcttccttgcaagagccttaggccggagaagatccctaaccatgtctttgaaattgatgaggactgcgagaaggacgaggacagcagctcattgtgctcccagaaggggggggtcattaagcagggctggctgcacaaagccaatgtgaactcaacaattacagtgacaatgaaggtgtttaagagacggtacttttatctcacccagctccccgacgggtcatatatcttgaattcatataaagacgaaaagaatagcaaggagagcaaaggttgcatttatctggatgcctgcatcgatgtggtgcagtgccccaagatgcgccggcacgcttttgagctaaaaatgcttgacaaatattcccactatctcgcggccgagactgaacaggagatggaagaatggctgattaccctcaaaaaaattatccagattaacaccgacagtctggtgcaggagaaaaaggagacagtcgagactgctcaggacgacgaaacttcaagccagggaaaggccgagaacatcatggccagcttggagcggagcatgcacccagaactcatgaagtacggccgggagactgaacagctgaataagttatcacggggtgacggtcgacagaatctatttagcttcgattccgaggtgcaacgccttgatttcagcggaattgagcccgatatcaagccattcgaagagaagtgcaacaagagatttctggttaattgtcatgatttgaccttcaatattctgggccagattggagataatgcaaaagggccacccaccaatgtcgaaccattttttatcaatctggccttgtttgacgtgaaaaacaactgtaaaatcagtgcagattttcacgttgatcttaatcctccaagtgtgcgtgaaatgctgtggggctctagcacccagctcgcctctgacggctctcctaagggaagcagccccgagagctacattcatgggattgctgagagtcagctgcggtacattcagcagggtatctttagcgtgaccaacccgcaccctgagatcttcctggttgcgagaatcgaaaaggtcctgcagggaaatattacccattgtgctgagccgtacattaagaactccgatcctgtgaagaccgctcagaaagtgcaccgaacagcgaagcaagtttgttcccggctcggccaatacaggatgcctttcgcgtgggccgcgcgacctatcttcaaggacactcagggatcactcgacttggacgggcgtttttccccactctacaagcaggattcgtcaaaactttcctctgaagatatcctgaagctactgagtgagtataaaaaaccggagaagacaaagctccaaatcattcctggtcagctcaacattactgtggagtgcgttcccgtagatttgtccaactgcatcacctcttcctacgtacctctcaagcccttcgagaaaaactgccagaacattacagttgaggtggaagaatttgtgcctgaaatgacaaaatactgttatcccttcaccatttacaagaaccacctgtacgtgtaccccttgcagctgaagtacgacagccagaaaacctttgctaaggccagaaatatcgcagtgtgcgtggagtttcgagacagcgacgaatcagatgcatccgccctcaaatgtatctacggcaaacctgccgggtcagttttcacaaccaacgcctacgcggttgtcagtcatcataaccagaatccggaattctatgacgagatcaagatagagctgcctatccatctccaccagaaacatcatttgctgtttaccttttaccacgtctcctgtgaaataaacactaaagggaccaccaagaaacaggataccgtggagaccccagttgggtttgcatgggtgccattattaaaggatgggcgaatcattacctttgaacagcaactgcccgtgtccgccaacctgcccccagggtacctgaacctgaacgatgcagaaagccgacgtcagtgcaacgttgacattaagtgggtggatggggccaaaccattgttaaagatcaagtcccacctggagtcaaccatttacacacaagatcttcacgttcacaagttctttcatcactgtcagctaattcaatccggaagcaaagaggtacccggggaactgattaaatacctcaagtgcctccatgcaatggagattcaggtgatgatccaatttctgccagtgatcttgatgcagctgtttcgcgtgctgacaaacatgacacatgaggacgatgtccctattaactgtacgatggtactacttcacatagtatctaaatgccatgaggaaggtcttgactcctacctgagatccttcataaaatattccttcagaccagaaaaaccttcggctcctcaagcacagctcatccacgagacccttgctaccactatgatcgctatacttaaacagtcagcagattttctcagcattaacaagcttcttaaatactcctggtttttctttgagattattgccaagtcaatggcaacttatctcctggaagaaaacaagatcaagttgccacgtggtcagcggtttccagagacatatcatcatgtcctgcactctcttctgctggcgatcatccctcacgtcactatcaggtatgctgaaatccctgatgagtctcggaacgtcaattattccctggctagttttctcaagcggtgtctgacgctcatggatcgaggcttcatttttaacctcatcaatgactatatcagcggttttagcccaaaagacccgaaagtattggctgagtacaagtttgagtttctgcagaccatttgtaaccacgagcattacattcctctaaatttacccatggcatttgccaagccaaagctacaaagggtgcaggacagtaatctggagtactcactgtcagacgagtactgcaaacaccattttctggtcggattacttttgcgggagacatcaattgctctgcaggacaactatgagattagatacacagctatcagtgtgattaaaaacttgctgatcaagcacgcattcgacacgcgataccaacacaagaatcagcaggcaaagatcgcccagttatatcttccttttgtgggcctactgctagagaatatccagagactggcgggtcgcgataccctttactcctgtgccgccatgcctaacagcgcgtctagagacgagttcccatgtgggttcacttcaccagcaaatcgaggttccctctcgaccgacaaggacacggcctacggtagttttcagaacggccacggaatcaaaagagaggatagcagagggtcactgattcccgagggtgccactggatttcccgaccaggggaacacaggcgaaaacacccgacagtccagcacacggtcttccgtatcgcagtacaaccgcctggatcagtacgagattcgaagtcttctgatgtgctacttgtacatcgtcaaaatgattagcgaggacaccctgcttacatactggaacaaggtctcccctcaggagctgatcaatatcctgatcttgctggaagtttgcttgtttcatttcagatacatgggcaagcggaacattgcccgggtccacgacgcctggttaagcaaacattttggaatcgatcgcaaatcacagacaatgccggccttaaggaaccggagtggcgttatgcaagccaggctgcagcacttgtcatcattggaatcttctttcacgctcaatcacagctctaccacaaccgaggctgacatttttcaccaggccttattggagggcaataccgctaccgaagtttccttgaccgtgctagacaccatttcgttctttacccagtgcttcaagactcagctgctgaataatgacggacacaatccattgatgaagaaagtgtttgatattcacttggcctttctgaaaaacggccagagcgaagtgtctctcaaacacgtcttcgcaagtttgcgagcctttatttctaaattcccttctgccttctttaaaggtagggtgaacatgtgcgcagctttctgttatgaggttctgaagtgctgtacctcaaaaatctctagtacaagaaacgaggccagcgctctgctctacctcctgatgaggaataacttcgagtatacaaaaagaaagaccttcttacgcacccacttgcagatcattatcgcagtgagccagctcattgccgacgtggccctgtcaggtgggtcccgattccaggaaagcttatttattattaataatttcgctaatagcgacaggcctatgaaggctaccgcttttccagccgaggtgaaagacctcacaaaacggattaggaccgtgcttatggccactgcccaaatgaaggagcatgagaaagacccggaaatgctgatcgatctccaatattctctggctaaatcatacgccagcactcccgaattacgtaagacatggctcgattcaatggcgaaaatccacgtgaaaaatggagacttctccgaggctgccatgtgttacgtgcatgtggccgccctagtcgctgagttcctccaccggaagaagttgttccctaatggctgcagcgcattcaagaagatcactcccaacatcgatgaggagggagcaatgaaagaagatgctggcatgatggacgtgcactattcagaggaagtgctcctggaactgctggagcaatgtgtggatggtctttggaaggctgagaggtacgagatcattagtgagattagtaaacttatcgtgccaatctacgaaaaaagaagagagttcgagaagttaacacaggtctatcgtacgctgcacggcgcttataccaagattcttgaagtcatgcatactaagaaacgactccttggcacatttttccgcgttgctttctacggccagtccttttttgaggaagaggacggcaaagaatacatatataaggaacctaagctgacgggcctgtcagagatctccctgcgcctggtaaagctgtacggcgaaaaatttggtactgaaaatgtcaaaatcattcaggacagcgataaggttaacgcaaaagagctggaccctaaatatgcccacatccaggtaacctacgtgaaaccctatttcgatgacaaggagctgactgagcgaaagacagagtttgagaggaaccacaatatttcccgatttgtttttgaggcgccctacaccctgagtggcaagaagcagggttgcatagaagaacaatgcaagcgtcgaacaattctgactacgagtaattcattcccttacgtgaagaaacggatcccaattaattgtgagcagcagattaacctcaagcctattgacgttgctacggatgaaattaaggataagaccgcagaactccaaaagctctgcagttcaacggacgtcgacatgatccaattacagctgaagctccaagggtgtgtgagtgtgcaagttaacgctggacccctggcttatgccagagcctttctgaacgacagccaggccagcaaatatccacctaaaaaagtttctgaactgaaggacatgttccgcaaatttattcaagcctgctctatcgctctggagttaaacgaacgccttataaaagaggaccaggtggagtatcacgaaggactgaagagcaacttcagagacatggttaaggagcttagcgatatcatccacgaacagatccttcaggaggataccatgcacagtccctggatgtcgaacactttgcacgtcttttgcgcaatcagtgggactagcagcgatcggggatatggatccccaaggtatgccgaggtctag

SEQ ID NO: 23103 - DNA, 1644 bp, Artificial Sequence
  Description of Artificial Sequence: Synthetic coding sequence
atgggcggctgcatccccttcctgaaggccgcccgggccctgtgccccaggatcatgcctcctctgctgctgctctcagccttcattttcctggtgagcgtgctcggtggggctccaggccacaaccctgaccggaggaccaaaatggtgtctatccactctctctctgagctcgagcgcctgaagttgcaggagacagcctaccatgaactagtcgctagacattttttgtctgagttcaaacctgacagggccttacccatcgataggcccaataccctggacaaatggttcctgattctcagaggccagcagcgcgctgtctctcataaaacgtttggaatctccctggaagaggtcttggttaatgaattcacaaggagaaagcacctcgagttgacagctacaatgcaagtggaggaagccactggacaagccgctggaagaagaagaggaaatgtcgtccggcgagtgttcgggagaattcggcggttcttcagtagaagacgaaatgagcccacgctgcccagagagtttactcgccggggtcggcgcggtgctgtgtcagtcgacagcctcgccgaactggaggacggagccctgcttttgcagaccctccagttgtccaaaatcagttttcccattggacaaagactgcttggcagtaaacgtaaaatgtcgctgaaccctatcgccaagcagataccccaggtcgtcgaggcatgctgccagtttattgagaaacacggcctatctgccgtgggaattttcaccctggaatactctgtgcagagggtgcgtcagttaagagaagagttcgaccaggggctcgatgtcgttttggatgacaatcagaatgtccatgatgttgcagcactcctgaaggaattctttcgggacatgaaagattcgttattgccagacgatttatacatgtcatttttactgaccgccaccctgaagccacaggaccagcttagtgcgctgcagcttctggtgtacttgatgcccccttgtcacagcgataccttggagaggttgctcaaggccctccacaagattacggagaactgtgaggatagcatcggcatcgatggtcaacttgtgcccggcaatcgcatgacatcaactaatttagcactggttttcggatccgccctgctgaagaaggggaagttcgggaaaagagagagtcggaagacgaagctgggaatcgaccactacgtcgcctcggtcaacgttgttagggccatgatcgataactgggatgtcctgttccaggtgccaccacacattcagcggcaggtggccaagcgggtgtggaagtcttccccagaggcacttgacttcattagacgcagaaacctgagaaaaattcagtctgctcgcattaaaatggaagaagacgccctgctgtccgaccctgtcgaaacctcggctgaggcccgagctgccgtgcttgcgcaatctaagccatctgacgaggggagctctgaagaaccggccgtgccttccggtaccgcgcggtcacacgacgatgaagagggcgccggtaatccccccatcccagaacaggatagaccgctgttgagagtcccacgcgagaaggaggccaagacaggcgtgtcctacttctttccttag

SEQ ID NO: 23104 - DNA, 5613 bp, Artificial Sequence
  Description of Artificial Sequence: Synthetic coding sequence
atggcccggtggatccccaccaagcggcagaagtacggcgtggccatctataactacaacgcatcccaggatgtagaactttctcttcaaatcggtgacaccgtgcacattctcgaaatgtatgaaggatggtacagaggatacacactgcagaacaaatccaaaaagggaatttttcccgagacatacatccacctgaaggaggccactgttgaggatttgggtcaacacgagaccgtgatcccaggggagctgccattggtacaggagctgacttccacgctgagggaatgggcagtaatttggagaaagctttatgtaaacaacaagctgacactcttccggcagttgcagcaaatgacttatagcctcattgaatggcgctcccaaatactctcagggactttgcctaaagacgaactggccgagctcaagaaaaaagtgaccgccaagatcgatcacggtaatcgcatgctgggactcgatctcgttgtgcgcgacgacaacggaaatattctggacccagacgagacctccaccatagcgctttttaaggcacacgaagtggcaagcaaaaggatagaagagaaaatccaggaggaaaagtccatcttgcaaaaccttgatctgagagggcaatcaatcttttcaacgatccatacgtacggactgtacgtgaacttcaaaaattttgtatgtaacatcggggaggatgcagaactgttcatggctctctatgacccagaccagagcactttcatcagcgaaaactacctgatccgctggggtagcaacggcatgccaaaggagattgaaaagctcaataatcttcaagcggtgtttacagatctttctagcatggatctcattcgcccgcgggtcagcttggtgtgccagattgttagagttgggcatatggagcttaaggagggtaaaaagcacacctgtggcctccggaggccattcggtgttgcagttatggatatcaccgacattatacatggcaaagtggacgacgaggagaaacagcactttatccccttccagcagattgccatggagacctatataagacagagacagttaatcatgtccccccttataacctcacatgtgattggagaaaatgagccactaacaagcgtgctcaacaaggtgatagcagctaaggaggtcaaccataagggtcagggattgtgggtgagcctgaaactgctgccaggtgatctcacacaggtgcagaaaaacttttctcacttggtggatcggtcaacagccattgcaagaaaaatggggttccctgaaattatcctcccgggtgatgtgagaaacgatatttatgttaccttgattcacggggaatttgacaagggcaagaaaaaaaccccgaagaacgtggaggtgaccatgtcagtacacgatgaagaaggcaagctattagaaaaagctatacaccctggggcgggttacgaaggcatttctgaatacaaatccgtcgtctattaccaggtaaaacagccctgctggtacgagacagttaaggtgagtatcgccatcgaggaggtgacacgatgccacatccgcttcacatttaggcatcgtagctcccaagagacccgggacaaaagtgaacgcgctttcggagtggcattcgtgaagctaatgaaccctgacggcactacactgcaggacggccggcatgatctagtcgtgtacaagggcgataacaagaagatggaagacgctaagttctacctcactttgcctggcaccaaaatggaaatggaggagaaagagcttcaggcgtccaagaacttggttaccttcacaccctccaaggattccacaaaggactcgtttcagattgccacactgatttgttctaccaaactgacccagaacgtcgacttgctgggacttttgaattggagatcaaacagccagaatattaaacataacctcaaaaaactcatggaagtggacggaggggaaattgtgaaattcctgcaggacacactggacgctctgtttaacataatgatggaaatgagcgattccgaaacctacgacttcctcgtttttgacgctctggtctttatcatcagtctgatcggagacataaaattccagcacttcaacccagttcttgagacctatatttacaaacacttttccgccacactcgcctacgtaaagctgtccaaagttctgaacttctacgttgccaacgccgatgacagctcaaagaccgagttgctttttgctgctttgaaagccctcaaatatctatttaggtttattattcagtctcgagttctgtacctcaggttctatggccagtcgaaagacggcgacgagttcaacaattctatccgccagctttttctggcctttaatatgctcatggaccgcccactggaggaagctgtcaaaatcaagggagccgccctgaaatatctgccctcaatcatcaatgatgtcaagctggtgttcgatcctgtagaattgtctgtgctgttctgcaagttcatccagagtatccctgataaccagctggtcagacagaaactcaattgtatgactaagatcgttgagtccaccctattccggcaatcagagtgtagagaagtgctgttgccccttctcacagaccaattgtctggacagctggatgacaacagtaacaagcccgaccatgaggccagcagccagctgctgagtaacatactggaagtgctcgataggaaagacgtcggagctacagctgtccatatccagctcattatggagcgactgctgaggaggatcaacaggacagttatagggatgaataggcagagtccccatatcggcagctttgttgcctgcatgatcgccttgctgcaacagatggacgacagccattacagtcactatatctccacatttaagacgagacaagacataatcgattttctgatggagacatttattatgttcaaagacctgataggcaaaaatgtatatgcaaaagactggatggtaatgaatatgacgcagaaccgggtcttcctaagagctatcaaccagtttgctgaagtgttgacacgcttcttcatggaccaagcgagcttcgagctccagctgtggaataattacttccaccttgccgtcgccttcctgacccacgagtcactacagcttgagaccttctctcaggctaaacggaacaagatcgtcaagaagtatggcgacatgcgaaaagagatcggcttccgaatccgcgatatgtggtacaaccttggacctcacaaaatcaagtttatcccatccatggtcggcccaattctagaggtgacactcacaccggaagtcgagctgcgcaaggccacaatacccatcttttttgacatgatgcagtgcgagttcaattttagtggcaatggtaattttcatatgttcgaaaacgagctgatcactaagctcgaccaagaagtcgagggcggccggggggacgagcaatacaaggtgctgctggaaaagctcttactcgagcactgcagaaaacacaagtatctgtcttcatccggcgaggtgttcgccttgcttgttagctccctgctcgagaatctgctggattaccgcaccattattatgcaggacgagtcaaaggaaaacaggatgtcatgcaccgtgaacgtgctcaacttttataaagagaaaaagagagaagacatttatatcagatatctctacaagttgagagatctgcaccgggactgtgagaattacaccgaggctgcctatactttactgcttcacgccgagttgctacagtggagcgacaaaccctgtgtgccccaccttctgcagaaagattcatactacgtttacactcagcaggaactgaaagagaaactgtatcaggagattatctcttacttcgataaggggaagatgtgggaaaaggccatcaagctcagcaaagaactggccgagacttatgaatcaaaagtgttcgattacgagggactcgggaaccttctgaagaaaagagcctccttctacgagaacattatcaaagctatgcgaccccagcccgagtatttcgccgtcgggtactacggacaggggtttccgagctttctgagaaataagatttttatatatagggggaaggaatatgagcgccgcgaggactttagcctccggctgctgacacaattcccaaacgcagaaaaaatgactagtactacaccaccaggtgaggacattaagagttcccccaaacagtatatgcagtgctttacagtcaaaccagtcatgagccttccgccgtcctataaggataaacccgtgccagagcagatactgaattactatcgggcaaacgaagtccagcagtttaggtatagcagaccttttaggaagggcgagaaagatccagacaatgaattcgcaacgatgtggatcgagcgaaccacttacaccacagcctacaccttcccaggcatactgaaatggtttgaggtaaagcagatctctacagaagagatctctcccctggagaacgcaattgagacgatggagcttactaatgaaaggatatcgaattgtgtgcagcagcacgcatgggatcgaagcttgtcggtacatcccctcagcatgctgctgtccggtattgtggatcccgccgtgatgggagggttctctaactacgagaaggccttttttacggaaaagtacttacaagaacaccctgaggatcaggagaaggtcgaactcctgaaaaggctgattgctctgcagatgcctttgttgaccgaaggcattcgaatccacggtgagaagttgaccgagcaactgaaaccattacacgaacgtctgagtagttgtttccgggagctcaaggaaaaagtagaaaagcactacggtgtcatcacactgccccctaacctaacggaacgcaaacagagcagaaccggatcaatcgtcctcccttatatcatgtcaagcactctgcgaagactttctatcaccagtgtgaccagttccgtagtttccacatcctcaaattcctccgacaatgccccctcccgacccggctccgacggaagtattcttgagcctctgcttgagcggcgcgcctcttcgggcgccagggtagaggacctctcactgagggaggaaaactctgagaacagaatcagcaagtttaaaagaaaggactggagtctgtctaaaagccaggtgatagccgagaaagccccagagcctgacttaatgtctcccacacgcaaagcacagcgaccaaagtcactgcagttaatggacaacaggttaagccctttccacggtagctcacctccacagtcaacccccttgagtccgccccccctaacaccgaaagccaccagaacgctgagtagccccagtctgcagacagacggcatcgctgcaacccccgtgcctccacctccccccccaaagtctaaaccttatgagggctcccagagaaacagtaccgagctggccccccccttgcccgtgcgcagggaggcaaaagcgccgcctcccccccctcccaaagcaaggaagtcaggcatccccacatcagagcccgggtcccagtag

SEQ ID NO: 23105 - DNA, 1623 bp, Artificial Sequence
  Description of Artificial Sequence: Synthetic coding sequence
atgagcgccagcctgaactacaagagcttcagcaaggagcagcagacaatggacaacctggagaagcaattgatctgccctatctgtctcgaaatgttcactaaaccagttgtgatcctcccttgtcagcataatctgtgtagaaaatgcgcgagtgacatttttcaagctagcaatccctacctacccacccgcggggggactacaatggcctcaggaggaagatttagatgtccgagctgcagacatgaagtggtcctagacagacacggcgtctatggcctgcagcgtaacctactggtagaaaacattatcgacatctacaagcaggagtccaccagaccggaaaagaagtctgaccagcccatgtgtgaggagcacgaggaggaaaggatcaatatctactgcctgaactgtgaggttccgacctgtagtctctgtaaagttttcggagcacacaaggattgccaggttgcgccactgacccacgtgttccagcgccagaagtccgagctgtccgatgggatcgccattctggtaggatccaatgatcgggtgcagggggtaattagtcaacttgaggatacctgtaagacaatcgaagagtgctgccgaaagcaaaagcaagaattgtgtgagaaatttgattacttgtatggcattctagaggaaagaaaaaacgaaatgacacaagtgatcacgcgcacacaggaagaaaagcttgagcacgtacgggccctgattaaaaaatactcggaccaccttgaaaatgtgtcaaagctggtggaatctgggatccagtttatggatgaaccagagatggctgtgttccttcagaacgcaaaaactcttcttaaaaagatcagtgaggccagtaaagcctttcagatggagaaaattgaacacggatacgagaatatgaaccattttaccgttaatctgaacagagaagagaaaataatccgcgaaattgatttctaccgcgaggacgaagacgaagaggaggaggaggggggagagggggaaaaggagggagaaggcgaagtgggaggtgaggcagtcgaggttgaagaggttgaaaacgtgcaaactgaatttcctggggaagatgagaatcccgagaaggcatccgaactgagccaggtagagttacaagccgctcctggcgccctccccgtcagtagccccgagccaccaccagcactgcctccagccgccgacgcccccgttacacagggcgaagttgtccctaccggatcagaacaaacaacggaaagtgaaacacccgtaccggcagccgccgaaaccgccgatccgctgttttaccccagctggtacaagggccagactaggaaggcaactaccaatcccccctgcacgccaggctcagagggactagggcagatcggaccccccggttccgaggactccaatgtccgcaaggctgaagtggctgccgctgctgcttctgaaagagccgcagtctccggaaaggagacctcggcccccgctgccacttcccaggagcttgttatttgccttgcactgttggcattcttaatccttcactacatctggtcccagattcagtgccttatatttacattgatggactggatatag

SEQ ID NO: 23106 - DNA, 3252 bp, Artificial Sequence
  Description of Artificial Sequence: Synthetic coding sequence
atgagccagacccaggactacgagtgccggagccacaacgtggacttgcctgaatcaagaatccctggatctaatacccggctcgagtgggtggaaattatcgagcctcgcaccagggagcggatgtacgcaaatctggtcactggcgaatgcgtgtgggacccgcctgcgggcgtgcgcatcaaacggacaagcgaaaatcagtggtgggagcttttcgacccaaacacatcccgtttttattactacaatgccagcacccagcgcactgtgtggcacaggccccagggatgtgacatcattcccctcgctaaacttcaaactttaaaacagaacacagaaagtcccagggcctccgcagaatcctctcccggcagaggaagtagtgtgagcagagaagggagcacctcctcatcactggaaccagaacccgacactgaaaaggctcaagagctcccggcgagagccggccgcccagccgccttcggaaccgtgaaagaggactcaggatcttcttcgccccccggagtcttccttgagaaggattacgagatctaccgggactactctgcagatggtcagctgttgcattataggacttcctcactccgctggaattcaggcgctaaagaacgcatgctgatcaaggttgcagaccgggaaccgagctttctggcagcacaggggaacgggtatgctcctgacggccccccgggcgtgcgatcacggaggccttccggatcacagcacagcccgtccctgcagacattcgcacctgaagcggacgggacaatcttctttcccgagcgccgaccgtcaccatttctgaaacgggctgaactgcccggatcttcctcacccctgctggcccagccaaggaagccatcgggtgatagccagcccagttctcctaggtacggctatgagccaccattgtacgaggagcccccagtcgaatatcaagcgcccatctacgacgaaccacccatggacgtgcagttcgaggcaggcggcggctaccaggccgggagtccccagaggtcccctggccggaaaccccgtccattcctccagccgaataagcagggcccgcctagtccctgtcagcagctggtgctcactaaacagaagtgtccagagcggtttctctccctcgagtattcccctgccggaaaagagtatgtgcggcaactggtttacgtagagcaagccgggtcgtctccaaagctcagggctggccctaggcacaagtacgctcccaatcccggcggcggttcatactccttgcagccctccccatgcctgctgcgagatcaaaggctgggtgtgaagtcaggagattatagcacgatggagggcccggaattgcggcattctcagcccccaacccctcttccccaggcccaggaagatgcaatgtcctggagtagtcagcaagacaccctgtcgtcaacgggatactcccctgggacaagaaagcggaagtcaagaaaaccatctttgtgccaagccacctcggccacacctacagagggacctggcgatctcctcgtggaacaaccactggctgaggaacagccaccctgtggtacatccctggcccccgttaagagagcagagggggaagccgaaggggctaggggagcagccgagcccttcctcgcccaggccaggctcgcgtgggaggcccagcaggcacacttccatatgaaacagagatcttcctgggactctcagcaggatggaagcggttacgagagcgacggggctctcccattgcccatgcctggaccagtggtcagagcgttcagtgaggatgaagcactcgcacagcaggagaatcggcactggaggcgcggaacatttgagaagctcgggtttccccaaatactgcttgagaaatcagttagcgtgcagacaaatctggcttctcccgagccttacttgcatccttctcagagcgaagacttggctgcttgtgcccagtttgagtccagtcgacagagccgtagtggcgtacccagctcctcttgtgtgttccccacatttactcttcgcaagccatctagtgaaacagacattgagaactgggctagcaagcatttcaataagcacacacagggcctgttccggcgcaaggtctccatcgctaacatgctggcctggtctagcgagagtattaagaaacccatgattgtgaccagcgacagacatgtgaagaaagaggcctgcgaactgtttaaactgatacagatgtacatgggcgaccgccgcgccaaggctgacccattgcacgtggctttggaggtcgccacaaaaggctggtctgttcagggactacgtgacgagctctatatccagctctgtcggcaaactaccgagaacttccgtctggaatctctcgccaggggctgggaactgatggcgatctgcttggcattttttccacccacaccaaaatttcatagttatctagaggggtacatttataggcatatggaccccgttaacgacaccaagggagtggccattagcacatacgcaaagtactgctaccacaagttacaaaaggccgccttgactggagctaagaagggcctcaagaagccgaatgtcgaggaaattcgtcatgctaagaacgcggtttttagcccttcaatgtttggcagtgctcttcaagaagtgatggggatgcagagggagaggtacccagaacgccagctgccctgggttcagactcgtcttagtgaagaggtcctcgctcttaacggggaccagactgagggtatttttagagtgcctggagacatcgacgaggtcaacgcccttaagctccaagtcgatcagtggaaagtgcccaccggcctggaggacccacacgtccctgcatctctgctgaagttgtggtatcgggagctcgaagagccgttaataccacacgagttctacgaacagtgtatagcccattacgacagccccgaggctgcggtggctgtggtccacgccctgccacgcattaaccgcatggtcctgtgttatctcatcaggtttctgcaggtttttgttcagcctgcaaatgtcgcagtgaccaagatggacgtgtccaacttagccatggttatggcccctaactgcctgcggtgccagtccgacgacccccgagtcatctttgagaacacacgcaaagagatgtcattcctgcgggtcctgattcagcacttagatacttcttttatggaaggcgttctgtag

SEQ ID NO: 23107 - DNA, 426 bp, Artificial Sequence
  Description of Artificial Sequence: Synthetic coding sequence
atgggcaagggcatccccctgaacgaccaggaccggatcccctggctctgcaacctgcatgatatcctgttgcgtgatgtggccagcgggcagcgggtggttctggcctgcagcgccctgaaaaaaacttaccgcgacattctgactcagggcaaggatggggtcgccttgaagtgcgaagaatcaggcaaagaggctaaacaggccgagatgcagcttctcgtagtccacctaagcggatctttcgaggttataagtggccgactcctgaaaagagagggacacttcatgcctcctgagctcctccagtcccaatttgaaactttggagccgcctgccgctccagagaacttcattcaaatatcggtcgacaagaatgtgtcagagatcatcgcgacgatcatggagactctcaaaatgaagtag

SEQ ID NO: 23108 - DNA, 1701 bp, Artificial Sequence
  Description of Artificial Sequence: Synthetic coding sequence
atggacatccagctggaccccgcccgggacgacctgcccctgatggctaacacatcccacatcttggtgaaacactatgtactggatctcgacgtggacttcgaatcacaggttattgaaggcacgatcgtgctatttctggaggacggcaacaggttcaagaagcagaacagttcgattgaggaggcttgccagagcgaaagcaacaaagcatgcaagttcgggatgcccgaaccatgccatatcccagttactaacgccaggacttttagctctgaaatggagtacaatgactttgcaatttgcagtaagggcgagaaggacacctccgataaagatggcaatcacgacaatcaggaacacgcctccgggatatcgagctctaagtactgctgcgacacaggcaaccatggcagcgaagattttcttctggtgttggactgttgcgatcttagtgtgttaaaggtggaagaggtagacgtggctgccgtcccagggcttgagaaatttactcgatcacccgagttgacagtggtgtccgaggagtttagaaaccagatcgttagagaactggtcaccctgcctgcaaacaggtggcgagagcagttggactattacgcacgctgtagccaggctcctgggtgtggagaactgctgtttgataccgacacttggtccctgcagatcaggaaaacgggcgcccagacagcaactgacttcccgcatgccatacggatatggtacaagaccaaaccagagggccgctccgttacttggacatcagatcaatctggccgcccttgtgtgtataccgtagggtctcctataaacaatcgcgccctttttccttgtcaggaacctcctgtcgcaatgagtacttggcaggctacggtgcgggccgcagcgagcttcgtggtcctgatgtcaggggagaattctgcgaagcccacacagctgtgggaagaatgctcaagttggtattactacgtgacaatgccaatgccagcttcaacctttactattgcagtgggatgttggaccgaaatgaaaatggaaacttggagcagcaacgatctggctacagagcgccctttctccccaagtgaagcaaatttccgccatgttggcgtttgcagccacatggagtacccctgcaggttccagaatgcaagcgccactacccaggaaattatcccacatagggtcttcgccccagtgtgcctcaccggcgcctgtcaggagacacttcttaggttgatccctccgtgtctgtccgcggcccacagcgtgctgggagctcaccccttttcacgactggatgtccttatcgtgccagcgaacttcccgtccctcggtatggcatcaccacacatcatgttcctcagccagagcatcctcaccggaggaaatcatctgtgtggaaccagactctgtcatgaaatcgcccacgcatggtttggcttggccattggagctagggattggacagaggaatggctgtcagaggggttcgctactcatctcgaggacgtgttttgggccacagctcagcagctggctccatacgaagcccgagagcagcaggagcttagagcgtgcttacggtggaggagactgcaggatgaaatgcagtgttcgcctgaagagatgcaagttctgagatttccacacgtgggaggctgcagtggctcttttagctag

SEQ ID NO: 23109 - DNA, 1266 bp, Artificial Sequence
  Description of Artificial Sequence: Synthetic coding sequence
atgcccttcctgcacggcttccggcggatcatcttcgagtaccagccccttgtggacgccatcttggggtcgttgggaattcaagaccccgagcgccaggagtctctggaccgcccctcctacgtggctagcgaggagtcccgaatactcgtcctgacggagctgctggaacgcaaagcccattctccgttttaccaagagggagtgtccaacgcccttctgaagatggccgaattggggttaaccagggctgctgatgtcttgttacgtcacggagctaacctcaattttgaagacccagtgacttattataccgctctccatatcgctgtcctgcgtaaccagcccgatatggttgaattgctggtccaccacggagctgatgtgaacagaagggacagaatccatgagtcttctccccttgacctggcctccgaagagcctgagcgtcttccctgcttacagaggctgctggacctgggggcagatgtcaacgccgctgataagcacggcaaaacagctctgctgcacgcgttagctagcagcgatggggttcaaattcacaacaccgaaaatatacgacttctcctggaaggaggagccgacgtcaaagccacaacaaaagacggagacactgtctttacatgcattatcttcttactaggcgaaaccgttggcggcgataaagaagaagcgcagatgataaacagattctgcttccaagtgaccaggctcctgctggcacatggggccgatccatctgaatgccccgcacatgaatcgctgacacacatatgcctcaagagcttcaagctccactttccccttttgcgattccttctagagtcgggagcagcctacaactgctccctacacggcgcatcttgttggtctggcttccatatcatcttcgagagactgtgttcacaccccggatgtaccgaagacgaaagccacgctgacctgctgcggaaggctgagaccgtcctggatcttatggtgaccaacagccagaagctgcaattgcccgagaacttcgacatccaccccgtcggatctctcgctgaaaaaattcaggctttgcacttctccctccgtcagctggagtcgtacccaccccccttgaagcacttatgcagagtggctattagactgtatctccagccatggccagtggacgtgaaagttaaggccctgccgctgccagacaggctgaagtggtacctcttgtcagagcatagcggttcggttgaagacgatatctag

SEQ ID NO: 23110 - DNA, 594 bp, Artificial Sequence
  Description of Artificial Sequence: Synthetic coding sequence
atgcccttcctgcacggcttccggcggatcatcttcgagtaccagccactcgtcgatgccatcctggggtccctcggtatccaagaccccgagcgacaagaaagcttggatagaccttcctatgtggcctccgaggaatcgcgcatcctggtcttgaccgaactgttggaacgcaaagcccactccccattttaccaggaaggggtcagtaatgccctcctaaagatggccgagctgggacttaccagggcggccgatgtcttgctgcgccacggcgcgaatctcaatttcgaggacccagtcacttactacacagctctgcatattgccgtactgcgaaaccagccagacatggtggagctcttggtccaccacggtgctgacgttaaccgcagggatagagaaaaactactgtgttctatgctgtggccagctgccacggggtgcagatctacaattttacgcacctttgttagctactggaaagaaggacaaacttctaggccacctccaaagatggggacacaatgctcccctgccagctccagttgcttagttagaccatgggaagggacgaagcgccggccgagatag

SEQ ID NO: 23111 - DNA, 684 bp, Artificial Sequence
  Description of Artificial Sequence: Synthetic coding sequence
atgagcgacatcaacctggactgggtggaccggcggcagctgcagcggctggaggaaatgctgattgtggttgacgaaaacgataaagtgattggcgccgacacaaaacgaaactgccatctgaacgagaatatcgaaaagggactgctgcaccgggccttttctgttgtgttgttcaacactaaaaatcgaattttgatacagcaacgatcagatacgaaggtcacgtttccaggatatttcactgattcctgcagctctcaccccctctacaatcccgccgaactggaagagaaggatgccataggcgtgcggcgtgctgcccagcgcagactccaggccgagctggggatcccaggagagcagatttcacccgaggacatcgtttttatgaccatttatcatcataaggccaaatctgacaggatatggggcgaacatgagatctgttacctgttgctggttcgtaagaacgttacccttaatccagatccgtctgagacgaagagcatactctacctttctcaggaagaactgtgggaactcttagagagagaggcaagaggtgaagtgaaagtgactccctggttaagaacaatcgctgagagattcctctaccgatggtggcctcacctggacgatgtgactcccttcgtggagctccacaagatacaccgcgtctag

SEQ ID NO: 23112 - DNA, 864 bp, Artificial Sequence
  Description of Artificial Sequence: Synthetic coding sequence
atggaggtgatggagggccccctgaacctggcccaccagcagagcaggcgcgctgaccgactgctcgcggccggcaagtatgaggaggcaataagctgccataagaaagctgccgcatatttaagcgaggccatgaaactcacacaaagcgaacaggctcacctatcccttgaattacagagggattcacacatgaaacaactgttactgatccaggagagatggaaacgtgctcagagagaggagaggctcaaggcccagcaaaacaccgataaggatgccgccgctcatctccagacatcgcacaagccaagcgccgaagatgccgaggggcagtcccctctatcccagaagtattctccttccactgagaaatgcctcccagagatacagggtatattcgacagggacccggataccctgctatacctcctacagcaaaaaagcgagccagccgaaccttgtatcggcagtaaagcaccgaaggatgataagacgatcatcgaggaacaggctacgaaaattgcagatttgaaacgccacgtggaattccttgtagctgagaacgaaaggctccgcaaggaaaataagcagctgaaggccgagaaagcccgtctcctgaaggggccaattgagaaggagctggacgtggatgcggactttgtcgagacatccgagttgtggtctctcccccctcatgccgaaacagcaacagcatcctcaacctggcagaaatttgccgcaaatacaggaaaagccaaggacattcctattccgaacctgcctcccctagacttccccagcccagaattacctcttatggagttgtctgaggatatcttgaagggcttcatgaataactag

SEQ ID NO: 23113 - DNA, 2844 bp, Artificial Sequence
  Description of Artificial Sequence: Synthetic coding sequence
atgtgcgtggacagcctggtgcggatctgcagcggcctgagctacggccgtataagaaatatcaagtcgttaagcgatatacaaatcgttcaggtagcatgcggctactatcacagcttggccctgtctaaagctagcgaagtgttttgctggggccagaacaagtacggccaactcggcctgggtactgattgcaaaaaacaaacatccccacagttgctgaagtctttgctggggatccctttcatgcaggtggcagccggaggggcccatagcttcgttctcaccctgagcggcgccatcttcggatgggggaggaacaagtttgggcaacttggccttaatgatgaaaatgatcgatacgtccctaatctcctaaagtccctgcggagccagaaaatcgtttacatctgttgtggcgaagaccacacggccgctctgacaaaagaaggcggcgtgtttacctttggggctggcggatacggacagctgggccacaacagtacttcccacgagattaacccacggaaagtctttgaactaatgggatccattgtcaccgagattgcttgcgggaggcaacacacgagcgcttttgtcccctcctccggccgcatttacagcttcgggttgggaggaaacggtcagttgggtactggttccacgagcaacaggaagagtccattcacagtgaaggggaactggtacccgtacaacggtcagtgtctgcccgacatcgattctgaggagtatttttgcgtcaaaaggatcttcagcggcggggatcagtccttctcccactacagcagtccgcagaactgtggtccgccggacgactttcgatgtccaaatcccacaaagcaaatatggactgttaacgaagctctgattcaaaaatggttaagctatccaagtggccgctttcccgtggagattgccaacgaaatagacggcaccttcagcagttcgggctgtttaaacgggtcattccttgcagtgtccaacgatgatcattatagaaccgggacccggtttagtggagtggacatgaacgccgcccgcctgctgttccataagttaatccagcctgaccacccacagatttctcagcaggtggcggcctctttagaaaagaacctgattccaaagctgacctcatccttacccgacgtggaggcactacgtttctacttaaccctcccagaatgccctctgatgtcggacagcaataatttcacgacgatcgccatccctttcgggaccgccctcgtcaacctcgaaaaagcaccacttaaggtgctggagaactggtggagtgtcctggagcctcccctctttctcaagatcgtggaactgttcaaggaggtggtggttcatttattgaagttgtacaaaattggcatccctccaagcgaacggaggatctttaatagcttcctgcatactgcccttaaagttctcgaaatcctgcatcgggttaacgaaaagatgggccagatcattcagtatgataaattctacattcatgaagtgcaggagctgatcgacataaggaatgactacattaactgggtccagcaacaagcatacggtatggatgtgaaccatggactgactgaattagccgatatccccgtcaccatttgcacctacccttttgttttcgacgcacaggcaaagacaaccctgttacagaccgatgcggtcctccagatgcaaatggccatcgatcaggctcacaggcagaacgtgtctagcctgttcctcccggtgatcgagtctgtgaacccctgcttgattctggtggtgaggagggagaatattgtgggagatgcgatggaggtgttacggaaaacaaagaacatagactacaaaaagcctttgaaggtgatttttgtgggagaggacgccgtcgacgccgggggagttaggaaagagttctttctgctgattatgcgcgaactgctcgatcccaagtatggcatgtttcgctattatgaggattcccgactgatctggttctctgataagacctttgaagactccgacctgttccatctgattggcgtgatttgtggtttggctatttacaattgcaccatcgttgatcttcactttccactcgcactgtataaaaaacttctgaaaaagaaaccgtctctggacgatcttaaggaactcatgccagacgtagggaggtccatgcaacagttgttggattaccccgaggatgatatcgaggagactttttgcctgaactttacgattactgtagaaaatttcggagccacagaggttaaagaactcgtgttgaatggagctgatactgctgtgaacaagcagaacagacaagaattcgtcgacgcttatgtggactatatctttaataaaagcgtagcatctctctttgatgcctttcatgctgggtttcacaaagtttgtggtggtaaagttcttcttctttttcagcctaacgaacttcaagccatggtgattgggaatactaattacgactggaaagagctagagaagaatacagagtataaaggtgaatactgggccgagcacccaaccatcaagatcttttgggaggtctttcatgaactgcctctggagaagaaaaaacagttcctgctgttcctcacagggagcgaccgcattcccatactgggtatgaaatcactgaagctggtcatccagagcaccggggggggggaggagtacctgccagtgagccacacctgcttcaacctccttgatctgcctaaatatacggaaaaggaaactctacggagcaaacttatccaggccatagatcataatgaaggattcagcctaatttag

SEQ ID NO: 23114 - DNA, 2541 bp, Artificial Sequence
  Description of Artificial Sequence: Synthetic coding sequence
atgcccgccttcctgggcctgaagtgcctgggcaagctgtgcagcagcgaaaaaagcaaagtcacctcatcagagcggacatccgctcggggaagcaacaggaaacggctcatcgttgaagatcgccgagtctctggcaccagctttaccgcacacagacgggctaccatcactcacctcctgtacctttgtccaaaagactattgcccgagaggaagggtgtgcaattcagtggacccatttgtcgcccatccacaggatccccaccacccatccgagaagccggtgatacactgccacaaatgtggggagccctgtaagggagaggtgctgcgcgtgcagacaaagcactttcacattaagtgctttacctgtaaggtctgcggctgtgaccttgcgcagggaggtttctttatcaagaacggggaatacctgtgtacactcgactatcagcgtatgtacgggactaggtgccacggatgcggagaattcgtggagggcgaggtcgtaaccgccctgggcaaaacctaccacccaaactgctttgcttgtacaatatgcaaacgtcccttcccgccaggagaccgggtcaccttcaacggccgcgattgcctatgccagctgtgcgctcagccgatgtcttctagcccaaaggagaccaccttcagctctaactgcgccggctgcggcagggacataaaaaacggacaggcactcctggctctcgataagcagtggcacctggggtgcttcaaatgcaaatcatgcgggaaggtgttgactggggaatatatttccaaagacggcgcaccttactgtgaaaaagactaccaaggactattcggcgtcaaatgcgaggcgtgccatcagtttataacgggcaaggtgttggaagctggcgacaagcactatcacccctcctgcgcaaggtgctcccgatgcaaccagatgtttacagaaggggaggagatgtatctgcagggctccactgtgtggcaccctgattgcaagcagtccacaaagaccgaggagaagttgaggctgcccaatatacgacggagctcatctgactttttctatagtaaaagcctaataaggagaaccggacggtcccctagcttgcaacctacaaggaccagttcagagagcatttattcacgccccgggtctagcatacccggatcaccaggccacacaatatacgcgaaagtggacaacgaaattctcgattataaggatctagccgccattcctaaggtaaaggccatctatgatatcgagaggccagatctaatcacatacgaacctttctacacatccggatatgacgacaaacaggaacggcagtcactgggagagagcccccggaccctgagccctactccttctgccgaggggtaccaggatgtccgcgataggatgattcatagatccacttcgcagggaagcatcaacagtcctgtttatagtcgtcactcctacacccccaccacaagtagatccccacagcacttccatcggcctgaacttctcagcccaggagtacagcgcctgtcatatctgcggacgtcatccctgtcccccacccacagtgactctcgtccaaacccccccttcaggcatcactttatcccccacatcaaaggcaacgaaccaagctcgggcagaaattcaccactgccctataggccagactcccggcccctcacacccacatacgcccaggccccaaagcatttccatgtaccggaccagggaataaatatatataggaagcctcctatctacaagcaacatgccgcactggccgctcaaagcaagagttctgaggatataatcaagttcagtaaatttcccgccgcgcaggcccccgacccaagtgaaactcccaagatcgagactgatcattggccaggtcctcccagttttgcagtggttgggccggatatgaagcggaggtcatctggacgcgaagaggacgatgaagagcttcttcgcaggaggcaactgcaggaagaacagctcatgaagctgaatagcggactgggccagctcattctcaaggaagaaatggagaaggaatcacgcgaaagaagctctctactggcttcccggtatgattcgccaatcaacagtgccagtcatatcccttcctctaagacagccagcttacccggctacggtcgcaatggccttcaccgaccggtaagtactgactttgcgcagtacaatagttatggcgacgtgtcaggaggagtgcgagattatcagacacttcctgatggtcatatgcccgccatgagaatggatcggggggtgtctatgccaaatatgctggaaccaaagatcttcccatatgagatgctgatggtcaccaataggggcaggaataaaatactgcgagaggtggacagaaccaggttggagcgacatttagctcccgaggtgtttagagaaatctttggcatgagtatccaagagtttgatcgattgcccctgtggaggaggaatgatatgaaaaaaaaagccaaactcttttag

SEQ ID NO: 23115 - DNA, 594 bp, Artificial Sequence
  Description of Artificial Sequence: Synthetic coding sequence
atgttcggctgcctggtggccggccggctggtgcagaccgccgcccagcaggtagctgaagacaagttcgtttttgatctgcccgactacgaaagcattaaccacgttgtggtgttcatgctgggaaccattcctttccccgagggcatgggaggcagcgtttatttttcttaccctgacagtaacggtatgccagtctggcagctgctcggtttcgttactaatggcaagccatcggctatcttcaagatttctgggctgaaatccggtgaagggtctcagcaccctttcggagctatgaatattgtgcgtacaccaagcgtggcccagattggcatctccgtggagttgctagatagtatggcccagcagactcccgttggaaatgctgccgtctcctccgtggatagcttcacccagtttacccagaagatgcttgacaacttttacaattttgcttcctccttcgctgtgtcacaggcgcagatgacaccaagccccagcgagatgttcatcccggcgaacgtcgttcttaagtggtacgagaatttccagcgccggctagcgcagaatccattgttctggaaaacatag

SEQ ID NO: 23116 - DNA, 930 bp, Artificial Sequence
  Description of Artificial Sequence: Synthetic coding sequence
atggtgttccccgccaagcggttctgcctggtgcccagcatggagggcgttaggtgggcatttagttgtggcacatggctcccgtcccgggctgaatggctgctggctgttaggagcattcaacccgaggagaaggaaagaatcggccagtttgtttttgcaagagacgccaaagccgctatggccggccggctgatgattcgcaagcttgtcgctgagaaacttaatattccctggaaccatataaggctgcagaggactgccaaaggtaaacctgttctcgctaaggatagcagcaatccatatcccaactttaattttaacatctcccatcagggggattatgccgtcctggccgccgagcctgaactgcaggtggggatagacattatgaagacaagcttccccggaaggggaagcatccccgagtttttccacattatgaagcgaaaattcaccaataaggaatgggagactattaggtcctttaaggatgaatggacgcagttagacatgttttaccgcaactgggcactgaaagagtcattcattaaagctatcggcgtgggcctgggattcgaactgcagcgcctcgagtttgatctcagccctttaaacctggatatcggccaagtctacaaagaaacccggctcttcctggatggtgaggaggagaaggaatgggctttcgaggaatctaagatcgatgagcatcatttcgtggcggtcgcgctaagaaaaccagacggaagccgacatcaagacgtgccgagccaggatgattctaaacctacacagaggcagtttacaatactgaattttaatgacctgatgtcctcggccgtccccatgacacctgaggatccatccttctgggactgtttttgtttcacagaagaaatcccaatcagaaatgggactaaatcttag

SEQ ID NO: 23117 - DNA, 1599 bp, Artificial Sequence
  Description of Artificial Sequence: Synthetic coding sequence
atgcagagctgcgagagcagcggcgacagcgccgacgaccccctgtctaggggccttagacggcgtggccagccaagagtcgtggttattggggctggcctggccggactagccgctgccaaagccctgcttgaacagggattcaccgacgtgaccgtgctggaagcctccagtcacattgggggtagagtccagagcgtgaaactggggcacgcaacctttgagctcggagctacttggattcacgggtctcacggtaaccctatttatcaccttgccgaagcaaatggactgctggaggagactactgatggagagcggtcagtgggaagaatcagcttgtactcaaagaacggagttgcttgttatctgacaaaccatggcagacgcatcccaaaggacgttgtggaggagtttagtgacctctataatgaggtctacaatttgacgcaggaatttttcaggcatgataaaccggtgaacgcagaatcacaaaactcagtcggagtattcacgcgagaagaggtgaggaatcgaattagaaatgaccccgacgatcccgaggctactaagcgtctgaaactcgccatgattcagcagtacctaaaagtggagagctgcgagtcttcaagccactctatggacgaggtcagtctgtccgcattcggtgagtggaccgagattcctggggcccatcacatcatcccatccgggttcatgcgtgtcgtggagctcctagccgaggggatcccagcacacgttatccagctgggtaaacccgtgcgatgtatacactgggaccaggctagtgccagacccagaggtcctgaaatcgagcctagaggcgtcttgaaaaggcagtatacctctttctttcgcccaggtctgcctacggagaaagtggccgccatccataggctcgggattggtactaccgacaagatcttcctggagttcgaggaaccattttgggggcccgagtgtaatagtctccagttcgtctgggaagatgaggcagagagccacacattaacataccctcccgaactctggtatcgaaagatatgtggctttgacgtcctgtatccccctgagcggtatggacacgtgttgagcggttggatctgcggagaagaagcacttgtcatggagaaatgtgacgacgaggccgtagccgaaatatgtaccgaaatgcttcgtcaattcacgggaaatcccaatatcccaaagcccaggaggattctcaggagtgcttggggatcaaacccctacttccgagggtcatactcctacacacaggttgggtcatcaggggcagatgtggagaagttggcaaagcctctgccttataccgagtcaagtaaaactgcacacggatcctccactaagcagcagccaggacatctgttttcttccaagtgtcctgagcaaccgctcgacgcaaataggggtgcggtcaagcccatgcaagtgttattctcaggagaagcaacacaccgcaaatactattccacaactcatggggcgctcctcagcggccaacgtgaggccgctcggctgatcgagatgtaccgagatctgttccagcaaggcacctag

SEQ ID NO: 23118 - DNA, 2349 bp, Artificial Sequence
  Description of Artificial Sequence: Synthetic coding sequence
atggacagcagcatccacctgagcagcctgatcagccggcacgacgatgaggcaactagaaccagcactagcgagggcttagaagaaggcgaggtggaaggtgaaaccctgctgattgtcgaatctgaagatcaggccagtgtggatctgtcacatgatcagtccggagattcactgaacagtgatgaaggcgatgtctcttggatggaagagcagttgtcatatttttgcgacaagtgccagaaatggatccccgcctctcagttaagggagcagctgagttacctgaagggagataacttcttcaggttcacttgttccgattgcagcgcagatggtaaagagcagtacgaacggcttaagctgacctggcagcaggtcgtgatgctcgccatgtataacctgtctcttgagggaagcgggcgacaggggtacttccgatggaaggaggacatttgtgctttcattgagaagcactggactttcctactgggcaaccgcaagaagacttccacctggtggtccaccgtggccggctgcctgtctgttgggtcgcccatgtacttccggtcaggtgcccaggagttcggggaaccgggttggtggaagctcgtgcataataagccacctactatgaaacctgagggagaaaagctcagcgccagcacccttaagataaaagctgcgagtaaacccacacttgatccaatcattaccgtggaaggccttcgtaagagggcatcgcgcaacccagtggagtccgctatggaacttaaggagaaacgatccaggacacaggaagctaaggacatcagaagggctcaaaaagaagccgccggtttccttgatcggtccacctcttctacaccagtaaaattcattagcagagggcggcgccctgatgtcatcctggaaaagggggaagtgattgacttttctagcctgagcagttccgatcgtactcccttaacgtcccccagtccctcgccatctctcgacttttctgcccctgggaccccagcctctcatagcgcaacacccagcctgctgtcagaagctgatctgatccctgatgtaatgcctcctcaagccctctttcacgacgacgacgagatggagggcgacggggtgatcgaccccggaatggaatatgtaccgccacctgccgggtccgtggccagcggccctgtagtgggggtccgtaaaaaagtgagaggacctgagcaaattaaacaggaggttgaatccgaggaagaaaagcctgatcgtatggatatcgatagcgaagataccgacagcaacaccagtctccagacaagagcaagggagaaacgaaaaccccaattggaaaaggataccaaacctaaagagccccgatacaccccggtgtcgatttacgaggagaaattgctccttaagagactggaggcttgcccaggggcagttgccatgactcccgaagcccgccgactcaagaggaaattgattgtccgacaagccaagcgcgataggggtcttcccctgtttgatctcgatcaggtagtcaacgccgcactgctgctggtggatggaatttacggggccaaggagggcggaatcagtagactgcctgcaggtcaagctacatatcggaccacctgccaggacttcaggattttggacagatatcagacctccctgccttcccgtaagggattccgccatcagacaactaaattcttgtaccggttggtcggatccgaggacatggctgttgaccagagtatcgtctctccttatacaagcaggatcttgaagccttacataagaagggactacgaaactaagccacccaagctacagctgctgtcgcagatccggagtcatctgcaccgctctgacccacactggacgcctgagcctgatgcccccctagattactgctatgtgcggcctaatcacattccaacaataaattcaatgtgccaggagttcttttggcctgggatcgatctttctgaatgcctgcagtatccagacttctcggtcgtagtattgtacaagaaggtcattattgcctttgggttcatggtgccagatgtaaagtacaacgaggcgtatattagcttcttgtttgttcaccccgaatggaggagggccggtatcgcaacttttatgatttatcatctgatccagacctgcatgggtaaagacgtgacgttacacgtgagcgcgtctaaccccgccatgctactttatcaaaagtttggctttaagactgaggagtatgttctagacttctacgataaatactaccccttggaatcaaccgaatgtaaacacgccttcttcttacgactcaggcggtag

SEQ ID NO: 23119 - DNA, 2745 bp, Artificial Sequence
  Description of Artificial Sequence: Synthetic coding sequence
atgggcaccaccgcccccggccccatccacctgctggagctgtgcgaccagaaactgatggaattcctgtgcaacatggacaacaaagatctggtctggttggaggaaatccaggaggaggcggaaaggatgttcacacgggaattttccaaagagcctgaactgatgccaaaaacccccagccaaaaaaaccgccgcaaaaaaagacggatcagttacgtgcaagacgaaaacagggatcctatccggcggagactttcccgtagaaagagtcggtcatcacagctgagtagccgcagactgcggtctaaggattcagtggaaaagcttgccaccgtggttggcgagaatggatccgtattacggcgcgttactcgcgccgcagcagctgcagccgccgctaccatggccctggccgccccatcatcacccacacccgaaagtcccaccatgctgactaagaagcctgaggacaaccacactcaatgccagttggtgccagtcgtggagatcggtatttcagaacggcaaaacgccgagcaacatgtgacccagctgatgagcaccgagccattgcctcgaaccttgtctcccactccagcgtcagcgacggccccaactagtcagggcatacctacaagtgacgaggaaagcacccccaaaaagtccaaagctcggattctcgagagcattacagtttctagtctgatggcaacccctcaggaccctaaaggccagggggtggggaccggccgctccgcatcaaagcttagaattgcacaggtgtctcccgggccccgggattcacccgccttcccagattctccttggcgagagcgcgtgcttgctcctatcctgccggataacttttccacaccgacaggaagtcggactgattcccagagtgtgcgccattcaccaatcgcacctagtagcccaagccctcaggtgctggcccagaaatacagcttggtagccaagcaggagagcgtcgtgcgtagggcttcaagaaggctggcgaaaaagacagccgaggagcccgccgcctcaggcaggatcatttgccacagttacctggaaagactcctgaacgtggaagtcccgcagaaggtgggctccgaacaaaaagagcctcctgaagaagcagagcctgtggcagcggcagagccagaggttccagaaaacaacggaaataatagctggccacacaacgatactgagatcgctaattccacccccaacccgaagccggccgcgtcttcccccgagactccatcagctggacagcaagaagccaagaccgatcaggccgacggccctcgggagcccccacaatccgcaaggcggaaacgcagttacaaacaagccgtctcagagcttgacgaagaacagcatctggaggatgaggagctgcagcccccgcggtctaagacaccgtcttccccctgtcccgctagtaaggtcgtccggcccctgaggacttttctgcatacagttcagcgaaaccagatgctgatgacacccaccagcgcaccccgcagtgtgatgaagtctttcatcaagcgaaacactcccctgagaatggatccaaaagagaaggagcggcagaggctggagaacctccgtcggaaggaagaggccgagcagctcagaaggcagaaagtggaggaggataaaagaagacggctggaggaggttaaactcaaacgggaagaacgattgagaaaagtcctccaagcacgcgagcgggtcgagcaaatgaaagaagaaaagaagaaacagattgaacaaaaatttgctcagatagatgagaagacagagaaggccaaagaagagagactggcagaggagaaggctaagaagaaagccgccgccaagaagatggaggaggttgaggcccgccggaaacaggaagaagaggcaaggagattaagatggctgcagcaagaggaggaagaacggcgacaccaggaattgcttcaaaaaaaaaaagaggaggagcaggagcggcttcggaaagctgctgaggcaaaaagattggccgagcagcgcgagcaggagaggcgggagcaggagaggagagaacaggaacgacgggaacaagagcggagggagcaagagagaagagaacaggaacggcaactagcggaacaagaaaggagaagagaacaagagcgccttcaggccgaacgcgagctgcaggagagggagaaggccctcagactacaaaaggagcaactgcaaagagaactcgaggaaaaaaagaagaaggaggaacagcagcgcttggccgaacgccagttgcaggaggaacaggagaagaaggctaaggaggctgccggggcctcaaaggcacttaatgtgaccgtcgatgttcaatcccccgcatgcaccagctaccagatgacaccccaaggtcatcgtgccccacccaagatcaaccctgacaactacggcatggacctcaactcagatgattccacagatgatgaagcccaccctagaaagcctatccccacatgggcccgcggaactccactctcgcaggcaatcattcaccaatattatcacccccctaaccttctcgaacttttcgggaccattttgccccttgatctggaagacatctttaagaagtcgaaacccaggtaccacaagagaacatccagcgcggtgtggaactccccgcccctgcaaggcgcccgggttcccagctctctggcctactccctgaagaaacattag

SEQ ID NO: 23120 - DNA, 4149 bp, Artificial Sequence
  Description of Artificial Sequence: Synthetic coding sequence
atggacgaggaggagaaccactacgtgagccagctgcgggaggtgtatagctcatgtgacacaaccggcactggtttcctggacagacaggaacttacgcagctctgcctcaaacttcacctggagcagcagctgcccgttcttctccaaacactcctgggcaacgatcatttcgcgcgcgttaattttgaggagttcaaagagggctttgtggctgtactatcttcaaatgccggcgttcgacccagcgacgaggattcctctagcctggaatctgccgcgtcctccgcaatccccccaaaatacgtcaacggctccaaatggtatggcagaaggtcacggccagaattgtgcgacgccgcaaccgaagctcggcgcgtgccagaacaacagacacaggcttccctgaagtctcatctttggagatcggcaagccttgagtctgtcgagagccccaaatccgacgaggaggctgagagtactaaggaggcacagaacgagttatttgaggcacagggccagctccaaacctgggactccgaggattttgggtcaccccaaaaatcatgctcgcctagcttcgacacacctgagtctcagatccgcggtgtatgggaagaactgggcgttggttccagcgggcatctcagtgaacaagaactcgccgtggtgtgtcaaagtgtcggcctgcagggacttgagaaagaagagctcgaggatctgttcaataagctcgatcaagacggcgacggcaaagtaagcctggaggaattccaacttgggttgttttcacacgagcctgcgctcctacttgagtctagtacccgcgtaaaaccttcaaaagcctggtcacattaccaggtccctgaggaatccggctgccacactaccacgacatcctcactcgtgtccttgtgttcgtctctcaggctgttctcctcaatcgacgatgggtccggctttgcttttccggatcaagtgctggctatgtggacacaggaagggatccagaacggcagagaaattcttcagtccttggacttttcagtggacgaaaaggtgaaccttcttgaactgacctgggccctcgacaacgaattaatgaccgttgattccgcagtgcagcaggccgccttggcctgctatcaccaggaactgtcgtatcagcagggacaggtggaacaactcgctcgtgagagagataaagcccgccaggatctggagagagcagagaagcgcaacctcgagttcgtgaaggagatggacgactgtcatagcaccctcgagcagctgaccgaaaagaaaatcaagcacttggagcagggctacagagagcggctgtctctgttgcggtcagaagtggaggctgagcgggagctcttttgggagcaagctcaccgacagcgggccgcgttagaatgggacgtaggtcggctgcaggcggaggaagcagggttgcgagagaagctgacacttgcactgaaggaaaattcgcggctgcagaaggaaatcgttgaggtggtggagaaactctccgacagtgagcggctggccctgaaacttcagaaagacctcgagttcgtacttaaggacaaactggaaccacaatcagccgagttactggcacaggaggagagattcgctgccgttctcaaggagtatgagctgaaatgtcgggatctgcaagatcggaacgatgagcttcaagccgaattagaagggctgtgggctcggctgcctaagaacaggcacagtccaagttggtcacccgacggtcggaggagacagctgcccggactgggccctgccggaatatccttccttggcaactcggctcctgtgagtattgaaacagaacttatgatggagcaggtgaaggaacactaccaggatcttcggacccagttggaaactaaagtcaattactatgagagggagattgctgcactgaagcgcaactttgagaaggagcgaaaggatatggaacaagcccgtcggcgtgaggtatccgtgctggagggccagaaggccgatctggaggagctgcacgaaaaaagccaggaggtgatttggggcctgcaggaacagttacaggatacagcccgggggcccgagcctgaacaaatgggcctggctccatgttgtacacaggctctgtgtgggctcgccctgcgtcatcacagtcacctgcaacaaattcgacgcgaagccgaggccgagctctctggggagctgagcgggttaggggctctgcctgccaggagggacctgaccctggaactggaggaaccaccacagggacctctccccagggggtcccagaggagtgagcagctcgaacttgaaagggccttaaagcttcaaccatgcgcttccgagaagcgagcgcagatgtgtgtctctctggctctcgaagaagaggagctagaattagccagaggtaagagggtggacggaccctccctggaggccgaaatgcaagccctccctaaggatggtctggtggcaggctctggtcaggagggtactcgcgggctgttgccactgagaccaggttgcggcgagcgtccgttggcgtggttggcccccggcgatggcagagaaagtgaagaggcagccggtgcaggccccagacggagacaggcccaggacactgaagctacacagagccccgcccccgctcctgcgcccgccagccatggcccctctgaacgctggtcacggatgcagccttgtggggtagacggtgacattgtgcctaaggaacccgaaccatttggcgctagtgcggccggccttgaacagccaggcgcccgggagctgcccctgctgggcaccgaaagagacgcctcacagacccagccacggatgtgggagccgccattgcggcccgcagcctcatgccggggtcaggctgagaggctgcaagcaatccaggaggaacgcgcccgctcctggtcacggggcacccaggaacaggcctccgaacaacaagcccgcgcagagggtgcactggaacctggctgccacaaacactcagtggaggttgcccgcaggggaagtctgccctctcatcttcagctggccgaccctcagggttcatggcaggagcagttggcagcccccgaggagggagagacaaaaattgcgctggagcgggagaaagacgacatggagacaaagctgcttcaccttgaggacgtcgtgagagcactggagaagcatgtcgacctgcgagagaacgacaggctggagttccaccgactgtcagaggagaatacgctgctgaaaaatgatttgggaagagtgaggcaggagcttgaagcagcggaatccacacacgacgcacagcgcaaggaaattgaggtgctcaaaaaggataaagagaaggcatgtagtgaaatggaggttctcaaccgccagaatcagaattataaggaccagctgagccagctgaatgtgcgagttctccagcttggtcaggaagccagcacccaccaggctcagaacgaagagcacagagtaaccattcagatgctgacccagtctctagaggaggtcgtgcggtccggccaacagcaatccgaccagatacagaagttgcgcgtggagttggagtgcctcaaccaagaacatcagtctttgcaactgccttggtcagaactgactcagactctggaggagtctcaggatcaggtgcagggggcgcatctcaggcttcgtcaggcacaggctcagcatcttcaggaagtgaggcttgtgccacaagacagagttgccgagttgcaccggctcctcagcctccaaggagagcaggctagaagacggttggatgcacagagagaagagcatgaaaaacagctgaaagccaccgaggaacgagtggaggaagcagaaatgattcttaaaaacatggaaatgctgctccaagagaaggttgataagctgaaggaacaattcgagaagaatacgaaaagtgacctactgctcaaggaattgtatgtcgagaatgcccacctggtcagggccctgcaggctacggaagagaagcaacggggggctgagaagcagtctaggctgctcgaggagaaagtgagggcattgaataaactcgtttctagaattgctcctgccgctctcagcgtgtag

SEQ ID NO: 23121 - DNA, 4383 bp, Artificial Sequence
  Description of Artificial Sequence: Synthetic coding sequence
atggccggccggcccctgcggatcggcgaccagctggtgctggaggaggactacgacgagacctatattccttctgagcaggagatactggaatttgccagagagattggaattgatccgattaaggaaccagagcttatgtggctggccagggagggtattgtcgcacccctgcctggcgagtggaaaccgtgtcaggatatcactggagatatttattatttcaactttgcgaacggtcagagcatgtgggatcatccctgtgacgaacattaccgctccttagtcatccaggagcgcgcaaaattgagcacttccggcgccatcaagaaaaaaaaaaaaaagaaagagaagaaggacaagaaagacagagatcctcctaaatcgagcttagctcttggctcatccctggcccctgtccacgtccctcttggcggactggcccctctgcgagggctggtggacactccaccaagcgcgttgcgcggctcccagtcggtctctttgggaagttctgttgaaagcggtaggcaactcggcgaactgatgctgccttcacagggcttaaagaccagcgcttatacaaaagggctgctgggatcgatatacgaggacaagaccgcactgagcttgctcgggctcggggaggagaccaatgaggaggatgaggaggagtccgacaatcagtctgttcatagctccagtgagccactacgcaatctgcaccttgatatcggcgcactgggaggggactttgagtacgaggaatccctacgtacatcccagccagaagaaaagaaggatgttagcctggacagtgacgccgctggacctcccacaccctgtaagccctcctcacccggcgccgattccagcctctcgtccgccgtgggcaagggtcgtcaaggcagcggcgctagacctgggctgccagagaaggaggagaatgaaaagagcgagcctaaaatctgtcggaacttggtgacacctaaagccgatccgaccggaagcgaaccagctaaggcctctgagaaagaggcacccgaggacaccgtggatgccggagaggagggctcacgaagagaggaggcagctaaagagcctaaaaaaaaggcaagcgccctggaagaagggtctagcgacgcgagtcaggaactggaaatctccgaacatatgaaagaaccccaattaagtgattcaattgcatccgaccctaagagctttcacgggcttgatttcgggttcaggagccgaatctcagagcatctcctggacgtcgacgtgcttagccctgtcttagggggagcttgtcgacaggcgcaacagccactggggattgaggataaagatgactcccaatccagtcaggacgaactgcagtccaagcagagcaaaggactggaggagcgtctgtctcccccgttaccccacgaggagcgggcccagtctccacctaggagcctggccacagaagaggagcccccacagggccctgaaggtcagccggaatggaaggaggcagaagagttgggtgaagactcagccgcttctctgtccctccagttgtctttgcaaagggaacaggcgcccagcccacccgctgcctgtgagaagggcaaggagcagcactctcaggccgaagagctaggcccgggccaggaggaggccgaagaccccgaggagaaagtcgccgtctctccaacaccgcccgtgagcccagaggtgagaagcaccgaaccagtcgcacccccggaacagctatctgaagccgcacttaaggcgatggaggaggcagtggcgcaagttctggaacaggaccagcgtcacctcctggaaagcaaacaggagaaaatgcagcaacttcgtgagaaattgtgtcaggaagaagaggaggagatcctgcggctccaccagcagaaagagcagagtctgtcaagcctgcgcgagaggcttcagaaagccatcgaggaggaggaggcacgaatgcgggaagaggaatcacaaagattgtcctggctcagggcccaggtacagagctctacgcaggccgatgaagaccagatacgtgccgagcaagaggcatccttgcagaagttgcgcgaagaactagagtcgcagcagaaagccgaacgcgcatctttggaacagaagaataggcagatgctcgaacagctgaaagaagagatcgaagcctctgagaagagtgagcaggcagctctgaatgccgccaaagagaaggccctgcagcagctgagagaacagctggaaggtgagcgcaaggaggctgtggcaactctggagaaagaacattcagccgagctggagcggctgtgttcaagcctcgaagctaagcaccgggaggtcgtgtcttcgttacaaaagaagatacaggaagcccaacagaaggaggaggctcaattgcaaaaatgtttgggccaggtcgagcatcgtgtgcaccagaagagctatcacgtggccggatacgagcatgagctaagttcccttctgcgggagaaacggcaggaagtggaaggagagcatgagcgacgtctggacaaaatgaaggaggaacatcagcaagtcatggcaaaggccagggagcaatacgaggctgaagaaagaaaacagagagccgaattgcttggccacctgaccggggaactggagcggctccagcgtgcccatgagcgcgagctggaaacagtacggcaggaacagcacaaaaggttagaagatcttcgcagacggcacagggaacaggagcgcaaattacaggatctggagctggatttggaaactcgggccaaggatgtgaaagcgcgccttgccctcttagaggtgcaggaggagacagcccgacgagagaagcaacaattgctagacgtacagcggcaagttgcactgaagagcgaggaagccaccgccacacaccagcagctggaagaagcccagaaggagcacacgcacttactgcagagtaaccagcagctacgcgagatcttggacgaattgcaggctaggaaattgaagctcgagtcacaggtagacctgttgcaggcgcagtctcaacagcttcagaaacatttcagcagcctggaagccgaagcccagaagaagcagcaccttctgcgcgaggtaacagtcgaagagaataatgcctctccccacttcgaacccgatcttcatattgaagacctccggaagagtcttggtactaatcaaacgaaagaggtgtcctcctcattgtcacagtctaaagaggatctatatctggattctctctctagccacaatgtctggcatcttctgagcgctgagggagtagccctgcgttcagccaaagaattcttggttcagcaaactcggtctatgcggagaagacagaccgctttgaaggcggcccagcagcactggagacacgagctagcttccgcccaggaggtggctaaggatccacccggaattaaggccctagaagacatgcgaaagaatctggagaaagagacgaggcacttagatgagatgaaaagcgccatgagaaagggtcataaccttctgaagaaaaaagaagaaaaactcaaccagcttgaatcttcactctgggaggaggcctctgacgagggaactttaggcgggtctcccacaaaaaaggctgtcaccttcgacctatccgatatggattctctgtcctcggagtcctcggagagtttcagcccacctcatagggagtggtggcggcaacaacgcattgacagcacacccagcctgacatcacgcaagatacacggcctatcccacagtttgcgccaaatcagctctcagttatcctctgttctgagcattctggatagtctgaacccacagtctccgcctcctctactcgcatccatgccagctcagctgccacctagggacccgaagtctactccaacaccaacctactatggctcactggcgaggttttcagctctcagcagtgcgacacctaccagtacgcagtgggcttgggattccgggcaaggccctcgactgccctcctcagtggcccagaccgtagatgactttcttctcgaaaagtggcggaagtactttcccagcggcatcccacttctgtctaattcgccgactcctttagagtctagacttggatacatgtcagccagcgagcaactccgcttgctccagcattcccattcccaggtacccgaggctggcagcaccacctttcagggtatcattgaagccaatcgtcgctggctggagagggttaagaacgatcctaggctaccactgttctcttccacaccaaagcccaaagcaaccctgtcgctactccaactgggcctcgatgagcacaatcgcgtgaaggtgtaccggttctag

SEQ ID NO: 23122 - DNA, 1881 bp, Artificial Sequence
  Description of Artificial Sequence: Synthetic coding sequence
atgatggccaacgacgccaagcccgacgtgaagaccgtgcaggtgctgagagacaccgcaaatcgactcagaattcactcgattcgcgcaacttgcgcctcgggttccggacaacttacttcgtgctgcagcgcggctgaggtggtatccgtgctgtttttccatacaatgaaatataagcaaacggacccagaacaccccgacaacgatcgttttatcctttcgcgggggcacgccgcccccatcctgtatgctgcttgggtggaggtgggggatatcagcgagagtgacctgctaaatcttcggaaactccatagcgacttggaacgacaccccaccccccgactgccctttgtcgacgtggcaaccggctccttagggcaggggctcggcaccgcgtgtggaatggcatatacgggtaagtacctggacaaggcatcctatcgggtcttctgtctcatgggggatggtgagtctagcgagggctcggtgtgggaggcgttcgcatttgcatctcactacaaccttgacaacctcgtggcagtttttgacgtcaataggctaggacagagcggacccgcccccctggaacacggagccgatatctaccagaattgttgcgaggctttcggctggaatacgtatctcgtcgacggacatgatgttgaagccttgtgccaggccttctggcaggcgtcccaagtgaaaaacaagcccacagctattgtcgccaaaactttcaagggccgcggtatacctaatatcgaggacgcggaaaattggcatggcaaaccagtgccaaaagaacgcgcagacgctattgtcaagctcatcgagtcgcagatccagactaacgagaacttaatccctaaatcacccgtggaagattccccgcagatcagcataacggacataaaaatgactagcccccccgcctataaggtaggggataagatagccacccagaaaacttatggattagctttggctaagctgggcagggcaaacgagcgcgtgatcgtattatccggtgacacaatgaactcgacattttccgagatcttccgcaaagagcatccagaacgatttattgaatgcatcatagccgagcaaaatatggttagcgtggcgctcggatgtgccacaagaggccggaccattgcttttgcgggcgcattcgccgcctttttcaccagggcattcgatcagttacgcatgggtgcaattagccaggcaaacattaacctgatagggtcccactgtggagtgagcacaggcgaggacggcgtaagccagatggccctcgaggatttggccatgttccggtctatcccgaattgcaccgtcttttacccaagtgacgccatcagcacagaacacgccatctacctggctgcaaatactaagggaatgtgtttcatccgtacaagtcagcctgaaactgctgttatttacacaccccaggagaatttcgagatcggacaggccaaagtggtccggcacggcgtgaacgataaagtcacagttatcggggccggcgtcactctgcatgaagctttggaggcagccgatcatctgtcccagcaaggcatctccgtccgggtgattgaccctttcactatcaagcctctcgacgccgctactatcatctccagcgcaaaggccacgggcggcagggtcattaccgtcgaggaccactatcgggagggaggaatcggtgaggctgtctgtgctgcagtgagccgagagccagatatcctggtccaccagttagccgtgagcggcgtgccccagcgcggaaagacctcagagctcttggacatgtttggcatatctactagacacattatcgcagcggtgacattgacgctcatgaagtag

SEQ ID NO: 23123 - DNA, 999 bp, Artificial Sequence
  Description of Artificial Sequence: Synthetic coding sequence
atggccaccatcaagagcgagctgatcaagaacttcgccgaggaggaggctatccatcataacaagatcagcattgtgggaacagggtccgtgggagtggcatgcgctattagcattctcctaaagggcctgtccgatgagcttgtgctggtggatgtggacgagggcaaattgaaaggagagactatggaccttcagcatggctcgccattcatgaaaatgccgaacattgtttcctcaaaggactacctagtgactgccaactctaatctcgtgattattactgccggcgcgcgccagaagaaaggcgagactcggttggatttagtacagcgtaatgtgagcatctttaaactcatgattccaaacatcactcagtattctccccattgtaagctcctcattgtcaccaacccagtggatattctgacttacgtagcctggaagctctcaggttttccaaagaaccgcgtaatcggcagcgggtgcaatctggattcagccaggtttcggtacttcattggacagaggttgggcattcacagcgagagctgccacggcctaattctgggagaacacggggacagttctgtgcctgtgtggtccggggtgaacatagctggcgtacctctcaaggatcttaatcccgacattggcaccgacaaggacccagagcagtgggaaaatgtccataagaaggttatttcttccggctatgagatggtgaaaatgaaaggatacactagctggggcatctcactgagcgttgccgatctgacagagagcattctgaaaaatctgcgaagagtgcatcccgtcagcaccctgtccaaaggactatacggtattaacgaagacatcttcttgagtgttccatgcatcctgggggagaatgggattactgacttaattaaagtgaaactgacccttgaagaagaggcgtgtcttcagaagtccgccgagacactctgggaaatccaaaaagaattaaaactgtag

SEQ ID NO: 23124 - DNA, 972 bp, Artificial Sequence
  Description of Artificial Sequence: Synthetic coding sequence
atgcccgagatgcccgaggacatggagcaggaggaggtgaacatcccaaaccgtagggtgctagttaccggggccactggtcttctagggagagcagtgcacaaggagttccagcaaaacaactggcatgccgttggctgcggattccggagagctagaccaaaattcgagcaagtaaatctcctcgactcaaacgcagtccaccatatcattcatgactttcagccccacgtaatcgtgcattgtgcagctgagcgaagaccggacgttgtcgaaaaccaacctgatgccgcatcccaacttaacgtcgacgccagcggcaacctcgctaaagaagccgcggctgttggtgcttttctgatttacatttctagtgattatgtgttcgatggcacgaaccctccttatcgtgaggaagacatccctgcccccctgaatttgtatggcaagaccaagctggacggtgaaaaagccgtcctggagaataacctgggcgctgctgtgcttaggattcctattctctacggcgaggtagagaaattggaagaaagcgccgtgactgtgatgttcgacaaggtacaatttagcaataagagtgccaatatggatcattggcagcagcgattcccaactcatgttaaggatgtggcaacagtttgcaggcagttagcagaaaaacgcatgttagatccgtccattaagggtaccttccactggtctggcaatgagcagatgaccaagtatgagatggcctgcgccattgcagatgcatttaatctcccctcctctcatctccggcccatcacggattctccagtgctcggagcccagcgtccaagaaatgcccaacttgattgttccaaactggagactttaggtataggccagagaacgccgttccgcatcgggatcaaagaatccttgtggcctttcctgattgataaacgctggcgccaaaccgtgttccactag

SEQ ID NO: 23125 - DNA, 3285 bp, Artificial Sequence
  Description of Artificial Sequence: Synthetic coding sequence
atggccgagagcagcagcgagagcgaccacttccggtgccgggaccggttgtccccttgggccgcaaggagcacccacagagggacccgcagcttgcccacagtagaggtgaccgaaaaagtgaacaccataacgtcgaccctccaggatacatccaggaacctccgacaagtggaccagatgctggggcgttatcgagagtattccaatggtcaggcaggtgctatcgagcatctgaaagagtccctcgaacaatcgatagaccagctccgatcccagcgtctgctgagaaacagcggtgggagatccatctctgtgacatccctgtccgcgagtgatctcgacggtggcaccgggagtgagctgcatcattttccccctaccagcccattaaaggactacggtgacccacaaggcatcaaaagaatgcggtctagaactggcgtgcggttcgtgcaagagaccgatgatatgacacagcttcacggatttcaccagtctttacgagacctgagttctgagcagataagactcggcgatgatttcaatcgcgagctgagccgtcgctccaggtccgacgcagagactaaacgagctctggaagagcttacagagaagcttaatgaggcgcagaagcaggaagtggtgtccgatagagttgagcggcggctgcaagagcttgagcgcgagatgcgcaccgagcgcgagctggtagagcgtcgacaagaccagttgggcctgatgagtctccagttgcaggaagcccttaaaaagcaggaagccaaagcagatgaacacgaaggcgcgatcaaaaacaagctgcggcagaccgagaccgaaaaaaatcagttagagcaggagctcgagttgagccgcagactgctcaaccaatcggagggtagtagagaaacactgctgcaccaggtggaggagctgcgcacccagttgaccaaggccgaaggggatagaaaaggtctgcagcatcaggtgagtcagatatccaaacagcagagcaattatcaggatgaacaaggggaggattggcgctttagacggggagtggagcgagaaaaacaagatttggagaaacagatgagcgacctgcgcgtacagctgaatttcagtgccatggccagtgaactggaagaggtgaaaaggtgtatggagcggaaagataaggagaaggcacacctggcgtcacaagtggagaacctaacacgcgaactagagaatggggaaaagcaacaactgcagatgctagatagattaaaggaaatacagaatcacttcgacacatgtgaggcagagaggaagcacgccgatttacagatttcagaattgacgaggcatgcagaggatgccaccaagcaggctgagcggtatttgtccgaactgcagcagagcgaggctctgaaggaagaggccgaaaaacgccgggaggaccttaagctaaaagcacaggagagcatcaggcagtggaaacttaagcacaaaaagctcgaaagggctctcgaaaagcagagcgaaacagtagacgagttaactgggaaaaataatcagatcttgaaagaaaaggatgagctgaaaacacagctctatgccgcactccagcaaatcgagaatctgagaaaggaattaaacgatgtgcttaccaaacgggccctccaggaagaggaactacattccaaggaggagaagctgagggatatcaagtcccaccaggctgaccttgagctggaggtgaagaacagtctagatacaatccacagactggagtcagagctgaaaaagcagtcgaagatacagtcccagatgaaagtggagaaagcccatctagaagaggagatcgccgaattgaaaaagtctcaggcacaggacaaagccaagctgctcgagatgcaggagtccattaaagatctgagtgctattagagcagatcttgccaacaagctcgcagaagaagagcgggccaagaaggctgtactgaaggatctgtccgacctgactgcccaggcaaagagccgcgacgaagaaaccgccactattattacacagttgaagcttgagagggacgtgcaccagcgggaattgaaggatctcacctcatctttgcaaagtgtcaaaactaagcacgaacagaatattcaggaactcatgaagcatttcaaaaaggagaagtccgaggcagagaatcatatcagaaccctgaaagcagaatcgctggaggaaaaaaacatggccaaaatccaccgaggacaactggagaagcttaaaagccagtgtgatagattgacagaggaactaacacagaatgagaatgaaaacaaaaagcttaaactaaaatatcagtgcttaaaggatcagttggaagagcgagagaagcatatttctatcgaggaggaacacctacgacgaatggaagaggcccgcctgcagctgaaggaccagctgctgtgcttagagactgagcaagaatctatcctaggtgttattggaaaggaaattgacgcagcttgcaagacatttagcaaggactccgtggagaaactcaaggtgttttcaagcggacccgacattcattacgacccacacagatggctggccgagtccaaaaccaagctacagtggctgtgtgaggaactgaaggagagagagaatcgcgagaaaaatctgcgtcaccagctaatgctctgccggcagcagctacgaaacttgaccgagaataaagaatctgagcttcagtgcttattccaacagatagaacgtcaagaacagctattggatgaaatacatcgggagaaaagagatttattggaggagacccaacgtaaggatgaggagatggggagcttacaggatagggtgatagcactcgaaacatctacccaggtcgctctggaccacttggagagtgtaccagagaagctgagcctgctggaagacttcaaagacttccgtgattcttgttcaagcagtgagcgcactgatggtcggtatagcaaataccgcgtgaggcggaacagcctgcagcaccatcaggatgacacgaagtatagaacaaaatccttcaaaggggacagaaccttcctcgaaggaagtcacacaagaggcttagatcatagctctagctggcaagaccacagcaggttccttagcagccccaggttcagctacgttaatagctttacaaagcgtaccgtggctccagactcagccagcaacaaagaagatgctacgatgaacggcacttccagccagccgaagaaagaagaatacggttcctag

SEQ ID NO: 23126 - DNA, 1011 bp, Artificial Sequence
  Description of Artificial Sequence: Synthetic coding sequence
atgaagaaggagcacgtgctgcactgccagttcagcgcctggtaccccttttttaggggagtgacaataaagagtgtcattctacctctcccacaaaacgtgaaagattacctcctggacgatggcaccttggttgtcagcggcagggacgatccacctacccacagtcagcccgacagcgatgacgaggccgaagaaattcaatggagtgatgatgagaataccgctacattgacagctcccgagttcccagaattcgccaccaaagtccaggaagccattaattccctggggggaagcgttttccccaaactgaattggtctgcccctcgggatgcctattggattgccatgaattcctccctgaagtgtaaaaccctctccgacatcttcctgctctttaagtcctctgatttcatcactcgcgacttcacccagccctttatccactgcacagatgattcaccggacccgtgtatagagtatgagctggtgctccggaaatggtgcgaattgatccccggcgcagagttccggtgcttcgttaaggagaacaagttgattggaatctctcagcgcgactacacccagtactacgaccacatttccaagcagaaagaggagatcagacggtgtatccaggacttcttcaaaaagcacatccagtacaaattcctggacgaggatttcgtatttgacatctatagggattcaagaggaaaagtatggttgatcgactttaaccccttcggcgaagtcacagattcactcctgtttacctgggaggaactgatcagcgagaataatctgaatggagacttctcggaagtagacgcccaggagcaggacagtcctgcgttcaggtgcacaaatagcgaagtgacagtccagccgtccccctacctgagttatagactgcctaaggattttgtggacttatccaccggcgaggatgcccacaagctgatagatttcctgaaactgaagaggaatcagcaggaagatgactag

SEQ ID NO: 23127 - DNA, 1248 bp, Artificial Sequence
  Description of Artificial Sequence: Synthetic coding sequence
atgaagctgagcctgaccaaggtggtgaacggctgccggctgggcaaaattaagaatctgggtaagactggggatcatactatggacatcccagggtgcctgctctatactaaaacagggtccgctcctcatctgacacatcacaccctgcacaatattcatggagttcctgcgatggcccagctgacactatctagtctcgccgaacatcacgaggtcctcacagaatacaaagagggggttggaaaatttatcggcatgcctgaatccctactgtattgttcactgcacgatccagtgagcccctgtcccgccggttacgtaacaaacaagtccgtgtccgtgtggtctgtcgccggaagggtggaaatgactgtttcaaagttcatggctatacagaaggcgttgcagcccgattggttccaatgtctctctgatggagaagtgagctgtaaagaggccacaagcatcaaaagagtgcgaaaaagcgtagatcgcagcctgctctttttggataactgtctgaggttgcaagaggaatcagaagttctgcagaaatccgtgattatcggcgtaatcgaggggggtgacgtcatggaggagcggctcaggtctgctagagagacagccaagcgacccgtggggggcttcttgctcgatgggtttcaggggaaccctacaacattggaggctaggctgagactcctgtccagcgtgactgctgaactgcctgaagacaaaccccggttaatcagcggggtatctcgaccagatgaagtgctcgagtgcatcgaacgcggagtcgacctcttcgagagttttttcccatatcaagtgaccgagagggggtgtgccctgaccttctctttcgattaccagcccaacccggaggaaaccttactgcagcagaacggtactcaggaagaaattaaatgtatggaccagatcaagaagatagaaacaacgggctgcaatcaagaaatcacctccttcgagatcaatttaaaggagaagaagtaccaggaggatttcaacccattggtgagaggatgcagttgctactgttgcaaaaaccatacccgagcatatattcaccacctcctcgtcacaaatgaattacttgccggggtgctgctcatgatgcataactttgagcactattttggattctttcattatatcagggaggccctgaaaagtgacaaactggcacagctaaaggagctcattcatagacaggcaagttag

SEQ ID NO: 23128 - DNA, 1770 bp, Artificial Sequence
  Description of Artificial Sequence: Synthetic coding sequence
atgcccaccgtgagcgtgaagcgggacctgctgttccaggccctgggccggacatatacagacgaggaatttgacgagctctgttttgagttcggcctcgagcttgatgagattacgagtgagaaagagatcatctccaaggagcagggcaacgttaaggctgcaggagccagtgatgtggtcctgtataagattgatgtgcctgccaaccggtacgacctattgtgcctggaaggactggtacgcgggctgcaggtgttcaaggagagaatcaaagcacctgtgtacaagcgggtaatgcccgatggaaagatacaaaagcttattataacagaagaaactgctaagatccgaccgtttgccgtggctgccgtcctccggaacatcaaatttaccaaggataggtacgactcatttattgaactgcaggagaagcttcatcaaaacatatgtagaaagcgggcactggtggccatcgggactcacgatttggataccctgtcaggcccttttacatatacagccaagcgaccctctgacattaagtttaagcccctcaacaagacgaaggagtacaccgcgtgtgaacttatgaacatctacaagacagataatcatctcaagcactacctgcatattatcgagaataagcccctgtaccccgtgatttatgactcgaatggggtggtgctgtccatgccacctattatcaacggcgatcattcgaggattactgttaacactaggaacatcttcattgagtgcaccggcaccgatttcaccaaagcaaagattgtgcttgatataattgtgactatgtttagtgagtattgcgaaaaccagttcacggtcgaagccgccgaggtggtgtttcctaacggcaagagtcatactttccccgaactggcgtatcggaaggaaatggtgagagccgatctaatcaataaaaaagtaggcattagagagacaccagaaaacttggcaaaactcctcactcgcatgtacctgaagtcagaggtgatcggtgatggtaaccagatcgaaatcgaaatccctcccacacgcgccgatatcattcacgcctgtgatatagtggaggacgccgccatcgcctacggatacaacaacatccagatgactctcccaaagacctatacgatagctaaccaatttccactgaataaactgaccgagctcctgagacacgatatggccgccgcaggatttacagaagctctgacttttgctctttgcagtcaggaagatatcgcagataagttgggagtcgacataagcgccaccaaggcagtacatattagcaatcccaaaacagcagagtttcaagtcgcacgcaccactcttttacccggtctgctgaagaccatcgccgccaaccgcaaaatgcctctgccactgaagttgttcgagatctcggacatagtaatcaaggactcgaacaccgacgtgggcgccaaaaactaccgccacctgtgcgctgtttactacaataaaaatccaggcttcgaaattatccatggtctgctagatagaatcatgcagctgctggacgtaccccctggagaggataaagggggctatgtgatcaaggccagcgagggaccagcctttttcccagggcggtgcgccgaaatcttcgccagaggccagagcgtgggaaagctgggggtgctccatcccgatgtgatcacaaaatttgagctcacaatgccttgtagttctctcgagattaacgtaggcccattcttgtag

SEQ ID NO: 23129 - DNA, 477 bp, Artificial Sequence
  Description of Artificial Sequence: Synthetic coding sequence
atggccgcccagggcgtgggccccggccccggcagcgccgcccccccaggactcgaggcagcccgccaaaagcttgccctgcgcagaaagaaggtgctgagcactgaggagatggagctgtacgagcttgcacaggctgctggaggggcaatcgatccagatgtgtttaagatcctcgtagacttactcaagcttaatgttgcccctctcgccgtgttccagatgttgaagtcaatgtgcgcaggccaacgactagcctctgaacctcaggatcccgccgcggtgagccttccaacttcatctgtgccagaaactcgagggagaaacaaagggtcagcagctctggggggggcactcgctctcgccgagcgatcttctagggaaggctcctctcagcggatgccaaggcagcccagcgccacccgcttacccaagggcggcggacctggaaaatcccctacgcgggggtcaacatag

SEQ ID NO: 23130 - DNA, 675 bp, Artificial Sequence
  Description of Artificial Sequence: Synthetic coding sequence
atggtggaggacgagctggccctgttcgacaagagcatcaacgagttttggaataagtttaagtccaccgacacttcatgtcagatggccggcctcagagatacctataaagactccatcaaggcctttgctgagaaactgtccgtcaagctgaaggaagaagagagaatggtagagatgtttcttgaataccaaaatcagataagccgacagaacaagttgattcaggaaaagaaggataatctcctgaagctaatcgcagaggtgaagggaaaaaaacaggaactggaagtgttaaccgcaaatatccaagatctaaaagaggaatactctcgaaagaaggagacaatctctaccgctaataaggccaacgctgagcggctaaaaaggttacagaagtcagcggacctgtacaaggataggctcggccttgaaatccggaaaatctatggtgaaaaattgcaatttatatttacaaatatagaccctaagaatcccgagagcccattcatgtttagtctgcacctcaacgaggcgcgcgactatgaggtgtcggactcagcacctcacctagaggggctcgctgaattccaagagaacgtccgcaaaactaacaacttcagcgctttcctggctaacgttcgcaaagctttcactgccactgtctacaattag

SEQ ID NO: 23131 - DNA, 1728 bp, Artificial Sequence
  Description of Artificial Sequence: Synthetic coding sequence
atgaagctgaccgacagcaccaagggctggatcgtgtgggccgccctggatagttctatgcgcgggatgagcctgtctgcaggatctagccccctccactccccaaaaatcacacctcatacatccccagcccctcggcgccgctcacacaccccaaatcccgcctcctacatggtcccttcctctgcaagtactagcgtaaacaacccggtatcccagactcccagctctggtcaggttattcagaaggagacagtgggaggcaccacctatttttacaccgacacaacacccgctcctttgaccgggatggtgttccccaactatcacatatatccacccaccgcaccccacgtggcatatatgcagcccaaagcaaacgcgccctcattctttatggccgatgagctgcggcaggagttgattaaccggcacctcatcacaatggcacaaatagaccaagcagatatgccagcggtgcctaccgaggtggattcttaccatagtttattcccactggagcctctcccgccgcctaaccgcatccagaagtcaagtaatttcgggtacataacttcctgttacaaagctgttaatagcaaagatgatcttccttactgcctgcgacgcattcacgggtttcgcttagtgaacacaaagtgcatggtgcttgtggacatgtggaaaaaaattcagcatagcaacatagtgaccctcagagaggtgttcacaacgaaagccttcgctgagcccagcctagttttcgcttacgacttccacgcaggcggggagaccatgatgtcccgacatttcaacgaccccaacgcagatgcgtactttactaagagaaaatgggggcagcacgaagggccactaccgcggcagcatgccggactactgccagagtccctgatctgggcctacatcgttcaactgtcaagtgcattgagaacaatccatactgccggattggcttgcagggtgatggatccaactaagattcttatcaccggtaagaccagattgcgcgtcaactgtgtcggcgtgttcgatgtactgactttcgacaactcccagaacaataaccccctagcccttatggcgcagtatcaacaggcagacctgattagtctcgggaaggtggtgcttgcactcgcatgcaacagcttggccggcattcaaagagagaatttgcagaaagcaatggagctggttacaattaactacagctctgatttgaagaacttaattctctacctactgactgatcagaaccgaatgagaagcgtcaatgatatcatgcctatgataggcgctcgtttttacacgcagctggatgcagcccagatgagaaacgacgtaatagaggaggatctcgccaaggaggtgcagaacgggaggctgtttcggctcctagcgaaactgggtacgattaacgaaaggcctgaattccagaaagacccaacctggtctgagacgggcgaccggtatctgcttaaactgtttcgggaccatctgttccaccaggtcactgaagcaggggctccctggattgatttgtcccatatcatatcttgcctgaacaagctggatgctggagtgcccgagaagatctcactcatttcccgggatgagaagtcagtcttagtcgtgacatatagtgacctaaagcgatgcttcgaaaacacatttcaggagctgattgcagctgccaacggacaattatag

SEQ ID NO: 23132 - DNA, 1785 bp, Artificial Sequence
  Description of Artificial Sequence: Synthetic coding sequence
atggagagcaaccacaagagcggcgacggcctgagcggcacccagaaggaagccgctctgcgcgctttggtgcagcgaactggttatagcctagtgcaggaaaacggtcagcggaagtacggcggaccaccgcccggatgggacgccgcccccccagagcgcggctgtgagatcttcattggcaaactgccccgcgacctttttgaggatgagttgattcccctctgtgagaaaatcggcaaaatctacgagatgcgaatgatgatggatttcaacgggaataataggggctatgcgtttgttacatttagcaacaaggtagaggccaaaaatgctattaagcagctgaataattacgagataagaaacgggaggttattgggcgtttgtgccagtgtggacaattgcagactgttcgtcggagggatacctaagacgaagaagcgcgaggagattctgtccgagatgaagaaagttacggagggcgtggtggacgtaatcgtttatccttctgcggctgacaaaactaagaaccgtggctttgcatttgtcgagtacgaatcccacagagcagccgctatggcccgaagaaagttactgccaggccgaatccagctgtgggggcatggcatcgccgtggactgggctgagcccgaagtggaagtcgatgaggacaccatgtctagcgtgaaaattctgtacgtcaggaatcttatgctgtctacatctgaggaaatgatcgaaaaagaatttaataatataaagcctggagcagtggaaagggtgaagaaaatcagagactacgccttcgtacacttctctaatcgggaagacgcggtcgaggccatgaaagccctcaacggaaaggtgctagacggctctcctatagaagtcaccctcgctaagcccgtggataaggacagctatgtccggtatacacggggcaccggtggacgcgggacgatgctgcagggcgagtatacgtatagccttggccaagtctacgatcctaccactacatatctgggcgcaccggtcttctacgcaccccagacctatgccgccatacctagcctgcactttcctgcgaccaaaggccatctctccaaccgcgctatcatccgcgcacccagcgtgcgcgagatctacatgaatgtaccagtgggtgcggcaggtgtgaggggtttaggcggccgggggtacctggcatacacaggtttgggaagggggtaccaggtgaagggggacaaacgcgaggataagttgtatgacatattacccggaatggagttaactcccatgaatccagtgacccttaaaccacagggtattaagctggcccctcagatcctcgaagagatctgtcagaagaacaattggggccaaccagtttaccagttacattctgctatcggacaagaccagcgacagttgtttctctacaagattacaattccggccctcgcctcccaaaaccccgcaatacacccatttacacctcccaagttgtctgcttttgttgatgaagctaaaacctacgccgcggagtatacgctccaaacactgggcatccccacagatgggggggatggcaccatggccacagctgccgctgctgcaaccgccttccctgggtatgcggtccctaacgcgacggctcctgtgagcgctgcacagctcaaacaggcagttacgctgggtcaggatctggctgcctacacaacgtacgaggtataccccactttcgccgttaccgctcgaggcgacgggtacggtaccttctag

SEQ ID NO: 23133 - DNA, 1167 bp, Artificial Sequence
  Description of Artificial Sequence: Synthetic coding sequence
atgctggagggcagctggatcaaccggcgggaggacaagctgggcgtctattctctggtgcacttttccccaaagatgctgggctccgtggccactacactgcctcttagttccagtaatagcagtgggatgccgctggggtactacttgagttcaccacaaatcagcagggttaccatttctaccaccgggcaactgacctccaaggcaaccgtggggtcctgctctcgcgtggaaaattccttagatgcaagccctttttctgtccctaaaaagcaggatgaaagccccatgatcggggacggggaggactacttcctgagcctcttcggggatagcaaaaagctcaccgcccacagcaattatacacaaaagaccctgaagtatttctccatgattcttgaggaggtaggccaatttaccagctccagcctgggagatgtcgagattgccgaagtgaacgtcaaggggctgttcgttaaattgatcaacagttcccttgacaaagaaatggctatcggcgatcatatcttgcagcaaaatgtaaacggtcaaacaatttctttgtatcgatttctgcccaatatcgtgatgcaggccaatagtaccgtcacagtgtgggcagcggcctcagaagccaaacaccagcctccttctgatttcttgtggaaggaacaggataaatttcgcgccagtccggattgtatcaccatcttatgcaagccaaatggccaagcaatagcttggtatactccgatccattggaagcaggcctgggaaaaactcgatgctgatgtagagttcaaccgctgttcggtagtctctcctacattccggaaacgggtctttcaatggactgcgtccaccgctacaattaccaaagagaagcaagatcagcccaagaaggatatttcaaactatcaggttgagcaggcccaggtgctgctgaagagggagaaggaaattcctcccacagtcttccccaaccggtccccatggtgccagaatccctacgtctccgcgcatccctactgccccctgatcgaaccacacaacacatctacagccggaggccggttggacagacaaccccggactaggtccactcggcctaatcgagcgtccggaagcaaaaaaaagaaaacctccgagtcgcagaaacagtag

SEQ ID NO: 23134 - DNA, 744 bp, Artificial Sequence
  Description of Artificial Sequence: Synthetic coding sequence
atggaggagcagccccagatgcaggacgccgacgagcccgccgactcgggaggcgagggccgcgcaggggggccgccacaggtggccggtgcccaggccgcgtgctctgaagatcggatgactttgctactccggctgcgcgctcagaccaaacagcagctcctcgagtacaagtccatggtggatgccagcgaggagaagacccccgaacagatcatgcaggagaagcaaatagaagcgaagatagaggatctcgagaacgaaattgaagaggtgaaggtggcctttgaaattaaaaagctggcccttgacaggatgaggcttagcaccgcccttaagaagaatctggaaaaaatatcacgccaatctagtgtacttatggacaatatgaaacatctgctggagttaaacaagctgatcatgaaatcccagcaggagagctgggacctggaggaaaagcttctcgatattaggaaaaagaggttgcagttgaagcaggcctcagaatctaaactcctcgagatccaaactgaaaagaataagcagaaaattgatctggatagtatggagaattcggagcgtataaaaatcattagacagaacctgcagatggaaattaagattacgactgtaatccagcatgtgttccaaaacttgatactgggctcaaaagtgaattgggcagaggacccagctcttaaagagatagtactgcagctcgagaaaaacgtggatatgatgtag

SEQ ID NO: 23135 - DNA, 1458 bp, Artificial Sequence
  Description of Artificial Sequence: Synthetic coding sequence
atggagttcctgggcaccacccagaccgccagctactgcggccccaagaaatgttgcggcctcacgtctttgccggcagtgcaggctcctgttatccaggaatgctaccagccatactacctgccagggtaccggtacttgaacagttggagaccttcgctgttctacaaaatagcgaatgtacagacatgccccgatgagtccactagtaccctgagaccacccactatcctaccgaccctgagatctgccctcttctctcgatattcaccacacgattgggaccagtccaaccagcttcaggtgcgtggtgctgaggcgagtcgcttgtgggcgtcacggcttactgatgacagtatgaggctcctccaagataaagatcagttgacccaccagatgcaagagggaacctgcagaaacctgggccaacggctgagcgacattgggttctggaagagcgagctgtcctatgagctggacagactactcacagaaaaccagaatttggagaccgttaagaggcggttagagtgtgccgccaatgaggttaactgccctctgcaggttgctctggaatgtctctatcatcgggaaaaaagaattggaattgacctggttcacgacaatgtagaaaaaaacctgattagggaggtcgatctcctcaagtgttgccaggaacagatgagaaaacttgcccagcgaatcgacatccagatgcgtgacaaccgtgatgcccagcacgttctggaaagggacctggaggacaagtcctctgcccagtgcatcgacgagaagtgcttcaacttgcggaatacatctgactgcatcagcttctttcacggaatggaaaaaattgatggaactatcagcgttcctgaaacttgggctaaattcagtaatgataacatcaaacattctcagaacatgcgtgccaattcaattcagctgcgtgaagaagctgagcacctgtttgaaacattgtcagaccagatgtggcgacagttcactgacacgaacctcgctttcaatgccagaatctctgaggtcaccgatgtgaaaaataagcttcaaactcaactggccaaaaccctacaggaaatcttccaggccgaaaacactatcatgctcttagaacggtcaatcatggccaaagaaggacccctcaaggtggcgcagacgcgactcgaatgtcggaccagaagacctaatatggaattatgcagagatatcccccagctgaaactagtgaatgaggtttttaccatcgatgatactctccagacgttgaagctacgcctgcgagagacacaggatacgctccaactgttggtgatgacaaaatgcaggctcgagcacgaactggccattaaggcgaacaccctctgcattgataaggagaagtgcatggggatgagaaagaccttcccgtgcactcctcgcctggtaggccacacgtag

SEQ ID NO: 23136 - DNA, 837 bp, Artificial Sequence
  Description of Artificial Sequence: Synthetic coding sequence
atgggcaagagcagcgagtggtgcgagcggatcgccggcatccagaagttcgtgctggagaaatggactaagaaggctaagcctgaagatactttgaatctttgtcagctgttaaataacgacttggcttcaactgtggtgtcctatccccgtcgttttgtgggcctggggacattgcctatgcaggctccagagctggcggtcaaggagatggagcgttgcgtgaaggagttggggttccctggggtacagattggaacccacgtcaacgagtgggacttaaacgcacaggagcttttcccggtctacgcagctgcggaacgcctcaaatgttctctcttcgttcatccctgggacatgcagatggacggcaggatggccaaatactggcttccctggctcgtggggatgcccgccgagaccaccattgccatttgttccatgatcatgggtggtgtcttcgaaaagttcccaaagttaaaggtttgtttcgcccacgggggcggcgcgtttccttttactgtgggacggattagtcatgggtttagtatgcgacccgacctatgcgcccaggataatccaatgaacccaaaaaagtacctgggttctttttacactgacgctctggtacacgatcctctatctctgaagctgctcacagacgtcataggaaaggacaaagtgatccttgggaccgactacccctttcctctgggagagttggagcctggtaagctgatcgaatccatggaggagttcgacgaggaaactaaaaataagctgaaagcaggaaacgcccttgccttcctgggcttggagagaaagcagttcgaatag

SEQ ID NO: 23137 - DNA, 2478 bp, Artificial Sequence
  Description of Artificial Sequence: Synthetic coding sequence
atgagcagcagccccgtgaacgtgaagaagctgaaggtgagcgagctgaaagaggagctcaaaaaacggcgtctctccgataaagggttgaaagcagagttgatggagcgcctgcaagctgctttagacgatgaagaagcgggagggcggcctgccatggaaccaggaaacggatcactagacctcggtggggactccgccggaagatctggggctggcctggagcaggaggctgccgctgggggtgatgaggaagaggaggaggaggaggaagaagaggaaggcatcagcgccctggacggcgatcagatggagctgggggaggagaatggcgcagccggcgcagccgatagtggccctatggaggaagaggaggccgcctctgaagacgagaatggcgatgaccagggatttcaggagggagaggacgagcttggggacgaagaagagggtgcaggagatgaaaacggtcatggagagcagcagcctcagccccctgctactcagcagcagcagcctcaacagcagcgaggcgccgctaaggaggcagcaggaaagtcttcaggaccaacttcattgttcgccgtaactgtcgccccacctggtgcccggcaggggcagcagcaggctggagggaagaaaaaagctgagggtggaggtggcggaggacgacccggggcgccggctgccggagatgggaagactgaacagaagggaggggacaagaaacgaggcgtcaagcgcccacgagaagatcacgggcgaggatattttgagtacattgaggagaataagtatagccgcgccaagtcaccgcaacccccagtggaggaagaggacgagcatttcgatgacacagtggtttgcctggacacttacaactgcgacctgcacttcaaaatttctagggaccgactctctgcatctagcctcacgatggagtcgtttgccttcctttgggctggtggcagagcgtcctacggggtctccaagggaaaggtgtgttttgagatgaaggtgacagaaaagatacccgttagacacctgtatacgaaggacattgacattcacgaggtgaggattggatggagtctaaccacatctggtatgctgctcggtgaagaagaattttcttacggctatagcttaaaggggattaaaacttgtaattgcgagaccgaggactacggagaaaaatttgacgaaaatgatgtgattacctgctttgctaatttcgagagcgacgaagtggagctgtcctatgcaaaaaatggacaggaccttggcgtcgcttttaaaatcagcaaggaggtgctagctggaaggcccctcttccctcacgtgctctgccacaattgcgcagtggagttcaactttggtcagaaggagaaaccttacttccccatccctgaagagtataccttcatccagaatgtcccactcgaagacagagtgaggggaccaaagggtcccgaggagaagaaggattgcgaggtcgtgatgatgataggcttgccaggagctgggaagaccacctgggtgaccaaacacgcggcagagaacccgggcaagtataatatcctgggaaccaatacaatcatggacaagatgatggtggccgggtttaaaaagcagatggcggataccggtaaacttaataccctgcttcaaagagctccacagtgcctggggaagttcattgaaatcgccgcgaggaagaagaggaactttatacttgaccagaccaatgtctccgctgcggcacagagacggaaaatgtgtcttttcgcagggtttcaacggaaagctgtggtcgtgtgtccaaaggatgaggactataaacagcgcactcagaaaaaggcagaagtcgaaggaaaagatctgccagaacacgctgttctcaaaatgaaagggaatttcactttgcctgaggtggcggagtgttttgatgagatcacctacgtcgagctgcagaaggaagaggctcagaagctcctggagcagtacaaagaagaatccaagaaggccctgcctccagaaaagaaacagaacacaggtagcaagaaatcaaacaagaacaagagtggaaagaaccagttcaatcggggcggcggacacagaggacgtggcggcttcaatatgcgcggggggaatttccgcggcggagcacccggtaacaggggagggtacaataggcggggaaacatgccccagagaggcggcggaggcgggggttctggggggattggctatccttaccctagagcaccagtgttcccaggccgggggagctatagcaatagagggaactacaacagaggtggcatgccgaaccgtggtaattataatcagaacttccgtggacgtgggaataacagaggttacaagaaccagagccaggggtacaatcaatggcagcaaggccagttttggggacaaaaaccctggtcacaacactatcatcaggggtattactag

SEQ ID NO: 23138 - DNA, 945 bp, Artificial Sequence
  Description of Artificial Sequence: Synthetic coding sequence
atgcagaacgtgatcaacaccgtgaagggcaaggccctggaggtggctgagtaccttacacccgtcctcaaggaatcaaagtttaaggaaaccggtgttatcaccccagaagagttcgtggcagccggggatcacttggtccatcattgtcctacgtggcaatgggccaccggcgaggaactcaaggtgaaagcatacctgcccacgggtaagcagttcttggttaccaaaaatgttccctgttacaagagatgcaagcagatggaatactcagacgagcttgaagccattattgaagaggacgatggagatggcggctgggtcgacacgtaccataacaccggtatcactggcatcacggaagctgtgaaggagattacacttgagaataaagataatatcaggctgcaggattgttccgcactctgcgaggaggaggaggacgaagacgagggtgaggcagccgatatggaggagtacgaagaatcaggactgcttgagaccgacgaggcaaccctggacacaaggaaaatagtggaagcctgcaaggcaaaaactgacgccggcggagaggatgctatactgcagacacgtacctatgatctttatataacatatgacaagtattaccagacaccgcgcctttggctgtttggatatgacgaacaacgacagcctctgactgttgagcacatgtacgaggatatcagtcaagaccacgtgaagaaaacagtgacaatcgagaatcaccctcatttgccaccgcccccgatgtgttctgtccacccctgcagacatgcagaagttatgaagaaaataattgaaactgtagccgagggaggaggagaactgggtgtacacatgtacctacttatatttctgaagtttgtgcaggccgtgatccccaccatagaatatgactacaccaggcactttacaatgtag

SEQ ID NO: 23139 - DNA, 900 bp, Artificial Sequence
  Description of Artificial Sequence: Synthetic coding sequence
atggtggacaagaagctggtggtggtgttcggcggcaccggcgcccagggaggatccgtggcgagaaccctcctggaggacggcacctttaaagtgagagtcgtgacaaggaatcctagaaagaaggctgcaaaggagctcaggctccagggcgctgaagtcgtccagggggatcaagacgatcaggttattatggagctggctctgaatggggcctacgctacattcattgtgactaattactgggaatcctgtagccaggagcaagaagtaaagcaaggcaagctgttggctgacctggctagacgcttggggctccattatgtggtgtattcaggcctggaaaacatcaaaaagctcaccgccggcagactcgctgcagcccacttcgacgggaaaggtgaagtcgaggaatattttagggacataggagtcccaatgacgtccgtaaggctcccctgctattttgagaaccttctctctcattttctgccgcagaaagcccctgatggcaagtcttacctcctgtccctccccacaggcgacgtgccgatggatggaatgagcgtctccgatctcggcccagttgttttaagcctgctaaagatgcccgaaaaatatgtcggccaaaatattggcctctccacctgtagacacacggctgaggagtatgccgcactgctgactaagcacacacgcaaggtcgtccacgatgctaaaatgacacctgaagattacgaaaaacttggatttcccggtgcaagagacctggccaacatgttcaggttctatgccctgcgacctgacagggacatagagcttaccctgcgtctgaatcctaaagccctcaccctcgatcaatggcttgagcaacacaagggcgatttcaacctgctctag

SEQ ID NO: 23140 - DNA, 2571 bp, Artificial Sequence
  Description of Artificial Sequence: Synthetic coding sequence
atggacatcagcaagggcctgcccggcatgcagggcggcctgcacatttggatttccgaaaataggaagatggttccagttcccgagggggcgtacggaaactttttcgaagagcactgctacgtgatcttacatgtgccgcagtcacctaaagccacgcagggggcatcatccgatctgcactactgggtgggcaagcaggctggtgcggaagcccagggcgccgccgaggcatttcaacagcgacttcaggacgagctgggaggacagactgtactccacagagaggcccagggtcatgagagtgactgtttctgtagctactttcgacccggcatcatctaccggaagggcggactggcctctgacttaaagcacgttgaaacgaatttatttaacatacagagactgttgcacattaagggacggaagcacgttagcgctaccgaggtcgagctctcctggaatagcttcaacaagggtgatatatttctgttggacttaggcaagatgatgattcaatggaatggccccaagacgtcaattagcgaaaaggctcgtgggctggctttgacctacagtctgcgggatcgggagaggggcgggggtagggcccagatcggtgtcgtggatgacgaggccaaagctcctgatttaatgcagatcatggaagccgtcctcggcagacgtgtaggatcactcagggcagccactcctagcaaggatataaatcagctgcagaaggccaatgtgcgattgtaccatgtctatgaaaaaggaaaggacttggtcgtgcttgaactcgccactccacctttaacccaagacctgctacaagaggaggacttctacatccttgaccaggggggctttaaaatctacgtgtggcaagggcggatgtcttctcttcaggaacgaaaagccgcattttcacgggcagtggggttcattcaagccaagggctaccctacttacaccaatgtggaagtggtgaatgacggggcagaatctgccgctttcaagcagctattccgaacgtggtccgaaaaaagacggcggaaccaaaagctgggcggtcgggataagtcaattcatgtcaagcttgacgtggggaagctgcacacacagccgaagttggccgcccaactgcgaatggtagacgatggctcgggcaaggtcgaggtgtggtgcattcaagatcttcatcgccaacccgtggatcccaagcgacatggccaattgtgcgccggaaactgttacctggtactgtacacctatcagcggctgggcagagtgcagtacatcttatacctatggcagggtcatcaggctactgctgatgagatcgaggccctcaattccaatgccgaggaactagatgtcatgtacggaggggtcttagtgcaggaacacgtgaccatgggttcagagcctcctcactttcttgctatctttcaaggtcagctggtgatctttcaggaacgggcgggccatcacggtaaaggacagagcgccagtaccacgaggctttttcaagtacaggggacggactctcataacaccagaacaatggaggttcccgcacgggcctcctctctcaattcatcagacatcttcctgctagtgacagcctcagtgtgctacctatggttcggtaaggggtgcaacggcgaccagagagaaatggctagagtggtggtaaccgttatttcccgcaaaaatgaagagaccgtcttggagggacaggagcctccgcacttctgggaagctctcggtggtcgcgcaccgtacccatccaacaaaaggctccccgaggaggtcccttcgttccagccaaggctcttcgagtgctcctcgcatatgggctgtctggtcctggctgaggtcggtttcttttcacaggaggacctggataagtatgacattatgcttttagacacgtggcaggagatcttcctctggcttggagaggcggctagtgagtggaaggaggctgttgcctggggacaggagtacttgaagacccatcccgctggcaggagccctgccactcccatcgttttggtgaagcagggacacgagccaccaacatttatcggttggttttttacatgggacccatataagtggacgtcacatccatctcacaaagaggtcgttgatgggtccccggccgccgcttcaacaatctctgagataactgccgaggtgaacaacttgaggctctcaagatggcccggaaacggcagggccggtgcagtggctcttcaagctctgaaggggtctcaagacagctctgagaacgatctcgtcagatcacctaaaagtgctggctcccgcacgtccagcagcgtcagcagcacatcagcaacaatcaatggcggactcaggcgagagcagctcatgcaccaggcggttgaggatcttccggaaggggtcgacccagcgcgccgtgaattctatttatccgatagcgactttcaggatatctttggaaagagcaaggaagaattttactccatggctacctggcgccagaggcaggaaaagaaacagctgggcttcttctag

SEQ ID NO: 23141 - DNA, 987 bp, Artificial Sequence
  Description of Artificial Sequence: Synthetic coding sequence
atggaggccaacggcagccagggcaccagcggcagcgccaacgactcccagcacgatcctggtaaaatgttcattggagggttgagctggcaaacctctcccgatagtctgcgggattacttcagtaagtttggagagatcagggagtgtatggtgatgagagaccctacaaccaaaagaagtaggggtttcggcttcgtgactttcgccgaccctgcttcagttgataaggttttgggccagcctcatcatgagctggactccaaaacaatcgaccctaaagtggcattccctagaagagctcagcccaagatggtgaccaggacaaagaagatcttcgtaggcggtctgagtgccaacacagtggtggaggatgtcaaacagtactttgagcaatttggaaaagtcgaggatgccatgcttatgtttgataaaactaccaaccgccatcggggctttgggttcgtgacattcgaaaatgaagacgtcgtggaaaaagtgtgtgagatacattttcacgagatcaataacaagatggtcgaatgtaagaaagcgcagcctaaggaagtgatgttcccacccggcactcgaggccgcgcccggggactgccatataccatggacgcatttatgttaggtatgggtatgctcggatatcctaactttgtagccacctacggtcgtggataccctggcttcgccccgagttatggatatcaatttcccgggtttcccgcagccgcctatggacctgttgccgccgctgctgttgcggccgccagagggtcagggtccaatccggcccgaccgggcggattccctggggccaactctcccggtccagtggccgatctttacgggcctgcttcccaggactccggcgttggaaattatatcagtgctgcgtctcctcagcctggttccgggtttgggcatggcatcgcaggacccctgattgccactgcatttaccaatggttaccactag

SEQ ID NO: 23142 - DNA, 654 bp, Artificial Sequence
  Description of Artificial Sequence: Synthetic coding sequence
atggagagcgtggccctgtacagcttccaggccaccgagagcgacgaattggcttttaacaaaggcgatacccttaaaatcctgaacatggaagacgaccagaattggtacaaggccgagctgcgcggcgtggagggcttcatccccaagaactacattcgagtgaagccccacccctggtatagcggaaggatcagccggcagttagccgaggagattctgatgaaaaggaaccatctgggtgcgttcctgatccgtgagagtgagagttctcccggtgaattcagcgtcagtgtgaattacggggaccaagtccaacacttcaaggtacttcgggaagcctcagggaaatatttcctgtgggaggagaagttcaattcgttgaatgagctcgtggatttttaccgcaccacaacaatcgcaaagaagcgacagattttcttacgtgatgaggaacctttgctcaagtcaccgggggcttgcttcgcacaggctcagttcgatttctccgcccaggacccatcacagctgagtttcagacgcggagatattattgaggtcctggagcgacccgatccgcattggtggcgcggtaggtcctgtggacgggtggggttttttcctcgtagctacgtgcagccggtgcatttgtag

SEQ ID NO: 23143 - DNA, 231 bp, Artificial Sequence
  Description of Artificial Sequence: Synthetic coding sequence
atgggcctgaagatgagctgcctgaagggcttccagatgtgcgtgagttcctcctcttcgtcccacgatgaggcccccgtgctgaacgacaagcacctcgacgtgccggacattatcatcactccgccgacccccaccgggatgatgctcccaagagacttggggtctactgtttggctggacgagaccggctcttgccctgatgacggggaaatcgatcctgaggcctag

SEQ ID NO: 23144 - DNA, 19863 bp, Artificial Sequence
  Description of Artificial Sequence: Synthetic coding sequence
atggaccagccccagttcagcggcgccccccggttcctgacccggcctaaggccttcgtggttagtgtgggtaaagacgctaccctgagttgtcagatagtggggaatcctactccccaggtgtcctgggagaaagaccagcaaccagttgccgcaggagcccggttcaggctggctcaggatggagatctttatcggctcaccatcctggatcttgcactcggggattcaggccagtatgtctgtcgcgcgagaaatgcaattggtgaggccttcgctgctgtgggattacaggtcgacgcagaagccgcatgcgccgagcaggcaccacactttcttttacgacctacatctattagggtgagagaaggaagtgaggccaccttccgctgtcgggttggcggatctcctagaccagccgtgtcctggtccaaggacggacgcaggctgggcgagcccgacggcccccgggtccgcgtcgaagagctgggcgaggcgtctgcactgaggatcagggccgcaagaccccgcgacggcgggacatatgaagtgcgagctgaaaatcccttaggagctgcttctgcggcggccgctctggtcgttgactccgacgctgcggatacagcttcaaggcccggtacaagcaccgccgcactgctggctcatctgcagcggcgtagggaggcgatgcgcgctgagggtgcaccagcaagcccgccaagtacagggacccggacttgtactgtgacagagggaaaacacgccaggctgtcctgttacgtcaccggggaaccaaagcctgaaaccgtgtggaagaaggatggccagctcgtcaccgagggtcgaagacacgtggtgtacgaagacgcccaggaaaacttcgtgctcaagattctgttttgtaagcagtccgaccggggtctgtatacttgtaccgcatcaaatctggtgggacaaacctactcgagtgtcctagtggtggtgcgggagccagccgtgcctttcaagaagcgtctgcaggatctcgaggtccgcgaaaaggaatctgcaacctttttgtgtgaagttcctcagccaagcacagaagctgcttggtttaaagaggaaacccgtctgtgggcctccgccaaatatggaatcgaagaggaaggaacagaacgccgccttaccgtgagaaacgtgagtgcggacgatgacgccgtgtatatctgtgagacccctgagggaagccggaccgtagctgagctggcagttcaaggcaatttactccgcaagctccccaggaagactgccgttagagttggagatacagcaatgttctgcgtcgagctggctgtgccggtcggacctgttcactggctgcggaaccaggaggaggtcgtcgccggcggtcgggtggctatctctgctgagggcactagacacactctgacgatctcccaatgctgcctggaggacgtgggacaggtcgctttcatggccggcgactgccagacttccacacagttttgcgtctccgcccccagaaagcctccactccagccgccggtcgaccccgtggtcaaagccaggatggagagctctgtgatactgagctggtcaccccctccacacggagagaggcctgttactattgatggatacctggtcgaaaaaaagaagcttgggacttatacttggatccgatgtcacgaggccgagtgggtcgcaactcctgagttaactgtcgccgacgtggccgaagagggcaacttccagttccgcgtgagtgccctgaactcttttggccagtctccctatctggaatttccagggactgttcacttggcccccaaactcgccgtacggacccctctcaaagcggtacaggccgtggagggcggcgaggtgacattcagcgtcgatctgacagtagctagcgctggtgagtggttcctagatggccaggctctgaaagcctccagcgtgtatgagatccattgcgaccgcacacggcatacactgaccattcgcgaggttccggcgagtctgcacggagcacagttgaagtttgttgccaacgggattgagtcatcaatcaggatggaagtgcgagccgccccaggcttaactgccaataagcctcccgcagctgcagctcgcgaggtgctggcccgtcttcacgaggaggcccaactcctggccgaattatcggatcaggctgcagccgtgacctggctgaaagatgggcggacattgtcccctggtcccaaatatgaagtccaggcaagtgccggaaggagggtgcttctcgtgcgggatgtcgctagagatgacgccgggctgtacgagtgcgtatctcgaggtggaagaatagcttatcagctgagtgtgcaggggctggcccggttcctgcataaggacatggctgggtcgtgcgtggatgcagtcgcaggaggtcctgcgcagtttgagtgtgagacctccgaagcccacgtgcatgtgcactggtataaggatggcatggaactgggccatagcggtgaacgcttcctgcaggaagacgtgggcacaagacaccgcctcgtggccgctaccgttacacggcaggacgaagggacctacagctgccgcgtgggggaggactctgttgacttccgactcagagtgtccgagcctaaggtcgtgttcgctaaagaacaactggccaggaggaaattgcaggcagaagccggcgcttcagcaacactgagctgtgaggtagcccaggcgcagacagaagtgacctggtataaagatggaaagaagctgtctagcagctcgaaggtatgtatggaggccactggctgcacccgaaggctggttgtgcagcaggctggacaggccgatgccggggagtactcatgcgaggccggcggccagcgactgagctttcacctggatgtcaaggagccaaaggtagtgtttgctaaagaccaggtagcccatagcgaagtgcaagcagaggcaggagcttcggcgaccctctcgtgcgaggtggcacaggcacagaccgaagttatgtggtacaaagatggcaaaaagctcagcagttctctgaaagtgcacgtggaagccaaggggtgccgacggcgcttggtggtgcagcaggccggcaagactgatgccggagattactcctgtgaagcgcgtgggcagcgtgtgtcttttagacttcacatcacggagcctaagatgatgttcgccaaggagcaaagtgtacacaacgaggtccaggcggaggctggggcctccgctatgctttcatgcgaagtggcccaggcacagacagaagtcacatggtacaaagacggcaagaagctgtcaagctcaagcaaggtgggcatggaagttaaaggctgcacacgcaggcttgttttgccgcaggccggaaaggcagacgccggcgaatatagctgtgaagccggtggacagcgagttagcttccacctccatataactgagcccaagggcgtcttcgccaaggagcaatctgtgcacaacgaagtacaggccgaggccgggactacggccatgctgtcgtgcgaggtggcacaacctcagactgaggttacttggtacaaagacggcaaaaagctcagcagctcaagtaaggtgaggatggaagtcaaaggctgcactcggaggctcgtggttcagcaggtgggtaaagcagacgctggcgagtacagctgtgaggcaggggggcaaagggtgagcttccagctgcacattacggagccaaaggctgtgttcgcaaaagaacaactcgtccacaatgaggtgcggacggaggccggcgcgtctgcaacactgagctgtgaagtggcacaggctcaaaccgaagtgacttggtacaaagacggcaagaagcttagtagcagcagcaaagtgaggattgaggcggctggatgcatgaggcagcttgtcgtgcagcaggccggacaggccgacgccggcgaatatacctgcgaggctgggggccagcgcctgtccttccacctcgacgtcagtgagcccaaagctgtatttgcaaaggagcagttggcacacaggaaggtgcaggcagaggccggtgccatcgctaccctctcttgcgaagttgcccaggctcaaaccgaggtgacgtggtataaggatgggaagaaactcagtagttcgagcaaggtaaggatggaagcagtgggttgcacccggaggttggtcgtccaacaggcatgccaagcagacactggggaatactcgtgcgaagcagggggccagaggctgtctttctccctggacgtggctgagcccaaggtggttttcgctaaagaacaaccagtgcatcgagaagtgcaggcccaggctggagccagcacaacattgtcatgcgaagttgcgcaggcccagacagaagtgatgtggtacaaagacggaaaaaaactctccttcagctctaaggtgcgtatggaggcagtgggatgtactcgtagactggttgtgcagcaggcaggccaggccgtggcgggagaatactcctgtgaggcaggttcccagcggctgtctttccatctgcacgtagctgagccaaaagccgtatttgctaaggaacagccagcgagccgggaggttcaggccgaggcaggaacttctgccactctctcctgtgaagtggctcaggcgcaaactgaggttacgtggtacaaggacgggaaaaagctgtcctccagtagtaaggtccggatggaagctgtcggatgcacacggaggttggtcgtacaggaggctgggcaagccgatgctggagagtattcatgcaaggcaggggatcaacgcctttcttttcacttacatgtagccgagccaaaagtagtatttgcaaaggagcaaccagcacacagagaagttcaggctgaagcaggagctagtgcaacccttagctgcgaggttgcacaagcgcaaaccgaagtgacctggtacaaagacggcaagaagctcagttcgtcgagcaaagtgcgcgttgaggcagtggggtgcacgagacggctggtggtccaacaggctggacaggcagaagccggtgagtactcttgcgaagccgggggccagcagctgagttttcgactgcaggtcgccgaactagagccacaaatatcagagaggccttgtagacgtgagccactcgtggttaaggagcacgaagacataattctgacggctaccctggcgacccccagcgcggccaccgtgacgtggctgaaagacggcgtcgagatcagaagatctaagaggcatgagactgcctcgcagggagacacgcatactcttaccgtacacggagctcaggtgttagattccgccatctacagctgccgcgttggtgccgaggggcaagattttcccgttcaggttgaagaagttgcagctaagttctgtcggttactggagccagtatgcggggaactgggcggcactgtgaccttagcctgcgaattatcaccagcctgcgccgaagttgtttggcgctgtggcaatacccagctccgggtgggaaagcggttccagatggtggctgagggacctgtcagatcactcacggtgttaggactgcgtgctgaagatgccggcgagtatgtgtgcgagagcagagatgaccacaccagcgctcagctcacggtgtccgttccaagagtggtgaagttcatgtccggcctgtccactgtagtagcggaggaaggcggagaggctacttttcagtgcgtagtgagtcctagcgacgtggcagtggtgtggtttcgggacggggccctgctacagcctagcgaaaaatttgccattagccagtctggtgcgtctcacagcttgacaatatccgatttggtgctcgaagacgccggacaaattacagttgaggccgagggtgcaagcagttcagcggctctccgagtgcgggaggcaccggtgctgttcaaaaagaagctcgaaccacagactgttgaagaacgaagctccgtcacattggaggtagagctgactagaccatggcctgagctcaggtggactagaaatgcaactgccttggctcctggaaagaatgtggagattcacgctgagggagcccgacaccggctcgtgctccataatgttgggttcgcagacaggggcttcttcgggtgcgaaacccctgacgacaaaacccaagctaaactgactgtcgagatgcggcaagttaggctagtgagaggactgcaggctgtggaagcaagagaacaaggcactgccactatggaggtacagttgagtcacgccgatgtggatgggtcatggactcgagatggactgcgctttcagcaaggccctacatgccacctggccgtacgtggccccatgcataccctgaccttatccggcctgagacccgaggattccggcttgatggttttcaaggcagaaggcgtgcacaccagcgcacggcttgtggttaccgaactgcccgttagcttctcaaggccccttcaggacgtggtgacaactgaaaaggaaaaagtaaccctggaatgtgaactgagccgcccaaacgtagacgtgagatggttaaaggacggagtagaactgcgagccgggaagactatggccatcgccgctcaaggagcctgccgaagcctcactatctacagatgtgagtttgcagatcagggggtgtatgtgtgtgacgctcacgacgcccaatcgagcgcctccgtcaaagtccaggggcgcacctacaccttgatttataggcgagtcctagctgaagacgcaggcgagatccagtttgtagctgagaacgctgaaagccgggctcagctgcgggtgaaggagctgcccgtgaccctggtgcgtccgcttcgggataaaatcgcaatggaaaagcatcgcggtgtgctggagtgtcaagtgtcccgagcctctgcccaggtgcgttggtttaaggggtcacaggaactgcaacctggtcctaaatatgaactggtctccgacggcctctatcgcaagctcatcatcagcgacgttcatgcagaagatgaagacacatacacctgtgatgctggcgatgtaaagaccagcgctcagttcttcgttgaagagcagtccatcacaatcgtgagaggtctgcaagacgtgacagtgatggagcctgcacctgcctggtttgagtgcgaaacatcaataccaagcgttcggcccccaaaatggctcctgggaaagactgtgcttcaagccggcggtaatgtaggacttgaacaggaggggaccgtccacagactgatgcttagacgcacctgttccacgatgacggggcccgttcatttcaccgttggcaaaagtcggtcgagtgccagattggttgtgagcgacataccagtcgtgcttactcggcctttggagcctaaaacagggcgcgaactacagagcgttgtcttgagctgcgatttccggcctgctccaaaagcagtgcagtggtataaggacgacacacctctgtccccatccgagaaatttaaaatgagcctcgagggccagatggcggagctgcgcatacttcggctcatgcctgcagatgcaggagtttatcgctgccaggcagggagtgctcactcttcaactgaggtaacagtagaggctagggaagtgaccgttacgggccctctacaggacgctgaggccaccgaggagggctgggcaagcttctcatgcgagttgagccacgaagacgaagaggtcgagtggtccctgaatgggatgccactgtataatgattcgttccacgagatctcgcataagggccgtagacacacgcttgtccttaagtcgattcagcgggcagatgctggcatcgtgcgggcatcctcgcttaaagtttccacttccgcacggctggaagtgcgcgtgaaacccgtggtcttcttgaaagcgttggacgacctttcagccgaggaaagaggcactctggccttgcagtgtgaggtatccgaccccgaggcgcatgtcgtctggagaaaggatggagttcaactgggacctagcgacaagtacgacttcctgcacacggctggcacccggggactggtggtgcatgacgtgtcccctgaggacgcagggctttacacctgccacgtgggcagcgaggagaccagggcacgagtccgcgtgcatgatcttcatgtggggattaccaaacggttgaagacgatggaggtgctggagggagagagctgttccttcgagtgcgtcctctcacacgaaagtgcgtctgatcctgcaatgtggacagttggcgggaaaactgtgggaagcagcagcagattccaggccactaggcaggggcggaaatatatcctcgtggtcagagaggcggccccctcagacgcaggagaggtggttttctccgtgcggggcctcacatctaaggcctcgcttatcgttcgggaacgaccagctgccattatcaagccattggaggaccaatgggtggccccgggggaggatgtggagttgcgatgcgagctctctagggcaggcaccccagtacattggctgaaggaccggaaggcgattcgcaagagccagaagtatgatgtcgtgtgcgaggggaccatggccatgctggtcataaggggcgcttcattgaaagatgctggcgaatacacgtgtgaagtggaagcgagcaagagcacggcctcacttcatgttgaagagaaggccaactgttttacggaggagctcaccaacttgcaagtggaggagaagggaacagccgttttcacctgcaagaccgaacatccggcagccacggtgacctggagaaaaggtctgctggaactgcgcgcctcaggcaagcaccagccttcgcaggaagggctgacactgagacttactatttcagcactagagaaggctgatagtgacacatacacttgcgatatcgggcaagcacagtctcgtgcccagttattagtgcagggaagacgggtgcatattattgaagaccttgaggacgtcgatgtacaagaggggtcttcagctacatttcgttgcagaatatcaccagccaactatgagcccgtacactggttcctggataagactcccctgcacgcaaatgagcttaatgagatcgacgctcagccgggtgggtatcatgtgctgaccctgaggcagttagctctgaaggattctggaaccatatacttcgaggctggcgaccaaagagcttccgccgccctgcgggtgaccgagaaacctagtgtgtttagccgggagcttaccgacgccacgataaccgagggcgaagaccttacactggtctgcgagactagcacctgtgatattccagtgtgctggacgaaggacgggaagacacttagaggctccgccagatgtcagctgtcccatgaggggcaccgtgctcagctgctgataactggtgctactctgcaggactcaggcaggtataaatgcgaggccggaggagcatgtagctcatcaatcgttcgggtgcatgcaagaccagtgaggttccaggaagcactcaaagacttggaagttcttgaggggggcgccgccaccctgcggtgtgtgctctcaagcgtcgctgcgcccgtgaaatggtgttacggcaataatgtcttacggcccggggataagtattccttgcgacaggagggggctatgctggagctggtggtccgaaaccttcggccgcaggacagtgggcgatacagctgctcattcggtgaccagactactagtgccactttaactgtgacggcactccctgctcagtttatagggaagctgaggaataaagaggctacggagggtgccacagccaccctcaggtgtgaactatccaaggcagcccctgtcgaatggaggaaggggagcgaaacattgcgagatggggatcgttattgtttaagacaggacggagctatgtgcgagctccaaattcgcgggctggcaatggtggatgcagctgagtactcttgtgtatgtggggaggaaaggacctcggcctccttgacgatccggcccatgccagcccactttattgggcgactgagacatcaagagagcatcgagggtgccaccgccaccctgagatgcgaattgagtaaggctgcccctgtggagtggcggaaaggccgggaatcgctgcgcgacggtgaccgtcattctttgcggcaagatggtgcagtgtgcgagctgcagatatgtggactggcagtggccgatgctggggagtactcctgcgtttgtggggaggagaggacctctgctacacttacggttaaagcccttccagcgaaattcaccgaaggattacgcaatgaagaagcggtcgaaggggctaccgccatgctgtggtgcgagctgtcaaaagttgcccccgtggagtggcggaaaggcccagagaacctgcgtgacggagacaggtatatattgcgccaggaggggactagatgtgagctacaaatttgcggcttagccatggctgacgccggtgaatacctttgcgtgtgcggtcaagagcgaacatccgcaactctgacaatccgagccttgcctgccaggtttatcgaagacgtgaaaaatcaggaggcgagggaaggagctaccgcagtccttcagtgcgaactgaactccgccgcacccgtcgaatggagaaaaggtagtgaaaccctcagagatggcgatcggtactctttgcggcaggacggcacaaagtgcgagctgcagattagaggcctggccatggctgacacaggagagtactcttgtgtgtgcgggcaagaacgaacatctgccatgcttaccgttagagccctccccattaagtttaccgaaggtctcaggaatgaggaagccacagagggggctacagctgtactgcgctgcgagctgtccaagatggctcccgtggagtggtggaagggtcacgagacactcagagacggcgacaggcacagcctcagacaggacggagcaaggtgcgagctccaaattagagggctagttgccgaagatgccggcgaatacctttgcatgtgcgggaaggaaagaacctccgcgatgctaaccgtgagggctatgccttctaaatttatagaaggtctccgcaacgaggaggcgacagagggcgacacagctacactgtggtgtgagcttagcaaagcggcccccgtagagtggaggaagggacacgagacccttcgggatggggaccgtcattcattgcggcaggacggatcccgttgcgagcttcagattcggggattagcagtcgtggatgccggagagtatagctgcgtctgtggacaagagcgcacttccgcaactctcactgtcagagctctcccagcacgcttcatcgaagacgtcaaaaatcaggaagcgcgcgagggggccaccgccgtcctgcagtgcgaattgagtaaagcggcccctgttgaatggagaaaaggttcggaaaccctacggggcggcgacaggtatagccttcgccaagatggcaccaggtgtgagctccaaatccacggcttgagtgtcgctgatacaggtgaatactcatgtgtttgtggtcaggaacgaacatccgcaacactgacagtccgagctccgcagccagtgtttcgagagccccttcaatcccttcaggccgaggaagggtctaccgccaccctgcagtgcgagctttccgagccaacagccaccgtcgtgtggtcaaagggcggcctgcagctccaggcaaacggccgacgcgagccgcgactgcaaggctgcacagctgaattagtactgcaggacctgcagagagaggacaccggcgagtacacttgtacgtgtgggtctcaggccacttcagccactctcactgtgactgccgcccccgttaggttcttgagggagctccagcatcaggaggtcgatgaaggaggcaccgcgcacctgtgctgcgagctgagcagggcgggggcaagtgtagaatggcgaaaaggcagcctacaactcttcccttgcgcaaagtaccagatggtgcaggacggggccgcagctgaactgctcgtgagaggggtcgagcaggaggatgccggcgattatacgtgcgacaccgggcatacgcagagcatggcaagtttatcggtccgagtcccccggccgaaatttaagactagattgcagagccttgaacaggaaaccggggacattgcgcgcctctgctgccagctttctgatgctgagtccggggcggtggtccagtggctgaaggagggcgtggagcttcatgctggaccaaaatacgagatgagatcacagggggctacgcgtgagctgctgattcatcagctcgaggctaaggataccggagaatatgcgtgtgtaacagggggacagaaaacggccgcgtccctcagagttacagaaccagaagttacaattgtgaggggccttgttgatgctgaagtgacagcagatgaggacgtggagttcagctgcgaagtgtcaagggccggagctacaggcgtccagtggtgcctgcaaggtctcccactgcaatctaatgaggtgactgaagttgcggtgcgggatggtagaattcatacactcaggctcaaaggggtaactccagaagatgccggaacagtctccttccatcttggtaaccacgcctctagtgcccagcttacagtccgggcgcctgaggtgacaatccttgagcccctacaggatgtgcaactgtcggaggggcaagatgccagcttccaatgccggttatcacgggctagcggccaagaggccagatgggccctcggtggcgttcccttacaggctaatgaaatgaatgatatcaccgtagagcaaggaaccctgcacctgctgacccttcacaaggtcaccttggaagacgcaggtacggtgagctttcacgtaggcacatgttcctccgaggcacagctgaaagttacggccaaaaacaccgtcgttaggggtctggaaaatgtagaggcactcgaggggggggaggccctcttcgaatgtcagctatctcagccagaagttgctgctcacacgtggctcctcgacgacgagcctgtgcacacctcagagaacgcagaggttgtgttctttgaaaacgggctccggcacttgttgctgctgaagaacctccggccacaggactcttgccgcgtcacattcctcgccggcgacatggtaacaagtgcgttcctgaccgtaagagggtggcggctcgagattttggagccgcttaaaaacgctgcagtgcgggcaggagcccaggcctgtttcacctgtacactctccgaggccgtgccagtgggggaggcaagctggtacatcaatggagcagccgtgcagcccgatgactctgattggaccgtcacagcagacggcagtcaccatgccctgttgctgcggtctgctcagccgcatcatgcaggcgaggttaccttcgcttgtagggacgctgtggcatctgccagactgaccgttttaggccttcctgacccacctgaggacgctgaggtggtcgcacgcagtagccacacggttaccctcagttgggctgctcccatgtcagacggtggggggggactgtgcggttatcgcgtagaagttaaggagggcgccacagggcaatggcggctatgccacgaactagtaccgggcccagagtgtgtggtagatggcttggccccaggagagacatacagattccgcgtggctgccgtcgggccagtcggcgccggggagccagtgcacctcccccagacagtaagactcgcggagccccctaagcctgtgcctccgcagccatcagcacccgagagcaggcaggttgctgctggtgaggatgtgtccctggagctagaggttgtagccgaggctggggaagttatatggcataaaggtatggaacggattcagcccggtggacggttcgaagtcgtttcgcagggccgccaacaaatgttggtcatcaagggatttactgctgaggatcagggcgaataccattgcggactggctcagggatctatttgccctgctgctgcaacgttccaggtagcgctttcacctgcctctgtggatgaggcgcctcaacccagcttaccccctgaggcggcccaggaaggagacctgcaccttctatgggaggcccttgcacgtaagagaagaatgtcacgagaacccacactagactctatatctgagttgccagaggaggatgggcgttcacaacgcctgccgcaggaggcagaagaggtggctccagatctgagcgaggggtattccacagcggacgagctggcccggaccggggatgccgatctcagtcatacaagcagcgacgacgagagcagagcagggactcctagcttggtaacttacctaaagaaggcaggccggcccggaaccagtcctctggccagcaaggtgggagctcctgcagctccttctgtgaaaccacagcagcaacaggagccgctggctgcagttcgacccccactcggcgatttgtcaaccaaggatctcggtgacccttcaatggacaaagccgccgtgaaaattcaggcggcctttaagggctacaaggttagaaaagagatgaaacaacaggaaggaccaatgttttctcacacctttggcgacacagaggcccaggttggtgatgctctgcgcttggagtgtgtggtggcttctaaagctgacgtaagggcccgttggctgaaagatggcgttgaattgactgatggccgacatcatcatattgatcaacttggcgatggaacttgctcacttcttattactgggctcgatcgggctgacgctggctgctatacttgccaggtgagcaataaatttggacaggtcacccactcggcttgtgtagtggtgtctggttccgaatccgaggcagaatcatccagtggcggagagctagatgacgccttccggcgagccgcacgccgactgcaccgcctcttccgcaccaagtctcccgccgaagtatcagacgaagagctcttcctgtccgcggacgaggggcctgcagagcccgaagaaccggctgactggcagacctatagggaggatgagcactttatttgcatccgctttgaagctctgacagaagctcggcaggccgttactcggtttcaggagatgttcgcaacgctcggcattggcgtcgagattaagctagtggagcaagggcctcgccgggtcgagatgtgtatctctaaagagacaccggcgcccgtggttccacccgaacctttaccatcgttactgacttcggatgcagctcccgtgttcttgaccgaattacagaatcaggaggtgcaggacggctaccccgtctccttcgattgtgttgtgactggccaacccatgccctccgtaagatggtttaaagacgggaaactgttagaggaagacgatcactatatgataaacgaggatcagcagggtgggcaccaactgatcattacagccgtggtgccagctgacatgggcgtctacaggtgtttagccgagaatagtatgggcgtgagctcaactaaagctgaactgagagtggacctcacatctacagactatgatactgctgctgacgccacagagtccagcagttacttttcagcccagggctatctcagttccagggaacaggaaggaaccgaaagtacgacagatgaggggcaactgccacaggtggtggaagaactgcgtgatctacaggtcgctcctggtactaggctggcaaagtttcaacttaaggtgaaaggctacccagcaccccgcctgtactggttcaaagatgggcagcccttaacggccagcgcccacattcgcatgaccgataagaaaattcttcacactttagagataatcagcgtaacaagggaggactctggacagtacgctgcctatatctctaacgctatgggagccgcgtattcaagtgcccggttattggtgaggggtcctgacgagcccgaagagaaacccgcctccgatgtgcacgaacagctggttccccctcggatgttggagcgctttacaccaaagaaagtgaaaaagggttcgagtatcaccttcagcgtgaaggtggaggggagacctgtcccgacagttcattggctccgggaggaagccgagcgcggtgtgctgtggattggaccagatacccccgggtacaccgtggcaagctcagcgcagcaacatagcctcgttctgctggacgtgggacgccaacatcaggggacgtatacgtgcatcgcgtctaatgcggccggccaagctctttgtagtgcttccctgcatgtgtcaggtctgccaaaagtcgaggagcaagagaaggtgaaggaggctctgatcagcacattcctgcagggcaccactcaggctatcagtgcccaggggctcgaaaccgcaagtttcgccgatctagggggccagagaaaggaggagcccctagcggccaaagaagctttgggtcatttgtcgcttgccgaggtggggactgaggaatttctccaaaagctgacgtcccagattaccgagatggttagtgccaaaatcacccaagcaaagcttcaagtgcctgggggagacagcgatgaagatagtaaaacacctagtgccagccctaggcacggtcgcagcaggccatcctccagcatccaggaatccagttcggaaagcgaagatggcgacgcccgaggcgagatctttgacatctatgtggtgaccgcggattacctccccctgggtgcagagcaggacgcgattaccttgcgtgaaggccagtacgtcgaagtgttggatgccgcccaccctctgcggtggctggtgagaaccaagccgaccaagtcgtctccatctagacaaggatgggtatctcccgcttaccttgaccgacggctcaaactgagcccggagtggggtgctgccgaagctcctgagttccctggagaggcagtgagtgaagatgagtataaggccaggctttcctctgtgattcaggaactactgagctcagagcaggctttcgtggaggaactccagttcctgcagagccatcacttgcagcatctggagcggtgtccccacgtgcctattgcagtggcgggacaaaaggccgtgatatttcgaaatgtgcgtgacattggaaggtttcatagctcttttctgcaggagcttcagcagtgtgacacagacgacgacgtcgcgatgtgtttcattaagaaccaggcagcatttgagcagtacctggagttcctcgtaggccgcgtccaagctgagagcgttgtcgttagtaccgcgattcaggaattctacaagaaatatgccgaggaagcactcctggcaggggatccctcccagcccccccccccgcctctgcagcactacctggaacaaccagtggaacgagtgcagagataccaggctctgctgaaggagctaattaggaataaggctagaaataggcaaaactgcgcgctgctagagcaggcctacgcagtggtgagtgcgttgccacagcgcgctgaaaataaactacatgtgagtctgatggagaactacccgggcaccttacaggcgctgggggaaccgatccgacaaggtcactttatcgtgtgggagggcgcgcccggcgctcggatgccctggaagggtcacaatcgccatgtctttctgttcagaaatcacctggttatatgcaaaccccgtagggattctcgtaccgataccgtgtcctacgtttttagaaatatgatgaaactgtcctctatcgaccttaacgatcaggtcgagggcgacgatagggctttcgaagtgtggcaagagagagaagactcggtgaggaagtatctgctgcaagcccgtaccgccattataaagtcctcttgggtgaaggagatttgcgggatccagcaaagacttgcactgccagtttggagaccaccggactttgaggaagaactggcggattgtaccgcagagctgggagagacggtgaaactggcttgccgtgtgactggaactcccaagccagttattagttggtataaagatgggaaggctgtgcaggtggatccacaccatatccttattgaggatccagacggtagctgtgctctgattttagactcacttacaggagtggatagcgggcagtacatgtgtttcgccgcttccgccgcaggaaattgttccaccttaggcaaaatcctggttcaggttccgccccgttttgtgaacaaggtgagagcttctccatttgtggaaggagaagacgctcaattcacctgtactatcgagggtgccccttaccctcagataaggtggtacaaggacggggcgctgttgaccacgggaaacaaattccagacactctccgagccacgctccggcctccttgtcttggttatcagagcggcttccaaggaagatcttggcttgtatgagtgcgaactggttaacagattgggctcagcgcgtgcgtctgcggaattgcggattcagtcaccgatgttacaggctcaggaacaatgccatcgagagcaacttgttgcggccgtggaggtgactgaacaggagacgaaggttcccaagaaaactgtgattatagaggagaccatcaccaccgtcgtgaaatcaccccggggacaaaggcggagccctagtaaaagcccttcgcgtagcccaagccggtgtagcgcaagcccacttagaccgggcctcctcgcccctgacctactgtacttgcctggggcgggacagccacggcgcccagaggctgagcctggacagaaacccgtagtgccaacactgtacgtgacggaggcagaagcacattcgcctgcgctgcctggcctgtccggaccccaaccaaaatgggtggaggttgaggaaacaatcgaagtgagggttaagaaaatgggacctcaaggcgtgagtccgactaccgaagtgcctcggtcctcaagcgggcacctctttactctccccggagccacgcctggaggtgatcccaatagcaacaacagtaataacaaactgcttgcccaggaagcttgggctcaaggaaccgcgatggtgggtgtgcgcgaaccgcttgtcttccgcgtggacgcccgcggctccgtcgattgggcagcatcagggatgggctccttggaagaggagggcactatggaggaggctggggaggaggagggagaagacggtgatgcattcgtgacggaagagtctcaggacacccactccctgggcgatagggacccaaaaattttgacacacaatgggcgcatgttgacactcgcagatctggaggactacgtaccgggggaaggggaaaccttccactgtggaggcccaggcccgggcgctcccgacgatcctccctgtgaagtctcagtgattcaacgtgagatcggggagcccactgtgggtcagcctgtcctcctttccgtgggtcacgctctgggtccacgcggaccgttgggactatttcgccccgagccacggggcgcttctccgccgggaccacaggtcagatcactggagggaacctctttcctcttaagggaagcccccgccaggcctgttggctctgctccttggactcaaagcttctgcacccggatcagaaggagtgccgattcgggacaatcttccttcacaactgaactcagtactcagaccgtgaatttcggaaccgtcggtgaaaccgtgactttgcacatatgtcccgatcgagacggcgacgaagcagctcaaccctag

SEQ ID NO: 23145 - DNA, 1407 bp, Artificial Sequence
  Description of Artificial Sequence: Synthetic coding sequence
atggccgcccccgacctgagcaccaacctgcaggaggaggccacctgtgcaatttgtctggattatttcactgaccctgtgatgaccgactgcggtcataatttttgtcgcgagtgtataaggcgttgctggggacagcctgagggaccctacgcatgcccggagtgccgggaactgagcccccagcggaacttgcgtcccaaccgccccctcgcaaagatggccgaaatggcaaggcgcctgcaccccccctcaccggttccacaaggcgtgtgtccagcccaccgcgagccactggccgctttttgtggagacgagctgcgtctcttgtgcgcagcgtgtgaacggagcggagaacactgggcgcacagagttcgtcctctccaggacgctgccgaggaccttaaggcaaagcttgaaaagtcccttgaacacctgagaaagcagatgcaggacgcccttctgttccaggcacaggcggacgagacatgtgtgctctggcagaaaatggtcgagtctcaacgtcaaaacgtgctgggggaatttgagcgcctgagacgtctgctggcagaggaggaacagcagctacttcagaggctcgaggaagaagagttggaggtgctgccacggttaagagagggagcagctcatttggggcagcagtctgcccacctcgctgaattgatcgcagaacttgagggccggtgtcagctccctgccctcggacttctccaggatattaaggacgccttgcgcagggtacaggatgtcaagctccagccccccgaagtcgtgccgatggaactgagaactgtgtgcagggtgccaggactagtggaaaccttgagacgctttcgcggcgacgtgactctcgatcccgacaccgcgaatccggaactgatcctgagtgaggacaggcgcagcgtccagcgaggagacctgcggcaggccctcccggattctccagagaggttcgatcccgggccatgtgtgctgggacaagagagattcaccagcgggaggcactactgggaggtcgaggtcggggatcggacatcttgggcactgggtgtttgcagagaaaatgtgaaccggaaagaaaagggagagctttctgcgggaaacggcttttggatccttgtgtttctggggtcatactacaattcttcggaaagggcattggcacctttgcgagatccccctcggagagtcgggatttttctcgattacgaggcgggccatctgtctttttactcggccacagatggaagcttgcttttcatctttccagagattcccttctctggtaccctaaggccactatttagccccctttcatccagtccaaccccaatgaccatctgcagacctaaaggtggttcaggcgacaccttggcacctcagtag

SEQ ID NO: 23146 - DNA, 813 bp, Artificial Sequence
  Description of Artificial Sequence: Synthetic coding sequence
atgagccccggcagcggcgtgaagagcgagtacatgaagcggtaccaggaacctcgatgggaggagtacggcccttgctaccgggagctgttgcactaccgcttgggccggcgactcctcgagcaggctcacgcgccctggctgtgggatgattggggccctgccggctcatccgaggattcggcaagctctgagagtagtggggccggcggtcctgctccgagatgcgctccaccgtcccccccccctccagtggaaccagcaacccaagaagaggcagagagacgggctagaggcgcgcctgaggagcaggacgctgaggcgggggatgccgaggcagaggatgccgaggacgctgcactccccgccttgccagttaaagacgtggaagacaagccagaacagcagaccagaacgagagagactgacaagtctcctacatcaacagaacccagacaacagccttcagcgcttttcgcaagggggaatcgaaaggccgtcaagagccctcaacgatcatcatccaagatcaaggaaaataaacaccctttcgccctttacggatggggcgagaagcagacagatacaggctcacagaagactcataacgtctgcgcttcagcacctgtgcatgaaatacacgagtccgcccttcgcgccaaaaaccgccgacaggttgagaagaggaagctcgttgcccagcgtcaacgggcccactctgtcgatgtggagaaaaacagaaagatgaaggcatcgagtagcgaaaacccatggatgacagagtatatgaggtgctattctgcgagggcctag

SEQ ID NO: 23147 - DNA, 2667 bp, Artificial Sequence
  Description of Artificial Sequence: Synthetic coding sequence
atggacgagagcgccctgctggacctgctggagtgccccgtgtgcctagagcgtttagacgccagtgctaaggtactgccatgtcaacacaccttttgcaagcgctgccttttgggcattgtggggtcccgtaacgagctgcgttgccccgaatgtagaacgctagtcggctccggcgttgaggaattgccatctaacatcctgctggttcgcctactggacgggattaagcaacgcccctggaagccaggccctggcgggggctccgggacaaattgcacgaacgccttgagaagccagtcttcgacagtggccaactgctcttcaaaggatctgcagtctagccagggagggcagcaacctcgggttcagagttggtccccacctgtccgtgggattccacagctaccttgtgccaaagctctgtataactatgagggcaaagagcccggggatctgaaattttccaaaggtgatattatcatactgcggagacaggtggacgaaaactggtaccatggtgaggtaaacggcatccatgggtttttccctacaaacttcgttcagatcattaagcctctgccgcagcccccaccacaatgtaaagcattgtacgacttcgaagttaaggacaaggaagcagacaaggattgcctgccctttgctaaagacgatgttcttacggtcatcaggagggtggacgagaactgggccgagggcatgctcgccgacaaaattggtatatttccaattagttatgttgaattcaattcagccgctaagcagctgatagagtgggataaaccccccgtccctggagtggacgccggcgagtgtagctctgccgccgcgcagtcaagtacagcccctaagcatagtgacactaagaagaacacaaagaagcgtcactctttcacttctcttacaatggcgaacaagtccagtcaggcgagtcagaacaggcatagcatggaaatcagcccacccgtccttatatcctccagcaacccaacggcagcagcccggataagtgaactcagtggcttgagctgcagcgccccctctcaggtccacatatctaccaccggacttattgtcaccccgccaccgtcgtcccccgttacaacaggtcccagctttacatttcccagcgatgtgccttatcaggccgctctcgggactctcaacccacccctaccccccccaccattacttgcagcgactgttttagcctccactcccccaggcgccaccgccgctgccgccgctgccggcatgggcccgagacctatggccgggagcactgatcagatcgcccacctgaggcctcaaactaggcccagcgtgtatgtggctatatatccgtacaccccacggaaggaggacgaactggagctgagaaaaggggaaatgtttcttgttttcgaaagatgccaggacggttggtttaaagggactagtatgcacacgtctaagattggtgtgtttccagggaactatgtcgcgcctgttacccgcgccgtaactaatgcttcacaggcgaaggtccccatgtcaacagcaggccagacaagtcgaggggttactatggtaagcccatcaactgccggaggacctgctcaaaagctgcagggcaatggggtcgctggcagcccctctgttgtgccagcagccgtcgtgtcagccgcacacattcaaacatctccacaggccaaagttctgttgcacatgaccggccagatgactgtcaatcaagctaggaacgccgtcagaactgtagcggctcacaaccaggagagaccaaccgccgccgtcaccccaatccaggtgcagaacgctgcaggactgagccctgcatccgttggactaagccaccactcgcttgccagcccacaacctgctcccctgatgcccggatccgccacccacaccgccgcaatttctatctcacgcgcatccgcacctttagcttgcgcagccgcagccccactcacctcaccttcgattacctcagcaagccttgaggcagaaccgtcgggccgaatcgtaaccgtattgcctggactccctacctctccagactcagcatcctccgcgtgcggtaattctagtgcaacaaaaccagataaggactccaaaaaggagaaaaaaggattgcttaaattgctaagcggcgcctctactaagcgcaaaccccgtgtaagccctcctgcctctcccaccctggaagtcgagctgggcagtgcagagctgccgctgcagggggctgtgggccccgagcttccaccgggaggggggcacggtcgggcaggttcatgtcccgttgatggcgacgggcccgttactacagcagtcgctggagccgccctcgctcaggacgcttttcatcgaaaagctagttccctggatagtgccgttcccattgctcctccacctaggcaggcctgtagctctttaggacctgtccttaacgaatccagaccagtcgtttgcgaaagacatagggtggtagtgagctatcccccccagagcgaggccgagctggaactcaaggagggcgacatcgtcttcgtgcacaaaaaacgggaggacggctggtttaaagggaccttgcagcggaacgggaaaactggactattcccagggtctttcgtcgagaatatttag

SEQ ID NO: 23148 - DNA, 570 bp, Artificial Sequence
  Description of Artificial Sequence: Synthetic coding sequence
atgccccagaccgtgatcctgcccggccccgccccctggggcttccgtctgagcggaggtatcgacttcaaccagccactagttatcacccgcatcactcccgggtctaaggctgccgcagcaaacttgtgtccaggagacgtcatcctggctatcgatgggtttggtaccgagtcaatgacacacgctgacgcacaggataggatcaaggccgcagctcaccagctgtgcctgaaaatcgatagaggcgagactcatctgtggtcccctcaagtttcggaggatggtaaggctcaccccttcaagattaatctggaaagtgagccacaggagtttaagccaattggtaccgctcacaaccggcgggcacagccattcgtggccgccgcgaacatagacgacaagcggcaggtagtgagcgcctcatacaatagccccattgggttatatagcacttctaacatccaggatgcgctccacggccagctacgcggattgatccccagtagccctcagaaaaccggcaccaccctgaataccagcattattttcggtcctaacctgagctag

SEQ ID NO: 23149 - DNA, 1095 bp, Artificial Sequence
  Description of Artificial Sequence: Synthetic coding sequence
atgccccagaccgtgatcctgcccggccccgccccctggggcttccgactttcaggcggtatcgattttaatcagccgctggttatcactagaattacacctggttcgaaagcagctgctgccaatctgtgccccggggacgtaatccttgccatagacgggttcggcaccgagtccatgactcacgccgacgctcaggatagaattaaggctgctgcacaccaactatgcctgaaaatcgataggggcgagacacatctgtggtcaccacaggtaagcgaagatggaaaggcgcatccctttaagataaacctagagtccgaaccacaggatgggaactactttgagcacaaacataacatacgcccaaaacctttcgttatccctggcaggtcctctggctgtagcacaccctcaggcatcgattgtggcagtgggcggagcactccctccagcgtctccaccgtctcgaccatctgtcccggggatcttaaagtggccgcgaaactggcaccaaacattcccctggaaatggaactccccggagtgaagatcgtgcatgctcaatttaatacccccatgcagttgtactcagatgacaatatcatggaaacgctgcagggccaggtgtctaccgcactcggtgagacccctcttatgtctgaacctactgcttctgtgcctccagagtccgatgtgtatcggatgctacatgataacagaaatgaacctacgcagccccggcaaagtggctctttccgggtcttgcaaggaatggtggatgatggaagcgatgaccgcccagctgggactcgaagtgttcgggcccctgtgaccaaggtgcatggaggatcaggaggcgctcagaggatgcccctgtgcgacaagtgtggatccggcattgttggcgcagtcgttaaggcacgagacaagtatcggcatccggagtgttttgtgtgcgctgactgtaacctgaacctcaaacagaaggggtactttttcatcgagggggaactgtactgcgagacccatgcgcgtgcccggacaaaacccccggaggggtatgacacagtcaccttgtatccaaaagcatag

SEQ ID NO: 23150 - DNA, 951 bp, Artificial Sequence
  Description of Artificial Sequence: Synthetic coding sequence
atgccccagaccgtgatcctgcccggccccgccccctggggcttccgcctcagcggggggattgacttcaaccagcctctggtaattaccaggatcaccccaggatcaaaagctgccgcagctaacctttgcccaggggatgtgatacttgccatcgacgggttcggaaccgaatccatgacccatgctgacgcacaggacagaataaaagccgcagctcatcaactgtgcctcaaaattgacaggggagaaacgcacctgtggagtcctcaggtgagcgaggacggtaaagcacaccccttcaagatcaatcttgagagcgagccgcaggaatttaagcccattggaaccgcacacaatcgaagagctcagccctttgtggccgccgccaatattgatgataaacggcaggtggtaagcgccagctataatagtcccatcgggctctatagtacatccaatatccaagacgcgctgcatggccagctgcgcgggctaatcccctcctcaccacaaaacgaaccaaccgctagtgtgccacctgaatctgatgtgtatcgtatgctgcacgataacagaaatgaaccaacccagccaagacagtccggcagttttcgtgtcctacagggaatggtcgacgatggatcagacgataggcccgccggcactcggtccgtgcgggcacctgtgactaaggtgcacgggggatctggcggcgcccagaggatgcccctgtgcgacaaatgtgggtccgggatcgttggggctgtggtcaaagcccgtgacaagtataggcaccccgagtgtttcgtgtgtgccgactgtaaccttaacctaaaacagaagggctacttctttattgagggcgagttgtactgcgaaacccacgcgcgagcccgtacgaaacctcctgagggatacgatactgtaaccctctatcctaaagcctag

SEQ ID NO: 23151 - DNA, 3303 bp, Artificial Sequence
  Description of Artificial Sequence: Synthetic coding sequence
atgagctactaccagcggcccttcagccccagcgcctacagcctgcctgccagtcttaacagctccattgtgatgcagcacgggacctcactggactccacagatacgtatcctcagcatgcccaatctctcgatggtacgacatcaagcagcattcctttgtatcgttcctccgaggaagaaaagagagtcaccgttataaaagccccacactatccagggataggccccgtggacgaatccggtattcccaccgcaatacgcaccacagtggatagacctaaggattggtataagactatgttcaagcagatccacatggtccacaaacctgacgatgacactgacatgtacaacaccccttacacttacaacgccggactctacaaccctccgtattcagcacagtcacatccagctgcaaaaacacagacttaccgccccctcagcaaatcccattctgataactcacccaacgctttcaaagacgcctcctcccctgtcccacccccacatgttccaccccccgtcccgcccctccgcccacgagaccggagtagtacggagaagcacgattgggacccccccgatcgcaaagtggacacacgtaagttccgctctgagccgcgatctatcttcgaatacgagcctgggaagtctagtattttgcagcatgagagacccgcctccctgtatcagtcctcaatcgataggtcactcgagcgacctatgtcctccgcctccatggcatcagactttcggaaacgcaggaagtctgagcctgctgtggggcctccacgtggccttggagaccaatcagcgtcccgaacaagtcccggtagggtcgatcttcccggatcctcaactaccctcaccaaatcctttacttccagctcccccagctctccttcgagagcgaagggaggcgatgattccaaaatatgtcccagtctctgctcttatagcgggcttaacggaaacccctcctccgagttggactactgctcaacttataggcagcaccttgacgtgcctagggattcccctcgggcaatctctttcaagaacggctggcaaatggcaagacagaacgcagagatctggtccagtaccgaagaaactgtgtctccgaagattaaaagtcggtcatgtgatgatttgctaaacgatgactgtgactcattccccgacccaaaagtgaagtccgagtctatgggttcgttgctctgcgaagaagatagcaaagagagctgccccatggcatggggtagcccttatgtgcctgaggtccgatcaaacgggcgatctcgtatccggcaccgatccgccagaaacgcccctggcttcctgaaaatgtacaagaaaatgcacaggatcaatcgaaaagatctaatgaatagtgaggttatttgcagtgttaagagtcgcattctccaatacgagagtgagcagcaacacaaagatttgctcagagcatggtcccagtgctctacagaggaggttcctagggatatggttccaacacgaatatccgaatttgagaagttaatccagaaaagtaagtccatgccaaatcttggcgacgatatgctctcccccgtaactttggagccaccgcagaatggcctctgtccaaagaggcgcttttcaatagaatatctgttggaggaggagaaccaaagcggccccccagcccgaggccgcagaggctgtcagtccaatgccttggtgcccatccatatcgaagtgacttccgacgaacagccccgcgctcacgtcgaattttctgattccgatcaagacggagtcgtaagtgaccattctgactatatccatctggaggggtccagtttctgctccgaatccgacttcgatcatttctcctttactagttcagaaagcttttatggctcatctcaccaccaccaccatcaccaccaccaccatcaccggcacctaatctccagttgcaagggtaggtgtcctgcctcctacactagattcaccaccatgcttaaacacgagcgggcacgccatgagaacacggaagagccaagaagacaggagatggacccaggattgtcaaaactggcgttcctggtgagtccagttccatttaggaggaagaaaaatagcgcgccgaaaaaacaaacggagaaggcaaagtgtaaagcttcagtgtttgaggcgctcgatagcgccctgaaagacatctgtgatcagataaaagcggagaaaaagagagggtcactgcctgataattccattctgcataggctgatctcggagttattgcccgacgtgcctgagaggaactcatccctcagggccttgagacggagccccttgcaccaaccactccatccacttccacccgatggagctatccactgcccaccctaccagaacgattgcggacgcatgccaaggtctgcctccttccaggatgtcgacacagctaattcatcttgccatcaccaggaccgtggaggagccctccaggacagggaatctcctcgctcctactcttccactctcaccgacatggggcggagcgcaccacgggagaggagaggaacacctgagaaggaaaaactgcccgctaaagctgtctacgattttaaggcacagactagcaaggaattgagcttcaagaaaggcgacaccgtctacatactgcgaaagattgaccagaactggtacgaaggagaacaccacggcagagtaggcatcttccctatatcttacgtcgagaaactcaccccacctgagaaggctcagcctgcaagaccacctcctccggcacagcccggggaaataggagaggccatagctaagtacaatttcaatgcagatacaaacgtggagctttcccttaggaagggtgaccgggtgatcttgctcaagcgagtcgaccagaactggtatgaaggcaagatccctggtacgaatcgccagggaatctttccggtgagctatgtggaggtggtgaagaagaatacgaaaggcgccgaagactatcccgaccctcccatcccccactcatacagtagtgaccgcattcatagcctctcctccaataaaccacaacgtcccgtctttacccacgaaaacatccagggggggggcgagccctttcaggcattgtataattatactcccagaaacgaggacgaactagagcttagggaatctgatgtaattgacgtcatggaaaaatgcgacgacggctggttcgtggggacaagtcgtaggactaagttttttggcaccttccccggaaactacgttaagcgcctatag

SEQ ID NO: 23152 - DNA, 4389 bp, Artificial Sequence
  Description of Artificial Sequence: Synthetic coding sequence
atgttccggggccccaagccccccatcgcccccaagccccggctgactgctcctaacgaatggagagcgtccgtttatctgaatgattcactgaacaaatgttctaacggccggctcccatgtgtggacaggggcctcgatgaggggccaaggtccattcctaaatgttctgagtccgagactgacgaagattatatcgtggtgccgcgcgtccccttgcgcgaagatgaacccaaggacgaaggcagtgtcgggaataaagcgctcgtcagtcccgaatcctccgcagaggaggaggaagaacgagaggaaggcggtgaggcctgcggactggagggcacaggcgctggggaagattctgttgcacctgcggccccaggggcaggcgcactcagtagagagggcgaagaaggcaccgaccttgctctcgaggatgagggtgaaggttgtgccgatgaaccaggaacactggagcaagtatccaggtcagaagaagaagagaaacttgtccagccccatagggagtgttccctggaggacagtgggccttgggccggcgaaggggtgtttcagagcgacttattgctgccacacattcacggagaggaccaggagccgcctgacacccctggagaggccgaagaggatgatgaagagggatgcgccagcactgaccccgctggagccgacgagggctccgggccggaccggcctacggaggatatgggccaggatgccgaagacacctccgaagaacccccagaaaaggaagagctggcgggagtccaggaggccgagacagctacagattgcccagaggtcctggaggagggttgcgaggaggccaccggtgtgacggggggagagcaggtggaccttagcgagccacccgaccacgaaaaaaaaactaatcaggaagtcgccgccgccactctggaagaccacgcacaagatgagtcagctgaagagtcctgccagattgtgccctttgagaacgactgcatggaggacttcgttacgtccctaaccggttccccgtatgaatttttcccaacggagagtacctccttctgcagcgagtcttgctcccccttgagtgagtctgctaagggtttggaatcagaacaagctccaaagttgggactccgtgccgaggaaaatccaatggtcggcgccctgtgtggacagtgcgggagtttgcagggaggcgcagcggaaggaccagccgccccagatgttgtggtcgttctggaagaagaagcactggacgatgccctcgccaatccatatgtcatgggcgtcggactgccgggtcaggcagcccctggcgagggtggccaggccgccagcgacgccctgggaggttatggttcaaaagaggagctgaattgtgaagccgagggcggcttagtgccagcagaccggaagaacacatctacacgcgtgaggccgcactcaggaaaagttgcaggctacgtccccgaaaccgtgcccgaggagaccggacccgaggctgggagctccgccccaggcatcgggggtgctgctgaggaagtgggcaagacactgctttctcttgagggtaagcccctcgaggcatcccgcgcattgcccgctaagccgcgggccttcaccttatatccccggtcattctccgtggaggggcgggagattcccgtcagcgtttaccaggagcctgaagggtctggtctcgacgatcaccggattaaacgcaaggaggacaacctgtccttgtcctgtgtgatagggtctagcggatctttttctcagaggaatcacttacccagcagcggaactagcacaccaagcagtatggtggatatccccccgccattcgacttagcttgtattactaagaaaccaataaccaaaagttctccctcgctgttgatcgagagcgacagccctgataagtacaaaaaaaagaagagttcatttaagcggttcttagcactgacgtttaagaaaaagaccgagaataagttgcatgtcgacgtgaacgtgtcgtccagccgatctagctccgaatcaagctatcacggcccgagccggatcctggaagttgaccggcgttcactaagtaattcacctcaattgaagtccaggaccggtaagctgcgggcttccgagtctccctcttcccttatattctaccgggacggtaagagaaaaggggtcccgttttcccggaccgtgagtcgcgtcgaatccttcgaggacaggtcccgacctccattcctcccattaccacttactaagccccgctccattagctttcctagtgctgacactagtgactatgaaaatatccccgcgatgaactcagattacgaaaacattcagattccaccccgaagaccggcacgagccggagcatttaccaagttattcgaggatcaatcccgtgcgctctcaacggccaacgagaacgatggctacgtggatatgtcttcttttaatgcgttcgaatctaagcagcagtctgctgatcaggatgcagagtccgcctatactgaaccatacaaagtatgtcctataagtagtgccgcgccaaaggaagacctgacctctgacgaggagcaaagatcatccgaagaggaagactcggccagccgggatcccagcgttacccacaaagtggaaggccaaagcagagctttggtcatcgctcaagagctgctgagctctgaaaaggcttacgtggagatgctgcagcacttgaatcttgatttccacggtgccgtgatgcgcgctctggacgatatggatcatgagggtagagataccctggcccgcgaggaacttagacagggtctgagtgagctccctgccatccacgatctccatcaggggattctagaagaattagaggaaagactgagtaactgggaatcgcaacagaaggtggccgatgtgttcctcgctcgcgagcagggctttgaccaccacgccactcatattctccagtttgatcggtacctggggttgctatcagagaattgtctgcactcgccccgcctggccgccgccgtgcgcgagttcgagcaaagcgtgcagggtgggagccagactgctaaacacaggctattgcgggtggtgcagcgactgttccaataccaggtgcttctgacggattatcttaacaacctgtgccctgacagtgcagaatacgataatactcagggagcgctcagtttgatctcgaaggtgactgatagagctaatgatagcatggaacaaggggagaatctacagaaactggtacatattgaacatagtgtccgcggccagggcgacctcctgcaacctgggagagaattccttaaggaaggtacactgatgaaagtaacaggaaaaaacagaaggccacgccacctgttcttgatgaacgacgtgcttctatatacctacccccagaaggacgggaaatacagactgaagaatacgctggcagtcgccaatatgaaggttagcaggccagttatggagaaagtcccatatgccctgaagattgaaaccagcgagtcctgcttaatgttgtcggcctctagctgtgcagagagagatgaatggtatgggtgcttgtctcgcgctctacccgaggattataaggcgcaggctcttgcagcttttcaccactctgtcgagatccgggagcggttgggggtgtctctgggagagcgtcctcctacattagtacctgtcacacacgtgatgatgtgcatgaactgcgggtgtgattttagcctcaccttaaggaggcatcactgccacgcttgtgggaaaatcgtctgtcgcaattgttcaagaaataagtacccactcaagtatcttaaagatcggatggccaaagtctgtgatggatgtttcggtgagttgaaaaaacggggaagggctgtccccggactgatgcgcgagagaccagtgtcgatgagctttcccctctcctccccgcgattctcaggctcagccttctcctcggtattccagtccataaaccctagcactttcaagaagcagaaaaaagtccctagcgccctcactgaggtggcagcaagcggggagggcagcgctattagcggctacctcagtcggtgtaaacgagggaagaggcattggaagaagctttggttcgtcatcaagggtaaggtgctttatacttacatggctagcgaggacaaagtggccctggagtcaatgcccctcctaggttttaccatcgctcccgaaaaagaggagggatcttcagaagtggggcctatctttcacctgtaccacaaaaagactttattctacagtttcaaggcggaggataccaatagcgcccagcggtggatcgaagccatggaggatgcctctgtgctgtag

SEQ ID NO: 23153 - DNA, 768 bp, Artificial Sequence
  Description of Artificial Sequence: Synthetic coding sequence
atggccagcagcgacctggagcagctgtgcagccacgtgaacgagaagatcggaaacattaagaagactctgagcctgagaaactgcggtcaagagcctaccttgaagacagtgctcaacaaaattggtgacgagattatcgtaatcaacgagctactgaacaagcttgagctggagatacagtaccaggaacaaaccaataactcactcaaagagctgtgtgagagcctagaagaagattacaaggacatagagcatctgaaagagaacgtaccctcccacctgccacaggtgaccgtgactcaatcttgtgttaaggggtcagacctcgatccagaagagccgataaaagtggaagagcctgaaccggtcaagaaaccacccaaagaacaaagatctattaaggaaatgccattcattacctgcgacgagttcaacggtgtacctagctatatgaagtcgagacttacctataaccagataaacgacgtcattaaggagattaacaaagccgtgatcagcaaatataagatcctgcatcagccaaaaaagagtatgaactctgtgacccgcaacctgtatcacaggttcatcgacgaggagaccaaagacaccaaaggccgctacttcatcgtggaagcggacattaaagagtttacgactctcaaggccgacaaaaagtttcacgtactcctgaatatcctgcgccattgcaggcgactgtctgaagtacgcggtggaggcctgactagatatgtgataacgtag

SEQ ID NO: 23154 - DNA, 627 bp, Artificial Sequence
  Description of Artificial Sequence: Synthetic coding sequence
atgagcgccggcggcgacttcggcaaccccctgcggaagttcaagttggtcttccttggcgagcagtctgtcggaaaaacctccctgataacccgcttcatgtatgactctttcgacaatacataccaagcaaccattggtatcgactttctatccaagaccatgtaccttgaagatcgcaccgttaggctgcagctgtgggacaccgctggccaggagagattcaggtctctgattcccagttatatacgggacagtaccgttgctgttgtggtgtacgacatcacaaacctgaacagctttcagcagactagcaaatggatcgacgacgtgcgaactgagcgtggctccgacgtgatcattatgttggtgggcaacaagactgatctcgctgacaagagacaaattaccattgaagaaggagaacaacgcgcaaaagaactgtctgtgatgttcatcgaaacctccgctaagactgggtataacgtgaagcagctatttcgaagggtggcctccgctctgcctggcatggagaacgtccaggagaaatccaaggaaggaatgatcgatataaagcttgacaaaccccaagagccacctgcctccgaagggggctgctcctgttag

SEQ ID NO: 23155 - DNA, 3168 bp, Artificial Sequence
  Description of Artificial Sequence: Synthetic coding sequence
atgaccgtggagcagaacgtgctgcagcagagcgccgcccagaagcaccaacagaccttcctgaaccagttacgcgaaatcactggaattaatgacacacaaatactccaacaagctctcaaagactccaatggcaatttggaattggccgtggccttcctaacagcgaaaaatgctaaaactccccaacaggaggaaacaacgtattaccagaccgctttgcctgggaatgaccggtacattagcgtgggttcccaggccgatacaaatgtcattgatttgaccggagacgataaagatgacctgcaacgagcaattgctctgtccctagcggagtcgaacagagcctttagagagacaggaattaccgatgaggaacaggcaatttccagagtccttgaagcaagcatcgccgaaaataaagcttgcctgaagaggactcctacggaagtgtggagggattcccggaatccttatgatcgcaagcggcaggacaaggcgccagtaggactgaagaacgtggggaacacttgctggttctccgccgtcatacaaagcttgttcaacttgctcgagtttcggagactcgtgctcaattataaaccgccaagcaatgcgcaggacctcccccgaaatcaaaaggagcaccgtaaccttcccttcatgcgggagctccgatatctcttcgctctgttggtgggcacaaaacgtaagtatgtcgatccatcccgtgcagtggagattttgaaggatgcattcaagtccaatgatagccagcaacaggatgtaagcgaatttacacataaacttctggactggttagaagacgcctttcagatgaaggctgaggaggagacggacgaagagaagcctaaaaacccgatggttgaactgttctacggccggtttctggccgtgggcgtgctggaagggaagaaatttgaaaatacagaaatgttcggtcagtatccactgcaggtcaacgggttcaaggatctccacgagtgtctggaggcggctatgatcgagggagaaatagaatctctgcactccgaaaacagtgggaagtccggccaggagcattggttcacagagctgcctccggtgttgaccttcgagttgtcccgatttgaatttaatcaggccttggggcgacctgagaagatccataacaagcttgagttcccccaggtgctgtatttggatcggtacatgcataggaatcgcgagatcacccggataaaaagagaggagattaagcgtctgaaagactacctgaccgtgctgcaacaaagactggaaagatatctaagctatgggtctggacctaaaagatttcctttggtggatgtcctgcaatacgcactggagttcgcttcgtctaaacccgtgtgtacatcacccgtcgatgacatcgacgcaagttcccccccatccggatctattccctctcagacactgccctccactactgagcagcaaggcgcactctcttcagagctgcccagcacatcacccagcagtgtggccgctatctctagcaggtcagtaattcataaaccattcactcagagtagaatcccgcccgatttacctatgcaccctgctcctagacacatcaccgaagaggagttgtcagtcctggaaagttgcctccaccggtggcgtacagagattgaaaatgacacacgagacctccaggagtccatcagtagaattcatcggacaattgagctgatgtattctgataagagcatgatccaagtcccgtacagacttcacgccgtgctggtccacgaaggccaagcgaatgccgggcactactgggcgtatattttcgatcaccgggaatcacgatggatgaaatataatgacatcgccgtaactaaaagttcatgggaagaactcgtgagggattccttcggtggctacaggaatgcgtctgcctattgtttaatgtacatcaatgacaaggcccagtttctgattcaggaggagtttaacaaggagactggacagccactggttgggatcgaaaccctcccccctgatctgagggacttcgtggaggaggataatcagaggttcgagaaggagctcgaagagtgggacgctcagctggctcagaaagccctccaggagaagctgctagcaagtcagaagctgagggagagtgagacctccgttaccaccgcgcaggcagcgggggatcctgaatatctggagcagccttctagaagtgacttctcaaaacatcttaaagaggagaccatccaaataattactaaggcttcccacgagcacgaggacaagagtccagagacggtcctgcagagcgcaataaagctggagtacgcccgtctggtgaagctggcccaggaggacaccccccccgaaaccgactatagattgcaccatgtcgtggtgtactttatccaaaatcaagctcccaagaagataatcgagaaaacactacttgagcagttcggggatagaaacttgtcattcgatgagcgttgtcataacattatgaaggtcgcccaggccaaactggaaatgattaagcccgaggaggtgaatttggaagagtacgaagaatggcaccaggattacagaaagttccgggaaacaacgatgtacctcatcattggccttgagaatttccagagagagtcgtatatcgactcactactgttcctaatctgcgcctatcagaataacaaggaacttctgtctaaaggcttgtatcgggggcacgacgaagaactgatatcgcactaccgccgcgaatgcctgttaaagctgaatgagcaggctgctgagctcttcgagtctggggaggacagggaggttaataacggcctgatcattatgaatgaatttattgtgccgttcctgcccctgctgctcgtggatgagatggaggaaaaggacatcctggccgtggaggacatgcgcaaccgttggtgcagttacctgggccaagagatggagccccacctccaagagaaactcaccgattttttgccgaaacttttagattgtagcatggagatcaagtcgttccatgaaccaccaaaattaccttcttacagcactcacgaactgtgcgaacggtttgcacgaattatgctgtccctgtcgcggacaccagcagatggaagatag

SEQ ID NO: 23156 - DNA, 3264 bp, Artificial Sequence
  Description of Artificial Sequence: Synthetic coding sequence
atgaccgtggagcagaacgtgctgcagcagagcgccgcccagaagcaccaacagactttcctgaatcagttgagggagataacaggaattaatgatactcagatcctgcagcaggccctgaaagactcaaatgggaatctagagttagctgtggctttcctaacagcgaagaatgcgaagaccccccagcaggaggaaaccacatactaccagactgcgttgccagggaacgatcgctacatatctgtggggagccaggctgacacaaatgtgatagatcttacaggggacgacaaagatgacttgcagcgggcgatcgcattatctttggctgagtccaacagggccttcagagaaaccggtatcacagacgaagagcaagccatcagtagagtactggaggccagtatcgccgaaaataaagcctgtttgaagaggacaccaacagaggtttggcgggattctagaaatccctacgatcggaaacggcaagataaggctccagtcgggcttaaaaacgtgggaaatacttgctggttttcggctgttatccagtccttattcaatctcctggagttcagacgcctcgtgctgaactataaacccccttcaaatgctcaagatcttcctaggaatcagaaggaacatcgcaacctgccatttatgcgcgagttacgctacttattcgcactgttggttggcaccaaacggaaatacgtggacccaagccgcgctgtggagatcttgaaggatgcattcaagagcaacgatagccagcagcaggatgtgagtgagttcactcacaaactgcttgactggctcgaagacgcctttcagatgaaagctgaagaggagacagatgaagaaaaacctaaaaatcctatggtggagctcttctacggccggtttcttgccgtgggggtgctggaaggtaaaaaatttgagaacacagagatgtttggccagtaccccctccaggtgaacgggtttaaagatctgcacgaatgtcttgaggcggcaatgatcgagggagagatcgaatctctgcattcggaaaacagcggcaaatccggccaggaacattggtttactgagctacctccagtgttaacattcgagctgtcaagattcgaattcaaccaggccctgggcaggccagagaaaatccataacaaactggaattcccccaagtgctgtatctggacagatatatgcaccgaaatagagaaattacacgaattaagcgggaggagatcaagagattgaaggactacctgacagtactgcaacaaaggctggaacgttacctcagctatggctcgggccctaaacggttccccctggttgatgtactgcagtatgctcttgagttcgccagttccaaaccagtctgtacctctcctgtggacgatattgacgcctcctcccctccttcaggctcaattcctagccaaactctcccatctaccactgaacagcaaggtgctctctcctctgagctgccaagtacaagccctagctccgtagccgccatttccagccgttcggttatacataagccctttacccagagccgcattcctccagacctgcccatgcatcccgctccccgccacatcaccgaagaggagttgagcgtgctcgaatcttgtctgcaccggtggcgtaccgagattgaaaatgacactcgggatctgcaggaatctatcagtagaatccatagaaccatcgagctgatgtatagcgacaagagcatgattcaggtcccttaccgcctgcacgcagtactcgtgcacgaagggcaagccaacgctgggcactattgggcttacatcttcgaccaccgggagtccagatggatgaaatataacgacatcgccgtcaccaagagctcctgggaggaactggttagggatagcttcggaggctaccggaacgcatctgcctattgcctgatgtacatcaacgacaaagcgcagtttctcatacaggaagaattcaacaaggagactggtcaacccttggtgggcatcgagaccttgccgcccgatttacgggacttcgtggaggaggataaccagaggttcgaaaaggaacttgaggagtgggacgcacagttggcccaaaaagccctccaagagaagttgctcgccagtcaaaagttgcgtgaatctgaaaccagtgttacgaccgcccaggctgccggcgacccggagtatctcgagcaaccgtccaggtctgacttcagcaagcatcttaaagaggaaactattcagatcataaccaaagcatcccacgagcatgaagataaaagtcctgagacagtgctgcaatccatcatgatgacgccaaatatgcagggaatcataatggccattgggaaatctcggtccgtgtacgatcgatgcggaccggaagccgggttttttaaggctataaagctagagtatgctaggctcgtcaaactggctcaggaggataccccccctgagacagactacaggctgcatcacgtagtcgtgtatttcatccagaaccaggcgccaaagaagattattgagaaaaccctgctggagcagtttggggatcgcaatctctcctttgatgagcgctgtcataacatcatgaaggtcgcccaggctaaattggaaatgatcaagcctgaagaagtcaatttggaggaatacgaagagtggcaccaggactaccgcaaatttcgtgaaaccactatgtacctgattatcggcttagagaattttcagagagagagttacatcgactccctgctttttctcatatgtgcttaccaaaacaacaaggaacttctgagcaaggggttatatcgcggccatgatgaagaactgatttcccattaccgacgagaatgcctgctgaaactgaatgagcaagctgcagagctgtttgaatctggagaggatagggaagtgaataacggactaatcataatgaatgagttcatcgtgccgttcctgccactgctcctcgtcgacgaaatggaggaaaaagatatcctggccgttgaagatatgagaaacagatggtgttcatacctcggacaggagatggagccccacctccaggaaaagctgactgatttcttgcccaaactgctggactgctcaatggagatcaagtctttccacgaacctccaaaactgccctcatactccacacacgagctgtgtgaacgtttcgcaagaataatgctcagcctgtctaggacaccagctgatggaaggtag

SEQ ID NO: 23157 - DNA, 2559 bp, Artificial Sequence
  Description of Artificial Sequence: Synthetic coding sequence
atgagcagcgtgagccccatccagatccccagccggctgcccctgttattgacgcatgagggggtgctactcccgggtagtactatgaggacctccgtggacagtgctcgcaatctccaactggtccgctcccggctgttaaaggggacttcccttcagtccacaatcctcggagtaattcccaatacaccagacccggcgagtgatgcacaggatctaccacctctccaccggataggaacagctgctctggctgtgcaggtggttggaagcaactggccgaagccgcattatactctactgattaccggcctgtgcagattccaaatcgtgcaagtcctgaaggaaaaaccctatcctattgcagaggtggagcaactggatcgtttagaagaattcccaaatacctgcaagatgcgagaagagctaggcgaactgtctgagcaattttacaagtacgccgtccagctcgtagagatgttagatatgagcgtccctgccgttgccaagctcagaaggttgctggactcattaccccgggaggcactacccgatattctcacatcaatcatacgaaccagtaacaaagaaaagctgcaaattctggatgccgtgagcctggaggaaaggtttaagatgaccatccctctgctcgtccgacagattgaaggcctgaagctcttacagaagacgcgaaagcctaagcaagacgacgacaagcgagtgatagccattcgcccgattaggcgcatcacccatatctcaggaacactcgaggatgaggacgaggacgaagataacgacgacatcgtgatgcttgaaaaaaaaattcggacctcgagtatgccagagcaggcgcataaggtgtgcgtcaaggagattaagcgccttaagaagatgccccaaagcatgccagagtatgccctcacccgtaattatctggaattgatggttgaactcccttggaataagagcactactgacagactggacattcgagctgctcgcatcttgctcgacaatgaccattacgccatggagaagctaaaaaagcgagtactcgaatacctggctgtcagacaactaaagaacaaccttaaaggccccatcttatgcttcgtggggcccccaggggtgggcaaaacaagtgttgggaggtcagtcgccaaaactctcggccgagagtttcacagaattgctctcggcggagtgtgcgaccaatcagacattcggggacatcgcaggacatatgtgggaagcatgcctggacgaatcattaatggcctgaagacagtcggggtaaacaacccggtgttcctcttggatgaggtcgacaagctcggcaagagcctccagggggatcccgccgccgctctcctcgaagtgctggatccagagcagaaccacaatttcacggaccattatctaaacgtggccttcgatctctcacaggttctcttcattgctaccgcgaacacgaccgccacaatccctgcggccttactggatcgaatggaaatcatccaggtgccgggatacacccaggaagaaaagattgagattgcacatcgacatcttattccgaagcagcttgagcaacatggacttaccccgcagcagattcagattccccaggttaccaccctcgacattattaccaggtacacacgcgaggctggagtgcggagcctggatcgcaaattgggagccatttgccgggccgttgccgtcaaggttgcagaaggccagcacaaagaggccaagttggacaggtctgatgtaactgaacgcgaaggctgtcgggaacacattctggaagacgagaagcctgaatccatttccgataccaccgacctggcacttccgccggagatgcctattctcattgattttcatgccctgaaggatatattgggccctcccatgtacgaaatggaggtatcccagaggctctcccagcctggcgtcgcaatcggtctggcgtggactcccctggggggggaaataatgtttgtagaagcgtcgcgcatggacggtgaaggacaactaacgctgactgggcaactgggagacgtaatgaaggaatctgcacaccttgccatttcatggctacgttctaacgcaaagaagtaccaattaactaatgcattcggcagttttgatcttctggataataccgatatccacctgcacttccctgcgggggctgttacaaaggatggaccatccgccggtgtgaccattgtgacctgtcttgcttccctcttcagcggacggctcgttaggtctgatgttgcgatgaccggcgagatcacactacgagggctagttctgcctgtgggcgggattaaagataaagtcctcgccgcacatcgcgccgggttgaaacaggtgatcattccacgtaggaacgagaaggatctggaggggattccgggaaacgttagacaggatctgagctttgtgactgcgtcctgcttggatgaagtcttgaatgcagccttcgacgggggctttacagtgaaaacaagaccgggactcctgaattcaaaattatag

SEQ ID NO: 23158 - DNA, 390 bp, Artificial Sequence
  Description of Artificial Sequence: Synthetic coding sequence
atggccgacggcggcggcggcggcggcaccggcgccgtgggcggcggtggtaccagtcaggcatcggcgggcgctgctactggtgctactggcgcctccggcgggggaggtccaattaaccccgcttctttgccgccaggcgacccacagctgatcgccctgattgtggaacagctcaaaagccgaggattgtttgatagttttagaagggattgccttgctgacgttgatacaaaaccagcttaccaaaatttgcggcagaaagtcgataactttgtgtcaactcacctggacaagcaggagtggaaccctaccatgaacaaaaaccagctgcgtaatggcttgcgccagtcagttgtccagattcgccaaacgcccttcgagagttag

SEQ ID NO: 23159 - DNA, 1425 bp, Artificial Sequence
  Description of Artificial Sequence: Synthetic coding sequence
atggacgaggccggcagcagcgccagcggcggcggcttccggcccggggtggattccttggatgaaccccctaactctagaatcttcttagtgatatcaaagtacacccctgaaagtgtacttcgcgaacggttcagtcctttcggtgatatccaagatatctgggtggtgagagacaagcatactaaggagagcaagggcattgcttttgtgaagtttgcccgctcttcccaggcttgccgcgccatggaagagatgcatggtcagtgccttggccctaatgacaccaaacctatcaaggtctttattgcacagtctcggagctctggttctcatcgagatgtagaagatgaagagctgaccaggatctttgtgatgatccccaaatcatataccgaggaggacctgcgggaaaaatttaaagtttacggcgacatcgagtactgctccattatcaagaataaagtgaccggcgagagcaagggcttaggctacgtcaggtaccttaaacccagccaggcggcccaggcaatcgaaaactgcgatcgatcgttcagagccatcctggcagagcccaaaaataaagccagcgaatctagcgagcaagattactactctaatatgcggcaagaagctctgggacacgagccacgcgttaatatgttcccgtttgagcaacagtctgagttttcttcttttgacaaaaacgactcccgtggccaagaggctatctccaagcgattatctgttgtttctcgtgtacccttcaccgaggagcagcttttttctatttttgatatcgtgcccggcctcgaatactgcgaggtacagcgagatccttactcaaactatggccacggcgtggtgcagtattttaacgttgcaagcgctatctacgctaagtacaaattacatggctttcagtaccctcccggcaatcggataggcgttagcttcatcgacgacggaagcaatgccaccgatcttctccgaaaaatggcaacccagatggtcgccgcgcaattagcaagcatggtctggaataatccatcccagcagcaatttatgcaattcggcggttcatccgggagccagttacctcagatacagacagatgttgtgctgccttcctgtaagaagaaagcgccggccgaaacgccagtgaaagagaggctattcatcgtcttcaacccacatccgctgccgctggacgtactagaagacatcttctgccgattcggtaatctcatcgaagtgtacttagtgtcagggaaaaacgtgggttacgctaaatatgctgaccgcatctcagccaacgacgccatagcaaccttgcatggcaagatattgaacggagtcaggctgaaagtcatgttggccgactcacctcgggaggaatcaaacaaaaggcagaggacttactag

SEQ ID NO: 23160 - DNA, 1938 bp, Artificial Sequence
  Description of Artificial Sequence: Synthetic coding sequence
atgcggccccggaaggccttcctgctgctgctgctgctgggcctggttcagctgctggccgttgccggagctgagggcccggatgaggattcatctaaccgtgaaaatgccatagaggatgaggaagaggaggaagaggaagacgacgacgaggaagaagatgacctagaggttaaggaagaaaacggtgtgctagtcctcaacgacgcaaattttgataactttgtggcggacaaggacacagtgctgctcgagttttacgccccctggtgcggccactgcaaacagtttgcccccgagtacgaaaaaatagcgaacattctgaaggacaaggaccctcctatacccgtagctaagatcgatgccacctcggcatctgtgctagccagcagatttgacgtgtctggctacccaactattaagatcctgaaaaaggggcaggccgttgactacgaaggatcaaggactcaggaggagattgtggccaaggtccgcgaggtttcgcaacccgattggactccgccccctgaggtgacgctggtacttacaaaggagaactttgatgaagtcgtgaacgatgccgatattattctggtcgaattctatgctccatggtgcggccattgcaaaaaactggcacctgaatacgagaaggctgcgaaagagttaagtaagagatcccctcctattcccttggcaaaggtagacgctacagcagagactgatctcgccaaacgtttcgacgtcagtgggtacccgaccctgaagatatttcgaaaaggaagaccttatgactacaacggcccacgcgagaagtatggcatcgtagactacatgatcgagcagtccggaccgcccagcaaggagatcctgacactcaaacaggtacaggagttcttaaaggatggcgatgacgtgataattattggcgtgtttaagggcgaatctgatcccgcttatcaacagtaccaggatgccgctaacaatctgcgtgaagactacaagttccaccataccttcagtaccgaaattgcaaagttcctgaaggtcagtcagggccagctggtcgtaatgcaaccagagaaattccagtcgaagtacgaaccaagatcccatatgatggacgtccagggaagcactcaggactccgcaatcaaggattttgtcctgaaatatgctctgccactggtggggcaccggaaggtgtccaacgacgctaaacggtacacccgccggccactcgtcgtggtctactacagcgtggacttcagtttcgattatcgtgccgcaacacagttctggaggtccaaggtgctagaggtcgccaaggacttcccggaatatacgttcgctatagcagacgaggaagattacgccggggaggtcaaagacttgggccttagcgaatccggagaggacgtaaacgctgccattcttgatgaaagtggtaagaaattcgcaatggagccagaagagttcgactcagatacactccgggagttcgtgactgcctttaagaaaggcaagctaaaacctgtcattaaatctcagcccgtgcccaagaataacaagggccccgtcaaggtggtggtgggcaagacgttcgattctattgtcatggaccctaagaaggatgtgttaatcgaattttatgccccctggtgtggccactgcaagcagttagagcctgtgtataacagtttggccaagaagtacaagggccagaaggggttagtaatcgcgaaaatggatgccacagccaacgacgtgccctctgaccgatacaaggtggagggcttccccaccatatactttgcccccagcggggataagaaaaatccagtaaagtttgaaggaggtgatagggatctggagcacttgtccaagttcatcgaggagcacgcgacaaaactctcaaggacgaaagaagagctctag

SEQ ID NO: 23161 - DNA, 1338 bp, Artificial Sequence
  Description of Artificial Sequence: Synthetic coding sequence
atgtaccccaaccccctgatctactgcacctgctgggacccctggaacctgggccccaggaagttaattaaaacgccacaactgccccggaagaactcaaccggatctagtaagcttacaccgctcgtgccagcccccaagaaccataactacttgcaaccaacaaagcccgtggtttctccaaaaatgaaaatccactcagccaggcaggaagagacaaacaaaagcttttatgaagttattaatgtctcgcccgggtatcagctagtgagaaatcgtgagcaaatctccgttaccctgggggacgaaatgttcgacaggaagaagcggtgggagtccgaaatccctgataaaggcagattcagtcgaactaacatcatctccgacttggaagagcaaatctcagagctgacagcgatcatcgaacaaatgaatcgggatcaccagtccgcccagaagttgttgtcctccgagatggacttgcggtgcgcggagatgaaacaaaacttcgaaaataagaatcgggaactaaaggaagcacatgaggcagaattaagcgagctcgaaaacaactacaaggcggctcttaaggccgaaaaactggcagcgcaggaaaaactggaagagatgggaaaagagtacaaatatctgaaaaacatgtttcggacctatcaagattcaatctacgatgaaatggaggagaaatggagcaagcagaaagccaagtggaagaaggacgaaaaattcgaacgcgagaacattttactgcagcaaaaaaagaaaatgaccaagaaatttgaaatggagtcaggtgaagaagataaaaagatcaatgagtcttgttcggctgtgttcgaaaatttcatccaggagaaggaggaactgctgaagcagcatcaaagcgatacacttcagcttgaagaactccgcaaaactaaggaagtgccttggcgcagagatcagataaacagacactggcacgacgtcctccagcaactcctgctgatgcaggtcatgcaggaagagctgcatgcgcaggccctcatcctcgagagccttaatacgaatctgtactacacacagttggagttacagaaggagaaagccatcgtgggcaatttggagaagatgctgcagaccaaatttgccgagacggaggaaaaatataagcacactatacagatcctgacagaggagaatatccatctgaaacagaagattatcagcaaaaatgaggagatctgcgaaggctgctcgggcagactggcttctattacagtctccaaggacgactcagacacagtgcaggacgggtccaagaagggccaggaaagctag

SEQ ID NO: 23162 - DNA, 1872 bp, Artificial Sequence
  Description of Artificial Sequence: Synthetic coding sequence
atggagcccccccaggagaccaaccggcccttcagcaccctggacaaccgttccggtcaggtccaggtattgtccgccacaccactgttgcagaggaacccttactcttccccggacattatgcacattaaaggatccgaagcaagctctgtgccgtatgctcttaaccaggggacaacggccttgcctaagaataaaaaccaggaaggaaccgggcacagattgctcaacatgttgcggaagactttgaaggaatctgactcagaggagcttgagatcacacaggaaactccgaatttggtgccgtttggcgatgtggtgggttgcctcggaatacacataaaaaattgtcggcacttcatgcctaagatttccctgcagcattatgctaaccttttcatcagaatttctatcaataaggccgttaaatgcactaaaatgtgcagcctcctcagcaagaacgatgagaagaacaccgttattaaattcgatgaggtgaaatatttctccgtgcaagtccctaggcgatacgacgacaagaggaacaacatcctgttggagctgatccagtacgacaatcgcgaaaagcgcgccttcctgctgggatcggtccagattcacctgtatgaggtaattcaaaaaggatgttttatcgaggaggtccaggtgcttcacggaaacatctttgtgtgtcgccttgaggtagagttcatgttttcatacggcaacttcggctatggattctcgcatcaactcaagcccctccagaaaatcaccgagccgagcatgttcatgaatctcgcacctccacctgagagaacagatcccgttaccaaggttatcacacctcagacagtcgaataccccgcctttctaagcccagatttaaatgtgacagtgggtactcctgctgtgcaatccagcaaccaaccatcggtggtgaggttggaaaagctgcaacaacagcctcgcgaaaggctcgaaaagatgaaaaaagaatacaggaacctgaatacatggattgacaaagctaattatctggagagtatcctgatgccaaagctggagcataaggatagtgaggaaaccaatatcgacgaagcttccgagaacacaaagagcaatcatccggaagaagaactggaaaacatagttggtgtggatattcctctggttaacgaggaagctgaaactacagcgaacgagttactggacaatgatagtgaaaaaggcttaaccatccccacactgaatcaatcagaccaggacaacagtaccgccgacgcaagtaaaaatgatgagagcacgcccagtcccacagaggtgcacagcctgtgcacaattagtaaccaggaaaccatcaaggcggggcgcataccccccttgggtgagcggcagtctgagtccatgcccgaccgaaaaatgaaaaatgtgtttttccctcttgaggtcaagttgaaagataactacccatccatactgaaagccgattcatcgctttcggaggtagcctttagtcctaaagagtacaattctccttctttcaggcccgaatatatagaattcaagcccaaattccaggattgctctgataaatttgaggatctgcacgacatgactagttttacacaccttaaaaaagtcaaaagccgatcccgtctgctcggcaagtcaagcgatgatatccacaatcacgcccgccactctgcccgcccttatactgcaccagaggttaataagcagagagaatcctacagtggcaagttcactagccgcaggatggtgtcctccggactggttcacataaacgataaaacctctgattacgaaatgcataaaatgaggcccaaaaaaatcaaaaggggttactag

SEQ ID NO: 23163 - DNA, 3594 bp, Artificial Sequence
  Description of Artificial Sequence: Synthetic coding sequence
atgcacatcaagagcatcatcctggagggcttcaagagctacgcccagcggacagaggttaacggttttgaccctctctttaatgctatcacaggactcaatggatctggtaaatcaaacatcctagattctatctgtttccttcttggcatcagtaacttgtcccaggtgcgagcatccaatctgcaggatctcgtttacaagaatggccaggcaggaatcactaaagcctctgtctccatcaccttcgacaactccgacaagaagcaaagtccactggggttcgaagtgcacgacgaaatcactgttaccagacaagtcgtgatcgggggccgcaacaagtatctgatcaacggcgtgaacgccaacaatacacgagtccaggatttgttttgtagcgtcggcttaaatgttaataacccccattttctgattatgcaggggcgtattaccaaggtcttgaacatgaaaccgccggaaattttatccatgattgaggaggcagctggtaccaggatgtacgaatacaagaagattgccgcacagaaaactatagaaaaaaaggaggctaagttgaaggagatcaagactattctggaagaagagataacacctactattcagaagctgaaagaagagcgtagtagctacctggagtatcagaaagttatgagggagatcgagcatcttagtcgcctatatatcgcctatcaattcctgttggctgaggacaccaaagtgagaagtgccgaggagctcaaggaaatgcaggataaagtgatcaagttacaggaggaactttcagagaatgacaagaaaatcaaggctcttaaccacgagatagaagaactggagaagcgtaaggataaggaaactggcggaattctgaggagccttgaagacgctttggccgaggcccaacgggtcaacacaaaatcccagagcgcatttgacctgaagaaaaagaatctggcctgtgaagaatcaaaaaggaaagagctggagaagaatatggttgaagacagcaagactcttgccgctaaagaaaaggaagtgaaaaagatcacggatggactgcacgcactgcaggaagcaagcaacaaggacgctgaagcactcgcagccgctcagcagcattttaatgccgtaagcgccggactgagcagcaacgaggatggcgcagaggcaactctcgctggtcagatgatggcttgcaaaaatgatatttccaaagcgcagacagaagccaaacaggctcaaatgaagcttaagcatgctcaacaagagctgaaaaacaagcaggccgaagtgaaaaaaatggattccggatatcggaaggatcaggaagcattggaagccgtgaaacgcctcaaagagaaactcgaggctgagatgaagaaactgaattatgaggaaaacaaggaggagtcactgctagaaaagaggagacagttgtctagagacatcggtcggctcaaggaaacttacgaggcgctactggcccggttcccgaacctcaggtttgcgtacaaggacccagaaaaaaattggaacagaaactgtgtgaaaggcttggtggcatctctaatctcagtcaaagatacatcggcgaccaccgcactggaacttgtggccggagagcggctgtacaacgtcgtggtagatactgaagtgacgggaaagaagctgttagagcggggtgagctgaaacgacgatatactattatcccacttaataagattagcgctcgctgcatcgcccccgaaaccctgcgcgtcgctcagaacctagtcggcccagataacgtgcacgttgctctgagtttggtcgaatacaaaccagaactccagaaggccatggaattcgtgtttggcactaccttcgtctgtgataatatggataacgccaagaaggtggccttcgataaacggataatgacccgcaccgtgactctggggggggatgttttcgatccacatggaacgttgtctgggggtgcaaggagtcaggcagcctcaattctcaccaaattccaggagctaaaggatgtgcaagatgaactgagaataaaagaaaatgaattaagggccctcgaagaggagcttgcgggactcaaaaacacagctgagaagtatcgccaactcaaacagcagtgggagatgaaaacagaggaagcggacttgctgcagacaaaactacagcagtcttcataccacaagcagcaggaggagttggacgccttgaagaaaactatagaagagagtgaagagacccttaagaatacaaaggaaatccaaaggaaggccgaagaaaagtatgaagtcctcgaaaacaaaatgaagaatgccgaggcagagagagagcgggagctcaaggacgcgcagaagaaattagactgcgccaaaaccaaggccgatgcatcatccaaaaaaatgaaggagaaacagcaggaggtggaagcgattacactggaactggaagagctgaagcgagaacacacttcttataagcaacaactggaagcagtcaatgaagccattaagagttacgaatcacagattgaggtcatggccgcggaagtcgccaagaacaaagaatctgtgaacaaggcgcaggaggaagtgacgaagcagaaggaagtgatcaccgctcaagataccgtaatcaaggccaagtacgccgaggtggcgaagcacaaggaacagaacaacgatagtcagctgaagataaaagaactggatcacaatatcagcaagcataaacgtgaagccgaggatggcgctgctaaggttagcaaaatgcttaaagattatgactggattaatgcggaaagacacctctttggacagccgaattcagcctacgattttaagacaaacaatcctaaggaagctgggcagcgcctgcaaaagcttcaggagatgaaagaaaaacttggccgtaatgtaaatatgagggcaatgaacgttcttacagaggctgaagaaagatacaacgatctaatgaagaagaagaggattgttgaaaacgataaaagcaaaattttgacaaccattgaagatctggaccaaaagaagaatcaggctctcaacatcgcttggcagaaggtgaacaaggatttcgggagcatctttagcactctgttgcctggcgccaatgctatgctcgctcctcctgagggacagacagttttagacggacttgagtttaaagttgctcttggaaatacttggaaagagaacttgacagagctttctggcgggcaacggtcgcttgttgctctatctctgatcctcagtatgctactgttcaagcccgctcccatttacatcctcgacgaagtcgatgcagccctcgacctcagtcacacccaaaacatcggccagatgttgagaacacatttcacccactctcaatttattgtggtgtccctcaaggaagggatgttcaataacgctaatgtgctgttcaaaaccaaattcgtagacggggtgtccacggtggccaggtttacccagtgccaaaacggtaaaatcagtaaggaggccaaaagcaaggccaaaccccctaagggtgctcacgtcgaagtgtag

SEQ ID NO: 23164 - DNA, 1080 bp, Artificial Sequence
  Description of Artificial Sequence: Synthetic coding sequence
atgcggaccgccgaccgggaggcccggcccggcctgcccagcctgctgcttttacttttggcaggtgccggcctcagcgccgccagccctcccgccgcccccagattcaacgtttcccttgactctgtaccagagctcagatggcttccagtcctaaggcattacgatctcgatctggtgagagcggctatggctcaagtcattggtgatagggtgcctaaatgggtccatgtcctgataggaaaggttgttctggagttggagcgctttctgcctcagcccttcactggggagattagagggatgtgcgacttcatgaacctgagtcttgctgattgtttgctcgtcaaccttgcctacgagtcatcggttttttgtaccagtattgttgcccaagattcccgcggacacatctatcatggacgtaatctggattacccctttggaaacgtgctgaggaaacttacagtggatgtacagttcctgaagaatggacagatcgcattcaccggcaccacttttattggctatgttggactttggactggccagtcccctcacaagtttacagtgtccggtgatgagagggacaaaggatggtggtgggagaatgccatcgctgccctttttcgacgacacatcccggtcagttggctgataagagctaccttatcagagagcgagaactttgaggccgccgtcggaaaactagctaagacccccctgattgccgacgtttattacattgtcggaggtacaagcccacgggagggagtcgtgatcacgagaaatagggacgggccggctgatatctggcccctggatcccctaaacggggcctggtttcgagtggagacaaactatgaccactggaagcccgcaccaaaagaagatgaccgcaggaccagcgcgattaaagcactgaacgcaaccggccaggccaacctgtccctggaagccctttttcagatcttgtccgtcgtgccagtatataataatttcaccatctatactaccgtaatgtctgcaggctccccagataaatatatgacaagaatccgcaatccatcgcgaaaatag

SEQ ID NO: 23165 - DNA, 1647 bp, Artificial Sequence
  Description of Artificial Sequence: Synthetic coding sequence
atggccctgcacgtgcccaaggcccccggcttcgcccagatgctgaaagagggtgcaaagcacttctcagggctggaggaggcggtgtatcggaacattcaggcatgtaaggagcttgctcagaccaccaggacggcctacggcccaaacggaatgaacaagatggtgataaaccacctggaaaagctctttgtaaccaatgacgcagcgactatacttcgggagcttgaggtacagcatccagccgccaaaatgatcgtgatggcctcccacatgcaagagcaggaagttggcgacggaacgaacttcgttttagttttcgccggcgcactgcttgaactggctgaggaattactcagaatcgggctctccgtctctgaggtaatcgagggctatgagattgcttgcagaaaagcacatgaaatcctccccaatctggtgtgctgctccgcgaagaatctccgagacatcgatgaagtgagctcacttctccgcaccagtattatgtcaaagcaatacggaaatgaagtctttctggccaaacttatcgcccaggcctgcgttagcattttcccagactctggccactttaatgttgacaatataagagtttgcaagatcttggggtcaggcatctcgagtagctctgttttacacggcatggtgtttaagaaagagactgagggtgacgtcacatccgtgaaggacgccaaaatcgccgtttacagctgtccgttcgatggtatgatcactgagacaaaaggtacagtgctcataaagactgcggaagagctcatgaatttttctaaaggagaggagaatttgatggacgcccaagtaaaggccatagcggacaccggcgctaacgtcgtggtcacaggagggaaggtggcagacatggctctccactatgcgaataaatataacatcatgctcgttagacttaacagtaaatgggacctaaggcgactctgtaagacagtcggcgctaccgcgcttccacgattgacccccccggttctggaggagatgggccactgtgacagtgtctacctgtcagaagtgggcgatactcaagtggtggtgttcaagcacgaaaaggaagatggtgccatctcaacaatcgtcttgcgagggtctactgacaacttgatggatgatatcgaacgtgccgtggacgacggtgtcaacacgtttaaagtgctgacacgggacaagaggctggtacctggggggggagcgactgagatagagttagctaagcaaataaccagttatggtgaaacatgtcccggcctcgagcaatacgctattaaaaagtttgccgaggcgttcgaggccatcccccgtgccctggcagaaaattctggggttaaagccaacgaagtcatttctaagctgtacgcggtgcaccaggagggcaacaaaaacgttgggctcgacattgaggccgaggtgcccgccgttaaggatatgctggaggccggtatactggacacatacctgggcaaatattgggccatcaaacttgcgactaatgcagccgtcactgtcctcagggtagatcaaattatcatggcaaaaccagccggcgggccgaagccaccaagtgggaaaaaagattgggatgatgaccagaatgactag

SEQ ID NO: 23166 - DNA, 690 bp, Artificial Sequence
  Description of Artificial Sequence: Synthetic coding sequence
atgaacatccggaacgcccagcccgacgacctgatgaacatgcagcattgtaaccttctgtgcctgccagaaaattaccagatgaaatattacctttaccacggactatcttggccacagctgagctatatagcagaggatgaagacgggaagatcgtggggtatgtacttgccaagatggaggaggaaccggacgatgttccgcacggccatatcacctccttggcagtaaagcgaagtcaccggcgccttgggcttgctcagaaacttatggatcaggcatcgagggcaatgatcgaaaactttaatgctaaatatgtctctttacacgttaggaagagcaatcgacctgctttgcatttatattctaacactcttaactttcaaatctctgaggttgaacccaagtactacgcggacggcgaggacgcatatgcaatgaagagggatctttcacaaatggccgatgagctccgccgccagatggacctaaaaaaaggtggctatgtggttttggggagtcgagagaaccaggaaacccagggcagcacactgtcggacagtgaggaggcctgccagcagaaaaaccctgcaactgaggagagcggttcggacagtaaggagcccaaggaaagcgtcgagtcaacgaatgttcaggactcctctgaatcaagcgactcaacctcctag

SEQ ID NO: 23167 - DNA, 1374 bp, Artificial Sequence
  Description of Artificial Sequence: Synthetic coding sequence
atgagcgccctgcggcggagcggctacggccccagcgacggcccctcttacgggaggtattacggccccggcggtggtgatgtaccggtgcacccccctcctccattgtaccccctgcgaccagaaccaccccagccgccgatctcctggagagtcaggggtggaggtcccgctgaaacaacctggctgggggagggaggcggaggagacggttattacccctcgggtggagcttggcccgagccgggcagagccggcggctctcatcaggaacagcccccttacccatcttacaatagcaactattggaattctactgcaaggagccgcgctccctatccctcaacgtacccagtccgaccagaactgcaaggccagagtctgaactcctacacgaatggggcgtatggacccacctaccccccaggaccaggcgcaaatactgccagctatagcggagcttattacgcacctggatacacccagacctcctattctactgaagtgccttctacgtatagatcatcgggaaacagtcccaccccggtttccagatggatctatccccagcaggactgccaaacagaggcgccacccctgcgcggacaggtgcctgggtatcctccctcccagaaccccgggatgaccctgccacactacccctatggagacgggaaccggtccgtgccccagagtggaccgacagtgagaccacaggaagatgcttgggcgtcaccaggtgcatatgggatgggaggaaggtatccatggccttcaagcgcaccctcagctcctccagggaacctatacatgaccgagtctacctccccttggccctcttctggctcacctcagagcccaccttctccacccgtgcagcaaccaaaagattcaagttacccctactcccagagcgaccaatccatgaatcgacataacttcccttgttcggttcaccaatatgaatcttcagggaccgttaacaacgacgactcagatcttctggattcgcaggtgcagtacagtgccgagccgcaactctacgggaacgccacttcagaccaccctaataatcaggatcagtcgagctccctgcccgaggagtgtgtaccatccgatgaaagtaccccacctagcatcaagaagattatccatgtactggaaaaggtccagtatctggagcaggaggttgaggagtttgtggggaaaaaaaccgataaggcatattggttgctcgaggagatgctcacaaaagagctgctagaattggatagcgttgagacaggcggacaggatagcgtgcgtcaggctcgcaaagaggctgtgtgcaagatccaggctattctggaaaaacttgagaagaaggggctatag

SEQ ID NO: 23168 - DNA, 3201 bp, Artificial Sequence
  Description of Artificial Sequence: Synthetic coding sequence
atgcagagcaccgacctgggcaacaaggagagcggcaagatctggcatagaaaacccagtcccgcgactagagatgggatcatagtgaacattatccacaacacctcggattaccaccccaaagttctccgctttctcaacgtcgcatttgacggcaccggtgactgcttgattgcaggtgaccatcagggaaacatctacgtgttcgatctccatggcaatcgattcaacctggtgcagagaacagctcaagcctgcaccgctcttgcatttaatcttagaaggaagagcgagtttctggtggctctggcagattacagcattaagtgtttcgatacagttaccaaagaacttgtctcctggatgcgcgggcacgaatcatccgtattctctatttctgtgcacgccagcggaaaatatgcgataaccacgagtagtgacacagcccagctctgggaccttgataccttccagcgtaagcggaagctgaatataaggcagagcgttggtattcagaaagtattcttcctgccgttgagtaatacaatcctctcatgtttcaaggacaactcgatctttgcatgggaatgtgacacactgttttgtaaataccagctgccagctcctcccgaaagcagctccatcctatacaaggtgttcgccgtcacaagggacggtcgcatcctggccgcaggcgggaagtcgaatcacctgcacctttggtgtcttgaggcaaggcaattattccgcattatccagatgcctaccaaagtgcgggcaatccggcacttagaatttcttccggacagtttcgacgcgggatcaaatcaggtgcttggagtgcttagccaggacgggatcatgagatttattaacatgcagacttgtaagctgttgtttgaaatcggaagcctcgatgagggcatctcaagttccgccatcagcccacatggccggtacattgcgagcatcatggagaatggctcattgaatatctacagtgtgcaggctttgacccaggagataaataagccccccccccctctggtcaaagtcatagaagacctgcccaagaataagctttccagttctgatttaaagatgaaagtgacctccggccgggtgcagcaaccggctaagagcagggagtccaaaatgcagaccaggatcctgaagcaggatcttactggtgattttgagtctaagaaaaacgagctgcctgatggccttaataaaaagaggttacagatcttgcttaagggttacggggaatatcccacgaaataccggatgttcatatggaggtctcttctccagctgcctgagaaccacaccgcatttagcacactcattgacaaaggaacccacgtcgcctttctcaacttgcagaagaagtatcctattaaaagcagaaagctgctgcgcgtactgcagaggactctctctgcattggcccattggtccgtgattttctcagacaccccatacctcccactgctggcttttccctttgttaagctctttcagaacaaccagttgatttgcttcgaagtaatcgctacattgattatcaactggtgtcagcattggttcgagtattttccgaacccgcctattaatatcctgtcgatgatcgagaatgtcttggccttccatgacaaggaacttctgcagcatttcatagaccacgacatcacgtcccagttgtacgcctggccccttctcgagacggtgttttccgaggttcttacaagagaggagtggctgaagttattcgacaatattttctctaaccaccccagttttcttctcatgaccgtcgtcgcttataacatatgttcccgcacacctcttctctcctgtaatttaaaagacgatttcgaattcttcttccatcatcggaataaccttgatattaacgttgttattcgacaagtgtaccacctgatggagaccaccccaacagacatccatcccgatagcatgcttaatgtgtttgtcgcgctaacaaaaggccagtatcccgtgtttaaccaatatccaaagtttatcgttgactatcagactcaggaacgcgagcgtatccgaaacgatgagctagattatctcagagagaggcaaacggtcgaagacatgcaagctaaagtcgaccagcagcgcgttgaagacgaggcctggtaccagaaacaggagttacttcgcaaggctgaagagacaagacgtgaaatgctgcttcaggaggaggaaaagatgatccaacagcggcagcggctggcagctgtgaaaagagagttaaaagtcaaggaaatgcatctacaggatgccgcaagaagacgttttctcaagctgcagcaggatcaacaagagatggaactccgacggctcgatgatgagattggaaggaaggtctatatgagggaccgagagatagcagccaccgctagggacctcgagatgcgccaactggagttggagagtcagaagcgactgtacgaaaagaatttaactgagaaccaggaggcccttgccaaggagatgcgtgccgacgccgatgcctaccgtaggaaagtggacctggaggagcatatgttccacaaacttatcgaggctggcgaaactcaaagtcagaagactcagaaagtgatcaaggaaaacctggccaaggccgaacaggcttgcctgaacacagactggcagattcaaagcctgcataaacaaaagtgcgatgacctccaacgcaataagtgttaccaagaagtggctaaactgctaagagaaaatcgtcgcaaggaaattgaaattataaacgcgatggtggaggaagaagctaaaaaatggaaggaggctgagggaaaagaatttaggctcagatcagctaagaaagcaagcgctctgtctgacgccagcaggaagtggttccttaaacaggaaattaatgccgctgttgagcacgcagaaaatccgtgtcataaggaggaacctagatttcaaaatgagcaggatagctcttgtttgccaagaacttcccagctgaatgactcctcggaaatggacccatcgacccagatcagtctgaaccgacgtgctgtggagtgggataccacagggcagaatttaataaagaaggttcggaacctacgccaacgcttgaccgccagggccagacacagatgtcagactccccacctcttggccgcttag

SEQ ID NO: 23169 - DNA, 618 bp, Artificial Sequence
  Description of Artificial Sequence: Synthetic coding sequence
atggagggcaacggccccgccgccgtgcactaccagcccgccagccctccaagggatgcatgcgtgtactctagctgttactgcgaagaaaacatctggaagctatgcgagtatatcaagaatcacgaccaatacccgctggaggagtgctatgcagtgttcatttccaacgaaaggaaaatgatccccatctggaaacaacaggctcggcccggggacggccctgttatctgggattaccacgtggtcctcctccacgtgtcctcaggggggcagaacttcatatatgatctggatacagtgttgcccttcccctgtctcttcgacacttacgtggaggacgcattcaaaagcgatgacgacattcacccacagttcaggcgtaagttcagggttatacgggccgattcatacctcaaaaacttcgcttctgaccggtcccacatgaaggatagttccgggaattggcgcgaaccgccacccccttacccctgtatcgagaccggggactccaagatgaatctaaacgatttcatctctatggatcccaaggtgggatggggcgcggtgtacacccttagtgagttcacgcaccgctttgggtctaagaattgttag

SEQ ID NO: 23170 - DNA, 1974 bp, Artificial Sequence
  Description of Artificial Sequence: Synthetic coding sequence
atgagccaggtgctgttccaccagctggtgcccctgcaggtgaagtgcaaagattgcgaggagcggcgtgtctccattagaatgagtatcgagcttcagtcggtctctaaccctgttcaccgcaaggatctggtaatccggcttacagacgacacggatccatttttcttatataatctggtgatctcagaggaagattttcagagtctgaagttccagcaaggtctgctggtcgacttcttggctttcccacaaaagttcatagatctgctgcaacagtgcacccaggaacacgccaaggaaatccctagattccttttgcagctggtatctcccgccgctatcctcgacaattctccagcatttctgaatgtcgtggagaccaatccctttaagcacttgactcacctgtctctcaagctgctgcctgggaacgacgtcgagattaagaagttcctggctggatgtctcaaatgctcaaaggaggaaaaactgagcctgatgcagtctttagatgacgccaccaaacagctcgatttcacccggaagacgctagccgagaagaagcaggagttggataaacttaggaacgagtgggcgagtcacacggcagcactgactaacaaacacagtcaggagctgaccaatgagaaagagaaggccctgcaggcccaggtgcagtaccagcaacagcacgagcagcaaaagaaagaccttgagattctgcatcaacaaaacatccaccagctacagaatcgcctgtccgaattagaggccgccaataaagacctaaccgaacgtaaatacaagggagactccacaatcagagagcttaaggctaagttgagcggagttgaggaggagctgcagcgcaccaaacaagaggtgctgtcccttaggcgcgaaaacagtacattggatgtggagtgtcatgagaaagagaaacacgttaatcagttgcagaccaaagtggctgtcctggaacaggaaatcaaagacaaggatcagttggtgctgcgcactaaagaggcatttgacacaatacaggagcagaaagtagtcttggaggagaacggcgagaagaatcaggtacagcttgggaaattggaggctactataaagagcctgtctgccgaattgctgaaagcaaatgaaatcataaagaagctgcaaggggacttgaagactcttatgggtaagctgaagctgaagaataccgttactatacaacaagaaaagctgcttgctgaaaaggaagagaaattgcagaaggaacagaaggaactacaggatgtgggacagagcttacgtatcaaagaacaggaggtttgcaagctccaagagcagttggaggctaccgtgaagaagctcgaggaatccaaacagcttctgaaaaataacgaaaaattgataacctggttgaacaaagagctgaatgagaaccagctggtaagaaaacaggacgtactgggaccttcaactactccacccgcccattccagtagtaacaccatccggtcaggcattagtcccaacctgaacgttgtcgatggaagactgacttaccctacttgcggcatcggataccctgtctcctctgcctttgcctttcaaaatacgtttccccatagtattagtgctaagaatacgagccaccctgggtcagggactaaggtccagtttaacctccagttcaccaaacctaacgcttcgctgggcgatgtgcaatctggagcgactatctctatgccatgctcaaccgataaggagaatggcgagaatgttggacttgagagcaaatacctcaaaaagagagaagattccatacccctcagaggcctgagccaaaatttgttctctaacagcgatcaccagcgcgacggtaccctgggagcccttcacaccagttcaaagccaaccgccctcccttcagcatcctctgcgtatttcccaggacaattgcctaatagctag

SEQ ID NO: 23171 - DNA, 237 bp, Artificial Sequence
  Description of Artificial Sequence: Synthetic coding sequence
atgcggttcatgatgatgcgggccgagaacttcttcatcctgcggcgcaagcccgtggaaggttacgatatctccttcctcattacaaatttccatactgagcagatgtataaacataaattggtggatttcgtgattcatttcatggaggagattgacaaggagattagtgaaatgaagctttccgtaaacgcccgcgccagaatcgttgcggaggagttcctgaagaacttttag

SEQ ID NO: 23172 - DNA, 933 bp, Artificial Sequence
  Description of Artificial Sequence: Synthetic coding sequence
atgcccctgctggtggagggccggcgggtgcggctgccccagagcgccggtgacctggtacgggcccacccaccgttagaagaacgcgccaggttgcttagaggccagtccgttcagcaggtcgggcctcaaggcctgttgtacgtgcaacagagggagctcgccgtgacatccccgaaagacggatctatttcaatcctgggaagcgatgacgccactacctgtcacattgttgtgctcaggcacacaggaaatggtgccacttgccttacacattgtgacggaactgataccaaggccgaggtccccctcataatgaactccatcaaaagcttttcagatcatgcccaatgcggtagactcgaggttcacttggtgggcggcttcagcgatgaccggcagttatcccagaagttgacccatcagctgctgtccgaatttgatcgccaggaagacgatatccatctcgttacactctgcgtaactgaactaaacgaccgcgaagagaacgagaaccattttcctgtcatatacggaattgccgtgaacatcaaaacggccgagatctatcgcgcaagtttccaagatagaggacctgaggagcaactgcgggctgcccggactctcgcgggcggtcccatgattagtatctatgatgctgaaacagaacagctcaggatcggtccttacagctggactccctttccccatgtggatttttggcttcatcaagacgacaagcagattctggaaaacctgtccacatccccgctggcagaacccccacacttcgtcgaacacatacggagcacgctcatgttcctaaagaaacatccctcgccagctcacacgcttttttccgggaataaggcactgctctacaaaaaaaacgaagatggattatgggagaaaatcagttcacccggatcatag

SEQ ID NO: 23173 - DNA, 924 bp, Artificial Sequence
  Description of Artificial Sequence: Synthetic coding sequence
atgaccgagaccaccaagacccacgtgatcctgctggcctgcggcagttttaatcctattactaaagggcacatccagatgtttgagcgggcaagagactacttgcacaagacagggagattcatcgtgatcgggggcattgtgtccccagtgcacgactcatatgggaagcaggggctcgtctccagcaggcatcggctgataatgtgccagttagcagtacagaatagtgattggattagggtcgacccatgggagtgctaccaggatacttggcaaactacatgttctgtgttagaacatcaccgcgacctgatgaaaagagtgacaggatgtatcctcagcaatgtgaatactccttccatgactcccgtcatcgggcaacctcagaacgagaccccacagcccatctatcagaattccaatgtggctacaaagcccaccgcagccaaaattctgggaaaggtgggcgagtccctgtctcggatttgctgcgtcagacctcctgtagagcggttcacttttgttgatgagaacgccaacctcgggacggtgatgaggtacgaggagatcgagctcaggattttattgctgtgtggatcggacctgctagaaagtttctgtattcccgggctgtggaatgaggccgacatggaggtgatagttggggatttcggcatcgtggtggtacctagggacgctgcagataccgatcgaatcatgaatcattcttccattctcaggaaatataagaataacataatggtcgtcaaagacgacatcaatcatccgatgagcgtcgtcagctctaccaagagccggcttgcgctgcagcatggcgacgggcacgtggtggattacctgtctcaacccgtgatagactatattctgaaatcccaactttacatcaatgcatcagggtag

SEQ ID NO: 23174 - DNA, 1476 bp, Artificial Sequence
  Description of Artificial Sequence: Synthetic coding sequence
atggaggagggcaagatggacgagaacgagtggggctaccacggcgagggtaataaaagtctagtggttgcccacgcccagaggtgtgtagttctgagattcctgaagtttccccccaatcggaagaaaacaagtgaagagatcttccagcacctccagaatattgtggatttcgggaaaaatgtaatgaaagagttcctcggcgagaactacgttcattacggagaggtcgtccagctgcccctagaatttgttaaacagctttgtctaaaaatccagtcagagcgcccagagtcaagatgtgacaaagatctggacacactctccggatacgcaatgtgtcttcctaatctgacccgactgcagacttatagattcgcggagcatagacccattctgtgcgtcgaaatcaaacccaagtgcgggttcattcctttcagctctgatgtgactcacgaaatgaaacacaaagtctgccggtattgcatgcaccagcacttaaaggtggccaccggcaaatggaaacaaattagcaaatactgtcctctagacttgtactcagggaataaacagcgcatgcattttgccctcaaaagtttgcttcaggaagcccagaacaatcttaagatttttaaaaatggagagctcatttatggatgcaaggatgcacgatcccctgttgcagactggagcgagctggcccaccacctaaaacctttctttttcccatccaatggattggctagcgggccacactgtacccgcgctgtcatcagagagctcgttcatgtcatcacccgtgtcttgttgagcggttccgataagggcagggccggaacactgtcgcctggactcggaccgcaggggcctagagtctgtgaagcaagccctttttctaggagcctgagatgccagggaaaaaatacacccgaacgctcagggttgcccaaggggtgtctcctttataaaacattacaggtacaaatgttggatttactggatattgaaggactgtaccctctatacaatagagtcgagagatacctcgaagagttcccggaagagagaaaaacccttcagatcgatggaccatacgacgaggccttctatcagaagctcctggacctatctactgaagacgatggtacagttgccttcgccctgaccaaagtgcagcagtacagggtggctatgaccgccaaagactgttctataatgattgccctctccccttgtctgcaagacgcctcctccgaccagcgtcctgtggtccctagtagtcgcagtcgcttcgctttttccgtgtccgtcctggacctggacctgaaaccctacgagagtatcccccaccaatacaaactggacggaaaaatcgtgaattactacagcaaaacagtccgggctaaggacaatgcggtgatgagcacccgcttcaaagaatctgaggattgcacactggtccttcacaaggtgtag

SEQ ID NO: 23175 - DNA, 2640 bp, Artificial Sequence
  Description of Artificial Sequence: Synthetic coding sequence
atgatgttctaccggctgctgagcatcgtgggccggcagcgggcctcacctggctggcagaactggtcatccgcccggaacagtacttccgctgccgaagcccggagtatggccttgccaacccaggctcaggttgtgatttgtggcggggggatcaccgggaccagcgtagcatatcacctgagtaagatgggttggaaagacatcgttttactcgaacagggtcgcctggctgctgggagtacaagattctgcgcggggatccttagtacggctcgacacctcaccattgaacagaagatggccgactactccaataagttgtattaccaattggaacaggagacgggtattcaaactggatacacgagaaccggctccatttttctggcccagactcaggaccggctaatctctctaaagcgcattaatgccggactgaacgtgatcggaataccttccgaaatcattagtcctaagaaagtggccgagctgcaccatctcttgaacgtgcatgacctggtcggggccatgcatgtcccagaggatgctgtggtgagtagtgctgatgtggccttagcactcgccagcgcagcttcccaaaatggtgtgcaaatatacgaccgaacaagtgtgttacatgttatggtgaagaaagggcaggtcaccggcgttgagactgacaagggacagatcgaatgtcagtattttgtgaattgcgcaggccaatgggcgtatgagctcggcctctctaacgaggagcccgtgtcaatccccctccacgcatgtgagcacttttacttgctgacgaggccacttgaaactcccttgcaatcctccacaccaactattgtcgatgctgacgggcgaatctatattcggaattggcagggggggatcttatctggcgggttcgagaagaaccccaagccaatttttacagaaggtaaaaaccaattggagattcaaaatctgcaggaggattgggaccatttcgagcctttgctatcctcacttctgagacgtatgcctgagctagagaccctggaaattatgaagctagtgaactgccctgagacatttactccagacatgagatgtattatgggggaatctcctgcagttcaaggatacttcgtgctggcaggcatgaattccgctgggttatccttcggtggcggcgctggcaaatacctggccgaatggatggttcacggctaccctagcgaaaatgtctgggagctggatcttaaaagattcggagctctgcagagttcacgtacgttccttcgccatagagttatggaggtcatgcccctgatgtatgacctgaaggttcctagatgggactttcagaccgggaggcagctcaggaccagccctctgtatgaccgcctggacgcacagggagcaagatggatggaaaagcatggatttgagcgtcccaaatacttcgtgcccccggataaagatctgctggccctggagcagagcaagaccttttacaaacccgactggtttgacattgtcgagtctgaggttaagtgctgcaaagaagcagtttgtgtgatcgatatgagcagttttacgaagtttgaaatcacaagcaccggcgaccaagcgctcgaagtgttacagtatctattcagcaacgacctggatgtccctgtgggccacatcgtgcataccggaatgttgaacgagggaggcgggtatgagaacgattgctcaattgctaggctgaacaaacggtcctttttcatgatctcacctacggatcagcaggtgcactgttgggcttggctgaaaaaacacatgcccaaagactcaaacttgcttctcgaagatgttacttggaagtacacagccctgaatttgatcggaccccgtgcagtagatgtcttgagcgaactaagctatgccccgatgacccccgatcacttcccctcgttattttgtaaggaaatgtccgtcgggtatgctaacggcatcagggtgatgtcgatgacacatactggggagccgggatttatgctttacatcccaatcgagtatgccctacacgtttataacgaggtgatgtctgtgggacagaaatacggcatcagaaatgccgggtactacgccctccgttcactcaggatcgagaagtttttcgcattctggggccaggacattaacaacctgaccacacccctggagtgtggacgagaaagtagagtaaaacttgaaaagggtatggactttatcggcagggacgccttacttcaacagaaacagaatggagtttacaagcggttaaccatgttcattctcgacgatcacgacagtgatctggacctgtggccctggtggggagagcccatttacaggaatggtcagtacgtgggcaagactacaagctccgcttattcttactctttggagcgacatgtgtgccttggtttcgtgcacaacttctctgaagacactggggaggagcaagtagtgactgccgactttatcaaccgcggcgagtatgagatcgatatcgctgggtaccgcttccaggccaaggcaaagttatacccggtggcatcactttttacccagaagcgcaggaaagatgacatggagctgtcagatttgcacgggaagtag

SEQ ID NO: 23176 - DNA, 1440 bp, Artificial Sequence
  Description of Artificial Sequence: Synthetic coding sequence
atggccaccgacagctgggccctggccgtggacgagcaggaggccgccgctgaatctctcagtaaccttcatctgaaggaagaaaagatcaagcctgatactaatggggcagtcgtgaaaaccaacgccaatgctgaaaagaccgatgaagaagaaaaggaagatagagctgcacaaagcctgttaaataagttgatcagaagcaacctggtggataacactaatcaggtggaggtgctgcaacgggaccctaactctccactgtacagcgtgaaatcgttcgaagaactgagacttaagcctcagctgctgcaaggagtatatgcaatggggttcaataggccatccaaaattcaggagaacgcattgcctctcatgctcgcggaacccccccagaacctcattgcccagtcgcagtctggcaccggaaagaccgcagccttcgtactcgctatgctgagtcaagtggaacccgcaaataaataccctcagtgcctgtgccttagccccacttatgagttagcacttcagacaggtaaggtgattgagcaaatgggcaagttttatcccgagcttaaactggcgtacgcggtgagaggtaacaaacttgagagggggcagaagatcagcgaacagatcgtgatagggacaccaggaactgtgctcgactggtgtagtaaacttaaattcatcgacccgaagaagataaaagtatttgtcctggacgaagcagatgtaatgatcgccactcaggggcatcaagatcagagtatcaggatccagagaatgcttcccagaaattgccagatgttgctcttcagcgcgactttcgaagactcagtatggaagttcgcccagaaggtagttcccgaccctaatgtgatcaaactaaaaagagaagaggagacactggatacaattaagcaatactacgttctgtgttccagtcgcgatgaaaagttccaggcactctgtaacctgtatggcgccatcactatcgctcaggccatgatattctgtcacactcggaaaacagccagctggctggcagctgagctgtctaaagagggccatcaggtggctctgctgtccggcgagatgatggttgagcagagagccgcagtaatcgaacggtttcgagagggcaaggaaaaggtgcttgtcacaacgaatgtgtgtgctcgcggaattgatgtagaacaggtttctgtagtaataaatttcgatctgccagtggacaaggacggcaatccggacaatgagacctacctgcataggatcggccggacagggaggtttggaaaacgtggtctggcagtcaatatggtggattcaaagcatagcatgaacatcctaaataggattcaggagcactttaataagaagattgaacgtttagacacagatgatctagatgagattgaaaagatcgccaactag

SEQ ID NO: 23177 - DNA, 3255 bp, Artificial Sequence
  Description of Artificial Sequence: Synthetic coding sequence
atggagcagcccaagggcgtggactggaccgtgatcatcctgacctgtcaatataaggatagcgtccaggtgttccagcgcgaactggaggtgcggcagaaacgtgagcaaatccctgctgggacgttgctgttagccgtcgaggatcctgaaaaaagagtgggcagcggcggagctaccctcaatgccctgctagtggccgccgagcacctgtccgcaagggcagggtttactgtggtcacatcagacgtgctccacagcgcttggatcctcatcctgcacatggggcgcgactttccatttgatgactgtgggcgggcgtttacttgcctgcccgtggaaaaccctgaagcgcctgtggaagcattggtgtgcaacctcgattgtctgctggacataatgacctaccggctcggccctggttcgccccctggggtgtgggtttgttctacggatatgctcctgagcgtcccagctaatccaggcatctcgtgggattcgttcagaggtgcgagggttatcgcactacctggaagccccgcgtacgcccagaatcacggggtgtacctgaccgacccgcagggcctggtgctcgacatatactaccagggaaccgaggccgagattcagcggtgtgtgcgcccggacggacgggttccccttgtgagtggagttgtgtttttttctgtggagactgcagaaagactcctggcaacacatgtctctcccccactggatgcttgcacctatctgggtttggatagtggagctagacctgtgcagctaagtctcttcttcgacattctccattgcatggcagaaaatgtcacccgggaggattttctggtgggtcgaccgcctgagttggggcagggcgatgcagatgtagccggctatctgcagtcggctcgagctcagttgtggcgagagttgagagatcagccactgaccatggcctatgtgtctagtggatcatattcttatatgaccagcagcgccagcgagttcctgttatccctaacactgccgggcgcccctggcgcacagatcgtgcacagccaggtggaggaacaacagctcttagctgcggggtcctccgtcgtctcttgtttactggaaggaccagtgcaactgggaccgggctcagtgctgcagcattgtcacctccaaggacccatccatatcggagccggatgtcttgtcacaggactggacaccgcccacagcaaggcactgcatggaagagaactgcgggacctcgtccttcagggacaccatactcgcctgcatggctcccctggacatgcttttactctggtgggcagactggacagctgggaaagacaaggtgcaggcacatatcttaatgtcccttggtccgagttctttaaacgaaccggcgtgcgagcttgggacctctgggaccctgaaacgttaccagctgagtattgcctgccctcagcgaggctgttccctgtgctgcacccatccagggaactggggccacaggatttactgtggatgttagaccaccaagaggacggcggtgaggccctgagagcctggcgcgctagctggcgactcagttgggagcagttgcagccctgtctcgatagggcagccaccctggcgtccaggagggatctgttctttaggcaggccctgcacaaagcacgtcacgtgctggaggctagacaagaccttagcctgagaccgctgatttgggctgcagtgcgggaaggttgcccagggcccctcctcgcgacccttgaccaagttgctgccggcgccggagatccaggggttgctgcccgcgctctggcctgtgtcgccgacgttctggggtgcatggctgagggacgcggaggtctgcggtcaggacctgccgccaatccagagtggatgcgaccctttagttatttagagtgcggagatcttgccgcaggagttgaagctctggctcaggagagagataagtggctgagccgcccagctctcctggttagagcagcccgtcattacgagggggcgggtcaaattctgatcagacaggcagtaatgtctgctcagcattttgtatcaacagagcaggttgagctccccggacctgggcagtgggtggtcgcagagtgtcccgcccgagtcgatttttcaggcgggtggagtgacacccctcctctcgcatacgagttaggtggcgccgtacttggcctggcagttagagtcgacgggcgcagacctataggggcccgcgccaggaggattcctgaacctgaactctggctcgctgtgggccccagacaagatgaaatgacagtcaagattgtgtgtagatgtctggccgacctcagggattattgccagccccatgccccgggagcactactaaaggcagccttcatatgtgcaggcattgtacatgttcacagcgagctgcagctctcagaacagcttctcagaacgtttggcggggggtttgagttgcatacttggagtgaattgccccatggtagcgggctggggacctcatcaattttggctgggaccgccctggccgccctacagagagctgccggaagggtagtcggcaccgaagcgctgatacacgccgtacttcacctggaacaggtcctaacaacaggggggggatggcaggatcaggtgggcgggcttatgcctggcattaaagtcggtcgttcccgcgcgcaactgcctttgaaggtggaggtggaggaggtgaccgtccctgaaggcttcgtgcagaagcttaacgaccacttgttgctcgtgtacacagggaaaacccgcctcgctcgcaatctgctgcaggatgttttgcgctcatggtacgccagactccccgcggtcgtacagaacgctcactcattggtacgccagaccgaagaatgcgcagagggattcagacagggcagtctacctcttctcggacagtgcctgacatcatactgggaacagaagaagctcatggccccaggttgtgagcccctcaccgtgcggaggatgatggatgtattggcgccccatgtgcacggccagtctctggcaggcgcaggggggggcggctttctgtatctcctcaccaaggagcctcagcagaaagaggccttggaggccgtgctggcaaagacagaggggctgggtaactattccatccacttggtcgaagtggatacccaagggctctccctgaagctcctaggcacagaagcatcaacatgctgtcccttcccttag

SEQ ID NO: 23178 - DNA, 2139 bp, Artificial Sequence
  Description of Artificial Sequence: Synthetic coding sequence
atgcagcccggcagcgcccccccccccggccggatggaccccagcgccccccagcctcgtgccgagacctctggcaaggatatttggcaccccggggaacgatgcctggcaccctcccctgacaacggtaagctgtgcgaggctagcatcaaatccataactgtcgatgagaatgggaagagcttcgcagtggtgctgtatgctgactttcaggagcgcaaaatccccctaaagcagttacaggaggttaaatttgtgaaggattgtccaagaaacctgatttttgatgatgaggaccttgaaaagccatactttccaaacagaaagttccccagcagttccgttgccttcaagctgagtgataatggtgatagcattccctataccattaacaggtatctgcgtgactaccagagagaggggactaggttcctttatggtcattacatccacgggggtgggtgcatcctgggggatgatatgggcctcgggaagacagtacaagttatctcttttctggctgctgtgctgcataagaagggtacgagggaggatattgaaaataacatgccagaattcctgctgcgatctatgaagaaggagccactgtcttctacagcgaagaagatgttcctgatcgtagcgcccctgtctgttttatataattggaaggacgagttagatacctggggctattttcgggtgacggtgctgcatgggaaccggaaggacaacgagcttattcgggtgaagcagagaaagtgcgagatcgcgctcaccacttacgaaaccctccggttgtgtttggatgaactgaattccttggagtggagtgcagttattgtagacgaagcacaccgcattaaaaaccccaaggctagggtgactgaggtgatgaaagcgttaaaatgcaatgtgcggattgggcttacaggaacaatactgcagaataacatgaaggaactgtggtgtgtgatggactgggctgttcccggtctcctgggctccggtacatactttaagaagcagttctctgaccctgtggagcatggccagaggcacaccgctacaaaaagagagctcgccaccggaaggaaggcaatgcaaaggctcgccaagaaaatgagcgggtggtttctacgcaggacaaagacccttattaaagaccaactaccaaagaaggaggaccggatggtatactgctccctcaccgatttccagaaggccgtgtaccagacggtgttggaaacggaggacgttacactgatcctacagtcatctgagccttgcacgtgccgtagtggccagaaacggaggaattgctgctacaagacaaactcgcacggtgagactgtgaagacactatatctcagctatctaactgtgctacagaaggtcgcaaatcacgtggcactcctgcaggccgctagcactagcaaacagcaggaaacgttaattaaacggatttgtgatcaggttttcagccggttcccagactttgtacagaagtccaaagacgcagccttcgagacgctgtcagaccctaaatatagcggcaaaatgaaggtacttcagcagctgttaaatcactgccgtaagaacagagataaagtgctcctgttctcattcagtacaaagctgctcgatgtactgcaacaatattgcatggcctcaggactggactatagaaggttggacggctctacaaaatctgaagagcggcttaaaatcgtgaaagagttcaactccactcaggacgtgaacatctgcctggtgtctactatggctggtggcctcggcctaaattttgtgggcgccaacgtggtagtcctcttcgaccctacttggaaccctgcaaacgatttgcaggccatagatagagcataccgtattgggcagtgtcgagacgtcaaagtgctgcgcctgatttctttggggaccgtagaggagattatgtacttgaggcagatttacaaacagcaactccattgcgtagtagtggggagcgaaaacgccaagaggtactttgaggcggtccaggggtctaaggagcaccaaggggaactgttcggcatccataacttgttcaaatttagatctcaaggaagttgcctgacaaaggatatcctggaggtgtag

SEQ ID NO: 23179 - DNA, 1212 bp, Artificial Sequence
  Description of Artificial Sequence: Synthetic coding sequence
atgaagcagcggaagggccagggcagcggcggcagccggggccggaagaaaagagggctgtccgatatttccccaagcacatctcttcctcctctcgtggagggccaacttcgctgtttcctcaagctgactgtgaaccgcgtgatttggaaaatcgcaaagccgccaacttgcgtactcgtccgtgtgcgctggtggggtgagactagcgatggaacacttttttgccctagagacgcgcttcagacggagcctaaagcagtacggactaccaccaggtatgcaatcagatgcggtcctaagcaattcactagctatctgactgatatggccgtgctagtgctggaggtaattactaagctcgacgggctgcctatcgggcgggtccaaatcaacggtctagcgcagctaagccccacccaccagatcaatggatttttcaccattgtgtctagcacctccaagaagttgggagaacttcaggtctcgctagctttagagccgctttctgaaacttacgactcctaccaccccctgccgacaacagacatgacagagaacgtgttgctcagcaagcaagggttccgggagaatacagagccctctagcacccagtttcaggtgccaagccgcccaagggacattcacactattaagatcgacgggaaggaattggccgcaaactcatctaggtccaccaccccacgggggaaagaccacgtatgcttcgctgagaatcccgacacaatcaaggacagttccttcgggctccaacacagccttaatagtggacaatcactagaaagtgtgaccctgaaaggcagagcaccaaggaaacaaatgagccttttaaattctagcgagtttcagcctcagatccgaacggtcgctaagtcccatagtgactcttgcatcctctcttctaacaaccttccaacaaaagatttgctcagcgctctgctggaacagggaaataagcttagaaatgctatggtgatctctgccatgaaatcatcccctgaaacttctatgctgctcgaccaggtgcatcctctcctcatgaaaattctgctggaacatcagcatcggagtgagcccttcctcgggatcggcctaaaaacaaccttgaagatcacaagcagcctgcaactcagaatccactttggtgacatgactcagaaattaatccccgaactgtatagttgctactag

SEQ ID NO: 23180 - DNA, 3663 bp, Artificial Sequence
  Description of Artificial Sequence: Synthetic coding sequence
atgggcaagaagcagaagaacaagagcgaggacagcaccaaggacgacattgacctggacgcactcgcagccgagatcgagggagccggagccgccaaagaacaggagcctcagaagagtaagggaaagaaaaagaaagaaaaaaaaaagcaggattttgacgaggatgacatactgaaagaacttgaggagttaagtttggaagcacagggaataaaggctgatcgggagacagtagccgttaagcctacggaaaataatgaggaggagtttacatccaaagataaaaaaaagaagggccagaaaggaaaaaagcagagtttcgatgacaacgacagtgaagaattagaagataaagactcaaaatctaagaagaccgccaaacccaaagtagaaatgtatagtggatcagacgatgacgatgacttcaacaagttacctaagaaggctaaggggaaggcccagaagtcaaacaagaagtgggacggaagtgaggaggacgaggataactccaaaaagattaaggaaaggagccgcataaatagttctggcgagtccggggatgagtctgatgagtttctacagtccaggaagggtcaaaagaagaatcaaaaaaataagccgggtcctaatattgaatccggcaatgaagatgatgatgccagctttaagattaagaccgtcgcacaaaaaaaggctgagaagaaggagcgagaaagaaaaaagagggatgaagaaaaggccaagctgcgaaaacttaaggagaaggaggagctcgagactgggaagaaggaccagagcaaacagaaggagtcacagcgcaaatttgaagaagaaaccgtaaaaagcaaagttacagttgacaccggagtgatcccagcttcagaggagaaggctgaaaccccaactgcagccgaggatgacaacgagggtgacaaaaaaaagaaagataagaagaaaaaaaagggggaaaaggaagaaaaagagaaggaaaaaaagaagggcccatccaaagctacggtgaaggctatgcaggaggctctggccaagctgaaggaggaagaggagaggcagaagcgggaagaagaggagaggatcaagcggctggaggaactcgaagctaagcgtaaagaggaagagcgccttgagcaggagaagcgcgaaaggaagaaacagaaagaaaaagaacgtaaggagcggctgaagaaagagggtaagctgttaacgaagtctcaacgcgaggccagagctagggctgaagcgacgcttaaattgctgcaggcacagggcgtggaagtgccttctaaagatagcctgccaaaaaaacgtcctatttacgaggacaagaagcggaaaaagattccacagcagctcgagtctaaggaggtatctgaatcaatggagctgtgtgctgccgtcgaggtgatggagcaaggagtacccgagaaggaggagaccccccctccagtagagcccgaagaggaggaggatactgaagacgcggggctggacgattgggaggccatggcttcagacgaagagacagagaaagttgagggtaacaaggttcatatcgaggtcaaagagaatccggaagaagaagaggaggaggaggaagaagaggaagaggatgaggaatcggaagaagaggaggaagaggagggcgagtcagaagggagcgagggagacgaagaggatgagaaagtgagcgacgaaaaagactcagggaagacgctcgataagaaaccctctaaggaaatgagttccgactcagaatatgacagcgacgacgaccgcacaaaggaagaacgtgcctacgacaaggccaagagacgcatcgaaaagcggaggctcgagcacagtaagaatgtgaatactgagaaactgagagcaccaatcatatgcgttctcggccatgtggatacaggaaagaccaagattcttgacaagctgcggcatacacatgttcaggacggagaggcagggggaattacccagcagatcggagccaccaacgtgccgctggaggctatcaatgagcaaacgaagatgatcaagaacttcgaccgggaaaatgttcggatcccaggcatgctgatcatcgacacccctggacatgagtcattctcaaatttgcggaatcgtggctcttctctgtgcgacattgctattctcgttgttgatataatgcacggcctggagccacagacaattgagtccattaacctcctgaagtcaaagaagtgtccctttatagtagctctgaataaaatcgacagactatatgactggaaaaagtctcccgactctgacgtggctgccactctgaaaaaacagaagaaaaatactaaagatgaattcgaagaacgcgctaaagcgattattgtggaattcgctcagcagggcctgaatgccgctctgttttatgagaataaagacccccgaacttttgttagtctggtgccaacaagtgcacacacgggtgacggcatgggatcgctgatctatctgctcgtcgagctgacgcaaactatgctcagtaaaaggctggcacattgcgaagagctacgcgcacaagtcatggaagtgaaggcactgcccggtatgggcacgaccatcgacgtgattcttattaatggccggttaaaggaaggcgacaccataatagtgcctggagttgagggccccatcgtgacgcagatcagaggtctgctgctaccgcctcccatgaaagaacttagagtgaaaaaccaatacgagaagcacaaagaggttgaggcagcccagggggttaaaatcctgggaaaggatctggagaagacgttggccggcctgcccctgctcgtcgcctataaggaagatgaaatccctgtgctgaaagatgaattaatccacgagctcaaacagactctcaacgcaatcaaactggaagagaaaggtgtgtatgtgcaggctagtaccttaggtagcctggaggcattgctggaatttctgaagacatccgaggtgccatatgccgggatcaacattggacctgtgcataagaaagatgtaatgaaggcatcagtgatgctagagcacgatcctcagtatgccgtaatactagcctttgacgttaggatagaaagggacgcacaggagatggccgattcactcggcgtgcgaatcttctctgccgagattatctatcacctgttcgacgctttcaccaagtaccggcaggattataagaaacagaagcaggaagagttcaagcatatcgctgtgtttccctgcaaaatcaagatcctcccgcagtacatctttaatagccgggatcccatcgtgatgggggtaaccgtcgaggccggccaggtaaagcagggtactcctatgtgcgtgccaagtaaaaactttgtggatataggaatcgttacctctatcgaaatcaaccacaaacaggttgacgtagctaagaagggacaggaagtgtgtgtaaaaattgagccgattcccggcgagagccccaagatgttcgggagacacttcgaggccacggacattctggtgtcgaaaatcagcaggcagagtattgatgccctcaaagattggttcagagacgagatgcagaagtctgactggcagttgattgtggagctgaagaaggtgttcgaaatcatttag

SEQ ID NO: 23181 - DNA, 138 bp, Artificial Sequence
  Description of Artificial Sequence: Synthetic coding sequence
atgagcgacaagcccgacctgagcgaggtggagaagttcgaccggtcgaagctgaaaaagacaaatactgaagaaaaaaatactctgccatctaaagagacaattcaacaggagaaggagtgtgtgcagacttcctag

SEQ ID NO: 23182 - DNA, 1533 bp, Artificial Sequence
  Description of Artificial Sequence: Synthetic coding sequence
atgcccggcggcggcgccagcgccgccagcggccggctgctgaccgccgcagaacagcgtgggtcccgcgaggctgccggttccgcttccagaagtggctttggcggcagcggtggaggaagaggtggtgcatcgggcccaggctctgggtccggcggacccggcggaccagccggcagaatgtcactgacaccaaaggagctgtccagcttgcttagcattatttccgaagaggcaggggggggatctactttcgaagggctgtcaaccgcgtttcaccactatttcagcaaggcggatcactttcggctcgggtcagtgctcgtcatgctactgcagcagcccgaccttttaccaagtgccgcccagcgattaaccgccttgtacttgctgtgggagatgtacaggacagagccactggcagcaaaccccttcgctgcaagctttgcccatctcttaaaccccgcccctcccgcccgcggcggccaggagcctgatcggcctcccttatccggctttcttccccccatcaccccccccgaaaagttcttcttatcccagctgatgctcgcccctccaagggagctctttaagaagacaccaagacagatagctctgatggacgtagggaatatgggacagtcagtggacataagcgggctgcagctggctctggccgaacgtcaatcggaactgcccacccagagcaaggcctcctttccttctatcctgtctgatccggacccagatagtagcaattccggttttgactcctccgtagcttcccaaattactgaggctctggtctcggggcccaaacccccaattgaatcccacttcaggcccgaattcatccgtcccccaccaccgttgcacatttgtgaggacgaacttgcatggctgaatccaactgaaccagaccacgcgattcagtgggacaagtcaatgtgtgtgaaaaacagcacgggtgtggagatcaagaggatcatggctaaggcgtttaaatctcctttgagctcaccccaacagacgcagctcctgggggagcttgagaaagatcccaaactggtttaccacatcggcttgaccccagctaaactccccgaccttgtggaaaacaatccactggtagccattgagatgctattaaagctcatgcagagtagccagattacggagtacttcagcgttttagtgaacatggatatgtctttacatagcatggaggtcgtaaatcggctgaccactgcagtggatctcccccccgaattcattcatctctacatctcaaactgtatctccacttgtgaacagataaaagacaaatacatgcagaatcgtctggtaaggttagtctgcgtgttccttcaatcactaattagaaataagatcataaacgtacaggacctgtttatcgaagtccaggccttttgtattgagttcagccgtatccgagaagctgcaggcctgttcagattattaaaaaccctggacacgggcgagactccctccgaaactaaaatgagcaaatag

SEQ ID NO: 23183 - DNA, 2184 bp, Artificial Sequence
  Description of Artificial Sequence: Synthetic coding sequence
atgagcggccggaagcggagcttcaccttcggcgcctacggcggcgttgataaaagcttcacttctcgaaggtccgtgtggcgtagtgacggtcaaaatcaacactttccacaggcactcgacctgagtcgcgttaatctagtgccttcatacactccgagcctctatccgaaaaacaccgatcttttcgaaatgatcgaaaaaatgcagggaagccgtatggatgagcaaagatgctcttttcctccacccttgaaaaccgaggaggattatattccttatcccagcgtgcacgaggtacttggtagggagggaccattcccactgatcctattgcctcagttcggcggatattggatcgagggaaccaatcacgagattacatccatccccgagacagaaccactccagtcgccgaccactaaggtgaaactggaatgcaaccccaccgcaagaatatatagaaaacatttcctgggcaaggaacactttaactactatagtctcgacgcagcccttgggcacctcgtgttctctctgaagtacgacgtcattggcgatcaagagcacttacgactcctgctcagaaccaaatgtaggacttatcatgacgtgatcccaatttcatgcctaactgaatttccgaacgtggtacagatggcgaagctcgtgtgtgaagacgtaaacgtcgatcgtttctatccagtcctgtaccccaaagccagcagactgattgtcacgtttgatgagcacgtcatctccaacaactttaagtttggagtcatataccagaagctggggcaaacatcagaggaagaactgttctccacaaatgaggagagccctgcatttgtagagtttctagagttcctgggtcagaaagttaagctgcaagactttaagggttttagaggtggcttagacgttacgcacggacagaccgggactgagtcagtgtactgtaatttccgaaataaggagattatgtttcacgtgtctacgaagcttccgtatacagagggcgatgcccagcagttacaacgcaaacgccatatcgggaacgatattgtggccgtcgtctttcaggatgagaatacacctttcgtacctgacatgatcgcgagcaactttctgcacgcttacgtagtggtacaggccgaaggaggagggcccgacggacctctgtacaaggtctccgtcaccgctagggatgacgtgccttttttcgggccgcctcttcctgaccctgccgtgtttcggaaggggcccgagttccaggaatttctactcacaaaactgataaacgcggagtacgcctgttacaaggccgaaaaatttgccaagttggaagagcggacccgggctgctctgctcgaaaccctttatgaagaactacacatccactcccagtcaatgatggggctggggggagacgaggataaaatggagaacggaagtggcggcggcggattttttgaaagcttcaaaagggtcattcggtcacgctctcagtcgatggatgcaatgggacttagcaataaaaaacccaatacggtttcaacaagccacagcgggagtttcgcaccaaacaacccagacctggcgaaggcggcagggatttcactcatcgtgccgggcaaaagtcctacccggaagaaaagcggacccttcggaagccgacggagcagtgccattggaattgagaacattcaggaggtccaagaaaagcgcgagagtccacccgcagggcaaaagactccagatagcggtcatgtgagccaggagccaaagtccgagaacagttcaactcagtctagccccgagatgcccaccaccaaaaatcgggcagagactgcggcccagagggcagaggccctgaaagacttttctaggagctcctcctctgccagctcttttgcctctgtggtggaagagacagaaggtgtggacggggaggatactggcttggagtctgtctcctccagcggtactccccataagagagattcttttatctactctacctggttagaagactctgtttcaaccacttcggggggatcgtcccctgggccttcacgatctccacacccggacgccgggaaactcggtgatcccgcttgccctgaaattaagatacaactggaagcttctgagcagcatatgccccagctgggctgctag

SEQ ID NO: 23184 - DNA, 873 bp, Artificial Sequence
  Description of Artificial Sequence: Synthetic coding sequence
atggtgctgctgcacgtgaagcggggcgacgagagccagttcctgctgcaggcccctggctctacggagttggaggaactgaccgtacaggttgcaagagtgtataatgggagattgaaggttcagagactgtgcagcgagatggaggagctggcagaacacggaatatttctgcccccaaacatgcagggtctgacagacgatcagatcgaggagctgaagctcaaggacgagtggggtgagaaatgtgtcccctccggtggcgcagtgtttaaaaaagacgacattggtcgcagaaacggccaggcccctaacgagaagatgaaacaggtcctgaagaaaacaatcgaagaggctaaggcaataattagcaaaaagcaggtggaggctggggtttgcgtcactatggagatggtgaaagatgcgctagatcagctgagaggtgccgtaatgatcgtctatccaatgggactgccaccctacgaccctatccgcatggaattcgagaacaaggaggacctgagcggtacgcaggctggtttgaatgttattaaggaggctgaagcccagctttggtgggctgccaaggaattgaggaggaccaagaagctatctgattacgtgggaaaaaacgaaaagaccaagatcattgccaagattcaacaaagaggacagggagctcccgctagggaaccgattatatcttctgaggaacagaaacaactaatgctttactatcatagacgacaagaggaacttaagagactagaagagaatgacgacgatgcgtacctgaattcgccttgggccgataataccgccctgaagagacatttccacggggtcaaggacattaagtggcgcccgcgttag

SEQ ID NO: 23185 - DNA, 567 bp, Artificial Sequence
  Description of Artificial Sequence: Synthetic coding sequence
atggagcccccccggggcccccccgccaacggcgccgagcccagcagagccgtaggtacagtgaaggtctatctgccaaataagcagcgcacagtggttacagtacgggacggaatgagcgtatatgactctttggataaggcccttaaagtacgaggactgaatcaagattgctgcgtggtttataggctgattaagggccggaagaccgtaacagcatgggacaccgcaatcgctcccctggacggcgaagagctcatcgttgaggtgctcgaagacgtgccgttgacgatgcacaacttcgtgcgaaaaacctttttcagtctggccttttgcgacttctgcctgaagttcctgtttcacggattcaggtgccagacctgcggctataagttccaccagcactgcagctctaaagttccaaccgtgtgtgttgatatgtcaacgaataggcagcagttctaccattccgttcaagacctgtccgggggcagccggcaacacgaggccccttcaaaccggcctcttaatgagctgctcactccacaagggccatcctgccggtag

SEQ ID NO: 23186 - DNA, 2034 bp, Artificial Sequence
  Description of Artificial Sequence: Synthetic coding sequence
atggacgaccccgactgcgacagcacctgggaggaggacgaggaggacgccgaagatgccgaggacgaagactgcgaggatggtgaggcagccggcgcccgagacgctgacgctggagacgaggatgaagaatccgaggaaccccgcgcggctagaccgagctccttccagtccagaatgaccggaagccgcaactggcgtgctacacgagacatgtgccgatataggcataactacccagatctagttgagcgtgattgtaacggggacacacccaacctgtcattttatagaaatgagatcaggttcctgcctaatggctgcttcattgaagatatcctccagaactggacagacaattacgacttgctggaggataaccatagctatattcagtggctcttccctttgagggaacctggcgtgaactggcatgctaagcctctcacattaagagaagtcgaagtattcaagtcctctcaggaaattcaggagaggctggtcagggcctacgagcttatgctgggattttatggcattcgtctagaagataggggcacaggcacagtaggccgagcacagaattatcagaagcggtttcagaatctgaactggcggagccataacaatctccggatcactaggatcctcaaaagtcttggcgaactggggctcgagcacttccaggctccactggtccggttttttcttgaggagactctggttagacgggaactgcctggagttagacagtctgctctggactatttcatgttcgccgtgaggtgtagacaccagaggcggcagctggtgcacttcgcctgggaacatttccgtccccggtgcaagttcgtgtggggaccccaggataaacttaggagatttaagcctagctcattacctcaccctctcgagggttctcgaaaggtggaggaggaaggcagcccaggggacccggatcatgaggccagtacccagggacgtacctgcggaccagagcattcgaaggggggtggcagggttgatgagggaccccagcccaggtctgtggaaccccaggatgctggcccacttgagaggtcccagggggacgaagccgggggacacggcgaggacaggcccgagccattgtctccaaaggaatcaaaaaagcggaagttagaactgtctagacgggagcagcctcctaccgaacccggtcctcagtcagcttcagaagtggagaagatcgcgctcaatttggaaggctgcgctctctctcagggctctttacgaaccggtacacaggaggtcggcggacaggatcccggagaggccgtgcagccatgtagacagcctctgggagcacgggtcgccgataaagtcaggaagcggcggaaggtggatgaaggcgccggagacagtgccgccgttgcttctggaggcgcccaaactctggccctggccggaagtccagctccgagtgggcaccccaaggccggccatagcgagaatggcgtggaggaagataccgaaggacgcactggacctaaggaggggacccccgggtcacctagcgagacaccagggccctcacctgctggcccagcgggcgatgaacctgctgagtccccatctgaaactcctggaccacggcccgccgggcccgccggcgacgaaccagctgaaagtccctcggagacgcctggccccaggccagcaggaccagcaggggatgaaccggcagagtccccatcagagactcccggcccctctccagctggacctactcgggatgagcccgccgaaagcccatcagaaaccccgggcccgcgtcctgccgggcccgccggtgatgagccagcagagtctccgagcgagacacctggccctcggccggccggtcctgcgggtgacgagcccgccgaaagcccttcggaaacacctggccccagtcctgcaggccccacaagagacgagcccgccaaagccggcgaggccgcagagcttcaagacgccgaggttgagagtagtgccaagtctggcaaaccatag

SEQ ID NO: 23187 - DNA, 735 bp, Artificial Sequence
  Description of Artificial Sequence: Synthetic coding sequence
atgggcctggagctgttcctggacctggtgagccagcccagccgggctgtctatatcttcgcaaagaagaatggcatcccactggagctgagaactgtggacctagtaaaggggcaacacaaatctaaggagtttctgcaaataaacagccttggcaaattacccaccctgaaagacggcgattttattttaacagagagtagtgctatcctgatctatctaagctgcaagtaccaaacccccgaccactggtacccttcggatctacaggccagggcccgcgtccatgagtatctgggatggcatgccgactgtatcaggggcacctttgggataccactctgggttcaggtcctcggccctttgattggggtgcaggtgcccgaggaaaaggtggaacgtaacaggactgccatggatcaggcacttcaatggctcgaagataagttcctgggggatagaccttttctggcaggccagcaagtgacactagccgatttgatggctctagaggagctgatgcagcccgtggccctcggctacgaattatttgaagggcggccaaggcttgccgcctggcggggccgggttgaggcatttctgggcgcagagctttgtcaggaggcccattccattattctgtcaatcctggagcaggccgccaaaaagacactacccaccccttcacctgaagcttaccaagctatgttgctgaggatagccaggattccttag

SEQ ID NO: 23188 - DNA, 531 bp, Artificial Sequence
  Description of Artificial Sequence: Synthetic coding sequence
atggccgccagcaccgacatggccggcctggaggagagcttccggaagtttgcgatccacggagaccctaaggcgtctggccaagaaatgaatggcaaaaattgggccaaattatgcaaggactgtaaagtggctgatggtaagtcagtgacgggaacagatgtggacatagtgttttccaaggtcaaggggaaaagcgctcgcgtgattaactacgaggagtttaagaaggcgcttgaggagctggccacaaagagattcaagggcaaatccaaggaagaagcattcgatgccatttgtcagctggtggccgggaaagagcctgctaatgtcggtgttaccaaggccaaaacggggggcgctgtggaccgcctgaccgatacttcaaggtatactggaagtcataaggagcggttcgatgagtccggaaagggcaagggtatcgccgggcgtcaagacatcttggatgatagtggttacgtgtcagcttataaaaacgcaggaacctatgatgcgaaggtgaagaaatag

SEQ ID NO: 23189 - DNA, 930 bp, Artificial Sequence
  Description of Artificial Sequence: Synthetic coding sequence
atgagcgacctgggcagcgaggagctggaggaggagggcgagaacgatattggagagtatgagggggggcggaatgaagccggcgagcgtcacggccgaggccgggctcgactccccaacggggacacttacgaaggcagctacgagtttgggaaacggcatgggcaagggatttataaattcaagaacggagcccgctatatcggagaatatgtgcgcaacaagaagcacggtcaaggcacttttatctacccggatgggtcgcggtatgagggggagtgggccaacgacctgaggcacggccatggtgtctattattacattaataatgacacctacacgggggaatggttcgcccatcagagacatggacaagggacatacctgtatgccgagaccgggtctaaatacgtaggcacttgggtgaatgggcagcaggaaggtacagccgaactgattcatctgaatcaccgttatcagggcaagttcctgaacaaaaaccccgtaggacctggtaagtatgtcttcgacgtcgggtgcgaacagcatggcgaatatcgactgacagacatggaacgcggcgaggaggaggaggaggaagaactggttaccgtagtaccaaaatggaaagccacacagataacggagctggcactctggacacccacgcttcctaagaagcctacatcaactgatggacctggccaggatgctccgggcgctgagtcagctggcgagcccggagaagaggcccaagcacttctcgaaggttttgaaggcgaaatggacatgaggcccggcgacgaggacgcggatgttctccgtgaagaatctcgggaatacgatcaggaagagttccggtacgatatggacgagggcaacattaatagtgaggaggaagaaactaggcagtcagatctgcaagattag

SEQ ID NO: 23190 - DNA, 5943 bp, Artificial Sequence
  Description of Artificial Sequence: Synthetic coding sequence
atgaaccccaccaaccccttcagcggccagcagcccagcgccttcagcgcgtcaagctccaacgttggaaccctgccttctaaaccacccttcaggttcggtcagccctcactgttcggacaaaactctacactgtctggcaaaagctcagggttttcgcaagtgagctcctttccagccagtagtggtgtctcacactccagctctgtccagacgcttggatttactcagacatcctcagtgggccctttctccggattagagcacactagcaccttcgtggccacctccggcccaagtagctcatctgtgctgggaaacacagggtttagcttcaaatcccccaccagcgtcggggccttcccatctaccagcgcgtttgggcaggaagccggggagattgttaattcgggattcgggaaaaccgaatttagttttaagcccctggaaaacgccgtcttcaagcctatactgggtgccgagagcgaacctgaaaaaacccaatcccaaattgcaagtggcttttttaccttcagtcaccccattagtagcgccccggggggactcgccccgttctcctttcctcaggtcacctctagttcagccactacatccaatttcactttcagcaagcctgtctcatctaacaattctctgtcagccttcaccccagccctctctaaccagaacgtggaagaggagaaacgtggtcctaagagcatctttggctcatctaataactcattcagctcctttccagtgtcttccgcagtgctgggagagcccttccaagcaagcaaggctggtgtgcggcaagggtgcgaggaagcagtgagtcaagtggagccgttgccatccctaatgaagggcttgaagagaaaggaggatcaggaccgaagtccccgtaggcatggacacgagcccgcagaagatagtgatccgctgagcagaggcgatcaccctcctgacaagcgtcccgtaaggctcaaccggccacgcggtggaactctgtttggacgcaccattcaagacgtcttcaagtccaataaggaagttgggcgcctgggaaacaaggaggctaaaaaggaaactggtttcgtcgagtcagctgagtctgaccacatggcaataccaggggggaatcagtccgttctggctccgtcccggatccctggagtgaacaaagaggaggaaacagaatcccgcgagaagaaagaggactcccttcgaggaactcccgcacggcagtctaatagaagtgagtcaactgattcactgggcgggctgtcaccctccgaagtcacggccattcagtgtaagaatatccccgattatttaaatgaccgtaccattcttgaaaatcacttcgggaaaatagccaaggtacagagaatctttacgagacggagtaagaagctcgccgtggtgcatttctttgaccacgcgtctgctgctctagcacggaaaaaaggaaagagcctccataaggacatggccatattctggcaccggaaaaagatcagtcctaacaagaagcccttctctctcaaagagaaaaagcccggcgacggagaggtctccccgtcgaccgaagatgctcccttccagcatagccccttgggaaaggccgcaggacgcactggagcaagctccctactgaacaaatcgagtccagtgaaaaagcccagcctgctgaaagcccatcagttcgagggtgattcctttgattcagccagcgaggggagtgagggtctaggcccttgcgtgctctcacttagcaccctcattggcacagtggcagagacttctaaggaaaaataccgccttctggaccaacgcgatcgcataatgcgtcaggctcgcgtcaagcgtactgaccttgataaggcccgcacttttgtggggacttgcctggacatgtgccctgagaaggagcgctacatgagagagactagaagtcaattgagcgtgttcgaagtggtgcccgggaccgatcaggtggaccatgctgctgccgtgaaagagtattcgcgctccagcgccgatcaggaagagccactccctcatgaactcaggccccttcctgtgctgagtaggaccatggattaccttgtcacgcagatcatggatcagaaggaaggatctttgcgggattggtatgacttcgtgtggaatcgaactcggggtattcgcaaggacatcactcaacaacatctgtgcgatccactgaccgtttccctgattgagaagtgtactcggttccacatacattgcgctcattttatgtgcgaagaaccaatgtcaagtttcgacgcaaagatcaacaatgaaaacatgacgaagtgcctccagtccttaaaagagatgtaccaggatttgaggaataaaggcgtcttctgcgcatctgaggctgagtttcaggggtataatgtgctgctgagtctcaacaagggggacatccttcgtgaggtgcagcagttccatcccgcggttagaaatagctcagaagtcaaatttgccgtgcaagcgtttgctgccctcaattccaacaacttcgtcaggttctttaagcttgtgcagtccgcttcctacctgaatgcttgtctgcttcactgttatttttcccaaatacggaaagacgcactgagggctcttaattttgcctatactgtgtccacccagagatcaactatttttcctctggatggtgtagtgcgtatgcttctattccgggactgcgaggaagcgactgattttctgacatgccacggacttaccgtttctgacggatgcgtggagctcaatcgctcagcctttctggaaccagagggcctctctaagaccaggaagtccgtctttattaccaggaagctcaccgtgagtgtgggtgaaatcgtgaacgggggcccactgcctccagttcccagacatacccctgtgtgctcatttaattcacagaataagtacatcggggaatccctggcagccgagctccctgtatctactcagagacctggatctgacacagtaggagggggtaggggtgaagaatgcggagttgagccagacgcgcccttgtctagccttccccagtcattacctgcgcctgcccccagccctgtcccgttgcctcccgtgctcgcactgacgccgagcgtggctccatcattatttcaactgtctgttcagccagagcccccacctccggagcccgttccgatgtactctgacgaggacttggcccaggtggtagacgaattgatccaggaagccctgcagcgagactgcgaggaagtcgggtccgcaggggccgcctacgcagccgctgccttgggcgtgagcaacgccgcgatggaggacctgctaaccgctgctacaaccggcatcctcaggcacattgctgccgaggaggtgagcaaagagagagaacgcagagaacaggagcggcagcgtgcggaggaagaacggttgaaacaggagagagaacttgttctttctgaactgtcccagggtctggccgtcgaactgatggagcgggttatgatggagtttgtgcgcgaaacttgttctcaggaactgaagaacgctgtggaaacggatcaaagagtccgggtagctcggtgttgcgaggacgtttgtgctcacctggttgatctgtttctggtagaggagatcttccaaactgccaaagagaccctgcaggaactccagtgtttctgcaaatacctgcaacggtggagagaggccgtgacagctcggaagaagctgcggcggcaaatgcgcgcgttccctgctgccccctgctgtgtggacgtgagcgatcgccttcgcgccctggccccaagcgccgagtgccccattgccgaggaaaacctggcccgtgggctattggatctgggacatgcgggcaggctggggatttcctgcacaaggctgagacgcctgaggaataaaacagctcaccagatgaaggtgcaacatttttaccagcagctgctcagcgatgtcgcatgggcgagcctcgatctgccttctctcgtagcagaacacctgcctgggaggcaggagcacgtgttttggaagttggtgctggtgctcccagatgtagaggaacagagtcccgagtcctgtggtaggattctcgccaattggcttaaggttaaatttatgggagacgagggatccgtggatgacacgagcagtgacgctggcggtatccaaacactgtctttatttaattcattaagtagcaaaggtgaccagatgattagcgttaacgtttgtatcaaggtggcccatggggccctgagcgacggtgcaatcgacgccgtggagacgcagaaggacttgctgggggcttccggactgatgctgctcctgcctcctaagatgaagagtgaggacatggcggaggaagacgtgtactggctgtccgccctgcttcagctgaaacaacttctccaggcgaagcccttccagccagcactccccctagtcgtactggtgccatcacctggaggagatgcggtggagaaagaggtggaagatgggctgatgctgcaggatcttgtcagcgccaagctcatcagcgactacacagttactgaaatccctgatacaattaatgacttgcaaggtagcacaaaagttctgcaggccgtccagtggctggtcagccattgtccccacagcctggacctgtgttgtcagaccctgatacagtatgtcgaagatggaattgggcacgagttttcagggcggtttttccacgacagacgagagcggcggctgggcggcctggcatctcaggagccgggcgcaatcattgagttgttcaacagcgtgctacaattccttgcatccgtggtctcctcagagcagttgtgtgacctcagttggcccgttaccgaattcgctgaggccgggggctcacgactgctcccccatctccattggaatgctcctgagcacctggcttggctgaagcaggccgtgctgggcttccagctccctcagatggacttaccccccctcggagccccctggctgcctgtctgctccatggtggtgcaatacgccagtcagatcccttcctccagacaaacacagcctgttctacagagccaggttgagaatcttcttcatcgtacctactgccggtggaaatcaaaaagcccatcgccagtgcatggcgccggaccatccgtgatggagatcccctgggacgacctcatcgcgttgtgtattaaccacaagctacgggattggacgcctccaagactacctgttacatccgaagccctgtccgaggacggccagatctgcgtctactttttcaagaatgacttaaagaaatatgatgttccactcagctgggagcaggcaaggctccaaactcaaaaagaactccaactgcgggagggaaggctggccataaagccttttcatccctcagccaacaacttccctattccgctattgcacatgcaccgcaattggaagcgttctaccgagtgcgcccaagaagggcgaattcccagcacagaggacctgatgaggggagcgtcggctgaggaattgctggcacagtgtttgtcgagtagcttactgctggaaaaagaggaaaacaagcggttcgaggatcagctgcagcagtggttgtccgaagatagtggggcctttaccgacctcacttcactgcctctgtaccttccccagacgcttgtgagcttgtctcatacaatcgagccggtcatgaaaacctccgtcaccacaagtccgcagtcggatatgatgagggagcagctgcaactttccgaggccactgggacatgcctgggagagcgcctcaaacacctagaacggctcattcggtccagtcgggaggaagaagttgcatcggagctgcacctgtccgccctactcgacatggtcgatatctag

SEQ ID NO: 23191 - DNA, 3147 bp, Artificial Sequence
  Description of Artificial Sequence: Synthetic coding sequence
atgagcgacgtgaacccccccagcgacacccccatccccttcagcagcagctctactcactcaagccacattcccccatggacatttagctgctatccgggtagcccctgtgagaacggggttatgctgtacatgcgaaatgtttcccatgaggagctacagagatttaagcaactgcttcttactgagctgtccacaggaacaatgccgatcacatgggaccaggtcgagaccgcctcctgggcggaggtagtgcatctcttgatagagagatttccaggtcggcgagcatgggatgtgacatctaatatattcgccatcatgaactgcgataaaatgtgcgtggtggtgagacgcgagatcaacgccatactccctactctcgaaccagaggacctcaacgtcggcgaaacccaggtcaatctggaggagggtgagtcgggcaaaatcagaagatacaaaagcaacgtgatggaaaagttcttccccatttgggatatcacaacgtggcccgggaatcagcgcgattttttttatcagggcgtacaccgccacgaagagtacctaccatgtttgttgttaccgaaacggcctcagggacgtcaacctaaaaccgttgcaatacaaggcgctcctggcatcggaaaaaccatccttgctaaaaaagttatgttcgaatgggcccggaataagttttacgcccacaagaggtggtgcgcattctattttcactgccaggaagttaaccagactaccgaccagtctttctccgaattgatagagcagaaatggccgggctcccaagacctggtctctaaaattatgtccaaacccgatcaactcctgttgctgctcgatggattcgaagaactgacgagcaccctcatcgatcggctggaggatctgtcagaggattggagacagaaattgccaggaagcgtcctgttgagcagtctgttgtccaagactatgctgcccgaggcaacactgcttattatgatcagatttaccagttggcagacatgcaaacccctccttaagtgccctagtttggtcacgctgcccgggttcaataccatggagaagattaaatatttccaaatgtactttgggcatacagaggagggagatcaggtgctgtcttttgccatggagaacaccattcttttctccatgtgccgtgtgccagttgtgtgctggatggtgtgttctgggctgaagcagcagatggagaggggaaacaacttaacccagagttgcccaaacgccactagcgtgtttgtgcgatatatcagcagtctgtttccgactagagctgagaattttagcagaaagatccatcaagcccagctggaggggctgtgccatctggccgcggactcaatgtggcaccgcaaatgggtgctcggcaaggaagatctagaagaggccaagctggatcagactggcgtgacagcctttctcgggatgagcatcctccgtagaattgccggagaggaggatcactacgtgtttaccctcgtaactttccaggaattcttcgctgcactgttctacgttttgtgtttccctcagcgtctgaaaaacttccacgtgctgagtcacgtaaatatacagcggttaatcgcctccccccggggctccaaaagctatcttagtcacatgggcctcttcctctttggcttcttaaatgaagcctgcgcctctgcagtggagcagtcattccagtgtaaggtatctttcgggaataagcggaaactacttaaggtgattcccctgcttcataagtgtgaccctcccagcccgggatctggtgtgcctcagcttttctattgcttgcacgagattcgcgaggaagcctttgtcagtcaagcgctcaacgattatcataaggtagtgctaagaataggcaataacaaagaggtccaggtttctgccttctgcctgaagcggtgccagtacctccatgaagtggagctcactgtcaccctaaatttcatgaatgtctggaagctgagctcgtcatctcatcctggaagcgaggctccagagtctaacgggttacatcgctggtggcaagatctgtgcagcgtctttgctacgaatgataagctggaggtacttacgatgaccaactctgtgctcggtcctcccttcctgaaggctctcgcagctgcgctgcgtcatccgcagtgcaagctacagaaactccttttgcgtcgcgttaattccaccatgctgaaccaagacctgatcggtgtgttaaccggtaaccaacacctccgatacctcgaaatccagcacgtcgaggtcgagtcgaaagctgtcaaactgctgtgccgggtcctgcgctcgccaaggtgtaggcttcagtgccttagactggaggactgtctcgcaacaccaaggatatggacggacctcggaaataatctgcagggaaacggtcatctgaagacgctaatcctacgcaaaaacagtctggaaaactgtggcgcttattatttatctgtggcgcagcttgagcgtttgtctatcgaaaattgtaacctcacacagctgacttgcgagtctcttgcttcatgtctgaggcagtctaaaatgctgacccacttgtcgttggctgagaacgccctgaaggatgagggtgcaaagcacatatggaatgctcttccccatctcagatgccctctgcaaagactggtccttcggaagtgcgaccttaccttcaattgctgtcaggacatgataagcgctctctgcaaaaacaagacgttaaaaagcctggatctaagcttcaattctttgaaggacgacggggtgatcctgctgtgcgaggctctaaagaatcccgactgtacacttcagatcctggaactcgaaaattgtctgttcactagtatttgttgtcaggccatggcctctatgttacgcaaaaaccaacatctgcgacacttggatcttagcaaaaatgcgattggagtctatggaatccttacgctgtgtgaagcattcagttcacagaagaaacgagaagaagtaattttttgtattccagcctggacacgtattacaagctttagccccacccctcacccgcctgatttcactggtaagtctgattgcctgtctcagataaatccatag

SEQ ID NO: 23192 - DNA, 3792 bp, Artificial Sequence
  Description of Artificial Sequence: Synthetic coding sequence
atgcccgcccggatcggctactacgagatcgaccggaccatcggcaaagggaacttcgcggtggtaaagagagccactcacctcgttacaaaggccaaagtcgccataaagataatcgataaaacgcagctcgacgaggaaaacctcaagaagattttccgggaggtccagatcatgaaaatgctatgtcacccacacataattcgattgtaccaagtgatggagacagagaggatgatttatcttgtgacagaatacgcatcaggcggcgagattttcgaccacctggtggcacacggaaggatggcagagaaagaggcacggaggaagttcaaacagatcgtgaccgccgtttacttttgtcactgtaggaatattgttcaccgcgatctgaaagcagagaatctcctcctggacgctaatcttaatataaaaatcgcagactttggttttagcaatttgttcacccctggacagctgcttaaaacttggtgtggatctcccccctatgctgctccagagttatttgaggggaaggaatacgatgggccgaaggttgatatttggagcctcggcgtggtattgtacgtgctggtctgtggggcgctgccatttgacgggagcaccctgcagaatctacgcgctagagtgctgagcggaaaattcaggatcccatttttcatgagtacggagtgcgaacacctgatcagacatatgctggtgcttgacccaaacaaaaggttgagcatggagcagatctgcaagcataagtggatgaaactgggcgacgctgacccgaatttcgataggttgattgcagaatgtcaacaactgaaggaagagaggcaggttgatccactgaatgaggatgtgttactcgcaatggaagatatgggattagataaagaacaaacattacagagtctccgctcagacgcttatgaccactatagcgccatttattcgttgctttgtgatcggcataaacgccataaaactctgcggctaggggcgctccccagtatgccaagggctctcgcttttcaagccccagttaatattcaggccgaacaggcaggcactgcaatgaatatctctgttcctcaggtgcagttgatcaatcccgagaatcaaattgtggagcccgatggaacactcaacctggacagcgacgagggggaggagccatcccccgaagcactcgtccggtatctgtcaatgcggaggcatactgtcggggtcgcggatcctaggaccgaggtaatggaagacctgcagaagctactgccgggctttcccggcgtcaatccccaggcgcctttcttgcaggtggcccccaatgtcaatttcatgcataacctgctccccatgcagaatttacagccaactggacaacttgagtacaaggaacagtccctgctgcaaccgcccacactgcaactgctgaacggcatgggccccctggggaggcgggccagtgacggaggggccaacatacaattacacgcccagcaactgctaaaacgccctagaggtccttcacctctggtgacaatgacacccgccgtgcccgcagtaacccccgtcgatgaggaaagctccgatggggaacccgatcaagaggctgtgcaatcttccacctataaggactctaacaccctccacttgccaaccgaacgcttcagccccgtgaggcggttctccgacggggccgccagtattcaagctttcaaggcgcacctagagaaaatgggaaacaacagctccatcaaacagttgcagcaagagtgcgaacagctccaaaagatgtacggggggcagattgatgagcgtaccctggaaaagacacagcaacagcacatgttgtaccaacaggaacagcatcatcagattctgcaacagcaaatccaggattcaatttgcccaccacagccctcaccacccctgcaggccgcttgtgaaaatcagccagccctgctcacgcaccagctccagcgtttgcgcatacagccatcctctcctcctcccaaccatcccaataatcatctctttagacaaccttccaattcacctcctcccatgtcgagcgccatgatccagccacacggcgcagcaagctcatcacagtttcaggggctgccttcgagatccgcaatttttcaacagcaaccagagaactgctcttccccccccaatgttgccctgacgtgcttggggatgcaacagccggctcagtcacaacaggttaccattcaggtgcaggagcctgtggatatgctgtccaacatgcctggcaccgctgccggttcttctggacgaggcatatccatttccccttccgcaggccaaatgcagatgcagcaccgaacgaacctgatggccaccctttcatacggccaccgccctctgtccaagcagctctcagctgatagcgccgaggcacactcactcaacgttaacagattttctccagcaaactatgaccaggctcacctgcatcctcacctcttttccgatcaatctcgaggtagcccctcgtcgtactctccaagcaccggggtaggcttctctcctacacaggcgctgaaggtgccccccctcgatcaattccctaccttcccgccttccgcccaccagcagcctccccactatactacatctgctctccagcaagcgctgctatctccgacgcctcctgactacacccgccatcagcaggtgccacatattcttcagggtttacttagtccccggcatagcctgaccggacactcagatatcagacttccaccaaccgagttcgcgcagctcatcaaacggcagcagcagcagcggcagcagcagcagcagcagcagcagcagcaggagtatcaggaactgtttaggcacatgaaccagggcgatgcaggcagtctggcgccgagcctgggtggacagtccatgacggagaggcaggctctgtcttatcaaaacgcagactcttatcaccaccatacttcaccacagcatttgctccaaattcgggcccaggagtgcgtgagccaggcctccagccccactccccctcacggttatgcccaccagcccgcgttgatgcattctgagtcaatggaggaagactgcagctgcgagggcgctaaggatggatttcaggattccaagagcagtagtacacttacaaagggctgccatgacagtccattattgctttccactggggggcctggagaccctgagtctctgctgggcactgtcagtcacgcacaggaacttggaatccacccctatggacatcaacccactgccgccttctccaagaacaaagttccctccagagaacccgtgattgggaactgcatggatcgtagcagtcctggacaagcggtcgagcttcctgaccacaatggtctaggctaccccgccagacccagcgtgcatgagcaccaccgcccacgggctctgcaacggcaccacacaatccagaattcagacgatgcgtacgtccagctggataatctgcccgggatgtccctggttgccgggaaagctctgagttctgctcgaatgtcagacgccgtgctgtcccagagttctctgatgggctcacagcagttccaggacggggaaaatgaggaatgcggcgccagcttgggcggacacgagcaccccgacctgtcggatggatctcaacacctgaattctagctgctacccctccacctgtattaccgatatccttttgtcatataaacatcccgaagtttccttctctatggaacaggctggcgtttag

SEQ ID NO: 23193 - DNA, 4395 bp, Artificial Sequence
  Description of Artificial Sequence: Synthetic coding sequence
atgtaccagcccgaggacgacaacaacagcgacgtgaccagcgacgacgacatgacccgaaatcgaagggagtcttcccctcctcactctgtgcatagcttcagtggggatagagattgggatcgcagaggccgttccagagatatggaacctcgggaccggtggagccacacacggaaccccagaagtcgtatgccacctcgggatctgtcacttccggtggtggccaagaccagcttcgagatggatcgcgaggatgatagggatagtagagcgtatgagtctcgtagtcaagatgccgagtcgtatcagaacgtcgtcgatttggccgaggacaggaagccccacaacaccattcaggacaatatggagaattatagaaaacttctctccctcggcgtgcagctcgccgaggatgatggacactctcacatgactcagggtcattcaagccgttccaagcgaagcgcatatccctctacgtcccggggattgaaaacaatgcccgaggcgaaaaagagtacccaccgcagggggatatgtgaggacgaaagctcccacggagtgattatggagaagttcattaaggatgtctcacgaagttcaaagtcagggcgggcgcgtgagagctctgaccggtctcagcgtttcccaagaatgagcgacgacaactggaaggatattagcttgaataagcgtgagtctgtcatccagcagcgagtttacgagggcaatgccttccggggtggatttcgtttcaacagtacgctggtcagtaggaaaagagttctggaaagaaagcggcgctatcacttcgatacagacggtaaaggtagcattcacgaccagaaagggtgtccgaggaagaaaccgtttgagtgcggatcagagatgcgaaaagcgatgagtgtctcttccttgtcttccctctcatctcctagcttcactgagagtcagcctattgacttcggcgccatgccatacgtctgtgacgagtgcggcagaagcttttccgtgattagcgagtttgtcgagcatcagatcatgcacacccgggagaatttgtacgaatacggagagtcatttattcacagtgtcgccgtgtccgaggtccagaagagtcaggttgggggaaagcggttcgagtgcaaggattgtggtgaaaccttcaacaaaagcgcagccctcgccgaacaccggaaaatacacgccaggggctacctggtcgagtgcaagaaccaagagtgcgaagaggcatttatgccttccccgacattttctgagctgcaaaaaatctacggcaaagataaattttacgagtgcagggtgtgcaaggagactttcctgcacagctctgcactgattgagcaccagaagatccattttggagatgataaggacaatgaaagagaacatgagcgggagcgagaacgtgagagaggagaaacattccggccttctcccgctctgaacgagttccagaagatgtacggcaaggaaaagatgtacgaatgcaaagtgtgtggcgagaccttcctccactccagcagcctaaaggagcatcagaagattcatacaagaggaaatccttttgagaacaaaggtaaggtctgcgaggaaacctttattcctggccaatcgttgaagaggcgccagaaaacatacaataaagaaaagttgtgcgacttcaccgacggaagggacgcctttatgcagagctccgagttaagtgagcaccaaaagatccattcgcgcaaaaacttgtttgagggacggggctacgaaaaaagtgtgatccacagtggaccgtttactgagtcgcagaaatctcataccattacccgccccctggagagcgacgaggacgaaaaagcgtttaccatttccagcaatccatacgagaatcagaagattcccactaaggaaaatgtgtacgaagcaaagtcatatgagcgcagcgtgatccattcgttggcctccgtagaggcccagaagagccacagtgtggcggggccttccaagcccaaagtcatggctgagagcacaatccagtctttcgatgccataaaccatcagcgggtccgtgccggaggtaatacatcagagggcagggaatacagcaggtctgtaattcactccctcgtggcaagcaaaccaccacggtcccataacggcaatgagttagtggaaagcaatgagaagggggagagctcgatatacatctctgacctgaatgacaagagacaaaagattcccgccagagaaaacccctgcgaaggaggttccaagaatcgcaactatgaggacagcgtgatccaatccgtgtttcgagccaaaccccagaagtctgtacctggcgagggtagtggcgaatttaaaaaggatggtgaattcagcgtcccctcatccaacgtcagggagtatcaaaaagcaagggccaaaaaaaagtacatcgaacaccgcagtaatgagaccagtgtcattcacagtctacctttcggggaacagacttttcggcctcgcggcatgctttacgagtgtcaagaatgcggggagtgttttgcccattctagcgatctgactgagcaccagaagatacatgaccgggaaaaaccgtcaggctcacggaattatgagtggagcgttatacgcagtctcgcccccacagatccacagacgagttacgcacaggagcagtacgcgaaggaacaggcccgcaacaagtgtaaggactttcgccagttttttgcaacatctgaagacctcaatactaaccagaaaatttacgaccaagaaaaatctcatggcgaagagtcccagggtgaaaacacagatggggaggaaacgcattccgaggagacacatggacaggagacaatcgaggacccagtgatccagggctccgacatggaggatccacagaaggacgatccagacgacaaaatttacgagtgtgaagactgtgggcttggattcgtggatctaacagatctgaccgaccaccaaaaggtgcactcacgcaagtgcctggtcgatagccgcgagtacacccactcagtgattcatactcacagtattagtgagtatcaacgggactacacaggggagcaactgtacgagtgcccgaagtgcggcgaatcttttatccattcttcattcctctttgagcaccagaggattcacgaacaggaccagttatactcaatgaagggatgcgacgatggtttcattgccctcttaccgatgaagccacggaggaacagagcagccgaacgaaatccagccttagctggctcagctatcaggtgcctgttatgcggccagggttttatccactcctcagctctgaacgagcacatgcggctgcatcgcgaagacgacttgctggaacagagccagatggctgaagaggcgatcattccaggcttggcactcacagaattccagaggtctcagacagaagaaaggttgttcgaatgcgctgtgtgtggggagtctttcgtcaatccggctgaactggccgaccacgtgaccgtccacaagaacgaaccttatgagtacggctcttcttatacccatacgtcatttctgactgagcccctgaagggggcaatcccattttacgaatgcaaggattgcggcaaaagttttattcacagcacggtgttgaccaagcataaggaactccacctggaggaggaggaagaggatgaggccgcagcagcagctgctgccgcagcacaggaagtggaggccaacgtgcatgtcccccaggtggtgttacgaatacagggactgaacgtggaggctgccgagcccgaagtagaagctgccgaacctgaagttgaggccgccgaaccagaagtggaggcggctgagccgaatggggaggcagaggggcctgatggggaggccgccgaacccatcggagaggccgggcaaccaaacggtgaggccgagcaacccaacggtgacgccgacgaacccgatggggccggcatcgaagaccctgaggaacgtgctgaggaaccagagggcaaggcggaggagcctgaaggcgacgctgatgaacctgacggtgttggcatcgaggacccagaggagggggaagatcaagaaatacaggtggaggagccatactatgattgccacgagtgtaccgagactttcacatcctctacagccttctccgagcacctgaaaactcatgcgagtatgataatctttgaacccgctaacgccttcggagagtgtagtgggtacatcgagagagcttctaccagcaccggtggcgctaatcaggccgacgagaagtacttcaaatgcgacgtgtgcggtcaactgttcaacgaccgactgtcacttgcccgtcatcaaaacacccatacaggatag

SEQ ID NO: 23194 - DNA, 1302 bp, Artificial Sequence
  Description of Artificial Sequence: Synthetic coding sequence
atggccgaggcccagagcggcaccggccagctgcaggagcagaagaagggtcttctgattgcagtatccgtttcagtggacaaaatcatcagtcactttggagccgctcgcaatctggtccagaaagcacagcttggcgactcacgcctgtcacctgatgtgggacacctcgtgctgacgacactgtgtcccgctctacatgccttggtagcagacgggctgaaacctttcagaaaagacttgatcactggacaacgccgctctagtccgtggagcgtggtcgaggcctccgttaaacctggaagctcaactaggtctttaggaaccttgtattcgcaggtcagccgcctggcacccctctctagctctaggtctagatttcacgccttcatcttgggacttctgaacactaagcagctggaactctggttttcatccctgcaggaggatgccggactgcttagtctgctgtacctgccaactggatttttcagcctcgctagaggtggctgtccaagcctgtccactgagctgctattgctgcttcaaccactgagcgttttaaccttccacctggacctgcttttcgagcatcaccatcatctgcccctggggccaccacaggcaccggccccccccggcccacctcctgcactgcagcaaacaatgcaagccatgcttcatttcggagggcggctggcccagagtctccgtggtacttcaaaagaggccgcctcagacccaagcgatagtcctaacctgcccaccccaggcagttggtgggagcaactgacccaagctagcagggtgtacgcctccggcggcaccgaaggatttccactgtcacggtgggcccccggtcgacacggcacggcagccgaggaaggcgctcaagaaaggccgttgccaaccgatgaaatggcccctggcaggggtctgtggctgggccgcctgtttggtgttcccggcgggccagccgagaatgagaacggcgctctcaagtcccggagaccaagctcatggctacccccaacagtgagtgtgctggctctagtgaagcgcggggctcctccagagatgcccagtcctcaggaactcgaggcctctgctcccaggatggtccagacccatcgcgcagtgcgggccctgtgtgaccataccgccgcccgacccgaccagctgagctttcgccgaggggaggtgctcagggttatcactactgtagacgaggattggctgcgttgcggacgggacgggatggagggattagtgcccgtaggctatactagcttggtgttgtag

SEQ ID NO: 23195 - DNA, 1584 bp, Artificial Sequence
  Description of Artificial Sequence: Synthetic coding sequence
atggcccagaccctgcagatggagatccccaacttcggcaacagcatcctcgagtgtctgaatgagcagcgacttcagggactttactgcgacgtctccgtggtcgtaaagggccatgcgttcaaggcacaccgggccgtgttagcagcctcttcctcttatttcagagatttattcaacaattctcgctctgctgtggtcgaactgccagccgcagttcaaccacaatccttccaacagatactgtcattttgctacactggtcgactgtccatgaatgtcggtgaccagtttctcttgatgtacacggctggcttcctccaaatccaggaaattatggagaaaggcaccgagttcttcctgaaggtgtcttctccctcatgtgactcccagggactccacgcggaagaagcccccagttctgaaccccaatccccagtggcacagacatcaggatggcctgcctgttcaactccactgccattagtatcgagggtgaaaacagaacagcaggaaagcgactccgtgcagtgcatgcccgtggcgaaaaggttatgggattcaggccagaaggaggccggtggtggcggtaacggtagtcgtaaaatggccaagttttccaccccagacctggccgccaaccgaccccatcaacccccaccccctcagcaagcccctgtcgttgccgccgcccagcctgcagtggccgccggagccggacagcccgcagggggtgtagcggccgcgggaggagtggtaagcggcccaagcacaagcgaaagaacgagccccggcacctccagcgcatacacttctgattccccaggcagctatcacaacgaagaagacgaggaggaggatgggggagaagaaggcatggatgaacagtatcggcaaatatgtaatatgtacacaatgtattccatgatgaatgtggggcaaacagctgaaaaggtggaggccttgcctgagcaggtcgccccagagtcccggaaccgcatccgtgtgcggcaggacttagctagcctgccggcagagttgattaaccagattgggaataggtgccatccaaaactgtatgatgagggtgacccctctgaaaagctcgagctcgtgactggaactaatgtgtacattacccgcgcacagttgatgaattgccacgttagcgccgggacccgccataaagtgcttctgaggcgactgttagcgtccttcttcgacagaaatacactggctaattcttgtggcaccggaattcgctcatcaactaacgatcctcgtcgaaaacccctggatagtcgagtgctgcacgctgtgaagtattattgtcagaacttcgcccctaacttcaaagaaagcgaaatgaatgccattgctgccgatatgtgcacgaatgcccggcgcgtggtgcgaaagtcttggatgccaaaggtgaaggtgctgaaggctgaggacgatgcgtacacaacattcatcagcgagaccggtaaaattgaaccagacatgatgggtgtggagcatggctttgagaccgcctcgcacgagggcgaggcaggcccatcggcggaggctctccagtag

SEQ ID NO: 23196 - DNA, 672 bp, Artificial Sequence
  Description of Artificial Sequence: Synthetic coding sequence
atggaggtgcagaaggaggcccagcggatcatgaccctgagcgtgtggaaaatgtatcactcaaggatgcaacggggggggctgagactgcatcgaagcttacagctgagcctggtgatgagatccgcgcgcgagctctacttatcggccaaagtggaggcgctggagccggaagtgtcactccctgctgctttgccgtcagaccctaggttacatccccctcgggaggccgaaagcactgcagagaccgccacccccgatggagaacacccattcccagaacctatggatactcaggaggctccaacagctgaagagacatccgcatgctgtgccccccgcccagcaaaagtatcccggaaacgtcggtcaagtagtctctctgatgggggagacgccggtcttgtaccatccaagaaagcgcgactggaggagaaggaagaggaggagggcgcttccagcgaagtggcagatcgcctgcaacctccaccagctcaagccgagggcgcgttccctaatttggcaagagtgcttcagcgccgcttcagcggactcttgaattgctcgcccgcagcgcctcctaccgcaccacccgcatgtgaagccaagcctgcctgcagaccagcagactctatgctcaacgtgctggtcagagcagtggtggcgttttag

SEQ ID NO: 23197 - DNA, 1500 bp, Artificial Sequence
  Description of Artificial Sequence: Synthetic coding sequence
atgcgggtgctggtgccccccgccgagcggagccaggacacccgggtgggagcacccgcatggcgggaagccgcccaggcaatggctagaacagcccatattctgacggacaggtgtggtcaggaggctgtgactatgtggcagcccaaggattccgtgctggaccctaacgtcgcacaccatcttggccgggctgcttacattcagccttggcgatttagggtagaaatgataaaaggaggcggcacgcttgagaagcctccacccggcgagggcgtgactctgtggaaaggtaagatgaagccccccgcctggtacgccagattacccctgccattgcaccgaaaggcccgggcattgcagaccactgaggtcgtccatgcccacgcacgcggcgctcgcctcacggccgcaagactggggcgggcccaacaccagatcaatggccgcgtcagacagctcttgcggcaacgtgaagtgactgatcacagactctctgaggtacggaaggggctgctcattaaccagcagtccgtcaagcttaggggttaccgccctaaatctgagaaggtgccagataaggcggactctatgctgacctgggagaaagaagaactaaagtctatgaagcggaaaatggagcgcgacatggaaaagtctgaggtgctgttgaaaaccctggcgtcttgccgggatactctcaacttttgctttaaggagaggctccaagctgtggaccttatgaaccagcctctagataaggtgctcgaacaggcccgccgccattcctgggtcaatttgagtagggctcctacccctcggacacaaggacagaagactccaccgccagatcccgtgggcacatacaaccccgcctgtgcactcgcacttaatgaggccaaacgtctgctggtggaaagcaaagacaccctcgtggaaatggccaagaacgaggttgatgtaagagagcagcagcttcaaatatccgatagggtgtgtgcctccctggcccagaaagcatccgaaacacttgaactcaaagagcgcttaaatatgacactgggacttatgcgcggaactattttaaggtgtaccaaatataatcaggagctttatacaacacacggcctgatcaaaggtccactttcgaaggtgcatctggaaacggccgagaagctggacaggccccttgtgcggatgtaccagcgccatgtgggaacacagcttcccgaagctgcgcgcttagcacagggtaccgataagttgcagtgtcatatcacttacctggagaaaaatcttgacgaactgcttgccacgcacaaaaacctgtcatggggcctcaactgtaagaatatcggccacgaagtagacgggaatgtggtgaggctacgactacggcagagacagcctcacgtatgttatgaacaggcccaaagacttgttaaggattgggatcctcggacaccgcctccaagatccaagtccagtgcagacccctag

SEQ ID NO: 23198 - DNA, 1827 bp, Artificial Sequence
  Description of Artificial Sequence: Synthetic coding sequence
atggagatggagagcgccgccgccagcacccggttccaccagccccatatggagcggaagatgtctgcaatggcttgtgagatctttaatgaactcaggctggagggtaaactctgcgacgtggtgatcaaggtgaacggcttcgagttttcagcccacaagaatatcctgtgctcttgtagctcctatttcagagcattgttcaccagcggatggaataatactgagaaaaaagtgtataacattccaggaatctctccggatatgatgaagctgataatcgaatacgcctacactcgcacagttcctataacaccggacaatgtcgagaaacttctggcggctgcagatcagttcaatatcatggggattgtccgcggatgttgcgagtttttgaaatccgaactctgcctggacaattgcatcggcatttgcaagttcacggattattactattgcccagagcttagacagaaggcctatatgttcattctacataattttgaggagatggtaaaggtaagcgcagaatttttggaattgagcgtgacagagctcaaggacatcatcgagaaagacgaactgaacgttaagcaagaggatgccgtgttcgaagccatcttaaaatggataagccatgatcctcagaaccggaaacagcatattagcatcctgctgcccaaggtgcgtctggcgttgatgcatgccgagtacttcatgaataatgtaaaaatgaacgactatgttaaggattctgaggaatgtaagcccgtaattataaacgcgcttaaagccatgtacgacttgaacatgaacggaccaagcaactcagatttcaccaacccacttacacgacctcgactaccttacgccatcctgttcgcaatcggaggatggagtgggggctcccccacaaacgccattgaagcatatgacgcgagagctgacaggtgggtgaacgttacatgcgaagaggaatctccgcgagcgtatcacggagcagcctacttaaaggggtatgtttatataattggcgggtttgatagcgtggactacttcaattctgttaagcgatttgaccccgttaagaagacctggcaccaagtggcaccgatgcatagccgcaggtgctacgtgagcgtaactgttttgggtaacttcatttacgcaatggggggcttcgatggttacgttaggcttaacactgctgagagatacgaaccagagacaaatcaatggaccctgatagcccccatgcacgaacagaggtccgacgcctccgccacaactctatacggcaaggtttacatttgcggtgggttcaacggaaacgaatgcttgtttaccgcggaagtatataacaccgagagtaaccagtggacggtcatagctcccatgcgctctaggcgctctggaatcggcgtgatcgcctacggagagcacgtctatgctgtgggggggttcgacggagccaaccggctacggtccgccgaggcctattcccccgtggctaatacctggcggactatccccacgatgttcaaccctcggagtaactttggcattgaagtggttgacgacctcctgttcgtggtgggcggtttcaacggctttactactacattcaatgtggagtgctacgacgagaaaaccgacgagtggtacgatgcacatgacatgtctatataccgaagcgcactgagctgttgcgtcgtaccgggactcgccaacgtggaagaatatgccgctcggagagataatttccccggccttgccctgcgggacgaggtgaagtattcagcaagtacctcaaccctgcccgtgtag

SEQ ID NO: 23199 - DNA, 942 bp, Artificial Sequence
  Description of Artificial Sequence: Synthetic coding sequence
atggccgccctgaccgacctgagcttcatgtaccggtggttcaagaactgcaacttggtagggaacctgtctgagaaatatgtgttcattactgggtgtgattccggcttcggcaacttgctggccaaacaacttgtggaccggggaatgcaggtactcgcggcatgctttactgaagaggggtcccagaagctgcagcgcgatacctcttacaggctgcaaacaacgcttctggacgtgacaaagtcagagtccattaaggccgcagcccaatgggtcagggacaaagttggcgagcaggggctttgggctcttgtgaacaacgccggggtgggtctcccctcaggtcccaatgagtggcttacgaaagatgacttcgtgaaggtgattaacgtcaaccttgtgggactaatcgaagtgacactacacatgttacccatggtcaagcgcgcccgtggacgcgtcgtgaatatgtcatctagcggggggcgggtggccgtgatagggggcggctactgcgtttcaaagtttggtgttgaggcatttagcgattctattcggcgcgagttgtactacttcggagttaaagtttgcatcattgaacctggcaattatcgtacagcaatcttgggcaaggagaatttggaaagcagaatgcgcaagctttgggagagattgccgcaggagacccgcgatagctacggcgaggattacttcagaatttataccgataagctaaaaaacatcatgcaagtcgccgaacctagggtccgggatgtgataaacagtatggagcatgcaattgtctcaaggtctccccgcatcaggtacaacccaggcctggacgcaaaactgttatatattcctctcgccaagctccctacgcccgtgactgacttcatactatctcggtacctgccccgtcccgcggacagtgtatag

SEQ ID NO: 23200 - DNA, 1461 bp, Artificial Sequence
  Description of Artificial Sequence: Synthetic coding sequence
atgacctgcggcagctactgcggcggccgggccttcagctgcatctccgcctgtgggcctcgtcccggacggtgctgcattaccgcggcaccttaccgaggcataagctgctaccgcggtttgactggcggctttgggagccatagtgtgtgcggaggattcagggcaggctcttgcggtaggtctttcgggtataggtctggaggagtgtgtgggcctagtcccccttgcatcactactgtgtctgttaatgaaagtctgctgactcctttgaacctggaaattgaccccaatgcccagtgcgttaagcaggaagagaaggagcagataaagtcactgaatagccggtttgccgcgtttatcgacaaagttcgattcttggaacagcagaacaagcttctcgaaactaaattgcagttctatcaaaaccgggagtgctgtcagtcaaatctcgagccactgttcgagggatacatcgaaacactgagaagggaggctgagtgtgtagaggccgacagtggccgccttgcctccgagttgaatcatgtgcaagaagtgctcgaaggatacaaaaagaagtatgaggaagaggtatccctcagagcaaccgccgaaaacgagttcgtggctctgaaaaaggatgtggactgcgcctatctccgcaaatctgacctggaagcgaacgtcgaagccctgatccaggaaattgactttcttaggagactctacgaagaagagatccgggtgctgcagtcacacatatctgatacaagtgtcgtcgtcaaactggataactcccgggatctgaacatggactgcatcattgccgagatcaaggcccagtacgacgatattgttacccgatctcgggcagaggcagagtcgtggtatagatccaaatgtgaagagatgaaagctacagttattcgccatggggagaccctccggcgaaccaaagaggagataaatgagctgaatagaatgatacagcggttaaccgcggaggtcgaaaatgctaagtgccagaatagtaagcttgaggctgctgtagcacaatccgagcagcagggagaggcagctctctccgatgcccgctgcaaattggcggaactggagggcgcactgcagaaagcgaagcaggatatggcctgccttatacgagaataccaagaggtcatgaactcaaagctaggtctcgacattgagattgcaacataccgtaggctcttagaaggagaagagcagaggctttgcgaaggcgtggggtctgtgaacgtctgcgtgtctagctctcgcggcggagtggtctgtggtgatttgtgtgcctcaactaccgccccagttgtcagcacgagggtatcctcagtgccctccaactcaaacgtcgtggtaggtaccacaaacgcatgcgcccctagcgctagagtgggcgtttgcgggggatcctgcaagagatgctag

SEQ ID NO: 23201 - DNA, 939 bp, Artificial Sequence
  Description of Artificial Sequence: Synthetic coding sequence
atggccgagctgaccgccctggagagcctgatcgagatgggcttccccagagggcgtgccgaaaaagcccttgcccttacaggaaaccagggtattgaggctgctatggactggctgatggagcatgaagatgacccagatgtcgatgaacccctagagacgcccttgggccacatcctgggccgagagccgacctcgagtgaacaaggtggactcgaaggctcagggagcgccgcaggagagggtaaaccggcactgtctgaggaagagcgccaagagcaaactaaacggatgttggagctggtcgctcagaagcagcgggagcgcgaagagcgcgaggagcgtgaggctcttgaacgggaacgtcaaagacgaaggcagggacaggagctcagtgcagctcgacagcgactccaggaggacgagatgagaagagcagctgaggaaagaaggagagagaaagcagaggaacttgccgccagacagcgtgttcgcgagaaaattgaaagggataaagccgaacgagccaagaagtatggcggctcagttggatcacaacctccccccgtcgcacctgagccaggccccgtgccatcctctccaagccaggagcctccgaccaaacgcgagtatgatcagtgccgcattcaggtcagactaccagatggaacatcactgacccaaactttccgtgctagagaacagctagctgcggtccgcctgtacgttgagctccatagaggagaagagctgggggggggacaggacccagtgcagttgctaagcggctttcccaggcgggcattcagtgaggcggacatggaaagacccctacaggaactcggtatggctgcaagactggagactaggacacggaattggggttcgagggaggcatgtcttgggaaaggaggcatgcaaagagagggtgctctctag

SEQ ID NO: 23202 - DNA, 405 bp, Artificial Sequence
  Description of Artificial Sequence: Synthetic coding sequence
atgcccgccgacctgagcggcacctggaccctgctgagcagcgacaattttgagggatatatgttggcgttgggaatagactttgctacccgcaaaatcgccaaactgttaaaaccgcagaaagtgattgagcaaaatggtgactcctttactattcatactaactcttcgctgcggaattattttgtgaaattcaaggtcggagaggagttcgacgaggataaccgaggtcttgataacagaaaatgcaagagcctggtgatctgggataacgaccgtctaacatgtatccagaagggtgaaaaaaagaatcggggttggactcactggatcgaaggagacaaactccatctggaaatgttttgcgagggccaggtgtgtaaacagacattccaacgcgcttag

SEQ ID NO: 23203 - DNA, 1383 bp, Artificial Sequence
  Description of Artificial Sequence: Synthetic coding sequence
atggccggctacctgagcgagagcgacttcgtgatggtggaggagggattctctaccagggacctgctgaaggagctcaccctaggagcctcacaggctacgaccgacgaggtcgcagctttttttgtggccgaccttggcgccattgtgagaaagcacttttgcttcttgaaatgtctcccgagggtgagaccattctacgccgtgaaatgtaactcctcacccggagtgctgaaggtgcttgcacagttgggactgggtttttcctgcgctaacaaagccgaaatggagctcgtgcagcatatcgggattccggccagcaagatcatctgcgccaatccctgtaagcagatcgcccagatcaagtatgctgccaagcatgggattcaactcctctcctttgacaacgaaatggagctagccaaggttgtgaagtcgcatccctcagccaagatggtgctgtgcatcgccacagatgatagccactcactgtcctgtctctctcttaaattcggcgtcagcttaaaatcgtgtcgccatcttctcgagaacgccaaaaagcatcatgtggaagttgtcggggtgtcatttcatataggaagtggctgcccagacccacaagcctacgcgcagagtattgctgatgccagactggtgtttgagatggggactgaacttgggcataagatgcacgttctggaccttggcggcggttttcctgggactgagggggccaaagtccgtttcgaagagattgctagcgtcataaatagcgctttggacctgtatttccctgagggatgcggtgttgacatcttcgcggaactgggacgatattacgtcaccagtgcttttacagtcgccgtgagtatcatcgccaaaaaggaagtcctgctcgatcagcccggtcgcgaagaggagaatggctccacatcaaagactatagtgtatcacctggacgaaggcgtttacggaatcttcaacagtgtcctgtttgataatatatgccctacgccaattcttcagaaaaaaccgagcaccgagcagccattatactcttcatccttatgggggccagcagtggacggctgcgattgcgtggccgaagggctctggctccctcagttgcacgttggagactggctcgttttcgataatatgggcgcatataccgtgggcatgggaagtccattttggggaacacaggcatgtcacataacctacgcgatgagccgcgtagcctgggaggctcttcggcgtcagctaatggcggccgaacaggaagatgatgtggagggtgtgtgtaagcctttatcctgtggttgggaaataaccgatacgctgtgcgtgggacccgttttcacacccgctagcataatgtag

SEQ ID NO: 23204 - DNA, 1209 bp, Artificial Sequence
  Description of Artificial Sequence: Synthetic coding sequence
ggcggcccccggggcagcggcagcgccgccgagaccatgcccgagatccgagtcacccccttaggggctgggcaagatgtaggccggagctgcattctcgtctctatcgctggaaaaaatgtgatgctcgactgcgggatgcatatgggttttaatgacgacaggcggttccctgacttttcatatattacacagaacggtcgactcaccgacttcctggattgtgtgataattagtcacttccatctggatcattgcggggcgctcccctatttttctgagatggtcggttatgatgggccaatctatatgactcaccctacacaagctatttgtcccatcctgttggaggattacagaaagattgccgtggacaagaaaggcgaagcaaacttcttcacctcccagatgatcaaagattgcatgaacctactggaaacgttctgggagcgcatgaacctcaaggtgccgatctatttcagcactgggcttacagagaaggcaaaccactattacaaactatttatcccctggaccaatcaaaaaattcgtaagacttttgtccagagaaacatgtttgagttcaaacacattaaagcatttgaccgggcctttgccgataatcccggccccatggtcgtgttcgccactcccggaatgctgcatgcaggtcagtcactccagattttcagaaagtgggctggcaatgagaagaacatggtcatcatgcccggatattgcgtgcaggggacggttggacataagattctgagtgggcagcgcaagctggagatggagggtcgccaggttctggaggtcaagatgcaggtcgagtacatgtccttcagcgcacacgctgacgccaagggcattatgcagctcgtgtcgagcgaacaggccctgaaagagctgggtctcgcagaacaccagctgaggttcacctgtcgcgtgcatctgcatgatacccggaaggagcaggaaacggcactgcgagtgtactctcatctgaaaagcgttttaaaggaccattgtgtgcagcacctacctgacggcagtgtgactgtggagagcgtgctcctccaggcagccgccccctcggaagacccaggaaccaaggttttgttggtctcctggacctatcaagatgaagagctgggatcattcctcacctctctacttaaaaaaggactgcctcaagctccttcatag

SEQ ID NO: 23205 - DNA, 1863 bp, Artificial Sequence
  Description of Artificial Sequence: Synthetic coding sequence
atggagaaggccgtgaacgacggcagccacagcgaggagctgttctgtcaccttaagaccatctccgagaaggaggaccttccgcggtgtacttccgaatcccacttgagctgcctgaaacaggacattctgaacgagaagacggagctcgaagccaccctgaaggaagccgagctggtcacccattcagtagaattgctgttaccattatttaaagatacaattgagaaaatcaatttcgaaaacgccaatctcagcgcgcttaacttgaaaatctccgagcagaaggaaattctgattaaagagttggacaccttcaaatcagttaagctcgctctggagcatctgctgcgcaagcgagactacaagcagaccggagacaatctcagctccatgttactcgaaaatctgacagacaacgaatccgagaacacgaacctcaagaaaaaggtcttcgagaaggaggcacacatacaggagctctcttgtctgtttcaatctgagaaagcgaacacactaaaagctaatcggttctctcagtccgtgaaagtggtgcacgagcggttgcagatccaaatccacaagcgcgaggctgaaaatgataaactgaaagaatacgtgaaatctctggagaccaaaattgcaaaatggaaccttcaatctagaatgaataagaatgaggctatagtgatgaaagaggctagccggcagaagaccgtggcgctaaagaaagcatctaaagtatataagcagcgtctggaccatttcacaggcgcaatcgagaagcttacctcgcaaattcgcgatcaggaagcaaaactgtctgaaaccatttcagcttctaatgcttggaagtcacactatgagaaaattgtaatagagaaaacagagttggaggtgcagatagaaaccatgaagaagcaaatcattaatctactagaagacttaaagaagatggaggatcatgggaaaaattcttgtgaagaaatccttcgaaaggtgcattccattgagtacgagaacgaaactctgaaccttgaaaataccaagttaaaaaccaccctggccgctctgaaggatgaagttgtaagtgtagagaacgaattaagtgagttacaggaagttgagaaaaagcagaagaccctgattgagatgtacaagacccaggtgcagaaactccaagaggctgccgagatcgtaaaaagccgatgcgaaaacttgctccacaagaacaaccagatcacaaagactaaaaacaagaacgtggagaaaatgagaggccagatggaatcgcacttaaaagagctcgagcgggtttgcgattcattgactgccgctgaaagaaggttacatgaatgccaggagtctctccaatgttgtaagggcaaatgcgcagatcaggaacataccatacgggagttgcaaggacaaatactaaaacagtgggaggagtatagcgtgttggcatgggtagacggtaaccataacttgcttactaagctgagcctcgaagaagagaattgccttatacaactcaaatgcgagaatctgcaacaaaaactggagcaaatggatgcggaaaataaagaactggaaaagaagctggcaaaccaggaggagtgccttaaacacagtaatctgaaatttaaggaaaaaagtgccgagtacaccgccctggccagacaactggaagcagctctggaggaagggagacagaaggtggctgaagaaattgagaagatgtcaagccgggaaagcgccttgcagataaaaattctggacttagagactgaactccggaagaaaaatgaggagcagaaccagcttgtgtgcaagatgaactccgatcccgaaaccccatag

SEQ ID NO: 23206 - DNA, 465 bp, Artificial Sequence
  Description of Artificial Sequence: Synthetic coding sequence
atgagcaagaacaccgtgagcagcgcccggttccggaaggtggacgtcgacgaatatgatgaaaacaagtttgtcgatgaagaggacgggggggatggacaggcaggtcccgatgagggagaggtcgattcgtgtctgcggcactcaataaccggcaacatgacggccgcgctgcaggctgctctgaagaacccacccattaataccaaaagccaggcagtcaaggaccgcgctggcagcatcgtactgaaggttcttataagctttaaagccaatgatatagagaaggccgtccagtcgctagataagaacggtgttgacttgctgatgaagtatatctacaagggattcgagagcccatccgataattcttccgctatgctcttgcagtggcacgaaaaagctctggctgccggaggggtcgggagcatagttagggtcctcacagcacgcaagacggtctag

SEQ ID NO: 23207 - DNA, 2946 bp, Artificial Sequence
  Description of Artificial Sequence: Synthetic coding sequence
atgagcgagcaggagcggatccaggagtgcctgcggaaggagatccggtcactgctcatcagcaccaaagacggtctgagcccccaggagctggaaaaggagtatctgctcatggtgggcaatcatttgcctttacgtatacttggctatcgtagcacaatggaactggttctcgacatgcccgacgtagtgcgagtttgccccggagctggggggacagtgatcttgaaggcaatacccgatgagagcacaaagggaattgcctctctggtggccaagcagcgatcatctcataagctgaggaactcgatgcacaaaggtagaccttcgatttactcaggacccaggtcccatagacgggtcccttacaggggacgagtggctccaattctgcccgccgtggtcaaaagcgagctcaaagatctactggctctatcccccgtgttactgtcggatttcgaaaaggcctttgccaaacgctttggccgctcattccagtacatgcagtacggctttttgtccatgttcgaggtgctgaacgcggcaagcgatgtaatttcagtcgagcaaacccgcgccgggagcctactgatgcttaaaaaaagcgtgacggaggaaaagcctcgaggctgccccgcaggcaagatctttacccagccattccgcatgaagcaggggagctattctaccggcttccccgtggcaaagccatgtttctcccaacccacaagcaatatggaaccaccaaagcaaataatgtccatggagaagaccagcaaactcaacgtcgttgagaccagtagattgaatcataccgagaaactgaaccagttagagaacacattcaagagtgtaatcgcgcaaatagggcccggcggaaccatatcaagtgagttaaaacataagatcaaattcgtggtgtccaaattccctgagggccttttcatttctaagcttcttggggagtacgaagtcatatttaaggaacagctatcacccaagaagctgggctttttaaatgtgaccgagcttgtgggagcattgtctgatattctgcacgtggagttccgtaaaggtcatcaggatctgcttgtgttcgatgccgacaagaagcctctgcctcccgttcaatcagacaaaaagatagaagcgaaggcctgcgtctcaagtcctcctcggaactccctttcaaccgccgcggtcaaggagaccgtgtggaattgcccctctaaaaagcagaaggaaccacaacagaagatctgcaagaagcccaacttggtcgtcaagcccttgcagctgcaggttgaaaccaataaaagcgagctgaatctggcaatggccaatcatgatatccctcccgacgcggtaccaaacaagaagctgtgcagactgccaccactcgataccagcagccttatcggggtgttcgtggagtatattatttctccctctcagttttatataaggatttactcccgtgactcaagtgagcttctcgaagatatgatgattgagatgagaaggtgctactcgaatcagctagtgtccgatcggtacgtaatgccagaatgttttattcagccagggcacctgtgctgcgtgcgcatttctgaagacaaatggtggtaccgcgtgataatccaccgtgtcctggaaaagcaggaggtagaggttttttatccagactttggaaacattggtattgtccagaagtcctccctgcgattcctgaagtgctgttacaccaagctgcccgcccaggcaattccatgctcattagcatgggtgagacccgtcgaagagcactggacgagtaaagccatactgcagtttcagaagttgtgtggcttaaaacccctggtgggagttgtagatgagtatgttgacgggattcttaatattttcctttgcgacacctcctccaatgaagatgtctatttccaccacgtactgcgcacagaaggccacgctatcgtttgtcgcgagaatatttcttctaaaggattctccgagctcaatcccctggctctgtacaccacaagttccggaggccctgaagacattgtactgaccgaactcggctacccatcacagcagcattactttaacgaggaccgtaaaatttcaccacaatcaaaggaatccgagctcaggattttggacgagattccgacaggtatgccgtgcctggagtcagtgaccattggcgacgatatatgggatgagaattggctcccattacaggcaaaaatgggcaaaggtggggatgccgcatcccatctattcaccgcatcgctggggggtaaaaatcagtactccagctgtaaggagatgcctcagaaagattggtgtttcagtaccccaaaggatacatgggacgattcctggcagccaagtggcctcgtgaatgggactaaggtcgaggtgcacaagccggaagttcttggagcacaggagaaaaatacaggtactaacagaacacagaaacagcttgatatcaatggttcctccgattcatccactcttcccaaactcgaagaattttgtaccagcctcacccagagcgaacagtcagctgatgggagccagagtgagccaaacaactcccagacacagcccaaacagattcagttatcaacagctgccccctgttctacaaccgctgtggacgacagtgcagaaaagccctctggctctgttgagtcctctcccgagatccttaagaacgaggacttttcttcctcacgagcaataaccctgtataaggacaagcggcaggagagtgtggaccaactcagtttgatcctgtcctacgaatgtcagatatcacaaaagctgtatattcctcgcagtacagccactgccgcgctcggcgcggccgcgcggcttgccacttcaagaagtctcctgcactggtatcctagcgttaagagaatggaggcttag

SEQ ID NO: 23208 - DNA, 909 bp, Artificial Sequence
  Description of Artificial Sequence: Synthetic coding sequence
atggagatccaggagctggaggagatccaggcctgccagggcctgtgggaggttttcgttactctgtcggaaagggcaagagattacttacataagacagggcgatttattgtgatcggcgggatcgtttctcctgtccatgactcctacggcaaacagggcctcgtttcttcccgacaccgtctcattatgtgccaactcgcggtacagaactctgactggatccgggtcgacccgtgggagtgttatcaggatacctggcaaacgacctgctctgttctggagcaccacagagaccttatgaagagagtaacaggatgcatcctttctaatgtcaacaccccctctatgacccctgtcattggccagccacagaatgaaacccctcaacccatctatcagaatagtaacgtagccactaaacctacagcagcaaagatcctggggaaggtcggagagtccctaagtcggatctgctgtgttcgcccgccggtagaaagatttacattcgttgatgaaaatgccaacctggggaccgtgatgcgttacgaggaaatcgaactgcgcatcctgctgctctgcggtagcgatttgctggagtccttttgcatccccgggctttggaatgaagcagacatggaggtgatagttggcgactttgggatcgtcgtggtaccaagggatgccgccgacacggaccggatcatgaatcatagctcaattctgaggaaatacaagaacaatatcatggtcgtgaaggacgacatcaaccaccctatgtcggtggtctcctctaccaagtcacgcctggccctccagcatggtgacggacatgttgtcgattacctctcgcaacccgtcatcgactacatcctgaagagccaactgtatataaatgcatccgggtag

SEQ ID NO: 23209 - DNA, 861 bp, Artificial Sequence
  Description of Artificial Sequence: Synthetic coding sequence
atggagcggcggctgggcgtgcgggcctgggtgaaggagaaccggggatctttccaacctccggtgtgcaataaacttatgcatcaggagcaactcaaagtcatgttcatcggcggacctaacacgcgcaaagactatcacatagaggagggcgaagaggttttctatcagctcgaaggtgatatggtgctgagagtgctcgagcagggcaagcatagagatgtcgtgatcaggcagggtgagatctttttgcttccagctagggtgcctcattcgccccagagatttgcgaacaccgtcggactagtggtggaacgtaggcgcctggagaccgaactggatggcctccgctactacgtgggcgatacaatggacgttctcttcgagaaatggttctactgcaaagacctgggcacccaattagcaccaatcattcaggaatttttcagctccgagcagtataggacagggaaacccatccccgaccagttgctcaaagagccaccgttcccactgtctactaggtccattatggagccgatgagtcttgacgcatggcttgattcccaccatcgcgaactgcaggctggcaccccactgtctctgttcggcgacacctatgaaacccaggtgatagcttacgggcagggcagcagcgaagggttgcggcagaacgttgacgtgtggctgtggcagctggagggcagctcagtcgttactatgggcggccggagattgtcccttgctcccgacgacagcctgctcgtcctcgccggcactagctacgcttgggaaaggacccagggcagtgtggcgctgtctgtgacacaggaccctgcatgtaagaaaccgcttggctag

SEQ ID NO: 23210 - DNA, 1545 bp, Artificial Sequence
  Description of Artificial Sequence: Synthetic coding sequence
atgcaggagagcggctgccggctggagcaccccagcgccaccaagttcaggaatcacgtcatggaaggcgactgggacaaagcagagaacgacttaaatgaactgaagcccctggttcactctccacacgctatagttgtccggggtgccctggaaatctcgcaaacgctcttagggattattgttagaatgaaatttttgttgctgcaacagaagtatttagaatatctggaggacgggaaggtgttagaggcccttcaggttctgcgctgcgagcttactccgctgaagtataacaccgagagaatccacgtgctgtccggctacctgatgtgtagccacgccgaagacctgagggctaaggccgagtgggaaggcaagggtactgcaagtcgatccaagcttctggacaaactgcagacttatctccctcccagcgtgatgcttccccctagacggctgcaaaccttgcttcgccaagccgtcgagctccagagagaccgttgtctctatcacaatactaagctggataacaatctggactccgtgtctctgctgatagaccatgtctgttcccgtcgccaatttccctgctacacccaacagatccttaccgagcactgtaacgaggtgtggttttgtaagtttagcaacgatggaaccaaactggcaactggaagcaaagatacaacagtgatcatctggcaggtggaccccgacacccatctgctcaagctacttaaaacgctagagggccatgcctacggcgtgtcatacatcgcttggagcccggacgacaattacctggtcgcatgcggccctgatgattgctcagaattgtggctgtggaacgttcagactggcgaactccgcacaaagatgtctcagagccacgaggattctctgacatctgtggcctggaatccggacggcaagaggttcgtgactggagggcagcgaggacaattctatcagtgtgatctcgacgggaaccttttggactcgtgggagggagtgcgcgttcagtgtctgtggtgtttgtccgacgggaaaaccgttctcgcatccgacacccaccaaagaatacggggatataacttcgaggacctgacagataggaacatcgtccaggaagatcatcccattatgtcatttactattagcaaaaatggcaggctggccttactaaacgtggcaacacagggggtgcatctgtgggacctccaagatagggttttggtgagaaagtatcagggagttacacagggtttctacacaatccactcttgcttcggcggacacaacgaggattttattgcatcgggcagcgaggatcacaaggtttacatttggcataaaagatctgagctgcccatcgcagagctgactgggcacacccggaccgtgaattgtgtatcctggaatccacagattccttctatgatggccagtgcaagcgatgatggaactgtgagaatctggggccctgccccttttatcgatcatcagaatattgaggaggagtgttcatccatggacagctag

SEQ ID NO: 23211 - DNA, 540 bp, Artificial Sequence
  Description of Artificial Sequence: Synthetic coding sequence
atgggcatcctgttcacccggatctggcggctgttcaaccaccaggaacacaaagtcatcatcgtaggccttgacaatgccgggaagacgactatcctctatcagttctcgatgaacgaggtggtacacaccagccctactataggctccaatgtcgaggagattgtgatcaataatacgagattcttgatgtgggatatcggaggccaggagtccctgcggtcgagctggaacacctactataccaataccgaattcgtgatcgttgtggtggactccactgatagggaacgcatctcagtgacccgggaggaactgtataaaatgctggcccatgaagatttacgtaaagcagggttgttgatttttgcgaacaagcaggacgtcaaggagtgtatgaccgttgccgagatatctcagtttctgaagttgactagtatcaaagatcaccaatggcatatccaggcctgttgtgccctgaccggcgaagggctatgccagggcctggagtggatgatgtcacggctcaaaatcagatag

SEQ ID NO: 23212 - DNA, 1428 bp, Artificial Sequence
  Description of Artificial Sequence: Synthetic coding sequence
atgcagaagagcaccaacagcgacaccagcgtggagaccctgaactccacccggcagggcaccggcgctgttcagatgcgcataaaaaacgcaaattctcaccacgaccggctgtcgcaatcaaaatccatgattttaactgacgtcgggaaggtaaccgagcctatctctcgccaccggcggaaccactcccaacatattttgaaggatgtgattcccccacttgagcagctgatggtcgaaaaagaagggtacctgcagaaggctaaaatagcggatggaggcaagaaactccgaaaaaattggtcaacaagctggatagtgctctcttctagaaggatcgagttttacaaggaaagcaaacagcaggcgctctccaatatgaaaaccggtcacaaaccagagagtgtcgacttatgcggcgcccatatcgaatgggctaaggaaaagtcatctcggaaaaatgtgttccagattaccaccgtatccggcaacgaattcctcctccagtcagacatagattttatcattctggattggttccatgccatcaagaacgccatagacagactcccaaaggactcatcatgtccttcccgaaatctggaacttttcaagattcagaggtcgtccagtactgagttgctcagccactacgactccgacattaaagagcagaaaccagaacataggaaatccttgatgttccgcctgcatcactcagcttcagatacaagtgataaaaatcgcgtcaagtctagactgaagaagtttatcacacgtcggccaagtcttaagactctccaggaaaaagggctgataaaggatcagatctttggctcccaccttcacaaggtctgtgagagagagaactctactgtaccatggtttgttaagcaatgtattgaggcggtcgagaaaagggggctggacgtagacgggatctaccgcgtttccggcaacctggcaactatccagaagcttcgatttattgtgaatcaggaggaaaagctgaatctcgacgactcccagtgggaggacatccatgtggtcaccggcgcactaaaaatgttcttccgggaattgccagaacccttgttcccatactcattctttgagcagttcgtagaggctattaaaaagcaggacaacaatactagaatcgaagctgtgaagtcccttgttcagaagttaccccctcccaacagagataccatgaaagtgctgttcggccatttaacgaagatagtggctaaggcatctaagaatctgatgtccacacagagcttgggaattgtgtttggcccgacattactgagagccgaaaacgagacaggaaatatggcaatacacatggtttaccagaaccagatagccgagctgatgctatctgagtactccaaaatctttggtagcgaggaagactag

SEQ ID NO: 23213 - DNA, 1308 bp, Artificial Sequence
  Description of Artificial Sequence: Synthetic coding sequence
atggcccagaccgtgcccccctgcgagctgccctgcaaggagtacgacgtggctcggaatactggagcttatactagctccggattagcgactgccagctttcggacctctaaatatttactggaagagtggttccaaaactgctatgcccggtaccatcaagcttttgcggatcgggatcaatctgaacgccagcggcatgagagccagcagctggccacagagactcaggcattagcacaacgcacgcagcaggattccacacgaactgttggagagcggctacaggatacacactcctggaaaagtgaactccagcgcgaaatggaggctttggccgccgaaaccaacctgctattggcccaaaagcagaggctcgagcgtgccctggatgctacagaagtcccttttagcataaccaccgataatctccagtgccgagagcgaagggagcaccccaacctcgtgagagatcacgtggaaactgaactgctcaaagaggcagagttaatacgaaacattcaagaacttctcaaacgcaccattatgcaggctgtctcccaaattaggctgaaccgagaacacaaggaaacctgcgagatggactggtccgacaagatggaggcatacaatatcgacgagacgtgcggacgccatcactcccagtcaactgaggtccaggcacacccatactccaccaccttccaggagtccgcatctacacccgaaacgagagcaaaattcacacaggataatctgtgccgggctcagagagagcgcctcgcctctgctaatttgagagtgttagttgactgcatactccgagataccagtgaagatctgaggctccaatgcgacgccgtgaacttggcatttggaaggagatgcgaggagttagaggacgccaggtataaactgcatcatcatttacataagacactgagagaaataacagaccaagaacataacgttgctgccttgaagcaagcgattaaagataaggaggcccctttgcacgtcgctcaaactcggctgtatctgagatcccacagaccgaatatggaactctgcagggacgccgcacagttccgtttgctatctgaggtggaggagctgaacatgtcactgacagccctaagggaaaaattgctcgaagcggaacaatctctccgtaatcttgaggatatccacatgtctctcgagaaagatatagccgcaatgaccaattccctgttcattgacagacagaagtgtatggctcatcgcacacgttatccaactatcttgcaactagcagggtaccaatag

SEQ ID NO: 23214 - DNA, 828 bp, Artificial Sequence
  Description of Artificial Sequence: Synthetic coding sequence
atgcggaagcggctgagcgcccccgagctgcggctgagcctgaccaaggggcccggcaatgatggggcctcgccaacacagagcgccccctcaagtcccgacggctccagcgatttagagattgacgaactggaaaccccctcagactccgaacagctagactccggacacgagttcgagtgggaggatgagttgcctcgtgccgagggtcttggtacttctgagacggccgagaggctgggcagaggctgtatgtgggacgtgactggggaagacggacaccactggagggtgttccggatgggtccccgggaacagcgggtggatatgacagtgatcgagccatataagaaagtcctcagtcatggaggataccacggtgacggattgaacgccgtgatcctctttgcgtcctgttatttgccacgctcttccataccgaactatacatacgtgatggagcatctgttccggtatatggtgggcacactcgaactgctggtcgctgaaaattacctcctggtgcatctgtccggcggcacttccagagcccaggtgcctccactgagctggattagacagtgttaccgaaccctagatcggcgacttagaaagaatctgcgggcactggtagtggtgcacgcgacatggtacgtgaaggcctttttggccctgcttagaccttttatatcctccaagttcactagaaaaatccggtttctggactctctgggagaactggctcagctgatctcgctggatcaggtacacatacccgaagctgtgcgtcagctggacagagatctgcatggaagcggcggtacatag

SEQ ID NO: 23215 - DNA, 2391 bp, Artificial Sequence
  Description of Artificial Sequence: Synthetic coding sequence
atggaggaggaggccagccggagcgccgccgccaccaaccccggcagtcgcctgaccaggtggcctcctcccgacaagcgtgagggctccgcggttgatcccggtaaacggagatcactcgctgcaactccgtcttcctccttgccctgcaccctgattgctcttggacttaggcatgagaaggaggctaatgagctgatggaggatttgtttgagacattccaggacgagatgggatttagcaatatggaggacgacggccccgaagaggaggagagagttgccgaaccacaggcaaactttaacacgcctcaggccctaaggttcgaagagctgctggctaacttgctgaacgaacagcaccaaattgccaaggagctctttgagcaactgaagatgaagaaaccttctgctaagcagcagaaggaggtggagaaggtgaagccccaatgcaaggaagtgcatcagaccctcattcttgacccagcccagcgcaaaagacttcaacagcagatgcagcagcacgtgcagctgttgactcagattcacctcttggcaacctgcaacccaaacttgaatccggaggcttcgtccacacgtatttgtctgaaggagctcggcacttttgcccaaagtagtatcgctctgcaccaccaatataacccaaaatttcagactctgtttcagccttgcaacctgatgggggccatgcagttgattgaggatttttccacccacgtcagcatcgattgttcccctcacaaaaccgttaaaaagaccgccaatgagttcccctgcctgccgaagcaggtggcatggattctggccacctccaaggtgttcatgtatcccgaattgctgccagtgtgttctttaaaggcaaagaatcctcaggacaaaattttgttcaccaaagccgaggataacaaatacctgttgacatgcaagaccgcacggcagttaacggtccgaattaaaaatcttaatatgaatcgagcccctgataatataatcaaattttacaagaaaacaaaacagcttccggtcctaggtaagtgctgcgaggagatacaaccccaccagtggaaacccccgatcgagcgtgaggagcacaggctgcccttctggttaaaggccagccttccttcaattcaagaggaactgcgccacatggccgacggagcacgggaggttggtaacatgacagggacaaccgagatcaatagcgatcagggattggagaaggataactccgagttaggctctgaaacccgttacccactgctgctccctaagggcgtcgtgctgaagttgaagccagtcgcagacagattcccaaaaaaggcctggcgacagaagcgctcctctgttctgaagcccctgttgattcagccctcacctagcctgcagcccagcttcaacccgggaaaaactccggcacagagcacccacagcgaagcacctccatcgaaaatggttctgagaatcccccacccaattcagccagcgacagtcctgcagaccgtccctggcgtgcctcctctgggcgtcagtggcggggaaagcttcgagtcccccgcggcgctcccggccatgcctcctgaggcacgaacaagctttcctttatcggagtctcagacgctgctctcctccgcacctgtgcctaaggtgatgatgccaagccctgctagctccatgtttcggaagccttacgtccggcgccgaccttccaaacgacgaggggcccgcgcattccgctgcattaagcccgccccggtgatacacccagccagcgtcatttttacggtgcccgctacgacagtcaagatcgtgagcctagggggaggctgcaacatgatccagcccgtgaatgccgcagtcgcccaatccccacaaaccattccgatcgccaccctgcttgtgaaccccacctcattcccctgtcccctcaatcagcccttagtggctagctctgtaagccccctcatcgtgtctggaaattctgtcaacctacctattccgagtacgccggaggacaaagcccatatgaatgtcgatattgcctgcgccgtggccgacggggaaaacgcattccagggtctcgagccgaaactagagccccaggaactgagcccactttccgcaacagtgtttcccaaggtagagcacagtcccggcccgcctcctgtggacaagcagtgtcaggagggcctgagcgagaattccgcctacaggtggaccgttgtaaagaccgaggaggggcggcaggccttggagccattgccacagggcatccaggagtctttgaataactcgtcccccggtgatctggaagaggtggtcaaaatggagcccgaggatgcaacagaggaaatatccggattcctttag

SEQ ID NO: 23216 - DNA, 1380 bp, Artificial Sequence
  Description of Artificial Sequence: Synthetic coding sequence
atggccgccagcgccagcgccgccgccggcgaggaggactgggtgctcccttctgaagtagaagtcctggagtccatctatctggatgaactgcaggttataaaagggaatggccgcacttccccatgggagatctatatcacccttcatcccgctactgctgaggatcaggatagccagtatgtttgtttcaccctggtcctacaggtcccagccgagtacccccatgaggtaccgcaaataagtatcagaaacccgaggggcctgagcgatgagcagatccacaccatcctgcaagtcctgggtcacgtagccaaggccggtcttgggactgctatgttatacgaattgattgaaaagggtaaggagatcctgacagacaacaacatcccacatgggcagtgtgtgatttgcttatacggattccaggaaaaggaggcatttactaagacaccctgctatcactacttccactgtcactgtctggcacggtatatccagcacatggagcaggagctcaaggcccaaggccaagagcaggagcaagagcgccagcatgccaccacaaagcagaaggccgtgggagttcaatgtcctgtatgccgtgaaccactagtttacgatctcgctagcctgaaagctgctccagaacctcaacagccaatggagctgtaccaaccatcagccgagtctctccgtcagcaggaggaacgaaaacgcctgtatcaacgacagcaggagcgcggcgggatcatcgatttagaagcagaaaggaacaggtacttcatttcactccaacagcccccggcgccagcagagccagaatcagccgtggatgtgtctaagggcagtcagccgccatcgacgctggctgcagaattaagcacttccccggctgtgcagtcgaccctgccaccgcccctgcctgtggcaacacagcacatttgcgaaaaaatccctggtacccggtctaaccaacagagattgggagagacacagaaggccatgctggatccccctaaaccatcaaggggcccatggaggcaacccgaacgaagacatcccaaaggcggagagtgtcacgctccaaaaggaaccagggatacacaggagctgcccccacccgaaggccccctgaaggaaccaatggacctcaagcctgagccacatagccagggagtcgagggtcctccgcaagagaaaggccctggctcgtggcaaggaccgcctccacgcagaacaagggactgcgtgcgatgggaacgatccaagggcagaacacccggaagctcctatcctagactaccgaggggccagggggcttacaggcctgggacccgccgtgagtctctcggactcgagagcaaagatggcagttag

SEQ ID NO: 23217 - DNA, 2079 bp, Artificial Sequence
  Description of Artificial Sequence: Synthetic coding sequence
atgggcagcgccgccgacgtgcggttcagcctgggcaccaccacccacgcacctcccggggttcatagacggtacagcgctttgagggaagagtcggcaaaggattgggaaacgagccctctgcctggaatgctggcccctgctgcaggtcctgccttcgacagtgatcctgaaatatcagacgtagatgaagatgagccaggggggctggtcggtagcgctgatgtcgtcagtcccagcgggcacagcgatgcccagacgctggcaatgatgcttcaggaacagttagacgctatcaatgaagagattagaatgattcaggaagagaaagagagcactgaattaagagctgaagagatagaaactcgtgttacgtccggaagtatggaggccctcaatctaaagcaactgaggaagagaggctccattcccaccagcctcacagctctttccctggcaagcgcgagcccacccctctctggtcggtcaacccctaagctaactagtcgctccgctgcccaggacttggatcgtatgggggtgatgaccctcccaagcgatctgcgcaagcacagaagaaaattgctgtcccccgtgagcagggaggagaaccgtgaggacaaggccaccatcaaatgtgagaccagccctccttcatctccaaggaccctgagactggaaaagcttggccaccctgccttaagccaggaagagggcaagtccgcactcgaagatcaagggtcaaatccttcctccagcaatagtagccaggactctctgcacaagggcgctaaacgcaagggtatcaaatcctcaatcggacgtttatttggcaagaaagagaaaggccggctgatccagctctctagagacggagcgactggtcatgtgttattaacagacagcgaattctccatgcaagagcctatggtgcccgcaaaactgggaacccaggccgagaaagacaggcgccttaagaaaaagcatcagttgctggaagacgcccgtcgcaaaggcatgccatttgcccaatgggatggacccacagtagtaagttggttggagctatgggtcgggatgcctgcctggtatgtggctgcatgccgagccaacgtgaagagcggcgctattatgtccgctcttagcgataccgaaattcagcgcgagatcggcatatccaacgccctccaccggctgaagttgcggctcgcaattcaggagatggtcagtctgacttctccctccgctccccctacttctcgcacctcatccgggaacgtgtgggtcacccacgaagaaatggagaccctggagacgtccactaaaaccactctggcctacggggatatgaatcacgagtggatagggaatgaatggctcccaagcctcggcttgccgcaatacaggtcttattttatggagtgccttgtggacgctagaatgctcgaccacctgactaagaaagaccttagagtgcacctgaaaatggtagattcctttcataggacctctttacagtatggaattatgtgtctgaagcggcttaattacgatcggaaggaactcgagaaaaggcgggaggagagccagcacgagatcaaggatgtcctggtgtggacgaatgatcaggtggttcactgggtccagtcgattggtcttagagactatgctggaaatttgcacgaatcaggagtccacggggccctgttagccttggacgagaacttcgatcacaataccctggctctgatcttacagataccaacccagaatactcaggcacgccaggtgatggaacgcgagtttaacaatctgctcgcccttggaacagaccggaagttagatgatggcgatgacaaggtatttagaagggcgcctagttggcgcaaacgcttccgaccccgagaacatcatggccgcggcgggatgctttccgcgagtgccgaaacactgccagctgggtttcgagtgtcaactttaggaactttgcagccaccacccgcacctcccaaaaaaattatgcctgaggcgcacagtcactatctgtatggccatatgctgtccgcgttcagagactag

SEQ ID NO: 23218 - DNA, 369 bp, Artificial Sequence
  Description of Artificial Sequence: Synthetic coding sequence
atggccccccagaaggaccggaagcccaagcggagcacctggcggtttaacctcgacctaacacacccagttgaagacggcattttcgactcaggcaacttcgagcagttcttaagagaaaaggtgaaggtgaacggaaaaaccggcaacctagggaatgttgttcacattgaacgcttcaagaacaaaattactgtggtgagcgagaagcagttcagtaaaagatatctgaagtacctgacgaaaaagtaccttaagaagaacaatctgcgcgactggcttagagtcgtggccagcgataaggaaacctatgagctgcggtactttcaaatctcacaggatgaggacgagtctgagagcgaggactag

SEQ ID NO: 23219 - DNA, 936 bp, Artificial Sequence
  Description of Artificial Sequence: Synthetic coding sequence
atgcagtacatcagccacatcttcggcgtgatcaactgcaacggctttacgctgagcgaccagcgcggacttcaggcagtcggagtcgggatcttccccaatttgggtctggtgaatcacgattgctggcccaactgcactgtgatttttaataatgggaagattgagctgcgcgcacttggcaaaatcagcgaaggcgaagagctcacagtgtcttacatcgattttttgaacgtgtctgaggagcggaaacgccagctgaagaagcagtactatttcgactgcacctgtgagcattgtcagaaaaaactgaaagatgacttatttctgggcgtgaaggacaatccaaaaccctcgcaggaggtcgtgaaggagatgatccaattctccaaagacaccctggaaaagatcgataaggctaggtccgagggcctgtaccacgaggtcgtcaagctgtgtcgagaatgcctcgagaagcaggaaccggtatttgcggacaccaacatctatatgctccgaatgctcagcatcgtttctgaagtcctctcatacctgcaggccttcgaggaagcaagcttctatgcccgccggatggtggacggatatatgaagctgtaccatcctaataacgcacagctaggcatggcggtgatgcgggccggactgacaaattggcatgctgggaatatagaggtgggacatggcatgatttgcaaagcttacgccattctgctggtcacccacggtcctagtcatccaatcacaaaggatcttgaagcaatgcgcgtgcagactgagatggaactgcggatgttccgccagaacgagttcatgtactacaaaatgagagaagccgccttaaacaaccagcctatgcaggtcatggcggaacccagcaacgaacctagtcccgccctcttccataaaaagcagtag

SEQ ID NO: 23220 - DNA, 1542 bp, Artificial Sequence
  Description of Artificial Sequence: Synthetic coding sequence
atggccgagctgcagatgctgctggaggaggagatccccggcggccgcagggcattgtttgatagctatactaatctggaacgcgtggcagactattgtgagaacaattacatccagtcagccgataaacagcgcgccctcgaagagacaaaggcgtacacgacccagagcctcgcctccgtggcgtacctaatcaatactctggcgaacaatgtcctccagatgttagacatacaggcctcgcagctgcgacgcatggaaagctccattaatcatattagtcagactgtagatatccacaaggaaaaggtggcgaggagggaaattggtattttgacaactaataaaaacacatcgcgcacacacaaaattatagctccagccaacctggagcgaccagttaggtacatccgtaaaccaattgactacacgattttggacgatatcggccacggcgtgaagtggttgcttcgctttaaagtgtcaactcagaatatgaaaatgggcggactgccaagaaccactccacctactcaaaaaccccccagccctcctatgagcggcaagggaacgctcggcaggcactcaccttatagaaccttggaaccagttcgaccgccagtcgtccctaatgactatgtgccctctcctactagaaacatggccccgtctcaacagagccctgttagaaccgcttctgtgaaccagcggaatcggacgtatagctcgtctggaagcagtgggggtagccatcctagctccaggtcctctagcagggaaaactccggctctggcagtgtgggggtgcccatcgcggtgccaacaccgtccccaccttcagtgttccccgctccggcggggagcgccggtacaccaccactgcccgcaacctctgcctctgctcctgcccccctagtgccagccaccgtgccctcctccacggctcccgatgctgccgcaggaggcgcccagactctcgcggatggatttacatcaccgacaccaccagtggtgagttcaacaccccctaccggacatcctgttcagttctacagcatgaaccgaccagcaagccgccacactccaccaaccattggcggtagcttgccttatcgcaggccgccaagtataacatctcaaacaagcctgcagaaccaaatgaacgggggacccttctattcccagaaccccgtcagtgacaccccaccgccacccccacccgttgaggaacctgtcttcgatgaaagcccaccgcctcctccccctcccgaagactacgaggaagaggaggccgccgtggtcgagtacagcgacccgtacgctgaggaagacccgccttgggctccaagaagctaccttgaaaaagtggtagccatctacgactataccaaggataaggaggacgaactgtcttttcaggagggggcaattatctacgtcattaagaagaatgacgatggatggtacgaaggcgtcatgaatggcgtgacaggcctttttcccggcaattacgtggagtccatcatgcactattcagagtag

SEQ ID NO: 23221 - DNA, 1170 bp, Artificial Sequence
  Description of Artificial Sequence: Synthetic coding sequence
atgcccctggagaacctggaggaggagggcctgcccaagaaccccgatttgcgtatcgctcagcttcgctttctcttatctttgcctgagcatcgtggggatgctgcagtgagagatgagcttatggccgcagtacgcgataacaacatggccccatactatgaggcattatgtaagtctctggattggcagatcgacgtcgatctgcttaataagatgaagaaagctaatgaggatgaattgaagcgcctagatgaggaactggaagacgccgaaaagaatcttggtgagtcagaaattagggatgccatgatggcaaaggccgagtacctctgtcgcatcggagacaaagagggggcccttaccgcctttagaaagacgtatgataaaacggtcgccttaggccaccggttggatattgtgttctacctgcttcggattggtttattttatatggacaacgatctaataacacgcaatactgagaaggcaaagtccttgattgaggaaggtggggactgggatcgcagaaacagacttaaagtctatcagggactctactgcgtggccattagggacttcaagcaggccgctgagctgtttctggataccgtaagtacctttacgtcctatgagctgatggactacaagacgttcgtgacatacactgtgtacgtgtcaatgatcgctttggagcgccccgatctccgcgagaaggtgattaagggggctgaaatcttagaagtgcttcactcgctgcccgccgtaagacagtacctgttttcactgtatgagtgcagatacagcgtcttcttccaatccctcgccgtcgttgagcaggaaatgaagaaggattggctctttgcgccacactatagatactacgtaagggaaatgcgcattcatgcttatagtcagttgctcgagtcttaccggagcttgaccctggggtacatggcagaagcgttcggggtgggggtagagttcattgaccaggaactgagtcgcttcatcgctgctggtcggctccattgcaaaatcgacaaagttaatgaaatcgttgaaactaaccgtcctgactctaagaattggcagtatcaggagacaatcaaaaaaggggatctgttgctgaaccgagtccaaaaactgtcccgggtcatcaatatgtag

SEQ ID NO: 23222 - DNA, 420 bp, Artificial Sequence
  Description of Artificial Sequence: Synthetic coding sequence
atggccaacatcgccgtgcagcggatcaagcgggagttcaaggaggtgcttaaatcagaggaaactagtaagaaccagataaaggtggacttggtggacgagaacttcacggagctcagaggcgagattgcaggaccacccgacaccccctacgaaggcggacggtatcagctggagattaagatccccgagacttatccattcaacccacccaaatataaacagaatcccgagatgtttaaacaaacagcccggttgtgggcccatgtgtacgccggagccccagtgtcctctcccgagtacaccaagaagatcgagaacctctgcgcaatggggtttgacaggaatgcggtgatagttgccctcagctcaaaatcttgggatgtggagacagcaactgagctgctgttgtccaattag

SEQ ID NO: 23223 - DNA, 1203 bp, Artificial Sequence
  Description of Artificial Sequence: Synthetic coding sequence
atgaacttcaccgtgggcttcaagcccctgctgggcgacgcccacagcatggacaacttggagaagcaactcatatgccccatctgtctagagatgttctctaagcctgtcgtaattcttccctgtcagcataacttgtgtagaaaatgtgcaaatgatgtgttccaagcctccaatccattatggcagtcgaggggatccacaacagtgagtagtggagggaggttccggtgcccctcatgtcggcacgaggttgtgctggataggcacggggtttatgggcttcagcggaatctgctcgtagagaatattattgatatatacaagcaggagtctagtagacctcttcatagtaaggccgaacaacaccttatgtgtgaggaacacgaggaagaaaagatcaacatatattgccttagctgtgaagtgcctacctgctctctatgtaaggtcttcggcgcccataaagactgtgaggtggctcccttgcctacgatctataagcgtcagaagaagcaggaccttaccctgctaccaagactggagtgttctgggactaacaccacctattgtagcctcgacctgccgagctctagtgacccccctatcctcgcctcgcaaaataccaaaatcatcgacagtgagttgtctgacggcatagctatgcttgtagccggtaatgaccgcgtgcaggcggtgattacacagatggaggaagtatgccagacaattgaggataacagccgacgccaaaagcaattgctcaatcaacggttcgaaagcttatgtgcagtgctggaggagagaaaaggtgaactattgcaggccctcgctcgagagcaagaagagaagctgcagcgcgtgagggggctgatccgacagtacggcgaccacctggaggcgtcatctaagctggtcgaatccgcaatccagtccatggaagagcctcagatggccctgtacttgcagcaggccaaagaattgattaataaagttggggctatgagcaaggtggaattggccggcagacccgagcccggctacgaaagtatggaacagtttacagtgcgggtcgaacatgtagctgaaatgctcaggacaattgattttcagcccggcgctagcggcgaggaagaagaggtggcaccagacggcgaggaaggttctgctggccctgaagaggagagacctgacggaccttag

SEQ ID NO: 23224 - DNA, 198 bp, Artificial Sequence
  Description of Artificial Sequence: Synthetic coding sequence
atgttcctgagcgccgtgttcttcgccaagagcaagagcaagaacatcctcgttagaatggtgtcggaggcagggacaggcttttgcttcaatacaaaaagaaaccgccttcgcgagaagctcaccctgctacactacgatccggtcgtgaagcagagagtgctctttgtggaaaagaagaagattcgcagtctttag

SEQ ID NO: 23225 - DNA, 2919 bp, Artificial Sequence
  Description of Artificial Sequence: Synthetic coding sequence
atgcggcccgagggcgccggcatggagctgggcggcggcgaggagcgtctaccagaggaaagcagacgtgagcactggcagttgttaggcaacctgaagacaacagttgaaggactcgtcagcaccaatagcccaaatgtgtggtccaagtatggggggctcgaaagactgtgccgtgatatgcagagcattctctatcacggtttgattcgggatcaggcctgcagaagacaaactgactattggcagttcgttaaagacatccggtggctttcccctcacagcgcactgcacgtcgaaaagttcatctccgtccacgaaaacgaccagagttcagcggatggagcttctgagcgggccgtggccgagctgtggctgcagcattctctgcaataccattgcctgagtgctcagctgagacctcttctcggtgatagacagtatattcggaagttctataccgatgctgcttttcttctgtctgacgcgcacgtgaccgcaatgctacagtgcttagaggccgttgaacagaataatccacgcctgttggcgcagatagacgctagcatgtttgccaggaaacacgagtctccgctgctggtgacaaagtcccagtccctaacggccctgccgtcgagtacctacactcctcctaatagctacgctcaacactcctactttggcagtttctcctcgctccaccagtcagtgccaaacaacggttccgagcggcgctccacaagcttcccgctgagcggccctcccagaaaacctcaggagtcccggggccacgtatctcccgcggaagaccaaaccattcaggcgcctccggtgtcggtgagcgcactcgctcgcgactcccccctgacgcctaatgagatgagttcgtctaccctaaccagcccgatcgaagccagctgggtttccagccagaacgactccccgggcgatgcatcagagggtcctgagtatctggccattggcaaccttgatcctcggggcagaacagcctcatgccagagccactcctccaatgctgaatcttccagctccaatctcttctccagttcgtcttctcaaaaaccagatagcgccgcctcaagtctgggagatcaggagggtggcggggaatcacagctctcttctgtgctgaggagaagctcgttttcggaggggcagacccttacagtgacatctggagcgaagaagtcacacatcagatctcattccgatacgtcaatcgctagcagaggagcaccagaaagctgcaacgacaaggcaaagctaagaggacccctgccttattccgggcagtcatcggaggtatccacaccctcaagcttgtacatggaatatgagggtggtagatacttatgcagtggagagggcatgttccgcagaccgagtgaaggccagtccttgattagctatctttcggagcaggatttcggctcatgcgcggacttagagaaagaaaacgctcacttctccatctccgagtctttaatcgcagccatcgagctgatgaaatgtaacatgatgagtcaatgtctggaagaggaggaggtggaggaggaggactctgatcgggagatccaggagcttaaacagaagattcgtttgaggcgccagcagattcggacgaagaatctgttacctatgtatcaggaagctgagcacgggtcctttagggtgacttcttctagctcccaattttcctcccgagacagtgcgcagctgtcagattctgggagcgcagatgaagtcgacgagtttgaaattcaggatgccgacataagacggaacacagcctctagttcgaagagttttgtatcatctcagagcttttcccactgctttctccatagcaccagcgctgaagctgtggctatggggctgcttaaacagttcgaaggcatgcagctgcccgcagcgagcgaactcgagtggcttgtccctgaacatgatgccccacaaaagctgttacctatccccgattctctgcctataagtcccgacgacggccagcacgcagacatctacaaactccgcatccgcgtgcggggcaaccttgagtgggccccccccaggccacagataatctttaatgtccaccccgcacctacccggaagattgccgttgcgaagcaaaattatcggtgtgccggctgtggaattcgaactgaccccgattatatcaaaaggctaagatactgcgaatacctcggaaagtacttctgccaatgttgccatgaaaacgctcagatggccattcccagccgcgtgctgcgcaagtgggacttctcaaagtattacgtttccaatttttctaaagatctgttaataaagatctggaatgatccactgttcaacgtgcaggatatcaattcggccctgtaccggaaggtcaagctactgaaccaggtgcggctgttgagagtccagctgtgtcacatgaaaaacatgttcaagacttgcaggctcgccaaggagttactcgacagttttgatactgttcccggccacctgacggaggacttacatctttattccctgaacgacctgactgccactagaaaaggagagttaggcccccggctggctgaactgactcgcgcaggcgccactcacgtggagcggtgtatgctctgccaggccaaaggattcatttgtgagttctgccagaacgaggacgatatcattttccctttcgaattacacaaatgtcggacttgcgaggaatgcaaggcgtgctaccacaaggcttgttttaagagcggctcttgcccccggtgtgagagattgcaagccaggcgggaggctttggcgcggcagagtctggaatcctatcttagcgactacgaagaagagcccgctgaggccctggcacttgaggcggcagtgctcgaagccacttag

SEQ ID NO: 23226 - DNA, 1161 bp, Artificial Sequence
  Description of Artificial Sequence: Synthetic coding sequence
atggccgccgtggagacccgggtgtgcgagaccgacggctgcagctccgaggccaagttgcaatgcccaacatgcatcaaacttggcattcaagggagctacttttgtagccaagaatgttttaaaggttcctgggccactcataagctgctgcacaaaaaagccaaggatgagaaagcaaaaagggaggtatcatcctggactgtcgagggcgacatcaataccgacccctgggccggttatcgttatacaggtaaactcaggccgcactatccactgatgccaacgaggcctgtgccgagctacatccagcggccggattacgcagatcatccattggggatgtccgaaagtgagcaggcactgaagggcacctcccaaatcaaactgctatccagtgaagacattgagggtatgcggctcgtctgtcgccttgctagagaggttctggacgtggctgcaggaatgataaaaccaggtgtgacaaccgaggaaatcgaccacgccgtacacctagcctgtattgcgcggaattgctatccctcgcccttgaattattacaacttcccgaagtcctgctgtactagcgtgaatgaagttatttgtcacgggatcccggaccgccgaccactgcaagaaggagacatagtgaatgtagacataacattatacaggaacggatatcacggcgacctgaacgagactttttttgtgggtgaggtcgatgacggggctagaaaactggtgcagacgacatatgaatgcctgatgcaggcaatagatgcagtcaagcctggagtgcggtaccgggaactgggtaacattattcaaaagcacgcccaggctaatggcttcagcgttgtgaggtcttactgtggtcatggcatacataagctgttccacacagcacccaacgtgccacactacgctaaaaacaaagccgtgggggtcatgaaaagcggacacgtgtttactattgaacccatgatctgtgaagggggctggcaggacgaaacatggcccgacggatggacagcagtgactcgcgacggaaagagaagcgcccaattcgagcatacacttcttgttacagatacagggtgcgagatactcactcgtcgcctcgattccgccagaccccactttatgtcccagttctag

SEQ ID NO: 23227 - DNA, 738 bp, Artificial Sequence
  Description of Artificial Sequence: Synthetic coding sequence
atgggccggctggacggcaaggtgatcatcctgaccgccgccgcccagggaatcggccaggctgcagcactggccttcgcccgcgaaggcgccaaggtgattgccaccgacattaacgagagcaagctccaggagttggagaagtatcctggcatccagacacgggttttggacgtgacgaagaagaaacagatcgatcaatttgctaatgaagtcgaacgactggatgtgctcttcaatgtggctggcttcgtgcatcatggaacggttctggactgcgaggagaaggattgggacttttctatgaacctgaacgtcagatccatgtatctcatgatcaaagcatttctccccaagatgctggcccagaaatccggtaatatcataaacatgagttcagtagcatcctctgtcaaaggagttgtgaaccgctgtgtgtattccacaactaaagctgccgtgatcgggctcactaagtccgtggctgcggattttatccagcagggcataaggtgtaactgcgtatgtcccggcaccgtggatactccctccttgcaagagagaatccaagctaggggtaacccggaggaagcaaggaacgacttcctgaagagacagaagacgggcagattcgctacagctgaggaaattgctatgttatgcgtctacctggcatccgacgaatctgcttacgtgaccggcaaccctgtgatcattgacggaggatggagtctgtag

SEQ ID NO: 23228 - DNA, 2520 bp, Artificial Sequence
  Description of Artificial Sequence: Synthetic coding sequence
atgagcgtggtgggcatcgacctgggcttcctgaactgctacatcgccgtggctagaagcggcgggatcgagacgattgccaacgaatactccgaccggtgcacacctgcctgtattagtctggggtccaggactagagcaattggtaacgcggcaaaaagtcaaatcgtcaccaacgtaagaaataccatccatgggtttaaaaaactgcacggccgaagctttgatgacccaatcgtccaaacagaacgaatccgcttgccctacgaactgcagaagatgcccaatggatcggcaggagtcaaagtgagatacctggaggaggaaaggccatttgccattgaacaggtaaccggtatgctgctggcaaagctgaaagagactagcgagaatgccctgaaaaagcccgtcgcggactgtgtgataagcattccctccttctttactgatgctgagcgacgttcagtgatggcagccgcccaggttgcaggtctgaattgcctgcgcctgatgaatgaaactacagccgtcgctttggcatatggcatttataaacaggatctgccaccccttgacgaaaaacccagaaatgtcgtgttcattgacatgggtcactcagcttatcaggtcctggtctgtgccttcaataagggtaaactcaaagtactggccactacattcgacccctacctgggcggccggaacttcgatgaggctctcgttgattacttctgcgatgaatttaagacgaaatataagattaacgtgaaggaaaacagtcgggccctgttgcgactgtatcaggagtgtgaaaagctgaagaaactgatgagtgctaacgcgagtgaccttcccctcaatattgaatgtttcatgaacgacctggacgtttcgtcaaagatgaatagagcccaatttgagcagctctgcgcttcgctcctcgcgcgcgtggagccaccactgaaggccgttatggagcaggctaatctccagcgggaagacatttcttctatcgagatcgtcggaggcgccactaggatccctgcagtgaaagaacagataacaaaattcttcttgaaagacatctccacaacgctcaatgctgacgaggccgtggcccgcggttgcgctctgcagtgtgccattctgtcacctgcgtttaaagtgcgagagttcagtatcactgatctcgtgccttactccataacgctgcgctggaagacaagttttgaagatggcagtggagaatgtgaagttttctgtaaaaatcaccccgctccgttttcgaaagtgattacctttcacaagaaggaaccgttcgagttggaagccttctacacaaacctccatgaagtgccctaccctgatgcccggatcggaagcttcactattcaaaatgtgtttccgcagagtgacggcgattcctctaaagtgaaagtgaaggtgagggtaaacatacatggaatcttctcagtcgcctcggcttctgttatagagaaacaaaatctggagggagaccactccgatgcccctatggagacagagacttcttttaagaatgagaacaaagacaatatggacaaaatgcaggtggaccaggaagaagggcatcaaaagtgccatgctgagcatacccctgaggaagaaattgatcacactggagccaaaacaaagagtgccgtatccgacaagcaggaccgactaaatcagaccttgaaaaaaggcaaggtgaagtctatagatctgccaattcagagctccctctgtaggcaactgggacaggacctactgaactcttacatcgagaacgaaggaaagatgatcatgcaggataaattagaaaaggaaagaaacgacgcaaaaaatgcagtggaggaatacgtctacgatttccgggatcgcctgggtaccgtgtacgaaaagtttattactcccgaggacctgtccaagctatctgctgtgctcgaagacactgaaaattggctgtatgaggacggggaggaccagccgaaacaagtttatgttgataaactgcaagagctgaagaagtacggccagcccatccagatgaagtatatggagcacgaagaacggcccaaggctctaaatgatctgggaaaaaagatccagctggtcatgaaggtgatagaggcatatcgaaacaaggacgagcgatacgaccacctcgatcccactgagatggaaaaggttgaaaagtgtatctccgacgcaatgtcatggttaaatagcaaaatgaatgcccagaataaactgtctctaactcaagatccagtggtcaaggtatccgagatcgttgccaagtcgaaagaactagataacttctgtaaccccattatttataagcccaagcctaaagctgaagttccggaagataagccaaaagccaacagcgagcacaatggaccgatggacggccagtccggaacggagacaaagtcagattcaaccaaagactcctcccagcatactaagtcaagcggggagatggaagtggactag

SEQ ID NO: 23229 - DNA, 1224 bp, Artificial Sequence
  Description of Artificial Sequence: Synthetic coding sequence
atggccgccccctgcgccgaggaccccagcctggagcggcacttcaagggtcacagggacgcggttacttgtgttgacttctcaataaataccaagcagctagcgagcggatcgatggatagctgtctcatggtttggcacatgaagcctcagtcgcgagcctacagattcaccggtcataaagacgccgtgacatgcgtgaatttctcccccagcggccatttactggctagtggtagtagagataaaaccgtccgaatatgggtccccaatgttaagggcgaatccaccgtattcagagctcacacagctaccgtgagatctgtacacttctgtagtgacggccagtcgtttgttaccgcttcagacgataagaccgtgaaggtatgggccacacatcgccaaaagtttctcttttctctcagtcagcacattaattgggtcagatgtgccaagttttctcctgacggaagattgatcgtttcagcctccgacgacaaaacagttaaactttgggacaaatctagccgcgaatgtgtgcattcctattgcgaacatggggggttcgtgacctacgtcgacttccatccatctggcacctgtatagctgccgccggaatggataataccgttaaggtttgggacgtccgtacacaccggttgttacagcactaccaactgcacagcgcggccgtaaacggattgtcttttcacccttccggcaactaccttatcactgcatcaagcgattccactctcaagatcctggatctcatggagggccggctgctctatacattgcatggacatcagggccccgctacaactgtggccttttctaggactggcgagtactttgcgtccggggggagcgacgaacaggttatggtatggaaaagtaattttgacattgtggaccatggcgaggtaactaaagttcctcgacctcctgccacacttgcatcatctatgggaaatctcccagaggtggattttcccgttcccccaggtcgcggccggagcgtcgaaagcgtgcagagccagccacaggagccagtctccgtgcctcaaaccctgacgagtactctggaacatatcgtcggccaactggatgtcctgacccaaacagtgagtattttagagcaacgcctcacgcttactgaggataagctgaagcagtgcttagaaaatcagcagctgataatgcaacgtgccactccgtag

SEQ ID NO: 23230 - DNA, 1173 bp, Artificial Sequence
  Description of Artificial Sequence: Synthetic coding sequence
atggccaccggcgacctgaagcggagcctgcggaacctggagcaggtacttagactgcttaactatccagaggaggtggattgcgtgggcctcataaaaggcgaccctgccgcgtccctgcctattatatcttattcttttacatcctactctccctatgtgactgagctcataatggagtccaacgtggagctcatcgccaagaacgatctgcgctttattgatgcagtgtacaaactcctgagggatcaatttaattacaaaccaattctaacaaagaaacagtttatccaatgcggcttcgccgaatggaagatccaaattgtgtgtgatattctgaactgtgtgatgaagaaacacaaggaactgtcctctctacagaagattccctcacagcagaggaaaaaaatttcctcaggaaaatccgagccaccactcggcaacgaaaagatctcagctgaggccgttggggttgacatcagcggacgctttatgacctctggtaagaagaaggctgtagtcatcagacatctgtacaacgaggataacgtcgatatctcagaggacacgctgagtcctattactgacgtcaatgaggccgtcgatgtgtcagatctcaacgccacagaaattaagatgcctgaggtgaaggtcccagagataaaagccgaacagcaggacgtcaacgttaaccccgagattactgctctacaaacaatgctggccgaatgccaagaaaacctgaaaaagctaacttccatcgagaagcgtttggattgcctcgaacagaaaatgaagggtaaagtgatggtcgacgagaatacttggacgaatctgctgtcaagagtgacactcttagagaccgagatgttactctcaaagaaaaatgacgaatttattgagttcaacgaagtatctgaagattatgcttcatgcagtgacatggacctgttgaatccacatcgtaagagcgaggtcgagaggcccgcatcaattcctttatcctcagggtattcgactgcatctagcgacagcacgcctagagcctccaccgtcaactactgtggtctgaatgaaataagcgaagagacaaccatccagaagatggaacggatgaagaagatgtttgaagaaacagctgaacttctcaaatgcccgaatcattacctctag

SEQ ID NO: 23231 - DNA, 2601 bp, Artificial Sequence
  Description of Artificial Sequence: Synthetic coding sequence
atgcccgccgtgagcctgccccccaaggagaacgccctgttcaagcggatccttaggtgttacgagcataagcagtatcgtaatgggttgaagttctgtaaacagatcctaagcaatcctaaattcgctgagcatggagaaacactggccatgaagggactgacattaaattgtctgggcaaaaaggaagaggcatacgagttggtgcgaagaggactccggaacgatctgaaatcacatgtgtgttggcacgtgtacggcttgctgcagcgttctgataagaaatacgatgaggccatcaagtgctaccgaaacgctctgaagtgggataaagataaccttcagattttgagagacctctctctgctccaaatacagatgcgggatctggaaggctatcgcgaaacccgctatcaactgctccagctgcggcctgcgcagcgggcctcttggattggatacgccatcgcctaccatctcctggaagactacgagatggccgccaagatcctagaggaatttcggaaaacacaacaaacatcccccgataaggtggactacgagtactcagaactgctgctctaccagaaccaggtgcttcgcgaagcgggcctgtatcgggaagctcttgaacatctatgtacctatgaaaaacagatatgtgacaagctggcagtggaggagaccaagggggagttactgctacaattgtgtcggttagaggatgctgccgatgtttacagaggcttacaggaacgcaatccagagaactgggcgtattataaaggactggagaaagccctcaagcctgcgaacatgttggagagacttaaaatctatgaagaggcttggacgaaatatccccgaggcctggtaccccggcgactccctctgaacttcctgagcggcgaaaaattcaaggagtgcctagacaagtttctccgaatgaatttctcaaaaggctgccccccggtgtttaacaccttgcggagtctgtacaaggataaagaaaaggttgccatcatcgaggagctggttgtgggttatgaaacgagccttaaaagctgcagactgttcaatcctaacgacgatgggaaggaagagcctccaacgacactgctttgggtccagtattacctagcccagcactatgataagatcggtcaacccagcattgcactggaatatatcaatacggctattgagtcgacccccactctcatcgagctgtttctagtgaaagctaagatctacaagcatgcgggaaatatcaaagaagcagctcgctggatggacgaggctcaagccttagacactgctgatcggtttataaattctaagtgcgccaaatatatgcttaaggccaacctcatcaaggaggccgaagagatgtgctctaaatttacccgtgagggaacatccgccgtggagaatctgaatgagatgcagtgcatgtggtttcagactgagtgcgcacaggcttataaggcaatgaacaaatttggagaggccctgaagaagtgtcacgagatcgaaagacacttcattgagatcacggatgaccagttcgattttcacacgtattgcatgagaaagattacactcaggagctatgtagaccttcttaagctggaagatgtcctacgccagcatccattttacttcaaagccgcccggatcgcgatcgaaatatacttgaagcttcatgacaatcctctgactgacgaaaataaagagcacgaggccgataccgccaatatgtccgacaaagagctgaagaaactccgcaataaacagcgtcgtgcccagaagaaggcccagatcgaagaggagaaaaagaatgccgagaaggaaaaacaacagcgtaatcagaagaaaaaaaaagatgatgacgatgaggagatcggtggacctaaagaggagttgattcccgagaagttagccaaagtggagacccctcttgaagaggcaatcaaatttctgacacccttgaaaaatctggtaaagaataagatcgagacccacttatttgcctttgagatctatttccgaaaggagaagtttctcctcatgctgcagtctgtgaagagagcgttcgctattgatagctctcacccatggctccacgaatgcatgatccgacttttcaacacggccgtgtgcgagtccaaagatctaagcgataccgtacgtaccgtcttgaaacaggagatgaaccgcttattcggagcaactaatcccaagaatttcaacgaaaccttcctgaagcgcaacagcgactctttgcctcaccgcctatcagcagcaaagatggtttactaccttgatccttcttcccagaaacgcgccattgaactggcgaccacactggatgagtcactgactaaccgcaatctccagacctgtatggaagtcctggaggccttatacgatggctctttgggagactgcaaggaggctgctgaaatctaccgggctaactgtcacaaactgttcccctatgccctggcgttcatgccccccggctatgaggaggacatgaaaatcactgttaatggcgactctagcgcggaagctgaggagttagcaaatgagatctag

SEQ ID NO: 23232 - DNA, 1293 bp, Artificial Sequence
  Description of Artificial Sequence: Synthetic coding sequence
atggccagcagcgccaagagcgccgagatgcccaccatcagcaagacggtcaatcctacccctgatccccaccaggaatacctcgatccgcgtatcaccatcgccctgttcgagatcgggtcccacagcccgtcaagttggggtagcttgccatttctaaagaactcctctcatcaggtgacggagcagcagacagcacaaaagtttaacaatctactgaaggaaatcaaagatatattgaaaaatatggctggctttgaggaaaaaatcacagaagcaaaggaactgtttgaagaaactaacatcacagaggatgtgtcagcgcataaggagaacatccgcggcctggataaaattaatgagatgttatccacaaatttgcctgtatctcttgctcccgaaaaggaggataatgagaagaagcaggagatgattttagagacgaatatcaccgaggacgtgtccgctcacaaggagaacatcaggggtctagataagattaacgagatgctgagcactaatttaccagtgtctttggcacccgagaaagaggacaacgaaaagaagcagcagatgatcatggagaatcaaaatagcgaaaatacagcccaagtgtttgccagggatttggtgaacagactggaagagaaaaaggtcctcaatgagacccagcagtcccaggagaaagcgaaaaaccggctgaatgtgcaggaggaaacgatgaagatcaggaataacatggagcaactcctgcaagaagctgagcactggagcaagcaacataccgagctcagcaaactaattaagagctaccagaagtctcaaaaagatatatccgagacgctaggaaataatggagtaggttttcagacgcaacctaataacgaagtgtccgcgaaacacgaactggaggagcaggttaagaaactctctcatgatacctacagcctgcaactcatggcggcactgttggaaaacgagtgtcaaatattgcaacagcgcgtggaaattctgaaggagctgcaccaccagaaacaaggaactctgcaggaaaagcccatacagatcaactacaaacaggacaagaagaatcagaagcccagtgaagcaaagaaggttgagatgtataaacagaacaagcaggcgatgaaaggcacattctggaaaaaagatcgtagttgtagatccctggatgtttgcctgaacaaaaaagcgtgtaacacacagttcaatattcatgtggcacgcaaggctcttcgcgggaagatgcgcagcgcttcatcccttagatag

SEQ ID NO: 23233 - DNA, 5199 bp, Artificial Sequence
  Description of Artificial Sequence: Synthetic coding sequence
atggccgccatcggccggggccggagcctgaagaacctgcgggtgaggggtagaaatgactccggtgaggaaaatgttcctctggatctgacccgtgaacccagcgacaacctgagggaaatcctgcagaacgtagcccgactccagggtgtgagcaatatgcgcaaactcgggcacttgaacaatttcaccaagctgctgtgtgacatcgggcacagtgaagagaaacttgggtttcattatgaagacataattatttgcctgcgccttgctctcctcaatgaagccaaggaagtgcgggccgcaggactacgggccctgcggtatcttatccaggattctagcatcctgcaaaaagtgctgaagctgaaagtggactatctgatcgcccggtgcattgacattcagcaatccaacgaggttgaaaggactcaagcgctgcgcctcgtaagaaagatgattactgttaacgcctcacttttcccttcctcagtgacgaattccctaatcgccgtgggcaatgacggcctccaggaacgcgaccgcatggtcagggcttgtatcgccatcatttgcgagttagcactccagaatcctgaggtagtggcattaagggggggcctcaataccatccttaagaatgtcatcgattgccagctgagtaggattaacgaagccctaataactacaatcctccatctgctcaaccacccaaagactcggcaatatgtgagagccgatgtggaactcgagagaatcctggctccctacacagactttcactaccggcacagtccagacacggctgaaggacagttgaaggaggatcgcgaggctcgtttcctggcctcaaagatgggaatcattgctacattccgatcttgggcgggcatcattaatctttgtaaacccggcaacagcggcatacaaagcctgatcggcgttctttgcataccaaacatggaaattcgtagaggccttttagaggtcttgtatgacatcttcagactgcccttgcccgtcgttacagaggaattcattgaagcactgctgtctgtagatccaggcagatttcaagattcatggcgcctgtctgacggattcgttgctgcggaagcaaagacaattctgccccatcgcgcccgctctcgacctgatcttatggataactacctggcactaatcctttcagccttcatccgtaatggtctgctcgaggggctggttgaagtgatcacaaatagtgatgatcacataagcgtccgagcaacgatccttctgggtgaacttctacatatggctaacacaatcttgccgcactcccattcccaccacctccattgcctgccaacacttatgaatatggctgccagctttgacataccaaaagagaagcgtcttagggcatctgccgctcttaattgcctcaaacgattccacgaaatgaaaaagcgcggcccgaaaccttacagcctccatttggatcacataatacagaaggccatagctacacaccaaaaaagagatcagtatttgcgggtgcagaaagacatcttcatcctgaaggacactgaagaggcccttctgatcaatctccgggacagccaggtgctgcagcacaaagagaatcttgaatggaactggaatctcatcgggactatcctgaaatggcctaacgtgaacctgaggaactacaaggacgaacaactgcatcgctttgtgcgccgcctgctgtatttttacaagccaagctcgaaactgtatgcaaacctggatttggactttgctaaggcaaagcaactcactgtcgtaggttgtcagttcacagagttcctgctcgaatctgaggaggatggacagggttaccttgaggacttggtgaaagacatcgtccagtggctgaacgccagtagcgggatgaagcccgaacggtcattacagaacaacgggcttttgaccactttaagtcagcattacttcctcttcatcgggactctcagctgccatccccatggggtgaaaatgctggagaagtgttcagtttttcagtgtctcctgaatctatgtagcttgaagaatcaggatcacctgctgaagctgacggtcagcagcctagactactcaagggacggcctggcgcgtgtgatactgtcgaaaattttgacagccgccacggatgcatgcaggctgtacgctacaaaacacctacgagtactattgagggccaatgtggagttcttcaacaactggggtatcgaactcctggtaactcagttgcatgacaagaataaaaccatctcctccgaagcactggatatactggacgaggcctgtgaggacaaagctaaccttcatgcactcattcagatgaagcccgctctatcccatctgggtgacaagggattgcttctgctgctgagatttttgtccattcccaaaggcttcagctatctaaatgagcggggatacgtggcgaagcagctggagaagtggcatcgggaatataactctaagtacgtggacctgattgaagaacagcttaacgaagccttgactacttaccggaagcccgtggatggagataactatgtccggcgtagtaaccagcgtctgcagcgtccacatgtttacctgccgatacatctgtacggtcaactggtacatcacaaaacaggctgtcatctgctcgaggtacagaacatcataacagaactctgccggaatgtcaggaccccagatctcgacaaatgggaggagatcaaaaaactcaaagcatctctatgggccttaggaaatataggttcttctaactggggcctcaatttattgcaagaggagaacgtgattcccgacattttaaaattggccaaacagtgtgaggtcctgtccataaggggaacgtgcgtgtacgtgctcggtctgattgccaaaactaagcagggctgcgacattctgaagtgtcacaactgggatgccgtgcggcacagccggaagcatctatggccagtggtccccgatgatgtggagcagctctgtaacgagctctcctctataccctccacgctcagccttaatagtgagtccacgtcctctcgccacaattccgaaagcgaaagtgtgcctagttccatgtttattctggaagatgacagattcggcagcagctcaacatcaacattctttctggatatcaacgaagacactgagcccacattctacgatcggagcgggccaattaaggataagaatagctttcccttcttcgccagctccaaactggtgaaaaacagaatattgaattccctcacactcccgaacaagaagcacagatctagtagcgatcctaaaggagggaagctgtcgagtgaaagcaagacctctaataggagaatccgtactttaacagagccatcggtggacttcaaccactccgacgactttactcccatctctaccgttcagaagacactgcaacttgaaaccagtttcatgggcaacaaacatattgaggacactggatcgaccccctctataggcgagaacgacctgaaattcactaaaaacttcggaaccgaaaaccaccgtgagaatacttctcgcgaacgtttagtggttgagtcttcaacctcgagtcatatgaaaattcgatcccaatcattcaatactgacaccactacctcgggaatctcaagcatgtctagcagcccctctcgagagaccgtgggagtggatgcgaccaccatggacaccgactgcggatccatgagcaccgtcgtttctacaaagacaataaaaacctctcactatctgactccccagtccaaccacctgtccctgtcaaagtctaacagtgtgtccctggttccgccaggcagctcccacaccttaccgcgtcgtgcacagagcctgaaggctccttccatagccacaatcaagtccctagctgactgtaacttcagctacacctcctccagggacgctttcgggtacgccaccctaaaaagactgcagcagcagagaatgcacccttcactcagccactccgaagcattggctagccccgccaaagatgtgctctttaccgatactattactatgaaggcaaattcttttgagagccgcctcactccatctcgaatcgattttaagaaaaaacacgttggaggtatccgcagcctgcggccaactatcaccaacaatttatttcgttttatgaaggccctcagctacgccagtttggataaggaggatttattatcccccattaatcaaaacaccctgcagagatcttcctccgtccgttctatggttagcagcgcaacttacggaggatctgatgactacattggtttggctctgccagtcgatattaatgacatcttccaagttaaagacatcccatattttcagaccaaaaacatacccccgcacgatgatcgtggtgcgcgagccttcgcgcacgatgccgggggtttaccaagcggcacagggggactggttaagaacagctttcatttactgcggcaacagatgagtttgacagagattatgaattcaattcactcagacgcgagccttttcctcgagtccacagaagacaccggcttgcaggagcataccgatgacaactgtctttattgcgtgtgtatcgagatcctcggctttcagcctagcaatcagctgtcagctatttgtagtcactccgactttcaggacattccttactccgattggtgcgagcaaaccatccacaatcccctagaggtcgtaccatcaaagttttcgggtatatccggatgttctgacggcgtgtcccaggagggaagcgcctcctctactaaatcaacagagcttctacttggagtgaaaaccatcccagatgacactcctatgtgtcggatcttactgcgaaaggaggttctgcgcctagtgatcaatctcagcagttcagtttctacgaaatgtcatgagaccggcctgttaacgattaaggagaagtatccgcagacatttgatgatatttgcctgtattctgaagtttcgcatctgctatcccattgtacttttaggctgccatgccgacggttcattcaggagcttttccaggatgtgcagttcttacaaatgcatgaagaggctgaagccgttcttgcgaccccacccaaacagccaatcgtggatacctcagccgaatcttag

SEQ ID NO: 23234 - DNA, 1761 bp, Artificial Sequence
  Description of Artificial Sequence: Synthetic coding sequence
atgagcgccaccgtggtggacgccgtgaacgccgcccccctgagcggctccaaagagatgtctctggaggaacctaaaaagatgactcgcgaagattggcgcaaaaaaaaggagctggaggagcagagaaaactgggcaacgctccggccgaggtagatgaagagggcaaggatattaacccccatatacctcaatacatcagctcagtgccctggtacatagatcctagcaaacggcctaccctcaaacatcagagaccccagccagagaagcagaaacagttttcctcttcaggggagtggtacaagaggggtgttaaagagaatagcatcatcaccaaatacaggaagggtgcttgtgagaattgcggcgccatgacccacaaaaagaaggactgttttgagcgccctcggcgtgtgggagcgaaatttacaggaaccaatattgcaccagacgagcacgtgcagccccagctgatgtttgactacgatggcaaaagagacaggtggaatggctacaatcctgaagagcatatgaaaatagtggaagagtatgctaaggtagacctcgctaaacgaactctaaaagcccaaaaactacaggaagagctcgctagtggtaagcttgtggagcaagcgaactctccaaagcaccagtggggcgaagaagagccgaacagtcaaatggaaaaagatcacaacagtgaagatgaagacgaggacaagtacgctgatgacatcgacatgccgggtcaaaatttcgactccaagcggcgcataacagtcaggaatctgcgcattagggaggatatcgctaaatacctgcggaatctagacccgaattcagcatattatgatccaaagacccgcgcaatgagggagaatccctacgccaacgctggcaaaaacccagatgaagtttcttacgcaggcgacaacttcgtaaggtacactggggacaccatttcaatggctcagactcagttgtttgcatgggaggcatatgataagggctctgaggtccatcttcaggccgacccaaccaagctggaacttctatataagagttttaaggtcaagaaggaggattttaaggagcagcaaaaagaaagcatcttggagaagtatggcggtcaggaacacctagacgccccccccgcggaactactgctagcccagacagaagattatgtcgaatattcaagacacggaactgtaattaaggggcaggagcgtgccgtggcctgttctaagtacgaggaggatgtcaagatccacaatcacacacacatctggggctcttactggaaggaaggcagatggggatataagtgttgccacagcttttttaagtattcctactgcacgggggaggccgggaaagagatcgtaaatagcgaggagtgtattattaatgaaatcacaggggaagagtcagtgaagaagccgcaaactctgatggagcttcaccaggagaagctcaaggaggagaaaaaaaaaaaaaaaaaaaagaagaaaaaacaccgaaaatcaagtagcgactcagacgatgaggaaaagaagcacgagaaactcaaaaaagcactgaatgccgaggaagcccggttgctgcatgtgaaagaaactatgcagatcgatgaacggaagcgaccctacaactccatgtacgaaaccagagagccaacggaagaggagatggaagcttaccgcatgaaacggcagaggccagacgacccaatggcatctttcctgggacagtag

SEQ ID NO: 23235 - DNA, 1185 bp, Artificial Sequence
  Description of Artificial Sequence: Synthetic coding sequence
atggccctggaggtgggcgacatggaggacggccagctgagcgactccgactccgacatgacagttgccccttccgatcgacccttacagcttcccaaggtgctgggtggcgatagtgcaatgcgggccttccaaaatactgccacggcctgtgcacccgtcagtcactaccgagctgtcgaaagtgtggactcatcagaagagagctttagtgactcagacgacgatagttgtctgtggaagagaaaacggcagaagtgtttcaacccgcctccaaagcccgagccctttcagttcgggcagtcctcgcagaaacctcctgtggccggtggcaaaaagatcaacaacatctggggggcagtattgcaggaacagaatcaagatgctgtcgccactgaacttggcatactggggatggaggggacaatagacagatctcgtcagtccgaaacctacaattatctgctggccaaaaagctgagaaaggagtcacaggaacacaccaaggatctcgacaaggagcttgacgaatatatgcacggcggaaagaagatgggctcaaaggaagaggagaacggccaaggacatctgaagaggaaaaggcctgtcaaggatagacttggaaatcggcctgaaatgaattacaagggacgctacgagataaccgcggaggactctcaggaaaaagtggcagacgaaatctctttccggctccaagaaccaaaaaaagacctcattgccagggttgtgcggatcatcgggaacaagaaagctatagaactgcttatggagaccgctgaagtggagcaaaacggcggcctcttcatcatgaatggaagcagaaggaggacccccggcggggtatttctgaatctgctcaagaatacaccaagcatctctgaggagcagattaaggacatcttttacatcgagaatcagaaggagtatgaaaataaaaaggcagcaaggaaacgacggacacaagttctgggcaagaagatgaagcaggcaatcaaatcactgaacttccaggaagacgacgacacatcgagggagacattcgcctccgacacgaatgaagccctcgcctctttagacgaaagtcaggaggggcatgcagaggctaagctcgaagccgaagaagctattgaagtggatcatagccacgatcttgacattttctag

SEQ ID NO: 23236 - DNA, 789 bp, Artificial Sequence
  Description of Artificial Sequence: Synthetic coding sequence
atgttcctgttcagccggaagacccggacccccatcagcacctacagcgacagttaccgagcaccgaccagcattaaagaagtgtacaaggaccccccgctctgcgcgtgggaggcaaataagtttcttaccccgggacttacccacactatggaaaggcacgtggatcccgaagctcttcagaagatggccaagtgcgctgtccaggactacacttatcgaggctcaatttctggccatccctacctgcccgaaaagtactggttaagtcaggaggaggcagataaatgtagccctaattatttaggctctgactggtataacacttggagaatggagccttacaatagcagttgctgtaataaatacactacctacctgccccgactgccaaaggaagctcgcatggagaccgccgtcaggggcatgccactggaatgcccccccaggccggagagactgaacgcttatgaacgtgaggtaatggtaaacatgctgaacagtctaagcagaaatcaacagctcccccgaattacaccccgatgcggctgtgtggacccactaccgggtaggctcccattccacggttacgaatcagcctgtagtggaaggcactactgtctgagaggcatggattactacgcatcgggcgccccatgcacagatagacggctccggccttggtgccgcgagcaaccgacgatgtgcacgtccctgcgcgcccctgcacggaatgctgtgtgttgctacaattcacccgccgtcattctgcctatttcggagccttag

SEQ ID NO: 23237 - DNA, 4206 bp, Artificial Sequence
  Description of Artificial Sequence: Synthetic coding sequence
atggaggagatccccgtgaaggtggccgtgcggatccggcccctgctgtgcaaggaggccctccacaaccatcaggtttgtgtgagagttattcctaacagccagcaggtgattatcgggcgggatagggtgttcactttcgatttcgttttcggcaaaaactctacacaggatgaggtttacaatacttgtattaagcccttagtgctctcacttatcgaaggatataacgccaccgtctttgcctacggccagaccggcagcggtaaaacgtacaccattgggggcggacatattgcaagtgtggtagaggggcagaagggcataattccaagggctatccaggaaatcttccaaagcattagcgagcatcccagtatcgattttaatgttaaagtttcttacattgaagtttacaaagaagacctccgggatctcctggagctcgagacctccatgaaggatcttcacattagggaagatgagaagggcaacactgttatcgtgggcgccaaggagtgccatgttgaaagcgcaggcgaggtgatgagcctcctcgagatgggtaatgccgcacgtcatacagggacaacccagatgaatgaacattctagccggagtcacgccattttcactatcagtatttgtcaggtccataagaacatggaggcggccgaggacggctcatggtattccccgcgccatatcgtgagtaaattccattttgtcgatcttgcaggtagtgagcgtgttactaagactggcaatactggggaaagatttaaggaaagcatccagattaatagcggcttgctggcactcggaaacgtcatttccgcccttggggatccacgccgcaagagttctcacatcccctaccgcgatgcaaaaatcacacggctgctcaaggacagcctaggaggaagtgctaagactgtgatgatcacttgtgtgtcccccagcagttccaattttgacgagtctctgaacagtttaaaatacgccaacagggcgagaaacattagaaataagcctacagttaatttttcaccagaaagcgatagaatagacgagatggaatttgagatcaagctcctacgtgaggccctgcagtctcagcaggctggggtgtcacaaacaacacagataaaccgggagggcagccccgacactaatcggatccactccctagaggaacaggtggcccagcttcagggagagtgtctcggatatcagtgttgcgtggaagaggccttcacttttcttgtcgacctgaaggacaccgtcagactgaacgagaagcaacaacataaactgcaggaatggttcaatatgattcaggaggtgaggaaggctgttctaacatctttccgggggattggcggtaccgcctcacttgaggagggccctcagcacgtaacggtgttacagttaaaaagagagctgaagaaatgtcagtgcgtcctcgccgccgatgaggtcgtgtttaaccagaaagaactggaggtgaaggagctgaaaaatcaggtccagatgatggtgcaggaaaataagggacacgccgtgagcctgaaggaggctcaaaaggtgaaccggctccagaacgaaaagataattgagcaacaattgcttgtggaccagctctcagaagagctcaccaaattgaacctctccgtgacaagctcggccaaagagaattgcggtgatgggcctgatgctaggatccctgaacgtcgaccctacacagtaccgttcgacacccatttaggccattacatttatattcccagtcggcaggactcacgaaaggtgcatacttccccacctatgtattccttggatcgtatattcgcaggattccgcacacgctctcaaatgttgctcgggcacatcgaggagcaggacaaggtgctccactgccagttttcagacaattctgatgacgaagaatccgaaggccaggagaagagcgggacacgttgtcgaagcagaagttggatccagaaaccagacagcgtttgcagcctcgtcgaattatcagacacccaggatgagacacagaaatccgatctcgaaaatgaggatttaaaaatcgactgcctgcaggaatcgcaggaactaaatctccagaaattaaaaaacagcgaaaggatcctcaccgaagcgaagcagaagatgcgggagctgaccattaatatcaaaatgaaggaagacctaatcaaagagctcattaaaactggcaatgacgccaagtccgtgtcgaaacagtactccctcaaggttaccaaactggagcacgatgcggagcaggcaaaggttgagctgatagagacgcagaaacaactgcaagaactggagaataaagatctgagcgatgtagctatgaaggttaagcttcagaaggaattccgtaaaaagatggacgctgccaagctgcgcgttcaggttctacaaaagaaacagcaggactccaaaaaacttgcatcattgtcaattcagaatgagaaacgagcaaacgagcttgaacagtctgttgaccatatgaaatatcagaagatccagctacaaaggaagctccgggaggaaaacgagaagagaaaacagctcgatgcggtcattaagcgcgaccagcagaagattaaggaaattcagttgaaaacgggtcaagaagaaggcctgaagcccaaggcagaggatctcgacgcctgcaatttgaaacgacggaagggttcatttggcagtatcgatcatctccagaaactcgacgaacagaaaaaatggttagatgaagaggtcgaaaaggtgcttaaccagaggcaggaacttgaagaactggaggccgacctgaaaaagcgggaagccattgtcagtaagaaagaagcgttactgcaggaaaaaagccacttggaaaacaagaagttgcgtagctcacaggctttaaacaccgattctctgaagattagtacaaggctgaatctcctggagcaggaactgtcggagaaaaacgtgcagctgcaaacttcgaccgccgaagaaaagactaaaatcagtgagcaggtggaagtgctgcagaaagagaaagatcagttacagaaacggagacataacgtagacgaaaagctgaaaaacggtcgcgtcctttcaccagaagaggaacatgtcctgttccagctagaagaaggaatcgaggcccttgaggctgcgattgaatatagaaatgagagcatccagaaccgtcagaagagcctgagggctagctttcacaatctgagcagaggggaggctaacgtgcttgaaaagctggcctgcctgtcgcccgttgagattagaaccattctctttcggtactttaataaggtggttaatctgcgtgaggccgaacggaagcaacagctctacaacgaggagatgaagatgaaggtgctggagcgggacaatatggtgcgcgaactggaatcagccctcgatcacctaaaactccaatgcgaccgccgcttaaccctccagcagaaggaacatgagcaaaaaatgcagttattgcttcaccacttcaaggagcaggacggggaggggatcatggagactttcaagacctacgaggataagatccagcagctggagaaggacctgtatttctataaaaagacctccagggatcataagaagaagctgaaggagcttgtgggggaggctattcgacggcagttggcaccatcagagtaccaggaggcaggtgacggggtgcttaagcccgaaggcgggggcatgcttagtgaggagctgaagtgggcaagtcggccagagtccatgaaactaagcggccgggagcgggagatggattcatctgccagctctctcaggacccagccgaatcctcaaaagttgtgggaagacattccagagctgccccccattcactcgtccttggctcctccctctggccacatgctcggaaatgagaataaaacggaaaccgatgacaatcagttcactaagtcacatagccgcttatccagccagattcaggtggtgggtaatgtcggacgtctgcatggcgtaactccagttaagttatgcaggaaggagttacggcaaatatctgctctcgagctgagcctgagacgcagcagtctcggagtgggcattgggtctatggccgccgactctattgaggtctctcggaagccacgcgatctaaagacttag

SEQ ID NO: 23238 - DNA, 768 bp, Artificial Sequence
  Description of Artificial Sequence: Synthetic coding sequence
atggtgaagggcgagaagggccccaagggcaagaagatcaccctgaaggttgcaagaaattgtattaagatcactttcgacggcaaaaagcgcctggatctatctaaaatggggataaccacatttcctaaatgtatactcagactgtctgacatggacgagctcgacctgagcaggaacttgattcggaaaatcccggattctatttcaaagtttcagaatctcaggtggctggacctgcactccaattacattgataaactgcccgaatctatcggtcaaatgacatctctgctttatttaaacgtctccaataaccgcttgaccagtaatgggctgccagtggaactgaaacagttgaagaatatcagagccgtgaaccttggtctgaaccacctggactccgtgcctaccaccctcggcgctttaaaagaactccacgaagtgggtctgcacgataatttactgaataatatcccagtctccattagcaagcttccgaaactcaagaagctgaacattaaacgcaatcctttccccaagcccggcgaatctgaaattttcatcgactccatacgacgattggaaaacctttacgtcgtggaagagaaagatttatgcgccgcctgtctgagaaaatgtcagaatgctcgcgacaatctgaatagaataaagaacatggccaccacgacacctcgaaaaaccattttcccaaacctgattagccccaactctatggcgaaagatagttgggaggactggcggtag

SEQ ID NO: 23239 - DNA, 645 bp, Artificial Sequence
  Description of Artificial Sequence: Synthetic coding sequence
atgggccggcggcccgcccggtgctaccggtactgcaagaacaagccgtatccgaagtcccgcttctgcagaggggtgccagacgcaaaaattcgcatcttcgacttgggccgaaagaaggccaaggtggacgagttcccactgggcgggcacatggttagtgatgaatatgagcagctgagcagtgaggccctggaagctgcccgtatctgtgccaataaatacatggtgaagtcctgtggaagagatgggttccacatgcgagtaagacttcatcctttccacgttatccggattaataagatgctcagctgcgcaggggcagacagactccagactgggatgcgaggcgcctttggcaaacctcaaggtaccgtggctagggttcatattggccaggttatcatgtccattcggacaaagctgcagaatgaggaacacgtgattgaggcactccgcagggcgaagttcaagtttcctggcaggcaaaagatccatataagtaaaaagtggggatttacgaagttcaatgcagacgagttcgaagatatggtcgctaagaaatgcttgattcccgacggctgtggcgtcaagtacgtgccgtctcacggtcccttggacaagtggcgcgtgttgcactcttag

SEQ ID NO: 23240 - DNA, 3231 bp, Artificial Sequence
  Description of Artificial Sequence: Synthetic coding sequence
atgaagagccggttcagcaccatcgacctgcgggccgtgctggccgaactgaatgcgtccctactcggcatgagagtaaataatgtatatgatgtggacaataagacttatttgattagactccagaagccagatttcaaagctactctgctactcgagagcggtatcagaatccataccacagagttcgagtggcctaagaacatgatgcctagttctttcgcgatgaagtgccgcaagcatctcaagagccggagactcgtgagcgctaaacagctgggagtggaccggatcgttgactttcagtttgggtctgatgaagccgcctatcacttgattatcgaattatatgacaggggtaacatcgtactgaccgactacgaatacgttatcctcaatatacttcgcttcaggactgatgaggctgatgacgtgaagttcgctgtgcgtgagcgctatccactagaccatgctagggcagccgagccacttctcactttagaacgccttacagagattgtagccagcgctccaaaaggcgagcttctgaaaagggttcttaatccccttcttccctacgggccggcacttatcgagcactgcctgctggaaaatgggtttagcgggaatgtgaaggttgacgaaaagcttgagaccaaagatatagagaaggtcctcgtttccctgcagaaagccgaggattacatgaaaactacttccaatttcagcgggaaaggctatattatccagaagcgagaaatcaaaccttccctggaggccgacaagccagtcgaagatatactcacctacgaggaatttcacccgtttctgttcagccagcattcacagtgcccttacattgagttcgagtccttcgataaagccgtggacgagttctattccaaaatcgagggccaaaagatagacttgaaagccttacagcaggaaaaacaggccctgaagaagctcgacaacgtgcggaaagatcacgaaaatcgcctcgaagctcttcagcaggcacaggagatagataagctgaaaggggagctcatcgagatgaacctccaaattgtcgaccgggccattcaagtggtgcggtccgctttagccaaccagattgattggaccgagattggactcatcgttaaagaagcccaggcccaaggtgaccccgttgccagcgcaatcaaggaattaaaactgcagaccaatcacgtaacgatgctcctgcgcaacccctacctgctttcagaagaggaagatgacgatgtcgacggtgacgtgaacgtcgaaaagaatgaaacggagccaccaaagggaaagaagaagaaacagaagaataagcaactgcaaaagcctcagaagaacaagccgctcctagtcgacgtcgacctgtcgctgagtgcgtatgctaacgcgaagaagtattacgaccataagcgctacgctgccaagaaaactcagaagaccgtagaggccgcagagaaagcttttaaaagcgcagagaaaaagactaagcagacactgaaggaggtccaaacagttactagtattcagaaagccaggaaggtgtactggtttgagaaattcctctggttcatttcttcagagaattacctgattattggaggacgagaccagcaacagaatgaaatcattgtgaaacggtatctcaccccgggcgatatctatgtgcacgccgaccttcacggagccacatcatgcgtgataaagaaccccacgggagaacctattcccccgcggaccttgaccgaggccgggacgatggccctgtgctatagtgccgcatgggacgctagggttattaccagtgcttggtgggtgtatcaccatcaggtaagcaagactgccccaactggggaatatttgactaccggatcattcatgatacgggggaagaagaactttcttcctcctagctatttgatgatgggtttttctttcctgttcaaagtcgacgagtcctgtgtgtggcggcaccagggggagcgcaaggtgagagtgcaggacgaggacatggagacgttggcaagttgtacatccgagctgattagtgaagaaatggagcagctagatggtggtgatacatccagtgacgaagacaaggaggagcacgagactccagtcgaggtcgaacttatgacacaggtggaccaggaggacatcactctgcagtccgggcgcgacgagctcaatgaggagctgattcaggaagaaagttcagaggatgagggcgaatacgaggaagttagaaaggaccaggatagtgttggcgaaatgaaagacgagggcgaagagaccctcaattaccctgacactactatcgatctgagtcacctgcagccccaaagaagcattcaaaagctcgccagcaaggaagagtcttctaattcgagcgacagcaagtcccaaagtagaaggcatctgagtgcaaaggagcggagggagatgaagaaaaagaagctcccatcagactccggagaccttgaggccctcgagggcaaagacaaggagaaagaaagcacagtacacatcgaaacacaccagaatacctctaaaaacgtcgccgccgtacagcccatgaaacggggacagaagagcaaaatgaaaaagatgaaggagaaatataaggatcaagacgaagaggacagggaactcatcatgaaactgctgggcagcgccggctcaaataaagaggagaagggtaaaaagggtaaaaaagggaagaccaaggatgaaccagtcaagaagcagccacagaaaccacgcgggggacaacgcgtgtccgacaacatcaagaaagagactccctttttagaagtgatcacccatgaactccaggacttcgctgtagacgatccgcacgacgacaaggaagagcaggacctggaccaacaggggaacgaggaaaacttgttcgactccctgaccggacaaccacacccagaagacgttctgttattcgccatcccgatatgcgctccgtacactactatgacgaattacaagtacaaagtgaagctcactcccggtgtccagaagaaaggcaaggcggctaaaaccgcactgaactccttcatgcacagcaaggaagctaccgcccgtgagaaggacctgttccggtctgtgaaggacaccgacttgagcaggaatatccctggtaaagtgaaggtgagtgctccaaatcttctcaacgttaaacgaaaatag

SEQ ID NO: 23241 - DNA, 963 bp, Artificial Sequence
  Description of Artificial Sequence: Synthetic coding sequence
atgggcgacatccccgccgtgggcctgagcagctggaaggccagcccgggtaaggtcaccgaagctgttaaggaggccatcgacgctggttacagacattttgactgcgcctacttttaccataatgagcgggaggtgggtgccggaatccggtgtaagataaaagagggggcagtgcgccgagaggatttgttcatagccacaaaactctggtgtacctgtcacaaaaagagccttgtggagactgcttgtcggaaatcgctgaaggcattgaagctcaattacctggatctttacctgattcattggcccatgggatttaaaccaccacacccagagtggattatgtcttgtagcgagctgagtttttgtctgagccacccgcgcgtgcaagacttgcccctcgacgagtctaacatggtaatcccctctgataccgactttctggacacatgggaagcaatggaagacctagtgatcacaggattagtcaaaaatattggagtgagtaatttcaatcacgaacagctggagcgcctgttgaataagcccggcctccggttcaagcccctcactaatcagatcgaatgccatccatacttgactcagaagaacctgatttccttttgccaatccagagatgtctcggtgactgcttaccgaccattgggaggcagttgcgagggggtggatttaatagataatccagtaatcaagcgtattgctaaggaacacggaaagtcccccgctcagattcttatccgattccagatccagcggaacgtgatcgttatccctggaagtatcacccccagccacatcaaagagaacatccaagttttcgatttcgagctgacccaacacgacatggacaatatcttatccctcaatagaaatctcagactggccatgttccctatcacaaaaaatcataaagattacccatttcatatagagtattag

SEQ ID NO: 23242 - DNA, 1239 bp, Artificial Sequence
  Description of Artificial Sequence: Synthetic coding sequence
atgagcggctaccagcggcggcccggcgccacccccctgagccgggctcggtcactggccatccctgacgctcccgctttttatgaacggagatcttgcttgccccaactaaattgcgaaaggccacacggccgggacctggattctccattctttggtatccggcccgccttcatgtgctacgttccatcacctgtgctcgctagtgtgggagatactgacgatcgatttgaggacctggaggaagcaaaccctttctccttccgggaatttttaaaaaccaagaacctgggactgtctaaggaagatccagcgagccgcatctacgcaaaggaagcttctaggcattcgcttgggctcgaccacaatagcccaccctctcagacaggagggtatgggctcgagtatcaacagccattcttcgaggatcccacaggcgccggtgatctacttgacgaggaagaggatgaggacaccggctggagtggggcgtacctgcccagtgcaatcgaacaaacgcaccccgaacgagttcctgctggcacttcaccctgctctacctacttgagttttttcagcacaccttctgagctggccggcccagaaagcttgccctcatgggcgctcagtgatacagactcccgggtgtctcccgcgtctccagcagggtcacccagtgcagactttgccgtccacggcgaatccttaggggaccggcatctcaggacgctccagatcagctacgatgccctgaaagatgagaatagcaagttgcgaagaaagctgaatgaagttcagtctttttctgaagctcagactgaaatggtgcgaactttagagcggaaactggaggctaaaatgatcaaagaagaatctgactaccatgaccttgagtctgttgtgcagcaggtggagcagaatctggaactcatgacaaaacgcgcagtcaaagccgaaaaccacgtggtgaaactcaaacaggagatcagcctgctgcaggcccaggtgtcaaatttccagcgcgagaatgaggcactccggtgcggtcagggcgcaagcctgaccgttgtgaaacagaatgcagatgtggccttgcagaacctgcgcgtggtcatgaatagtgcacaggcctcaatcaagcaacttgtcagcggtgccgagactctgaaccttgtcgccgagattttgaagtcgatcgacagaatcagcgaagtgaaggacgaagaagaagacagttag

SEQ ID NO: 23243 - DNA, 1440 bp, Artificial Sequence
  Description of Artificial Sequence: Synthetic coding sequence
atggacgccaccatcgccccccaccggatcccccccgagatgccccaatatggcgaggaaaaccacatattcgaattgatgcagaatatgctagagcagttactgattcatcaaccagaggatcctattccgttcatgatacagcacctgcaccgggacaatgataacgttccccgcattgtcattctgggaccccccgcatcgggaaagacaactatcgcaatgtggctgtgtaaacaccttaacagcagcctactgacccttgagaatctgattctgaatgagttctcctacacggctaccgaggcccggaggctgtatctgcagagaaagacagtgccaagtgcattacttgttcagctgatccaggagcgccttgctgaggaagattgtataaaacagggctggatcttagatggaatccccgagacaagggagcaagcccttaggatccagaccctcgggatcactccgcgccacgttattgtcctgagcgctccagacaccgtgcttattgaacgcaatttgggaaagcggattgaccctcagactggcgaaatatatcataccacctttgattggccccccgagtccgagatccagaaccgcctgatggtccccgaggatatcagcgaactcgagacagcccagaagttgctggaatatcaccggaacatcgtccgagtgattccctcctatccaaagattctgaaagtaatcagtgcagatcagccatgcgttgatgtcttttatcaggctctgacatacgtccaaagcaaccataggaccaatgcaccattcaccccgcgggtccttctgctgggacctgtaggaagcggcaagagtttgcaggcagcgctcctggctcagaaatataggttggtgaacgtctgctgcgggcagctgctgaaagaagcagtggcagaccgaacaaccttcggtgagctcatccagcccttcttcgaaaaggagatggccgttcctgacagtttattgatgaaagtgttatcacaacggctcgatcagcaggattgtattcaaaaaggatgggtcctccacggggtgccgcgcgatctcgaccaagctcacctcctgaaccgcttgggatataacccgaatcgcgttttttttctgaacgttccatttgactccataatggaaaggcttacattacgccgaatagatcctgtgacaggggaacggtaccacctgatgtacaaaccgccccccaccatggagatccaggcgagattactgcagaatccaaaggatgctgaggaacaggtcaagctgaagatggacctcttctaccgaaactcagccgatctggaacagctctacggaagcgccatcacacttaacggggaccaggacccctacacggtgttcgagtacatcgaaagcggcattataaacccattgccaaagaaaataccctag

SEQ ID NO: 23244 - DNA, 432 bp, Artificial Sequence
  Description of Artificial Sequence: Synthetic coding sequence
atggcccacgagatgatcggcacccagatcgtgaccgagcggctggtcgcactgttagagtcagggacagaaaaagtactactgatcgactctaggcctttcgttgagtacaacacatcacatatcctggaagctatcaatattaactgttccaagctgatgaaaaggcgacttcagcaggataaggtcctgatcaccgagctcatccagcattccgctaagcacaaggtagacatcgactgttcacagaaagtggttgtgtacgatcagtcctctcaagacgtggcttcgttaagctctgactgctttctcacagtcttgttggggaaacttgaaaaatcttttaatagcgtgcacctgctcgccggtgctgacgccgccgaatgggattggctttgcgtgaaatgccagcagtacctgtccaaagcctag

SEQ ID NO: 23245 - DNA, 1191 bp, Artificial Sequence
  Description of Artificial Sequence: Synthetic coding sequence
atggccagcctgagccgggccctgcgggtggccgccgcccaccccaggcagagcccaactagaggaatgggcccctgtaatctgtcatctgccgccgggccaaccgcggagaagagtgtgccttaccagcgcaccttgaaggaaggacaggggacatctgtcgtggctcagggtccaagtcgacctttaccatctactgctaacgtggttgtaattgggggaggatcccttggatgtcagacactgtatcatctggcgaagctgggtatgtccggcgctgtcctgttggagcgagagcggctgaccagtggtacaacttggcacacagctgggctgctctggcagctgcgacccagcgatgtcgaagtagaattgctggcgcacacccgccgcgtggtgtctcgcgaactggaagaggagactggtttgcacaccggctggatccagaatgggggtctgttcatcgcatcaaataggcagcggctggacgagtacaagagattgatgtccttaggaaaagcttatggtgtggagagtcatgtcctctcaccggccgagacaaagacactatatcctctgatgaatgttgatgacctgtacggcacactttatgtccctcatgacgggaccatggaccccgcaggaacttgcaccactttggcgagagccgcttccgcgaggggcgctcaggtcattgaaaattgccccgtcacaggcatccgggtgtggacggatgacttcggtgtacgacgggtggctggggtggaaacgcagcatggttcaattcagaccccctgtgtcgttaactgtgccggcgtgtgggcttcagcagtgggcagaatggctggcgtgaaggtgccactggtagccatgcaccatgcatatgtggtaactgagagaattgagggaatccagagcttcaccttgttgccgactctcgagtacagtggcaccgtctcagcccactgtaatcttaggcttccgggttcttcaaactcaagggcttctgcaagtcacgttgcaggcatcaaatgtgctaggcatcacacccgcttaatattcttttgtatattggtggagactgaattccaccacgtcgcaaaggctggactcgagctgctcagttccggcaacccaccaatatcggacttccagtccgcccgaattacaggagtaagtcaccatgcctag

SEQ ID NO: 23246 - DNA, 4416 bp, Artificial Sequence
  Description of Artificial Sequence: Synthetic coding sequence
atggagcccgagcccgtggaggactgcgtgcagagcaccctggccgccctatatcctccctttgaagccactgcacccacactgttgggccaggtcttccaggtggtggagcgcacatatcgagaggatgccctgagatacacattggacttcctggtgcccgcaaagcatctgctggctaaggtccagcaggaagcttgcgctcagtactccggctttctgttctttcatgagggttggccattgtgcttgcatgagcaagtcgtggttcagctggccgcacttccatggcagctcctgcgccctggtgatttttatctccaggttgtccctagcgcggcacaagcgccacggcttgcactcaagtgcctggcccccgggggaggccgagtgcaggaggttccagtacccaatgaagcctgtgcatatttattcacacccgaatggctgcagggcattaacaaggatcgcccaacaggtcggctgtctacatgtcttctgagcgccccctctggcatacagcgccttccatgggcagagctcatctgtcccaggttcgtccacaaagaggggctcatggtcggccaccagccttccactctgccccccgagttacctagcgggccgcctggtctgcctagcccacctctgccagaggaggctttgggcacacgctcgcccggtgacggccataacgcaccagtggagggcccagagggagaatatgtagagctgctggaagtgacgctgcccgttaggggctcccctacagatgccgaaggttctcctgggttgtcccgggtacgtaccgtgccaaccaggaagggggctggcggcaagggccgacatcgacgccatcgagcgtggatgcaccagaaggggttagggcctagagggcaggacggtgcacgccctccgggggaaggatcaagtacaggcgccagtcccgagtccccacccggcgccgaagctgtgccagaagcagcagtgctggaagtgagtgagcctccagccgaggccgttggggaggcctcgggatcatgccctcttcggcccggcgagttacggggtggcggcggtggaggccagggagccgaagggccgcctggcactccacgcaggaccgggaagggcaatcgacgtaagaagcgggctgcaggccgaggggctctctcccgggggggggattccgcccccctttcgccaggagacaaagaggacgcaagccatcaggaggcactcggaaacctaccgagtccatctgagcataaacttccagaatgtcacctggtgaaagaggaatatgaagggagtggcaaacccgaatctgagccaaaggagctcaaaacagcaggcgagaaagagcctcaactcagcgaggcctgcgggccgacagaggagggggcaggggagcgggagttagaaggccctggtctactttgcatggccggacacactggtcctgaaggaccccttagtgatacccccacccctcctctggagacagtacaggaagggaaaggcgacaatatcccagaagaggccctggcagtttctgtatcggaccacccagacgtggcctgggatctcatggcaagcggatttctaatcctcaccgggggcgttgaccaatctggaagggcattgctgacgattacaccgccatgtcctcccgaggagccccctccttctcgggatacacttaataccacccttcattacttgcactctctgttgcgacctgatttgcagaccttgggattgagcgtgttgctagatcttcggcaggccccgcctctcccaccagcactaattcccgcactctcccagttacaagactcaggagacccccctctggttcagagactactcatcctgatccatgacgacctccctaccgagctgtgcggcttccaaggggccgaggtgctgagtgaaaatgatctcaagcgggtggcaaagccagaggagctccagtgggagctcggcggtcatcgtgatccatcaccctctcactgggtagagatacaccaagaggtggtgagactgtgtcgcctctgccagggcgtgctggggtcagtgcgacaggccatcgaagaactggagggggccgccgaacctgaggaggaggaggctgtcgggatgcccaagccactgcagaaggtattggccgaccctcggctcaccgccctgcaaagggacggcggcgctatccttatgagactgcggtctacaccctcctctaagttggaaggtcaaggacctgccacgctgtaccaagaagtggacgaagcgatacaccagctggtgcgcctttctaatctgcatgtacaacagcaggagcagcgccagtgtctgcggcgcctgcagcaagtcctgcagtggctctcgggcccaggtgaggagcaactggcttcattcgccatgcctggagacaccctcagcgcattgcaggagaccgagctgcgctttagagcgttcagcgcagaagtgcaggagcggctggcccaggctagagaggcactggctttagaagagaatgccaccagccagaaagtgttagatatattcgagcaaaggcttgaacaagtcgaatccggcctgcatagagccctgcggcttcaacggttttttcagcaggcccatgagtgggtcgatgagggcttcgcccggctggctggggctggacccggacgcgaggctgtgctagcagccctcgcattgcggcgtgctccagaaccttccgcagggacctttcaagaaatgagagccctggcactggacctgggcagtccagctgcacttcgcgagtggggtagatgtcaggcccggtgtcaggaactcgagcgccgcattcagcagcatgtgggcgaagaggcatctcccagaggttatcgcagacgtcgcgccgacggcgcatcgtcgggaggagcccagtgggggcctcggtctccatccccaagcctctcctccctgctcctcccctctagtcctgggccacgtcccgctccttcccactgcagccttgccccgtgtggagaggattacgaagaggagggccctgaactagctcccgaggcagagggaaggccacccagggctgtactgatccgggggctcgaggtcacgagcaccgaggtggtggacaggacctgcagcccccgcgagcacgttctgctgggacgtgcaaggggtcccgatggcccttggggtgtaggaacgccaaggatggaaaggaaacgtagtatcagcgctcagcaacgattggtgtcagagcttatagcctgcgaacaagattacgtcgccaccctgagtgagcccgtgccgccaccaggccctgaattaacccccgaacttagaggaacttgggctgcggccttaagcgccagagagcggctcaggtctttccatcggacgcatttcctacgagaactacaggggtgcgctacccaccctctgcgtattggcgcttgcttcctgcgccatggggatcagttttcgctgtacgcccagtatgtcaaacatcggcacaagctcgagaacggtctcgctgccctatcacccctcagcaagggctcaatggaagccggcccgtatcttccgcgagcgctgcagcaaccactggagcaactgaccagatacggtcgactgcttgaggagctgctccgcgaagccggcccagaactgagctctgagtgccgagccctcggtgccgctgtgcagctactgcgagagcaggaggccaggggccgggatctccttgccgttgaagcagtgcggggatgcgaaattgaccttaaggagcagggtcagctgttacaccgtgaccccttcactgtgatctgcgggaggaagaagtgtttgcggcatgtcttcctctttgaacatctacttttattctccaaattgaaaggcccagagggcggatctgaaatgtttgtgtacaagcaggcgtttaaaacggctgacatgggcctgaccgagaacattggcgactcgggtctgtgcttcgagttatggttcagacggcggcgcgcccgggaagcctatacattgcaagccaccagccccgaaatcaaactcaagtggacatcaagtatagctcagttgctctggcgtcaggctgcccacaacaaggagttaagggtgcagcagatggtctctatgggtatagggaataaaccttttctggatatcaaggctctcggtgagcggacactgtccgcgctgctcactgggagagcccctgagacattggattcaagtggcgatgtgagccccggcccacgaaatagtcccagcctacagcccccccatccagggtccagcactcctacattagcctcccggggtattttaggcctgagccgccagtcgcacgcacgagccctgagtgaccctactacacctctctag

SEQ ID NO: 23247 - DNA, 4560 bp, Artificial Sequence
  Description of Artificial Sequence: Synthetic coding sequence
atggagcccgagcccgtggaggactgcgtgcagagcaccctggccgccctgtaccccccgttcgaggctaccgcacctacattgctgggccaagtgttccaagtcgtggagcggacatatcgagaggatgctttaagatatacactggattttcttgtccccgctaaacatctgttggcaaaggtgcagcaagaagcctgtgcccagtactccggcttcttgttctttcacgagggctggccactgtgcctgcatgaacaggtggtcgttcagcttgccgcgctcccatggcagctgctgcgaccgggagatttctacctgcaagtggtcccttccgcagcacaggcgccacgcctcgcgctgaagtgtcttgcacctggagggggaagagtgcaggaagtgcctgtgccaaatgaggcctgtgcctatctttttacccccgagtggctccaggggatcaacaaagaccgccctacagggaggttgtccacatgcctcctttcagccccgtccggcatccaaaggttaccgtgggctgaactgatttgcccccggtttgtacacaaagagggcctaatggtcggccatcagccaagcacgttgccgccggagctgccctccggccccccgggtctgccttcacccccacttcccgaggaagccctggggacaagatctccgggcgacggacacaatgcaccagtggaggggcctgagggcgagtatgtggagctgctggaggtgaccctacccgttcgggggagcccaactgatgctgaagggtctcccggactctctagggttcggacagtacccacccgaaaaggcgccggtggcaaaggcaggcatcgtcggcatagggcctggatgcaccagaaaggactcgggcctaggggtcaagatggcgctcgaccacccggggagggcagttctacaggggcttcccccgagtcccctcctggagcggaggcagttcccgaagccgccgtgctggaggtgtccgaaccacccgccgaagccgtgggggaggcttcgggaagttgcccattgcgccccggagagttgagggggggtgggggaggcggtcagggagcagaagggcctccagggacaccaaggagaacgggaaagggaaacagaaggaagaaaagggcagctggcagaggcgccctgagtagagggggcgactccgctcccttaagccccggagataaggaagacgcctcacaccaggaggccctgggaaacctcccttccccatctgaacataaacttcccgaatgccacctggttaaagaagaatatgagggctcaggcaaaccggaatccgaacccaaggaactcaaaactgcaggagaaaaagagccacagctgtccgaagcctgcggtcctacagaagaaggggccggtgagcgggagctggagggacccggattactctgtatggcaggccataccggccccgaggggcctctctcagatacccctacccccccgctcgagacagtacaggaaggcaagggcgataatattccggaggaagcactcgccgtatcggttagcgatcaccccgatgtggcttgggacttgatggcctctgggtttttgatcctaactggaggggtagaccagagcgggcgggccctgctcaccattacccccccatgtcctccagaggaaccaccacccagccgggatactctaaatacaactttacactacttgcacagccttcttcgccccgatctgcagactctgggcctcagtgtcctgctggacttgcggcaggccccacctttaccgcctgcattaattcccgccctgagccagcttcaagacagcggggacccaccattagtgcaaaggctactcatactgatacacgacgatctccccaccgagctttgtggattccaaggggctgaggtgttgtcggagaacgatctgaagcgcgtggccaagcccgaagaactgcagtgggaactgggagggcatcgggaccctagcccctcccactgggtagaaattcaccaggaggtggtgcggctctgccgcttgtgtcagggcgtgctgggtagcgtgcggcaggcaatagaggaattagagggagctgctgaacccgaggaagaagaggctgtgggcatgccaaagccgctgcagaaagtattggccgacccacgcttgactgccttgcaacgagatggcggggcgatacttatgcggctccgatccacaccatcttcaaagttagagggccagggccctgctactctctatcaggaggtggacgaagccatccatcaactggtccggctctccaacctgcacgtgcaacagcaggagcagaggcagtgtttaaggcgcctacagcaagtactccagtggctctccggccccggggaggagcagctagctagtttcgcaatgcctggagacacgctgagcgcactgcaggaaacggagctgagattccgggcatttagtgctgaagttcaggagcgccttgcccaggcccgggaggccttggcattggaggagaatgcaacttctcagaaagttctagatattttcgagcagagactcgagcaagtcgaatctggcttgcacagagcgttgcgccttcagcggtttttccaacaagcccacgaatgggtggacgaggggttcgcacgactggccggcgcggggcctgggcgcgaagctgtgctcgccgccctggcactccgccgggcccctgagcccagcgctggtactttccaagagatgagggctttagctctggacctgggtagtcctgccgctcttcgtgaatgggggcgttgccaagctagatgccaggagctcgaacgacgcattcaacagcacgtgggcgaagaagcatccccccgtggctaccggcgccgacgggcggatggagcctccagtggcggggcccagtggggtccacgctcacccagtccgtctctcagctctctgcttctgccaagctcaccgggaccccgcccagctccaagtcactgctccctggcaccatgcggggaagactacgaggaagaaggtccagagctggcccctgaagccgaaggcaggcccccgagggcagtgttgatcagagggctagaagtcacaagcaccgaagtcgtcgaccgaacatgctcgccacgcgaacacgtgctgctggggcgcgccagaggaccagatggaccatggggcgtcgggacaccaaggatggaacgcaaaaggagcatttcagcacagcaaaggctagtgagcgagctgattgcatgtgaacaggactatgttgctacactgtctgagcccgtacccccaccgggtccagaactcacgcctgaactcaggggaacctgggctgccgccctctccgcccgggaacggctgcgctcctttcatagaactcatttccttcgtgaactgcagggatgcgcaactcacccgttgaggataggagcctgttttctgaggcacggggatcaattcagtctttacgcacagtatgtcaaacaccgccataagctggaaaacggtttggccgccttatcccctctaagtaagggctctatggaagctggtccctatcttccgagggcccttcagcagccacttgagcagctcacaaggtacgggcgcctactggaggaactgctccgggaggccggtcccgagctgtcctccgaatgtcgcgcccttggagctgctgtgcagctacttcgcgaacaagaggcacgtggtcgcgacctgttagcagtagaggctgtcaggggctgcgaaatagacctgaaagagcaaggccagctgttgcacagagacccgtttaccgtgatctgcgggcgcaagaaatgcctcaggcacgttttcttgtttgaacatctcctgctgttttcaaaactgaagggaccagagggtggctctgagatgtttgtctacaaacaggcatttaagacagccgacatggggctgaccgagaacattggagacagcggcctctgcttcgagctctggttcaggaggagaagggctcgagaagcgtacacactgcaggccacttcccccgagattaaactgaagtggactagcagcatcgcacagctcctttggcgccaagccgctcacaataaggagttgcgagttcaacaaatggtgtccatgggcatcgggaacaagccgttcctcgacatcaaagcgctgggcgagcgcacactgagtgccctcctgacaggaagagccgccagaacacgtgcatccgtggcggttagtagcttcgagcacgcaggcccgtctctgccaggattgtcccctggcgcctgttcgctgcctgctcgcgttgaagaggaggcttgggaccttgatgtgaaacaaatttcactagctcccgagaccctcgattcttcgggggacgtttcaccaggaccccgcaatagccccagtctgcagcctccccacccagggtcctcgacaccaaccctagcatcaagggggatcctgggtctatcccgccagagccacgctcgggcactctccgatcctacgacccccctgtag

SEQ ID NO: 23248 - DNA, 2709 bp, Artificial Sequence
  Description of Artificial Sequence: Synthetic coding sequence
atgttccccgccctggagacccacctgaagcagaccatccccgacccctacgaagattttatgtatagacacctccagtactacggatacttcaaagcccagcgcggctctctacccaacagcgccactcatcagcatgtgagaaagaataatcctcagtgtctacttaacgggagtcttggtgaaaaagatgatcttattccggacactcttcagaaggaaaagcttctgtggccgatctcactcagttctgccgtccaccgacagatcgaggccattaacagggatttccactcctgtttgggatggatgcagtggagaggactgagtagcttgcagcctccaccgcccaggttcaaggatagtccggcatcagcgtttcgggtcgctggtatcacggactcgcatatgctgtcactgcctcacctgcgatcgaggcaactcctgtacgacgagttggatgaagtaaatcccagacttcgggaacctcaggaactttttagcattttaagcacaaagaggcccctgcaggctcccaggtggccgattgagtgcgaagtcatcaaagaaaacatccaccatatcgagtgggcacccccccagcccgagtacttttaccaaccaaaaggcaacgagaaagtaccagaaatcgtcggcgagaaaaagggaacagtagtgtaccagctcgattctgtgcccatcgagggaagctattttaccagctctcgagtcggcggaaagcgcggaatcgttaaggaactggctgtcaccctccaggggcctgaagacaatacactgctcttcgagtctcgcttcgaaagcggcaaccttcagaaggctgtccgcgtggatacttacgagtacgagttgacacttaggactgacctatatacgaacaagcatacccagtggttctacttcagagtacaaaatactcgaaaggacgctacgtatcgattcaccatcgttaatcttctaaagcccaagtccctgtacacagtgggcatgaagcccctgttgtatagtcagttagacgcaaatacaagaaatatcgggtggagacgcgagggcaatgaaatcaaatattataaaaacaatactgacgacggacagcaaccattctactgtctcacttggacgatccaattcccctatgaccaggacacatgcttcttcgctcatttttacccctacacatacacagacctccagtgttatttactgagcgtggctaataatccgattcagtcccagttttgcaagctgcagactctctgtcgttccctggccggtaatactgtctacctgttgaccataactaatccctctcagaccccccaggaagcggccgctaaaaaggcagtggtcctgtccgcacgggttcaccccggagagagcaacggctcatgggtgatgaaggggtttctcgactttattctatccaatagtcctgatgcacagctactcagagacatttttgtgtttaaggttctccctatgctaaatcctgatggggtgatagttggtaattaccgatgctcccttgctggtcgtgacctgaaccgacactataaaacaatcctgaaagaaagctttccttgtatctggtacacccggaacatgataaaaaggctcctcgaagagagggaggtcctcttatactgcgactttcatgggcatagccgcaaaaataatatattcctttatggctgcaacaataacaatcgcaaatactggctccatgagcgtgtttttcctcttatgctatgcaaaaatgccccggacaagttctcctttcatagttgtaatttcaaagtacaaaaatgtaaagaagggactggccgtgtcgtaatgtggaggatgggaatcctgaactcctacactatggagagtactttcgggggttcaactctgggtaacaaacgggatactcatttcactattgaagacttaaaatccctcgggtaccacgtttgtgacacgctactagatttctgtgaccccgatcagatgaaatttacccaatgcttggccgagctgaaggaactgctgagacaggaaatacataaaaaatttcacgaacttgggcaggacgtcgatttagagggctcctggtctgacatcagcctgtctgacatcgagtcttccacgagcggcagtgactcctcgcttagtgacggactgcccgttcacttggctaatatcgcggacgaactgacacagaaaaagaagatgttcaagaaaaaaaaaaaaaagtccctgcagacaaggaagcagagaaacgagcagtaccagaagaaaaacttgatgcagaagctcaagctaaccgaagatacttcagagaaggccggctttgcctccacactgcaaaagcagcccactttctttaaaaactccgagaactccagctttctgcctatgaagaacgaaaatccccgcctgaacgagacaaacttaaataggcgtgacaaggacactcctctggacccatccatggcaactctcattctgccaaagaataaaggccgcatgcagaacaagaagcctggctttacagtgtcttgcagtccaaagaggaccattaattcctcccaggagccagcccccggaatgaagcctaactggccaaggtcacgatatcccgctacaaaacgcggatgcgctgcaatggccgcatatccatcactgcacatctacacatacccttag

SEQ ID NO: 23249 - DNA, 3234 bp, Artificial Sequence
  Description of Artificial Sequence: Synthetic coding sequence
atggaggtgcaggtgagccaggccagcctgggcttcgagctgacctcagtggaaaagagcctacgagagtggtcaaggcttagccgcgaggtgattgcatggctttgtccatcttctccgaatttcatcctgaacttcccacctcccccatctgccagctcggtcagcatggtgcagctgttctcaagcccgttcggctaccagtctccatcaggacactcagaagaggaaagggagggcaatatgaaaagtgcaaaaccacaggtcaaccactcccagcatggggagtctcagcgggccctgtccccactccagtctaccctctcctcagctgctagccccagccaggcctatgagacctacattgagaatgggctgatatgtttgaaacacaaaataagaaatatcgagaagaagaagctgaagctagaggattataaggaccggcttaagagcggggaacacttgaacccagaccagctcgaagctgttgaaaaatatgaagaggtgcttcataacctcgagttcgcgaaggaactccagaaaacattttcagggctgtctctcgacctgttaaaggctcagaagaaggcgcagcgtagggagcatatgctcaaacttgaggcagaaaaaaaaaaattaaggacgatcttgcaggtgcagtatgtgctacagaatctaacacaggaacatgtgcagaaagattttaaaggcggcctgaacggagccgtgtacctccctagcaaggaattggattatctgattaagttctccaagttaacttgtccagagcggaatgagagtcttagcgtggaggatcaaatggaacaatcatcactgtatttttgggacctgttagagggatccgagaaagcggtggtggggacgacgtacaagcacttgaaggatttgctttcaaagttgctcaatagcggatattttgagagcatcccagtacccaagaacgctaaggagaaggaggtcccattggaggaagagatgctgatacaatctgagaagaaaactcagcttagcaagacggagagtgtaaaggaatccgagagcctgatggaatttgcacagccggaaattcagcctcaggaatttctcaacaggcgttacatgacagaagtggattacagcaacaagcagggcgaggaacaaccatgggaggcagattatgcgcgaaagcccaacctccccaaaaggtgggatatgctgacggagccggatggccaggagaaaaagcaagagtccttcaagtcctgggaagcgtctggaaagcaccaggaagtatctaagcctgcagtgtctctcgaacagagaaaacaggatacatctaagctacggtcgacactccccgaagaacagaaaaagcaagaaatctcgaaatccaaaccgtcacctagccagtggaagcaggataccccaaagagcaaggccgggtacgttcaggaagaacagaaaaaacaggaaacaccgaagctttggcctgtccagttgcagaaggagcaagacccaaagaagcagaccccaaagagttggaccccgtctatgcagtcagagcagaataccacaaagagttggaccactcctatgtgcgaagaacaggatagtaaacagccagaaactcctaagtcttgggaaaataatgtggaatcccaaaagcatagtctcacaagtcaatcgcagatctctcccaagtcttggggtgtcgcaacagccagcctgattccaaacgatcagctgttaccccgcaaacttaatactgagcctaaagatgttcccaaacccgtgcaccaacccgtaggttcttcaagcacccttcccaaggatcccgttttgcgaaaggagaagctccaggacctaatgactcaaattcagggaacgtgcaattttatgcaagagtccgtgctggacttcgacaagccttctagcgcgatccctacaagccagccaccatcagcgactccagggtcgcctgtcgcatcaaaggaacagaatctctctagccagtccgatttcctacaagagcctctccaggccacctcttctccagtgacctgctcctctaatgcatgcctggtgaccacggatcaggccagcagtggcagcgagacagagtttatgacttcagaaacaccagaagtcttcaacgtgaacgcgcctttgcccccaaggaaggagcaggagatcaaggagtccccctactcccccgggtacaatcagtccttcactaccgcatcgacccagacaccaccccagtgtcaacttccgagcatccacgtggaacagacggtccatagccaagagaccgcaaactatcacccagatggcaccattcaggtaagcaatggcagtctcgctttttaccccgcccagaccaacgtctttccaaggcccacccaaccttttgtgaacagccggggctctgtgcgcggctgcacccgtggtggacgtttgatcacgaattcctaccggagcccaggcgggtataaggggttcgatacataccgcggactaccctcaatcagtaacgggaattacagtcaactgcagtttcaggccagggagtattctggcgcgccttattcccagcgtgacaactttcagcagtgctataaaagggggggaacctctggaggccctagagccaatagtagagctggttggtcagattcctcgcaagtcagctctcctgagcgcgacaacgaaacctttaattcgggtgactcgggccagggggactcccgctcaatgaccccggtagatgtgcccgtgactaacccggctgcaaccattcttcctgtgcacgtgtacccgctgcctcagcagatgagggtggctttcagcgcggcgcgaacaagcaaccttgctcccggtacccttgaccagcctatcgtcttcgaccttctcctgaacaacctgggagagaccttcgatctgcagctgggccggttcaactgtccggtcaacggcacttacgtgtttatattccacatgcttaagctggcagtgaatgtgccattgtacgtcaacctgatgaagaacgaggaggttctggtgtccgcctacgctaatgacggagcccctgatcacgaaaccgcctccaaccacgccatactgcagctcttccagggcgatcagatatggctacggctccatcggggggcaatctacgggagcagctggaagtactcaactttctccgggtatctcctgtaccaggactag

SEQ ID NO: 23250 - DNA, 1056 bp, Artificial Sequence
  Description of Artificial Sequence: Synthetic coding sequence
atgaccctgcggctgctggaggactggtgccggggcatggacatgaacccgcgtaaggctcttttaatcgctggaataagccagagctgtagtgtcgccgagattgaagaagcccttcaagctggcctggcaccactgggagagtaccgcctcctcggtaggatgttccgaagggacgagaaccggaaagtagcacttgtcggcttgacagctgaaacctcacacgcccttgtccccaaggaaatccctggaaaaggtggcatatggagggtaatattcaagcctcccgaccccgataatacttttctcagtcgactgaatgagttccttgcgggtgagggaatgacagtaggggaactctcccgggccctggggcacgagaatggctcattggatccagaacaaggtatgatacctgagatgtgggctccaatgctcgctcaggctctcgaggcactccaaccagccctgcagtgcctgaaatataagaagctgcgggttttctctggccgggaatcccccgaaccaggtgaggaagaatttggccgatggatgttccataccacacagatgataaaagcttggcaggtgccggacgtcgagaaaaggcgccggttgctggagagtttgaggggtcccgccctggacgtgatccgggtcttaaaaattaataacccgcttattactgtcgacgagtgtttgcaggcactggaggaagtattcggcgtgactgacaacccgcgggaattgcaggtgaaatatctgacaacgtaccagaaggatgaggagaaactatccgcgtacgtgcttcgactagaaccattgctgcagaaactggtccagcggggagcgattgagcgagatgctgtgaaccaggctcgcctcgatcaggtgattgcaggtgccgtgcacaagaccataaggcgcgagctcaacctcccagaggatgggcctgcgccaggctttcttcaactgctggtcctgatcaaggactacgaggccgcggaggaagaagaggcactcctccaggcgatcctggagggaaacttcacttag

SEQ ID NO: 23251 - DNA, 2559 bp, Artificial Sequence
  Description of Artificial Sequence: Synthetic coding sequence
atgagcggccgggcccgggtgaaggcccggggcatcgcccggagcccaagtgccacagaggttgggcgtattcaggccagccctttaccaagatctgtcgacctgtctaacaacgaggctagttcttctaatggtttccttggcacgtctcgcatcagtacaaatgataagtacgggatcagcagcggtgacgctggctcaacgtttatggagaggggcgtcaagaacaagcaggacttcatggatctgtcaatttgtacccgcgaaaaactggctcacgtaaggaattgtaaaactgggagttctgggattcctgtgaaactcgtcactaacctgttcaatttggacttcccacaagactggcaactgtaccagtaccatgtaacttatattccagacttagcctcccgccgcctccgaattgcacttctttactcccactccgaactatctaataaggctaaagctttcgacggcgcaattctcttcctcagccaaaagcttgaggagaaagtgacagaactgtcttcagaaactcagcggggcgagacaataaaaatgacaatcaccctgaagagggaactgccatccagcagtcccgtttgtatccaagtctttaacattatctttcgcaaaatcttgaagaagctgtcgatgtatcagataggaaggaacttttataatccctccgaaccaatggaaattcctcagcacaagttaagcctctggccaggcttcgcaatttccgtgagttattttgaaaggaagctattgttcagcgcagatgttagttacaaggtgttgagaaacgagaccgttctagaatttatgaccgcactgtgccagaggacgggccttagctgttttacacaaacgtgcgaaaagcagctaatcgggctcattgtcttgaccaggtataataatcggacttattccatcgacgacatagactggagcgtgaaaccaactcatacattccagaaaagagatggcaccgagattacatacgtggactattacaagcagcagtatgatatcactgtctccgacctaaatcagccaatgctggtctccctacttaaaaaaaaacgtaacgacaatagtgaggcgcaattggctcacctcatccccgagctgtgtttcctaacaggcctgactgatcaggccacttccgatttccagctgatgaaagctgtggccgaaaaaacacggctgtccccatctggcagacaacagcggttagctaggctggtagacaacatccagcggaacacaaatgcccgtttcgagcttgagacttggggtcttcactttggatcacagatttccctgacgggccgcatcgtgccaagtgaaaagattcttatgcaggaccacatctgccaacccgtttccgctgcagactggtccaaagacattaggacctgtaaaatcctcaacgcccagtcattgaatacttggctgatactttgctccgaccgaaccgaatacgtcgccgaatcgttccttaactgtttgagaagggtggcagggtcaatgggcttcaacgtcgattacccaaaaatcattaaagtgcaagaaaacccagccgctttcgtgagggcgatacaacagtacgtagaccccgacgtgcagctcgtcatgtgcattctcccgagtaatcagaaaacttactatgactctataaaaaagtatctttcttccgattgtccagtaccaagtcaatgcgtcctcgctcgcacgttaaataagcagggcatgatgatgtctatagctacgaaaatagctatgcaaatgacatgtaaacttggaggcgagctctgggcggtagaaattccgctcaaaagcctgatggttgtcggcattgacgtgtgcaaagacgcactcagcaaggacgtgatggtggtgggatgtgtcgctagcgtcaatcctcgcatcacacgatggttttcccggtgtatcctacagagaactatgaccgacgtggcagactgcttgaaagtgtttatgactggggcactcaataaatggtacaaatataatcacgatctgcccgccaggatcatcgtgtaccgggccggcgtaggggatggacaactcaagacgctgattgaatatgaggtgccccagctgctcagttctgttgcagaatcctccagcaatacgagttccagactttccgtgattgtggtgcggaaaaagtgcatgcctaggttcttcacagaaatgaatcgaaccgttcagaatccccccctcggcaccgtggtcgactccgaagccacgcgcaatgaatggtacgatttctacctgatcagtcaagttgcttgccgagggactgtgtcccctacctattataacgtaatttacgacgataatgggttgaagcccgatcacatgcagagactcacttttaaactctgtcacctctattataactggccaggcattgtttcagtaccggctccatgtcagtacgcgcacaaactgacttttctggtggcgcagagtatccataaggagccaagcctggagttggctaatcacctcttttacttgtag

SEQ ID NO: 23252 - DNA, 2163 bp, Artificial Sequence
  Description of Artificial Sequence: Synthetic coding sequence
atgtacggcagcgcccggagcgtgggcaaggtggagcccagcagccagagccctggaaggagtccccgactgccccgaagccctcgccttgggcataggcgaacgaactctaccggagggtcttccggttcttccgttggaggcgggtcaggtaaaaccctgagcatggagaatattcaatcactcaacgccgcctacgctacctctggccctatgtacctttccgatcatgaaaacgtgggatcagaaactcctaagagcaccatgacattggggaggtctggaggtcgactaccatatggcgttaggatgacagccatgggcagctcgcccaatattgctagctctggagtggcctccgacactatagcttttggagagcaccacctcccgcctgtgagcatggcctccacagtgcctcactcgctgcggcaggcccgggataacacaattatggatctccaaacacagttgaaggaggtgctccgggagaatgatcttcttagaaaggatgtggaagtcaaagagagtaaactcagctcttcaatgaatagtatcaagaccttttggtcaccagagttaaagaaggagagggccctgagaaaggacgaggccagcaagatcaccatctggaaggagcagtatcgcgtggtccaagaggagaatcaggtagatgccttgcggctcagacttgaggagaaagagaccatgttgaataagaaaacaaaacagatccaggatatggcggaagagaaaggtacccaagctggtgagattcatgatctcaaagacatgcttgatgtgaaggaaaggaaggttaacgtgctgcaaaaaaaaatagagaatctccaggaacagctgagagacaaggagaaacagatgtcgtctctgaaggagcgcgtcaaaagcttgcaggccgatactaccaataccgacaccgcactgaccactttggaggaagccttagctgagaaagaacgaacgatcgagcggctcaaagaacagagagacagggacgagcgggaaaaacaggaggaaatcgacaattacaagaaggatctcaaggatttgaaggaaaaagtgtcactgttgcagggggatctctccgaaaaagaggccagtctgctggacctgaaagagcatgctagtagtctcgcgtctagcgggttgaagaaagactctcggctgaaaacgctcgagattgctctcgaacaaaaaaaggaagagtgcttgaagatggagtcccaactgaaaaaggcacacgaggccgccttggaagcccgggcaagtccagagatgagtgatcgcatccagcacctcgagagggagatcactagatataaagatgagagctctaaggcccaggcagaagtggatcggctgctggaaatcttgaaggaggtcgaaaacgaaaagaacgacaaggataaaaagatcgccgaattagagtcattgttctcgaggcaggttaaggaccaaaataagaaagtggctaacctgaagcacaaggagcaggtggagaaaaagaaaagtgcccaaatgctggaggaagctcgtaggcgagaagataatctcaacgactccagccagcagctacaggattctctgcggaagaaagacgaccgcatcgaagaactggaggaggcactgagggagtctgtccagataaccgcagaacgagaaatggtgctcgctcaagaggagtcggcccggaccaacgcggaaaagcaggtggaagagctgctcatggccatggaaaaggttaagcaagaattagaaagcatgaaggccaagttatcctccacccagcaatctcttgctgagaaagaaacacatctgacgaaccttcgggccgagaggcggaagcatctggaagaggtcctagagatgaagcaagaagctctgctggctgcgatcagtgaaaaggacgctaatattgccttgctggagctcagttcctccaagaagaagacgcaggaagaagtcgcagcattgaagagggagaaggatcgactggtgcagcagctcaaacaacagacccagaaccgcatgaaacttatggccgataactacgaggatgatcatttcaagagttcccactccaatcaaacaaaccacaagccttcaccagaccaggatgaagaagaaggcatttgggcttag

SEQ ID NO: 23253 - DNA, 1344 bp, Artificial Sequence
  Description of Artificial Sequence: Synthetic coding sequence
atggacatgggcaaccagcaccccagcatcagccggctgcaggagatccaaaaggaggtgaaatcagtggaacagcaggtcatcggcttcagcggcctgtcagatgataagaactataaaaaactggaacgcatcttaactaagcaattatttgaaatcgacagtgttgacaccgaaggcaagggtgacattcaacaggctagaaagagggccgctcaggagacagagcgccttttgaaggaacttgagcagaatgccaatcaccctcaccggattgagatacagaatatattcgaagaagcccaatccctggtcagagagaagatcgtcccgttctacaacggggggaattgcgtaactgacgagttcgaggaggggattcaggacataattctgcgtctgacgcacgttaagacaggcggcaagatcagcctccgcaaggctcgataccatactctcactaagatatgcgctgtgcaggagatcattgaggactgtatgaagaaacagcccagcctgcccctatcagaggacgcccaccccagcgtggccaagatcaacttcgtgatgtgcgaggtaaacaaagctagaggggttctcatcgccctgttgatgggtgttaataataacgaaacatgcaggcacctaagctgcgtgctgagcgggctgatcgcggacctcgacgccctcgatgtgtgtggaaggacagagattagaaattaccgcagagaggtcgtggaggacattaacaagttactaaagtacctggatctggaggaggaggcagacacaacaaaggcctttgacctgagacagaaccactcgatccttaaaatcgagaaagtactaaagcgcatgagggagatcaaaaatgaacttcttcaagctcagaatccttctgaactgtatctgtcaagcaaaacggaactgcagggtttaattgggcagctggacgaggtgtctctggagaagaacccgtgcatcagggaggccagacgccgtgccgtgatcgaggttcagactctaatcacctatatcgacctgaaagaggcactcgagaagcgaaagctgtttgcctgcgaagaacatccatcccacaaagccgtgtggaatgtccttggaaacctgtctgagatacagggcgaagtcttgtcttttgacggcaatcggaccgacaaaaattacataagactggaggaacttttgactaagcaactgcttgcccttgatgccgtcgacccccagggagaagagaagtgtaaggcggcgcgaaaacaggccgttaggttagctcagaatattttatcctatctagatctgaagtcggacgaatgggagtactag

SEQ ID NO: 23254 - DNA, 1476 bp, Artificial Sequence
  Description of Artificial Sequence: Synthetic coding sequence
atggcccagagcggcggcgaggcccggcccggccccaagaccgccgtccagattcgagtggcgatacaggaagccgaagacgttgatgagctggaagatgaggaggaaggcgccgaaacgagaggggccggggatcccgccaggtacctgagtcccggctggggttcggcgagcgaggaggagcccagtcgggggcatagcggaacaactgccagtggtggggaaaatgaaagagaggatctcgagcaggagtggaaaccccccgacgaggagttgatcaaaaaactcgtagatcaaattgagttttacttctcagatgagaatctcgagaaggacgctttcctcctgaaacatgtgcgacggaacaagctgggatacgtgtctgtcaaactgctgacttcatttaaaaaggtcaaacacttaacgcgagactggcggaccaccgctcacgctttgaagtactcggtggtgctagaactgaatgaggaccaccggaaggtgaggcgcactactcccgtgcctctctttccgaatgagaacctccccagcaaaatgcttttggtgtatgacttgtatctttcaccgaagctttgggcattggctacccctcaaaagaacggtagagttcaggagaaggttatggagcacttgctgaaactgttcggcaccttcggtgtgatttcatcagtccggatcctgaagccgggccgcgagcttccccccgatatccgaagaatttcctcacgatactcccaagtcggcacccaggaatgcgctattgttgagttcgaagaagtcgaagccgccatcaaagctcatgagtttatgatcacggagtcacaagggaaggaaaacatgaaggcggttctcatcggaatgaagcctccaaagaagaagcctgccaaagacaagaatcatgatgaggagcccacggctagtatccatttaaacaagagcctgaataagagggtagaggagctccagtatatgggagatgagagtagcgcaaatagcagcagtgatccagagtccaaccctacaagccctatggctggcagacgacatgctgctactaacaagctgtcgccctctggacaccagaacttatttctcagccccaatgccagcccatgcacctctccatggtcttctcctctcgcacaaagaaagggcgtcagtcgtaagagtccactcgctgaagagggcaggctcaactgctccacaagtcccgagattttccggaagtgcatggattactcatctgattcgtctgtcaccccatcaggatccccctgggtaaggcgccggagacaggctgagatgggtacgcaggaaaaatcccccggcacctccccccttctttctaggaaaatgcaaaccgctgatgggttgcctgtgggcgtgcttcggctaccccgaggccctgacaatactagggggttccatggacatgagcgttcccgcgcctgcgtgtag

SEQ ID NO: 23255 - DNA, 315 bp, Artificial Sequence
  Description of Artificial Sequence: Synthetic coding sequence
atggccggcaaggcccaccggctgagcgccgaggagcgggaccagcttctgccgaatctgcgagcagtaggctggaatgagctcgagggtcgagatgcaatctttaaacagtttcatttcaaagactttaatagggcattcgggttcatgactagagtagctctgcaggcggagaagctagaccaccacccagaatggttcaatgtgtacaataaggtgcacatcacccttagcactcacgagtgcgccggactctccgaacgggacatcaatctggcctcctttatcgaacaggtggccgtcagtatgacctag

SEQ ID NO: 23256 - DNA, 738 bp, Artificial Sequence
  Description of Artificial Sequence: Synthetic coding sequence
atgatcggcgtgagcttcgaggaggccaagagcatcatcaccggcgcgaagctcagcacgaggcttgaatcggcctgggaaattgcattcatccggcagaaatctgataacatacagccagagaacttgagttgcacttctctaatcgaggctagtggggaatatggacctcaggcaagtacgctctcactgtttagctccccaccagagatcctgattccaaaaactagtagcaccccgaagaccaacaatgacatcctgagttcttgtgagatcaaaacaggatacaacaagacagtgcaaataccaatcacctccgaaaatagcaccgttggcctgagcaacactgatgttgcttcagcctggactgaaaattacgggctccaggagaagatctctcttaatccatcagtgcgttttaaggcagagaagctggagatggccctgaactacctaggcatccagcccactaaggaacaacatcaggcccttcggcagcaggtgcaggccgatagcaagggtacggtgtcttttggggactttgtccaggttgcacgcaacctgttctgtctccagttggacgaggtcaacgttggagcacatgaaatatccaatatcctggactcccagctcttgccttgtgattccagtgaagcggacgagatggagcgcctaaagtgcgaacgcgatgacgccctaaaggaagtcaatacgctgaaatggccaggccagaactag

SEQ ID NO: 23257 - DNA, 849 bp, Artificial Sequence
  Description of Artificial Sequence: Synthetic coding sequence
atgggcggcgccgtgagcgccggcgaggacaacgacgagctgatcgacaatctgaaggaggcccagtatatccgaacagagcttgtggagcaggcctttagggccattgatagggcagattactaccttgaggagttcaaggaaaatgcatataaagacttggcgtggaaacacgggaatatccacctttcagccccctgcatttactcggaggtcatggaggccctggacctgcagcccggtctttctttcttgaaccttggcagcgggactggctacctttcttcaatggtgggacttatcctggggcctttcggggttaatcacggggtggaactccatagcgatgtaatcgaatacgcgaaacagaagttggacttctttattaggaccagtgatagctttgataagtttgacttttgtgaaccctcctttgttacaggaaattgcctcgagatcagtcctgactgttcccagtatgatcgggtctactgtggtgccggagtacagaaggagcacgaagagtacatgaagaacctgctcaaggtgggggggatactcgtgatgcctctggaagagaagttaaccaagataaccagaaccggcccttccgcttgggagacaaaaaaaattctcgccgtaagttttgcaccgctaattcagccctgccatagcgaaagcgggaagtcacggttggtgcagttaagatccccgtcattcgtccagggatggtctgttgtggttctaagccagctgactgccgcctccaccttccaggccgaggcaatattacctagccagagcccgacttggcttacactgcaggtccttgcaaccatgcccaattag

SEQ ID NO: 23258 - DNA, 612 bp, Artificial Sequence
  Description of Artificial Sequence: Synthetic coding sequence
atggcccggccccggccccgggagtacaaggccggcgacctggtgttcgcgaaaatgaaaggttatccacattggccagctcggatcgatgagctccccgaaggagcagtcaaacctccggccaacaagtacccaattttctttttcggtacccatgaaactgcatttctggggcccaaagacttgttcccttataaggagtataaagataagtttggtaagtcaaataaacgaaaggggtttaatgaaggcctgtgggagatagaaaataaccctggggtgaagttcacagggtaccaagcgattcagcagcagtccagttccgaaacggagggtgagggggggaacactgccgacgcttcctctgaagaggagggagatcgggtggaggaggatggcaagggaaaaagaaaaaatgaaaaggcaggctcaaagcgaaagaaaagttacacatccaagaagagttctaagcagtccagaaaatcaccgggggacgaagacgacaaggactgcaaggaagaagagaacaagtcgtcatccgaagggggagacgccggcaatgacaccagaaacaccacctcagaccttcagaagactagcgaaggcacgtag

SEQ ID NO: 23259 - DNA, 540 bp, Artificial Sequence
  Description of Artificial Sequence: Synthetic coding sequence
atgaagacccccgtggagctggccgtgagcggcatgcagaccctggggttacaacacaggtgtcgaggggggtaccgggtgaaagcgaggacatcctatgtcgatgaaacactattcgggagccccgccggaactagaccaacaccgcctgattttgatcctccatgggtcgaaaaagccaatcgcacccggggtgtggggaaagaggcatccaaggcactgggggcgaagggatcttgtgagaccaccccttcccgtggaagcaccccgaccttgactcctagaaagaagaacaagtatagacctatctcgcacacaccttcctactgcgacgagtccttatttggatcgaggtcagagggcgctagctttggggcccctaggatggccaaaggagatgccgctaagctaagagctcttctgtggacccccccccccaccccgagaggctctcatagccccaggccgagagaggccccaccccctgttccccccacacagatggggcttcgaatttccggcctgccacggcaggggtag

SEQ ID NO: 23260 - DNA, 1104 bp, Artificial Sequence
  Description of Artificial Sequence: Synthetic coding sequence
atggacggcgaggacatccccgacttcagcagcctgaaggaggagacagcttattggaaagagctttcccttaaatacaaacaatcgttccaggaggctagagatgaattagttgagtttcaggaagggagtagagaactcgaagccgagcttgaggcccagctggttcaagctgagcagcggaatcgtgatttacaagccgacaaccagcggcttaagtatgaagtggaggccctgaaggagaagctggagcaccaatacgcccagagttacaaacaggtcagcgtgcttgaggacgatctcagccagacgcgagctattaaagagcagctccacaagtatgtccgcgaactagaacaggctaatgatgacctggaacgtgccaaaagggctaccattgtaagtttagaggacttcgaacagcgactgaaccaggccatcgagagaaacgcgtttcttgaatcagaactggacgaaaaggagtcgctcctggtcagtgtacagcgattaaaggatgaggcacgcgacctgcgacaggaactggccgtccgggagaggcagcaagaagtgactcggaaatctgctccctcttcaccaaccctcgattgcgaaaaaatggacagtgctgtacaagcctctctcagcctgcccgccactccggtcgggaagggtaccgaaaatacatttccatccccaaaggctattccaaatgggttcggcacgtcacccctcacaccttcagctcggatcagcgccctgaacatcgtcggtgatttgctacggaaggtgggcgccctggaatctaaattggcagcttgcagaaactttgcaaaagaccaagcctctagaaagagttatattagcggcaacgtaaactgcggggtactcaatggaaacggaaccaagttcagccgttctgggcacacctccttttttgataaagggtctagctctagttgcgcgatccgcgcatccagacgccgattttcgtcgtcctctgctgatctggcagggagaggggggggtgacggctcgatcccggcgcaacatagcaccggggcatctggtaaggcccccccccctactctgctactggaaacctag

SEQ ID NO: 23261 - DNA, 591 bp, Artificial Sequence
  Description of Artificial Sequence: Synthetic coding sequence
atgggcagccggagcagccacgccgccgtgatccccgacggcgactcaatccgtagagagaccgggttcagccaggcgagcctcctgcgactgcatcaccgctttcgagctctcgatagaaacaagaagggttacctgagccgcatggaccttcaacagatcggtgcactggcagtgaaccctttgggggataggataatagagagctttttcccggacgggtctcaaagggtggacttccccgggttcgttagggttttagcccatttcaggcccgtggaggacgaagataccgagacacaagacccaaaaaagcccgaacccctgaactcacgacgaaacaaactacattatgccttccagctgtacgacttggatagggacggtaaaatcagccggcacgagatgctgcaggtgcttcgcctgatggttggagtccaagtgaccgaagagcaactggagaatatagccgaccgaactgtacaggaggcagacgaggatggagatggtgccgtgtcctttgtcgagtttaccaaatcgctggagaaaatggatgtggaacagaaaatgtccattagaatcttgaagtag

SEQ ID NO: 23262 - DNA, 2313 bp, Artificial Sequence
  Description of Artificial Sequence: Synthetic coding sequence
atgttccggtacgagagcctggaggactgccccctggacgaggacgaagacgctttccagggacttggcgaggaagatgaggaaattgaccagttcaatgatgacacctttggtagcggagccgtggacgacgattggcaggaggcacacgagcggctggcggagctggaggagaagctgccggttgcagttaacgagcagacgggaaatggagagcgagatgaaatggatctgctcggagaccatgaagagaacctggctgagcgcttgtccaagatggtcatcgaaaatgaattggaggaccctgcaattatgagggccgtccaaacgagacctgtcctccagccacagcccggaagcctgaattcctcaatatgggatggctccgaagtgctcaggcggattaggggccccttgctggcacaggagatgcccacagttagcgtcctcgagtatgctctgccacagcggccaccacagggtccagaagacgaccgtgatctgagtgagcgtgctctgcctcggcgttcaacttcacccattattggatctccacccgtccgtgcagttccaatcggcacaccccctaagcagatggcggtgccatcattcactcaacagatcctgtgccccaaaccggttcacgtgcggccgcccatgccaccacggtacccagctccgtacggggaacggatgtcccctaatcaactctgcagcgtgcccaactcatctctgttaggacacccttttcccccaagtgtccctcccgtactttcaccacttcaacgagctcagcttttgggcggcgcccaattacagccaggaagaatgtcgccctcccagttcgccagagtgcccggttttgtggggtctccactggcggcaatgaaccctaagctgctccaaggccgcgtcggccaaatgctgccgcccgcaccgggcttccgggcttttttctccgcccccccatccgcgaccccccctccccagcagcaccctccaggaccagggccacatttacagaatttgaggagtcaggctcccatgtttagacctgacactactcacctgcatccgcaacatcggagactgcttcaccagcgacagcaacagaatcgatcccagcataggaaccttaacggtgccggggaccgggggtctcacaggtcaagtcatcaggatcaccttcggaaggacccctatgcaaacttaatgctgcagagggagaaggactgggtgtccaagattcagatgatgcagctgcagagcactgatccgtatttggacgacttttattaccagaattacttcgagaagctggaaaaactctcagcggccgaggagatccagggtgacggtcctaagaaggaacgaaccaagttaatcactccacaggtggcaaaacttgagcatgcatacaagccggttcagttcgaagggagcttgggcaaactgaccgtgtcctcagtgaataacccccggaaaatgattgatgctgtagtgacaagtagaagtgaggatgacgagacaaaggaaaagcaagtaagagacaagcgccggaaaactctagtcataatcgaaaagacatattcattattgctcgacgtggaggactatgagcggcgctatctgttatccctcgaggaagaacgcccagctctcatggatgatcgaaagcacaaaatttgcagtatgtatgataatctgcggggcaaattgcctgggcaagagcgcccatcagatgaccactttgtacagatcatgtgcattcggaagggcaagcggatggtcgccagaatcttgccattcctgagcaccgagcaggctgcagatatcttaatgacaactgctaggaacctcccgttcctgatcaaaaaggacgctcaggatgaggtactgccctgcctgcttagtccgttctctcttttattatatcacctgccttcggtgtctataacttccctgctccggcagttaatgaatctcccgcaaagtgctgccacaccagctttgtctaatcctcacctgactgccgttctacagaacaagtttgggctgtctctactactaatacttctctccaggggggaggacctccaaagttcagaccccgctactgagtctactcagaacaaccagtggactgaagtgatgtttatggccacccgggagctgctgcggatcccacaggccgccctggcaaagcctatatcaatccctacaaacttggtttctctattttcgagatacgttgaccgccaaaaactgaatctgctggagactaaattgcagttggtgcagggaattaggtag

SEQ ID NO: 23263 - DNA, 1518 bp, Artificial Sequence
  Description of Artificial Sequence: Synthetic coding sequence
atgcggctgcggcggctggccctgttccccggcgtggccctgctgctcgccgcggctcggttggctgctgcttccgacgttctggagctaacggacgataactttgagtcacgcatctccgatactgggtctgcaggactcatgctggtggagttcttcgccccatggtgcgggcattgcaaaagactcgcacccgagtacgaagcggcagctaccaggttgaagggaatcgttcccttggcaaaagtggactgcaccgctaacaccaatacttgcaacaaatacggagtttccggttaccctaccctgaagatattccgtgacggcgaggaagcaggggcctatgacggtcctcgaaccgccgatggaatagttagccatctaaagaagcaggccggtcctgcttcggtgccactcagaacggaggaggaatttaagaagttcatatctgacaaagacgcctctattgtgggattttttgatgattccttttctgaagcacacagcgagtttctaaaagccgcctccaacttgagagacaactataggtttgcccacacgaacgtggagtctttagtgaatgagtatgacgataacggcgaaggtatcatcctgttccgcccgtctcacctaacaaataaatttgaggacaagacggtggcatataccgagcaaaagatgacgagtggtaagataaagaagtttattcaggagaacatcttcggaatctgcccacacatgacggaggacaataaagatctcattcaggggaaggatctgctgattgcttactacgacgtggattatgagaaaaatgccaagggatctaactactggagaaacagggtcatgatggtcgccaaaaaatttctggacgccggtcacaagctgaactttgcagtggctagcaggaagaccttttcccacgagctatctgatttcgggcttgagtctaccgcaggggagatcccagtggttgccattcgcacagctaaaggcgagaaattcgtgatgcaagaagaatttagcagggacgggaaggcactcgagaggttcttgcaagactactttgacggcaaccttaaacggtacctgaaaagtgaaccgatccccgaatccaacgatggtcctgttaaagtggttgtggccgagaattttgacgaaatcgtcaacaacgagaacaaggacgtgctgatagaattctatgccccttggtgcgggcattgtaaaaaccttgaaccaaaatacaaagaactaggggaaaagctatctaaggaccccaacatcgtgatcgccaaaatggacgccaccgctaatgacgtgccttctccctacgaggttaggggctttcctacgatctacttcagcccggcaaacaaaaaactgaatccgaagaagtacgaaggcgggcgagaactgagcgatttcatttcatatctccagcgagaggctactaaccccccggtgatccaggaagaaaagcctaaaaagaagaagaaagctcaggaggatctgtag

SEQ ID NO: 23264 - DNA, 684 bp, Artificial Sequence
  Description of Artificial Sequence: Synthetic coding sequence
atgagcgtggtgccccccaaccggagccagaccggctggccccggggagtgactcagttcggaaacaaatatattcagcagactaagccactgacattggagcgaactattaacttgtatcctcttaccaattatacttttggtaccaaagagcctctatacgaaaaagattcatcagtggcggctcgctttcagcgaatgcgagaggagttcgacaagattggcatgaggagaaccgtagaaggagttctgattgtccatgagcaccggttaccccacgtgctcctcttgcaacttgggaccactttctttaagctgccaggaggagaactcaaccccggtgaggacgaggtggaagggctaaaacggctgatgacagagattctagggaggcaggacggcgtcctccaggactgggtgattgacgattgcatcggtaactggtggaggccaaatttcgagcctccccaatacccctatattcctgctcatatcacgaaaccgaaagaacataaaaaactgttccttgtacagttgcaggagaaggccctcttcgctgtcccaaagaattacaaactggtagccgctccgctcttcgaactttacgataacgcccccggttacggccccattatctcgagcctcccacagcttctctcccggtttaatttcatatacaactag

SEQ ID NO: 23265 - DNA, 2244 bp, Artificial Sequence
  Description of Artificial Sequence: Synthetic coding sequence
atgagccaggtgaagagcagctacagctacgacgcccccagcgacttcatcaacttctcctccttggatgatgaaggagacacgcagaatatcgattcctggtttgaggaaaaagctaacctagaaaataagcttctgggcaaaaatggaaccggcgggttgttccagggcaaaacacccttgcgcaaggccaacctgcagcaggccatcgtgaccccattaaaaccggtggataatacatactataaggaggctgagaaggagaatctggtggaacaatcgataccctccaatgcttgttcctcactggaggtagaggccgccattagccgaaagacgcctgctcagccacaacggaggagtctccggttgtcggcacagaaagacctggagcagaaggagaagcatcacgtgaagatgaaagccaagcggtgtgccactcccgtgatcatcgatgaaatcctcccaagcaagaagatgaaggtctcaaataacaaaaaaaagcctgaggaggaaggcagcgcccaccaggacacagcagagaaaaacgcatctagccctgaaaaggccaaaggacggcataccgtgccatgcatgccgcccgctaagcaaaaattcctcaagtctactgaagagcaagaactggaaaagtcgatgaagatgcagcaggaggtggttgaaatgcggaaaaaaaacgaggagtttaagaagctggctctggccggtatcggccagcctgtcaagaaatccgtgtcccaagtcacaaagagcgtggattttcacttccgcacagacgaacgcatcaagcaacaccctaaaaatcaggaagagtacaaagaggtgaattttacaagtgaactccgaaaacacccaagctcacccgctcgagtgacgaaaggatgcaccattgtcaagcccttcaatctttcccaaggtaaaaagagaacctttgatgagactgtgtccacctacgttccgctcgcgcagcaggtagaggatttccacaagaggacaccgaataggtatcatcttcgttcaaagaaagatgacatcaatttacttccatccaaaagcagtgtaactaagatatgcagggatccccaaacccctgtactgcagaccaagcaccgtgctcgcgctgttacctgcaagtcaacagctgagctcgaagcagaggaacttgaaaagttgcagcagtacaaattcaaagctcgggagctggatccaagaatactagagggcggaccgatcctccctaaaaaacctcctgtgaagcccccaacagaacccatcggttttgatctcgagatagagaagaggatccaggagcgggaaagcaagaagaaaaccgaggatgagcacttcgaattccacagccgtccttgcccaacgaagatcctggaagatgtagtcggggtccccgagaagaaggttctgcccatcaccgtcccgaagagcccagcattcgcacttaaaaatagaatccgaatgccgacaaaagaggatgaagaggaggatgagccagtggtcattaaagcgcaacccgtgccacattatggagtccctttcaaaccccagatccctgaggcaaggacagtagagatttgcccttttagcttcgactcccgagataaggaacgccagctgcagaaggaaaagaagataaaggagctgcagaaaggagaggtgcctaaatttaaggccctgcctctgcctcattttgacactattaatttgccagaaaagaaggtaaaaaacgtgacacagatcgagcccttttgcttagagaccgacaggaggggtgctctgaaggcccagacctggaaacaccaactggaggaagagctgcggcaacagaaggaagctgcatgcttcaaagccagaccaaacaccgtgatatctcaggaaccgttcgttcccaaaaaggagaagaagtctgttgctgagggactgtctggctcactggtgcaggaacccttccaattggcaacagagaaaagagcaaaggagcggcaggaactagagaagagaatggcggaggtcgaggcccagaaagctcagcagctggaagaggctagactgcaggaagaagagcagaagaaggaggaattggctaggctccgtcgcgagctggtacacaaggctaaccccatcaggaagtatcagggtctggaaattaaatcctctgaccagcccttgactgttcctgtgtctccaaagtttagtacccgattccactgttag

SEQ ID NO: 23266 - DNA, 360 bp, Artificial Sequence
  Description of Artificial Sequence: Synthetic coding sequence
atgaagctggtgcggttcctgatgaagctgagccacgagaccgtgactatcgaattgaagaatgggactcaagtacacggcacgattaccggggtggacgtctcgatgaatacacacttaaaggctgtgaaaatgacactgaaaaaccgcgagcctgtacagttggaaaccctcagcataagagggaacaacatacgctattttatactgcccgattccctccctcttgacacactcctagtagatgtggaaccaaaggttaagagtaagaagcgggaagcagtggccgggcgcgggcgagggagagggcgggggcgcgggcgcggcaggggacgaggacgtggaggcccccgcaggtag

SEQ ID NO: 23267 - DNA, 555 bp, Artificial Sequence
  Description of Artificial Sequence: Synthetic coding sequence
atgatgggcgccagcaccctgcaggagcccgccctgagccccggcaggtgtccccgccagcctctgaggtcaaaatttggccatcaaggctctaccgtccagaggaaatgctcgaagacaaatgccctcaacgtctcacaaaaaatgatagagatgtttgtcaggacaaaacacaagatcgataaaagtcatgagtttgcactcgtcgtagttaacgacgacactgcatggctcagcgggctgacttccgaccctcgggagttatgctcctgcctatacgatttggagactgcatcctgctccacattcaacatctcgggggccagcccggcacggcaacaaaagaccgagttgcctgttactgagaacgtgcagactatacctcctccatatgtggtcaggaccatcttagtctatagcaggccaccctgtcagccccaattcagtttgacagaacccatgaaaaaaatgtttcaatgtccctatttcttctttgatgtggtgtatattcataacggtacagaggagaaggaggaagaaatgtcctggaaatag

SEQ ID NO: 23268 - DNA, 1203 bp, Artificial Sequence
  Description of Artificial Sequence: Synthetic coding sequence
atggccagcgagaagcccctggccgccgtgacctgcaccgcccccgtgaacatcgctgttataaagtattggggtaagcgggacgaggagttggttctcccgatcaactcatcccttagcgtgacactccatcaggaccagctgaagacaacaacgaccgccgtcataagcaaagattttaccgaggacagaatctggctcaatgggcgcgaagaggacgtgggacagccccgattacaggcatgcctacgggaaattcgctgtctcgcacgaaagcgtaggaattcccgggacggggatccactcccatcatcgctgagctgtaaagtgcacgtcgcgtctgtcaataacttccccacagcagctggcttagcgagctccgctgcagggtatgcatgtcttgcatatactctcgcgagggtgtatggcgtagagtcagatttgagcgaggtggcaaggaggggttctggaagtgcctgcagaagcctgtacgggggcttcgtggagtggcagatgggagagcaagcggatgggaaggactccattgcgcgccaggtagcacccgagagccactggcctgaactccgcgtcctgatcctcgtggtgagcgccgagaaaaaactcaccggctcgactgtcggcatgagggccagcgtggagacctctcctcttctaaggtttagggcagagagcgttgtacctgctagaatggccgagatggcgcgttgtatccgagagcgtgattttccttcctttgctcagctgacaatgaaagattctaaccaattccatgctacctgtctggacacgtttccacctatctcctacttgaacgctatcagctggaggattatccatctggtgcaccggttcaacgcccatcacggcgatactaaagtggcctatacatttgatgccggcccgaacgccgtgatcttcactcttgatgacactgttgcagagtttgtagctgctgtgtggcacggcttcccaccaggcagtaacggagataccttcctgaaagggctccaggtgaggccggccccgttgtctgcagagctgcaagccgccctggcaatggagcctacaccaggcggagtgaaatacataattgttacacaggtcgggcccgggcctcagatcctagatgacccatgcgcccacctgctgggacctgacgggctgcctaagccagccgcctag

SEQ ID NO: 23269 - DNA, 1350 bp, Artificial Sequence
  Description of Artificial Sequence: Synthetic coding sequence
atgcgggagtgcatcagcatccacgtgggccaggccggcgtgcagattggaaacgcctgttgggagctctactgtctagaacatgggatccaacccgatggtcagatgccatcagacaaaactatcggcggcggtgacgactccttcaatactttctttagcgaaacaggcgctgggaaacacgtgccccgcgccgtgttcgtggatttggagcctacagttattgatgaggtgcggaccgggacttaccgccaactctttcacccagagcagttaatcacaggcaaagaagatgcagcgaacaattacgcaagaggtcactatacaattgggaaggaaatcatcgacctggtgctcgacaggattcggaagctggccgatcagtgcacaggcctccaggggttcctggtgttccactcattcggtggcgggacaggttctggatttacatctctcctgatggaaagacttagcgtggactacggtaaaaagagcaaactggaattcagtatctatccagccccccaagtgagtacagccgtggttgaaccctacaattctatcttgactactcatactactctggaacactcggattgtgccttcatggtagacaacgaagcgatttatgatatctgcagacggaatctggatatcgagcgccccacctataccaatcttaatcggttgatttcacaaatagttagctcgataaccgctagcctgcgattcgacggtgcgctaaatgtggatctcaccgaattccagacaaatcttgttccttatccaaggattcacttccctcttgccacctacgctccggtgatctcagcagaaaaagcgtatcatgagcagctaaccgttgcagagatcactaacgcttgttttgagccagcaaatcagatggtcaaatgcgacccgcgtcacggaaagtatatggcttgctgcttgctctatagaggagatgtggtacccaaagacgtgaacgccgcaatagccacaataaagacgaaacggaccattcagtttgttgattggtgccccactggcttcaaagtcggaatcaattaccagccgcccactgtcgtgcctgggggagatcttgccaaagtccaacgggccgtttgcatgctgagcaacaccacagccgtggcggaggcatgggctagactcgatcacaaattcgatctgatgtatgcaaaaagggcctttgtgcattggtatgtcggcgagggaatggaggagggtgaattttcagaggcccgggaggacatggccgcccttgaaaaggattacgaagaggttggagccgatagcgcggatggtgaggatgagggcgaagagtactag

SEQ ID NO: 23270 - DNA, 1365 bp, Artificial Sequence
  Description of Artificial Sequence: Synthetic coding sequence
atgagcaccttccggcaggaggacgtggaggaccactacgagatgggcgaggagctgggcagtgggcaatttgcaatcgtgagaaaatgtagacaaaagggaactggaaaggagtatgcagccaaatttatcaaaaagcggcggctgtcatccagccgtcgcggtgtgagcagggaggagatagagagagaggtgaatatcttaagggagatccgacaccccaatataatcacactccacgacatcttcgaaaacaagaccgacgttgtactcatcctcgagctcgtatcgggaggtgagctgttcgactttcttgctgagaaggaatccctgactgaggacgaggccacacagttcctgaagcagatcttagacggggttcactacctccacagcaagcggatcgctcactttgacttaaagcccgagaatatcatgctcttggataagaatgtccccaatccacggataaagctcatcgactttggtattgcccacaaaatcgaggctggcaatgagttcaagaatatcttcgggacccctgagttcgtggccccagagatcgttaattatgagccattgggactggaggccgacatgtggagcatcggcgtgatcacttacattctgctgagtggagccagtccctttctgggggagactaaacaggaaaccctgaccaatatctctgccgtgaactatgacttcgacgaggagtacttcagcaatacttcagaactggctaaagactttatccggcgtttgctggtgaaggacccaaagagaaggatgactattgcccagagccttgagcacagttggataaaagctattagaagacgaaacgtacgaggcgaagacagcggaagaaagcccgaaaggcgcaggctcaaaacaactcgcctgaaggagtatactataaagagtcattctagcttgccacctaataacagctacgccgatttcgagcggtttagcaaagtgctcgaggaggccgccgccgctgaagaaggtctgagagaactgcagaggagccgccgtctgtgtcatgaggatgtagaggcactcgccgctatttatgaggagaaagaggcgtggtaccgcgaggagagtgactcgctggggcaagatctccgaagattgcgccaggaactgctgaagaccgaggctctgaaaaggcaggcccaggaggaggccaaaggcgccctgctgggcacatctggcctgaagcggaggttctcacgcttagagaatcgttatgaggccctggccaagcaggtggcgtccgaaatgagatttgtgcaggatcttgtacgggctcttgagcaggagaaactgcagggcgtagagtgtggcctcaggtag

SEQ ID NO: 23271 - DNA, 1326 bp, Artificial Sequence
  Description of Artificial Sequence: Synthetic coding sequence
atgaagaagttcttccaggagttcaaggccgacatcaagttcaagagcgcagggcctggacaaaagctaaaagagtctgtgggtgagaaggcccataaagagaagccgaaccagcccgctcctagacccccaaggcagggtcctaccaacgaagcacaaatggcagccgcagccgcactggctcggttagaacagaaacagtcacgcgcttggggacccacctctcaagatacaattagaaaccaggtgagaaaagaattgcaggcagaggcaacagtgagcggaagtcctgaagccccaggcaccaacgttgtttcagagccacgcgaagaaggctctgcccatctggctgtgccaggagtctatttcacctgcccactcacaggggccacccttagaaaggaccagagggacgcctgcatcaaagaggccattcttctccacttcagcactgatccagtcgccgcgagcatcatgaagatatacacgttcaacaaagaccaagaccgggtcaagctgggtgtcgacaccatagcgaaatacctcgataacatccacctgcaccctgaggaagaaaaataccggaaaatcaaactgcagaacaaagtttttcaagagcgaatcaactgtctggaaggaacgcatgagtttttcgaagccataggctttcagaaagtcctcctgcccgctcaggaccaggaggaccctgaggagttttacgtcttgtctgaaaccacgttggcccagcctcagagtctggaacggcataaggaacagctgctggcagcggaacctgtgagggcgaaacttgacaggcaacgacgggtcttccagccatcaccgctggcaagtcaattcgagctccctggtgatttttttaatctcacggcagaggaaatcaaaagagagcaacggctccgatccgaagcagtggagcgcttgtcggtcttgcggactaaggcgatgagggagaaggaggagcagcggggtttgaggaaatacaactatacactgctcagagtccgtctgcctgacgggtgtctcttgcagggcacattctatgctagggagcgacttggagcagtgtatggatttgttcgcgaggcccttcagagcgactggctaccctttgaactgctagccagcggagggcagaaactgtccgaagacgagaacctggccctcaacgagtgtggcctcgtaccctcagctctcctcactttctcttgggacatggcagtgctcgaagacattaaggctgctggggctgaacccgactcgattctgaagccggagcttctgtcggctattgaaaagctgctctag

SEQ ID NO: 23272 - DNA, 900 bp, Artificial Sequence
  Description of Artificial Sequence: Synthetic coding sequence
atgcgggacctgctgctgcactggggccccggcccccccatccgggccccacaggaggaagccgaagcactgctggaactgcagggccgcctgcaagaggcacaggacaccacagaggcacttcgcgcgcagctaggtgtgcaggaggtacagctccaaggactgcagggcgccctgcaacagttacaacaggagaccgaacagaactgcagacgcgagctgcagcagatgcacggccagctcgccgggctgcgcgctagaatggccagcctacgccaggggtgcggagacttgaggggtcttgtcagcaccttcacgcagtcttgccaggggtctctgtcagaggcccggggccaggtcagctgggccctgggcgctctctcttcggggggtccaggcacacagttgccagagggccagcagggtccgcctgcgggctgccctggacgcctcccggagctcaaaggaaatattagagtgctgtgtcggttgaggcccggcacaagctcgagcctggtaagtgttgaaccggggcctggcggcacagttactacctgttatcgcgggaggcatcgaaggtttcgcctcgactgggtgtttcccccggatgccagtcaggaggaagttttcagagaactggaacccgcggtgctgagctgtcttcggggatattctgtttgcatttttacctacggccaaacaggaaccggaaagacctacagcatggaaggcccacctgaagatcccgggattgtaccaagagcgctgcagagcttgtttagagaaatgggggccggccgccaacaccgaaggtaccacggacgctgcctgtcaccagctgagtcacctgaacacccaagacccgggttgcccccttgcagagcaagatctccactgtag

SEQ ID NO: 23273 - DNA, 2517 bp, Artificial Sequence
  Description of Artificial Sequence: Synthetic coding sequence
atgtacgccttctacagcctgctgatctacatcttctacagcctgtttcgcagagacggaggggctgctgccgctgccgaaccaggcgatcctgcccagcgcgccaggaagcctcgcgggcgcaggcggccggatttgcctgcacccgagctgtggaccgagcttaccgggctcgctgctagctccgagcccgaggacgggtccgaaggcgcggccgaaggcagagctgcagccgtgtcattggaagaggccctgttaaggctcgccgaattcttatcagtgcaactaggggcagaggaaagctgtggggggcccgctgacctgggccagtcaggcgaagtgccaagtttgctgacggtgacaagccagctgctggcactgctcgcttggcttcgatcacccaggggccgccaagctctcttacagggcactcagccggcacccagagtgcgcccgcccagtcctgacgggtccacaagtcaggaggaaagcccttctcactttactgccgttccgggcgaacccctaggagacgagactcaaggccagcaaccgctgcagctcgaagaagaccaaagagcatggcagagactcgagcaactcatcctggggcagttagaagaactaaaacagcagctagagcagcaggaggaggaattgggcagattgcgcctcggagttggagcaaccgactcggagaagagagtgcagcacttgacgcttgagaatgaggcccttaagcagtctttaagtctgatgagggacctactgcttcattggggcccaggccccccgattcgtgcgccccaggaggaagctgaagctctcctcgagctgcagggacgattgcaggaagctcaggatacaacagaagcattaagggcccagttgggagtccaggaggtgcagctgcaaggcctgcagggtgcactgcaacagctgcaacaagagactgagcagaactgccgcagagaactgcagcaaatgcatggacaacttgcggggctaagggcacgaatggcttccctccgccaagggtgcggggatcttcgcggcttagtgagcactttcacacaatcctgccaaggctctctgagtgaggctagaggccaggtgagttgggctctcggcgccctgtcttccgggggccccgggacccagctgcctgaagggcaacaagggccgcccgcagggtgtcctggacggctgcctgagctgaaaggtaacatcagggtgctgtgccggctgcggcccgggacctccagttctctagtttccgttgagcctgggccaggtggcaccgtgacgacctgttaccggggacggcatcggagatttcggctggattgggtgtttcctccagatgctagccaggaggaggtattcagagagttggagcccgccgtactgagttgtctgcggggttacagtgtatgtatctttacctacggtcagactggaacagggaagacgtactccatggagggccctcctgaagaccctggcattgtccctcgagccctacagagcttgtttcgcgagatgggtgcgggacggcagcacagagtcaccctttccatggtggaaatttacaatgaggcagtgagggatctccttgccccggggccccctgaacggctggcagtgcggcagggcccagaaggccagggcggcattcaggtggccgggctgactcactgggacgtgcctaatcttgagacgctccaccagatgctaaaactgggtagaagcaatagagcaactgctgctacagctatgaaccagagaagcagtcgatcgcacgctctggtgacactgactctaagagccgcatctcccccgcgggctcctggcacagccggcacactgcacctggtggatctggcaggcagcgagagagcccgtaaggcgggcgcagccggacctcctcgaggggatccagatggggctcgaagattgagagaggcccagactatcaatagaagcctcctggccctcgggggtgttatggctgctttgcgagcccatcgcccacatgttccttttcgtgactctcagctgacgagactgctccagcctgcactgggaccagggaccacagctgtactcctattacaggttggagctggggcagggcaggtgtgtgcttgccgaagtcccccaactcgcgcaagaccacccgcccccctcgcgaggcgttccccacgcgggcgtcgaatttccggccggcagagtgcgcccagtagcagcccaaccgagtgggtaaagtggtcttggggccagccaggcgctgccgggtccagggccccaccaggaagactgctcccaagcgcacctactctgcggagccccggcccacctgcccctctccgccgcccactcgctgtgctgcatgctccagtacctacaacggccagggccaggctgtctcggccacaaagagcttgtccaagttcgcccggcagccgaccctgcccctgggggctcaggcctgggttatgttggcaacggcggtag

SEQ ID NO: 23274 - DNA, 597 bp, Artificial Sequence
  Description of Artificial Sequence: Synthetic coding sequence
atggccagcggcaacgcccggatcggcaagcccgcccccgacttcaaagcaacagctgtggtagatggcgcctttaaagaagttaaattgtctgactacaaagggaagtatgttgtgctgttcttctacccccttgacttcactttcgtctgcccgaccgagatcatcgctttctctaatagagccgaggatttccgtaagctgggttgcgaggtcctgggtgtgagcgtcgatagccagtttacccacttggcatggattaacacaccacggaaagaaggcgggctaggacctttgaacatcccacttctggcagacgtcacacgccggctctcggaggactacggcgtcctgaagactgacgagggcattgcttatcgaggactgttcattatcgatggcaaaggcgtgttgcgccaaataacagtgaatgatctcccagtggggaggtctgtcgacgaagccctccgcctggtccaagccttccagtatactgatgaacatggcgaggtctgtccagccgggtggaagccaggttccgatactattaaacccaatgtcgacgatagcaaggaatacttcagcaagcacaactag

SEQ ID NO: 23275 - DNA, 1380 bp, Artificial Sequence
  Description of Artificial Sequence: Synthetic coding sequence
atgagcgtgcggttcagcagcaccagccggcggctgggcagctgcggcggcactggtagcgtgcgcttgagttcagggggagcaggtttcggcgctggaaacacctgcggcgtgcccggcatcgggtctggattctcgtgcgccttcgggggttcttcatcagccggcgggtacgggggcggccttggcggtggatcagccagttgcgccgcattcacgggcaatgaacacggcctgctgtcaggcaatgaaaaagtcaccatgcagaacctgaacgatcgtctggcaagctaccttgagaatgttcgtgccctggaggaggccaatgcagacctcgagcagaaaatcaaagggtggtatgaaaagttcgggccgggttcctgtaggggcctggaccatgactatagtcggtattttcctatcattgatgaactgaaaaatcagataatcagtgccaccacaagcaatgcccacgtcgtgctgcagaatgacaatgccaggttgacagctgacgacttcaggttgaagttcgagaatgagctggctctgcaccagtcagtcgaagcagatatcaacggactgagaagagtgctggatgagttgacgctctgtcggaccgacctggagatccagctggagaccctttccgaggaactggcatatctcaagaaaaatcacgaagaagagatgaaagcattgcagtgtgctgccggtgggaacgtgaacgttgaaatgaatgcagcccctggagttgaccttactgtgctgctcaacaacatgcgggcagaatatgaggcattggccgagcagaatcgcagagacgccgaggcatggtttaacgagaagtcagcctctctccaacaacagatctccgatgatgcaggtgctacaacatctgcgagaaacgagctaattgagatgaaaaggaccctgcagacgctggagattgagttgcagagtctcctggcgactaaacactccctggagtgttccttgacagaaactgaatctaactactgtgcccagctggcgcagattcaggctcagataggcgctctggaagaacagctgcaccaggtaagaacagaaaccgaaggacagaaacttgagtatgagcagctgctggatattaaggttcaccttgagaaagaaatcgaaacatattgtctgctgatcgatggcgaagacgggtcatgctccaagtccaagggttacgggggcccagggaaccagacaaaggactccagcaagacaaccatcgtcaagaccgttgttgaggagatcgacccgcgcgggaaggtcctgtcgtctcgggtccataccgttgaggagaagagcaccaaggtcaataataaaaatgaacaaagggtaagctcttag

SEQ ID NO: 23276 - DNA, 834 bp, Artificial Sequence
  Description of Artificial Sequence: Synthetic coding sequence
atgcccagcgtgagcaaggccgccgccgccgccctgagcggcagcccacctcagaccgaaaagcctacccattataggtatttgaaggagttcagaacagaacagtgccccctcttttcacaacacaaatgcgcccagcataggcccttcacatgctttcactggcacttcctcaaccagcggcgcaggcgacctctacgtcgccgcgatggtacatttaattattcacctgatgtctactgttctaaatataacgaagccacgggtgtgtgcccagacggggacgaatgcccgtaccttcatagaaccaccggggatacagaacggaaatatcaccttcgctattacaagactggaacatgtatccacgaaaccgacgcccgcggccactgcgtgaaaaacggacttcactgtgctttcgcccatggacccctggatctacgccctccagtttgcgatgtaagagagctccaggcccaagaggcccttcaaaatggacaactgggcggaggcgagggtgtacccgacttgcagcctggagttctggccagccaagctatgatagagaaaatattatccgaggacccgcggtggcaggacgccaattttgtgttaggaagctacaaaaccgaacaatgtccgaaaccccccaggctttgtaggcagggatacgcttgcccgcattatcacaacagccgtgaccgccgcaggaacccaagacggttccagtactcatggcagctcgggaggcgggtactgcgcctgtcacccagggccaataatccccgtgtcgctctccctagggttcacacaggaccctcgtcgacagcttag

SEQ ID NO: 23277 - DNA, 918 bp, Artificial Sequence
  Description of Artificial Sequence: Synthetic coding sequence
atggacctgagcggcgtgaagaagaagagcctgctgggcgtgaaggaaaacaataagaaatctagcacccgagcacctagcccaaccaagaggaaagacaggtccgacgaaaagtccaaggaccgctccaaggacaagggcgccacaaaagagtcctctgagaaggacagaggacgagataagacaagaaaacgaagatccgctagcagcggtagttcgagtacccgcagccggagttcttccacttcatcatctgggagctcaacttcaactggaagctccagcggctcctcaagctcttccgcttcctcccgctccgggtctagtagtacctccagaagcagttctagcagtagtagcagtggcagcccaagtcctagtcggagaagacacgacaatagaaggcgttcccggagcaaatcgaaaccaccgaagagagatgaaaaagaaaggaaacggaggtctccctccccgaagcctactaaagtgcacataggccggctgacccggaatgtgaccaaggatcatataatggaaatcttctccacctatggcaagattaagatgatcgatatgcctgtcgaaagaatgcatccccatctgagcaagggctacgcctatgtcgagttcgaaaaccctgatgaggcggaaaaggccctgaagcatatggacggcggacagatcgacggtcaggagattactgctacagcagtactggctccatggcctcgtcccccgccccgtcggttttcgcctccaaggcgcatgctgccccctcctcctatgtggaggcgcagccccccgcgtatgagaagaaggtcgagatcacctcgacgtaggtctcctgtaagacgcagatctaggtcacctggtcgcagaagacataggtccagaagctccagcaattcttcccgctag

SEQ ID NO: 23278 - DNA, 3198 bp, Artificial Sequence
  Description of Artificial Sequence: Synthetic coding sequence
atgcggaagcaggaggtgcggaccggccgggaggccggccagggccatggaaccggaagccctgccgaacaggtaaaggccctaatggacctgttggcaggaaaagggtcacagggctcacaggccccacaagcactggatagaacgccagacgcgcctctcggcccgtgtagtaatgactccagaattcaacgacaccggaaggctttgttgtctaaggtgggagggggccctgaactgggaggtccttggcaccggctagcctccttgctgctggtagaagggctcactgatttacagctgagagagcacgattttacccaggtcgaagctaccagaggcggtggacacccagcccgcaccgtggccctggacaggctcttccttcctctaagcagagtctctgtgccacccagagtgagtatcaccattggggtggctgggatgggtaaaacgaccctggtccgccatttcgtacgactgtgggcccacggtcaggtgggaaaagattttagtctcgtcctaccgttgacttttagagatctgaatacccatgagaagctatgcgcagatcgtctgatctgctctgtcttcccacacgtgggagagcccagcctggccgtggcagtgcccgcccgcgctttgctcatccttgatggcttggacgagtgtaggacaccgctcgatttcagtaacactgtcgcctgtactgaccccaagaaggaaattcccgttgaccaccttatcacgaatataatccggggcaatctgtttccggaggtgagcatatggatcaccagtaggccttccgccagcggtcagattccagggggcctcgtggaccgcatgacagaaatccggggctttaatgaagaagaaattaaggtttgcctagagcagatgttcccggaagaccaggcactcttagggtggatgctctcacaagttcaggcggatagagccctttatctcatgtgtactgtgcctgccttctgtcgactgaccggaatggccctcggccacttatggcgcagcaggactggccctcaggacgcagagctgtggccgccaaggacgctctgtgagctctattcatggtacttcaggatggctctgagtggggaggggcaagagaagggcaaggcgagcccccggatagaacaggtggcacacggtggaaggaaaatggttggcaccttgggacgtcttgctttccacggactgctgaaaaagaagtacgtattttacgagcaggacatgaaagcctttggagtcgacctggccctcctccaaggagctccctgtagctgctttttacagcgggaggagacactggcatcctccgttgcgtattgcttcacccaccttagtctgcaggaattcgtggccgctgcatactattacggagcatctcggcgggctatcttcgacctgtttacggaatccggagtgagttggccaagactgggatttttgacacatttccgcagtgcagcccagcgagctatgcaggctgaggacggaagattagacgtgttcctcaggtttttaagcggtttattgtctccgcgggtgaatgccttattagcaggtagtcttttggcccagggagaacaccaagcctaccgtacccaagttgccgaactgctacaggggtgtttgcgaccggacgcagcggtatgcgcacgggcaattaacgtcctgcactgcctgcacgaacttcagcatactgagctggcaaggtccgttgaggaggccatggaatctggagccctggctaggttgaccggccccgctcaccgtgcggcattggcctatttactccaggttagcgatgcttgtgcccaggaggcaaacctctcattgagtttatcacagggcgtactccagtctctgctacctcaacttctgtactgccggaagctccgattggataccaaccaattccaggacccggtgatggagcttctcgggtccgttctctcaggcaaagactgcaggattcagaagatttctttagctgagaaccagatctcaaataaaggggccaaggctcttgctaggtcccttttggtaaatcgcagcctaactagcctggatttgagaggaaattccatcggcccccaaggtgcaaaggcactggcagacgcactgaagattaatcggactttgacaagtttaagtttgcaggggaacaccgtgagagatgatggagctcggtctatggcggaagctctggcaagcaatcggacgttaagtatgctgcacttgcagaaaaatagcataggccctatgggagcccaacgaatggctgacgcccttaaacagaatcgatctcttaaggagttaatgttctctagtaattcaattggcgatggcggggccaaggccctagcggaggcccttaaagtcaatcagggactagaatcattagaccttcaatccaatagtatttctgacgcaggagtagctgctctcatgggcgccctgtgtacgaaccagacactgttatctctgtccctgagggagaattctatctctcccgaaggcgcccaggcaatagctcacgcattgtgcgctaatagcaccctcaagaatctagaccttactgctaatctgttgcacgatcagggggctagggcaattgccgtggcagtacgggaaaatcggactctgactagcctgcacttacaatggaactttatacaagccggtgccgcccaggctctgggtcaggcccttcaactgaacagatccctgacttccctggaccttcaggagaatgctattggagatgatggggcttgtgccgtggcacgcgcactgaaggtgaataccgccttgaccgccctgtacctgcaggtggcgtctattggggctagtggcgctcaggttctgggtgaagcactcgcagtcaatcggaccctggaaatcctagacctaagaggaaacgccattggggttgctggagccaaagcattagccaacgcattgaaagtcaacagcagtttgcgacgcttaaatctgcaggagaatagcttaggaatggacggggccatttgcatcgccaccgccctgagcggaaaccacaggctgcaacatataaacctccagggcaaccatatcggagacagcggggcccgtatgatctccgaagctatcaagactaatgcacctacgtgtacagtggagatgtag

SEQ ID NO: 23279 - DNA, 927 bp, Artificial Sequence
  Description of Artificial Sequence: Synthetic coding sequence
atgaaccccatcgtggtggtgcacggcggcggcgccggccccatctcgaaagacaggaaagaacgtgtgcaccaaggaatggtgcgggctgctacagttggctatggtattctcagggaaggggggtcagctgtggacgccgtagagggcgcagtggtggccctcgaggacgaccccgagttcaatgctggatgtggctccgtgcttaacacgaacggcgaggtagagatggatgcatcaatcatggacgggaaggatctctcagctggtgcagtcagcgcagtgcagtgtattgcaaatcccatcaaattggctagactcgtcatggagaaaacaccacattgttttctaacggatcagggcgccgcgcagtttgcagcagctatgggtgttcctgagattccgggcgagaagcttgtgacagaacgaaataagaaaagattggagaaagagaaacacgaaaagggcgcgcagaagacagactgccagaagaatctggggacagttggcgcagtagccctggactgcaagggaaacgtggcctatgcgacgtcaacaggcgggatcgtgaacaagatggtcggccgcgtgggggatagtccttgcctgggcgccggaggttacgctgacaatgatattggtgccgtgtctacaaccggccacggagagtcaatcctcaaagtgaacctagccagacttaccctgttccacatagagcaagggaagaccgtggaggaggcggctgacctgtcactggggtacatgaagagtcgggtcaaaggcctgggaggcctgattgtggtgtctaagaccggagactgggtcgccaagtggaccagcacaagcatgccctgggctgccgctaaggatggtaaactgcacttcggaatagatcccgatgacaccacaattacagaccttccctag

SEQ ID NO: 23280 - DNA, 1212 bp, Artificial Sequence
  Description of Artificial Sequence: Synthetic coding sequence
atggccggccggcgggcccagaccggcagcgcccccccccggcccgcagctccacacccccctgccagtagggcctttccccagcattgtcgccctcgtgacgcagagaggcctccttctcctagatcgccattaatgcccggttgcgagctaccagtgggaacctgtcctgacatgtgccccgccgcggagagagcccagcgggaacgggagcatagattacataggctggaggtggtgcccggttgcaggcaggatcccccacgcgcagatcctcaacgtgctgtgaaggagtatagtaggccagctgcaggcaagccccgcccacctccaagccaactcaggccaccctccgtcttgctcgcaacagtacgatatctcgccggtgaggtcgcggagagcgcagacattgctagggctgaggtcgcctcttttgtcgcagacagattgcgagctgtgctccttgatctggctctgcagggagcaggggacgccgaggctgctgtggtgctggaagcagcactggctaccctcctcacagtcgttgcaagactgggacccgacgcggccagaggccccgccgatccagtgctcctccaagcccaggtgcaggaggggttcggtagtctcaggagatgttacgcccggggtgcgggaccgcacccacggcaacctgcttttcagggtctctttcttctgtacaatttagggtccgtggaagcgttgcatgaggtgctccagctaccagctgctttacgcgcttgcccgccacttcgcaaggccttggcagtggacgctgccttccgcgaaggcaatgccgcaaggctcttccgcctgctgcaaacactcccttaccttccgagctgcgccgtccaatgtcacgtcggccatgcacgccgcgaggcactagcccggttcgccagagcgttctccacacctaaaggacagactcttcctctgggtttcatggtgaatttgctcgcgctcgacgggctgagagaggcacgcgatctgtgtcaggctcatggccttcccttggatggtgaggaacgggttgtgtttctgcgaggcagatacgtcgaagagggcctgccacctgcatcaacatgcaaggtgttagtggagagtaaacttcggggaagaaccctggaagaggttgtaatggccgaggaggaagacgagggcaccgaccggcccggaagcccggcctag

SEQ ID NO: 23281 - DNA, 894 bp, Artificial Sequence
  Description of Artificial Sequence: Synthetic coding sequence
atggccgagctgaccgccctggagagcctgatcgagatgggcttccctcgtggtcgagctgagaaagctctggccttgacaggcaaccagggcatcgaggccgcaatggactggctcatggagcacgaggatgatcccgatgtagacgaacccctggagaccccactggggcacatattggggagagaaccaacatcctccgagcagggaggattggagggcagcggcagtgcagcaggagagggtaaacctgccctgtccgaagaggaacgacaggaacagaccaagaggatgctggaactcgtcgcccagaagcagcgggagagagaggaaagggaggagcgggaggccttagagcgcgaacgacagagacggcgacagggacaagaactcagtgcagcaaggcagagactccaggaggatgagatgagaagggccgccgaagagcgcaggcgagagaaagccgaagagctggccgcccggcagagagttagagaaaagatcgaaagagacaaagccgaacgggccaaaaaatatggtggctctgtaggttcacagcccccacccgtggcccccgagcccggcccagtgccttccagtccaagtcaagagcctccaacaaaaagggaatatgatcagtgccgaattcaagttaggttgccggacggcacttcgctcacccagactttccgggcaagggaacagctcgctgctgtgaggctatacgtggagttgcacaggggcgaggaacttggaggcggccaagatcctgttcagctgttatcaggtttcccacgcagagccttctcagaagccgacatggagaggcctctccaagaattgggccttgtgccatccgcggtccttatcgtcgctaaaaaatgtccatcctag

SEQ ID NO: 23282 - DNA, 570 bp, Artificial Sequence
  Description of Artificial Sequence: Synthetic coding sequence
atgcggctgagcctgcccctgctgctgctgctgctgggcgcctgggccattccaggtggtctcggggacagagcccctctgacggctacagcccctcaacttgacgatgaagaaatgtacagcgcccacatgccagcacatctccgctgtgacgcatgtagagccgtggcttaccagatgtggcaaaatttggccaaggccgagaccaagctgcacacttccaattcagggggacggcgggagctttctgagctcgtctacactgacgtgttggatcgatcctgcagtagaaactggcaggattacggcgttagagaggtagaccaggtcaagcggctgacaggaccaggattgagtgagggccctgagccttccattagcgtgatggtgactgggggcccatggccaaccagactgagccgcacatgcctccattatttgggtgaattcggggaggaccagatttacgaggcccatcagcagggcaggggggcactcgaggcactgttgtgcggtgggccccagggtgcctgtagcgaaaaggtgagtgccacgcgggaggagctttag

SEQ ID NO: 23283 - DNA, 3129 bp, Artificial Sequence
  Description of Artificial Sequence: Synthetic coding sequence
atggccaacgacagccccgccaagagcctggtggacatcgacctgtcctctctgcgtgatcccgctggtatctttgagctcgtggaggtagttggcaatgggacctatggccaggtttacaaaggaagacatgtgaagactggccagctggctgcaatcaaagttatggacgttacagaggacgaagaggaggagatcaaactggaaatcaatatgctgaagaaatactcacatcatcgaaatattgcgacctattatggcgcttttatcaaaaagtcaccaccaggccacgacgaccaactctggctggtgatggagttttgcggtgcgggttctatcacagatctagtcaaaaacacaaagggcaataccctgaaagaagattggattgcctatatttccagggaaattttgaggggactggcccatttacatattcatcatgtgattcaccgcgacatcaaggggcaaaatgtgttgctgaccgagaacgcagaagttaagctcgacgaaacagaatatgagtactccggctcagaagaggaggaggaggaagtgcctgagcaagaaggagaaccgagcagtattgtcaacgtcccgggtgagagcactttgcgcagggactttctgagacttcagcaggagaacaaggagcggagcgaagcgctgaggagacagcaacttctgcaggaacagcaactcagagagcaggaagaatataagagacaactgttagcagagcgacagaagaggattgaacaacagaaggagcagcgccggaggttggaggagcaacagaggcgagaaagagaggctcgcagacaacaggaaagggagcagaggaggagagaacaggaagagaagcgccgtctcgaggaattggaacgacggcgaaaggaagaagaagagagaaggcgggcagaggaggagaaaagaagagtcgagagagaacaggagtacatccgtcgccagttggaagaggagcagcgccatctagaggtgttgcaacagcagctcctgcaggagcaagctatgcttctggaatgtcggtggagagagatggaggaacaccgccaggctgaacgcctccagcgacagctacagcaggagcaggcatatttgctgagcctgcaacatgaccataggagaccccacccacagcacagccagcagcccccgccaccccagcaggagagatctaagccctcatttcatgcccccgaacctaaggcccactatgaacctgctgatcgggctcgggaggtgccagtgcgcacgactagccgctctcccgttctgagtcggcgggattccccactgcagggttccgggcagcagaactctcaggctggacaaagaaactctacatcttccattgaacctcggctgctttgggaaagggtcgagaagctagtgcccagacccgggtcgggctcaagtagcggctcaagcaactctggctcacagcccggatcccaccccgggagccagtccggctccggtgaacggttccgggttaggtcatcctctaaaagtgaagggagcccttcccaaaggctggagaacgccgtaaagaaaccagaagacaaaaaagaagttttccggcccttgaagcccgccgttcgtatagaccttaccgcgctggcaaaagaactgcgggctgtggaagacgttagacccccacataaagtgacagactactcctcatcttctgaagagtctggtaccactgatgaggaagacgatgacgtggaacaggagggagctgacgagtcaaccagcgggccagaggacactagggctgcttcatctctcaacttaagtaacggggaaactgagagcgttaagaccatgatcgtgcatgacgacgtagagagtgagcctgcaatgaccccatccaaagaaggtacattgatcgtgcgccagacacagtctgcatcttccaccctgcagaagcacaagagcagttcaagtttcactccctttattgatcccagattgctgcaaatttctcctagcagtggcacaacggtgacatccgtggtcggatttagctgcgacggcatgaggccagaagcaattagacaggacccaacacgcaaggggagcgtggtgaacgtgaacccaactaacactagaccccaatcggataccccagaaatcagaaagtataaaaaaaggttcaattcagaaatcctgtgtgccgccttgtggggggtgaatctgctcgttggaacagaatccggactgatgctcctcgatcgttccgggcagggaaaagtctatccgctgatcaatagacggaggttccagcagatggatgtgctggaggggctcaacgtgctggtgacgatctccggtaaaaaagacaagctgagagtgtattatctctcttggctgcggaacaaaatacttcataatgacccggaggtagaaaagaagcaagggtggaccactgttggtgatctcgagggttgtgtccactacaaggtagtgaaatatgaacgcattaaatttctggtaatcgccttaaaatcttcagtggaggtgtacgcatgggcacccaaaccttatcacaaatttatggctttcaaaagctttggcgagctggtgcacaagccattgctagttgatctgactgtggaggagggacaaaggctgaaggtcatttacggcagttgcgccgggttccatgccgtggacgtagatagtgggagtgtttatgacatttatttgcctacacatatacagtgcagcattaagccccacgcaatcatcatcttacccaacacggatggaatggagcttctcgtctgctacgaggacgaaggtgtttacgtgaacacttacggtcggattacaaaggacgtagtactgcaatggggcgaaatgcccacctctgtcgcttatatccgctctaatcagactatgggatggggggagaaggccattgagattcggagtgtagagaccggacacctagacggggtttttatgcataaaagggcacagcggttaaagttcctgtgtgagcgaaacgacaaagtgttttttgcatccgtgcgctccggaggcagctcccaggtgtatttcatgactcttggtaggacatcattgttgagctggtag

SEQ ID NO: 23284 - DNA, 1113 bp, Artificial Sequence
  Description of Artificial Sequence: Synthetic coding sequence
atgggcttcaaccggcccagcaagatccaggagaacgccctgcccatgatgttagccgagcctccccagaacctcatcgcccagagccagagtggcacgggcaagactgccgctttcgtgttggccatgttatctcgcgtggagccatcagatagatacccccagtgcctttgtctctcacccacctacgaattggcacttcaaaccggcaaagtgattgaacagatggggaagttctaccctgaattaaagctggcgtacgcagttcgtggaaacaagctggagcgggggcaaaaaattagtgaacagattgtcatcggtaccccagggaccgtcctcgattggtgctcgaaattgaagttcattgaccctaaaaaaatcaaggtgtttgtactcgatgaagctgatgtgatgattgccacgcagggacaccaggatcagtctattaggatacagaggatgctgcctcgcaattgccagatgctactcttctcggcaacatttgaagatagtgtgtggaaattcgcccagaaggtcgtgccagatcctaacgtgattaaattaaaacgtgaagaagagaccctcgacaccataaaacaatactacgtgctgtgctcttcccgagacgaaaaattccaggcgctctgcaacttgtatggcgcaatcacaattgctcaagccatgatcttttgtcacacccgaaagaccgcgtcctggcttgcagccgagctttcaaaagaggggcaccaggtcgcccttctgagcggagaaatgatggtcgaacagagggccgccgtaattgaacgctttagggaaggaaaagagaaagtgctggtgactaccaatgtgtgtgctcgggggattgatgtagagcaagtttccgtcgtgatcaactttgacctaccggtcgacaaggatggaaaccctgacaacgagacgtacctccacaggatcgggaggactggccgttttgggaagcgaggtctggcagtgaacatggtcgattcaaaacatagtatgaacatcctcaaccgtattcaagagcatttcaataagaaaatagaacgcctagacactgatgatctggatgaaatcgagaaaattgcaaattag

SEQ ID NO: 23285 - DNA, 1437 bp, Artificial Sequence
  Description of Artificial Sequence: Synthetic coding sequence
atggccaccgacagctgggccctggccgtggacgagcaggaggccgcagtcaagtccatgactaatctgcagattaaggaggagaaagtgaaagctgacactaacggcatcattaaaacatctaccacagccgagaaaaccgatgaggaagagaaggaggaccgggccgcccagtccttgctaaataaactaattaggagcaacctggttgataacaccaatcaggtggaggtgcttcagagagatccaaattctccactatatagtgtgaaaagtttcgaagagcttaggctgaaacctcagctgcttcagggggtctacgctatgggtttcaatcgcccttccaaaattcaggagaacgctttacctatgatgctcgccgaaccaccacagaacctgatcgctcaaagccagtcaggcacgggcaaaacagctgcattcgtgctggccatgctctcacgggtggagccctcagataggtaccctcagtgcctatgcttgagtcctacctacgagttggctctccaaacaggcaaggtgatagaacagatgggcaaattctacccagagcttaaactggcttatgctgtgagggggaacaagttagagagagggcaaaagatatcagagcagatcgtgatcggaactcccggcacagtgctggactggtgcagcaaattgaagtttattgaccccaagaaaattaaagtgttcgtgctggatgaggcagatgttatgattgcaacacagggtcatcaggaccagagcatccgcatacagcgcatgcttcctagaaactgccagatgctgctcttttctgcaacctttgaagatagcgtctggaagttcgctcagaaagtggtcccagaccccaacgtgatcaaactcaaacgcgaggaggaaaccctggatacgatcaagcaatactacgtcctatgctcgagccgcgacgaaaagttccaggcgctctgcaatctctatggtgccatcacaattgcccaggcaatgattttctgccacactaggaagacagcatcttggctcgctgctgaactctccaaggaaggacaccaggtcgcactcctttcgggggaaatgatggtagagcagcgggcagccgttatcgagcggttccgcgaaggaaaggaaaaggtactggtgaccaccaacgtgtgtgcacggggaatcgacgtagagcaggtttccgtggtcattaatttcgacctgcccgtggataaagacggtaatccagacaatgagacctaccttcacaggatagggcggacagggcgtttcgggaaaaggggcctggctgtgaacatggtcgattccaagcatagcatgaatatcttgaaccggattcaggagcatttcaacaagaaaatcgagcgtctcgatactgacgatctggatgagattgaaaagattgccaattag

SEQ ID NO: 23286 - DNA, 2238 bp, Artificial Sequence
  Description of Artificial Sequence: Synthetic coding sequence
atggtgggccccggccccaccgccgccgccgccgtggaggagcggcagagaaaattacaggagtatctggcggctaaggggaaacttaagagtcaaaacaccaaaccatacctcaaaagcaaaaacaactgtcagaaccagccaccgagcaagagcaccatcagaccgaagaatgatgtgacaaaccacgtcgtgctccctgtgaaacccaagagatccatcagcattaagctccagccaagacctcccaacactgctggctctcagaagcctaaactggagcctcctaaactcctggggaaacggctcacttccgagtgtgtcagctctaacccctacagtaaacctagtagcaagagcttccagcaatgtgaagccggtagcagtacgaccggcgaactgagccgtaagcccgttggctcactcaatattgagcagctcaagaccaccaagcagcagctgactgaccagggcaatggcaagtgcatcgacttcatgaacaacatccacgtggaaaacgaatcactggataacttccttaaggaaactaacaaggagaatctgcttgacatcttaacagagccagaaaggaagcccgaccctaagctgtacacacgttccaagcctaagactgactcttacaatcaaactaagaactctctggttccaaagcaggcactgggcaagtcttccgtgaactctgcagtactgaaggatagagtcaataaacagttcgtgggtgaaacacagtccaggacatttccggttaaatcccaacagctgagccggggcgcagatctggctcgcccgggcgtgaaaccttcgagaaccgtgccttctcacttcatccggaccctcagcaaggtgcaatccagtaagaagcctgtggtgaagaacattaaggacattaaggtgaaccgatctcagtatgaacgcccaaatgagaccaagatacgctcatatcctgtcacagaacagagggtgaaacacaccaaaccccgtacgtaccctagcctgctgcagggagaatacaacaatagacatccaaatatcaaacaagaccaaaaaagttcacaagtctgtattccccagacaagctgcgtgctgcagaagagcaaagccatatctcagcgccctaacctgaccgttggtaggtttaacagcgctattcctagcactccttcaatccgcccgaacggaacaagcggtaacaagcacaataataacgggttccaacagaaagctcagacactagattccaaactgaagaaggctgtgcctcagaaccatttcttgaacaagaccgcccctaaaacacaggcggatgtcaccactgtgaatgggacccagaccaatccgaatattaagaaaaaggctactgccgaggaccgtaggaaacagttggaggaatggcaaaaaagtaaaggtaaaacttataagcgacctcccatggagctcaagactaagagaaaagtcatcaaggaaatgaacattagcttctggaaatcgattgagaaggaagaggaagaaaaaaaagcacagttggagctttcttcaaagattaataacacattaactgagtgcctgaacctgatagaaggaggcgtcccctccaatgaaatcctcaatattctgagtagcatcccagaggctgagaagttcgctaaattctggatttgcaaagcgaaactcctcgctagtaagggtacctttgatgtcattgggttgtacgaagaggcgatcaaaaacggggcaactccaattcaggagctcaggaaggttgtcttgaacatccttcaggacagcaacagaaccacagaaggtatcacatctgatagccttgtagccgagacctcaatcacctcagtggaagagctcgcaaagaagatggagtctgttaagagttgcctgtcacctaaggaacgggagcaggtgaccgcaacacctagaattgccaaggcagaacagcacaactatcccgggattaagctccagattggacccatacctagaatcaacgggatgcctgaggtgcaggatatgaagtttattacaccagttagacgcagcagccgcatcgagcgagcggtgtcacggtatcccgaaatgctccaagaacacgatctggtggtcgctagcctggatgaattgctggaggtggaggaaaccaaatgtttcatttttcgccgtaatgaagctctgccagtaactcttggcttccagacccccgagagttag

SEQ ID NO: 23287 - DNA, 378 bp, Artificial Sequence
  Description of Artificial Sequence: Synthetic coding sequence
atgagcagcaccctgggcaagctgagcaaccaggtggaggagaccttgcctcttctgaaaaaggtgcctgctaactacttccacatctgttcagcaatcctgatgggattttcgctctctaaatcggccacacaggtgagtgcaatccacatggattccaaggtggacgaccatttaatccggggtactgagaagagccgcctggagccagctacacagctgttccaaaataccaaaaagatacggctcgaagacaccaaccaggagaattttacccgaatcgaagggactggcactggttccctcagcgggaaagccctgggtagtgtggtttatgtgaaagagtctgacggccttgagatgactgacgtggaatag

SEQ ID NO: 23288 - DNA, 4284 bp, Artificial Sequence
  Description of Artificial Sequence: Synthetic coding sequence
atgagcatgctgaagcccagcggcctgaaggcccccaccaagatcttgaaaccgggcagcactgccctgaagactcctacagcggttgtcgccccagtcgaaaaaacaatcagcagtgaaaaagcatcatcaacgccgtcctcggagacacaggaggagttcgtggacgacttccgcgtaggcgaacgcgtctgggtgaacggcaacaagccaggtttcattcagtttctgggcgagacacagtttgcccctggacagtgggccggcattgtgttagacgagccgattgggaaaaatgacggatcagtagccggagttaggtatttccagtgtgaaccgctcaaggggatctttacccgcccatcaaaactcacccggaaagtccaggcagaagacgaagctaatggcctacagacaactcctgcctctcgggccaccagtcccctctgcacaagcaccgcttccatggtaagctcttccccaagtacaccaagcaacattcctcaaaagccctctcaaccagctgctaaagagccatctgcaactcctcccatctctaacttgacaaagacagcttcggaatccatctccaacctgagcgaagccgggagcatcaagaaaggtgaacgagaacttaaaattggggatcgggttctggtcgggggaacaaaggcaggggtcgtacgctttttaggagagacagatttcgctaaaggtgaatggtgtggagtggagctagatgaacctttgggaaaaaacgacggagctgtggcaggaaccagatatttccagtgccaacctaagtacggtctgttcgctcctgtgcataaagtgaccaagatcgggttccccagcacaactcctgctaaggcaaaggccaatgcagtacggagggtgatggccacaacttcagcatccctgaagcgtagccccagtgcttcgtccctgagcagcatgtcttccgttgctagtagcgtgagctcaagaccctccaggacaggcctgctaaccgaaacctcctctcgatacgcccgcaagataagcggtacaacggctcttcaagaggcactcaaagaaaagcaacagcacatcgagcagttactggccgaacgcgacctggagcgagctgaagtagcaaaggccacctcccacgtcggggagatcgagcaggagctcgcactcgcacgtgatggccacgaccagcacgtgctcgaactcgaggcaaagatggaccaattacggactatggtggaggctgccgatagggagaaagtggagcttctgaaccaactggaggaggagaagagaaaggtggaagatcttcaattccgcgtagaagaggaaagtattaccaaaggggacctggagacccagacgaagctggaacatgctagaatcaaagagctcgagcaaagccttttatttgagaagacaaaggccgacaagctgcagcgtgagttagaagatactcgcgtggccactgtgtctgaaaaatctagaattatggagctggaaaaggacctggcactgcgggtccaagaagtggctgagctccggagaagactcgaaagtaacaaaccagcaggcgatgtggacatgtcattaagtcttctgcaggagattagctccttgcaggaaaagcttgaagtgaccagaacagatcatcaaagagagatcactagcctgaaggaacatttcggggctagagaggagacacaccagaaggagatcaaagctttgtacaccgcgacagaaaaactgtctaaggagaatgagagtctgaagtctaagctcgaacatgccaataaggaaaactctgatgtgattgctctctggaagtcaaagctggagaccgctatcgcctctcaccagcaggcaatggaggaactaaaggtgtccttcagtaagggcctggggaccgaaacagccgagttcgcagagctgaaaacacaaatcgaaaagatgcggctggattaccagcacgagatcgaaaacttgcagaatcaacaggacagcgaacgggctgctcacgcgaaagagatggaggctttaagggctaaactcatgaaggtgatcaaagagaaggagaactcccttgaggcaattcgttctaaactcgacaaagcggaagatcaacacctggtagagatggaagacacattgaataaattgcaggaggcggagataaaagtgaaagagctggaagtactgcaggcaaagtgcaatgagcaaacaaaggtaattgataacttcacttcacagttgaaggcaaccgaagagaaattgctggatctggacgccctgcgaaaagcttcctcagagggaaaatcagagatgaagaagctccgacagcagctcgaggccgccgaaaaacagatcaagcatcttgagatagagaaaaatgcggaatcatcaaaagcgtcttcaatcaccagagaattgcagggccgggaactcaaattgacaaacctgcaagagaacttatcagaggtatcccaggtcaaagagaccctggagaaagaactgcagattttgaaggaaaaattcgctgaagcatctgaggaggccgtgtccgtacaaagaagtatgcaggagactgttaacaagcttcaccaaaaggaagagcagttcaacatgctgtccagcgatctagagaagttgcgggaaaatctcgcagacatggaggcaaaattccgcgaaaaggacgagagagaggagcagctcatcaaagccaaggaaaaactagagaatgatatcgcagagattatgaaaatgtccggagacaactcctcccagcttactaagatgaatgatgagttgcgcctgaaagaaagagacgtggaggaactccaactgaaactcactaaggctaatgagaatgcttcctttcttcagaagagcatagaggatatgacagttaaagcggagcagtcgcagcaggaggccgcaaagaagcatgaagaggaaaagaaagaacttgagagaaaactgtctgacctggagaagaaaatggaaacaagccacaatcagtgccaggaacttaaagcacgctacgagagggctacatctgagactaaaaccaagcacgaggaaattctgcagaatttacagaagaccctgctggacaccgaggacaaattgaaaggcgctcgtgaagagaattccggcctgctgcaggagctcgaagagctgcgaaagcaagctgacaaggcaaaggctgcccagacggctgaggatgccatgcaaattatggagcagatgactaaagaaaagacagagactcttgcaagcctagaggatacgaagcagacaaacgcgaagttgcagaacgagctcgatacacttaaggagaataacctgaagaatgtggaagagttgaacaaaagcaaagaactgctcaccgtggagaatcaaaagatggaggagttccgcaaggaaatcgaaacccttaagcaggctgccgcacagaagtcacagcaactgtctgctctccaggaggagaatgttaagctggcagaggagctcgggcgctctagagacgaggtgacgagtcatcaaaaacttgaggaagaacgctcagtgttgaacaaccaactattggagatgaagaagagggagtcaaaatttatcaaggatgctgacgaggagaaagcgagtctgcagaaatctatatctattacctccgccctgctgaccgagaaagacgcagagctggaaaagctgcggaacgaggtaaccgttttgaggggtgaaaatgcaagcgctaaaagcttgcactcagtggtccagaccctcgaaagtgataaagtgaaactcgagctgaaggtgaaaaacctcgaactgcagttgaaagaaaataagcgccagctcagctctagcagcggcaataccgacacgcaagctgatgaagatgaacgggcacaggagtcacagattgattttctgaatagtgtgattgtcgacttacaacgcaaaaaccaggatctcaagatgaaagtcgagatgatgtccgaggccgccttgaacggaaatggcgacgatttgaacaactacgatagcgatgaccaagagaagcagtcaaagaagaaaccacgcctgttctgtgatatctgcgattgctttgaccttcacgacactgaggattgtccaacccaagcccaaatgtccgaagatcctccacactcaacacaccacggctctcgaggtgaggagcgcccctactgtgagatctgtgagatgttcggacattgggcaacaaactgcaacgatgacgagacattctag

SEQ ID NO: 23289 - DNA, 975 bp, Artificial Sequence
  Description of Artificial Sequence: Synthetic coding sequence
atggccagcagcaacaccgtgctgatgcggctggtggccagcgcctatagcatcgcccagaaggcagggatgattgtgaggcgcgtgatcgccgaaggcgacctcggtattgttgagaaaacatgtgccaccgatctccaaactaaggccgaccggcttgcccagatgtcgatctgctcttccctggcgcgaaagttcccgaagttaacaatcataggggaggaggatctacccagtgaagaagtggatcaggagctgatcgaagattcccaatgggaggagatcctgaaacaaccctgtccatcgcagtacagcgccatcaaagaagaggatctcgtggtctgggtggaccctctagatggaactaaggagtataccgagggactgctggacaatgtaacagtcctgattggtatagcctatgaaggcaaggccatcgctggggtcattaaccagccttattacaattacgaagctggtccagatgctgttctcggaagaaccatttggggggtgctcgggctaggggcatttggtttccagttgaaagaggtgccagcagggaagcatataatcacaaccacaagatcccatagcaacaagcttgtcaccgattgcgtggccgctatgaaccctgacgccgtcctcagagtcggaggtgcaggcaataaaattattcagctgattgaaggtaaagctagcgcttacgtgtttgctagcccaggctgcaagaagtgggatacctgcgcccccgaagtcatactacacgccgtcggtgggaagttgaccgatatccacggcaacgtcctccagtaccacaagggggtgtcgcatcgaacatggccaaaaccagactttttccgagctcagttcttcctggaatcgcattcatgctttagcaactttaagaacgtttcaacacctataaaaaatatctatgatgtcatcatttacgcctacgaaacagacctatag

SEQ ID NO: 23290 - DNA, 270 bp, Artificial Sequence
  Description of Artificial Sequence: Synthetic coding sequence
atgggcaccaagcgggaggccatcctgaaggtgctggagaacctgaccccagaagagcttaagaagttcaagatgaaactcggtacagtcccattaagggagggattcgagcgaatcccgagaggagcgctgggacagctggatatcgtggacctcaccgacaagctagtggcatcttattatgaagactatgctgccgaacttgtggtggccgtgctaagggacatgcggatgttggaggaagccgccaggctgcagcgcgccgcctag

SEQ ID NO: 23291 - DNA, 867 bp, Artificial Sequence
  Description of Artificial Sequence: Synthetic coding sequence
atgaccgtgggcaagagcagcaagatgctgcagcacatcgactaccgcatgagatgcattctccaggacggtcgtattttcatcgggacgttcaaagcattcgacaaacatatgaatctcattctgtgcgattgtgatgaatttagaaaaatcaagcctaagaacagcaaacaggccgaacgggaagagaaacgagtgctgggtcttgtgttgctcaggggtgaaaacctggtctctatgacagtggaagggcccccacctaaagacaccggtatcgcaagggtgcccctggcgggcgccgccggaggacccgggatcgggcgggccgccgggaggggaattcctgcaggggtccctatgccccaggccccagcagggctggcaggccctgtccgcggggtaggcgggccttcacaacaggtgatgaccccacaggggaggggaacagtcgccgccgcggctgccgctgcaacagcctcgatcgctggcgcccctacgcagtatcctccaggtcgggggggcccccccccccctatggggcgcggcgctcctccccctgggatgatgggacccccacccggaatgcgacccccaatgggcccccccatggggatcccccccgggcgcggcacccctatggggatgccccccccaggcatgcgcccaccacctcctggatgcgaagccttcttcgatccatggccacagtctatggaggtcgcaccacagcgacgcgggttggattcttcagggcctaggtaccaccgcccagtctgctttctctgctgctgctcttggtcacttatgggactgagtggatttctcacaggcccccctccacccggaatgaggccgccaagaccttag

SEQ ID NO: 23292 - DNA, 3300 bp, Artificial Sequence
  Description of Artificial Sequence: Synthetic coding sequence
atgcacatcaagagcatcatcctggagggcttcaagagctacgcccagcggactgaggtgaacggttttgaccctctttttaatgccataacgggactgaatgggtctggtaagtcaaatatcctggacagtatttgctttctcctggggatcagcaatctttctcaggtccgggcctcaaatctgcaggacttggtgtataagaacggtcaagcgggaatcacaaaggcgtccgtgtcaatcaccttcgataactccgataaaaagcagtctcctcttgggttcgaagtgcatgatgaaatcactgttaccagacaggtggtcattggtggccgaaataaatacctcataaatggcgtcaacgccaacaacacccgggtccaggacttgttttgcagtgtgggcctgaacgtgaacaacccccattttctcattatgcagggaaggattacaaaggtcctcaatatgaaaccacccgagatcttgtccatgatcgaggaagccgccggcactagaatgtacgagtacaagaaaattgcagcccagaaaaccatcgaaaaaaaagaagccaagctgaaagaaatcaaaactattttagaggaagaaattactccaacgattcaaaaactgaaggaagaaaggtcctcctatcttgagtaccagaaagtgatgcgcgagattgaacatcttagtagattgtacatcgcctatcagtttctactggccgaagacactaaggtgcgatcagcggaagaactcaaagaaatgcaggacaaagttatcaaactacaggaggaactgtctgaaaacgacaagaaaataaaagcactgaaccacgaaattgaggagcttgagaagaggaaagataaggagaccggtggcatcctcaggtctctggaagacgctttggccgaggcccagagagtgaatacgaagagtcaaagcgcctttgatctgaaaaagaaaaatctagcatgcgaagaatcaaagagaaaggaactcgaaaaaaacatggttgaagactcaaagacccttgcagctaaggagaaggaggtgaaaaagattacggacggcctgcacgccctccaagaagcttcaaataaggatgcagaagctctcgccgccgcacaacagcatttcaacgcggtttcggccgggctctcctctaatgaagacggtgccgaagcgacgttagcagggcagatgatggcctgtaaaaatgatatcagtaaggcccaaactgaggctaaacaggctcagatgaaactgaagcacgcccagcaggagcttaagaacaagcaggcagaggtgaaaaagatggattccgggtaccgaaaggatcaggaggctctggaggctgtgaagagactcaaagaaaagctcgaggctgagatgaagaagctaaactacgaggagaacaaagaagaaagtcttctcgaaaagcgcaggcagctgtctcgagacattggaagattgaaggagacatacgaagctttgctcgcacggttccctaaccttcgctttgcgtacaaagaccctgagaaaaactggaatcgcaactgcgttaaaggcctggtggccagccttatcagcgtaaaggacacatcagccaccactgccctggaactcgtggcaggggagcggctgtacaatgttgtggtcgataccgaagtaaccggcaagaaactactggaaaggggtgagctcaagcgaaggtacacaataatacccttaaataagatcagtgcccggtgtatcgcacctgaaacccttagagtcgcccagaatctcgtagggcccgataatgtgcacgtggctctgtccctcgttgaatacaagcctgagctgcagaaagcaatggagtttgttttcgggacgacatttgtgtgcgacaacatggataatgccaaaaaggtggcgttcgataagcggatcatgacacgcactgtgaccttgggtggcgatgtctttgacccccatggcactctttcagggggggcccgctcccaagctgcgagcattctaacaaaattccaggaactcaaggacgtgcaagacgagctgaggatcaaggaaaacgagctgagagctcttgaggaagagctggcaggacttaaaaacaccgccgagaagtaccggcagctgaaacagcagtgggagatgaagacagaggaagcagacctcctacaaacaaagcttcagcagtcttcataccataagcagcaggaagaactggatgccctgaagaagactattgaggagtccgaggagaccctaaagaacaccaaggaaatccagaggaaggccgaggagaagtacgaggtgttagaaaataaaatgaagaacgctgaggcagagcgagaacgagagcttaaggatgcacagaagaagctggattgtgccaaaacaaaggccgacgcctcgtctaaaaaaatgaaggagaaacagcaagaggttgaagctattaccctggagctggaagaattgaagcgggaacataccagttacaaacagcagctcgaggctgttaacgaagctattaaaagctacgagtcccaaattgaggtgatggccgccgaggtggctaagaataaggaaagcgtgaacaaggctcaggaagaggtgactaaacaaaaagaggtgattaccgcccaagacacggttattaaggccaaatatgccgaggtggccaaacacaaggagcaaaataacgattcccagctgaaaatcaaagaactcgaccataatatttcaaagcacaagagagaagccgaagatggggccgcaaaggtgtctaagatgctaaaggactacgactggatcaatgcagaacgtcacttgttcgggcagcccaattctgcttacgactttaagactaacaacccgaaggaggcaggccagaggttacaaaaactgcaggagatgaaggaaaaactaggccggaatgtgaatatgcgagcaatgaatgtgcttactgaggcggaggagaggtacaatgacctgatgaaaaagaaacggatagtcgagaatgacaaatctaaaatcctgaccaccatcgaagaccttgatcagaagaaaaaccaggctcttaacatcgcttggcagaaggtgaacaaagactttgggtctattttctctaccttgctgcctggggcaaatgcaatgcttgccccccctgaagggcaaaccgttctcgacgggcttgagtttaaggtagcactcggcaacacttggaaagaaaatctcaccgaactctcaggcgggcaaagacagaagcagcaaaatcacaccaccggttag

SEQ ID NO: 23293 - DNA, 381 bp, Artificial Sequence
  Description of Artificial Sequence: Synthetic coding sequence
atgttccagaaggacgagtactgcatcctgatcctgggcctggacaacgcgggaaaaacgactttcttagagcagtctaaaacccgctttaacaagaattataaggggatgtccctttctaaaattactacaaccgtgggcctcaatatcgggaccgtggacgttggcaaagcccgattgatgttttgggacttgggcggacaggaagagctgcaatccctctgggataaggataaaacgaagtgtggagatctgggaactttgcactccagtaaggtgagcgcctcattccggctaagagatctggctgcggaccatcaccgaacacagaagtggcagaggccggatgtcggaactgccgggtggcttcccttgccatag

SEQ ID NO: 23294 - DNA, 1119 bp, Artificial Sequence
  Description of Artificial Sequence: Synthetic coding sequence
atgaccttccagttcaacttcaccatcgaggaccacctggagaacgagctgactcccatccgtgatggagccctgactctggactcatctaaagaactgtcagtctccgagtcccagaagggagaggagcgggatcggaaatgcagtgccgaacagttcgatctaccacaggatcacctgtgggagcataagagcatggaaaacgcagcacccagccaggataccgactctcccctttcggctgcttctagctcacgcaacctcgagccccatggaaagcagccgagtttaagagctgctaaagaacacgcgatgccaaaggacctgaaaaagatgctcgagaataaagtgattgagaccctgcctggattccagcacgttaagcttagtgttgtgaaaacaatcttattgaaggaaaacttcccaggtgaaaacattgtatccaagagcttctcatctcactcggacctgatcaccggggtgtacgaaggggggctaaaaatttgggaatgcaccttcgaccttctggcctattttactaaggcgaaggtgaagttcgccggaaagaaggtccttgacttaggctgtggaagcggactcctaggcattacggctttcaagggcggctccaaggagatccactttcaggattacaattctatggtgatcgacgaagtcaccctgcctaatgtggttgcaaattcaacactggaggatgaggagaacgacgttaacgagccagacgtgaaacgttgtcgcaagccaaaagtgacccaattgtacaagtgccgattcttttctggagagtggtcagagttctgtaagctagttctctcaagcgagaagctgtttgtgaaatacgatctgatcttaacctcggaaacgatctataatcccgattactactcaaaccttcatcagacattcctgagactgttgtcaaaaaacggtcgcgttcttttagcaagcaaagctcattatttcggcgtgggaggaggggtacacctattccagaagtttgtggaagagcgcgacgtgtttaagacccgcatcctgaagattattgatgaagggttgaaacggttcattatcgagataacctttaagttcccagggtag

SEQ ID NO: 23295 - DNA, 1635 bp, Artificial Sequence
  Description of Artificial Sequence: Synthetic coding sequence
atgaagtgccactacgaggccctgggcgtgcggcgggacgccagcgaagaagaactgaaaaaggcctacagaaaattggccctgaagtggcacccagacaagaatctggacaacgccgctgaggccgccgagcagttcaagctaattcaggctgcatatgatgttctgtccgacccacaggagcgcgcgtggtacgacaatcacagggaggccctccttaaaggggggtttgacggagagtaccaagacgattccctggatctactcaggtatttcaccgtcacatgctacagtggctacggcgacgacgagaaaggattctatacagtctaccggaatgtctttgaaatgatcgctaaggaagaactggaaagtgtgcttgaggaggaggttgatgactttcctacctttggagactcgcagagcgactacgacaccgtagtacacccattttatgcatattggcagtctttctgtactcagaaaaacttcgcgtggaaagaagagtatgacactcgacaagcctctaacagatgggaaaaaagagctatggaaaaggagaacaagaaaattagggataaggcccgaaaagagaagaatgagctggtgcgccagctggtcgccttcattaggaagcgagataaaagggtgcaggcccaccggaagttagtagaagagcagaacgcagagaaagcccggaaagctgaagaaatgcgcagacagcagaagttgaagcaagccaaactcgtcgaacagtatagagagcaatcctggatgaccatggctaatctggaaaaggaacttcaggagatggaggctcgctacgagaaggaattcggggatggcagcgacgagaatgagatggaggagcacgaacttaaggatgaagaggatggtaaagacagcgatgaggctgaagacgctgaactctatgatgacttgtactgtcccgcttgcgataaatcctttaagaccgaaaaggcaatgaagaatcatgagaagagcaagaagcatcgggagatggtggctctcctcaagcagcagttggaggaagaggaggaaaacttttccagaccacaaatcgacgagaatcccctagacgataatagcgaggaggagatggaagatgcaccgaagcaaaaagtgaaatatctgacctttcggtttatcttcgccctacgcctaagtaaaaaacaaaaaaagaagaaacagaaaccagctcagaactacgacgataactttaatgtgaacggcccgggcgagggcgtaaaggtggatcccgaagatacaaacttgaaccaggattccgcaaaggaactggaggatagccctcaggagaacgtatctgtcacagaaattatcaagccttgcgacgatcccaagtccgaagccaagtcagttccaaaaccaaaagggaagaagaccaaggatatgaagaagcccgtgcgcgtgcctgccgaacctcagacaatgtccgtgctaatcagctgcacgacatgtcattctgagtttcctagtcggaacaagttgtttgatcatctgaaagcgacgggtcatgccagagccccctcctcgagttctcttaacagcgccaccagtagtcagtctaaaaaggaaaagcgcaaaaatcggtag

SEQ ID NO: 23296 - DNA, 945 bp, Artificial Sequence
  Description of Artificial Sequence: Synthetic coding sequence
atgcccggcttcacctgctgcgtgcccggctgctacaacaacagccaccgggataaggccctccacttttatacgttccccaaagatgcagaactgaggcggctgtggttgaagaacgtgagcagggccggcgtgtctggctgtttttctacctttcagcctacgactgggcaccggctgtgttctgtgcacttccagggagggcgcaagacatacactgtgcgagtgccaaccatcttccctctgaggggagtcaatgagagaaaggtagctcgacgccccgctggcgctgccgctgcaagacgccgtcagcaacagcagcagcagcagcagcaacagcagcagcaacagcaacagcaacagcagcagcagcagcagcaacaacagcaacagcagtcttctcccagtgcctctaccgcccaaactgcacagttgcaacccaacttggtgtctgcctcagcagccgtactactgaccctccaagccaccgtggactcaagccaggcccccggatccgtacagccggcacccatcacaccaactggggaggatgtgaagcctatcgacttaactgtccaggtagaattcgctgccgccgagggagctgctgctgccgctgctgcatctgagcttcaggctgccacagccgggctagaagcagctgaatgcccaatgggccctcagctcgtggtggtgggcgaggaaggatttcccgatactggttcagatcacagctacagtctgagttcagggacgacagaggaggaactgctcaggaagttgaatgagcagcgcgatattctggccctgatggaggtaaagatgaaggagatgaagggctccatcagacatctccgtctgaccgaggccaaactacgggaggagttacgagagaaggatcggctgctagcaatggctgttataagaaaaaagcacggaatgtag

SEQ ID NO: 23297 - DNA, 645 bp, Artificial Sequence
  Description of Artificial Sequence: Synthetic coding sequence
atggccggcgagaacttcgccacccccttccacggccacgtgggcagaggtgccttctccgatgtgtacgaacccgctgaggacacgtttctactcctgaacgccctcgaagccgctgcggctgagctagcaggagtggagatatgcctggaagtaggttctggttcgggggtggtgagcgcgttcctggccagcatgattgggcctcaggccctctatatgtgcacggatataaaccccgaggccgcggcctgcaccctagagactgcaaggtgtaataaggtacacatccagcccgtgattaccgacctggtgaagggattactgccacgcctgactgagaaggtagacctactggttttcaatcccccttatgtggttactcctccgcaggaagttggcagtcacggcattgaggcagcctgggcggggggcaagaacggaagagaggtcatggataggttcttcccacttgtgcccgatctcctgtccccaaagggattgttttatctcgtcaccattaaagaaaacaatcctgaggagatacttaagattatgaagactaaaggactgcaggggacaaccgctctctccagacaggcgggccaggaaacactgtctgtgctaaaatttaccaagtcctag

SEQ ID NO: 23298 - DNA, 1536 bp, Artificial Sequence
  Description of Artificial Sequence: Synthetic coding sequence
atgagcggcggcttcgagctgcagccccgggacggcggcccccgggtcgcccttgccccaggcgaaaccgtgattggacgcggacctttactcggaatcactgacaagcgtgtctctcggcgccacgcgatcctcgaggtggccggcggccagctgcgcattaagcccattcatactaatccctgcttctaccaatcatcggagaagtcacagcttcttccactgaagcccaatctgtggtgctatctgaatcctggagactccttcagcttgttggtggataagtacatttttagaatcttgtccataccatcagaagttgagatgcagtgcacactccgcaattctcaggtgctggatgaggacaacattctgaatgaaacccccaagagccccgtgattaacttgcctcatgaaacaacaggcgctagccaattggagggaagtaccgagatcgccaagacacaaatgacaccaacaaattctgtctcttttttaggggagaacagagactgcaataagcagcagcccatcttggctgaacgcaaacgcatcctgcctacatggatgctggccgagcatctgagcgaccagaatttaagcgtaccagccatttctggaggtaacgtgatacagggcagtggtaaggaagagatctgcaaggataaaagtcagctgaatactacacaacagggtcggagacaactgatctcaagtgggtccagcgaaaacacgtccgccgagcaggacactggcgaagagtgtaagaacactgatcaagaggaatccactataagttccaaagagatgcctcagtctttctccgctattaccctgtcaaatacagagatgaataacatcaaaactaacgcccagaggaacaaattgcctatcgaagagctggggaaggtgagcaagcacaaaatcgctaccaagaggactccacacaaggaggacgaagcaatgtcctgcagcgagaattgtagcagcgcgcagggagactccctacaggacgagagtcagggcagccacagcgaatcttcatccaatccgtctaatccagagaccttgcatgctaaagcgaccgacagcgtcctgcagggatcagagggcaacaaagttaaacgcacatcttgcatgtatggcgctaattgttatcgcaaaaatcccgtgcatttccagcatttttcccaccccggagatagcgattacggaggggtgcagatcgtgggccaggatgagacagatgaccgccccgagtgcccctacggacctagttgttaccgcaaaaatccccagcacaagatcgaatacaggcataacacgctgccagtgaggaatgtcttagatgaggataacgacaacgtagggcagcccaatgaatacgatcttaacgactccttccttgatgacgaagaggaggactacgagccgactgacgaggacagcgattgggagcccggcaaggaagatgaagagaaggaggacgtggaggaactgctaaaagaggcaaaacggtttatgaaacgcaagtag

SEQ ID NO: 23299 - DNA, 984 bp, Artificial Sequence
  Description of Artificial Sequence: Synthetic coding sequence
atggccgccgccgccgccgccgccgccgccaccaacggcaccggcggatctagcggcatggaggttgacgccgctgtggttccgtctgtcatggcctgtggcgttacaggctcggtgtcagtggcactccaccccctagtcatactgaacatctccgatcactggattaggatgcgctcccaggagggacggcctgtccaggtgatcggtgccctgatcggtaaacaagaaggacggaacatagaggttatgaacagttttgagctcttaagccacactgtcgaagaaaaaataatcatcgacaaggaatactattacaccaaggaggagcagtttaagcaagtctttaaagagctggagttcctgggatggtacaccacggggggcccgcctgaccctagcgacattcacgtccacaagcaggtctgcgaaatcatcgaatcccctctctttctgaagctgaatcccatgactaagcacaccgatctaccagtgagcgtgtttgaaagcgtgatagacataattaacggtgaggcaaccatgttgttcgccgagctgacctatactctagccacagaggaagccgaaaggataggggttgaccatgtggcccgaatgaccgcaacaggttctggggagaacagcaccgtggccgaacacctcattgctcagcacagtgctatcaagatgttgcattccagggttaaactgatcctcgagtacgtcaaagcatcagaggccggcgaggtaccattcaatcatgaaattctgcgggaagcatatgctttgtgccactgtctacctgtcctgtcaacagataaatttaagaccgacttttacgaccagtgtaatgacgtaggactcatggcttatctgggtacaatcacaaagacctgtaacacaatgaaccagttcgtgaacaagttcaacgtcctgtacgatcggcaagggatcggacgacggatgaggggccttttcttttag

SEQ ID NO: 23300 - DNA, 2574 bp, Artificial Sequence
  Description of Artificial Sequence: Synthetic coding sequence
atgaactaccagcagcagctggccaacagcgccgccatccgggccgaaatccagcgctttgaaagcgttcatccgaacatttactccatttatgaattacttgagagggtggaggaacctgtacttcaaaaccagatcagagaacacgtgatcgctatcgaggatgcctttgtaaacagtcaagagtggaccctgtctcgctcagtaccggagctgaaagttggaattgtaggaaatctggcctcaggaaagtcggccttagtgcaccggtacctgaccggaacctatgtgcaggaggagtccccagagggggggcgtttcaaaaaagagatagtggtcgatggacagagctatctgctcttgattagggacgagggaggtcctccggaagcacagtttgccatgtgggtagacgccgtaatcttcgttttttccctggaagatgaaatctcttttcagacagtgtatcattactattctcgcatggcaaactatcgcaacacaagcgaaatcccactcgtgctcgtgggcacccaggatgccatcagtagcgcaaaccccagggtcattgatgacgcgcgagccaggaaactatctaacgatctaaagcgctgcacttattacgagacttgcgcgacctatgggttaaatgttgaaagggtatttcaggacgttgcccagaaaatcgtcgccacacgcaaaaagcagcagctgagtatcgggccctgtaagtcgctgcccaacagcccttcgcactcctccgtgtgcagtgcccaggtatccgcagtacatatttcccagaccagcaacggcggtggctcattgagcgactactcctcatccgtgcctagtaccccttccacttctcaaaaagagctgcgaattgatgtgccccctaccgccaatacacctacccccgtaagaaagcagtccaaacgaagatccaacttgtttacctcacggaaaggctctgaccccgataaagaaaaaaaagggcttgagtcccgcgctgactctatcggcagtggccgggccatccctatcaagcaggggatgctcctcaagcgcagcggcaagtccctgaacaaggagtggaaaaagaaatacgtgactctgtgtgataacggggtgttgacttaccacccatctctgcacgactacatgcaaaacgtgcatggtaaagaaattgatctgctccggactaccgtgaaagtgcctggaaaaagaccccctcgggcaacctcagcctgcgcccctattagtagtcctaaaacaaacggcttatctaaagatatgagtagcctacacatatcaccgaactcagggaatgtgacctcggcctcaggcagccaaatggcttcaggcatcagcttggtttcctttaactctcgcccggacgggatgcaccagagatcttattcggtcagctccgctgaccagtggagcgaagctaccgtgattgctaactctgcaatctcttccgacaccgggctgggggattcggtctgctcctctccctctatttcgtccacaaccagcccgaagttggatccacctccatctccacacgctaacagaaaaaagcacagacggaagaagtcaacatccaatttcaaagcagatggattaagcgggaccgcagaggagcaagaggaaaatttcgaattcattattgtctcgctaacaggccaaacttggcactttgaagcgacaacctacgaggagagggacgcttgggtccaagctatcgagtcacaaattttggccagcctccagtcctgcgagtcgagtaagaacaagtccagactcacatcccagtccgaagccatggcgctgcagtccatccggaacatgcggggcaacagccattgtgtggattgcgaaacgcagaaccctaattgggcaagcctcaacctcggagcactcatgtgcattgagtgcagtggcattcaccgcaacctgggcacacatctatcacgagtaaggtctttggacttagacgactggccagtggaattgatcaaggtgatgtccagcatagggaatgagttggcaaactccgtttgggaagaaagctcacaaggtcgaacgaaaccgtctgtcgattcaacccgtgaagaaaaagagagatggataagagccaagtatgagcaaaaactgtttctggcccctctgccatgcaccgaactgtcattgggtcagcaccttctgagagcgactgctgatgaagatctccggaccgccatcctcctcctggctcacggctcccgggacgaggttaatgagacatgcggagagggagatgggcgaaccgctctgcacttggcatgccgaaagggcaacgtggtgctcgcgcagttactgatctggtatggtgtcgatgttacagccagagacgcgcacggaaacaccgcgctcgcctatgctaggcaggcatcaagtcaggagtgcattgatgtgctgctgcagtatggatgcccggacgaacggttcgtactaatggcaacccctaatctgagccgcagaaataacaataggaacaattcttcagggcgcgtacccactataatctag

SEQ ID NO: 23301 - DNA, 1653 bp, Artificial Sequence
  Description of Artificial Sequence: Synthetic coding sequence
atgagccagaccagcctgaagcagaagaagaacgagcccggcatgagatcttccaaagagtccttagaggccgagaaacggaaagagtccgacaaaactggagtaagactttccaaccaaggctcacaggaatcatcactgcgcaagacagattcacgtggctacctggtaagaagccagtggtcccgcataagtcgctcacctagtacaaaagctccatctattgacgagcccaggtctcggaatacgtcggcaaagttaccatcatcctctactagcagtagaaccccaagtacatcaccaagtttgcatgattcctctccaccccctctctctggacagccctccttacagcccccagcgagtccccagctgccccggagtctggactcaaggccgcccaccccccccgagccagacccaggctctaggaggtccactaagatgcaggagaaccctgaggcttgggcccaggggatcgtccgagagattaggcagactagggactcccagcccttggaatattctagaacatcccccacagaatggaagagctcttcacagcgtcggggtatctatcccgcatccactcagctcgaccggaactctttgagtgagcagcagcaacagcagagagaagacgaagatgactatgaagctgcttattgggcctcaatgcggtcattttatgaaaaaaatccctcttgcagccgcccgtggccccccaaacccaagaacgccataaccattgccctgtcatcctgcgctctgttcaacatggtggatggcagaaaaatctatgagcaggaagggctggaaaaatatatggaataccaattaactaacgagaatgtgattctgacgccaggaccagcctttcgctttgtgaaggccctgcaatatgtgaacgccagattaagagacttataccccgacgaacaggatctcttcgatatcgtcctgatgactaataaccacgcccaggttggagtgcggctgataaatagcgtcaaccactatggtcttcttattgatagattttgtctgaccggagggaaggaccctattggctatctgaaggcctaccttacgaatctttatatcgccgcagattccgagaaagtgcaggaagcaatccaggaggggattgctagcgctaccatgttcgatggggccaaagatatggcgtactgtgacactcaactgagggttgctttcgatggagacgccgtacttttctccgacgaatccgagcatttcacgaaggaacatggactggacaagttctttcagtacgacactctgtgcgaaagtaaaccattggcacaagggcccctgaaaggtttcctagaggatctgggaaggctgcaaaaaaagttctacgcaaagaacgaaagactgctttgtcccattcgtacatatctggttacagccagatctgctgcctccagcggagcgcgggttctgaaaacattgcgacgctgggggcttgaaatcgatgaggctctttttctggcaggtgctccaaaaagtccaatcctggtcaagattagacctcatatttttttcgatgaccacatgtttcacattgaaggagctcagaggctggggtccatcgctgcgtacggcttcaacaagaaattctcgtcttag

SEQ ID NO: 23302 - DNA, 888 bp, Artificial Sequence
  Description of Artificial Sequence: Synthetic coding sequence
atgcccgtgcacaccctgagccccggcgcccccagcgcccccgccttgccttgtcggcttcgtaccagagtaccagggtatctacttagggggccagccgatggcggagcacgaaagccatccgccgtggaaaggctcgaagccgataaagcgaaatacgtcaagtccctgcacgtcgcaaatacccggcaagagcctgtccagccactgctgtctaagcaaccactgttctcacccgagacacgcaggaccgtgctcacaccttctaggagagcactcccgggcccatgccgacgtccacagcttgacctggacattctgagctcgttgatcgatctgtgcgactctccagtctccccggccgaagcatcgcgtacgcctggaagggccgaaggggccggccgacccccccctgccacccccccaaggcccccaccctctacctccgctgtgcggcgggtcgatgtgagacccctcccggcttctcccgcccggccctgtccttcgcctgggcccgcggccgcctcatctcctgctcgcccccctgggctgcaaagatctaagtcggatttgtctgaacgatttagccgggccgccgcagatttggaaaggttttttaatttttgtggcctggatccggaggaagcacgggggctgggcgtggcccacttggctcgggcctcttcagacatcgtcagtctagcggggccatccgccgggcctggtagttccgaaggcggctgtagcagaaggagctccgtcaccgtcgaggagcgcgcgagggaaagagtgccttacggggtctctgtcgtagagagaaacgccagggttatcaagtggctgtatggactgaggcaggctagagaaagcccggctgccgaagggtag

SEQ ID NO: 23303 - DNA, 549 bp, Artificial Sequence
  Description of Artificial Sequence: Synthetic coding sequence
atgagcggccggagcgtgccccacgcccaccccgccaccgccgagtatgagtttgcaaacccgtcaagactcggtgagcagcgcttcggcgaaggtctcttgccagaagagattcttaccccaaccctgtatcatggttattacgttcgcccgcgggctgccccggccggcgagggctcacgtgccggcgcctccgagctccgtttgtctgaagggaagttccaggcattcttggatgtgtcccactttacaccagacgaggtgaccgtgcgaacagttgataacctgctggaagtctctgccaggcacccccaaaggctggataggcatgggttcgtgagtagagagttctgccggacctacgtgctgcctgccgatgtggacccctggcgggtgagagctgcgctcagccacgatgggatccttaacttagaagcccctcggggagggagacacctcgataccgaggtaaacgaggtgtatatctcattgctccctgcaccacccgatcccgaagaagaagaagaggccgctatagtggaaccctag

SEQ ID NO: 23304 - DNA, 636 bp, Artificial Sequence
  Description of Artificial Sequence: Synthetic coding sequence
atgagcaccgccgccgtgcccgagctgaagcagatcagccgggtggaagccatgcggctgggcccaggttggtcgcatagttgtcacgccatgctgtacgcggctaatcccggacagctgttcgggcggatcccaatgcgattttcagtgctcatgcagatgcggttcgatggccttctgggcttcccaggcggtttcgtggatcgcagattttggagtcttgaggatggccttaatagagtgctagggctgggactcggctgtctgaggctgaccgaagcggactacctttcatcacatcttacggaaggcccccatcgagtcgttgcgcatctgtacgccaggcagttaaccttggaacagttgcatgccgtcgaaattagcgctgttcactctagggatcatgggcttgaggtgttgggtcttgtgcgcgtgcccctgtatacccagaaggacagagtcggggggtttcctaattttctgtcaaacgcattcgtcagcacagccaagtgtcagcttctatttgccctaaaagtgctcaatatgatgcccgaggagaagctcgtggaagctctggccgcggctactgagaagcaaaaaaaagccttggaaaaactcttacctgcctcctcctag

SEQ ID NO: 23305 - DNA, 2622 bp, Artificial Sequence
  Description of Artificial Sequence: Synthetic coding sequence
atgcacccccccccccccgccgccgccatggacttcagccagaactcgctcttcgggtacatggaggatttgcaggaactgacaatcatcgagcggcctgtacgtcgaagcctaaaaactccggaggagatcgagcgactgacagttgatgaggatttaagcgatattgagagagcagtgtacttactctcagccggacaggacgtacagggtacttccgtcatcgcaaatctccctttcctgatgcgccagaatccaacagaaacgctaagacgcgtgttgcctaaggtgagagaggccctgcacgtcgccggagttgagatgcaactcacggcagcaatgtcgttcctgactatcctacaggatgaatctgtatcgatccacgcatatacacactctttcctgcaagtgattcttcttcatctcgagcatcgcgacaccggagtgtcgaatgcctggctggaaactctccttagcgttattgaggtgctacccaaggaaacgctcagacacgagattctaaacccactggtgtctaaagcccagctctctcaaactgtccagagtcgcctggtgtcttgtaagatactcggtaagctgaccaacaaatttgatgcccatacaattaagcgcgagatcctgcccctggtgaaatctctctgccaagacgtggaatacgaggttcgttcctgtatgtgcagacagttggagaatatcgcccaaggcatcggcactgaactgacaaagagcgtggtacttccggagctgatcgagctttctagagacgaaggctccagcgtgaggctggcggccttcgagacgctggtgaatttactggacatcttcgataccgacgatcgaagtcagaccatcttacccctggtgaaatccttctgtgagaaatccttcaaagctgacgaatccatcttgatttctctttcctttcacctgggaaaactttgccacggcctctatggcatcttcactccagaccagcatctgcgatttctggaattttacaaaaaactgtgtactctgggcctgcagcaggaaaacggccacaatgaaaaccagattccacctcagatcctggaacaggagaaaaagtacatcagcgtgcggaagaactgcgcttataacttcccagccatgatcgtgtttgtggaccctaagaatttccacatggagctctatagtaccttcttctgtctgtgtcacgatcccgaggttccagttagatataccattgccatttgcttttatgaggtctctaagctgctaaacagtggcgtgtatttgatccacaaagaactcattaccctgctgcaggacgaatctttggaagtgctcgacgccttgattgaccacctccccgagatcctggaactcatgagtaccggaggagagtcctccgtacaagagaataaactgtcttctctccccgacctgatccccgccctgaccgccgccgaacagcgcgccgccgctagtttgaagtggcggactcacgaaaagttgttgcagaagtacgcttgtctgccccacgtcataagtagcgaccagatctattacaggttcttacagagaatgttcacaataatgatgactaataacgtgctgccagtacagaaggctgctagtaggacactttgcattttcttgcgctataaccggaagcaggaacagcggcatgaggtgatacagaaactcattgagcagctgggccaaggcaagagctactggaaccggcttcgctttctggacacttgcgagtttatcatagagatttttagcaagtcctttttttgcaagtatttctttctgcccgcgatcgagctgacccatgatccagttgctaatgtgcggatgaagctgtgttacctattgcccaaggtaaagagcacactcaagattccagcagacaaacatctgctccaacagctcgagatgtgtgtgcggaagctgctgtgccaggagaaggataaagatgtgctggccattgttaaacgcactgtattagaactggatcggatggaaatgagcatggatgcatttcaaaaaaaattttacgagaaagacctcctggatcaggaaaaggagcgggaggagttactccttcttgagatggagcagctggagaaggagaagcagcagaacgacggcagaccaatgagcgataagatgtttgagaaaaagaggcgcgacaccaaaactcccactcaaagcctacctaaaaacatccctatcagtgtccccggcccctcctcagtgactccctccacttcaaaggagattaagaaaagcaaacttatcaggagccagagcttcaataatcaggcatttcacgcaaaatacggcaacctggagaagtgcgcatccaagtccagcaccactggctacactaccagcgtctccgggttagggaagacgtccgtcctgtctctagctgatgactcctttagaaccaggaacgcatcctctgtacccagctccttctcacccaatacacctctgccttccacttctagggggaccggcaactctgttgatcccaagagttccggaagcaaagatacccaacctagaaaagcaaccctcaaatcgagaaaatccaatccatag

SEQ ID NO: 23306 - DNA, 951 bp, Artificial Sequence
  Description of Artificial Sequence: Synthetic coding sequence
atgcggcagcccctgagctggggccggtggcgggccatgctggcccggacttacggtccgggtccgagcgccggatacagatgggcatccggtgcgcagggttatgtgagaaatcctccggtaggtgcctgcgatctgcagggcgaattggatcgattcggcgggatcagcgttcgccttgctagactggatgctctcgaccgtttggacgcagcagcctttcagaagggtctgcaagcagccgtgcagcagtggaggtccgagggccggactgctgtgtggctccatatacccatcttacaatcacgctttatcgcccccgcggcgtccctggggttttgcttccaccatgcagaatcagacagcagtacactgactctctggctgagggagggccctagtaggctgcctggttacgcgagccaccaggttggagtcgctggggcggtgttcgacgaatccacacgcaagatattagtcgtgcaggatagaaataaactgaaaaatatgtggaaattccctggcggtcttagcgaaccagaggaagatatcggggacacagctgtgagagaggtgtttgaggaaactggcatcaagtcagaattccggagcgtgctcagcatacgacagcagcatactaatcccggagccttcggcaaatctgacatgtacatcatctgcagactcaagccgtacagtttcaccatcaatttttgtcaggaagaatgcctccgctgtgagtggatggatctgaatgacctggcaaagacagagaatactaccccaatcaccagcagggtcgcccgcctgctcttgtacggctatagagaaggtttcgacaagattgatctcactgtagaagaactgcctgccgtctacactgggttgttttataagctgtaccacaaggaattgcccgagaattacaaaacgatgaagggaatcgactag

SEQ ID NO: 23307 - DNA, 537 bp, Artificial Sequence
  Description of Artificial Sequence: Synthetic coding sequence
atgggcgagacctggaagaacatctgcagcaccgtgcggcacggctggtggctgcgcgatcatcgcatggccggtctgccgatcccaccggagatagtgaaagaggccgaagtgcctcaggcggccttgggagtccccgctcaggggaccggcgacaacgggcatacccctgtagaggaggaggtgggaggtatccctgttccagccccaggcctgctgcaagtgacagaacgacgccaaccattgtctagtgtttcttcactggaagttcactttgacctgctagatctaacagaactgactgacatgtccgaccaagaactcgcagaggtattcgccgactctgacgacgagaacttgaacaccgagtccccagccggcctccacccattaccccgggctggatacctccggtccccaagctggactaggaccagggccgagcaaagccatgagaaacagccactgggggatcctgagagacaggctactgtactcgacacgtttctcacagttgaaaggcctcaggaagactag

SEQ ID NO: 23308 - DNA, 741 bp, Artificial Sequence
  Description of Artificial Sequence: Synthetic coding sequence
atggccgagcaggagcagcggaagatccccctggtgcccgagaacctgctgaagaagcgtaaggcctatcaggctctgaaagcgacacaggccaagcaggcactcctcgccaaaaaagagcagaagaaaggaaagggactccggttcaagaggcttgagtcctttttacacgatagttggcgtcagaaacgggacaaggtcagacttcggcggctcgaggtgaagccccatgccctggaactgcccgacaaacactctttggcttttgtggtgcggattgaaagaatcgacggcgtaagcctgctggtgcaaagaacaattgcaaggctgcggctgaaaaagattttctccggagtgtttgttaaggtgacacctcagaacttgaaaatgctacgcatagtggagccttacgtgacctggggtttccccaacctgaagtcagtgagggaactcatcttgaaaaggggacaggctaaggtgaagaataagacaattccacttaccgacaatactgtgattgaggagcatctggggaaattcggtgtgatttgcttagaagacctgattcacgaaatcgcattccccggaaagcactttcaggagattagctggtttctgtgcccattccaccttagcgtagccagacatgccaccaagaatcgagtaggcttcctcaaagagatgggcaccccaggatatcgaggagaacgcatcaaccagctgatccgccagctgaactag

SEQ ID NO: 23309 - DNA, 2442 bp, Artificial Sequence
  Description of Artificial Sequence: Synthetic coding sequence
atggcctggccctgcatcacccgggcctgctgcatcgcccggttctggaatcagctggataaagctgatatcgctgtcccactggttttcaccaagtactccgaggctacagaacatccaggcgcccctccacaacctccacccccccagcagcaggctcagccggccctggcaccccccagtgctcgagcggtggcaatcgaaacccagcccgcccagggcgagcttgacgccgttgcacgcgcgaccggaccagcacccggcccaacaggagaaagagagcccgcggccggtcctgggagatccggtccaggacctgggctgggaagtggctccaccagcgggcctgcggacagcgtcatgagacaggattatagagcatggaaggttcagaggcccgagccgtcctgcaggcctcggagcgagtaccagccaagcgacgcccccttcgagcgagagactcagtaccagaaagacttcagagcgtggccgctgccccgcagaggtgatcacccttggatccctaagcccgtgcagataagtgctgcgtcccaagcttctgctcctatactgggggcacctaaacgccggccccaatctcaagagaggtggcctgttcaggctgctgcagaggcccgagaacaggaagcagctccgggtggggccggaggcttggcagctggcaaggcttctggcgctgatgagcgtgatacccgcaggaaggcggggcccgcttggatagtgcgcagggcagaaggtctgggacacgaacagacacctcttcctgctgcacaagcccaggttcaggctacaggccccgaggctggccgcggccgagccgccgctgatgccctgaataggcagattcgtgaggaagtggccagcgctgtgagctctagttacagaaacgagttccgagcgtggacagacataaaacctgtgaagcccatcaaggcgaagccacagtataaacccccagacgacaagatggttcacgagacaagttatagcgcacagttcaaaggcgaggcgagcaagccaacaacagctgataacaaggtcatcgatcgtcgccggatcaggtcactgtattccgagccattcaaggagcctcctaaggtcgaaaagcccagtgttcagtctagcaaaccaaagaagacatcggcaagccacaaacccacgcgaaaggcaaaagataaacaagccgtctcaggccaggccgccaaaaagaaatcagccgaggggccaagcacaaccaaaccagacgataaagagcagtccaaagagatgaacaataagttggcagaagctaaggagtcactcgcgcagcccgtctcagatagctccaaaacgcaggggccggtggctaccgaacccgataaagatcaaggttcagtcgtccccggcctgttaaaaggccagggcccgatggtacaggagccgctgaagaagcaaggttctgttgttccaggcccccccaaggacctgggcccaatgattcctctacccgttaaagatcaggatcacaccgttccagaaccccttaagaatgaatctccagtgatatctgctcccgtcaaagatcaggggccatccgtaccagtccccccaaaaaatcaatctcctatggtccctgcaaaggtcaaggaccaaggctctgttgtgcctgagtcactcaaggaccaggggccaaggatccctgagccagtgaaaaaccaagctccaatggtcccagctccggttaaggacgaggggccaatggtgtctgcctctgtgaaggatcagggtccaatggttagcgctcccgtgaaggatcaaggtcctatcgtgcccgccccagttaaaggcgaagggccaattgtgcccgcacccgtaaaggatgagggcccaatggtgagtgcccccattaaagaccaggatccaatggttccagaacatcccaaagatgagagcgctatggccactgcgcccatcaagaaccaggggtctatggtgagcgagcccgtgaagaaccaggggctggtggtttccgggccagtgaaggatcaggacgtggtagttcctgaacatgctaaagtccatgatagcgccgtggtggccccggtgaaaaaccaggggcccgtggtgccggagtccgtcaaaaatcaggaccctatactcccggtcctggtcaaagaccagggccctacagttctgcagccccccaagaaccagggcagaatcgttcccgaacctctaaagaaccaggtcccaattgtacctgtgccactgaaggatcaggatcctctcgtgcccgtcccagcgaaagaccaggggcccgcggtgcccgagcctctcaaaacccaaggccccagagacccccaactccctaccgtcagccccctcccgagggtaatgatccctaccgcaccacatactgaatacattgagagctccccctag

SEQ ID NO: 23310 - DNA, 261 bp, Artificial Sequence
  Description of Artificial Sequence: Synthetic coding sequence
atgccccagtaccagacctgggaggagttcagccgggccgccgagaaattgtatcttgctgaccctatgaaagcacgggtggtactcaagtatcgacacagcgacgggaatctgtgtgtaaaggtcaccgacgatctggtgtgcctcgtatacaagaccgatcaggcacaggatgtgaaaaaaattgaaaagtttcactcccaactgatgcggctgatggtcgcgaaggaggctagaaacgttactatggagaccgaatag

SEQ ID NO: 23311 - DNA, 1206 bp, Artificial Sequence
  Description of Artificial Sequence: Synthetic coding sequence
atggcccacgtgagcagcgagacccaggacgtgagccccaaggacgagctcacagccagtgaggcttctacccggagccccctttgtgaacacacatttcctggtgatagcgatctgcgcagcatgatcgaggagcatgcttttcaggtgctctcacaggggtccctcctcgaatctccaagctatacggtttgtgtttcagaacccgacaaagatgacgatttcctgtccctgaacttcccacgcaagctatggaagatcgttgaatcagatcaattcaagagtatctcctgggacgagaatgggacatgcatcgtgattaacgaagagctgttcaagaaggaaattctggagaccaaggccccctacaggatctttcaaacagatgccatcaagagcttcgttcggcaactaaacctctacgggttttcaaagatccagcagaacttccagcggtctgcatttcttgctacttttctctcggaagagaaagaaagctctgtcctctctaagctcaagttctactacaatcccaattttaagcgaggttaccctcaattgctggttcgggtgaagcgcagaattggggtcaagaatgcaagccccatttccactctgtttaatgaggacttcaataaaaaacatttcagggctggggccaacatggagaaccataatagcgcactcgccgcagaggccagtgaagagtctttgtttagcgcaagtaaaaacctgaatatgcctcttacaagagagtcttcagtcaggcaaataatcgccaattccagtgtgccgatacgttctgggttccccccccctagcccttcgacatccgtggggcccagcgagcaaatcgcaacagaccaacacgcaatcctgaaccagctgaccacaattcacatgcacagtcacagcacatatatgcaggccagaggacacattgtgaactttatcacaactaccacgtcacagtatcacatcatctcccccctacaaaacggctactttgggctgactgtggagccatccgctgtgccaacaagataccccctggtgtcagtgaatgaagccccttaccgcaatatgttacccgccgggaacccatggctccagatgcctaccattgcggacagaagtgcagccccacattctcgcttggctctgcagccctcgcccttggacaaataccaccccaactacaattag

SEQ ID NO: 23312 - DNA, 4302 bp, Artificial Sequence
  Description of Artificial Sequence: Synthetic coding sequence
atgtggagcctgaccgccagcgagggcgagagcaccaccgcccactttttcctcggcgctggtgacgagggcctcggaactcgcggcattggaatgcggcccgaagaatctgacagtgagctcctagaagatgaggaggatgaagtgcccccagagccacagataatcgtgggtatctgtgccatgacgaaaaagagcaagagcaagccaatgacacaaatacttgagcgcttatgccggtttgactacctgaccgtggttattttgggtgaagacgttatcctcaacgagcccgtcgagaactggcctagctgccactgccttatctcgtttcactcaaagggctttccactggacaaggccgtggcatacagtaaactgcgcaatccatttctgataaacgacctggccatgcagtattacattcaagataggcgggaggtgtaccgaatccttcaggaggagggaattgacctgccgaggtatgcggtcctcaacagggacccagccaggcccgaagagtgtaatctgatcgaaggagaagatcaggtcgaagttaacggcgcggtattcccaaagcccttcgtagaaaaaccagttagtgcggaagaccataatgtctatatttattacccaagctcagccggtggcggctctcagagactctttagaaagataggaagtagatcttcagtatacagtccagaatcaagcgtacggaaaacggggtcatacatttacgaggagttcatgccaaccgacggcactgacgtgaaggtatatacagtgggacccgactacgcacatgctgaagctcggaagtctcctgcactcgatggtaaagtagagagagatagcgaaggtaaggagatccgctatccagttatgttgaccgctatggaaaagctggtggcgcggaaggtgtgcgtggcctttaagcagacggtgtgcgggtttgatctgctgcgggcaaatggccattcttttgtgtgcgatgttaacgggttcagcttcgtcaagaatagcatgaaatactacgatgactgcgctaagattctgggcaatacaatcatgagagagctggcaccacagtttcagataccctggagcatccctacggaagctgaggacattccaatcgtgccaacgacttcagggacaatgatggaattgcggtgtgtaatcgcgatcattcgtcacggagatagaaccccaaaacaaaagatgaagatggaggtgaaacaccccaggttctttgccctgtttgagaagcatggtggatataaaaccggaaagctgaagttgaagcggcccgaacagttacaagaggtgttagatatcaccagactgcttctggctgaactcgaaaaagagcctgggggtgagattgaggaaaagactggaaagctggagcagctcaagagtgtcctagaaatgtacggtcactttagtgggatcaacaggaaagtccagctaacctactacccccacggcgtgaaggcaagtaacgaggggcaggaccctcagagggaaacgctcgctccctcgctgttgctcgtgctcaagtggggcggcgagttgaccccagctggcagggtccaagctgaggaacttggtagggcttttaggtgcatgtaccccggcgggcagggcgattacgccggatttcccgggtgcggcttactgcgcttacactccacattccgtcacgacctgaaaatctatgccagcgatgagggaagagtccagatgactgctgccgccttcgcgaaggggctgctggctcttgaaggcgaactaacgccaatcctggttcaaatggttaaaagcgctaacatgaatggcctactggattccgatggtgactccctgtcctcatgtcaacacagagtgaaggcacggttgcatcatatactccaacaagacgctccttttgggccggaggattatgaccagctggcaccaacacggtctacaagtttgctcaacagtatgaccattatccagaatccagttaaagtctgtgatcaggtctttgcactaatagagaaccttacccaccagattagagagagaatgcaggatcccaggtccgttgacctgcagctgtaccactccgagacattggaattgatgctgcagcgttggagcaagctcgaaagagatttcagacagaaaagtgggaggtacgatatttccaagatccccgacatctatgattgtgtgaaatatgacgtgcaacacaacggttcactcggcttgcagggcaccgctgaacttttaaggctcagcaaggctctggcggacgtggtgatccctcaagagtatggtatttcacgggaggagaagctggagatcgccgtcggcttctgtctgcccctgcttagaaagatcctgcttgatctgcagagaacacacgaggacgagagtgtgaataaactgcatcctttatgttacttaagatactcaagaggcgtgctctctcccggacggcacgtacgcactcgcctttatttcaccagcgaaagccacgtgcactccctgctctccgttttccggtatggcggtcttcttgacgaaacccaggacgcacagtggcagagggcactggattacctgagtgccatatccgagctgaattacatgacgcagattgtaatcatgctctacgaagataatacacaggacccgctgagtgaggaaagattccacgtcgagctgcacttcagtcctggtgtgaaaggagttgaagaggaagggtcagctcctgccggctgtggcttccggcctgcttcttccgaaaacgaagagatgaagactaatcaggggtcgatggagaacctctgtcccggaaaggcttcagacgagcccgacagagccctacaaacaagtccacagcctcccgaggggcccgggctgcctaggagatcacctctaatccgtaatcgtaaggctggatctatggaggtgctgtccgagacttccagctcccgacctggtggttaccggctgttttcttcaagtcggcctcctaccgagatgaagcaaagtgggctaggcagtcagtgcaccggcctatttagcaccacggtgctgggcgggtccagctctgcgcccaacttgcaggattacgccaggagccacggaaaaaaattacctcctgcatctctgaagcacagggacgagctcctgttcgttccggccgtgaagcgattctccgtttcattcgcgaaacatccgaccaacgggttcgagggatgtagtatggtgccaacaatataccccctcgagactttacacaatgccctaagcctacggcaagtcagcgaattcctgtctagagtgtgtcagcgccacactgacgcacaggcccaggcttcagcggccctcttcgatagcatgcactcctcccaggcatcagacaacccatttagccctccccggaccttgcacagtcctcccctccaactgcagcagagaagtgagaagcctccctggtattcgtcaggcccatcctcaacggttagctccgctggaccgagcagcccaactactgtcgatggaaacagccagttcggctttagcgaccagccgagtttgaactcacatgtggctgaggagcaccaagggctgggattgctgcaagagacgccaggcagtggggcccaagaactctccatagagggggaacaggaattgttcgagcctaaccagtctcctcaggtccctccgatggaaacctcccagccttatgaggaagtatcccaaccatgtcaagaagtgcctgacatctcccagccatgccaggatattagtgaagccctctcgcaaccctgtcagaaggtgcccgatatttcacagcaatgtcaggagaatcacgataacggcaatcatacctgccaggaggtaccccacattagccagccctgtcagaagagcagccaactttgtcaaaaggtgtctgaagaagtctgtcaactgtgcttggaaaattctgaggaggtgtcccaaccttgtcagggtgtgtctgtggaggttgggaaactggtccacaagtttcatgtcggggtgggaagccttgtgcaggaaactttagtggaagttgggtcacccgctgaagaaataccagaggaggttatccagccatatcaggagttcagcgttgaggtgggccggctcgcgcaagagacctccgccattaacctgctcagccaggggatcccggagattgataagccatcccaggagtttcccgaagaaatagacctgcaagcgcaggaagttcccgaggagattaactag

SEQ ID NO: 23313 - DNA, 1137 bp, Artificial Sequence
  Description of Artificial Sequence: Synthetic coding sequence
atggacagcgtgcggagcggcgccttcggccacctgttccggcccgataattttattttcggtcaaagcggagctggcaataactgggccaagggacattacacagaaggagccgagctggtcgactcagtccttgatgtggtgcgaaaggagtgcgagaactgtgattgtctccaagggttccaattgacacactctctgggtggaggaacgggctcaggtatgggcaccctcttaatctcaaaagttagggaggagtatccagatcgaataatgaacacgttctcagtcgtccccagtcctaaagtttctgatactgttgtagagccttataatgctacactgagcatccaccagctcgtggagaataccgacgaaacttactgtatcgataatgaggcactgtacgatatttgtttccgcacgcttaaactggcaactcccacctatggcgacctgaatcatttagtgagcgctaccatgagtggcgtcaccactagccttcgatttccaggccagctgaatgcggacctgcggaagttagccgtgaacatggtgcctttcccacgcttgcacttttttatgccaggctttgccccgctcaccgcaagaggaagtcagcagtatcgcgccctcacagtgcctgagctgacccagcagatgttcgatgccaaaaacatgatggccgcttgtgatcctagacatggaagatatctcacagtggctactgtgttcaggggtcggatgtctatgaaggaggtcgatgaacagatgcttgcaatccagtcaaaaaattcaagctacttcgtggagtggattcccaataatgtgaaggtcgctgtgtgtgatattccacctaggggtcttaagatgtcttcaacattcatagggaatagcacagcaatccaggagttgttcaaaaggatttccgaacagtttacagccatgttccgtcggaaggccttcctgcactggtatacaggcgaaggaatggatgaaatggagttcacggaagccgagagcaatatgaacgatctggtgagcgagtatcagcagtaccaggatgccactgccgaggaggaaggggagatgtatgaggacgatgaggaagagtccgaggcccagggacccaagtag

SEQ ID NO: 23314 - DNA, 1161 bp, Artificial Sequence
  Description of Artificial Sequence: Synthetic coding sequence
atgtgcgagcgggccgcccggctgtgccgggccggcgcccaccggcttttacgcgaacccccgcagcaaggtcgcgctctgggcggcctgctaaggtgggtgggtgcacgcatgggcgaaccacgcgagtcattagcccccgctgcccccgccgatccaggcccagcctcccctcggggggggactgcggtgattctcgacatttttaggcgcgcagataagaatgatgacggcaaactttcgttggaggagtttcaattgttttttgcagacggagtgctcaatgaaaaagagttagaagatctctttcacaccatcgattccgacaatactaaccacgtggacaccaaagagctgtgcgactactttgtcgaccacatgggcgattatgaggacgttctcgcttctctggaaactcttaatcactcagtgctcaaagcaatggggtacaccaaaaaggtgtatgaaggaggcagtaacgtggatcagtttgtgacgagatttctccttaaagaaaccgcaaaccagattcagtctcttctgtcctctgtggagtccgctgttgaggcaattgaagaacagacatcacagttacggcagaaccatatcaaacccagccattctgcagcgcaaacttggtgtgggtccccaacaccagcctccgctcctaaccacaagttgatggctatggagcaggggaaaacactaccctccgctacagaggatgcaaaggaggaagggcttgaggctcagattagccgactggccgagctcatcggccggcttgagtctaaggccctgtggtttgaccttcaacagcgactctcagatgaggacggcacgaatatgcaccttcaattagtcaggcaggaaatggccgtttgcccggagcagttgagcgagtttcttgattcccttcgacagtatctgcgcgggaccacaggggttcggaactgcttccatataactgcagttaggttgtcggatgggttcacgttcgtgatttatgagttttgggaaacagaggaggcttggaaacgccatttgcagagtccactgtgtaaggctttccggcacgttaaggtggatactctgagccagccagaggctctttcacggattctggtgcccgctgcctggtgcacggtcggacgggattag

SEQ ID NO: 23315 - DNA, 1482 bp, Artificial Sequence
  Description of Artificial Sequence: Synthetic coding sequence
atggagcggagccccgacgtgagccccggccccagccggagcttcaaggaggagctgctgtgcgcggtttgttacgatccctttagagatgctgtcacattacggtgtggccataacttctgtaggggctgcgtgtcacggtgttgggaggtacaggtttcgccaacatgccctgtgtgcaaagatagggcttccccagcggacctgaggacaaaccacacactcaataacctcgtggaaaaactcctgcgagaagaggcagagggcgccaggtggacctcctataggttcagccgagtgtgccggctgcacagaggccagttgtccctcttctgcttagaggacaaagaattgttgtgctgttcctgccaggctgatccacggcaccagggtcatagagtacagcccgttaaggataccgcacacgattttcgcgcaaaatgccgcaatatggaacacgctctcagagaaaaggcaaaggcgttttgggccatgagaaggtcttatgaggcaatagccaagcacaaccaggtggaagccgcatggctggagggacgcattcgccaggagtttgataaactccgcgagtttctcagggtggaggaacaagccatcctggatgcaatggctgaggaaactcggcagaaacaactgctggcagatgagaaaatgaagcagctcacagaagaaacggaggttctcgcacacgagattgagcggctccagatggaaatgaaggaggacgatgtgagttttctcatgaaacacaagtcccgcaaacgcagactcttctgtactatggagccagagcctgtacagcccggcatgctaattgacgtctgcaagtacttagggtccctacagtacagagtgtggaaaaagatgctggcctcggttgagtctgttcccttttcatttgatcccaacaccgctgcgggatggctttcggtgtccgatgacctgacctcagtgaccaaccatggatatagggtccaggtggaaaatcctgagaggttttctagcgcaccttgcctcctgggttccagagtgtttagccaggggtcacatgcctgggaagtcgcactgggaggactgcagtcctggcgcgttggagtcgtgcgtgtgcggcaggactcaggagcagaaggccactctcacagttgttaccatgatacccgctcgggcttttggtatgtgtgcaggacacagggggtggagggagaccactgcgtaacaagcgaccctgcgactagccctttggttctcgccattccccgacgcttgcgcgtggaacttgaatgtgaagaaggagagctgtccttctacgacgctgagcgacattgccacctgtatacattccacgccagattcggcgaagtgaggccgtatttttacctgggtggggcccggggtgccggtcctcccgagcccctgcgcatttgtccccttcacatcagcgtgaaggaagagctagatggttag

SEQ ID NO: 23316 - DNA, 2262 bp, Artificial Sequence
  Description of Artificial Sequence: Synthetic coding sequence
atggcccccgacagcgaccccttccccgagggccccctgctgaagctgctcccgcttgacgctcgggaccgaggaacacagagatgcagactgggacccgccgcccttcacgcgctaggcgccagactgggctccgccgtcaagatcagcttacccgatgggggttcatgcctttgcaccgcatggcctaggcgagacggtgccgacggctttgtgcagctcgacccactgtgtgcctcgcccggtgccgccgtcggagccagcagatctcgacgatctctgagtctgaatagacttctgctcgtgccctgtccccctctgcgacgggtggccgtgtggcccgttctcagggagcgggccggtgcccccggtgcccggaacacagcagccgtccttgaggcggcccaagagctgctgaggaatcgtcccatctctcttggacatgtggtcgtggcacccccaggggctcccggactagtagccgcactccatatagtcggcggcacgccttccccagaccctgctggtctcgtcacccctcgcaccagagtgagcctgggcggtgagcctccctccgaggcacagccacagcccgaagtgcccctcggcggcctttccgaagcagccgatagtctgagagaattactgagattgcccctcagatatccgcgagccctgacagcattgggcttggccgttcctcggggggtcctgctcgcggggccacctggtgtcggtaaaacacagctagtccgggcagtggcacgggaagcaggagcagagctcctggctgtctcggcccctgcacttcaggggtctagacctggcgaaaccgaggaaaacgttaggagagtcttccagagagccagggaattggcgtcacgtgggccttctctcttgttcctcgacgaaatggacgcactgtgccctcagaggggtagcagagcccccgagagcagagttgtagcccaagtgcttactctgcttgatggtgcctctggcgatcgggaagtggtggtggtgggcgccacaaaccgccccgatgctctcgatcctgccctgcgtcgtcccggacgcttcgatagggaagttgtaatcggaactccgaccctgaaacagcggaaggaaatactgcaggtcatcacgagtaaaatgccaatctcttctcacgttgatctcgggcttctggctgaaatgacagtcgggtatgtaggcgctgatttgactgccctttgtcgggaggccgccatgcacgctttgttgcactcggaaaaaaaccaggacaatcctgttatcgacgaaatcgattttctggaagcattcaaaaacattcagccctcctcttttaggagcgtgataggtctgatggacatcaagccagtggactgggaagaaataggaggactcgaagatgtgaaacttaagcttaaacaaagtatcgagtggcccctcaaattcccatgggaattcgtgagaatgggccttacccaaccaaagggggttttactgtacggcccacccgggtgcgccaaaaccaccttagtgagggctttggccacgagctgtcattgtagtttcgtgtctgtttccggcgcagatttgttctctccatttgtcggagactctgagaaggtcctcagccagatcttccgccaagccagagcgagtactcctgccatactgttcctagatgaaatagacagcatactgggagcccggtccgcaagcaagaccggctgcgacgtgcaggaacgggttctcagcgtgttgcttaacgaactggatggcgtgggtttgaaaacaatcgagcgcagaggctctaagtcttcacagcaggagttccaagaggtttttaacaggtctgtgatgattatcgcggcgacaaaccgccctgacgtgctggatactgccctactgcgtccaggacggctagacaagattatttacattccgcctccagaccataaggggaggcttagcattctgaaggtttgtacgaaaaccatgcctatcgggcccgacgtgagtctagaaaatctggccgccgaaacttgtttcttctccggagccgatctccggaatctgtgtactgaggcagctctcctggccctgcaggagaacggccttgacgcgaccacggtgaagcaagaacactttctcaagtcattaaagaccgtaaaaccctccttgtcgtgcaaagacctagccttatatgaaaacctctttaagaaagagggattctcaaatgtcgagggcatctag

SEQ ID NO: 23317 - DNA, 1026 bp, Artificial Sequence
  Description of Artificial Sequence: Synthetic coding sequence
atgcccaagcggaaggtgaccttccagggcgtgggcgacgaggaggacgaagacgaaataattgtgccgaaaaaaaaactcgtggatcctgtggccggctccgggggtcccggatccagattcaaggggaagcactcactggatagtgacgaagaagaagacgacgatgacggtggttcatctaaatacgacattctggcctcagaagacgttgagggccaagaagctgccacactgccttctgagggcggcgtacggattacccccttcaatcttcaagaggagatggaagaaggccactttgatgctgacggaaactacttcctcaatcgggatgcacagatccgcgacagttggctggacaatatcgattgggtcaagatcagggagaggccccctggtcagcggcaagccagcgacagcgaagaggaagatagtctgggccagacctcgatgtccgctcaggccctgctggaggggctgctcgaacttctgttgccacgggagacagtagccggagccctacgtaggctgggagcccgcggagggggtaagggcagaaaaggccctgggcagccttcatccccccagagattggataggctgagcggattggccgatcagatggtcgcacgagggaacctgggtgtgtatcaggaaaccagagagcgtttagccatgcgactaaaaggccttggctgccagacacttggtccccacaaccctactcccccgccatccctcgacatgttcgctgaagaactcgccgaggaagagctggagacccccactccaactcagaggggggaggcagagagtcgaggagacgggctggtggatgtcatgtgggagtataagtgggaaaatacaggcgatgccgagctatacggaccttttaccagcgctcagatgcagacatgggtgagtgaaggctacttccccgacggagtctactgtaggaagcttgatccccccggggggcaattttacaacagtaaacgaatcgacttcgatctgtatacatag

SEQ ID NO: 23318 - DNA, 690 bp, Artificial Sequence
  Description of Artificial Sequence: Synthetic coding sequence
atggccgaggagatggagagcagcctggaggccagcttcagcagcagtggagccgtgtcgggggccagtggctttctgccgcccgcacggagccggattttcaagatcattgtgattggcgactccaacgtcggtaagacctgtcttacgtaccggttttgcgcaggtcggtttcccgacagaaccgaagcaaccatcggagtggattttcgcgagcgggcggtcgagattgacggcgaaaggattaaaattcaactgtgggatacagcaggacaggagcgattcaggaaaagcatggtgcagcactactatcgcaacgtacacgctgtagtattcgtctatgatatgactaacatggctagtttccatagcctacccagctggatagaagagtgcaagcaacatcttcttgccaatgatatcccgaggattctggtgggaaacaagtgtgatttgcggtctgcaatacaggttccaaccgacctggcacaaaagttcgcagatacacacagtatgcccttgttcgaaacttccgctaagaacccgaatgataacgatcacgtggaagcaatttttatgactctagcacacaagctgaagtcccataagccactgatgctttcccaacccccggacaatggaatcatattgaaacccgagcctaagcctgcgatgacatgttggtgttag

SEQ ID NO: 23319 - DNA, 2352 bp, Artificial Sequence
  Description of Artificial Sequence: Synthetic coding sequence
atgctgctgggcttccggcggggccggcggagccacttcaagcacatcattcatgggttactccctgctgcctctgtggcccccaaagccgccgtcccccgcacccctcctcctcgctcgcctaacccatcacccgaacgccctcgatcagcccttgctgcggccatccttgctaccaccctgacaggaaggactgtcgccattccccaaccacgccagaggagcaggtctgagtctgatgtttcctctgttgaacaggattcgttcatagaaccttatgctactactagccagctgcggcctaggcccaattggcagtcagagatgggacggcgatcatcccttccgtctttcgaaactcttgactatggggatgaagaagatattgagacccaactgagtagcagtgggaaagaactcggggacgtcagtgcccgggaagacagaggcgggcactctgatgatctctatgccgtccctcacaggaaccaggtgcctctattacacgaggtgaattccgaggatgacgagaatataagccatcaggatgggttccctggatcaccgcccgccccacaaagaacccagcagaaagacgggaagcaccccgtgcttaacctaaaggatgaaaagccacccttgtgcgagaagccccctccttctcccgacatcacagggcgagcccgacaaaggtatactgagatcacacgcgagaaattcgaggcactgaaggaagaaaacatggacctgaataacatgaaccaatcattaacccttgagctgaatacaatgaagcaggcgatgaaggagctgcagctgaagctgaaaggaatggagaaggagaagagaaagctgaaagaggccgagaaagcctccagccaggaggtagcagcccccgaattactttacttacgcaagcaggcccaggagctcgtagacgaaaatgacggcctgaagatgaccgtgcatagactcaacgtggaactcagtcggtaccaaactaagttccgccacctttctaaagaagagagtctaaacatcgaggggctcccttcaaaaggtcccatacctccctggttgctggacatcaagtaccttagccctcttctgttggcttacgaggacatgatgaaggaaaaagacgagctgaacgctacgctcaaggaagaaatgcggatgtttaggatgcgggtccaagaggtcgtcaaagagaatgaagagcttcaccaggaactgaacaagtcatccgccgtcaccagcgaagagtggaggcagctgcagactcaagccaagttagtcctggaggagaacaaactactcttggagcaactggagattcaacagagaaaggctaaggatagtcaccaggagaggctgcaggaagtgagtaaactcacaaagcagttgatgttactcgaagctaagacccacggccaggaaaaagagcttgctgagaatcgcgagcaattggagatcctccgagcaaagtgccaggagctaaagacccactctgatggtaagatcgcagtggaagttcacaaatcaatcgtaaatgaactaaagtctcagctccagaaggaagaagaaaaagaacgggcagaaatggaggagctgatggaaaagctcacggttctgcaggcacagaaaaagagtctgctgctggaaaagaattccctgaccgagcagaacaaggcacttgaagctgaacttgagagagctcagaagatcaaccggaaatcccagaagaagatcgaagtgctcaagaaacaggtagaaaaggcaatgggcaacgaaatgagtgcccatcagtacctggcgaacctcgtgggcctcgccgaaaatatcacccaggagcgggacagtcttatgtgcctagccaagtgccttgagtctgaaaaggatggtgtgctgaataaagtgattaagtctaatattagactgggcaaactggaggagaaggtaaagggatataagaagcaggcggctttaaaactgggcgacatctcccacaggttactggagcagcaggaagattttgctgggaagactgcacagtatcgtcaggagatgaggcatctacatcaggtgcttaaggataaacaggaggtcttggatcaggcactccaacagaatagggagatggaaggggagctagaagttatttgggaaagtacgttccgagaaaatagacgaattagagaattgctgcaggatactttaactcgcaccggagtccaggataaccctcgagcacttgtagcgcctagcctgaacggcgtgtctcaggcggatctgctggacggctgcgacgtctgctcctacgacctcaaatcccatgctcccacttgctag

SEQ ID NO: 23320 - DNA, 639 bp, Artificial Sequence
  Description of Artificial Sequence: Synthetic coding sequence
atggccgcccggcggggcgccctgatcgtgctggagggcgtggacagggccggcaaatccacacagtcacggaaacttgtggaggctctgtgtgctgctggtcaccgcgccgagctcctgaggtttcctgagcggagcacagagatcgggaagctcctctcaagctatctgcagaaaaagagtgatgttgaggatcacagtgtgcacctgcttttttccgcaaacaggtgggaacaagtccctctgattaaggaaaaacttagccagggcgttactctggtggtagacaggtatgccttcagcggcgtcgccttcacaggcgccaaggaaaatttctcactcgactggtgcaaacagccagacgtgggtcttccaaaacctgaccttgtactgttcctgcaactgcagcttgctgacgccgccaaaagaggggctttcgggcacgaaagatacgagaatggggcattccaggagagagcgctgaggtgttttcaccagttgatgaaggacacaacattgaactggaaaatggtcgacgcaagcaaaagcattgaggctgtgcacgaagatatccgcgtgctgtctgaagacgctatccgaacagctaccgagaaaccgctcggtgaattgtggaagtag

SEQ ID NO: 23321 - DNA, 504 bp, Artificial Sequence
  Description of Artificial Sequence: Synthetic coding sequence
atggaggagacctacaccgacagcctggaccccgagaagctgctgcaatgcccttatgataaaaatcatcagattcgggcatgtagattcccctatcacctcattaaatgtagaaagaatcaccctgatgtagccagtaaactggcgacctgtccattcaacgcgcggcatcaagtgcccagggccgaaatttcccaccatattagctcttgcgatgatcgcagctgtatcgagcaggatgtggtgaatcagactcgctctctgcgccaggaaaccttggcagaatctacatggcaatgtccgccatgtgatgaagactgggataaagatctatgggagcagacgagcacccccttcgtatggggtactactcactactcagacaacaatagtccggcttcaaacatagtgaccgaacacaagaataatcttgcaagcggcatgcgggtgcccaaaagtctaccctacgttctgccttggaagaataatggaaacgcccaatag

SEQ ID NO: 23322 - DNA, 381 bp, Artificial Sequence
  Description of Artificial Sequence: Synthetic coding sequence
atggccgccggccccgagccccccgagtgggagccccggtggcggaaagccctgagaggaaaggagaataaggggtcagtagaaataatgcgcaaagatctcaacgacgctagggatctccacggacaggctgaatccgcagcagctgtgtggaagggacacgttatggaccgccggaagaaggcactcacagactacaagaagctgagagccttctttgtagaggaagaggagcactttctacaggaggctgaaaaggaagaaggcttgcccgaagacgagctcgccgaccctacagagcgattcagatcacttctgcaggctgtgagcgagctggagaagaagcacagaaacctggggctaagtatgcttctccagtag

SEQ ID NO: 23323 - DNA, 1668 bp, Artificial Sequence
  Description of Artificial Sequence: Synthetic coding sequence
atgcagagctgcgagagcagcggcgacagcgccgacgaccccctgagcagaggtctcaggcgcaggggccaaccacgagtagttgtcataggggctggacttgctgggctcgcggcggccaaggctctgcttgagcaggggtttaccgacgtcactgtgctcgaagccagctcccacattggaggtcgagtgcaatcagtgaagctgggacacgctacattcgagctgggggctacgtggatacacgggagtcatggtaatcccatatatcatttggccgaggctaacggtctactggaggagaccacggatggcgaacggagcgttggtagaataagtctctatagcaagaacggcgtggcttgttatctcacaaaccatgggaggaggatacccaaggacgtcgtggaggagttctcggatctgtacaacgaggtgtataacttaacacaggaattttttcgccatgacaagccggtaaatgcagagtctcagaacagcgtgggcgttttcacacgagaggaagtacggaacagaatccgtaacgatcccgatgaccctgaagctacaaaaaggcttaagctggcgatgattcagcagtacctgaaggttgagtcctgcgagagcagctcccactctatggatgaagtgagcctgtcagcctttggggagtggaccgaaattccgggcgctcaccacatcattccatctggatttatgagagtagtggagttgttggctgagggtattcccgcccatgtcatacagttaggtaagcctgtccggtgcatccattgggatcaggcctcagcccggccaaggggacctgaaatcgaacctcgcggcgaaggggatcacaatcacgacaccggggagggggggcaaggcggtgaagaaccgcgcggaggacgctgggacgaagatgagcagtggtcagtggtggttgagtgcgaggattgtgagctgattccagcagatcacgttattgtgacagtgtcccttggcgtccttaagaggcaatacaccagtttcttccgccccggcctccccactgaaaaggtcgcagcaattcatcgactaggaataggtaccacagataagatattcctggaatttgaggaaccattttggggaccggagtgtaacagcctgcaattcgtctgggaggatgaagcagaatcacatactctaacctaccctccagaactttggtacagaaagatttgtgggttcgacgtgctttacccacctgagaggtacggccatgttttatctggctggatttgtggcgaagaggctttggtcatggagaagtgtgacgatgaagccgttgccgagatatgcactgagatgctgcggcaattcaccggcaatccaaacatacctaagcctcgacgaatactacggtcggcctggggctcaaacccttattttcgagggagctattcctacactcaagttggttcttcaggcgctgacgtcgaaaagctcgctaaaccattgccctacaccgaatcctccaagacagccccgatgcaggttttatttagcggggaagccactcaccggaaatactattccacaacccacggtgccctgttgtcgggtcagcgagaggctgcacgtctcatcgaaatgtatcgcgacctctttcagcaaggaacttag

SEQ ID NO: 23324 - DNA, 3153 bp, Artificial Sequence
  Description of Artificial Sequence: Synthetic coding sequence
atggccctgtacgacgaggacctgctgaagaaccccttctacctggccctgcagaagtgtcggccagacctctgtagtaaagtggcacagatccacggcattgtgctcgttccttgcaaaggctccctgagcagttccattcaatccacgtgccagttcgagagctacattctgatacctgtagaggaacattttcagactctgaatggcaaagacgtgtttatccagggcaaccgcattaaactcggagcaggatttgcctgcctgttatccgtcccgatcctgtttgaagaaacattttacaatgaaaaggaggaatccttctcaatcctctgtatcgcccaccctttagagaagagagaatcctcagaggaaccattagccccctccgaccccttctctttaaaaaccatcgaggatgtccgcgaattcttaggccgccacagcgagaggtttgaccggaacatcgctagcttccatagaaccttccgggaatgtgagagaaaatcgttgcgccatcacatagattcggctaatgcgctgtatactaaatgtctccagcagctgctcagagattctcatctcaagatgctcgcaaagcaggaggcccagatgaatttgatgaaacaggccgtggagatttacgtgcatcacgaaatttataacttgatcttcaagtacgtgggaacgatggaggcctccgaggacgccgcttttaacaaaattactcggtctctccaagacctgcagcagaaggacattggagtgaaacccgagttctcctttaatatcccccgggctaagagggagctcgcccagttaaataagtgtacatcgcctcaacaaaaactggtgtgcttgcggaaggtggtgcaactgatcacacagtctccatcacagcgtgttaacttagagactatgtgtgccgacgacctgctgtccgtcctgctttacctcctcgtgaaaacagagatcccgaactggatggctaacctctcttatattaaaaacttccggttttcatctttggccaaggatgaacttgggtactgtctcactagttttgaggcggccatcgagtatatccgccagggttctctatctgccaaaccccccgagtcagaagggttcggagatcggctgtttctgaaacagcggatgtccctgttgtcgcaaatgacaagcagtccaaccgattgtttatttaagcatattgcgtcagggaaccagaaagaagtggaaagacttctgagccaggaggaccatgataaggataccgtgcagaaaatgtgccacccactctgcttctgcgacgattgcgaaaagctggtgagtgggaggctcaacgacccatctgtggtcacaccctttagccgggatgatagaggccatactccactgcatgtagcggcagtctgtggacaggctagcctgatagatcttcttgtttcaaagggagcaatggttaacgccacggattaccatggtgcgaccccacttcacctcgcttgccagaaaggctaccaaagcgttactctccttctgctccattataaggcatctgccgaggtgcaagataataatggcaacacacctctccacctcgcctgtacatacggtcacgaagactgcgtgaaggcactggtgtactacgacgtagagtcctgccgcctggacattggcaatgaaaagggcgatactccacttcacatcgctgccagatggggctaccagggcgtgatcgagacactcctccagaatggagcctcaactgagatccagaatcggctaaaggagacgcccctcaaatgtgccctgaatagcaagattctgtcggtcatggaagcctatcacctttcctttgagcgacgccaaaagagcagcgaggcccctgttcagagtccacaaagatccgtggactctatctctcaggagagctctacatcatcctttagcagcatgagtgcctctagtcgccaggaagagacgaagaaagactacagggaagtggagaagttattgcgcgctgtcgcggatggggacctcgaaatggtgcggtacttacttgaatggactgaggaggatctggaggacgcagaagataccgtctctgcagcagatccggagttctgccacccgctatgtcagtgccctaaatgcgcgcccgcccagaaacggttggcaaaggtgcccgcttccggattgggcgtaaatgtaactagccaagacggctctagccccctccacgttgcagcattacatggccgagccgacctgatccccctcctcctgaaacacggcgccaatgcaggggccagaaacgcggatcaggccgtgcctctgcacctcgcttgccaacagggacatttccaggtcgtgaagtgcctcttggatagcaacgccaagccaaacaagaaggatctctcagggaacactccactcatctacgcttgcagcggcggccatcacgaattagtggccctgctcctccaacacggagcttcaataaatgcttctaacaacaagggaaatactgccctgcacgaggccgtgattgagaaacatgtgtttgtggtggagttgctattgctccacggcgccagtgtacaagtactgaataaacgacagcgaacggcagtggattgtgccgaacagaactccaaaatcatggagctgctgcaggtagttcccagttgtgtcgcgtctctggatgacgtggctgagacagaccgcaaagaatacgtgacagtgaagatccggaaaaagtggaattcgaagctgtacgacctgcctgatgaaccatttacacggcagttttacttcgttcacagcgcgggccagtttaagggcaagacctcccgggaaatcatggctcgcgatcgatccgttcctaacctaacagaaggctcactgcatgaaccagggagacagagcgtaacccttagacagaacaacctccccgcacagagcggctcacacgcagctgagaaaggaaattctgattggcccgagagaccaggcctgacacagactgggcctggacaccggcgcatgctgcgtcggcacacagtggaagacgcagtagtgtctcagggccctgaggccgccggtcccttatccactcctcaggaggtgagtgcctctcggtcatag

SEQ ID NO: 23325 - DNA, 1662 bp, Artificial Sequence
  Description of Artificial Sequence: Synthetic coding sequence
atggacgtggacaaggagctgggcatggagagcgtgaaggccggcgctagcggcaaacccgaaatgaggttgggaactcaggaggagactagtgaaggcgacgcaaatgagtctagccttctggtcctttcatctaatgtcccactcctggcacttgagttcttggaaatcgcccaggccaaagaaaaggccttcttgcctatggtctcacacacatttcacatgcgcaccgaagagtcagacgcgagccaggagggagacgacttgcctaagagctcagctaatacttcccacccaaagcaagacgacagtcccaaatcatcggaggaaaccatccagcctaaggagggggatattccaaaggccccagaggagaccatacagagcaagaaggaggacctccctaaatcttctgagaaagcaatacaacccaaggagagtaacattccgaaatcctctgctaagccaatacagcccaaattggggaatatcccgaaagcatcagtgaagccctcacaacctaaagagggcgacattccgaaagcacccgaagaaactatacagagtaagaaagaggacctgcccaaatcctcagaggaagcaattcagcctaaagaaggggacatcccaaagagttccgccaaaccgatccagcctaaactggggaatattgctaagacgtccgtcaagccaagccaacccaaagaaagcgacatccctaagtcacctgaagaaacaattcagcccaaagaaggagatatcccaaaaagcagtgccaagcctattcagcccaaattgggcaacattcctaaggcctcagtgaagccgtctcagccaaaggagggcgacatcagcaaaagccccgaagaggccatccagccgaaagaaggcgacctgcctaagtccctggaagaggcaatccagcctaaagagggcgacattcctaagagccccgaagaagccatccagccgaaagaaggagacattcctaagtctctggaggaggcaatccagccgaaggaaggcgacattcccaagtctcctgaagaaacaattcagccaaaaaagggagatattcccaagagtcccgaagaggctattcagccaaaggaaggcgacattcccaagtctccaaagcaggcgatacagcccaaggagggagacattcccaagtcactggaagaagctatcccaccgaaggagatcgacatccccaaatccccagaagaaacaatacagcctaaggaggacgattcccctaaatctctcgaggaggcaactcctagcaaggaaggagatattcttaagccagaagaagagacaatggaatttcccgagggtgacaaagtgaaggtgatcctttccaaggaggatttcgaagcgtcgttgaaggaggccggtgaacggctggttgccgttgatttttctgccacgtggtgcgggccatgtaggactattcggccatttttccacgcactaagtgtgaaacatgaagacgtcgttttcctggaagtggacgccgacaactgtgaagaggtggtgagagagtgcgcaattatgtgcgtccctaccttccagttctataagaaagaagaaaaagtggatgaactatgcggtgccttgaaagagaaactcgaagccgtgatcgctgagcttaaatag

SEQ ID NO: 23326 - DNA, 2268 bp, Artificial Sequence
  Description of Artificial Sequence: Synthetic coding sequence
atggtgagccacggcagcagccccagcctgctggaggccctgagctctgattttcttgcctgtaagatttgtttggagcagttaagggctcccaaaactctgccatgtctgcacacctactgtcaggactgtcttgcccagttagccgatggtggcagggttcggtgccccgagtgcagggagactgtccctgtccctccagagggtgtcgcctcttttaaaactaatttcttcgtaaacgggctgctagacctggtgaaagctcgggcgtgtggggatctgcgagcaggcaagccagcctgcgcgttgtgtcccttggtgggcggaacgagtacaggagggcctgcgacagcccgatgtttagattgtgcagacgatttgtgccaggcatgtgctgacggacataggtgcactcgacagacccacacccaccgtgttgtggacctcgtgggctacagggcaggctggtatgatgaagaagctcgggaacgtcaggccgctcagtgcccccagcatcccggcgaagccctacgttttctatgtcagccatgttcccagctgctgtgtcgcgagtgcaggctggatccgcacctcgaccacccctgtctgccacttgccgaagcagtgcgggcccggaggcctggactagaaggccttctcgcgggcgtggataataatttagtggaactcgaggcagcccggagagttgagaaggaagccctggccaggctcagggaacaggcagcccgagttgggacccaggtggaggaagcagcggaaggggttttgagggcgctgttagctcagaaacaagaagtcttgggacagctgagagctcatgtggaggccgccgaggaggccgcgcgcgaaagactcgccgaactggaagggcgggaacaggtcgctagagccgccgctgcatttgcaaggcgggtgttaagtcttggtcgcgaggccgagatactctctctcgagggagctatcgcccagcgcttgagacagctgcagggttgtccatgggcgcccggccccgctccgtgcctcctgccgcaactggagttacatccgggattacttgataagaactgccacctgttacgcttgtccttcgaggaacagcagccccagaaggacgggggaaaggatggcgcaggaacccaggggggggaagaaagccagagccgcagggaagacgagcccaagacagaaaggcagggcggggtgcagccacaagccggggatggcgctcaaactccaaaagaagaaaaagcacagacaaccagggaggaaggcgcccagactctggaggaagatagagcgcagaccccgcatgaggatggcggtccccagcctcacagaggtggccggccaaataagaagaagaagtttaagggtcggctaaagtcgatcagccgcgaaccctctcccgccttggggcccaatctcgatggctctggcttgctcccaagacccatcttctattgcagcttccctacccggatgcctggggacaagcgatcaccaaggattacaggcctgtgcccatttgggccccgcgaaattctggtagcggatgaacagaatcgggccctgaaacgattttctttgaacggggactacaaagggactgtgcccgtgccggaggggtgctccccgtgcagtgttgcggctcttcagtctgccgtggcgttctcagcctccgcccgtctgtatctaattaaccccaatggggaggtccagtggagacgcgctttatccctgagtcaggcatcgcacgccgtcgccgcactgccctctggcgacagagtcgccgtttcggtggccggccatgttgaagtctacaatatggagggatcgctcgccacccggtttattcccggcggcaaggcttcacgcggactgagggccctggtctttctcaccacctctcctcaggggcattttgtggggagtgactggcaacaaaactccgtggtgatctgcgacggcctgggacaagtggtcggcgaatataaaggtcctggcctacacgggtgccaacccggcagtgtgagtgtcgacaagaaggggtatatttttctgaccctgcgcgaagtgaacaaagtagttatcctggaccccaaggggtccctgctgggggactttctgacagcttaccatggcttagagaaacctcgtgtgacaacgatggtggatggaaggtacctcgtggtttccctaagcaacggaacaattcatatatttagagtgcggtcacccgattcttag

SEQ ID NO: 23327 - DNA, 1467 bp, Artificial Sequence
  Description of Artificial Sequence: Synthetic coding sequence
atggccgccggcagcgaggccaccacccccgtgatcgtggccgccggtgccgggggcgaagagggcgagcacgtcaagccattcaaacctgagaaggccaaagaaataataatgtctctgcagcagcctgccattttctgcaacatggtttttgattggcccgcccgccactggaacgcaaaatatctgagtcaggtcttgcatgggaagcagattcggttccgtatgggtatgaagagcatgtcaaccgttccccagtttgagaccacctgtaattatgtggaagccactctggaggagttcttaacgtggaattgtgatcaatcctcaatcagcggtccctttagagactacgatcactcaaagttctgggcttatgctgattacaagtacttcgtgagtctgttcgaggataagaccgatctgttccaagacgtgaagtggagcgactttggctttcctggcaggaacggacaggaaagtaccttatggataggttccctgggggcacacactccctgccatttagatagctatggctgcaacctggtgttccaggtgcagggccgcaagagatggcacctctttccgcccgaggacaccccttttctctaccccacccgcattccctatgaggaatcctcagttttctctaaaattaatgttgttaaccctgacctcaaaaggtttcctcagttcagaaaggcccagcgtcacgccgtcacattaagtcctggacaggtacttttcgttcctagacattggtggcactacgtggagagcatcgaccccgtcacagtatcgattaattcctggatcgagcttgaggaggaccacttggctcgagtcgaggaggccatcacacggatgctcgtctgcgcactaaaaactgccgaaaatccccagaatactcgagcgtggctgaacccaactgaagttgaggaaaccagtcatgccgttaattgctgctacctgaatgctgcagtgtctgccttcttcgacagatgtcgcacatctgaggtcgtcgaaatacaggccctgagaactgacggagagcatatgaaaaaagaagaactgaacgtttgcaatcatatggaggttgggcaaaccggcagtcagaatctgaccaccggcacggacaagcccgaagccgcctctccttttgggcccgatttagtgccggtagctcagagatcagaagagccaccttccgagcgaggggggatattcggaagcgacggcaaagacttcgtggacaaggacggggaacactttggtaagttgcactgtgccaagcgccaacaaattatgagtaattctgagaacgcaatcgaggaacagatcgccagtaacacaactactacgccacagacctttatatctacagatgacctgctagactgtctggtgaatccacaggtcacacggatagttgcccagcttctgatccaggggcgctcgctgtag

SEQ ID NO: 23328 - DNA, 579 bp, Artificial Sequence
  Description of Artificial Sequence: Synthetic coding sequence
atggcccccaagcccggcgccgagtggagcaccgccctgagccacttggtactgggtgtggtttctctgcatgctgctgtgtctaccgcagaggccagtcgtggggccgccgctgggttcctgttacaagttctggccgcaaccactacacttgctcccggactgtcaacccatgaagattgccttgcaggcgcttgggtggctacggttatcggtttgcctttgctggcgtttgacttccactgggtgaatggagatcgctcgagtgccaatctcctcctggggggtgggatggtactcgccgtggcaggtggtcatctgggacctgagggtcgatccgtggcaggacaggctatgttgctggttgtcgccgttactattctaatagtggctgtattcacagccaatacttacggtatgtggggtggtgccatgttgggagttgctgggctcctcagcaggttggaagaggatcgcctcttgctgctgccaaaagaggacgtctgcaggtgggccctagctgtcggctcttgggcttactgccgcgcactccatactcagaggctccagtgggagtag

SEQ ID NO: 23329 - DNA, 462 bp, Artificial Sequence
  Description of Artificial Sequence: Synthetic coding sequence
atgaccagcgagagcaccagcccccccgtggtgccccccctgcactctcccaagtctcccgtgtggcctaccttcccatttcatcgtgaggggtccagagtttgggagaggggtggcgtcccacccagggacctgccaagcccactgcctacgaaacgcactaggacctattcagccaccgcacgcgccagcgctggcccagtatttaagggggtatgtaagcagttctcccgctcccaggggcatggatttatcactccagaaaacgggagcgaggatatctttgtgcatgtcagcgatattgaaggggaatatgttcccgtggagggtgatgaggtcacttacaaaatgtgccccattcctccgaagaaccagaaatttcaggccgtggaggttgttctcacccagctggctccacatactccccacgaaacgtggagtggccaggtcgtgggatcctag

SEQ ID NO: 23330 - DNA, 537 bp, Artificial Sequence
  Description of Artificial Sequence: Synthetic coding sequence
atgagcagcttcagccgggccccccagcagtgggccaccttcgccagaatctggtaccttctggacgggaaaatgcagccccccggaaaacttgccgcaatggcttcaatcagattacagggcctacacaagcctgtttatcatgccctcagtgattgcggagatcacgttgtaataatgaatacccggcacattgccttctcaggcaacaagtgggagcagaaagtgtatagctcccatacagggtaccccggagggtttagacaggtgactgcggctcagttgcacctccgagaccccgtagctattgttaaactcgctatttacggcatgctgccgaaaaatctacaccgacgaactatgatggaacggctgcatctgttccccgatgaatatatcccagaagacattcttaagaacctggtagaggaacttccacagccacgaaagatcccaaagaggctggatgagtacactcaggaggaaatcgatgctttcccaaggctttggacccctcccgaggattaccggctctag

SEQ ID NO: 23331 - DNA, 8763 bp, Artificial Sequence
  Description of Artificial Sequence: Synthetic coding sequence
atgcggggccggcggggccggccccccaagcagcccgccgcccccgccgctgagagatgcgcgcctgccccaccaccacctccacccccgcctaccagtggacctattggtggcctaagatctcgacatcgcggttcaagtaggggcagatgggctgcggcccaggccgaagtggcccctaagacccgcctctcctcccctcggggcggaagttcaagccggcggaaaccccctccccctccacctgccccccccagcaccagcgccccaggcagagggggacgcgggggcggaggcgggcggacagggggcggcgggggcggggggcacctcgctagaactactgctgcacggcgagcagtgaataaggtggtttatgacgaccacgaaagcgaagaggaggaagaagaggaagatatggtcagcgaagaagaagaggaagaagacggtgacgcagaggaaacacaggacagcgaagatgacgaggaggatgagatggaagaagatgatgacgattcagattatcccgaggaaatggaagacgatgacgacgatgcttcctattgcaccgagagttcatttaggagccattcaacttactccagcacaccaggcagaaggaagccacgcgtccatcgaccacgctcacctatcctggaggagaaggatatccctcctctggaattccccaaaagtagcgaagatttgatggtgccgaatgagcatattatgaacgtaattgccatttacgaggtcctgcggaactttggaacggttctcaggctatcgccattcagatttgaagatttttgtgcagctctcgtatcccaggagcagtgcaccctcatggccgaaatgcacgttgtgcttttgaaagcagtcttgcgggaggaagatacatctaacaccacattcggaccagctgatctgaaggacagcgtgaactctaccctgtacttcatcgacggcatgacttggccagaggtcctgcgggtctattgcgagtccgataaggaatatcaccacgtcctgccctaccaggaagctgaggactacccgtacggaccagtcgaaaataagatcaaagtgctgcagtttctggtcgatcagttcttgaccaccaacatagcccgcgaagagctaatgagtgaaggcgtgatccaatatgacgaccattgcagagtatgccataagttaggagacctgctctgttgtgagacttgctccgccgtctaccacctggagtgcgtgaagccgccactggaagaggtgccagaagacgaatggcagtgcgaggtctgtgtcgctcataaggtgcctggcgtcactgattgcgtggctgagattcagaagaataaaccttatatacgacacgaaccaatcggctacgacagatcaaggcggaaatattggttcctgaatcgtcggctgattattgaggaagacacagagaatgagaatgagaagaaaatttggtactacagcactaaggtacaactcgcggaactgatcgattgcctagataaggattactgggaagcggagctgtgcaaaattctagaggaaatgcgtgaagaaatccaccgtcacatggatattactgaggatctgacaaataaagcccgcggcagtaacaagtctttccttgccgccgctaacgaggagatacttgagagcattagagcaaagaagggcgacattgataatgtaaagagtcctgaggagaccgagaaagacaaaaacgagacagagaacgacagtaaggacgccgaaaaaaatcgtgaggagttcgaggatcaatcactggagaaggactctgacgacaaaaccccagatgatgatccggagcaggggaagtcagaggtgggagatttcaaaagtgagaaaagcaatggtgagttaagcgagtctcccggtgccgggaagggcgcaagtgggtcaacccgaattatcactagactgcgaaaccctgatagtaaactaagccagctgaaatcccagcaggtcgcggctgctgctcacgaagccaataagctgttcaaggaaggcaaggaggttctggttgtcaacagccagggagagatcagccgactcagcaccaaaaaagaggtcatcatgaaaggcaacatcaataattatttcaaactcggacaggagggcaagtatcgcgtgtaccataaccagtacagtactaattcttttgccctgaataaacatcagcatagggaggaccacgataaacgtagacatttggcccacaagttttgcctgacccccgcaggcgagtttaaatggaatggaagtgtacacggctcaaaggttctcaccatatctacccttaggttgacaatcacccagctagagaacaatatccctagctcttttttgcatcctaactgggctagccaccgcgccaactggataaaggcagtccagatgtgtagcaaacccagagagttcgccctggcccttgcgattttagagtgtgcagtgaaacccgtcgtgatgttaccaatttggcgtgagtccttggggcacacgcgattacacaggatgacttctatcgagcgcgaggagaaagaaaaagtcaaaaaaaaggaaaaaaagcaggaggaagaggaaaccatgcagcaagccacttgggtcaagtacacctttccggtgaagcaccaggtgtggaaacagaagggcgaagaatatcgggtgacaggttacggtggatggtcatggatctcaaaaactcatgtgtatcgattcgtccctaaactgccgggtaacaccaacgtcaactacagaaagagtctcgagggaactaaaaacaatatggacgagaatatggatgaatccgacaagcgcaagtgctcacgatccccgaagaaaatcaagattgagcctgactctgaaaaagatgaagtcaaaggatctgacgccgccaaaggtgcagatcaaaatgagatggatatttccaagatcactgaaaagaaggaccaggatgtgaaggagctgctggattccgatagcgataagccctgcaaggaagagccaatggaagtagatgacgatatgaagacggagagtcatgtcaattgtcaggagtccagccaggtcgacgtggttaatgttagtgaagggtttcatctgcgcacgagctacaaaaaaaaaacaaagtcctctaaactggatggactgctcgaaagaaggatcaagcaattcaccctggaagagaagcagaggctggagaaaatcaagctggaggggggcattaaaggtatcgggaagacatcgaccaacagctccaagaatctgtccgaaagtcccgtaataactaaggctaaggaggggtgtcagtcagactccatgaggcaggagcaaagcccaaacgccaataacgatcagcccgaagaccttatccaaggctgcagcgaatccgattcctctgtgctgcgaatgagtgatccgagccatactaccaacaagctgtatccgaaagaccgtgtgctcgacgacgtgtcgatccgtagcccagaaacgaagtgcccgaagcaaaactccatcgaaaacgatattgaggaaaaagtgtcagatctggcctcgcgcggacaggaaccatctaagtctaaaaccaaggggaacgacttcttcattgacgattccaagctggctagcgccgatgatatcggaaccctcatctgtaaaaacaagaaacccctaattcaggaggaaagtgacaccatcgttagtagcagtaagagtgccctccacagttccgtgcccaaatctacaaacgaccgggacgctacacccctatcccgagccatggacttcgagggtaaactcggatgcgatagcgagagtaactccacgttagagaactcctccgataccgtttccatccaggatagcagtgaggaggacatgattgtccagaattctaatgaatcaatctcagagcagttccggaccagagaacaggacgtcgaggttctcgagccacttaagtgtgaattggtgagcggggagtctaccgggaattgcgaagatcgccttcccgtaaaaggaactgaggccaatggcaaaaagcctagccagcaaaagaaactggaggagcggccagtaaacaagtgtagcgaccagattaaattgaagaatactaccgataagaagaacaacgaaaaccgcgagtccgagaaaaagggacagagaaccagcacattccaaataaacgggaaggataacaagcccaaaatctaccttaagggagaatgcctgaaggagattagtgagtcccgtgtggtgtccggtaacgttgagcccaaagtgaataatatcaataaaataatcccggagaacgacatcaaatctttgacagttaaggagagtgctatccggccattcattaatggagatgtgatcatggaagactttaacgaaagaaacagttctgaaacaaaatcccaccttctgagtagcagcgatgctgaaggaaattacagagatagtctggagacccttccttctactaaagagtcagactctactcagaccactaccccttctgcaagctgtccagagagtaatagtgtgaatcaggtagaggacatggaaatcgaaacttcagaggtaaagaaagtaacttcttcccctataaccagcgaggaggagtcaaaccttagtaatgacttcatcgatgaaaatggacttccaattaacaagaacgagaacgtcaacggagagagtaagcgcaaaactgtaattactgaagttaccacgatgactagtaccgtcgcaacggagtctaaaacggtgatcaaggtggagaagggggataagcagacagtggtaagcagtacagagaattgtgccaagagtactgttaccacgacgaccactaccgttacaaaacttagcaccccctccaccggcggcagtgttgacattatcagcgtgaaggagcagagtaagacagtggtgacgacgactgtgacagatagtctgaccaccaccggaggaaccttagtgacctcaatgactgtgagtaaagaatactctaccagagacaaggtgaagctgatgaagttcagcagacctaaaaaaactagaagcggcaccgctcttccaagttatcggaaatttgtgacaaaatccagcaagaagtccatttttgtcctgcctaatgatgatctaaagaagttagcgcgcaagggaggcatccgggaagtgccttatttcaattacaacgctaagccggctctggatatctggccttaccctagcccgcggcccacatttggtatcacatggaggtatcgcctgcagacggtgaagtccctcgctggagtcagtttgatgttaagactcctgtgggcttcccttcgctgggatgatatggcagccaaagccccgccgggtggaggcacgacacgcactgaaacatcggaaaccgaaatcaccactacggaaatcattaaacgccgcgatgtaggcccctacggcatacgttcagagtactgcattcggaagattatctgccccatcggagtaccagaaacccccaaggagacaccaacaccgcaacgcaagggcctgaggtcttcagccctgcgaccaaaacgacccgagacacctaaacagacaggacccgtgatcatagagacttgggtggccgaggaggagttggaactgtgggaaatcagagcattcgctgagcgagttgaaaaggagaaagcacaggccgtggaacagcaggccaaaaaacggctcgagcaacaaaagcccaccgtgattgctacttcaaccaccagtcccacctcaagcacgacttccactatcagtccagcccagaaggtgatggtggcccccatttccggatctgtgacaaccggcaccaagatggtgcttacaaccaaggtgggtagccccgctacggttacctttcaacagaacaagaacttccatcagaccttcgccacctgggtcaaacagggacagtccaattcaggcgtagtacaggtccagcagaaagtactggggatcatcccgtccagcaccggcactagtcagcagactttcacatcattccagcctaggaccgctacagtcacaatcaggccaaacacatctggctctggcgggaccacaagcaacagtcaggtgatcactggaccgcaaatccgccctgggatgaccgtaattagaacccccctgcagcaatccaccttggggaaagcgataatacgtaccccagtgatggtccaaccgggtgccccacaacaggtgatgacacagatcatacgcgggcaaccagtgtcaacggccgtctccgcccccaacacagtctcctcaacccccggccagaagtcattaactagtgccacatctacatccaatatccaatcatctgctagtcagcccccgcgccctcaacagggccaagtgaagctgactatggcacagctgacccagttaacccaggggcatggaggcaaccagggcctaacagttgtgattcaaggtcagggacagacgactggacagctgcaacttattccccaaggagtaactgtgttgccaggccccggccagcagctaatgcaggctgctatgcctaacggaacagtgcagcgctttctgtttacaccactcgctactacggccaccacagctagtacaaccactacaaccgtttctactactgcagccgggaccggcgaacagcggcaaagtaagctctcaccccagatgcaggtgcaccaagacaaaactcttcccccggcgcaaagttcctctgttggccccgccgaagcccagccacaaacagcccagccttccgctcagccacagcctcagacccaaccgcagtctccagcccagcccgaggtccagacccagcctgaggtgcagacacagaccaccgtgagctcacatgtaccaagcgaagcccaacccacccatgcccagtcctccaaaccccaagtggcagcccagtctcagcctcagtctaatgtacagggccagtcaccggtcagagtacaatccccctctcagacacgtattagaccaagcacccccagtcagctatctcccgggcagcaaagtcaggtccagactactacatcccaacccattccgatccaaccacacacctcgttgcaaatccctagtcagggacagccccagtcccagccccaagttcaatcatcaacacagactctgagcagcggacagacccttaaccaggtaactgtgagcagccccagtcggccgcagctgcagatccagcaaccccagcctcaagtcatcgcagtaccacagctccagcagcaggtccaggtgctctcccagatccagagtcaggttgtggctcaaattcaggctcagcaatccggcgttccgcagcagattaaactgcagctgcccatccagattcagcaatcctctgccgtacagactcatcagattcagaatgtagtgaccgttcaggcagcaagcgtccaggaacagcttcagcgcgtccagcagttgcgagatcagcagcagaagaagaagcaacagcaaattgagatcaagagggaacacacactgcaggcaagcaaccagtctgagataatacagaagcaggttgtcatgaaacataatgcagtcattgagcatctcaagcagaagaagtccatgacgccagctgagcgagaggagaaccagagaatgattgtctgtaatcaagtgatgaagtatattctggataagatcgacaaggaggagaagcaagccgctaaaaagaggaaacgagaagaatctgttgagcagaaacgttccaagcagaacgcaaccaagctctcagctctccttttcaagcataaagaacagctgcgcgccgagattctcaaaaaaagagcgcttcttgacaaagacctccagatcgaagttcaggaagaattgaagcgcgatttgaaaatcaaaaaggaaaaggacctcatgcagttagcccaggctacggccgtcgctgccccctgtcctcctgtcaccccagctccaccggcgcccccggcccctccaccttccccacccccaccccccgcagtgcagcatactggactgctgagcactcccacgcttccagctgcatctcaaaagcggaaaagagaggaagagaaagacagctctagtaagagcaaaaaaaagaagatgatctctacaacttccaaagagactaagaaggatacaaaactgtattgcatctgtaagaccccgtatgacgagtccaagttctatatcggttgtgaccgttgccaaaactggtaccatggccggtgtgttggaatcctgcaatccgaggccgagctcatagatgagtacgtttgtccacaatgtcagagcaccgaagacgctatgaccgtccttacacctcttactgaaaaggactatgaaggccttaaaagagtgctgagaagtttgcaggctcataagatggcctggccattcctggaacccgtcgacccgaacgacgctccggattactatggggttatcaaagagcctatggatctggcaaccatggaagagcgagtccagcgtcgatactacgaaaagcttacagaattcgttgcggatatgacgaagatctttgataactgccgctattataacccaagcgattcccctttttatcagtgcgccgaagttttagagtccttcttcgtgcagaaacttaaaggctttaaggctagtcggtctcataacaataagttacagagtaccgctagttag

SEQ ID NO: 23332 - DNA, 390 bp, Artificial Sequence
  Description of Artificial Sequence: Synthetic coding sequence
atggccgacccccgggtgcggcagatcaagatcaagaccggcgtggtgaagcggctcgtcaaagaaaaagtcatgtacgagaaagaggctaaacaacaagaagagaagattgaaaagatgcgggcagaggatggggaaaactacgacattaagaagcaggcggagattctgcaggagagccgcatgatgataccagactgccagaggcggctggaagccgcttatctggatcttcaaagaatactggttagcaaagatttttgcgtgatgtttaaattttttttttcaatacagtacatggagagtcaaaagtttaaatatttaaccctgcgtacctcatggcagtattttctctttacatgcccactgtataggtacattttgaaatag

SEQ ID NO: 23333 - DNA, 582 bp, Artificial Sequence
  Description of Artificial Sequence: Synthetic coding sequence
atgagcgacgacgacagccgggccagcaccagcagcagcagcagcagcagttctaaccaacagactgaaaaggaaaccaacactcctaagaaaaaagagtcaaaagtgtctatgtcaaaaaatagcaaactgctatctacttctgccaaaaggattcagaaagaattagccgatataacactggatccacctcccaactgctcggccgggccgaaaggggacaacatctatgagtggcggtctacaatcctcggtcctccaggctctgtctacgaagggggtgtatttttcctcgatataacctttaccccagagtatccatttaaaccacccaaagtgacatttcgcactaggatctatcattgtaacataaattctcaaggggtgatctgtttggacatattaaaagacaattggagcccagccctgaccatctcaaaagtactgctgtccatttgttcactgctgactgactgcaaccccgccgatccattggtgggatcaattgccacacaatatatgaccaatcgcgcagaacatgatagaatggcaagacaatggaccaagaggtacgcaacatag

SEQ ID NO: 23334 - DNA, 1395 bp, Artificial Sequence
  Description of Artificial Sequence: Synthetic coding sequence
atgagcctgcagttcagcaacggcagccggcacgtgtgcctgcggtctggggcaggctcagttcggccactgaatggcggtgccgggttcgcggggagcagcgcttgcgggggtagtgtagccggatctgagttcagctgcgctctcggaggcggattggggagtgtgcccgggggcagccacgccggaggagccttagggaacgcagcatgtatcggctttgctggcagcgaaggtggattgctgtctggcaacgagaaggttacaatgcagaatctgaatgatagactggctagctacctcgacaacgtgcgagcactggaggaagccaacgccgaactcgagaggaaaatcaaaggctggtacgagaagtatggccctgggtcctgccgtggactcgaccacgactactcgcggtatcaccttacaattgaggatctaaagaataaaatcatctcaagtaccactacaaacgccaatgtgattctccaaatcgacaatgcgcgccttgctgccgatgactttcgccttaagtatgaaaatgagctgacattacatcagaacgttgaggccgatatcaatgggctacggagagtgttggacgagctgactctctgtagaactgatcaggagcttcagtacgaatccctgtctgaagaaatgacttatcttaagaaaaaccatgaagaggaaatgaaagccctgcagtgcgcggctggcggtaacgtcaacgttgaaatgaatgctgcacctggggtggatctggccgtgttgttgaataacatgcgcgccgagtacgaggcattggcagaacagaacagaaaagatgcggaggcatggttcaatgagaagagcgcaagcctgcagcagcagatctctcacgactctggggcagctacctttgccaggagccagctaacagaaatgagacgcactctccaaacgctggagattcagcttcagtcactgatggcgaccaagcattccctggagtgcagcctgactgagacagaatcaaactactgtacacagctcgctcagattcaagcccagattggtgcactagaagagcagctgcatcaggtcaggaccgaaacggaggggcagaaacttgaatatgaacacctgctggacgttaaggttcacttagaaaaggagatcgaaacctattgcaggctcatagacggggatggcaattcgtgctctaagtctaaaggctttggaagtgggtctccggggaactcctcaaaagacttatcaaagactacccttgtgaaaaccgttgtcgaggaattggatcagcgaggcaaagtgctgagttcccgtatccattctattgaggaaaaaacctctaagatgaccaatggcaagaccgaacagagggtccctttctag

SEQ ID NO: 23335 - DNA, 2013 bp, Artificial Sequence
  Description of Artificial Sequence: Synthetic coding sequence
atggaggagttccggcggagctacagccggctgtgccgggagagcggagccgagccccaggaagcggtcctgcaacaactccaccagcttccacgcggtaggctggatctcgccacccaatcgctgaccgtcgaaacatgccgggccttgggaaagctattgcctagagagaccctttgtaccgagttggtgctgtccgattgcatgctgtctgaagagggggcaacgctgcttttaagaggtttgtgcgccaacaccgttctgagatttttagacctcaaggggaacaatttgcgggctgccggcgctgaggccctggggaaactcttgcagcagaataaatccatacagtccttgactctcgaatggaacagcctcggaacttgggacgacgcatttgctactttttgcgggggccttgctgcgaatggagctctccagcggctagacctccggaacaatcaaatcagccataaaggcgccgaggagctagctctggcgctgaaaggaaacaccacacttcagcagctggatctgcgatggaataatgttggcctcctgggcggacgggccctcatgaattgtcttccttccaaccggactctctggcgactggatctggccggtaacaacatacccggagatgtgctaagggccgtcgagcaggctatgggtcatagtcaggatcggctgacaaccttccaagagaaccaagccaggacccacgttctctcaaaggaggtccaacatttgagagaagagaagtccaagcagtttctggacctgatggaaactatagataagcaacgggaagaaatggctaagtcatctcgggcaagcgccgcccgcgtgggccagctacaggaagccctgaatgagaggcacagtatcattaacgctctcaaagcaaagttacagatgactgaagccgcactggctctgtcggagcagaaagcccaggatctaggcgagttgctggccaccgcagagcaggagcagctgagtttgagccagaggcaagcaaaggaattgaaactagagcagcaagaagccgccgagcgcgaatctaaactcctgcgggatttgagcgctgctaatgaaaaaaaccttctgctgcaaaatcaggtagatgagctggaacggaaattccggtgccagcaggagcagttgtttcagacaaggcaggaaatgacaagtatgagcgctgagcttaaaatgcgcgccatccaagcagaggaaagacttgacatggagaaaagaagatgcaggcagtctttggaagacagcgaatctctcagaatcaaggaggttgaacatatgactagacaccttgaggaaagcgaaaaagctatgcaggagagagtgcagcgtctcgaagcggcccgacttagtctcgaggaagagctctcccgggtgaaagcggccgcacttagcgaacggggccaggccgaagaggagctgatcaaagcaaagtcccaggccaggctcgaagagcaacagagactagctcatctcgaagataaattaaggttactggcacaggcccgtgacgaggcccaaggggcttgtctacagcaaaagcaggtggttgccgaggctcagacccgtgtctcccagctcggtctccaagtcgaaggtttgagacgccgtctcgaagagcttcagcaagagctgtccctgaaggatcaggaaagggtggctgaagttagcagggttcgagtagaattgcaagagcagaacggacggctccaggcggagctggctgctcaggaggcacttagggaaaaggccgccgcactagaacgtcagctgaaagtgatggcaagcgaccacagggaagccctgcttgaccgcgaatcagaaaacgcaagcctgagagaaaaattgcggttacgggaggccgagattgccaggatccgggacgaagaagcccagagggcatccttcttgcagaatgcagtgctcgcttacgtccaagcaagccctgtgcgtaccctttctccacctaagtag

SEQ ID NO: 23336 - DNA, 1782 bp, Artificial Sequence
  Description of Artificial Sequence: Synthetic coding sequence
atggagcccgccaccgccccccggcccgacatggcccccgagctgacacccgaggaagaacaggctacgaagcagtttctcgaggagatcaataaatggacagtgcagtacaatgtcagtcctctatcgtggaacgtggcagtgaagtttctaatggcgcggaaatttgacgtgctgagggcaatcgaactgtttcatagctatcgggagactcggcgcaaagagggtatcgtcaagttgaagccccatgaagagcctctgaggtcagagatcctgtcaggaaagtttacaatcttgaatgtgagggaccccactggtgcttcaatagccctctttacagcccgattgcaccatccacacaagtccgtgcagcatgtggtacttcaggccttgttctacttgctggaccgagccgtagactccttcgagacgcaacgcaacgggttggtgttcatctatgacatgtgtggctctaattacgctaatttcgaactcgatctgggcaagaaggtgctgaacctgctgaagggagccttccccgctcggctcaagaaggtgctaatcgttggggcacccatctggtttcgcgtcccgtacagcatcataagcttacttctgaaggacaaagtgagagaacgaattcagattctgaaaaccagcgaagtcacccaacacctccccagagaatgtctgcccgaaaaccttggaggctacgtgaagatcgatctcgctacttggaattttcagttcctgccccaagttaacggacacccagaccccttcgacgagattatcctgttttccctgcctcccgcactggattgggactccgttcacgtccctggcccccacgccatgaccatccaggagttggtagactacgttaacgcaaggcaaaagcagggaatttacgaagaatacgaagatatacgacgcgaaaatccggttggcaccttccactgctctatgagtcccggcaacctagagaagaaccgctacggcgacgtcccttgtctcgaccagactagagtgaagcttaccaagaggagtggccacactcaaactgattatatcaatgcttctttcatggatggatacaagcagaagaacgcctacataggcacacaggggccactggagaacacttacagagacttctggctgatggtgtgggaacaaaaggtgctcgtgattgtgatgaccacgaggtttgaggaaggaggccggcggaagtgtggacagtattggcctctcgaaaaagactcgcgcatcagatttggcttcctgaccgtcaccaatctgggcgtcgaaaatatgaaccactacaaaaagacaaccctagaaatccataacacagaagaaagacagaaaagacaggtcacacactttcagtttttgagctggcccgattatggcgttccatcatccgctgcaagtctgatcgactttctcagggtcgtgagaaatcagcagagcctggcagtgagtaacatgggtgctagaagtaagggacagtgcccagaaccccccatagtcgtccattgctcagctggaattggtaggacgggtacattctgctcgttggacatatgcctggcccagttggaagagctcggcaccctgaatgtctttcaaacggttagtcggatgagaacacagcgggcatttagcatacagactcccgaacagtactacttttgctacaaagcaatcctcgagtttgccgagaaggaaggcatggtgtccagcgggcagaatctcctagcagtagaaagccagtag

SEQ ID NO: 23337 - DNA, 1884 bp, Artificial Sequence
  Description of Artificial Sequence: Synthetic coding sequence
atggagggcctggccggctacgtgtacaaggccgccagcgagggcaaggtgcttaccctggcggctcttctgctgaacagaagcgaatcagatatccggtaccttcttggctacgtctcacagcagggcggtcaaagatccacacctttaatcatcgccgctagaaatggtcacgccaaagtcgtgaggctgttgttggagcactatcgcgtccagacccagcagaccggtactgtccgtttcgatggatacgttattgacggtgcaaccgctctttggtgtgcagcaggggccggccatttcgaagtggtgaagttgttggtttctcacggggccaacgtcaatcacaccaccgtcactaactccacacctctgcgggctgcttgtttcgatggcagactggacatcgttaagtacctggtagaaaacaacgccaacataagcatagccaacaagtacgacaatacctgcttgatgattgccgcatataaaggtcatactgacgtggtgaggtacctcctggaacagcgcgccgaccctaatgccaaggcacattgtggcgccacagcactccactttgccgcagaggccggtcatatcgacatcgtaaaggaattaatcaaatggcgggcggctatcgtggttaacggccatgggatgacacctctgaaggttgcggccgaaagctgcaaggcggacgtggtggaacttctgctgtctcatgcagactgcgatcgccgctccaggattgaagcactggaactgctcggcgcttcctttgctaacgaccgggaaaattatgacattatcaaaacctatcattacctctatctcgctatgctggaacgtttccaagacggggacaacatcctggagaaagaagtgcttcccccaatccatgcctacggaaatcgcacggagtgccggaatcctcaggagctggagagtattcgccaggatagggatgcattacatatggaaggcctgatcgtcagagagaggatcctgggtgccgacaacatcgatgtgtcacaccctattatttatcgcggagccgtgtatgctgataacatggagtttgagcagtgtatcaaactgtggctacatgccctgcatctgagacagaaggggaatagaaatactcacaaggatcttctgaggttcgcccaggtcttttcacaaatgattcatctgaatgaaaccgtaaaagctcctgatattgagtgtgtcctgcggtgctctgtgctggagatcgaacagtctatgaaccgggtcaagaacatcagtgacgccgacgtccataacgccatggacaactacgaatgcaacttgtatactttcctgtacctggtttgtatatccaccaagactcagtgctctgaggaagaccagtgcaagataaataaacaaatttataacttgatacacctggacccgcggaccagggagggcttcacactgctgcatctggcagtcaacagtaatacaccagtggatgactttcatacaaacgatgtatgctctttccctaatgctctggttaccaagctgttgctggactgtggagccgaggtgaatgccgtggacaacgagggtaactctgctttgcatataattgtccagtataatcgtcctatctcagactttctgactctacactccattatcattagcctggtggaggcgggcgcacatacagatatgacgaataagcagaacaagacacctctggacaaatcaacaacaggggtgtccgagatattactcaagacacagatgaagatgtctctgaaatgtcttgccgctcgggcggtcagggccaatgacataaactaccaggatcaaatacctcggaccctggaggagtttgtcgggttccactag

SEQ ID NO: 23338 - DNA, 378 bp, Artificial Sequence
  Description of Artificial Sequence: Synthetic coding sequence
atgcccagcgagaagaccttcaagcagcggcggaccttcgagcagagggtggaggacgtccgtctaatacgggagcagcatccaaccaagattcccgtgatcattgaaaggtataagggggagaaacagcttccagttctggacaaaactaaatttctggtccctgaccacgtgaatatgagcgagctcattaagatcattcggcgaagactccagctcaacgcgaatcaggcgttcttcctgctcgtcaatggacattcgatggtttcagtgagcaccccgattagcgaggtctacgaatccgaaaaggatgaagacgggtttttatacatggtctgcgcctctcaggaaacatttggcatgaagctttccgtttag

SEQ ID NO: 23339 - DNA, 3786 bp, Artificial Sequence
  Description of Artificial Sequence: Synthetic coding sequence
atgggcaccggcgacttcatctgcatcagcatgaccggcggcgccccttggggatttcgactgcagggcgggaaggagcaaaaacagcccctgcaggtggcaaaaatcagaaatcaaagcaaagcctctggaagcggtctctgtgagggtgacgaagtagtctccattaacggaaatccatgtgctgatctcacttaccccgaggtcatcaaactcatggaatcgattacggacagtctgcaaatgcttattaaaagacccagtagcggcattagcgaagctctgatctctgagaatgagaataaaaacctggagcacctgacccacggcgggtatgtcgaatccacgacgctgcagattagaccagcaactaaaactcagtgcacagaattctttctcgcgcctgtcaagacggaagtgccacttgctgaaaatcagcgaagtggaccagactgcgccggctctctgaaggaggagacgggcccctcataccagcgagctccccagatgccagattcacaacgcggtagggtggctgaggagcttatcctccgggaaaaagtcgaggcggtgcagcccgggccggtggtggagctgcagctaagcctgtcacaggaacgccataaaggtgcttcaggtccactggtagccctccctggtgccgaaaagagtaaaagcccggacccagatccgaacctgtcccacgacaggattgtacatatcaactctatccccaccaatgaaaaggcggacccctttctgcgcagttccaagatcatccagatctcttccggcagagaacttagagtaatccaagagtccgaagccggcgacgccggtctgccacgggtagaagtgatcctcgattgcagcgaccgacaaaaaactgaaggctgtagactgcaggccgggaaggagtgtgtggatagtccggtggagggcgggcagagcgaggcacctcctagtctggtgtcttttgccgtttcatccgagggaacagaacagggagaggaccctcggagcgagaaggaccacagcaggccccacaaacaccgtgctcggcatgctcgcctgcggaggagcgaatccttgagtgagaaacaggtcaaggaggctaaatcaaaatgcaagtctatcgctcttctgctgacagacgccccaaaccctaatagcaaaggggtccttatgttcaaaaaacgacggcggcgagcacgtaagtatactctcgtcagttacggtacaggagagctcgaacgcgaagcagacgaggaagaagagggtgacaaggaagatacgtgcgaagtagcctttcttggggcctcagagtctgaggtcgacgaagagctcctgtccgacgtcgatgataacacacaggttgtcaatttcgactgggatagcggattggtggatattgaaaaaaagttgaaccggggagataagatggagatgcttcctgacacaacaggcaaaggcgcccttatgtttgccaaaaggcgggaacggatggatcaaatcacagctcaaaaagaagaggacaaggtgggtggcactccatctagggagcaggacgcagcacagacggatggactgcgcaccactactagttatcagagaaaagaggaggagagcgtccgtacccaatctagtgtctccaagtcctacatagaggtaagtcacggactcggacacgtgccacagcagaatggattttccggcacttcagagactgcgaatattcagcggatggtacctatgaatcgcacagcgaagcctttccccggatcagtgaatcagcccgccacacctttttctccaacaagaaatatgacatccccgattgctgactttccggccccccctccctacagtgccgtgacacccccccccgatgctttctctcgcggtgtgtccagccccatcgcagggcccgcccagccaccaccatggccacagcctgccccctggtctcagcccgcgttctacgactcatcagagagaattgccagtcgggatgagaggatttctgtcccagccaaacgtacagggattctccaggaggccaagaggcgcagtacaacaaagcctatgttcacttttaaagaacctaaggtcagccctaatccagagctgctgagcttgttgcaaaatagcgaaggcaagcggggtaccggcgctggaggcgacagtggacccgaggaagactatctttctttgggcgccgaggcttgcaacttcatgcaatcctcttccgcaaagcagaaaactccccccccggtggctcccaaaccagccgtaaagtcttcaagttctcagcctgtcacacctgtaagtcccgtatggagccccggagtggcccctacacagccccctgctttcccaacgtcaaacccctcaaaggggacagtggtgtcttccatcaagattgctcagccatcttatcccccagcccgcccggcgagcacacttaatgttgctggaccttttaaaggaccacaggctgctgttgccagtcagaattatactcctaaaccaactgtgtccactccaaccgttaacgcagtgcaaccaggtgccgtgggccctagcaacgagctccccggcatgtccgggaggggtgcccagcttttcgcaaagcgccagagtcgcatggaaaaatacgtagttgactccgacaccgtgcaggcccacgccgcaagggcccaatctcctacaccctctctgcccgcatcctggaaatactcaagcaacgttcgcgcacctccccccgttgcctacaacccaatccactccccctcttatcctctggccgctctgaaaagtcagcctagtgctgctcaacctagtaagatgggaaaaaaaaaaggcaagaagcctctaaacgcactggacgtaatgaaacaccaaccttatcaacttaacgcttcactcttcacctttcagccccccgacgcaaaagatggtcttccccagaagagcagcgtcaaggtaaactccgctctggcaatgaagcaagcgttacctccccggcccgtgaatgccgctagccctactaatgtccaggctagcagcgtttactccgtcccagcctacacctctcccccatcctttttcgctgaggctagctcacctgtgtcagctagccccgtgcccgtagggatcccgacttctccgaagcaagaaagcgcaagctcatcctacttcgtggcacccagaccgaagttctcggccaagaagagtggggtgacaatccaggaatcaggccgctccctctcccttccaggtcgctcggtaccaccaccgatttcgaccagtccctgggtgtaccagccaacgtacagctattctagcaaaccgacagatgggctcgagaaggctaacaaaagaccaacaccctgggaggccgccgctaagtcccctctaggtctggtcgacgacgccttccagccaaggaatatccaggagtcaatcgtcgcaaacgtcgtaagcgctgccagacgtaaggtcctgcctggcccccctgaagactggaatgagagactctcatatattcctcagactcagaaagcctatatggggtcatgtgggcggcaggagtacaacgtaaccgctaacaataacatgagtaccacctcccagtacggcagccagctgccgtacgcctactatagacaggcaagccgtaatgactctgcaataatgtccatggagaccagaagcgattattgtttgcctgtcgctgattataactacaatccacatccccgcgggtggagacgtcagacctag

SEQ ID NO: 23340 - DNA, 1146 bp, Artificial Sequence
  Description of Artificial Sequence: Synthetic coding sequence
atgagctggaccgtgcccgtggtgcgggccagccagcgggtgagcagcgtgggggcaaactttctgtgcctcggcatggcactgtgtccccgccaagcgacacgcattccactaaacggaacctggctgtttacccccgtctccaagatggcgacagtgaagtccgagttaatcgaacgctttacgagtgagaaacctgtgcatcacagcaaagttagtatcataggtacaggaagcgttggaatggcttgcgccatttctattctgctgaagggtctgtcggacgagctggctctggtagacctagatgaagacaaattgaagggtgagacgatggatttgcaacacgggagtcctttcacaaagatgcctaatatcgtgtgctcaaaagactactttgtgaccgccaacagtaacctggtcattatcacagctggggctagacaggaaaagggggagactagattaaatctggtacagcgaaatgttgcaatttttaaattgatgatctcctccatagttcagtactccccgcactgcaagctgataattgtcagcaatcctgtggacatcctgacgtacgtagcctggaaactttcggcatttccaaagaatagaatcatcgggagtggctgcaatctcgataccgcacgatttcggttcctgatcggtcagaaacttggcatccatagcgaatcctgtcatggctggattctaggggagcacggcgattcctccgtgccagtctggtctggagtgaatatagcaggcgtccctttgaaggacctgaatagcgacatcggaaccgacaaggacccagagcagtggaaaaacgtccataaagaggttaccgctactgcatatgaaattattaaaatgaagggctatacatcctgggcgatcggtctcagcgttgctgacttaaccgaatctatccttaagaatctcaggaggatccaccctgtctccacaattattaaaggtctgtacggtattgatgaggaggtcttcctctccatcccctgcatccttggcgagaacggcattacaaatcttattaagattaagcttacccctgaagaggaggcacacctcaagaaatctgctaagacactttgggagattcaaaacaagctgaaactgtag

SEQ ID NO: 23341 - DNA, 861 bp, Artificial Sequence
  Description of Artificial Sequence: Synthetic coding sequence
atgatggccacccccaaccagaccgcctgcaacgccgagagccccgtggctctggaggaggctaagacttccggagcccctggcagcccccaaactccccccgaacggcacgactcgggagggtccttgccactgacacccagaatggaatctcattccgaagatgaggacctggctggggctgtgggaggattgggctggaattctcgttcccctcgtacccagagccccggcgggtgttctgcggaggctgtgctggccaggaagaaacatcggcgacgcccatcaaaacgtaagaggcactggaggccttacctggagctctcttgggccgagaagcaacagcgggacgagcggcagagccaacgagcgtctagagttagagaggagatgttcgccaagggacagcccgtggcgccgtataacactacccagttcctgatgaatgaccgggatcccgaagaacctaacctggatgtgccccatgggattagccatcccggatcgagcggtgaaagtgaggccggagactccgatgggagaggccgagcccacggcgaattccagcgtaaggacttcagtgagacatacgagcgttttcacaccgagtctctgcagggaaggtccaagcaagaactcgtgcgcgactacctggagcttgagaaacggttatcacaagctgaggaagagacacggaggctccagcaattacaggcttgcactggtcagcaaagttgccgtcaggtggaagaacttgcagcagaagtccagaggctccgtaccgaaaaccaacgcctgaggcaggagaaccagatgtggaatagagagggctgtagatgtgatgaggagcccggcacgtag

SEQ ID NO: 23342 - DNA, 1206 bp, Artificial Sequence
  Description of Artificial Sequence: Synthetic coding sequence
atggcccacgtgagcagcgagacccaggacgtgagccccaaggacgagctgaccgctagtgaagccagcacacgatctcctctttgcgagcacactttccctggcgattctgacctgcgctccatgatcgaggaacatgcattccaggtccttagccagggaagcctgctggaaagcccgagttacacagtgtgtgtgtccgaacccgacaaggatgacgactttcttagcctgaacttccctagaaagctatggaaaatcgtggaatcagaccagttcaagtcgatctcatgggatgagaatggcacatgtatcgtaatcaacgaggagctgtttaagaaggaaattctggagaccaaggcgccgtataggatttttcaaacagatgcgattaagagctttgtccgtcaactgaatctctacggcttttccaaaattcaacagaacttccagcgttcagcgtttttagcgaccttcctgtctgaggagaaagaatcctcggtgttgagtaaactgaagttctactataacccgaactttaaacggggataccctcaactgctggtcagagtcaaacgacgcatcggtgtcaagaacgcatcaccaataagtactctgttcaacgaggatttcaacaaaaagcactttagggcaggtgcaaatatggaaaatcataattcagcactggcggccgaagccagtgaggagtcgctgttcagcgccagcaagaacctgaatatgcctcttaccagagaatctagcgtacgccagataattgccaacagtagcgtgccaattcggagcgggtttcccccgccaagtccctcaacctctgtgggccccagcgaacaaatcgcaactgaccaacacgctattctgaaccagcttaccaccatccacatgcactcacactccacgtacatgcaggctaggggccacatcgtgaactttattactaccaccacatctcaatatcatattatttctccacttcagaatggatactttggattaacggttgagccaagtgccgtccccactcgttaccccctcgtgtctgtgaatgaggccccataccgaaacatgcttcccgcgggcaacccgtggctccagatgcccaccattgccgacaggtccgccgccccccatagcagactggcattgcagcccagtcccctcgacaagtaccaccctaactataattag

SEQ ID NO: 23343 - DNA, 1728 bp, Artificial Sequence
  Description of Artificial Sequence: Synthetic coding sequence
atggccatggcccccagccccagcctggtgcaggtgtacaccagcccagcagcggtggccgtgtgggaatggcaggatggcttaggcacatggcacccctactccgcaactgtgtgctcctttattgagcagcagttcgtccagcagaagggacaacgcttcggcctggggagcctggcacacagcatcccactgggccaggcagacccatctctggccccatatataatagacttgccatcttggacacagttcaggcaagacactggaacaatgagggcagtgagacgtcacctctttccccagcacagtgcaccgggcaggggcgtggtgtgggagtggctgtcagacgacggctcctggaccgcatatgaggcctctgtctgcgactatctcgaacagcaagtagcgcgtggcaatcagctggttgatctagcgcctctcgggtataactacactgtaaactacaccacacatacccagacgaataaaacttcatcgttttgccgaagtgtgaggcggcaggctggccccccttatccggtcacaacaattattgctcctcccggccacacaggagtggcgtgtagttgccatcagtgcctttccggttctcggacaggaccagtgagcggtcgctataggcatagtatgactaacttgccagcttatcccgtcccccaacatccccctcaccgaactgcatctgtatttggaacccaccaggccttcgcaccatataacaagccttccctgtccggggcacgtagcgctccaaggctgaacacgacgaacgcgtggggagcggctcctcccagcctgggcagtcagcctttataccggtcctcattgagtcatttaggcccacagcacctgccccctggttcgtcgacttccggggccgtaagtgcttctttgccaagcggcccaagctcttcacctggatccgtgcctgcgactgtacctatgcagatgccaaagccctctagggtgcagcaagctctggcaggggctacgcccaagccagagcccgagccagagcaagtcatcaagaattacaccgaggaactcaaggtgccgcctgacgaggattgtatcatttgtatggagaaactgtcaactgccagcgggtactccgatgtgacagactctaaggccatcggaagcctggccgtcggtcacctaacaaagtgctcacacgctttccacctgctctgcttgctggctatgtactgcaatggcaacaaggatgggtcccttcagtgtccttcttgcaagaccatctatggcgagaagaccggtacccagccccaaggcaagatggaggtcctcaggttccaaatgtccctcccaggacacgaggattgcggtacaatcctgatcgtctatagcattccacatgggatccaggggcccgagcatccaaacccaggcaaaccttttacggcgcgcggctttccacgacagtgctacctcccagataacgctcagggcagaaaggtgctcgaactgctcaaggtggcttggaaaagacggcttatattcaccgtcggcacctcgtcaaccacaggtgaaaccgacactgtagtatggaacgaaatacaccataaaaccgagatggataggaacataacagggcacggttatccggatcccaactatctgcagaacgttctggctgagctggcagcgcagggggtgaccgaagactgcctcgagcagcagtag

SEQ ID NO: 23344 - DNA, 1095 bp, Artificial Sequence
  Description of Artificial Sequence: Synthetic coding sequence
atggagcacaacggcagcgccagcaacgccgacaagatccaccagaaccgcctgagcagtgtgacagaagatgaagaccaggatgccgcattaacgatagtgaccgtgttggacaaagtcgcctccattgttgacagtgtacaggctagtcagaaacgcattgaagagagacaccgagagatggaaaacgccattaaatctgtgcagattgacctactgaagctcagtcaaagccacagtaacactggccatatcataaacaagctcttcgagaaaactcgaaaagtaagcgctcatatcaaggatgtcaaggcaagggtcgagaaacagcaaattcacgtcaagaaagtggaagtcaagcaggaagagataatgaaaaaaaataagtttagggttgttatattccaggaaaagtttcgatgcccaaccagtctgagcgtggttaaagataggaatttaactgagaaccaagaggaggatgacgatgatatcttcgatccccctgtggatctctccagcgatgaggaatattacgtcgaggagagccggtccgctcgcctgagaaaatcagggaaagaacacatagacaacatcaaaaaggcattcagcaaggaaaatatgcagaagacaagacaaaacctggacaaaaaggtgaaccgcatcagaacgcgaattgtaactccagagcggcgggaacgcctgaggcaatccggagaaaggctgagacagtccggtgagagactcagacagtcaggggaacggttcaagaaaagcatctctaacgctgctccatctaaggaagctttcaaaatgcggtccctccgcaagggaaaggatcggaccgtcgctgaaggggaagaatgcgctcgggagatgggcgtggacattatagcccgatctgaaagcctcggtccgatatccgagttatactccgatgaactgtctgaaccagaacatgaagctgcccggcccgtgtaccccccccacgagggccgggagataccaacccccgaaccccttaaagtgacttttaaatcccaagtcaaggttgaggatgatgagtcactcctcttagatctgaagcactctagctag

SEQ ID NO: 23345 - DNA, 1266 bp, Artificial Sequence
  Description of Artificial Sequence: Synthetic coding sequence
atgcccaccctgagcgtgttcatggacgtgcccctggcccacaagctcgagggatcactacttaagacctacaaacaggacgactacccaaataagatcttccttgcctacagagtatgcatgacaaatgaaggccacccctgggtctcccttgttgttcagaaaaccagattgcagataagtcaggacccgtcactgaattatgagtacctgcccacgatgggactgaagtccttcattcaggcctctctggcgctgctgttcggcaaacatagccaggcgattgtcgagaacagagtgggtggcgtgcataccgtaggagattctggagcctttcagcttggcgtacagttcctgcgggcctggcataaagatgcgcggatcgtttatatcatcagttctcagaaagagttgcacggcctcgtttttcaggatatgggcttcactgtctatgaatacagcgtttgggacccgaaaaagctctgcatggaccctgatatcttgctgaatgtggtggagcagattccacatgggtgtgttttagttatgggcaacatcatcgactgtaagctgacgccaagtggctgggctaaactaatgtccatgattaaatcgaaacagattttcccattctttgatatcccctgccagggcttatacacctccgatctcgaggaggataccagaatcctgcagtattttgtctctcagggttttgagtttttctgtagtcaatctctgtctaagaattttggcatctacgacgaaggcgtggggatgttagtcgttgttgctgtgaacaaccagcagctattatgcgtgctttctcagctggaaggcctggcccaagccctctggctaaatccacctaacactggcgcacgcgtgataacctccatactgtgtaatcctgctctgctcggagagtggaagcaaagcctcaaggaggttgtggagaacattatgcttaccaaagaaaaggtgaaggaaaagttacagctgctcggtacccctgggtcatggggacatatcactgaacagtccggtacccacggctatctcggccttaactcacagcaggtggagtacctcgttcgcaagaaacatatttacattcccaagaatgggcaaattaacttctcctgtattaatgccaacaacatcaactacattacggaaggaataaatgaggcagtgctgctgacggaatctagtgagatgtgcctaccaaaagaaaagaaaacacttatcggaatcaagttgtag

SEQ ID NO: 23346 - DNA, 576 bp, Artificial Sequence
  Description of Artificial Sequence: Synthetic coding sequence
atgggcaagagctgcaaggtggtggtgtgcggccaggccagcgtgggcaagacctcaatcctcgagcagcttctctatggtaatcatgttgtggggagcgaaatgatagagactcaggaagacatttatgtgggctccatcgaaacagataggggggtgcgtgagcaggtccgcttctacgacactagaggtctgcgagatggagccgagttgcccaggcattgtttttcttgcaccgatgggtacgtcctcgtctactctacagacagcagagagtcatttcagagagtggaactgttaaaaaaggagatagacaaatccaaggataaaaaagaagtgacgattgtggttctgggaaataaatgcgatctgcaggagcagaggagggtggatcctgacgtcgctcagcactgggctaaaagtgagaaggtgaaattgtgggaggtgtctgtcgccgataggcggtctctgctggaaccctttgtatatcttgccagcaaaatgacgcagcctcaatctaaatctgcattccctctgagtagaaaaaataaagggtcaggttcattggacggatag

SEQ ID NO: 23347 - DNA, 3207 bp, Artificial Sequence
  Description of Artificial Sequence: Synthetic coding sequence
atggtgagcagcgaccggcccgtgagcctggaggacgaggtgagccacagcatgaaggaaatgataggtgggtgctgtgtctgcagcgacgagaggggctgggcggagaatcccctggtgtactgtgacggtcacggttgctccgtggctgttcaccaagcctgctatggaatcgtccaagtccccacaggcccttggttctgcaggaaatgtgagagtcaggaaagggctgcccgagtccggtgcgaactctgcccccacaaagatggggctctaaaaaggactgacaacggaggttgggcccacgtggtgtgcgctctgtacattcctgaggtgcagttcgctaatgtgtcaaccatggagccaatagtcctgcaatcagtccctcatgacagatacaataagacctgctatatttgcgacgaacagggccgagagtcgaaggccgctaccggcgcttgcatgacatgcaacaagcatggctgccggcaggcctttcatgtcacctgcgcgcaattcgcagggctgctttgcgaggaggaaggaaacggggccgacaacgtccagtactgcggttattgtaagtaccacttcagcaaactcaaaaagagcaaacggggatctaatcgttcctatgaccagagcttgtccgactcttcgtcccacagtcaggataaacatcacgaaaaagagaaaaaaaagtataaggagaaggataaacacaagcagaagcataagaaacaacccgagccttcacccgcgctggtgccatccttgacagttaccaccgagaagacttacacttcaacgtccaataacagcatcagtgggtccctgaagcgattagaggatactactgcacgttttaccaacgcaaattttcaggaagtgtcagcacacaccagtagcggtaaggacgttagcgaaaccaggggttcagagggaaaaggcaagaagtcttctgcgcactcctcaggacagaggggccgcaagcccggcggaggtagaaatcccggcacgacggttagtgccgccagcccctttcctcaaggcagcttctctgggacacccgggtccgtgaaatccagctcagggtctagcgtgcaaagccctcaagatttcctgagtttcaccgacagtgatctcaggaatgactcgtatagtcacagccagcagtcttctgccaccaaggatgtgcacaagggcgagtctggctcacaggaagggggcgtaaactccttcagcacactgatcggattaccgagcacgagcgccgtaacctcccagccaaagagcttcgagaactcaccaggagatttgggcaatagtagcttacctacagcagggtataaacgggcccagactagtggcattgaggaggagacagtgaaggaaaaaaaaagaaaagggaataaacagagtaaacatggaccggggcgaccaaaaggcaacaaaaaccaggagaatgtaagccacctctccgtctcaagcgcctcacccaccagctctgttgcatccgccgcgggctctattacctcttcttctcttcagaaatctcccacactgctgagaaatggtagtttgcagtcgctctccgtcgggtcctcacctgttggatctgaaatttctatgcagtacaggcacgatggcgcctgtccgaccacaacgttctcagaactcctgaatgcaatacataacggaatctataactcaaatgacgtagccgtcagctttccaaatgtcgtgtcgggatctggttcaagtacaccagtgtctagcagccatctgcctcaacagagctcggggcatctgcagcaagtgggcgcgctatcccctagtgcggtctcctctgccgctcctgccgtcgctaccacacaggccaacactctgtctggttcatccctcagccaagcgcccagtcacatgtacgggaatcgatccaactcaagcatggcggcactgattgcccagtcagagaacaatcagactgaccaagatctcggagacaactctaggaacttagttgggaggggaagtagcccccgtgggtctctgtcccctcggtctccagtttcctcactccaaattagatacgatcagccgggaaactccagcctggagaacttgccacccgtggcagcaagcatagagcagttacttgagagacagtggagtgagggccagcaatttttactagagcaaggcaccccaagtgatatccttgggatgctgaaaagcctacaccagctgcaggtcgagaaccgacgtttagaggaacagattaagaacctgacagccaaaaaagagaggctgcagctcctaaacgcacaattatcagttccatttcctactattacagcaaatcctagccccagccaccaaatccataccttttccgcccaaaccgctcccaccacagattcgctcaatagttcgaagtctccacatatcgggaattctttcctgcctgataactccttgcccgtgctcaaccaggatctgactagttctggacagtccacaagcagttctagcgcattaagtaccccgcctccagccgggcaatccccagcacagcaagggagcggcgtcagcggtgtacagcaggtgaatggagtaactgtgggagccttggcttctgggatgcagcctgtgaccagcacaatccccgcagttagcgctgttggaggtatcattggcgcactgccaggaaaccagctggccatcaacggcatcgtgggcgctctgaatggggttatgcagacgccagtgactatgtcccagaacccgaccccactgacacacacaaccgtaccgccaaatgctactcacccgatgccggcaacattaaccaattccgcttccggactgggcctgcttagcgatcagcagcggcagatcctgatccatcaacagcaattccagcaactcttaaacagccagcagttgaccccagagcagcaccaagctttcctgtatcagctcatgcagcaccatcatcagcagcaccaccagccagagctgcaacaattgcaaatcccaggacccactcaaattcccatcaacaaccttctagctgggacacaggcacccccgttgcacacagctacaactaatcctttcctgaccattcatggcgataatgctagtcagaaagtcgcccggctttcagacaaaacaggcccagtagcccaggagaaatcctag

SEQ ID NO: 23348 - DNA, 1353 bp, Artificial Sequence
  Description of Artificial Sequence: Synthetic coding sequence
atgagctgcctgatggtggagcggtgcggcgagatcctgttcgagaatcctgaccagaatgccaagtgtgtgtgcatgctaggggatattcgcctgagaggccagacaggcgtcagggccgaacgccgcggatcatatccttttatagactttagactgttgaattctacaacctacagcggagaaatcggcaccaaaaagaaagtgaagagacttttgtcttttcagagatactttcacgcttcaagactgctcagaggaataatcccccaggcgccacttcacctcctagatgaagattacttgggtcaggccagacatatgctctctaaggtgggtatgtgggatttcgatattttccttttcgatcggctgactaacggcaactcgctagtgacactgttgtgtcacctcttcaacactcacggcctgatccaccattttaagctggacatggttaccctgcatcggttcctcgtcatggtacaggaagactatcattcacagaacccctaccataacgccgtacatgcggctgatgtgacccaagcgatgcactgctacctgaaagagcctaaactggctagctttttgactccacttgatatcatgttgggtctattagcagctgccgctcatgatgtggatcatccaggcgtgaatcagccttttctgattaagaccaatcaccacctggcaaacctgtatcagaatatgtccgtcctcgagaatcatcattggaggagcaccatcggcatgctccgagaatctcgactgttagcccaccttcccaaagagatgactcaagatatagagcagcaactcggctctctcatcttagctactgacatcaacaggcagaatgagttcctgacacggcttaaggctcacctgcacaataaagatctgaggttagaggatgcccaggatcgccattttatgctgcagatcgctcttaagtgtgctgacatctgtaacccctgtcgaatttgggagatgagtaaacagtggagcgaaagggtttgcgaagaattctatcgccagggtgaattggagcaaaagtttgaactcgagatttcacctctttgtaaccagcagaaggattcaattcctagtattcaaattgggttcatgtcatacattgttgaaccattgtttcgtgaatgggcccacttcacaggcaacagtaccctcagcgagaatatgcttggacatctggcacataacaaggcccagtggaagtccctgctaccccggcaacatcggtccagagggagctccgggtctggccctgaccacgatcacgccggacagggcaccgagagtgaagaacaggaaggagattccccctag

SEQ ID NO: 23349 - DNA, 2268 bp, Artificial Sequence
  Description of Artificial Sequence: Synthetic coding sequence
atggccggctgcatccccgaggagaagacctaccggcggttcctggaactctttttaggcgaattcaggggtccctgcgggggaggtgaaccggagcccgagccagaacccgagccagaacctgagcccgagagcgaaccagaacctgagccagagttagtggaagccgaggccgccgaggcctccgtggaggagccaggtgaggaggcagcgaccgttgccgccacagaagaaggcgaccaggaacaggaccctgagccggaagaagaagctgcagttgaaggagaagaggaggaagaaggggcggccacagctgctgctgccccaggccacagcgccgtacctcccccaccaccccagctgccacctctcccccccttgcctcggcccctgtcggagcgcatcacacgcgaggaagtggaaggggaatcattggatttgtgcttacaacagttatacaaatataattgccccagctttctcgcggccgctctcgctagggccaccagcgacgaggtactccaatcagatctctccgcccactatatccctaaagagacggatggaacagagggtaccgtggaaatcgagactgtgaaactcgcccgcagtgtattctcgaaactgcatgaaatttgttgtagttgggtcaaggattttcctctccgccggaggccccaactatattatgagacatctatccacgctataaagaacatgaggagaaagatggaggacaagcacgtgtgcatacctgacttcaacatgttgtttaatctggaagatcaggaggagcaggcctactttgccgttttcgacggtcatggcggtgtagatgcggcaatctacgcctcaattcatctccacgtgaatctggttagacaagaaatgttccctcatgatccagccgaagctctctgcagggcctttagggttactgatgaacgctttgtccagaaggccgctcgggagagtctgagatgtggaacaacaggcgtcgtgacatttatcaggggaaatatgctacacgtggcatgggttggtgactcgcaggtgatgctcgtgcgcaaggggcaggcagttgagctcatgaaaccccataaaccagacagagaagacgagaagcaacgcatcgaagcgctgggcggctgcgtggtatggtttggtgcctggcgcgttaatgggagcttgagcgtaagccgagccattggggacgctgagcataaaccatacatatgcggcgacgccgattccgccagtacagtccttgatggcactgaggactacctaattttagcctgcgacggattttacgataccgtcaaccccgatgaggccgttaaggtggtcagcgaccatctgaaagagaataacggcgactcatcaatggttgctcataagctcgtggcgtcggcaagagatgccggcagctccgataacataacagtgatcgttgtgttcttgcgcgacatgaataaagcagtgaacgtgagcgaagagtctgactggactgagaactccttccagggcggccaggaagacggaggcgacgataaagaaaatcacggagagtgcaagcgaccctggccgcagcaccaatgcagtgcaccagcagacttgggttacgacgggagagtggatagcttcaccgaccgcactagcctttcaccaggctcccaaatcaacgtgctggaggatccggggtacttggacttgacccagattgaagccagcaagcctcacagtgcgcaatttttgctgccagtcgaaatgttcgggccgggggcaccaaagaaggcgaacctgataaatgagttgatgatggagaagaaatcagttcagagcagcctgcctgagtggtcgggcgccggagagtttccaacagccttcaacctgggatccactggcgagcagatctataggatgcagtccctgtcccctgtttgctctggtctagagaatgagcagtttaaatccccggggaatcgggtgagtaggttgtcacatttaaggcaccattactccaaaaagtggcatcgttttcgcttcaaccctaagttctattcattcctctccgcgcaggaacccagccacaagatcggaacttctctaagctctctgactggaagcggtaagcggaatcggattaggtcatccctgccatggcgccagaactcctggaagggctattcagagaacatgcgcaagttgagaaaaactcacgacataccttgcccagatctcccatggtcatacaaaatagaatag

SEQ ID NO: 23350 - DNA, 771 bp, Artificial Sequence
  Description of Artificial Sequence: Synthetic coding sequence
atggccagccggtacgaccgggccatcaccgtgttcagccccgacggccacctcttccaggttgagtatgcccaggaggccgttaaaaaggggtccacagccgtgggaattcggggtacaaacatcgtggtactgggggttgaaaagaagtcagtcgcaaaactgcaggatgagcgtaccgtccgaaaaatctgtgccctcgacgaccacgtatgcatggctttcgcagtcctcacaattttcattggcctaaccgccgatgccagagtggtgataaatcgagctcgggtggaatgtcaatctcacaagctcaccgtcgaggatccagtgaccgtcgaatacatcactcggttcatcgccactctgaaacaaaagtacacgcagagtaatggccgaagacccttcggaatttcagcactgatcgtggggttcgacgacgacggtataagcagactgtaccagaccgatcctagtggcacatatcacgcctggaaggcaaacgccattggacgctccgccaaaaccgtgagggagtttctggagaaaaattatacagaggatgccatagccagtgactccgaggcaataaagctcgccataaaagctctgctggaagtggtgcaatctggaggcaagaatatcgagctggcaattattaggaggaaccaaccccttaaaatgttttccgccaaggaggtggagctgtacgtgacagagatcgagaaagagaaggaagaggcagagaaaaaaaaaagcaagaaatccgtgtag

SEQ ID NO: 23351 - DNA, 3108 bp, Artificial Sequence
  Description of Artificial Sequence: Synthetic coding sequence
atggccccccggctgcagctggagaaggccgcctggcggtgggccgagacagtccgccctgaggaagtaagtcaggagcacatcgagaccgcctataggatttggttggagccatgtattcgcggagtttgtcgcaggaattgcaaagggaatcctaactgcctagtagggatcggggaacatatatggctgggggagattgatgaaaactcgtttcacaatatcgacgaccctaattgtgagaggagaaaaaagaatagttttgtggggttgaccaaccttggagccacctgctatgtgaacacatttctccaggtttggtttctgaacctcgaactgcggcaagcattatatctttgtccctccacttgcagtgattacatgctcggagacggaatccaagaggagaaggactatgagccccagaccatttgtgaacacctacaatatctgttcgcactgctgcagaactctaaccggagatacatcgacccttctggtttcgtgaaagctttggggctcgacactgggcagcagcaggatgcacaagagttttctaagctgtttatgagcctgttagaagacacgttgagcaagcaaaagaatccggatgtgcggaatatagtccagcagcagttctgcggcgagtatgcctacgtcacagtgtgtaatcagtgcgggagggagtcgaaactgctcagtaaattctatgaactggaactgaacattcaagggcacaaacagctgactgattgtatatctgaatttctgaaggaagagaagctggagggagacaatcgctatttctgtgagaactgccaaagcaaacagaacgcgactcgcaagatccggcttctgagcctcccttgtactctaaatctgcagctgatgagattcgtgttcgatcgtcagaccgggcacaagaaaaagctgaacacttatatcggattcagcgagattctggacatggaaccatacgtcgaacacaagggcggtagttatgtttacgaactctccgccgtcttaattcatcgcggggtctccgcttacagcgggcattacatagcccacgtaaaggaccctcagagcggtgagtggtataaatttaatgatgaagacatcgagaaaatggaaggaaaaaaattacagctcgggatagaggaagatctcgccgagcctagcaaaagtcagacacgcaaacccaagtgcggtaaaggtacacactgctcccgtaacgcttatatgctcgtctatagactccagacacaagaaaagccgaacaccaccgtgcaggtgcccgcctttttacaagagctcgtggatcgcgacaattcaaaattcgaggaatggtgcattgaaatggctgagatgaggaaacagtccgtggataagggtaaggccaagcacgaggaggttaaggagttataccaaagattgcctgccggggcagagccctacgagttcgtgtcactcgagtggttacagaagtggctggacgagagcaccccaacaaaaccgatcgataaccacgcgtgcctctgcagccatgacaagctgcatcccgataaaatcagcataatgaagaggatctccgagtatgctgcagatattttctattccagatatgggggcgggccgcgcctcacagtgaaggctctgtgtaaggagtgtgtggtcgagaggtgccgcattcttcggctgaaaaatcagctaaacgaagactataaaaccgtgaacaatctgctcaaagctgccgtcaaagggagtgacggcttttgggtaggcaaaagcagtctacgctcctggcgacagctcgctctcgagcagctagacgaacaagatggcgacgcagagcaaagtaacggtaagatgaatggaagtacactcaataaagacgagtccaaagaggaaagaaaggaggaagaggaattgaattttaacgaagacattctctgtcctcatggagaactgtgcatcagcgagaatgaacggaggcttgtgtctaaggaggcctggagcaaactgcagcaatatttcccgaaagcgccagaatttccctcttataaggagtgttgctcccaatgcaagatccttgagagggagggagaggaaaatgaggcgctgcacaagatgatcgccaacgagcagaagacctcccttccaaacttgtttcaggataaaaataggccttgcctgtcaaattggccagaggatactgatgtgctgtatattgtgtcacagtttttcgtcgaggaatggcgcaaatttgtgcgaaagcccacccgctgttccccggtctcaagcgtcggcaattccgccctcctgtgcccacacggagggcttatgttcacatttgcatctatgaccaaagaggattctaaactcatcgcactgatctggccttctgaatggcagatgatccagaaactgttcgttgttgatcacgtgatcaagatcaccagaatagaagtgggggacgtgaatccgagcgagacccagtacattagtgaacctaagctgtgtcctgagtgtcgcgagggcctgttgtgtcagcaacagcgagacttgcgcgagtacacacaggcaactatttatgtccacaaagtcgtggataacaaaaaggtgatgaaggattctgctccagaactaaatgtctcatcttccgaaacggaagaagataaagaggaggccaagccagacggagagaaggatcctgatttcaatcagtcaaacggaggaacaaagcgacagaaaatctcacatcaaaactatatagcctaccaaaagcaagtgatacggagatccatgcgccatagaaaagttagaggcgaaaaggccctgctcgtgtccgctaatcaaactctgaaggaactgaagatccagatcatgcacgctttctctgtggcacctttcgaccagaacctgagcatcgatgggaagatcctgagtgacgattgtgcaaccctggggacattaggagtcatccccgagagcgtgattctgcttaaggcagatgaacccatcgcagactatgctgcaatggacgacgtgatgcaagtttgcatgcctgaagaggggttcaaagggacagggctcctggggcattag

SEQ ID NO: 23352 - DNA, 2382 bp, Artificial Sequence
  Description of Artificial Sequence: Synthetic coding sequence
atgctgatccagagcgagaagaagacccagctgagcaagaccgagagtgtgaaagaatctgagagcctcatggagtttgcccaacccgagatccagccacaggaattcctgaatagaagatatatgacagaggtggattacagcaataagcagggagaggaacagccttgggaagcagactatgccagaaagccaaacctgcccaaaagatgggacatgctaactgagcccgacggtcaggagaaaaaacaggagtcattcaaaagctgggaagcctcaggcaagcatcaagaggtaagcaaaccggccgtaagtttagagcagcggaaacaggacacgagtaagctgagatcaacactccctgaagaacaaaagaagcaggaaatcagtaaatcaaaaccgtctccatcacagtggaaacaagatacacctaaaagtaaggcaggttacgtgcaagaggaacaaaaaaaacaggagacgcctaaattatggccagttcagctgcagaaggagcaggatcccaaaaagcagacacccaagagttggaccccgagtatgcagtcagagcagaacactacaaaatcgtggaccaccccaatgtgtgaggagcaagattccaagcagccggagacacctaaatcatgggagaacaacgtcgagagccagaaacattcactgaccagtcagagccagatcagccctaaatcttggggagtagccacggcgagcctaatccctaacgaccagttgttgcctcggaagcttaataccgagcccaaagacgtgcctaagcccgtgcaccagccggtgggttcaagcagcacgctgccaaaggacccggtgctacggaaagagaaactccaagacctgatgacccagattcagggcacttgcaactttatgcaggaaagcgtattggacttcgacaaaccatcgtccgccatccccacaagtcaaccccctagtgctacccccggctcacctgtagcctccaaggagcagaatctgagtagccagtctgacttcttgcaggaacctctgcaggctactagcagccccgttacgtgttcctcaaacgcttgtttagttactacagaccaggcaagttctggctccgagaccgaatttatgaccagtgagacgcctgaggctgctatcccacccggcaaacaacccagtagcctagcgtctcccaacccacctatggctaagggaagcgagcagggctttcagtccccacccgcctcttcatcaagtgttacgattaacaccgcaccctttcaagctatgcaaacggtatttaacgtgaatgcccctttaccacctaggaaagaacaggaaatcaaggagagcccatattcacccggctacaaccaatcgttcaccaccgcctctactcagacaccaccacagtgccaactcccttccatccatgtggaacaaactgttcacagccaggagactgcaaattatcatcccgacggtacaattcaggtatctaacggttctctcgctttctaccctgctcaaacaaatgtgtttccacgcccaactcagcccttcgtaaattctcgagggtccgtcagggggtgcactcggggaggtcgcctaattacaaattcttatcggagccccgggggctataaaggatttgatacctataggggactgccgtctatctcaaatggcaactattcacagctacaattccaggccagggagtactcgggggccccttactcccagagggacaattttcagcagtgctacaagagaggtggaacatctggcgggccacgcgccaattcccgggctggttggagcgactcctctcaggtgtctagcccggagagggacaacgagacgtttaactctggggatagtgggcaaggcgattctaggagtatgacgccagtggatgtgcctgttacaaatcctgcggctacaattctgcccgtccacgtatatcccctgccccagcaaatgagggttgcattttctgccgcgaggacgagtaatctggccccaggaactttggaccaacccatagtatttgatttacttctgaataacctcggagagacttttgacttgcagttgggccggtttaattgcccagtgaacggaacttacgtcttcatattccacatgttaaaactggcggtgaatgtccccctgtacgtgaatctgatgaaaaacgaagaggtgcttgtctcagcatatgcgaacgacggagccccagaccacgagacggcgtccaatcacgccattctgcagctcttccagggggaccagatctggctgcgcctccatagaggggcgatttacggctcatcgtggaagtactccacattcagcggctacctactttaccaagactag

SEQ ID NO: 23353 - DNA, 1083 bp, Artificial Sequence
  Description of Artificial Sequence: Synthetic coding sequence
atggaggagctgagccaggccctggccagcagcttcagcgtgagccaagacctcaattccaccgcagctcctcatcctagattatcgcagtataaaagcaaatatagctctctggagcaatctgagagacgcagacggctgttagagcttcaaaaatccaaaaggctcgactacgtgaaccatgcccggcgacttgccgaggatgattggactggaatggaatcagaagaggagaacaaaaaagacgatgaggagatggacattgacacggtgaaaaagctcccgaagcactatgcaaaccaactcatgctctctgagtggctcatcgatgtgccaagcgacctgggccaggagtggattgttgttgtgtgccccgtaggtaagagggctcttattgtggcctccagaggtagtaccagcgcgtatacaaaatctggctactgtgttaatcgcttctcttctctcctgccgggaggcaataggagaaacagcaccgcaaaagactacactatcctcgattgtatttacaatgaggtgaatcagacgtattacgtactcgatgtaatgtgctggcggggccaccctttctacgactgtcagaccgactttagattttactggatgcactccaaactccctgaggaggaaggtttaggcgagaaaacgaaacttaatccatttaagtttgtcggtctcaagaacttcccatgtactccagaatctctctgcgacgtgctgagcatggattttccatttgaagtcgatggactgctgttttaccacaaacagactcattatagcccaggaagtaccccactcgtgggttggttgagaccttatatggtttctgatgtcttaggtgtggcagtcccagcaggccctcttaccacaaagcccgactatgccggtcaccaactccagcagattatggagcacaaaaaaagtcagaaggagggtatgaaagagaaactgacacacaaggcgagcgagaatggtcattacgaactggaacacttgtcaaccccaaaactgaagggcagctcccacagccctgatcatcctggttgcctcatggagaactag

SEQ ID NO: 23354 - DNA, 525 bp, Artificial Sequence
  Description of Artificial Sequence: Synthetic coding sequence
ctgatccacaagcccctgaagcgggccatcaccaccctgatggccggtatacttaggttagtagtgcagtggcctcccgggaggttgcagaccgtcacaaagggcgtcgagagcctcatctgtaccgactggatacgtcacaagtttacaaggagcagaattcctgagaaagtctttcaagccagccctgaggatcatgagaagtacggcggagatccccagaacccccataagttgcacattgtcaccagaattaagtcgactaggaggcgtccctactgggagaaagatattattaagatgctgggcctcgaaaaagctcacacacctcaggtacacaagaacatcccaagcgtgaacgccaagcttaaagtagtgaaacatttaatccgcattaagcccctcaaactaccacagggattgccggccgaggaaaacatgagcaacacctgtctgaaaagcaccggcgaactggtggtacagtggcatttaaagcccgtggagcagaaagctcatgagagctag

SEQ ID NO: 23355 - DNA, 1434 bp, Artificial Sequence
  Description of Artificial Sequence: Synthetic coding sequence
atggccacctacacctgcatcacctgccgggtggccttccgggacgctgacatgcagagggcacattacaaaaccgattggcatcgctacaacctgcggcggaaagtcgcttcgatggcacctgtgactgccgaagggttccaggagcgagtcagggcccaacgagcggtcgctgaggaagagtcaaagggtagcgcgacatactgcactgtctgctcaaagaaattcgcctccttcaacgcatacgagaatcatctgaaatctcggcgccacgttgagctggagaaaaaagccgtgcaggccgtgaacaggaaagtggaaatgatgaacgagaaaaatctggaaaaaggactgggcgtggactccgttgataaagatgccatgaatgctgcaatccagcaagctatcaaagcccaaccaagcatgagcccaaaaaaagcccctccggccccagcgaaagaggctagaaatgtggtagccgttggaaccggcggtcgtgggactcacgatcgagatccttctgaaaagccaccgagattacagtggtttgaacaacaggctaaaaaactcgccaaacagcaggaggaagattcagaagaggaggaggaggatcttgacggcgacgactgggaggacatcgacagcgatgaggagctcgaatgcgaagacaccgaagcaatggatgatgttgtggagcaagatgctgaagaagaggaggccgaggaaggccctccattaggcgccataccaattaccgactgtctgttttgttctcaccattctagctcactgatgaagaacgtcgcacacatgacaaaggaccactcctttttcatccccgacatagaatatctgtccgatatcaaagggcttattaaatatctcggtgagaaagttggtgtggggaaaatctgcctgtggtgcaacgaaaaaggaaaaagcttttacagtaccgaggcagtccaagcacacatgaacgacaagagccactgtaagctctttaccgacggggacgccgccttggagttcgcagatttttacgacttcaggtctagttatcctgaccacaaagaaggagaggatccgaataaggccgaagagctcccttctgaaaaaaacttggagtatgatgatgagaccatggagctgatcctgccgtccggtgcaagagtcggacaccgttcattaatgcgctattataaacagaggttcggcctgagcagagccgtcgccgttgctaagaaccgaaaggccgttggaagagtcctccagcagtatcgcgctctaggctggaccgggtccaccggagcagctttgatgagagagcgcgatatgcagtacgtgcaaagaatgaagtctaagtggatgctaaagactgggatgaagaataacgccactaaacaaatgcacttccgtgtccaggtgaggttttag

SEQ ID NO: 23356 - DNA, 2862 bp, Artificial Sequence
  Description of Artificial Sequence: Synthetic coding sequence
atgatcaccagcgccgccggcatcatcagcctgctggacgaggacgaacctcagctgaaagagttcgccctccacaagctaaacgccgtagtcaatgatttttgggcagagattagcgagagcgttgataagatcgaggtgctttatgaagacgaaggatttcgtagtagacaattcgccgcccttgtggcaagtaaggtgttttaccacctgggtgcctttgaagaatctctgaattacgccctaggcgctggcgatctctttaatgtcaacgataattctgagtatgtcgagaccattattgcgaaatgtatcgaccattacactaaacagtgtgtggaaaacgccgacctcccagagggagagaagaaacccatcgaccagcggctggaagggatcgtcaataagatgttccagagatgcctggacgaccacaagtacaaacaagctattggtattgcgctagagacaagaagactggacgtttttgaaaagacaatcctggagtccaacgatgtgccaggcatgcttgcttacagccttaaactctgtatgtcactgatgcagaacaaacagtttaggaacaaggtactcagagtccttgttaaaatatatatgaacctggagaagccagattttattaatgtgtgccaatgtttaatctttctggacgacccccaggcggtttctgatatccttgagaaacttgttaaggaggacaaccttcttatggcctaccagatctgtttcgatctatacgagtctgcatcccagcaattcctttcaagtgtcatccagaatctgcgaacagtggggacaccgattgcatctgtcccgggatccactaacaccggaacagttcctgggtctgagaaagatagcgattcgatggagacggaggagaagacatcctccgctttcgtcggtaagactcctgaggcttcccccgaacccaaggatcaaactcttaagatgatcaagatactgtcgggggaaatggcaattgaactgcacctccagtttctgatccgcaacaataacaccgatctcatgatactgaaaaataccaaggatgccgtccggaattccgtttgccatacggctactgttatagctaactccttcatgcactgcggcactacgagcgatcaatttctgcgtgataatcttgaatggcttgcacgcgcgacgaattgggcgaaatttacagccaccgctagtctcggcgttattcacaaaggccacgagaaggaggccctgcagctcatggctacttatctccctaaagacacttctcctggaagtgcttatcaggaagggggcggcttatacgccctgggcctgatccatgccaaccacggaggcgatatcatagactacctattaaatcagttgaagaatgccagcaatgacatcgtgagacatggtgggtctctaggcctaggactcgccgccatgggcacagctagacaagacgtatacgatctcctgaagaccaatctgtaccaggatgatgccgttactggggaggctgcggggctggctttgggtctggtgatgctggggagtaaaaatgcgcaggccatagaggacatggtgggttacgctcaagagactcagcacgaaaaaattttacgcgggctcgccgttggaattgctctggtcatgtacgggaggatggaggaagcagatgctcttattgagagtctctgccgagataaagatccaattctgcgccgaagtggtatgtacacagtagctatggcatattgcggaagtggaaacaacaaagcaatcaggcgcttactgcacgtcgccgtgagcgatgtgaatgatgatgtacgaagagcagccgtcgaatcactcgggtttatcctgttcagaaccccggagcaatgtcccagtgtggtgagcctcctgtctgagtcgtacaatcctcatgtcaggtatggggccgccatggctttaggcatctgctgtgccggtaccgggaacaaggaggccatcaaccttcttgagcccatgacaaacgatcctgttaattatgtgagacagggagccctaatcgcaagcgccctgatcatgatccagcaaaccgaaatcacatgtccgaaggtcaatcagtttcgccagttgtacagcaaggtgatcaatgataaacacgatgacgtgatggcaaagttcggagccatcctcgcacagggtatcctggacgccggcggccataatgtgaccatctctctccagagtcgcacaggccatacccacatgcccagtgtggtgggtgtgcttgtgtttacacagttctggttttggttcccgttatcccattttctgtctctggcatatactccaacttgtgtcatcgggctcaacaaggacctgaagatgcccaaagtccagtacaaaagcaattgcaaaccgagtacctttgcctatcccgccccattagaagtgcctaaagagaaggagaaggagaaggtatccacagctgtgctgtccatcactgctaaagcaaagaaaaaggaaaaggaaaaggaaaagaaggaggaagagaaaatggaggtcgacgaagccgaaaaaaaggaggagaaggagaagaagaaagagccagaaccgaactttcagctcctcgataatcccgcccgcgtcatgcctgctcagttgaaggtgctaaccatgccagagacatgtcggtatcagccctttaagcccctctctatcggaggcattatcatcctcaaggacacctccgaggacatcgaggaattggtggagcccgttgcagctcatggccctaaaatcgaagaggaagagcaggaaccggaaccacccgaacccttcgaatatatcgatgattag

SEQ ID NO: 23357 - DNA, 984 bp, Artificial Sequence
  Description of Artificial Sequence: Synthetic coding sequence
atgtgcagcaccagcggctgcgacctggaggagatccccctggacgacgacgacctgaataccattgagtttaaaattctggcttattacaccaggcatcacgtgttcaaaagtactcccgcactcttttctcccaagttactgaggaccagatcactgagccagcgaggactcggtaattgtagtgcgaacgaatcttggacagaagtttcttggccatgtagaaactcccagtccagtgagaaggccattaatttgggtaaaaaaaagagttcatggaaagccttctttggagttgttgagaaggaagactctcaatccacccctgcaaaagtctcggcgcagggccagagaactttggaataccaggattcacattcccagcagtggtcccgctgtttgagcaacgtggagcagtgcctggagcatgaagccgtagatccgaaagtgatcagcatcgctaatcgcgtggcagaaatcgtctatagttggccgcctcctcaggccactcaggctggtggctttaagagcaaagaaatatttgtcaccgaggggctcagcttccagctgcagggtcacgtgccagtggcatcatctagtaaaaaagatgaagaggagcagatcctggccaaaatcgtagaactgctcaagtactcaggcgaccaattggagaggaagctgaaaaaggacaaggccttaatggggcatttccaagacggactgtcgtactccgtttttaagacgatcaccgaccaggtacttatgggcgttgatcccagaggagaaagcgaagtcaaagcccagggattcaaagcggccctggttatcgatgtcaccgccaaactgactgctattgataatcatcctatgaaccgtgtgttgggctttgggaccaagtacttaaaggagaatttctcaccgtggattcagcagcatggcggatgggagaaaattttagggatctcccacgaagaagttgattag

SEQ ID NO: 23358 - DNA, 1086 bp, Artificial Sequence
  Description of Artificial Sequence: Synthetic coding sequence
atgggcggcgccgtgagcgccggcgaggacaacgacgagctgatcgacaatcttaaggaagcccagtacattaggactgaactggtcgaacaggcttttcgagccattgaccgcgccgattactacttagaagagttcaaggagaacgcctataaagatctggcgtggaaacatggcaatatccatctgtctgccccctgtatctacagtgaggtgatggaggctcttgatttgcagccagggctttcatttttgaatttgggctccggaaccggctaccttagctcgatggtgggcctgatcctgggccccttcggcgtcaaccatggagtcgagttacactccgatgttatcgagtacgcgaagcagaaacttgacttcttcattaggacaagcgactcgtttgataaattcgacttttgtgagccatccttcgtcactgggaactgcctagaaatatcacctgactgttcacagtacgaccgggtgtactgcggtgctggtgtccagaaggagcacgaagaatacatgaaaaatttgctgaaagtgggcggaatcttagttatgccactagaggagaaactgaccaagattacccgaacaggcccaagtgcttgggaaaccaagaagatcctcgcagtgagctttgcccctctaatccagccgtgccattccgagtcagggaaatcaagactagtgcagctccccccggtggctgttcgctccctgcaggatctggcacgaatagcgatcagggggacgatcaagaagataattcaccaggagaccgtgagtaagaatggtaatggactgaagaatacaccgagattcaaacgacggagagtcaggaggagaaggatggaaacaattgtgttcttagacaaggaggtatttgcttctagaattagtaacccttcagacgataattcatgcgaagacctggaggaggagagaagagaagaagaggagaaaacaccaccagaaaccaagcctgacccccccgtgaatttccttcgtcagaaggttctgtccctgccccttcctgatcctctgaaatactacctcctttactaccgagagaaatag

SEQ ID NO: 23359 - DNA, 780 bp, Artificial Sequence
  Description of Artificial Sequence: Synthetic coding sequence
atgaaggacgtggacaacctgaagagcatcaaggaggagtgggtgtgtgagaccggttccgataatcagcctttaggtaacaaccagcagtccaactgtgagtattttgtggacagcttgtttgaagaagcccagaaggtgtcaagcaagtgcgtttctcctgctgaacagaagaagcaggtcgatgtgaacatcaaattgtggaagaatggcttcacagttaacgacgactttaggtcttactctgacggcgcttcacagcagttcttgaattccataaagaagggagaattgcccagtgagctccagggaatctttgataaagaagaagtcgacgttaaggtcgaggataaaaaaaatgagatctgcctcagcaccaagccagtgtttcagcccttcagtggccaaggacatcgcctcgggagcgccaccccaaagattgtttccaaagccaaaaatattgaggtagagaacaagaacaacttgtccgccgtgcccctgaataacctagaacctatcactaatattcagatctggctcgcaaacggtaagcgaattgtccagaagtttaatataacacacagggtgtctcatattaaggacttcatagagaaataccaagggagtcagcgtagcccccccttttccctggccaccgccctgcccgtgcttagactgcttgatgagaccttgacccttgaggaggccgatctacagaatgccgtaatcatccaaagactacaaaagacggccagttttcgcgagctgagtgaacattag

SEQ ID NO: 23360 - DNA, 990 bp, Artificial Sequence
  Description of Artificial Sequence: Synthetic coding sequence
atggtgcggaccaagacctggaccctgaagaagcacttcgtgggctatcccacaaattccgacttcgagctgaaaaccgcagagctcccacccctcaaaaacggtgaagtgttgctagaggcactgttcctgactgtagacccatacatgcgggtggcagccaagcgcctaaaggagggcgacaccatgatgggtcagcaggtggcaaaggtggtggagagcaagaacgtagcccttcccaagggcaccatcgtcttagcatctcccggttggaccactcacagcatctctgatgggaaggacctggagaagctgctgactgagtggcccgacaccataccactttcacttgccctcgggacagttggtatgcctgggctgaccgcctacttcggacttctggagatttgtggtgtcaagggcggcgagaccgtgatggtgaatgctgctgcaggggcagtcggatccgttgtaggacagatagccaaacttaaaggctgtaaagtcgtgggagctgtaggatctgacgagaaagtagcttacctccagaaactgggttttgacgtggtctttaattataaaacagtggagagcctggaagaaacgttaaagaaagcaagtccagatgggtatgattgctacttcgataacgttggcggagagttcagcaacactgttatcgggcagatgaagaaattcggtagaatcgcaatctgcggcgccattagcacttataaccggactggtcccctccctccaggcccaccacctgagattgtgatttaccaggaactacgaatggaggcattcgtggtttatagatggcaaggagatgccaggcagaaggctcttaaggacttgttaaaatgggttcttgaagggaagattcagtataaggagtatatcatcgaaggatttgagaacatgccagcggcattcatgggaatgctgaagggggataacttggggaagaccattgtgaaggcctag

SEQ ID NO: 23361 - DNA, 3006 bp, Artificial Sequence
  Description of Artificial Sequence: Synthetic coding sequence
atgcagagcaccgacctgggcaacaaggagagcggcaagatctggcatcggaagccctctcccgctactcgtgacggaattatcgttaacattatacacaatacctcggactaccatcccaaggttttaaggttcctaaacgtggcattcgacggaactggggactgtctcatagccggagaccatcaaggcaatatttatgtgttcgacctgcatggaaaccgctttaacctcgttcagaggactgctcaggcgtgtacagccctggctttcaatctgagaaggaaaagcgagtttctcgtcgccttggcagactacagcataaagtgcttcgatacagtaactaaggagctggtatcctggatgagaggccatgagtcaagcgtcttctccataagtgttcacgcgagtggtaaatacgctatcacaacgtctagtgacaccgcccagctgtgggatctggatacatttcagcgaaagaggaaactcaatattcggcagtccgttggtattcagaaggtattctttttaccgttgtccaacacaatcctcagctgttttaaagataattccatattcgcatgggagtgtgataccttattttgcaagtaccagctgcctgcccctcctgagagctctagtatcctgtacaaggtgtttgcagtgactcgggacggccgtattctcgcagcaggtggtaagtcgaaccacctgcacctctggtgtctggaggcccgccaactattccgcattattcagatgcctacgaaagtgcgggctatccgacacctggagtttctgcctgactcttttgacgcggggtccaaccaggtcctgggggtgctgtctcaagacggtatcatgagatttattaatatgcagacatgtaagcttctgttcgaaatcggctcattggacgaagggatttcctcctcagccatctccccacacggtcggtatatcgctagcatcatggagaatggatctttaaacatctacagtgtccaagcgctgacccaagagataaacaaacctcctcctccgcttgtgaaagttattgaagacctccctaagaataaattgagttcgtccgatctgaagatgaaggtaacctccggtagagtgcaacaacccgcgaagtcaagagagtcaaagatgcagacccggatcctgaagcaggacctgaccggagacttcgagtcgaagaagaatgaactgccggacggactgaataagaaacggctgcaaatcctgctgaagggctacggggaatatccaactaagtacaggatgttcatttggcgttcactgttgcagctgccggagaatcacaccgctttctctacacttattgataagggcacacatgtggcattcctgaacttgcagaaaaagtatcctatcaagtcaaggaaactgcttcgcgtgctccagaggaccttgagtgcacttgcacattggagcgtgatattttccgataccccttacttacctctgctggcgtttccgtttgtaaagctcttccagaataaccagctgatttgctttgaggtgatagcaactctgatcatcaattggtgtcagcattggtttgaatattttccaaaccctcccatcaacatcctgagtatgatcgaaaacgtcctcgccttccacgataaagagttacttcaacactttattgaccatgacatcacatcccagctctatgcttggcccctactggaaaccgtattcagtgaggtgctgacacgggaagagtggctcaagctattcgacaatattttttccaatcatccttctttcctgctaatgacagtggttgcctacaatatctgttctagaacacccctgctgagctgcaacttaaaggatgattttgagttttttttccaccacagaaataatctggacattaacgtcgttatcagacaggtctaccatcttatggaaacaacacctaccgacatccaccctgactctatgctgaatgtgtttgtagcccttaccaaagggcaataccccgtgtttaaccagtacccgaagtttattgtggattatcagacacaagaaagagaaaggatccggaacgatgaactggactatctgcgagaacgccaaacagtcgaggacatgcaggcgaaagttgaccaacagcgcgttgaagacgaggcctggtaccaaaaacaggaattgctgagaaaggcagaagaaacccgacgggagatgcttttgcaggaggaagaaaagatgatccagcagaggcagagactggctgccgttaagagggaacttaaagtcaaggagatgcacttacaggatgccgctcgtaggcggtttctcaaactgcagcaggatcaacaggaaatggagctgcggcgcctagacgacgaaatcgggaggaaggtgtacatgcgtgacagggagatcgcagccaccgcaagagacctcgaaatgcgccagctcgagttagaatcacagaagagactgtacgagaaaaacctgacagagaatcaggaagcactggcaaaagagatgagagcagacgccgatgcctaccgcagaaaagtagacctcgaggaacacatgttccataaactcatcgaagctggtgaaactcagtctcagaagacccagaaatggaaggaggcggagggaaaggagttccgcctgagatctgcaaagaaggcttccgctctctcagatgcttccagaaagtggtttcttaaacaggagatcaacgctgccgtggaacacgcagaaaacccctgccataaagaggagccacgcttccagaacgaacaggacagcagctgcctgccccgcacatcccagctaaatgattcaagtgaaatggacccatccacgcagatcagccttaaccgaagggctgttgagtgggatacaaccggacagaatctgattaagaaagtgagaaacctgagacaaaggcttaccgcaagggcccgccatcgctgccagacaccccacctgctggctgcatag

SEQ ID NO: 23362 - DNA, 651 bp, Artificial Sequence
  Description of Artificial Sequence: Synthetic coding sequence
atgagcttcctgttcggcagccggagcagcaagaccttcaagcccaaaaagaatatccctgaaggaagccatcaatatgagctactgaagcacgctgaagccacactaggaagcggtaatctccgtatggcggtcatgctccccgaaggcgaggatctgaatgagtgggttgccgtaaatacagtggatttcttcaaccagataaacatgttgtacggcacaatcactgatttctgtacagaggagagctgccccgtcatgagtgccggacctaaatatgaataccactgggcagatggaactaatattaaaaagccaattaaatgctcagcgcctaagtatatcgattatctgatgacctgggtccaggaccaactcgatgacgaaactctctttccttctaagatcggcgtgccttttccaaaaaacttcatgagcgtggccaagactatacttaagcggttgttcagggtgtatgcgcatatctaccatcagcatttcgatcccgtgatccagctgcaggaggaggcacatctgaataccagcttcaaacatttcatcttttttgtgcaggaattcaacttaatcgacaggagagagctggcgcctcttcaggaactgattgagaaacttacgagtaaagacagatag

SEQ ID NO: 23363 - DNA, 477 bp, Artificial Sequence
  Description of Artificial Sequence: Synthetic coding sequence
atggccgcccagggcgtgggccccggccccggcagcgccgccccccctggattggaagcagcccggcaaaaattggcattgcggcgtaagaaggtcttatctaccgaggagatggaactatacgaactggcccaggcagcaggcggcgggattgatccagatgtcttcaagatcctggtcgaccttctgaagctcaatgtagccccacttgcagtgtttcaaatgctgaagtctatgtgcgccggtcagaggcttgcatcagaaccgcaggaccccgcagcagtcagcctgccaaccagcagcgtgcctgagaccaggggccgggataaaggatcagctgctctcggaggggtgctggcactggcagaaaggtcaaaccacgaaggcagcagccagcggatgccgcgtcagcccagtgcaactaggctgccaaagggtgggggccccggtaaatccccaacccaagggtcaacttag

SEQ ID NO: 23364 - DNA, 1425 bp, Artificial Sequence
  Description of Artificial Sequence: Synthetic coding sequence
atgaacagcgtgagccccgccgccgcccagtaccggagcagcagcccggaagatgcccggagacgccctgaggccagacggcctagaggcccacgaggacccgatcccaacggcctggggcctagcggagcctcaggacccgccctgggcagccctggggccggaccttccgaacctgatgaagtcgacaagttcaaggcaaagtttctgacagcgtggaacaacgttaagtacggctgggtagttaagtctcgcacgagttttagtaagatttcctccatccatctttgtgggcgccggtatagattcgagggagagggggatattcagaggttccaaagagacttcgtgagtagactctggttgacttacagaagagacttccctccgttacccggtggctgcctcactagcgactgcggatgggggtgcatgcttagatctggacagatgatgctggcccagggacttctgctgcatttcctgcctagggactggacatgggcagagggtatgggcctagggccaccagaactgagtggctccgcctctccttcccggtaccacggaccagctcgctggatgcctccccggtgggcacagggagctccagaattggaacaggagagacgccacagacagatcgtgagttggtttgcagaccatcctagagctcctttcggactacaccgactcgtcgaactcggtcagagtagcggtaagaaggctggagactggtacggaccttcccttgtggctcacatcctgcgtaaggcagtcgagtcgtgtagcgacgtgacacgcctggtggtttatgtatcgcaggactgcaccgtatataaggcggatgtcgcacgtcttgtcgcacgcccagatcccactgccgagtggaagagcgtcgtgatactggtgcccgttagacttgggggcgagaccctcaatcccgtttatgtgccttgcgtgaaggagctcttgaggtgcgagttatgcctcggcattatgggtggcaagccaaggcactccctgtacttcattgggtaccaggacgatttcttactttacctcgatcctcattattgtcaacctactgtggacgtgtctcaggccgactttcccctggagagcttccactgtacctccccacgcaagatggcctttgctaaaatggacccaagttgcacggtcggattttatgccggagaccggaaagagttcgaaacactctgttccgagctgacccgcgtactttcatcctcgtccgccactgaacgctatcctatgttcaccctggcagaaggtcacgctcaggatcattcattggatgacctctgttcccagctggcacagcccacactccgactcccgagaacagggagactgctccgagctaagagaccgagcagcgaggatttcgtgtttctctag

SEQ ID NO: 23365 - DNA, 945 bp, Artificial Sequence
  Description of Artificial Sequence: Synthetic coding sequence
atggccttcgtgacccggcagttcatgcggagcgtgagcagcagctccaccgcttccgcctctgccaaaaagattatcgtgaaacacgtcaccgtcatcgggggtggcctgatgggggccgggattgcccaggtcgcagctgcaaccggacatactgtggtgttagtggaccagaccgaggacatcctggccaagagcaagaagggcattgaagaaagcctcagaaaagttgcaaagaagaagtttgctgagaatttgaaggccggagacgaatttgtcgagaaaaccctgtccacaatagcaacgtctaccgacgcagcatccgtggtccactcaactgaccttgtggtggaagcgatcgtggaaaatctaaaagtgaagaacgaactgtttaaacggctggacaagttcgccgcagaacataccatctttgcctccaataccagttcacttcagatcacatccattgccaacgctacaacaaggcaggacagattcgccggactgcattttttcaatcccgtgccggtcatgaaattagtggaggttattaagaccccgatgacatctcaaaaaacgtttgaatctctggtggacttctctaaagccttaggcaagcatcccgtatcatgtaaggataccccaggcttcattgttaataggctgctggtgccttatctgatggaggctatacgattgtacgagcggggagatgctagcaaggaggacatagacacagcaatgaaactaggagccggctacccaatggggccatttgagctgctggactatgttggcctggatacgaccaagttcatcgtggatggttggcacgaaatggatgcagagaatccgttgcaccagcccagtccttctctaaacaaactagtggcagaaaacaaattcgggaaaaagaccggggaaggattctacaagtataagtag

SEQ ID NO: 23366 - DNA, 810 bp, Artificial Sequence
  Description of Artificial Sequence: Synthetic coding sequence
atgggcaactgctgctggacccagtgcttcggcctgctgcggaaggaagccgggagactccaaagagtgggtggcggaggcgggtctaagtactttcggacatgctcccgcggcgagcacctgactatcgaattcgagaatctcgttgaaagcgacgaaggcgagtcaccaggaagctcacatagaccattgacagaagaagaaattgtcgatttaagagaacggcactatgactccatcgctgaaaaacagaaagacctggacaagaaaattcaaaaagagcaggaacgtcaacgcatagtgcaacaatatcaccccagtaataacggtgagtaccagtcatcaggacccgaggacgactttgagagttgtttaaggaacatgaaaagccagtatgaggtctttagaagtagcaggctgtcctcagatgccacagtgctgactccgaataccgaatccagctgcgatctgatgacaaaaacaaagtcaacaagtgggaacgacgattcgacatctctggacctggaatgggaagatgaggagggcatgaatcgcatgctgcccatgagggaacggtcgaaaactgaggaagatatactgcgcgctgctttaaaatatagcaacaagaagactgggagcaaccctacgtcagcaagcgacgatagtaacggtttagagtgggagaatgacttcgtcagcgccgagatggatgacaatggcaactccgaatacagcgggttcgttaatcccgttttggagctttctgactctggaattcgacactctgacactgatcagcagaccagatag

SEQ ID NO: 23367 - DNA, 1371 bp, Artificial Sequence
  Description of Artificial Sequence: Synthetic coding sequence
atgaagtgcgagcactgcacccggaaggagtgcagcaagaagaccaagaccgacgaccaagaaaacgtcagcgccgatgccccgtccccagcccaggagaacggagagaagggtgaattccacaaactggccgatgctaagatcttcttatctgactgtctggcctgtgacagctgcatgaccgccgaagagggcgtgcaactgtctcaacagaacgcaaaggacttcttcagagtattaaacctgaacaagaagtgtgacacttccaagcacaaggtcctggtcgtctctgtgtgtcctcagtctctcccctatttcgctgctaagttcaatctgtctgtaacggacgccagccggcgcctgtgcggttttctgaagtcactcggcgtgcattatgtcttcgataccaccattgcagcagattttagtatacttgagtcccagaaagagttcgtcagacgatatcgccagcactccgaagaggaacgtaccctgcctatgctcactagtgcttgtcccggctgggtaaggtacgcagagcgcgtgttggggcgccctattaccgcgcacttgtgcacggcaaagtccccccagcaggtgatgggaagtctggttaaagactattttgcccgacagcagaacctcagcccagaaaagatattccacgttatagtagccccgtgttatgacaagaagctcgaggcccttcaagagagcctgcctcctgcccttcacggcagccgaggcgccgattgcgtgctgacctccggcgaaatcgctcagattatggagcagggcgatctgtctgtccgcgacgcagcagtggacacgctgttcggagacctgaaggaagacaaagtcactagacacgatggcgcctcaagtgatgggcatctcgcgcacatatttcgacatgctgccaaggagctttttaatgaagacgtggaggaggtgacctatagggccctccgtaacaaagatttccaggaggtgacattagaaaagaatggtgaagtagttctccggttcgctgctgcatacggattcagaaacatccagaatatgatcttgaaactgaagaaggggaagtttccttttcacttcgttgaggtgctggcttgtgccggcggctgcctcaacggcaggggccaggctcaaacccccgatgggcacgccgataaagctcttctcaggcagatggagggaatttatgccgacattcccgttaggagaccagaatcctcagcacacgtgcaagaactctaccaggaatggctcgagggaattaatagtccaaaggcaagagaggtactccacaccacatatcagtcccaagagcgcggcactcacagcctcgacatcaaatggtag

SEQ ID NO: 23368 - DNA, 612 bp, Artificial Sequence
  Description of Artificial Sequence: Synthetic coding sequence
atggcccacgtgagcagcgagacccaggacgtgagccccaaggacgaacttactgcgtccgaggcgtctacccggtcacctttatgtgagcataccttccctggggacagcgatctgagatccatgatcgaggaacacgcctttcaggtgctcagccagggcagtttactcgagtcgccaagctacactgtttgtgtcagcgagccagataaagacgacgatttcctcagccttaacttccctcgaaaactatggaagatagtggaatccgaccagtttaagagcatcagctgggatgagaacggaacatgcatcgtgattaatgaggagctgttcaaaaaagagatcctggagacaaaagctccatatcggatcttccaaaccgatgctataaaaagcttcgtgagacagctgaacctttatgggttctccaaaattcagcagaattttcagcgatccgcattccttgctacattcctcagtgaagagaaggaatcgtcagtactatccaagattcgattcactaagatgaaactctcgcgatccagtacttacgaaaatcgctacttgtgttgcaacctgcatctgaaggacgaaagtaactacagttag

SEQ ID NO: 23369 - DNA, 2052 bp, Artificial Sequence
  Description of Artificial Sequence: Synthetic coding sequence
atgaacaccagcatcccctaccagcagaacccctacaacccccggggatcctccaacgtgattcaatgctataggtgtggggacacttgcaagggcgaggtggtgcgggtacacaataatcacttccacatacggtgttttacctgtcaggtttgtgggtgcggtctggcccagagcggtttcttcttcaaaaatcaggagtatatctgcactcaggactaccagcagctttatgggactaggtgcgacagctgcagagacttcatcacgggagaagttatctctgcgctgggccgcacctatcaccctaagtgttttgtctgttccctgtgtaggaagccattccccataggggataaggtgacattctccggcaaggagtgtgtctgccagacatgttcgcaatctatggcctcatctaaaccaatcaaaatccggggcccttcccattgcgctggctgtaaagaagaaatcaaacacgggcagtccctgttggccttggacaagcaatggcatgtgagttgttttaagtgtcagacctgctccgttatcctgacaggggaatacatctcaaaagacggtgtcccgtactgtgaaagcgactatcacgcccagtttggaatcaaatgtgagacctgtgatcggtacatttctgggcgcgttttggaggcaggcggtaagcactaccaccccacctgcgcccggtgcgtgcggtgccaccaaatgtttacagagggggaagagatgtatctcactggtagcgaggtctggcaccccatatgcaagcaggcagctcgggccgagaagaagctgaaacatcgccgcacctctgagacctccatctcaccacccggatctagcatcggttctccaaatcgtgtgatatgcgccaaggtggacaatgagatcttgaactataaggatttagcagcacttcctaaggttaagtcaatctacgaagtgcagcgtcccgacctgatttcttacgagcctcactctaggtatatgtctgacgagatgctcgagcggtgcggatatggggaatctctcggcacactcagcccttatagtcaagacatctacgagaacctggaccttcgacagcgccgagcttcatcgccggggtatattgactcccctacatacagtcggcagggcatgagtcccaccttctcccgttctccccatcactattaccgcagtggtccagaatctggcaggtcatctccataccactctcaactggacgtgcgctctagcactcctacctcatatcaggcaccaaagcacttccacatccctgcgggggactcaaacatttatagaaaacctcctatttacaaaaggcacggggacctttccacagccactaaaagtaagacgtcagaagatatttctcagacaagcaagtattctccaatatacagtcccgatccctactacgcgtcagagagtgagtattggacatatcacgggtccccaaaagttccaagagcacgccgtttcagctccggaggcgaagaagatgacttcgatcgttcaatgcataagctgcagagcggaatcgggcggttgatactgaaagaagagatgaaagctcgatcttctagctacgccgacccctggaccccccctcgctcatctacatccagccgcgaggctttacacaccgcgggatacgaaatgagtctcaacggctcacccagatcccactatctggccgacagcgacccgctaatctctaaaagcgctagccttcccgcataccgccgcaacgggctccaccgcacgccttctgcagacctgtttcactatgattctatgaatgcagtaaattggggtatgagagaatataaaatttatccatacgaacttctgctggtaacaacgagggggagaaataggctgcctaaggacgttgaccggaccaggctagagaggcacttgtcacaagaggagttttaccaagtgttcgggatgaccatatccgaattcgataggctggctctttggaaacgtaacgagctgaagaaacaggcgcgcctgttctag

SEQ ID NO: 23370 - DNA, 2541 bp, Artificial Sequence
  Description of Artificial Sequence: Synthetic coding sequence
atgctgttcaccgtgagctgcagcaagatgagcagcatcgtggaccgagacgactcgagcattttcgatggactggtggaggaggatgataaagataaggcgaagcgtgtatctcgcaacaagagcgaaaagaagagacgcgaccagttcaatgtcttgatcaaagagctcgggtcaatgcttccaggaaatgccaggaagatggataaaagcactgtgctgcagaaatctattgattttttgagaaaacacaaggagattaccgctcagagtgacgcctccgaaattcgacaggattggaagccgacgttcctatccaacgaagagtttactcagttgatgctggaggccctggacggcttcttcttagccatcatgacggatgggagcataatctatgtgtccgagagcgtcacatctttactcgagcacctcccctctgacttggtcgaccaaagcatcttcaacttcattccagaaggcgagcactccgaggtgtacaagatccttagtacacacctactggagagtgattcactgacccccgaatacctgaagtccaaaaaccagctggagttctgttgtcacatgctgagagggactatcgaccctaaggagccgagcacgtatgaatatgtaaagttcattgggaattttaagtccctcaattctgttagttccagtgcccacaacgggttcgagggtaccatacagaggacccaccgcccctcctacgaggaccgagtgtgcttcgtggcgaccgttagacttgcaactcctcagttcatcaaggagatgtgtaccgtggaggaaccaaacgaggaatttacttcccggcactcgctggagtggaagttcctgtttctggaccacagggcccccccaataatcggctatttacccttcgaggtgctggggacaagtggatacgattattatcacgtggacgatctggagaatctggccaaatgtcatgaacacctgatgcagtacggtaagggcaaaagctgttactaccggtttctaaccaaaggccagcagtggatctggctacaaactcattactatatcacctaccaccagtggaacagccggccagagtttatcgtctgcactcacaccgtggtgagctacgcggaggtgcgagccgagcggcgccgtgagctgggtatcgaagagtcgctgccggaaaccgcagcggacaaaagccaggattcaggctccgataatcggataaatacagtgagtctgaaggaggctctggagagattcgaccattccccaacaccgtcagcttcttctaggagtagtaggaaaagcagccacactgccgtatcagacccctccagcacaccgaccaagatcccaactgataccagcacccctcctaggcagcatctgcccgcccatgaaaagatggtgcaaagacgcagctccttctcaagccaatcaatcaactctcaatcggtgggaagttccttgacgcagccagtgatgagtcaggccacaaacctgccgatcccgcaaggcatgtctcaatttcaattttcagctcagctaggcgccatgcaacacctgaaggatcagctggagcaaaggacaagaatgatcgaagccaacattcatcgacagcaggaggaattgaggaaaatccaggaacagcttcaaatggtacatggccagggcctccagatgtttctacagcagagcaaccccggcctgaactttggaagtgtccagctgtctagcgggaattccagcaatattcagcaacttgcgcccatcaatatgcagggacaggtggtccctaccaaccagatacagagtggaatgaatacgggccatataggcaccacccagcatatgattcagcagcagacgcttcagtctactagtacacagagccaacaaaatgtgcttagcggacatagccagcagacctctctcccctctcagacacagagtaccctcacagcgcctctatacaatacgatggtgatttcacagccggcggctgggagcatggtgcagattccatccagcatgcctcagaattctacccaatctgctgcggtgactaccttcacccaagatagacagatcaggtttagccaaggccagcaactggttacgaagctcgtgacagcccctgtggcttgtggcgctgtgatggtgccatccacaatgctgatgggacaggttgttacagcctatcccactttcgccacacagcagcagcagagccagacactctccgtcactcagcagcagcagcagcagagcagccaggagcagcagcttactagcgtacaacaacccagtcaggcccagctgacccagcccccacagcaattcttgcagacaagccgcctattgcacggcaaccccagtacgcaactgatcctgtctgccgctttcccattacagcaatctacttttccacagagccatcaccagcaacaccagtcccagcagcaacagcaattgagccgacatcgaacggacagtctacccgacccctcgaaagtccagccacagtag

SEQ ID NO: 23371 - DNA, 1656 bp, Artificial Sequence
  Description of Artificial Sequence: Synthetic coding sequence
atgggccggaaggccatcgtgctggccatcgccaacaccagcctggcattcccgctgtgccaacacctggtcacattctgcctcggcgaagatgatggagtccataccgttgaggatgcttctcgcaagctggcagtcatggacagccaggggcgcgtgtgggcccaggaaatgctcttaagagtttcgcctgatcacgttaccctgctagatccagcgagcaaggaagaactggagtcatacccactgggcgctattgttcgatgcgacgccgtaatgcctcccggtcggagccggtctctgctgctgctggtctgccaggagccggagcgagctcagccggatgtgcatttctttcagggcctccgcctgggcgctgaattgatcagggaggatattcagggggcccttcacaattatagaagcggacgaggcgaaaggcgggctgcagccctgcgcgcaacacaggaggagttgcaaagggataggtcacccgccgctgagacacctccccttcagcgcagaccgagcgtgagggcagtgatatctacagtcgagagaggagctggaaggggtcgacctcaagccaagccaatcccagaggctgaagaggcacagcgccccgagcccgtcggaacaagcagcaatgcagatagcgccagccctgacttgggcccaagaggcccagacctggcggtgctgcaggctgagagagaggtcgacatcctcaatcacgtattcgacgacgtcgaaagctttgtgagccgactccaaaaatctgctgaagcggcacgggtgctggagcacagagaaaggggacgacggtctcgccggagagccgcaggggaaggactccttacactgcgcgccaaacccccatcagaggccgagtacactgacgtcttgcagaagattaagtacgcattttcactgctggcaaggctgagagggaacatcgccgatcccagctcaccagaattactccattttctctttggcccattgcagatgatcgtcaacacgtcaggcggcccggagttcgcctctagcgtaagacgaccacacctgacctcggatgccgtggcccttttgagagacaatgttacccccagagaaaacgaattgtggacctcgcttggtgacagttggacaaggccggggctggagttgagccccgaagaagggccgccctacagacccgaattcttttcaggatgggaaccccccgtcactgacccacagtcccgtgcatgggaagaccccgtggaaaagcaactgcagcatgagcggagaagacgacaggtcacccaagccacccagcaaggccgggggtgggaggttcggggaagggggcggtccgcatggcccaggcttaccagactctcttacttccttcagcagagcgcccctcaggtggccgtgaatggccatagagacctggagcctgagtctgaaccgcagttagagagcgagactgccgggaagtgggttttatgcaactacgacttccaggcgagaaattcctcagaactgagtgtgaaacagagagatgtccttgaagccctccaggacaaggagaaggtgtctgagctcgaggctgttatggaaaaacaaaagaaaaaggtcgagggggaggtcgagatggaggtgatctag

SEQ ID NO: 23372 - DNA, 1689 bp, Artificial Sequence
  Description of Artificial Sequence: Synthetic coding sequence
atggccgccagcgccaagcggaagcaggaggagaagcacctgaagatgcttcgagatatgaccggcttgccccataaccggaagtgcttcgactgcgaccagagaggacccacatatgtgaacatgaccgtgggttcgttcgtctgcacctcttgcagcggttctctcagaggactcaaccccccacaccgggttaaaagcatttcaatgacaacattcacgcaacaggagatcgagttcctccagaagcacgggaatgaagtgtgtaaacaaatttggctcgggctttttgatgataggagctcagccattcccgactttcgcgacccccagaaggtgaaagaatttctgcaggaaaaatacgaaaaaaaaagatggtatgtaccccccgaacaggcaaaggtggtggccagcgtccatgcctccatcagcggttctagcgccagtagcacttcaagtaccccagaagtcaaacccttgaagtctttgttaggggattccgctcccacattgcacctgaacaaaggaacccccagccagtcccccgtagtcggcagatcccaaggtcaacagcaggagaaaaaacagttcgacctgctcagtgatctgggcagcgacatttttgccgcccctgccccgcaatcaactgcgaccgcaaacttcgctaacttcgcgcattttaacagccacgctgcccagaattcagcaaacgcagattttgcaaacttcgacgcttttggccagtcctctgggtccagcaacttcggaggatttcccaccgcaagccactctccgttccagcctcagacaactggcggctctgccgcttctgtcaacgctaatttcgcccattttgacaacttcccaaagtcatcctccgctgacttcggaaccttcaacaccagccagagccaccaaacggcgtccgccgtttctaaggtgtctaccaacaaagccggtctccagacagccgataagtacgctgcattagctaatctcgacaacatcttttctgcaggacagggtggggaccaggggtctggatttggcactacgggtaaggctcctgtgggcagtgtcgtttccgtgccaagccagtcctctgccagtagcgacaagtatgccgccctggccgagttagattctgtgttttcatctgctgccacctcgagcaatgcctatacgagtactagcaacgcctcctctaacgttttcggcacggttcccgtcgtggcaagcgcacagacccagcccgctagcagctcagtccccgcaccgtttggggccacgccctcaaccaatccttttgtagcagcagctgggccttccgttgccagttcaacaaaccccttccagaccaacgcgcgcggggccaccgccgcaacattcggtacggcttccatgagtatgcctaccgggttcggcaccccagccccatattctttgccaacttccttctctggcagtttccagcagcctgcttttcctgcacaggccgccttcccccagcagactgcattttctcagcagcctaatggcgctggatttgctgcatttggccaaaccaagcccgtggtgactccattcgggcaggttgcagcagcaggggtgtcaagcaaccctttcatgactggcgctccaacaggccagttccctacaggttccagttccacgaatccatttttatag

SEQ ID NO: 23373 - DNA, 2052 bp, Artificial Sequence
  Description of Artificial Sequence: Synthetic coding sequence
atggccgccgccgtggccgcccccctggccgccggcggcgaggaggctgccgccactacgagcgtgcctggcagccctgggttacccggcagaagaagcgccgagcgggcactggaggaagccgtggccaccggcactttaaaccttagcaatcgccggctgaaacattttcccaggggcgctgctcgatcctatgatctgtcagatattacgcaagccgacttgtcgcgcaatcggtttcctgaagtgcccgaagctgcatgtcagcttgttagtctcgaagggctctccctgtatcataactgcctcagatgcctcaatccagcactcggcaacctcaccgcgctgacctacttgaatctctctaggaatcagctgtccttgctccctccatacatatgtcagctgcccctgcgggtgctgattgtatctaacaataaactgggggccttgccccctgatataggcaccctcggttcgctccgtcagctcgacgtaagtagcaacgagttgcagagcctgcccagtgagctgtgcggcttaagctctctccgggacctaaatgtgagaaggaatcaactgagtactctaccagaggaactgggagatttgcctctagtgcgcctggactttagctgcaatcgcgtttcccgcataccagtctctttttgtcgccttcgccacctacaagtgatccttctcgattcgaacccactgcagtctcctcccgcacaggtgtgtctaaagggcaagctgcatatcttcaaatatctctctaccgaagctgggcagcgtgggtcagctcttggtgacctggcaccttcccgaccacctagcttcagtccctgtccagctgaggatctttttcctggacatcggtacgatgggggcctggacagcggctttcatagcgttgatagtggttctaaacgctggagcggcaacgaatcgacagacgagttctctgagttgagttttagaataagcgagctggcacgtgagccacgcggccctcgtgaacgcaaggaagacggatctgccgacggcgatcccgtgcaaattgactttatcgatagccacgtacctggcgaggatgaggaacgcggcaccgtcgaagaacagaggcctcccgagttgtcccccggtgccggagaccgagagcgcgccccttcttcaaggcgggaagagccagccggagaggagcgccggaggcctgataccctgcagctatggcaggagagggagagaaggcaacaacaacagagtggagcctggggcgcccctcgaaaggactcactgttgaagcctggactgagagcagttgtggggggtgccgccgccgtcagcacccaggctatgcacaatggctcccctaaatcttccgcatctcaagctggcgcggctgctggccagggggcacccgcgcctgccccagcatcgcaggaaccactgcctattgccggccccgctaccgccccggctccaaggcctttaggaagcatccaacggcccaattctttcctgtttcggtctagttctcagagcgggagcggcccatccagtcccgactctgttcttcgaccccgcagatacccccaggtccctgacgagaaggaccttatgactcagttgcgccaggtgctcgagtcacggctgcagcggccactgcccgaagacctcgcggaggccctcgcatcaggtgtgatcctgtgccagcttgccaaccagttgcgccccagatcagtgcctttcatccatgtaccatctccagctgtgcctaagttgagcgccctcaaggcccgtaaaaacgtcgagtcttttctggaagcctgtaggaagatgggagtacctgaagctgacctgtgctccccttcagatctactccaggggactgcccggggactcaggactgccttggaggctgtaaaacgagtgggcggtaaagcgttgccacctttatggccaccaagcgggttggggggcttcgtcgtgttctatgttgtgcttatgctcctgctgtatgtcacctacactaggttgctgggatcctag

SEQ ID NO: 23374 - DNA, 303 bp, Artificial Sequence
  Description of Artificial Sequence: Synthetic coding sequence
atgagcaccagcaccagctgccccatccccggcggccgggaccagctgccagactgttactccacaacacccgggggcaccctctatgcgaccacaccgggaggcacgcgcatcatttacgaccggaagtttcttctggagtgcaagaatagcccaattgcccggactcctccttgttgcttgccgcagatcccaggagtaaccaccccacctaccgcaccactaagcaagttggaggagcttaaggagcaggagacagaggaggagattcctgacgatgcccaattcgagatggatatctag

SEQ ID NO: 23375 - DNA, 2382 bp, Artificial Sequence
  Description of Artificial Sequence: Synthetic coding sequence
atgcccatggagagcgccagcagcgacaacaagaagcagatccccaatgaggcgagcgccaggtctgaacgggatacctcagacttggaacaaaattggtcgctacaggatcattacaggatgtacagcccaatcatttatcaagcgctgtgcgaacacgtgcaaactcagatgagcctgatgaacgaccttacttctaagaacattcctaacggtatcccagctgttccctgccacgctccatcccactctgagagccaggcaaccccacattctagctatggcttgtgtacaagcacccccgtatggagcttgcaaaggccgccatgtccccctaaggttcactctgaggtgcagacggacggtaattctcagtttgctagtcagggcaagactgtgagcgcgacatgtactgatgttctgagaaacagtttcaatacatctcctggagtgccctgttccctgccgaagacggatatttctgctattccgaccttgcagcagcttggcctggtgaatggcattcttcctcagcagggcattcataaggaaactgatctgctgaaatgcattcaaacctacttgtccctgttcaggagtcacgggaaggagacccatcttgattctcagacccatcgcagccctacacagagtcagccagccttccttgccaccaacgaggaaaaatgtgcccgggaacaaatacgcgaggctacatccgagcggaaggatctgaacatccatgtccgcgatacaaagacagtgaaagacgtgcaaaaggccaagaatgtgaacaagactgccgagaaagtgaggattataaagtatcttctgggcgaattgaaggctcttgtggccgagcaggaagactctgagattcagagactgatcactgagatggaagcctgcatctcagttctccctacagtgtctggcaatacagatatccaggtggagatcgccctggctatgcagcccttgcggagcgagaacgctcagctgaggcgccagctgcggattctgaaccagcaacttcgtgagcagcagaaaacccagaaacccagtggcgccgtcgattgcaacctcgagctgtttagcctgcaaagcctgaacatgagcctccagaatcaactggaagagtcgttgaaaagccaggagttacttcagtccaagaatgaggaacttctgaaggtcatcgagaaccagaaagatgaaaacaagaaattttcctccatctttaaggacaaggaccaaactattctggaaaataagcagcaatatgatattgaaatcacccggattaaaatcgaactcgaagaagctttggtgaatgtgaaaagcagtcaatttaagcttgaaactgctgagaaggagaaccagatcttagggatcactcttcgtcagcgggacgccgaagtaacccgcctccgagagctcacccgcacactgcaaaccagcatggccaagcttctatctgacctgtcggtcgactccgctcgctgtaaacctggtaataatcttacgaagagcctgctcaatattcatgacaagcagctgcaacatgaccctgctccagcccatacgtctatcatgtcttatctgaacaagcttgagactaactacagcttcacccattctgagccactgtctaccattaagaacgaagaaacaatcgagccagacaagacttacgagaacgttctatcatctaggggtccccagaattcaaatactagagggatggaagaagcttccgctcccgggatcatctccgcactgagcaagcaggattccgatgagggtagcgagactatggcactgatcgaggatgagcataatctagataatactatctatatccccttcgcaaggtctacccccgagaaaaagagtccactgagtaagcggctttcccctcagcctcagatccgcgctgccaccactcagctcgtatcaaattctggattggcagtaagcggcaaagaaaacaagctttgcacacccgttatatgcagttcgtccaccaaggaagctgaggacgcccccgagaaactgtcaagagcctctgacatgaaggacacccagttgctcaagaaaatcaaggaggccattggcaaaatacccgccgcaacaaaggaaccagaggaacaaacagcgtgccatggtccaagcggatgcctgagcaatagtttacaggttaagggtaacactgtgtgtgatggcagcgtgttcacctccgacctcatgtccgattggagcatcagctctttctctaccttcacatctagggatgagcaggattttaggaacggattagcagctctggatgctaacattgctcgtctccagaagtccctgcgtacaggactgctggaaaagtag

SEQ ID NO: 23376 - DNA, 1119 bp, Artificial Sequence
  Description of Artificial Sequence: Synthetic coding sequence
atgaccttccagttcaacttcaccatcgaggaccacctggagaacgaactgactcctatacgggatggtgctctgacactagacagttctaaagaattatccgtgagcgagtctcagaagggggaggagcgggaccgcaaatgttcggcagaacaatttgatctgcctcaggatcacctttgggagcacaaatctatggagaacgctgctccctcacaggacactgatagcccactgagcgcagcctcctcatcccgaaacttagagccccacggcaagcagcctagtctgcgggccgctaaggaacatgccatgccaaaagacctgaaaaaaatgctcgagaacaaggtgatcgagacactgccaggattccagcacgtgaagttaagtgtggtgaagacgatcttactgaaggagaatttccccggtgagaatattgtcagtaaaagttttagcagtcatagcgacctgattacaggcgtctatgagggcggcctgaagatctgggagtgtacctttgatcttctggcatacttcactaaggcaaaggtgaagtttgcaggcaaaaaagtgctcgacctgggatgtggatccgggctgctgggcatcacagccttcaagggagggtcaaaagaaatacattttcaggactataactctatggtgatagacgaagtgacgctgcctaatgtggtggccaactcaaccctcgaggatgaggaaaacgacgtgaacgagccggatgtgaaaagatgccgcaaacctaaggtaactcagctttacaaatgcaggttcttcagcggagaatggtcagaattttgcaagctggtactgagctccgaaaagttatttgtgaaatacgatttaattcttacctcagagacaatttacaatccagattattactccaacttacaccagacctttttgcgccttctcagcaaaaatgggcgtgtcctgctggcgtcgaaggcgcactactttggcgtcggggggggagtgcatctgttccagaagttcgttgaggagagggatgtctttaagactcgcatcctgaaaattatagacgaaggactgaagcgatttattattgaaataacctttaagttccccggctag

SEQ ID NO: 23377 - DNA, 336 bp, Artificial Sequence
  Description of Artificial Sequence: Synthetic coding sequence
atgaccaccctgcgggccttcacctgcgacgacctgttccggttcaataacatcaacctggatcctttaaccgagacctacggaatcccgttctatctccagtatctggcacactggccagagtattttatcgtggccgaggctcccggcggagaactcatgggttatattatgggcaaagctgaagggtccgtggcacgggaggagtggcatggtcatgttacagctctctccgtggcacctgaatttagaaggctcggacttgcggcaaagctgatggaactcctggaggagataagcgagcgctatgaagagtctacattccagggatactag

SEQ ID NO: 23378 - DNA, 1449 bp, Artificial Sequence
  Description of Artificial Sequence: Synthetic coding sequence
atgaacggcaccctggaccaccccgaccagcccgacctggacgccatcaagatgttcgtcggccaggtgccgcgcacctggtcagagaaggatttgcgtgagttatttgaacagtacggagcagtctacgagattaacgtactccgtgacaggagtcaaaaccctccccaaagcaagggatgctgcttcgttaccttttacaccaggaaggcagccctggaggctcagaacgcccttcacaacatgaaggtcctccccgggatgcaccaccccatccaaatgaagccggcagattccgaaaagaataatgctgtggaagacagaaagctcttcatcggcatgatatccaagaagtgcactgagaatgacatacgagtaatgttctcctctttcggacagatcgaagagtgtcgcatactaagaggcccggacgggctgtcgcgcggctgcgccttcgtgacttttaccacccgggctatggcacagactgccatcaaagcaatgcaccaagcacaaacaatggaaggttgtagctctccaatggtggtgaagttcgcagatactcagaaagataaggagcaaaagcgaatggcacagcagctacagcagcagatgcaacagatcagtgccgctagcgtgtgggggaacctggcaggcttaaatacactgggtccccaatacctggcgctgttgcagcagaccgcaagctcaggtaatctcaataccctctctagcctacatcctatgggagggttgaacgcgatgcagttgcagaatctggccgctctggctgccgctgcgagcgcagctcagaacaccccatctggcacaaacgcccttacaacatcatctagcccgctgtccgtgttgacatcgtcaggcagctccccaagcagctcctcttctaattcagtgaaccccatcgcatccctgggtgccttacagaccctggccggcgcaactgctggcctgaacgttggctctctcgccgggatggccgctctgaacggcggattgggatcttccggcctctcaaacgggaccggcagtacaatggaagccctgacccaggcatattctgggatccaacagtacgccgccgccgccctgccaaccttgtacaaccagaacctgctgacccagcaatcaattggagccgccgggagccagaaagagggaccagaaggcgccaatctctttatctatcacctgcctcaggaatttggtgaccaggacctgttgcagatgttcatgcccttcggcaacgtggtgtccgcaaaggtatttatagacaaacagaccaatctgtcaaaatgctttgggttcgtgtcatatgacaacccagtgtcagcccaggcagctatccaatccatgaacgggttccaaattggtatgaaaaggcttaaggtgcagctcaagcgatccaaaaatgatagcaagccctactag

SEQ ID NO: 23379 - DNA, 1347 bp, Artificial Sequence
  Description of Artificial Sequence: Synthetic coding sequence
atgagccccctggagtgcagcgagtgcttcggcgaccagctgctgcaccgaacctacacttggcaattgacactgcactcaagacccaactatacgagaaagcgcgacaccagatctgaaagtctggagatacctattagtgtcgtgctcccgcaaagaggtaccgcggagcccttcccccgtctgcataacctgtatagtactccccggtgcgcccagcaggcggcactccctagactgtctaggcgcatggcatctcagcattcctacccccttaaccggtttagctctgtaccgctggatccaatggagaggcccatgtctcaagccgatctcgagttggattataatccaccacgtgtgcagttgagtgatgaaatgtttgtttttcaggatggtaggtgggtgaatgaaaactgcaggcttcaatctccctacttttcgccaagtgcctctttccaccataagcttcatcataaaaggctggcgaaagagtgcatgctgcaggaagaaaacaagtcactaagggaagagaataaagctctgcgagaagaaaaccgcatgctgtcaaaggagaacaagattcttcaagttttttgggaagaacacaaggcatccctgggcagggaggagtcccgagctccatcacccttactgcataaagattcagcctccctggaagttgtaaagaaggatcatgtggctcttcaggtcccccggggtaaggaggactctaccttgcagctgttgcgggaggaaaacagggccctgcagcagcttttggaacagaagcaggcctattgggcacaggccgaagacacagccgctcctgctgaggaatctaagcccgcaccgtcacctcatgaagaaccctgttcccccggtctactgcaggatcagggctctggactatccagccgttttgaggaacccaagggcccacccgcacgccaggaagattccaaggagctgcgggcgctgagaaaaatggtatctaatatgtcaggcccttcaggtgaagaagaggccaaggtggggccaggtctgcctgacggctgccaaccacttcagctgctccgggaaatgagacaggctctgcaggcacttctgaaagagaaccgactgctacaggaggaaaaccgcactctgcaggtgctccgagctgagcaccgtgggttccaagaagaaaacaaagcgttgtgggaaaacaataaacttaaattacagcagaaactcgtgatcgacacggtcaccgaagttacggcccgcatggaaatgctgattgaagaactgtatgctttcatgcccgctcggtcccaggaccccaagaaaccttctagggtttag

SEQ ID NO: 23380 - DNA, 1002 bp, Artificial Sequence
  Description of Artificial Sequence: Synthetic coding sequence
atggccgccgccgccgccggcaccgccaccagccagcggttcttccagagcttcagcgacgcgctcatcgacgaagacccacaggcggccctcgaggagctaaccaaagcgctcgaacaaaagcctgacgacgctcagtactattgccaaagggcatattgtcacattttgctggggaattactgtgtcgcagtggccgacgcgaaaaaaagcctggaactgaatcctaataatagtacagcaatgctgcggaagggaatctgtgaataccatgagaaaaactacgcagccgctctggagacctttaccgaggggcagaaattggacagtgccgatgccaatttctctgtttggatcaagagatgtcaggaagcccagaacggttctgagtctgaggtgtggacccatcagagcaagattaaatacgactggtatcagacagagtcgcaagttgtgattacgcttatgattaagaacgtacagaaaaatgacgttaacgtagaatttagcgagaaggagctcagcgccttggtgaaactgccctcaggtgaagattataatctgaagttggaactcctgcaccccatcataccggaacagtccaccttcaaggtgctgtccaccaagattgagatcaagctgaagaagcccgaggccgtgaggtgggagaaactggagggacaaggcgatgtccctacacctaaacagtttgtggctgacgtgaagaatctgtacccatcttcaagcccatatacccggaactgggataagctggttggcgagataaaagaagaagagaagaacgagaagctcgagggcgatgctgccttgaataggctctttcaacaaatctactctgacggatctgatgaggtgaaaagggctatgaataaatcctttatggagtcaggggggaccgtgctgtccaccaattggtcggacgtcggcaaacgaaaagtggagattaacccaccagatgacatggagtggaagaagtactag

SEQ ID NO: 23381 - DNA, 1029 bp, Artificial Sequence
  Description of Artificial Sequence: Synthetic coding sequence
atgagcctgcacggcaagcggaaggagatctacaagtacgaggccccatggaccgtgtatgccatgaactggtcagtgcgccccgataagagatttcgcttagccctcgggagcttcgtggaagagtataacaataaggtgcaacttgttgggctggacgaggaatccagcgagtttatttgcaggaacacctttgaccatccctatccgactacgaagctgatgtggatcccagatacaaagggagtgtaccctgatttattggccaccagtggggattacctcagagtgtggcgcgtgggcgagacggagacaagacttgaatgcctcttaaataacaataagaatagtgacttctgcgctcccttgacctccttcgattggaacgaggtcgacccttatttgctcggcacctcatcaattgacaccacgtgtaccatctggggactggagaccgggcaggtcctgggccgggtaaatctggtttcaggccacgtgaaaacccaactgatagcccatgataaggaggtctacgatatagcttttagccgggcagggggcggcagggacatgttcgcatccgtcggcgcagatggttctgttcggatgtttgatctccgacatctggagcattcaaccataatttacgaggacccacagcatcacccattactgcggttgtgctggaataagcaggacccaaactaccttgccactatggcaatggacggcatggaggtggtaattctggacgtgcgcgtcccttgtactccagtggccagattaaataaccatcgggcatgtgtcaacggcatcgcatgggcaccccattctagttgtcacatttgtactgcggctgacgatcatcaggcacttatttgggatatccagcagatgccgagggctatcgaggacccaatactggcctatactgccgagggagaaattaacaatgtgcagtgggcatctactcagccagactggatcgcaatctgctataataattgcctggagatcctgcgggtgtag

SEQ ID NO: 23382 - DNA, 507 bp, Artificial Sequence
  Description of Artificial Sequence: Synthetic coding sequence
atggccgagggcagccggatcccccaggcccgggccctgctgcagcagtgcttgcacgctcgcctacagatccggccagccgatggagatgtagcggcccaatgggtggaagtccaacgagggctggttatctacgtctgtttctttaagggcgcagataaagaactgcttccaaagatggttaacaccctgcttaacgtgaagctatccgaaacagaaaatggtaaacacgtatcaatcctggacctcccaggcaacatcctgattatcccacaagcgactctgggtgggcgtctcaaaggccggaacatgcaatatcactccaattccggtaaggaggaaggttttgaattatactcacagttcgtgaccctgtgtgaaaaagaggtagccgcgaatagcaagtgtgccgaggcgcgggtagtagtggagcatggcacatacggtaaccgacaggtactgaagctcgataccaatggaccatttacccaccttattgagttctag

SEQ ID NO: 23383 - DNA, 3069 bp, Artificial Sequence
  Description of Artificial Sequence: Synthetic coding sequence
atggagggcgccctgaccgcccgggacaaggtgggcgtgcaggacttcgtccttctggatgcttacacctctgagtccgcttttgtggataatcttaggaagcgattcagcgagaatctgatctatacatacatcgggactctactggtgagcgtgaacccttatcaggagcttggaatatacacggttagccagatggaactgtaccaaggcgtgaacttctttgaactgccgccgcacgtatacgctatagccgataatgcataccgcatgatgtgcgccgagctcaataatcactttatcctgatctcgggtgaatctggggcagggaagaccgaggctagtaaaaaaattctggaatatttcgccgtcacttgccccatgacacagtcattgcaaatcgcaagagatcgtctgttattctccaaccccgtcctggaggcattcgggaatgctaggacgctgcggaacgataactcttcccgattcggaaagtacatggacatccagtttgacttccagggaatacccgttggagggcatattatctcctacctgatcgaaaagtctcgcgttgtgtatcagaatgagggcgaacgaaactttcacatcttttaccaacttttggctggcggtgaggaggagcggctttcttacttggggctggaacgagatccacagctgtataagtacctgtcgcagggacactgtgcaaaggaaagcagtatctcagacaagaatgattggaaaaccgtttctaacgccttcagcgttatcgactttacagaggccgatctcgaaaacctgtttgggatcatcgcctcagttttacaccttggaaacattggattcgaggaagatgaccaggggtgcgccacaatccctgatactcatgaaatcaaatggatagctaagcttttgggtgtccaccctagcgtgcttttggaagccctgacacaccgaaaaatcgaggcgaaaaccgaggaagtgatttgccctctgactctagagctgtccgtctacgccagggacgcgatggcaaaggccgtttacgggagaacatttacttggcttgtgaacaaaattaacagctccttggtgaataaagactttacccgtaaaacagtgattggccttctagacatctatggcttcgaggttttcgacaaaaacggtttcgagcaattctgcattaactactgtaatgagaagctccagcagctgctgattgaaagaactctaaaagccgagcaggcggagtatgaaatggagggcattgagtgggagccaattaaatactttaataacaaaatcatctgcgacttagtagaggagcggcacaaggggatcatctccatcttagatgaggaatgtattcgacccggtcccgctacggatctgagttttttagagaagctggaggagaaggttgggaagcacgctcattttgagaccagaaagctcgccggccctaagggacgcaagcgaattgggtggatggaattccgactactgcactacgccggtgaggtgacatactgtacgaaaggtttcctggaaaagaataatgatttgctgtatcgacatctgaaggaagtgttgtgcaagagcaaaaatatcatcctgagagagtgttttctactggcagaactcgaaaaccgaaggaggcctcctactgttgggacccagtttaagaacagtctgtcatctctcctggagacactcatctctaaggaacccagttatatccgctgtataaaacccaatgaccgaaaagaaccaagcaaatttgacgactttctgataagacaccaaatcaagtacctcggtttaatggagcatttgagggtaagacgggcagggtttgcatacagacgaaaatacgaacattttctgcagaggtacaagagcctatgccccgacacgtggcctcactggcacgggcccccggcggaaggggtggagcgattgataaagtatatcgggtataaaccggaggagtacaagctaggaaagacaaaaatttttatacggttcccacgcaccctctttgccactgaagatgctttcgaattcagtaagcaccagctcgtcgcgcggatccaagctacttacaagaggtgcctgggcagacgagagtacgtcaagaaacgccaggcagcaatcaagctagaggcccactggcgcggagccctcgcccggaaggcaatccaacggaggaagtgggctgttcggataatccgcaaattcatcaagggattcatcagccgcaacaaacctctctgtcctgataacgaggagttcattgttttcgtgcgcaagaattacattctgaatcttcgttatcacctgcccaaaacagtgcttgacaagtcctggcttaggcctcctggcattctagaaaatgctagtgatttgcttaggaaaatgtgtgtgagaaacttagtccagaagtattgtcgcggtattaccgccgaacggaaggctatgatgcagcagaaggtcgtcacctcagagatttttaggggccgcaaagatgggtacacagagtccttgaaccagccatttgtgaattctaggattgatgaaggcgatatcaacccgaaggtgcttcaactgatttctcatgaaaagatccagtatggcgttccggttatcaaatacgaccggaaagggttcaaagcgagacagcgccagctaattttaactcagaaggccgcctatgtagttgaactggccaaaatcaaacaaaagattgagtattctgccctgaagggagtgagcactagcaacctgtccgacggaattctggtcattcatgtatcccctgaggactccaaacaaaagggagatgcagtcctgcaatgcggccacgtctttgaagcagttaccaagttggtgatgctggtgaaaaaagagaatattgttaacgtggttcaggggagcttgcagttcttcattagtcctggaaaggagggaactattgtatttgacacagggttggaggagcaggtgtacaagaataaaaatggccagctcacagtcgtgtccgtgcggaggaaatcatag

SEQ ID NO: 23384 - DNA, 1044 bp, Artificial Sequence
  Description of Artificial Sequence: Synthetic coding sequence
atgaacaccctgatggacgtgctgcggcaccggcccggctgggtggaagtcaaagacgaaggcgagtgggatttttactggtgcgacgtcagttggctccgggagaacttcgaccacacatacatggacgaacacgttcgcatcagccacttcagaaaccactatgagctgactcggaaaaattacatggttaagaacctgaaacgcttccggaaacagttggaaagagaggccggtaaactcgaagccgctaaatgcgacttctttccaaaaacctttgaaatgccctgtgaataccatctattcgttgaggaattcaggaagaaccccggcattacttggataatgaagcccgtagctaggtctcagggaaagggaatcttcttgtttcgccgactcaaggatatcgtggactggcgtaaagacacgcggagttcagacgatcaaaaggacgacatccccgtagagaattacgtcgcccaacgatacattgaaaacccatacttgatcggcggccgcaaatttgatttaagggtctacgtacttgtgatgtcatacatccctcttcgcgcatggctgtaccgcgacggctttgcgcgattcagtaatacccggttcacactgaatagtattgatgaccaatatgtccacctgacaaacgttgctgtgcagaaaacctcccccgattaccaccccaaaaagggctgtaaatggacccttcagcgctttaggcagtacttagctagcaagcacggaccagaagcagtagagacactctttcgcgacatagataacatttttgtgaagagtttacagtccgtccagaaagtcattatttccgacaaacattgttttgagctgtatggttacgacatactgatcgaccaggaccttaagccttggttacttgaagtaaatgcctcacctagcttaaccgcttccagccaagaagactatgagctgaagacttgtctgttggaagacaccctgcacgtcgtagatatggaggctaggtctttgcgagcggattcaccatgctggtag

SEQ ID NO: 23385 - DNA, 444 bp, Artificial Sequence
  Description of Artificial Sequence: Synthetic coding sequence
atgagcagcgagccccccccccccccccagccccccacccaccaggccagcgtcggcctcctggatacccctcggagccgtgagcggagtcctagcccccttcgagggaatgtggtccccagccctcttccaacccgccggactaggaccttcagcgcaacagtgagggcctcccaggggcccgtgtacaagggggtgtgcaaatgcttctgccgatctaagggtcacggattcattacacctgccgacggggggccggatatttttcttcacatcagcgatgttgagggagaatatgtgcccgtcgagggcgacgaagttacttacaagatgtgctcaatcccgcctaagaatgagaaactccaggccgtggaggtggtcataacgcaccttgctcccggaacaaagcatgaaacctggagcgggcacgtaatttcaagctag

SEQ ID NO: 23386 - DNA, 558 bp, Artificial Sequence
  Description of Artificial Sequence: Synthetic coding sequence
atggccgacggcggcggcggcggcggcaccggcgccgtgggcggcggcggtacgtcacaggcatcagctggcgccgcaaccggggctacaggggcgtctggcggcggggggccaatcaatcccgcctcactgccccccggcgacccacagttgatcgcactcattgtggagcagctgaaaagcaggggtctgttcgatagttttcggagagactgccttgctgatgtagacaccaagccagcttaccagaatctgcggcaaaaggtagataatttcgtgagtacccaccttgacaagcaagagtggaacccgaccatgaataaaaatcaactgaggaatggcttacgccaaagcgtagtccagagcggcatgctggaagctggtgtggatcggatcataagccaggtggtggatcctaaactgaaccacatatttcgaccacagattgagcgagctatccacgagtttttggcagctcaaaaaaaagccgcagtgcctgcaccacctcccgagcccgagggtcaggatcctcctgcaccctcccaagatacctcttag

SEQ ID NO: 23387 - DNA, 6351 bp, Artificial Sequence
  Description of Artificial Sequence: Synthetic coding sequence
atggacgaggtggagcaggaccagcacgaggcccggctgaaggagctgtttgacagctttgacaccaccggcacaggaagcctgggacaagaagagctgacagacctctgccatatgcttagtctggaagaagttgcacccgtcttgcagcaaactttattgcaggacaacctgctcggacgggtccactttgaccaatttaaggaggcgttaattctgatcctatctcgaacgctcagcaatgaggagcacttccaggagcccgactgttctcttgaagcacagcctaagtacgtgcgcggtggaaagcggtatggtcggcggtctctaccggagttccaggagtctgtagaagaatttccagaagtgacggtgatcgagcctctagatgaagaggcccggccgtcccacattcccgcgggcgactgctccgagcactggaagactcagaggtctgaagaatacgaggccgaggggcagcttcggttctggaatccggatgatctgaacgcatcccagagcgggagcagcccaccccaggattggatagaggagaagctacaagaggtttgtgaggacctgggcattacacgcgacgggcatctgaatcggaaaaagttagtcagcatctgcgaacagtatgggctgcagaatgttgacggtgagatgctggaagaggtttttcataaccttgatcctgatggaacaatgtcagttgaagacttcttctatggtcttttcaagaacggtaaaagtttgacaccttccgctagcaccccatatcgccaactgaaacggcacctttctatgcagtcgtttgacgagtccggccgccgaacaacgactagttctgcgatgaccagtaccatcgggtttagggtgttttcctgtctggatgatggcatgggtcatgcttcggttgagaggattctggatacatggcaggaggaaggtattgagaactcgcaggagattcttaaagcactggatttctccttggacggcaacattaacttgactgaactgaccttggccttggagaatgagttattggtgaccaaaaattccatccatcaggccgccctggctagttttaaagctgagatccgccatctgctggagcgtgttgatcaggttgtccgggagaaagagaagctcagatctgaccttgacaaggcagagaagcttaaaagccttatggcttccgaggtggacgatcaccacgccgctatcgaaaggcggaacgagtataaccttcggaaactcgatgaggaatacaaggagcggatcgcagctctcaagaacgaactgcggaaagaaagggaacagattttgcagcaggcaggcaagcaaagactggaactggagcaggaaatcgaaaaggcgaagactgaggaaaactacatccgtgatagactcgccctctccctgaaagagaattcgcggctggaaaatgaacttcttgagaatgctgagaatgtgctcgcggagaaattcggagacctggacccttcctcagccgaattcttcctacaggaggagaggctgacacagatgcgtaatgagtatgagcgccagtgcagagtgttgcaggatcaggtggatgagttgcagtcagaactggaagagtatagagcacagggtcgcgtcctgagattgcccctaaagaattccccctccgaagaagtggaagcgaactcaggggggatcgaacccgagcacgggctgggaagcgaagagtgcaatccactgaacatgtcgattgaagccgaactggtaatcgagcagatgaaagagcagcaccacagagatatctgctgccttcggctggaactagaggacaaggtgcgccactatgagaagcagttggatgagacagttgtgtcctgtaagaaagctcaagagaatatgaaacagcggcatgaaaatgagacacatacgcttgagaaacagatatctgaccttaaaaatgagatcgcggaactacagggacaagcggccgttctcaaggaagcacaccacgaagcaacgtgcagacatgaagaagaaaagaaacagcttcaggtgaaactggaggaagaaaagacacacctgcaggagaagctgagactgcaacacgagatggaactcaaggccagacttacccaggcccaggcctcatttgagcgggaacgggaaggcctacagtctagcgcatggaccgaggagaaagtgagaggtcttactcaggaacttgaacagttccatcaggaacagcttacatcattggttgaaaagcatactttggagaaagaagaactcagaaaagaactactggaaaagcatcaaagggagttgcaggagggcagagagaagatggagacagagtgcaaccggcgtaccagtcaaatcgaggcccagtttcagagcgattgccaaaaggtgacagaaaggtgcgagtcagctctgcagagcttggaagggagataccggcaagaactgaaagatctccaagaacagcagcgcgaagaaaaaagtcagtgggagtttgagaaagacgaactgactcaggagtgtgcggaagctcaggagctccttaaggagaccctcaaacgcgagaaaaccacatcactagttttgacacaggagagggaaatgctcgaaaaaacttacaaagagcatctgaattccatggtggtcgagcgacagcagctgctccaagatctggaggatctacgaaatgtctccgagactcaacagagtcttctctctgatcagattctggagttaaaaagcagccataagagggagctgagagaaagggaggaggtgctgtgtcaggcaggcgcttctgagcagctggcttctcagagactcgaacggttggagatggaacacgaccaagagaggcaggaaatgatgtccaagttgttggccatggaaaacattcataaagctacttgcgagactgctgacagagaacgagcagaaatgtctaccgaaatctcccgattgcagtccaaaataaaggagatgcagcaggccacttctccgctgagtatgctgcagtcagggtgccaggttattggtgaggaagaggttgagggtgatggtgccttatcactcctgcagcagggcgagcagctactcgaagaaaatggagatgtgttgctctctcttcagagagctcatgaacaggccgttaaagagaatgtgaaaatggccactgagatttccaggctccagcagcgtctgcaaaagcttgagcccggcttagtgatgtcctcctgtttagacgagcctgccactgagtttttcggcaataccgccgagcagactgagcagttcctacagcaaaatcgcacaaagcaagtcgaaggtgtcacccgacggcatgtcctgagcgacttggaggacgatgaggtgcgtgacctggggagcacaggcacctcttctgtccagaggcaggaagttaaaatagaggagtccgaggcaagcgtagaaggctttagtgagctcgaaaattcagaggagacaagaaccgaaagctgggagctcaagaaccagatcagccagctgcaagaacagttgatgatgctgtgcgcagactgcgacagagcttccgaaaagaaacaagatctcctgttcgacgttagcgtgctgaaaaagaagctgaagatgctggaaagaatccccgaagccagtcccaaatataagctgctgtacgaggacgtgtcccgcgagaatgattgcctgcaggaggagctccggatgatggagacaagatacgacgaagctctagaaaataataaagaactaaccgcagaggtgtttcgccttcaggacgaactgaagaagatggaggaggtaaccgagacgtttctgtccctagaaaagtcatatgacgaggtcaaaatagaaaacgaaggcctgaacgtcctggtactccgattacaaggcaagatagagaagcttcaggaatctgttgtacaaagatgtgattgctgtttgtgggaagccagtctggaaaatctggaaatcgaaccagacggcaatatcttacaattgaaccagacgctggaagaatgcgtccctcgggtgagaagcgtgcaccacgtaattgaggaatgcaagcaggagaatcaatacctggagggcaacactcagctgctggagaaggtgaaggcacacgaaattgcatggctgcacggaactatacagactcatcaggagaggcctcgggtacagaatcaggttattctcgaggagaacacgacattgctgggctttcaggacaaacacttccagcaccaggccacaattgcggaactggaactggagaaaaccaaactccaagagctcacaaggaagctgaaagaacgagtcactattctcgtgaaacagaaggacgtcttgtcacacggggagaaggaggaggaactgaaggccatgatgcatgatctgcaaatcacgtgttcggagatgcagcaaaaagttgaactgctgcgatacgaatcagagaagctccagcaggagaatagcattctccgcaacgagatcacaaccttgaatgaggaagactcaatttccaatctgaagctggggacactcaacggatcacaggaagaaatgtggcaaaagacggagacagtgaaacaggaaaatgccgccgtacagaaaatggtggaaaacctgaaaaagcagatctctgaactgaagatcaagaaccagcagctcgatcttgaaaacaccgagctgagccagaaaaactctcagaaccaggaaaaactgcaagaactaaatcaacgcttaacggaaatgttgtgtcagaaggagaaggaaccagggaatagtgctctggaagagagggagcaagaaaaattcaacttaaaggaggagctggaaaggtgtaaggttcagtctagcactctggtctctagtcttgaggctgagctcagcgaagtaaaaattcagacacatatagtccaacaggagaatcacctgctgaaggatgagctagagaagatgaagcagctgcatagatgtccagatctgtctgactttcaacagaaaatcagttccgtgctgagttataacgagaaactgctaaaagagaaggaggcactctcagaggaactgaacagttgtgttgacaagcttgcaaagtcatccctgcttgaacaccggatagctacaatgaagcaggaacagaagagttgggagcaccaatcagccagtctcaagagtcaactggttgcttctcaggaaaaagtgcaaaatctcgaggacacggtgcaaaacgtaaatctgcagatgtctaggatgaagtcggacctgcgcgtcacacaacaagaaaaagaggctctgaaacaggaagtaatgtccttacataagcagctgcagaatgccgggggcaagagttgggcaccagagatcgcaactcatccatctggcctccataatcagcagaagcggcttagctgggataagctagatcaccttatgaacgaggaacagcaattgttgtggcaggagaatgaacgtttgcaaactatggttcaaaacacgaaagccgaattgacgcacagtcgcgagaaggtgagacagctcgagagtaacctgctgcctaagcatcagaaacacctcaatccttcgggaaccatgaatcccactgaacaggagaagctgtccctgaaaagagagtgtgatcagtttcagaaagaacagagccccgcaaaccgcaaagtgagtcagatgaattccctggaacaggagctcgagactattcacctcgaaaacgagggcctaaaaaagaagcaagtgaagttagacgagcagttgatggaaatgcagcatctacggtctacggccaccccttctcccagcccgcacgcctgggacctacagctacttcagcagcaggcttgccctatggtcccaagggaacagttcctccagctgcagcgccagcttctgcaagccgaaaggatcaatcagcacttgcaagaggagctggagaataggacttctgagacaaatacccctcagggaaatcaagagcaactagtgaccgtcatggaggagagaatgatcgaggtggagcagaaactgaagctggtaaaacggctcctccaagagaaagtgaaccagttgaaggagcaactctgcaaaaatactaaagcagatgctatggtgaaggacctgtacgtcgagaacgctcaactgctgaaggctctggaagtcacagaacaaaggcagaaaaccgcagagaaaaagaattatttgctggaagaaaaaatagcgagcctgtctaatatcgtgcggaacttgactcctgctccactgacgtctacacctcctctgaggagttag

SEQ ID NO: 23388 - DNA, 2664 bp, Artificial Sequence
  Description of Artificial Sequence: Synthetic coding sequence
atgcccatcctgctgttcctgatcgacaccagcgccagcatgaaccaacggtcacacctggggacaacttacttggatacagccaagggagcggttgagacattcatgaaacttagggcgagagatcctgcgtctagaggggatagatatatgcttgttaccttcgaagaaccaccatatgccattaaggctggctggaaggaaaaccacgccacgtttatgaacgaattgaaaaatctgcaggctgaaggactaactactctcggacagagcctgcgtactgcttttgatctactcaacttaaacaggctggtgacaggtattgataattatggccagggtaggaatccattcttcctcgagcctgccatcattattactattaccgacgggagcaagctcactacgacttcaggggttcaggacgaactccatctgcccctaaacagtccgctgcccggcagtgagctgactaaggagcctttccgctgggaccaacgcctcttcgctttggtcctccggctgccagggacaatgtcagttgaatccgaacaattgaccggtgtccctttggatgactccgccatcacacctatgtgtgaggtgaccggcgggagatcctactccgtttgctcacccagaatgttaaaccaatgtctcgaatccctggttcagaaagtgcagtctggtgtagtcatcaactttgaaaaggccgggccagaccctagccccgtggaagacggccagccagacatctcacgaccatttggaagtcagccttggcattcttgccacaaactgatctatgttaggcctaaccctaagaccggagttcccatcggccactggcccgtgccagagagcttctggccggaccagaatagtcccacactacctcctcgaacaagccatcccgtggtgaagttttcctgtacagattgcgagccaatggtgatagacaaactgccttttgacaagtatgagttggaacctagccctctgacccaattcattctggagagaaaatcaccccaaacatgttggcaggtctacgtgtcaaattccgccaagtattctgagctgggccatccctttgggtaccttaaggcatccaccgccctcaactgcgtgaacctgtttgtgatgccctacaactatccagtgctgctgcctcttctggacgacttatttaaagtgcataaggccaagccgactctgaaatggcgacaatcattcgagagctatctgaagacaatgcccccatactacctaggacctctgaagaaagccgtccgaatgatgggagcccccaatttgatagcagacagtatggagtacgggctcagctatagcgtgatctcataccttaagaagctgtctcagcaagccaagatcgaaagtgatagagtgatcgggagcgtcgggaaaaaagttgtgcaggagacaggtatcaaggttagatccaggtctcacggtctgtccatggcgtaccgtaaggactttcaacagctactacaagggattagcgaggacgtgcctcacaggctgcttgaccttaacatgaaggaatatactggtttccaggtggccctcctcaacaaagatcttaaaccccagacctttagaaacgcttatgacatcccccggcggaatttactagatcatctgaccagaatgaggtctaatttacttaaaagcacaagacggtttttaaaaggacaggacgaagaccaggtgcactctgtccccatcgctcagatggggaactatcaagaatacctaaagcaggtaccttctcctcttcgtgagctagatcctgaccagcctagacgtctgcacacctttgggaacccattcaaactggataaaaaaggtatgatgatcgacgaagcggatgaattcgtcgcgggaccccagaacaagcacaaaaggcctggcgagcctaatatgcaaggtatcccgaagaggcggaggtgcatgagccccctgctgcggggtcggcagcagaatccagtcgttaacaatcatatcgggggcaaaggcccgccagcacccacaactcaggctcagcctgacctgattaagccgctcccactgcacaagatatccgaaacaaccaacgacagtatcatccacgatgtggtagaaaaccacgtagctgaccagttgagcagcgatattactccaaacgccatggatacggaattcagtgctagtagccccgcatcgctgctggagcggccaaccaaccacatggaagctctcggacatgatcatctgggcacaaatgacctgacagtcggtgggtttttggagaatcatgaagaacccagagataaggagcaatgcgcggaggaaaatataccagcctcttccttaaacaagggcaagaaattgatgcactgccgttcccacgaagaagtcaacacagagctcaaagcgcagatcatgaaagaaatcagaaaaccgggtagaaaatatgagagaatcttcacactgttgaagcacgtgcaaggaagcctgcagacccgactgatatttctgcagaatgtgatcaaagaagcctcccggtttaagaagcgtatgctgatcgagcagctggagaacttcctggatgaaatacataggagggcaaaccaaatcaaccacattaactcaaactag

SEQ ID NO: 23389 - DNA, 1944 bp, Artificial Sequence
  Description of Artificial Sequence: Synthetic coding sequence
atgagcgacgaggtgttcagcaccaccctggcctacaccaagagccctaaagtaacgaagcgcacaaccttccaggacgagttaatccgggctattacagccagaagcgctcggcaacgctctagcgaatactcagatgactttgattccgacgagatagtttccctgggcgatttcagtgacacctctgccgatgaaaactctgtgaataaaaaaatgaacgacttccacatctcagacgacgaggagaagaacccaagtaagctactgttcctgaagacgaacaagagcaacggcaacataacgaaggatgagcctgtatgcgctatcaagaacgaagaagagatggcccccgatggatgcgaagatatcgtggtgaagtccttttccgaatctcagaacaaggacgaagaatttgaaaaggataagatcaagatgaaaccaaagcccaggatcctgtctattaagtccacctcatcagcggaaaataattcattggacactgacgaccacttcaaaccttccccaaggccgagaagtatgctgaaaaagaaaagccacatggaggagaaggacggtttagaagacaaggagaccgccttatcagaagagctcgagctgcactctgcgccttccagccttcctacccctaacggaatccaattggaggctgagaagaaagcattctcagaaaacctagatcccgaagatagttgcttgacatcactggcttcttcctccttgaaacaaattcttggcgattcgttctcgcctgggtccgaaggcaatgcgtctggcaaagaccctaatgaggagataaccgagaaccacaatagcctcaagtcagacgagaacaaagaaaactctttctcagctgatcacgtaacaaccgccgtggaaaaatctaaagaaagtcaggtaacggccgacgatttagaagaggagaaggccaaggctgaacttataatggacgacgacaggacagtagaccccctcttaagtaagtcgcagagcatcttgatctctacgagcgccacagcgagctccaaaaaaacgatagaagatcgtaatatcaagaacaagaaatccacaaacaaccgagcaagtagcgcaagcgcaaggctcatgacttctgaatttctcaagaaatcgagcagtaaacggaggacacctagcactaccaccagtagccattatcttgggaccctgaaagtgctggaccagaaaccctctcagaagcagtccattgagcctgatagagccgacaacatcagggccgcagtgtaccaggagtggctagagaaaaagaatgtttatctccatgagatgcaccgcataaaaaggatagaaagcgagaacttgcgcattcagaatgagcagaagaaggcagccaaacgggaggaagcactggcatcctttgaggcatggaaagctatgaaggagaaagaggccaagaaaattgctgcaaaaaaaaggctggaggagaaaaataaaaagaaaactgaagaggagaacgccgctaggaaaggagaagccttgcaggcttttgagaaatggaaggagaaaaagatggaatatttgaaagaaaagaaccgaaaggagagggagtacgaacgtgccaagaagcagaaagaagaggaaacagtcgcagagaaaaaaaaagataaccttaccgctgtggaaaagtggaatgagaaaaaggaagcatttttcaagcagaaggagaaagagaagattaatgagaaacggaaggaagagttgaagcgggcagagaaaaaggacaaggataagcaggccattaacgaatacgagaagtggctggagaataaggaaaagcaagagcggattgagcgcaagcagaagaagcggcacagctttttagaatctgaagctctcccgccttggtctccaccttccagaactgtgtttgccaaagtgttttag

SEQ ID NO: 23390 - DNA, 1074 bp, Artificial Sequence
  Description of Artificial Sequence: Synthetic coding sequence
atgcagaccttcctgaagggcaagcgggtgggctactggctgagcgagaaaaaaataaagaaactcaacttccaggctttcgctgaactgtgtaggaagaggggcatggaagtggttcaactcaatctgtcccgccctatcgaggagcagggccccttagatgtgatcatacataagctcacagacgtgatcttggaagccgatcagaacgactcccagtctctggaactggtccataggttccaggaatacattgacgctcaccccgaaacaatagtgctcgaccctctgcctgccattcgaactctattggatagaagtaagagctacgaactgatccggaaaattgaagcatatatggaggatgaccgtatttgcagccccccttttatggaactgacctccctgtgcggggacgacacaatgcgattgttggaaaagaacggccttacgttcccttttatctgcaaaacacgtgtggcccatggcacaaacagccatgaaatggccatcgtgtttaatcaggaaggcttgaatgctatccaaccgccttgcgtcgtccagaattttatcaaccacaacgcggtcttgtacaaggtcttcgtggtcggagaaagctatacagtggtccagcgtccaagtctgaagaatttcagcgcaggcacgtccgatagggaatcgatctttttcaattcacataacgtttctaaaccagagagctccagtgtgctgactgaacttgacaagattgaaggggtgtttgagagaccttctgacgaggtgattagagagttatctcgggccctaagacaggccctcggggtgagcctgtttgggatagatatcattatcaataaccagactgggcagcacgccgtaatagacattaatgccttccctgggtacgagggagtaagtgaattcttcaccgatcttttgaatcacattgccaccgtcctgcaggggcagagtacggccatggccgcaccctcgggagagttccgggccggcgacctatgttgcgatctcggtaaaagctttcaagtgtttgggcccccacccccctgcctgtag

SEQ ID NO: 23391 - DNA, 852 bp, Artificial Sequence
  Description of Artificial Sequence: Synthetic coding sequence
atgctgcggtgcggccagatgatcttcgcccaggccctggtgtgccggcacctaggcagggactggcgatggacccagagaaagagacagccagattcctactttagtgtgctgaacgcattcatagaccgcaaagattcctattacagtattcatcagatcgctcagatgggcgtcggagagggaaaatccattggacagtggtacggaccaaatactgtggcccaagtgctgaaaaaactagctgtgtttgatacctggagcagcctcgctgtgcatattgccatggacaatacagtggtaatggaggagatcagaaggttgtgtcgaacctcagttccgtgcgctggggccaccgcatttcccgcagactcagacagacattgtaatggctttcccgccggagctgaggtgaccaatcgtccttctccatggcgccctcttgttttactgatccctctccgccttgggctgaccgacataaacgaagcttacgtcgaaaccctgaaacactgcttcatgatgcctcagagtttgggagttattggaggaaagcccaattccgctcactatttcattggatacgtgggtgaagagttgatctaccttgacccccataccacacagcccgcggtggagcctaccgacgggtgtttcatccccgatgagagcttccattgtcagcacccgccatgtagaatgtctattgctgaactggacccttcgatagccgttgtgctgggcgtcggaaagcagggtaggctcgtgcgttcaattccttgggcaccccggcctagttcttggtgtgctgcggtcttgggtgcggccgtggtgatgtgtggcacaccttag

SEQ ID NO: 23392 - DNA, 2160 bp, Artificial Sequence
  Description of Artificial Sequence: Synthetic coding sequence
atgggcttcagcaacatggaggacgacggccccgaggaggaggagcgtgttgctgagccccaggcaaacttcaacaccccacaagccctcaggtttgaagagctgctggcgaatctgctgaacgagcagcaccaaattgctaaggaactgttcgaacagttaaagatgaaaaaaccaagcgccaagcagcagaaggaagtggagaaggttaagccccagtgcaaagaggtgcaccagaccctcatcttagaccccgcccagcggaaacgccttcaacagcaaatgcagcagcatgtgcagttgctcactcaaatccacttgcttgccacctgtaaccccaacctaaaccccgaagcaagcagcacccgcatatgcctgaaagagctgggaacattcgcccaatcttcaatagctctgcaccaccagtacaatcctaaattccagacactctttcagccctgcaatcttatgggggccatgcagcttatagaagacttctccacccacgtgtccatagactgcagtcctcataagaccgtaaaaaagacagccaatgagttcccatgtctgccaaaacaagtcgcatggatcctggcaaccagcaaagtgttcatgtatccagaactgttacccgtatgctcgcttaaggctaaaaacccccaggataagatcctctttactaaggccgaagataataaatacctgttgacatgtaagactgcacggcaactgactgtacggattaaaaacctcaacatgaatagagctccagacaatattataaagttctataagaaaacaaagcagctgcctgtactgggaaagtgctgcgaggagatccaaccacaccaatggaaaccaccgattgaacgggaagagcaccgcctccccttctggttgaaagcgagtctgccatctatacaggaggagctccgacatatggcggatggagccagagaggtggggaacatgaccggtacaacagaaatcaatagtgatcaggggctcgagaaggataactctgagcttggaagcgaaacaagataccccctgctgctccctaagggggtggtgctaaagttaaaacccgtcgccgatcggttccctaagaaagcttggaggcagaaaagaagcagtgtactgaagcctctcctgattcagccgagtccctccctgcagcctagcttcaaccccggcaagacgcctgcccagagtacacacagcgaagcccctcccagcaagatggtcctgcggattccgcatcccatacagccggccacagtgctccagacggtgcccggtgtccccccgctgggtgtgagcggcggagaaagcttcgagtctcccgccgcattgccagccatgcctcccgaagctcgcacgtcattcccactcagtgaatctcaaactctgctgtcatccgctccagtccccaaggtgatgatgccctcgccagcctcttctatgttccggaagccctacgtacggagacgcccttcaaagcgcagaggtgctcgcgccttcaggtgtataaagcctgcccctgtgatccatccggcttctgtcatttttacagtgcccgccactaccgtaaaaattgtcagcctgggcggtggatgcaacatgatacaacccgtcaatgccgcagtggcccagtctcctcagactattccaattgcaactctgctcgtaaatcccacctcgtttccttgccctctgaatcagcccctcgtggcgtcctctgtgagcccactaatcgtctccggaaatagtgtaaatcttcctataccgagtacaccggaggataaggcgcacatgaatgttgacatcgcttgcgctgtcgctgacggagagaacgcttttcagggactcgagcccaaattagagccccaggagttgtcgcccctctctgccaccgttttccccaaggttgagcactcaccagggcccccccccgtggacaaacagtgtcaagaggggctctccgaaaattcggcttaccggtggaccgtagtcaaaactgaagaaggacgacaagctcttgaacctctcccccagggtatacaggagtctctgaataacagcagtcccggagacctggaggaagtcgtaaaaatggagcccgaagatgctaccgaagaaatctccgggtttttgtag

SEQ ID NO: 23393 - DNA, 1134 bp, Artificial Sequence
  Description of Artificial Sequence: Synthetic coding sequence
atggaggccgccgccgtgaccgtgacccggagcgccacccggcggcggagacgtcagctccagggactcgccgctccggaagctggaacccaggaagaacaagaagatcaggaaccacgccctagacgtaggcgccctggccggtccattaaggatgaagaagaggagactgtgttccgagaggtcgtgtccttctctcctgatccactgccagtccgatattacgataaagacacgacaaagcctatatccttttacctttcgtcccttgaggagcttctggcctggaagccgcgcctggaggatggttttaatgtggctctggaaccgttagcctgccggcaacctccactcagcagccagaggcctcgcactctactgtgtcacgatatgatgggcgggtacctcgacgaccgctttatccagggatcagtggtacagacaccatacgctttttaccattggcaatgcatagacgtgtttgtgtacttcagtcatcacacagtcaccattcctcccgtgggttggaccaacaccgcccatcgacacggggtgtgcgtgcttgggacttttatcaccgaatggaacgagggcggaaggttgtgcgaagcctttctagccggcgacgaacggagttaccaagctgttgcagatcggctggtacagattactcagttctttaggttcgacggatggttaatcaacatcgagaattcactttcactggcagcagtgggaaatatgcccccttttctccgctacctgaccacccagcttcatagacaggtgcccgggggattagtgctctggtacgatagcgtggttcagtctggacagctgaaatggcaggacgagctgaaccaacacaatcgcgtatttttcgacagctgcgatgggtttttcaccaactataattggcgggaagaacacctcgagaggatgctgggtcaagcaggtgagagacgtgccgatgtatatgtcggtgtcgatgtctttgctagaggaaacgtcgtagggggaagattcgacacggacaaatctctggagctgattaggaaacatggcttttccgtcgctctgtttgctccaggttgctctgtcttccctggcgttggcaacctgctgtgttgctag

SEQ ID NO: 23394 - DNA, 927 bp, Artificial Sequence
  Description of Artificial Sequence: Synthetic coding sequence
atgcggggcaagcggcggccccagacccgggccgcccggcggctggcagctcaagagagcagcgaggcagaggatatgtcagtgcctagaggccccatagcacaatgggcagatggggccatctcccctaatggtcaccgacctcaacttagagcggccagtggtgaagactctacagaggaggcccttgctgctgctgcggccccctgggagggcggcccggttccgggcgtcgacaccagtccattcgcaaaatctctcggccactcgaggggcgaggccgatctgttcgacagtggcgatattttcagcacagggactgggtcgcaatctgtcgagcgaaccaaaccaaaggccaaaatcgccgaaaatcctgccaatccccctgtggggggcaaagctaagagtccaatgtttcccgcactgggagaagcctcgtcagacgacgacctctttcagtctgccaaaccaaagcccgccaaaaagacaaaccccttcccattgctcgaagatgaggacgatttgttcaccgatcagaaagtgaaaaaaaacgaaaccaaaagtagtagtcagcaggacgtgatcctgactacacaggatatcttcgaagatgacatcttcgcgacagaagccatcaagccatcccagaagactagagaaaaggagaagactctggaaagcaatttgttcgacgacaatattgacatcttcgccgatctgaccgtgaaacccaaggaaaaatcaaagaaaaaagtggaagctaagtccatcttcgatgatgacatggacgacatattttccaccggcattcaagctaagaccaccaagcccaaatcccggagcgcacaggccgcgccggaaccccgatttgaacataaggtttctaacatctttgacgaccctttgaatgcttttggcgggcagtag

SEQ ID NO: 23395 - DNA, 933 bp, Artificial Sequence
  Description of Artificial Sequence: Synthetic coding sequence
atgctgaagaacaagggccacagcagcaagaaggacaacctggccgtgaatgctgtggcccttcaagatcatatcttgcatgatctccagcttagaaatttatctgtggcggatcactccaaaactcaggtgcaaaagaaagaaaataagtctctgaagagagatacaaaggccatcatcgacaccggcctgaaaaaaaccacacagtgtcccaagcttgaagatagcgagaaagaatacgttttggaccccaaacccccccccctcacacttgctcagaagctggggctgattggtcccccccctcctcccctatcatcagatgagtgggagaaggtcaagcaaagaagtctgctgcagggtgactccgtccagccatgtcccatttgcaaggaagagttcgagctccgcccacaggttttactcagctgtagccacgtctttcataaagcctgtttgcaggcattcgaaaagttcaccaataagaagacctgtcctctttgcagaaaaaatcaatatcagaccagagtgattcatgacggcgcccgcctctttcgaatcaagtgcgtgacaaggatccaggcctactggcggggttgtgtcgttcgtaagtggtaccgcaacctgaggaaaactgtccctcccaccgatgccaaactgaggaaaaagttttttgagaaaaagtttacggagattagtcacagaatcttatgctcttacaacacaaacattgaagaattgtttgccgagattgaccagtgtttggcaatcaacaggagcgtgctccaacagctggaggagaagtgtggacacgagatcacagaggaggagtgggagaagatacaggtgcagaatgaaacgagcgcgtgtttcgaggacccatgtctgggagcccacggctcacattttagtctgtcaaatttcttgctgtag

SEQ ID NO: 23396 - DNA, 1119 bp, Artificial Sequence
  Description of Artificial Sequence: Synthetic coding sequence
atgcgggtgggccccgtgcggagcgccatgagcggcgccagccagccccgaggccctgctctgctgtttccggcaaccaggggtgtgcctgctaaaagactcctggatgccgacgacgcagctgccgtcgctgccaagtgccccagactgagcgagtgtagtagccccccggattacctctctccgccgggcagtccgtgctccccacagcccccaccagccgccccgggcgccggagggggttccggtagcgcacccgggccttctcggattgcggactatcttcttctgcctcttgctgaaagagagcacgtttccagggccctatgtatccacaccggacgtgaactcaggtgcaaggttttccccatcaaacattatcaggacaagattcggccttacatccagctgcccagccactccaacatcaccggtatagtggaggtgatcctgggtgagaccaaggcttatgtgttctttgagaaagatttcggcgacatgcactcttacgtcaggtcaagaaagcgacttcgggaagaagaggcggcccgacttttcaaacagatcgtgtccgctgtggcccactgccaccagagcgcgatcgttttgggagacctgaaactgcgcaagttcgtgttttcaaccgaggagagaacacaactccggttagagtccctagaggacacccacatcatgaagggtgaagacgatgctctgtctgacaagcacgggtgtccagcttatgtgtcaccagagatccttaatacaaccgggacgtattctggtaaagctgcggatgtgtggtctcttggcgttatgctgtacaccctgctggtgggccgatacccctttcacgactccgaccccagcgcactgttcagtaaaattcgacgtggccagttttgtatcccggaacatatttcacccaaggcgcgctgtctgatccgttccctgctgcgtagggagccgagtgagagactcacagctcccgaaatcctactccacccttggtttgagtccgtgttggaaccaggctatatagactctgagattgggactagtgaccaaatcgtccctgaataccaggaggattctgatatttcaagtttcttctgttag

SEQ ID NO: 23397 - DNA, 1554 bp, Artificial Sequence
  Description of Artificial Sequence: Synthetic coding sequence
atggagaccgacctgaacagccaggaccggaaggacctggacaagttcatcaagttttttgcactgaagaccgtgcaggttatcgtccaggctcgtctgggcgagaaaatctgtacccgctcatctagcagcccaacaggatctgactggtttaatttggccatcaaggacattcctgaagtgacacacgaagccaagaaagcactcgccggtcagctccccgccgtgggccgatctatgtgtgtggagatatcgctcaagacttctgaaggagacagcatggaactggagatttggtgccttgaaatgaacgaaaagtgtgataaagaaattaaagtctcatataccgtttacaatcggctttccctgctactgaagtccctgcttgccattaccagagtcaccccggcctaccggctcagtaggaagcaaggccatgagtatgtcatactataccgaatatactttggggaggtgcaactctcgggcctgggcgagggctttcagacagttcgcgtcggaacagtcggtaccccggtgggtacaatcactctgtcttgcgcctacagaattaatttggccttcatgtctacacgtcagttcgagaggacacctcctattatggggatcatcattgatcatttcgtggataggccgtacccctcctcatcacccatgcatccctgtaactataggactgcaggtgaagatacgggtgtgatctacccctctgtagaggatagccaggaggtgtgtacaacctccttctctacctcacccccgagccagctctcctcaagcaggctctcttatcagccggccgctctcggggtgggcagcgccgacctcgcctatccggtggtttttgctgcagggctgaatgcaacgcatccgcaccaactgatggtccccgggaaagaggggggcgtcccccttgcgccaaatcagccggtgcacggtactcaggccgaccaagaacggctcgccacatgcacgccttccgaccggactcattgtgcagccaccccatctagttcagaggacactgagactgtaagtaatagctccgaaggtcgggcctccccccacgacgtgctcgaaactatttttgtgcgtaaagtgggcgcttttgtgaataagccgatcaatcaagtaacgctgacctcgttagatattcctttcgccatgtttgccccgaaaaacctggagttggaagataccgacccaatggtcaacccccctgatagccctgaaacagagagccctctgcaggggtccctacattccgatgggtcttctggtggaagctcaggaaatacacacgatgacttcgtgatgattgacttcaagcctgctttttcaaaagacgatattctgcccatggacctgggcacgttttatcgcgaatttcagaatccaccccagttaagctctctgtctatcgacataggggctcaaagtatggcagaggatctggacagccttcccgaaaagttggccgtccacgagaagaatgtcagagaattcgacgcgtttgtggagacactacaatag

SEQ ID NO: 23398 - DNA, 1488 bp, Artificial Sequence
  Description of Artificial Sequence: Synthetic coding sequence
atgtggcggggctgcgcccggagccggaagcggaagaaggtggacaatgactacaatgcgctgagggagaggctttccactttaccggacaagctgtcttacaacatcatggttccatttggcccttttgcgtttatgcccggaaagttggtccacacgaatgaggtcacagtgctccttggcgataactggtttgcaaagtgcagcgctaaacaagccgtggggctagtggagcatcggaaagagcacgtccgaaaaacaatagatgatctcaagaaagtaatgaagaacttcgagagccgggtggaatttacagaggatctgcaaaaaatgtctgacgctgcaggagatatcgtggacatccgggaagaaatcaagtgtgatttcgaatttaaggcaaaacatcggatcgcccacaagccacactcgaaacccaagacttccgatatttttgaggctgatatcgcgaatgatgtgaaatcaaaagatttgttggctgacaaagaactatgggcccgactggaggagctggagagacaggaagagctgctgggcgaattggatagcaagcccgataccgtgatcgctaatggtgaagacacaacatcatctgaggaagaaaaagaagacagaaacacaaacgtcaacgcaatgcaccaggtgaccgacagccatacaccctgccacaaggacgtggctagtagtgagcctttctccggacaggtgaatagccagcttaactgttctgttaacggcagctcatcgtatcactccgatgatgatgatgacgacgacgacgatgatgacgatgataatatcgacgacgatgatggggataatgaccatgaggctctgggggtcggcgataacagcattcctactatctatttttctcacaccgtggaaccaaagcgggtgcgtatcaacacaggaaagaatactaccctcaaattttccgaaaaaaaagaagaagcaaagaggaaaagaaagaattctactggctcgggacactccgcacaagagctgcctactatccgcactcccgcggacatctaccgtgcttttgtggatgtggtgaacggggagtacgttcccaggaaatccatcttaaagtccagatcccgggaaaatagcgtttgctctgataccagtgagtcaagtgctgccgagttcgatgatagacgaggagtgctgagaagtatctcctgtgaagaagctacgtgtagcgacacaagcgaatcgatcctggaggaggagccccaggagaatcagaagaagttgctcccactgtcagttacccccgaagctttttctggaaccgtcattgagaaagaatttgtctctcccagtttaactccacccccagctatcgcacaccccgctcttcccacgataccagaacgcaaagaggttctgttagaagccagcgaggaaaccggtaagagggttagtaaattcaaggccgctagactgcagcaaaaggattag

SEQ ID NO: 23399 - DNA, 1458 bp, Artificial Sequence
  Description of Artificial Sequence: Synthetic coding sequence
atgtgccaggtgggcgaggactacggcgagcccgcccccgaggagcctcctcccgctcccagaccctcacgggaacagaagtgtgttaagtgtaaagaagcgcagcccgtcgttgtaattcgcgctggcgacgccttctgcagagattgttttaaagctttttacgttcacaaattccgtgctatgcttggcaagaaccggctgattttccccggggaaaaagttttactcgcctggtcggggggaccaagcagcagcagtatggtgtggcaggtgcttgaaggcttatctcaggactccgctaagcgtcttaggtttgtcgccggagttatcttcgttgatgaaggtgcagcttgcggacagagtctcgaggaaaggtccaaaacactggccgaggttaagcccattcttcaggccacaggcttcccatggcacgtcgtggcccttgaagaagtgtttagtctacctccgagcgtgctgtggtgcagcgctcaagagctggtgggtagtgagggcgcttataaggcagcagtggacagcttcctccagcagcagcatgttctcggcgctggtggagggcccggaccaactcagggcgaggaacagcccccacaacctcctctggatccccaaaacctggctcggcctcccgcccccgctcagactgaggcgctgagccagttgttctgtagcgttagaactttaacagcgaaggaggaactcctgcagactctgaggacacatctcatccttcacatggccagggcacatggttatagcaaagttatgaccggcgattcttgtacgaggctggcgattaagctgatgactaacctggcgctgggaagaggcgccttccttgcctgggataccgggttttccgacgagagacatggcgatgtggtggtcgttaggcctatgagagaccacaccctcaaggaggtggcattttataataggctattcagcgtgccctcggtgtttactcctgcagtggataccaaggctccagagaaagcatcaatccacagactcatggaagcctttatcctgcggctccagacacaattccctagtactgtttccaccgtgtataggaccagcgagaaactcgtaaagggcccccgggatggccctgccgccggtgactcaggacctaggtgtctgctgtgcatgtgcgctctggatgtcgacgcagccgacagtgcaacagcttttggggcccaaacgagttctcggctctctcaaatgcagtccccaataccactgaccgaaacccggacacctccaggcccgtgttgctcaccaggggttggatgggctcagagatgcggtcagggggcgtgccgcagagaagatccgcaggcctgcattgaggaacagctgtgctactcctgtagggtgaatatgaaagatttggggctcggtctggctggggatcctgggctgtcagactag

SEQ ID NO: 23400 - DNA, 1353 bp, Artificial Sequence
  Description of Artificial Sequence: Synthetic coding sequence
atgagcctgcggctgagcagcgccagccggcggagctgcccccggcccacaaccggatctttgcggctctatggaggaggcacatcttttggcaccggcaattcctgcgggataagcggaattgggtccggcttcagcagcgcatttggcggaagcagttctgggggaaacacagggggcggcaacccctgtgctgggttcactgtgaacgaacgggggctgctgtccggcaatgaaaaggttaccatgcagaacctcaatgacaggctggcctcctatctggattctgtccacgcactcgaagaagccaacgcggatttagaacaaaagattaaaggctggtacgaaaaatttggaccaggcagctgtcgcggcctggaccacgattactccaggtatttcccgataattgacgatcttaaaaatcagatcatcgcctccacaacttccaacgctaatgctgtgctgcagatcgacaatgccagactaaccgctgacgatttcaggctaaagtacgagaacgaactggccctgcatcagagcgttgaagctgacgtgaatggcctcagacgagttctcgacgagattactctgtgtcggactgaccttgaaatccagtacgaaactctgagcgaagaaatgacgtacctcaaaaagaatcacaaggaagagatgcaggtccttcagtgtgccgctggaggaaatgtgaacgtggaaatgaacgctgcaccgggtgtggatctgacagtacttctgaacaacatgcgagccgaatacgaggctcttgccgagcagaaccgccgagatgctgaagcatggttcaacgagaagtcggctagcctgcagcagcagatctccgaggatgtgggggcaacaacctctgcccgcaacgagctcactgagatgaaaaggactctgcaaactttagagattgaactacagagccttctggctactaagcatagtctggagtgctccctcacggaaaccgagagtaattactgcgcccagctggctcagatccaggctcaaatcggcgccctggaggagcagctgcaccaggtccggacagaaacagagggacagaagctggagtacgaacagcttctcgatataaaacttcaccttgaaaaggagatcgagacttattgcctactgattgggggcgacgatggagcctgcaagtctgggggttataagtcgaaggattacggttccgggaatgttgggagtcaggtcaaggacccagcaaaagcgattgtggttaaaaaagtcttggaagaagtagaccagcggtccaaaatactgactacacgcttgcacagcctggaggagaagtcccagagcaattag

SEQ ID NO: 23401 - DNA, 2679 bp, Artificial Sequence
  Description of Artificial Sequence: Synthetic coding sequence
atggaccagcccgaggccccctgcagcagcaccggcccccggctggccgtggctcgggaacttctcttagccgcactcgaggagctgtcacaggaacaactgaaaaggtttcgacacaaactgcgtgacgtcggacccgacgggaggagtatcccatgggggcgcctggaacgcgcggacgcggtggacttggccgaacaattggcacaattctatggcccagaaccggctctagaagttgcaagaaaaaccctgaagagggcggatgctcgcgacgtagcggcgcagttacaagagcgccgcctgcagcgactgggactcggcagcgggactctgctctccgtgtcagagtacaaaaaaaaatatagagagcatgtcctccagctccacgcaagggtcaaagagaggaacgccagatcggtgaagattacgaaacggttcactaagctcctgatcgctcccgaatcagctgctccagaggaggcgatgggacctgctgaggaacctgagcctggccgggcgaggagatccgacacacacaccttcaaccgtctcttccgtagagacgaggagggcagaagacctctaaccgtggttttacaaggtcctgctggaattggcaaaaccatggccgctaagaaaattttgtatgactgggctgctggcaagctgtatcaaggtcaggtggacttcgcttttttcatgccttgcggcgaactgctagagcggccaggcactcggtctttagctgatcttatcctggatcagtgccccgatagaggagccccggtaccacagatgcttgcccagccccaacgcttgttatttattctcgacggcgccgatgagctgccagcacttgggggacccgaggcagcaccctgcacagaccccttcgaagccgcttccggagcgcgcgtgctcgggggcctcctgtccaaagccctcctgcccaccgccctcttgctagttactacaagagccgcggcgcctggtaggttgcaggggaggctatgttccccacagtgcgccgaggtgcgcggattctcagataaggacaagaaaaaatacttctataaatattttagggacgagagacgagcggagagagcctataggttcgttaaggaaaatgagacactgtttgcgctttgcttcgtcccattcgtttgctggatcgtctgcaccgtcctccggcagcagctcgaactcggacgcgacctttcacggacatctaagaccacgacttctgtatatctgctctttatcacatccgtcctgtcttcagctcctgttgccgacggccctcggttgcagggtgacttaaggaatctatgtcgcctcgcgcgcgaaggggtccttggacggagagcccaattcgccgagaaggaactcgagcagctggaattgcggggaagcaaagtccagaccttatttctttcaaaaaaagagttacctggagtcctggagaccgaggtgacttatcagtttattgaccagagctttcaggaattcctcgccgcacttagctacctgttggaggacggaggcgtgccgcgcacagctgctgggggtgtcggcacactgctcaggggagacgcacaaccacatagtcatctggtgttaacaacacggtttctctttggcctactgagcgcggagcgcatgcgtgacattgagagacattttgggtgcatggtgtcagaacgggtaaagcaagaggctctgaggtgggtgcaaggtcagggccagggctgccccggcgttgcacctgaggttacggagggcgctaaggggctggaggacacagaggagccagaggaggaagaggaaggcgaggagcctaactaccccctggagttgttgtattgtctgtacgaaactcaggaagatgccttcgtgcgccaggccttatgccgtttccccgaattagcgcttcaacgggttagattctgccgcatggacgtggccgtcttgtcttattgcgttagatgctgtcctgcagggcaagctctcagacttatttcttgccggctggtcgcggcacaagaaaagaagaagaagtctctagggaagcgactgcaggcttccctgggagggggctcttcctctcagggcactacaaaacagctgccagcctccctgctccaccctttatttcaagcgatgacagacccattgtgccacctgtcttctctcaccttatctcactgcaaactacccgacgctgtgtgccgtgatctttccgaggcactgcgagcagcccccgccctcacggaacttgggctcctgcacaaccggctgtccgaggctgggctgcggatgctcagtgaagggttagcctggccgcagtgcagagtacaaacagtgagagtgcagcttcccgatccccagcgggggctgcagtacctggttggcatgttaagacagtccccggcgctgacgactctggatctaagtggttgtcagctgcctgccccaatggtgacctacctgtgtgcagtgcttcagcatcaagggtgtggcttgcagacactgtcactcgcaagcgttgagctaagtgagcagtccttacaggagcttcaagctgttaagcgcgcgaagccagacctggtcatcactcatccagccttagatggtcatccacagccccctaaagagttaatcagtactttctag

SEQ ID NO: 23402 - DNA, 1047 bp, Artificial Sequence
  Description of Artificial Sequence: Synthetic coding sequence
atgggcaaggactactacaagatcctgggcatccccagcggcgccaatgaggacgaaatcaagaaggcctaccggaagatggcgttgaagtaccatcccgataaaaacaaagaacccaatgcggaggaaaaatttaaggaaattgctgaggcctacgatgttctgagtgatcctaagaaacggggactgtatgatcagtacggtgaggaggggttaaagaccggtggggggacttcaggcggcagctccggatcctttcattacactttccacggggatccccacgcaacatttgcctctttttttggaggatccaatcccttcgatatctttttcgcatcatccaggagcaccaggccgttttccggctttgaccccgatgacatggatgttgatgaagacgaagatcctttcggagcatttggacgcttcgggtttaacgggctgagccggggccctcgcagggccccagagccactttatccccggcgcaaagtgcaagacccccccgttgttcacgagctgcgtgtcagtcttgaagaaatctatcacggatctacaaagagaatgaagatcactagacgaagattaaatcccgatggaagaactgtgcggactgaggacaagatactgcacatcgttatcaagcgtgggtggaaggagggcaccaagatcacatttccaaaagagggcgacgccacaccggataacatccccgccgatatcgtattcgtgctaaaggacaagcctcatgctcatttccggagagacggaactaacgtactgtactcagcattgatatctttgaaagaagccctttgcggctgcactgtgaatatccccaccatcgatgggagagtaatcccgctcccatgtaatgacgtcatcaaaccggggacagtcaaaaggttgcgaggcgagggactgcccttccccaaagtgcccacccaaaggggggatctgatcgttgaattcaaggttcgcttcccagaccggctcaccccacagaccaggcagatcctaaaacagcatctcccctgttcctag

SEQ ID NO: 23403 - DNA, 1899 bp, Artificial Sequence
  Description of Artificial Sequence: Synthetic coding sequence
atggacaccatgatgctgaacgtgcggaacctgttcgagcagctggtgagacgggtggagatcttatccgaaggtaacgaggtgcaatttatccaattagctaaggattttgaggatttccgcaagaagtggcagcgaactgatcacgagcttggaaagtataaggacttactcatgaaggcagaaaccgagcggtccgcgctggacgtgaagttgaaacacgcccgaaaccaggttgacgtagagataaagcgccggcaaagggccgaagccgactgtgaaaaactggagcgtcagatccagctcattagggagatgctgatgtgtgatacttctggcagcatccagttgtcagaggagcagaaatccgccctggcctttttaaatagaggacagccatcatcttcgaacgctgggaataaacggctttctactattgatgagagcggcagcatactgtcagacatttcattcgacaagactgatgaatcccttgattgggatagctccctggtcaaaaccttcaagttgaagaaacgggagaaaaggcggtccacctctagacaatttgtggatggtcccccagggcccgttaaaaagaccaggtccattgggtccgctgtcgatcaggggaatgaatccatcgtcgccaaaacaaccgttaccgtacccaatgacggcgggcccattgaggccgtgtcgactattgaaacagttccttactggacaaggtcgaggcggaaaaccggtacattgcaaccctggaactccgattccactctgaactcccggcagctggagccaaggactgagaccgactccgtaggtaccccccagagtaatgggggtatgaggctgcacgactttgtgtctaaaaccgtgattaaaccagaaagctgtgtcccatgtggcaagcggatcaagttcggtaagcttagtcttaagtgcagagactgccgggtggtgtcccaccctgaatgccgcgacagatgccctctgccttgcattccaacgcttattggcacccctgtcaagataggagaggggatgctcgccgatttcgtgagccagacaagcccaatgataccctccattgtcgtgcattgcgtgaatgaaatcgagcaacgcggtctgacagaaactgggctctacagaatatccggatgtgatcggacagtgaaagagctcaaagagaaattcctgcgcgttaagaccgtacccttgctgtccaaagtcgacgatattcacgcaatctgctccctcctcaaggactttctcagaaacctgaaggagccactgctcacatttcgcctgaatcgggcatttatggaggctgctgaaattacagacgaagataatagcatcgctgcgatgtatcaggcagtgggcgagctccctcaagccaacagggacaccctagcctttctgatgattcacctccaacgtgtggcacagtcacctcatactaagatggatgtcgcgaacctcgccaaagtctttggcccgaccattgtcgcccatgctgtgccaaatcccgaccccgttacgatgttgcaggacatcaagaggcagccgaaagtggttgagagactgctaagcctgcctctggaatactggtctcagttcatgatggtggaacaggaaaatattgatcccctgcacgtcatcgaaaactccaacgctttctctacgccccagactcccgacatcaaggtttccttgctgggtcccgtgaccacaccagagcaccagttgctgaaaactccctcatcctcctctctgtctcagcgcgtgcgatccaccctgaccaaaaatacccctagattcggcagcaagtccaaatcagctaccaacctcggcagacagggaaacttttttgcgtccccaatgctgaaatag

SEQ ID NO: 23404 - DNA, 12075 bp, Artificial Sequence
  Description of Artificial Sequence: Synthetic coding sequence
atgagcagcgagcaggacaagagcgccagcaaggagaagagcaagaagcccgtcagattcttaccccagctcagtatggagaagcttgccagcaaggaaaagttcaaggccccagcccgcgctcttccgcagctgtccatggtgtccaccaaaccacactggcagcaggccgcccccagttttcacctttcagtaaagcaagatgatgagtcccccgaaccgttttctgtgaaaaatgaacagtcacatgcggaatacatggaacgcttcggaaagaaaggcaaattgccccaccaggtcgatgactcatacgtgggccccagcacaagcaaaagcaagggaaagtctccccataaggaaagggaaaacttccgaagcactctggtcaatgttatcatgcaacaagacgccgacctggattcggccgttcctgacggctccactattcccaagcctaccgctagtgccattgagaaggacatcttacgatactactattacatccaccacggcattgataccgaccatgttgctcctatggaggactcctggctggagcacgtgttggatctcgtaccccagcatctgaaggtgttcaccgactccatcgtcacactctctgatgagatgagggaagattatctgctcagcgtccgcaagagtatagttgactttgtcctcaaggacccccgggagaaaggtgatgataaaaagactgatgagctccctgcccacagagccgagatggagatcctgcccaaaccctggcggaagagttttctcgcagctagttcctacatccgggatcatctaaatgctatgaaccctaccatgctggcggtcctggacctatggcacacaaatttcaaaaaactcaggctcgtggacataaaggagtttcataactgccaggatgccctggagctgagtagcttccagaacatcatcatgcgacatatggactcggctaaagagactttgttgaagatgtggtttccggaggttcagaacatctactaccagggcaacaagaagaaacagcttcctacaggtgacagcagcgccaaattagagagcttctttaactgtgctgctgccctaatgacacttcagctgcaggacctgaccttagtgtccatgcaggattttaccgacttgattgctcagccacccgacagcgtgagggcatttgaacatcccggctttattatgcgcttgattcttgacaatgacactatcaaatttgagccagaattatcggactacattgacatttttctaaacgtgtacgacgtgatgattaaggcagtgtccttcgtccctagggtagaaaccaaactttactcaaaatgggagagcaaaagtaagccaacaacactgaagcctatcattctcaacgagatagtggatgctcacaaggagaagatcaaggaggtgataatgaaggaaagtgtggcccccactgaacacctgagactttacgataaatatgactttctgatcacacgtaaggctgaacgggatgtcgacaatttcctcgctgagaaccactcttacgagaaaattatcgatgaaatttgcaaatatcaaaagctcattgaggagatccagtacactagtattaagacaattcgactcggtatgtttgagatgcattgtgaagaactgattcgtgctttggtcaaacgtgccgacatcatttgtggaaagctgttagctaagatgttcagagaccaccaggaggtaaacacaaggctgtgcgacgagttcgaaagaatagctgaaaaggctctttccactcctcctaacactgcagaactgatggagatgaaagcctatatccagaaggtggaagttacagatatgattgaattggaacaaagactggtcgactcaaagaactgtcttgctttcctgattgaatacgtcaatttcagtcccgccgatatgcgccttaacaatagcgtatttcagtggtatggcaggatgggagaaattttcgaagagcatcggaagattatcaaagagaagatagaacagtaccaggaaggtcttaaactgcgctgtgaaagattcgtcgaggagctggagagttatgccaagcaatctgaggagttttacagttttggggacctccaggatgtgcagaggtacttaaaaaaggctcaaatcctcaatggaaagctggacctcgccgcagacaaaattgaacaattcaatgcagaggaggaagctttcgggtggttaccgagcgtgtatcctcagaggaagaagattcaagatggcctgaacccataccttcgactatatgaaactgccgtggagttcagcagtaactaccgcgcctggaccgaaggcccgtatcataaagtcaatcccgaccaggtagaagccgacatcggaaactactggcgggggttgtataagcttgagaagacgttccatgatagcccttacgctctcgccatgaccaagaaagttcgcagtaaggtggaggatttcaaacagcacatcccccttattcaagttatctgtaatcccggtcttcgaccccggcactgggaagctatgagcgcaattgtcggctaccccctacagccttctgacgacagcactgttagttcctttctcgatatgaatctcgaaccatacatcgatagatttgagggcatttctgaggctgctagcaaggaatacagtcttgaaaaagctatggagaaaatgatcacagagtgggatgctgtggagttcgtgatccattcttaccgggaaactggcactttcattctcgcctcagttgatgagattcagatgctgcttgacgatcatattattaaaacccagaccatgcgaggctcaccttttattaagccttacgagaagcagatgcgggaatgggagggcaagcttctactgctccaggaaattctcgacgagtggctgaaggttcaggctacttggttatacctcgaacccatctttagttcccccgacattatgagtcagatgccagaagaggggcgtcgattcacagcagtggataaaacctggcgagacatcatgagatcggtgatgcaggataaacacgtccttacagtcgtaacaattgatcgcatgctggaaagactcaaaaaatctaacgagcttctcgagctgatcctgaaagggcttaatgagtatctcgaaaagaagaggctgttctttcctcgctttttctttttgtcaaatgacgaactcctagaaatactgtcagagaccaaagaccccactagggttcagcctcacttgaaaaaatgctttgagggcatagccaaggtggagttcaccgagaccttggatatcacccacatgaagagtagcgaaggggaagtcgtcgagctcatcgagatcatcagcactgccaaagcaagaggccaggtcgaaaagtggcttgtggagcttgagagggtgatgatcaacagcattcataaggtaactggcgacgccaccttcgcatatacaaagtacgaaaggatcaactgggttagagattggcccggccaaacagtgctgtgcgtaagccagattttttggactaaagaagtgcaaaccgccatccctatgggaattaaggctttggaacagtacctgaaaacctgtaatcgccaaattgatgacatcgttacactggttagaggaaaactcagcatgcagaaccgcgtgaccttgggagccctggtggtgctggacgtgcatgctagggatgtacttagctcactcgttaaaaagaatatctcggacgactccgactttgagtggctaagccagctgcggtattattggcaggagaaccaccttgaaactaagatgattaacgccggattgcggtacggctatgaatacctcgggaacagcccaaggttagttataacaccacttaccgaccgctgctatcgaacactgttcggcgctctacatctgcatttgggcggcgcgcccgagggacctgcagggactgggaagactgagaccacaaaagacctggcaaaagctgttgcgaaacagtgcgtcgtttttaactgctctgacggcctggactacctcgcactcgggaaatttttcaaaggacttctatcttgtggcgcatgggcctgctttgatgagtttaatcggattgacctggaggtgctgtccgtggttgcgcagcagattttgactatccaacgcggaatcaacgctggggcggatatcctgatgtttgaagggacggaattgaagctggaccccacatgtgccgtgtttatcacaatgaatcctggctatgctggcagatcagaacttccggacaatcttaaggcactgttccggactgtggccatgatggtgcccgactacgccatgatcgccgaaatcgttctttactcctgcggatttgtgacagcccgtccactgagtgtcaaaatagtcgctacctaccggctttgttcagagcagttgagctctcagcatcactatgactacggcatgcgggcggtcaagtccgttctgaccgccgcaggtaacttaaagttgaaataccccaatgagaatgaagagattttgttgcttcgttctatcattgatgttaatctcccaaaattcctgagtcacgatctacctctgtttgaagggatcactagcgatctgttcccaggagtgaagctaccaaagccggactataatgacctccttgccgcaatcaaagacaattgcgccagtatgaatttacagatgaccgctttcttcagcgagaaaatcctccaggtgtatgaaatgatgattgtcagacacgggttcatgattgtcggggagcccttcggtggaaaaacatccgcctatagagttttggccggtgccctaaatgacatatgcgagaaaggtctgatggaggaaaataaagtgcagattactgtcctgaatccaaagagcgtaacaatgggacaactgtatggccaattcgattccgtgagccatgagtggtctgacggtgtgttagccgtctctttccgcgctttcgcatcctcagtaacacctgatcgtaaatggttgatttttgacggtccagtagatgctgtttggatagagaatatgaatacagtgctggacgataataagaagttgtgtttgatgtctggagaaatcatccagatgagcccccaaatgaatctgatttttgaacccatggacctggaggtcgcttccccagctaccgtttcaagatgtggaatgatctatatggagccacacatgttaggatggaggccacttatgttgtcatgggtgaacctgttgccagccagtgtaagcgtgatccagaaagagtttataatgggactgtttgatagaatggtgcctgtatcggtagaatttatcaggaaacacacaaaggagctgtcccccacctccgatacaaacctcgttcgttctctgatgaaccttatagactgctttatggacgatttcgcggacgaagtaaagctgaaagagcggaacgatagggagacctacagccttctggagggaatttttctgttttcacttatctggtccgtgggtgccagttgtacagatgatgatcgactgaagttcaacaagattctgagggagctaatggagtcgccaatctcagatcgaaccaggaacacattcaaactccagagcggaacggaacagacctcctcgaaggcgttgaccgtgccctttccggagaagggcaccatctacgattatcaatttgtcaccgaagggatcggaaaatgggagccatggattaagaagcttaaggaggccccccccattcccaaagatgtgatgttcaatgagataatagtaccaacactggacactattaggtactccgcgttaatggaactgttgaccactcaccagaagccaagtatctttgtggggcctactggcaccggcaagtcagtgtatattacaaattttttactgaatcaactcaataaggaaatttacaagccacttctgataaatttttccgctcagacaacagccgcacagactcagaacattgtgatgagcaaactggacaagcgtcgcaaaggcgtatttggaccccctctggggaagagaatggtggtgttcgttgatgacgtcaacatgcccgctcgagaagtctatggagcacagccccctattgaactcctgcgccaatggctggaccactggaactggtacgatctcaaggactgttcaatgattaagttggtcgatatccagattatgtgtgctatggggccccctggcggaggtcgcaatccagtcactcccaggtacatgagacattttaatatcattacgattaacgaattcagcgacaagtccatgtacactatcttctcacgcattttgacatggcatttggagatctgttacaaattccccgatgagttcctggacctgacaacgcagatcgtcaacggaactatgacactttataaggaggcaatgaaaaatctcttgcccacccccgccaaaagccattacctctttaacttgcgggattttagccgagtgatacaaggggtttgtctctccagaccggagacgaccgagaccacagaggtcatcaaacggctttgggttcacgaagtcctgagggtatattacgatcggctgttggacaataccgatcgaagttggctaattaattacattcaagagatactgaggaattacatgtacgaggatttccatgaactttttcaaagattagattttgacaatgacggaatggtagaggctgatgaccttcgctcattgatgttttgcgactttcacgatccaaaacgggaagacaccaactatcgagagattgcggatgtggataaccttagaatgatcgtggagatccatttagaggagtacaataacatctctaaaaagcctatgaaccttgtgctcttcaggttcgcaatcgaacatatcagcagaatctcacgtatcctaaagcagccacgcagccacgccctgctggtcggcgtcggaggctctggtcgccagagtgtaactcgactcgccgctcacatggccgactatagcgtgtttcaagtggaaatttccaagggctacgataccacagagtggcacgaagacctgaaggtcatcctgcgtaagtgcgctgaaggggaaatgcagggggtctttttattcacagacacacaaatcaaagaagagagctttttagaggacgttagcaatttgctgaatgctggcgagatccccaacctgttcgcactggacgagaagcaggagatctgcgacaagatgagacagctggatcgccagcgagacaaaaccaagcagactgacggaagtccaattgctctgttcaacatgtttatagaccactgtagatcacagttacacgtggtcctggccatgtctcctattggcgatgcttttagaaacaggctgcgcaaattcccagccttggtgaattgttgcaccatcgattggttccaaagctggcccgaagacgcccttcaagctgtggctagccgttttctggaagaaatcgaaatgtccgaggagatcagagacggatgtatcgacatgtgcaaatcttttcacacctctactattgatctctccaagtctttctttgtggagctccagagatacaactatgtgacccccactagctaccttgaactgatcagcactttcaagctgttactggagaagaaacggagtgaagtgatgaagatgaagaaacggtatgaggtggggctggagaagctggattccgcctcgtcacaggtcgctacaatgcagatggagctggaggctctgcacccacagttgaaagtggctagcaaggaggtggatgagatgatgattatgatcgaaaaagaaagcgtggaggtagctaagacagagaaaattgtgaaggctgatgagaccatcgcgaatgaacaggctatggcaagcaaggccattaaagacgagtgtgatgctgatcttgccggtgctctcccaattttagagtcagcgctggcggccctggatacactgacagcccaggatattaccgttgtgaagagcatgaaaagtccccctgcaggcgtaaaactggtgatggaagcaatttgtatactgaaaggcataaaagccgacaagatccccgaccctacgggctctgggaaaaaaatagaagatttctggggaccagcaaagcggctcctgggggatatgagatttcttcagtccctgcacgaatatgataaggataatataccccccgcttatatgaacattatacggaaaaattacatccccaaccctgattttgtccctgaaaagataaggaacgcctcaacagcagctgagggattgtgtaagtgggtcatcgctatggattcttacgacaaggtcgccaagatcgtcgcacccaagaagattaaacttgccgccgccgagggggaactcaagatagccatggatggcctgagaaaaaagcaagccgccctgaaggaggtgcaggataaattggccagactccaggataccctcgagcttaacaagcaaaaaaaagccgatctcgagaatcaagtggatttgtgctctaagaagttagaacgggcagagcagctcatcggcgggttgggcggggaaaaaactcgctggtcacacacggctttagagctcgggcagctgtatatcaatttaaccggcgatatcttgattagttcgggcgttgtggcttatttgggagcctttacttctacctacagacagaatcagacgaaggagtggactacactctgcaagggtcgagatataccatgtagcgacgactgctcactgatggggaccctgggcgaggcggtaaccatccgcacatggaacatcgctggacttccctcagacagcttctctattgataatggcataatcataatgaacgccagacgctggccattgatgatagaccctcagtctcaagctaataagtggattaaaaatatggaaaaggctaactctctatacgtgatcaagttgtctgaacccgattatgtccgcacactcgagaattgcatccagtttggcacaccagtgcttttagaaaatgtgggagaggagttggatcccatccttgaacctctgcttttgaaacagaccttcaaacagggtggctctacttgcatcagacttggagattccaccatagagtatgctcccgacttcagattttacatcactactaagttacgcaacccccactacttaccagaaacgtcagtgaaagtgactctgctcaatttcatgatcactcccgaaggtatgcaggatcagctgcttggcattgtcgtggcgcaggagaggcctgatttagaggaggagaagcaggctttgatattacagggcgcagagaacaaacgacagctgaaagaaatcgaggacaaaatcctggaggtgctgtccagctctgagggaaatatcctggaggatgagacagcaattaagattctgagctcctctaaagctttggctaacgagatcagtcaaaagcaggaagtggcggaggagactgagaaaaagatagatacaacccgtatggggtataggccaatagctatccactctagtattttgttcttttcccttgctgacctggcgaatatcgagccaatgtaccagtactccctgacgtggtttatcaatctgtttatcctgagtatcgaaaactctgagaaatctgaaattctggccaaacggttgcaaatcctgaaggatcactttacctacagcctgtacgtaaacgtgtgcagaagcctatttgaaaaagacaaattgttattttccttttgtctgacaatcaacctgctcttacacgagcgggcaatcaataaggccgagtggagattcttgctaactggaggcattggccttgataatccctatgcgaatttgtgtacgtggcttccccagaagagctgggacgaaatttgtcgactagacgatctgcccgctttcaaaacaatccgccgcgaatttatgaggctgaaagacgggtggaaaaaggtgtatgactcacttgaaccacatcacgaggtttttcctgaggaatgggaggataaggcgaacgagttccagagaatgctaatcattcggtgcttgcgcccagacaaggttatccccatgctgcaggagttcattattaacaggttgggtcgcgccttcatcgagccacctccattcgatttagcaaaggcctttggggacagtaactgttgtgcccctttgatcttcgtgctgtcacccggcgccgacccaatggccgccctcctgaaattcgccgatgatcagggatacggtggctccaagctcagttcactgtctctcggccaaggccagggtcctatagcaatgaaaatgctggaaaaggccgtgaaggaagggacatgggttgtgcttcaaaattgtcatctcgccaccagctggatgcccacactggaaaaagtctgtgaggaactgagccctgagagtacgcatcccgattttcgcatgtggcttacaagttaccctagccccaatttcccggtgagtgttttgcaaaacggggtgaaaatgaccaacgaggcccccaaaggcctaagagcgaacattattaggtcctatctaatggatcccatatccgatcccgagttctttggcagctgtaaaaaacccgaggaatttaagaaattactgtatggactttgcttcttccatgcactggtgcaggaacggcggaaattcggtcctcttggatggaacattccatatgagttcaacgagacagatctgcgcattagtgttcagcagcttcatatgttcctgaaccaatacgaagagctgccttacgaggctttgcgctatatgaccggcgagtgcaactatggggggcgagtcaccgacgactgggaccgccgaactttgagatcaatcctgaataaattcttcaatccagagttagtggagaacagtgattacaagtttgatagtagcggcatttacttcgttccccctagcggtgatcataaatcctacattgaatatacaaaaacactgcctctgacgcccgccccagaaattttcgggatgaacgctaacgctgacataaccaaagatcaaagcgaaacccaactattatttgacaacatactactgacacagtctcggtctgccggcgcaggagccaaatcgtctgacgaagtggtgaacgaggtggcctctgatattctcgggaagttgccaaacaatttcgacattgaagcagccatgcggagataccctacaacttacactcagtccatgaatacagtactggtccaggagatggggcgattcaacaaactgttgaaaacgatcagggacagttgcgtcaacattcaaaaagcaatcaagggcctggcagttatgtccactgatctggaggaagtggtttcctccattctgaacgtaaagatccccgaaatgtggatgggtaaatcctatccctctctcaaaccactggggagttacgtgaacgattttctcgccaggttgaagttcctccagcaatggtacgaagtggggccccccccagttttttggctgagtggcttctttttcactcaggctttcttaactggcgctcagcagaattatgcccgtaaatatactatccccattgacctgttggggtttgactatgaagtcatggaagataaggagtataagcacccaccagaggatggcgttttcatccatggtctgtttctggacggcgcatcttggaatcgcaagattaagaagttggccgaaagtcaccctaaaatcctctatgacactgtgccagtaatgtggctgaaaccttgtaaaagggccgacatcccaaaacgccctagctacgttgcacctctctacaaaaccagtgaaagacgcggagtgttgtccactacagggcattccaccaattttgttatagctatgacactgccaagcgaccagccaaaggaacactggattggtagaggtgtcgccttgctatgccagctcaattcatag

SEQ ID NO: 23405 - DNA, 1506 bp, Artificial Sequence
  Description of Artificial Sequence: Synthetic coding sequence
atgagcagccggcaggacaagagcgccagcaaggagaagagcaagaaaccagtaaggtttctgcctcaattgagcatggaaaaactagcaagcaaggaaaagtttaaagctccagctagggctctgcctcagctctcaatggtgagtaccaaaccacactggcagcaggctgcccccagttttcacctgtcagtgaaacaggatgatgagtcacccgagcctttttctgtcaaaaacgaacaatcgcacgcagagtatatggagcgcttcggaaaaaagggcaagctgccccatcaggtcgacgattcatatgtgggcccctcaacgagtaagtctaaggggaagtcaccccacaaggagcgagaaaacttccggtccactctggtcaacgttattatgcagcaggatgctgacctcgactccgccgtccccgacggcagtacaattcccaagccaactgcgtcagcaatcgagaaagacatcctccgctattactactatatccaccacggtattgacacagaccatgtcgcccctatggaggacagctggctcgaacatgtcttggatctggttccgcaacatttaaaagtcttcactgatagtatcgtcacactgagcgatgaaatgagggaggattatttactctcagtgcgcaaatctattgtcgactttgtgttaaaggatccacgggagaagggcgacgacaagaaaaccgacgagttacccgctcaccgggcagagatggagatcctcccaaaaccctggcgaaagtcctttctggccgcctcatcatatattcgcgatcaccttaacgcgatgaaccctaccatgcttgctgtgctggatctgtggcacaccaatttcaagaaactgcgtctcgtggacatcaaggagtttcacaattgccaggacgcgctcgagttgtccagttttcagaatatcattatgaggcatatggactccgcgaaagagacactcctgaagatgtggtttcccgaagttcagaacatctactaccagggaaataagaagaagcagctcccaacaggcgacagctccgctaaactcgaatcattcttcaattgcgctgcagccttaatgaccctccagctccaggaccttaccctcgtcagcatgcaagatttcacagatctgatcgcgcaacccccggattcagtgcgggcattcgaacaccctggatttatcatgaggctgattctcgacaatgacactataaaatttgaacctgaactgtctgactacatcgatattttcctgaatgtctatgacgtgatgattaaagccgtctcattcgtgccccgcgtggagactaagctctacagtaaatggagaaacaaggcaaagcccggacatttttatttctcacacattcagaggagtgtgaccttccaacattcagaagtcagcagcccccagaactcccacttcaaaatagtttctccgttctcggtgctcggatttacatggagatgtcaattatag

SEQ ID NO: 23406 - DNA, 840 bp, Artificial Sequence
  Description of Artificial Sequence: Synthetic coding sequence
atggccgcccccgtgcggcggaccctgctgggcgtggccggcggctggcgccggttcgagaggctctgggccggcagcttatcttcccggagcctggctctggcagcggcaccttcgagcaacggaagtccatggagacttttgggtgccctttgtctgcagcgtccaccagtcgtgtctaaacctctcactcctttgcaggaggagatggcaagcctactgcaacaaattgaaattgagcgaagcctatacagtgaccacgagctgcgggcgttggacgaaaatcagaggctggctaagaagaaggctgacctccacgatgaggaggatgagcaggacatactacttgctcaggacctagaagatatgtgggagcagaagttcctccagttcaagctcggggcgcggataaccgaagccgatgaaaagaatgatagaactagcctcaaccgaaaacttgaccgaaatctggtgctgttggtcagagagaaattcggcgatcaggatgtgtggattctgccacaggcagaatggcagccaggggaaactctccgcggcactgccgaacgcactcttgcaactctctccgaaaataacatggaggctaagtttctcggcaatgccccatgtggacactacaccttcaagttcccccaggcgatgcgcaccgagagtaacctgggagcaaaagttttcttttttaaagccctcctgctgaccggtgacttcagtcaggccgggaataagggtcatcacgtgtgggttactaaagatgaactgggcgactacctgaaacccaagtaccttgcccaggtccgacgattcgtgagcgacctgtag

SEQ ID NO: 23407 - DNA, 609 bp, Artificial Sequence
  Description of Artificial Sequence: Synthetic coding sequence
atggaggccgaggccggcggcctggaggagctgaccgacgaggagatggccgcccttgggaaggaagaacttgtccggcggttgcggcgtgaggaggccgctcggctcgcagcacttgttcagcgcgggcgcctgatgcaggaggttaatagacaacttcaaggccatcttggcgaaatacgcgagctaaagcagcttaacagaaggctgcaggctgagaatagagagttgcgcgatctctgttgtttcctggattcagagcggcagagagggcgccgcgccgcccgccagtggcagctgttcggcacacaggctagccgggctgtgcgggaagatctggggggatgctggcagaagctggccgaactggaaggaagacaggaggagcttcttagagaaaatctcgctctcaaggagctctgtcttgccctgggggaagagtgggggcccagaggcgggccgtctggcgcaggaggctcaggtgcaggtcccgcccctgaattggcactcccaccttgtggtccccgtgatctaggcgatggttcctcgtcaacggggagtgtaggatcccctgatcagttgccgctggcatgttctccagacgactag

SEQ ID NO: 23408 - DNA, 1353 bp, Artificial Sequence
  Description of Artificial Sequence: Synthetic coding sequence
atgcgggagtgcatcagcatccacgtgggccaggccggcgtgcagatcgggaacgcctgttgggaactttactgcttggaacatggtattcagcccgatggccagatgccctcggataaaactatcggagggggggatgatagctttaatactttctttagcgaaacaggagctggtaagcacgtgccccgggccgtctttgtcgacttagaacctacggtggtggatgaagtcagaacagggacctacaggcagctgttccacccggagcagctgatcaccggcaaagaggacgcagctagcaactacgcccgagggcactataccattggcaaagagatagtggatctggtcctggatcgtatcagaaaactcgccgatttatgcactggcctacagggattcctcatctttcactcatttggcggcggtactggttcaggtttcgcgtctctactgatggagcggctcagtgtggattactctaagaagagcaaactcgagttcgccatctatcctgcaccccaggtttcgacggccgtggttgagccctataacagtatcctgacaacccataccactctggagcattcggactgcgcattcatggtcgacaatgaagcgatctacgatatctgcagaaggaacctggatatcgaaagaccgacatataccaacctaaaccgcctgatcggacagatcgtgtcaagcattacagcttccttgcgttttgacggtgctctcaatgtggacctgacagaatttcagaccaacctggtaccctatccccgcatacattttcctttggcaacctatgcccccgttatcagtgcagaaaaagcataccacgagcagctgagtgtggctgagattactaacgcttgcttcgagccggctaaccagatggtgaagtgcgatccaagacatgggaagtacatggcttgttgcatgctataccgcggagacgtagtccccaaagacgtaaatgccgcaatcgcaaccattaagaccaaacggacaatccagttcgtcgactggtgccctacaggcttcaaagtggggatcaattaccaacctcccaccgtcgtgcctggcggtgatttggctaaagtgcagagagctgtgtgtatgttaagcaatactacagccatcgctgaggcctgggcaagactggtccataagttcgatctcatgtatgccaaatgggcattcgtgcattggtatgtgggtgaaggtatggaggaaggagagttttcagaagccagggaagacctcgcagctctggagaaagattgtgaagaagtgggggtagattctgtagaggccgaagcagaagagggtgaggcgtactag

SEQ ID NO: 23409 - DNA, 3078 bp, Artificial Sequence
  Description of Artificial Sequence: Synthetic coding sequence
atggtggccatggccgaggccgaggccggcgtggccgtggaggtgcgggggctcccccccgccgtgcctgatgaactgctgaccttgtatttcgagaacaggcgaaggtcaggagggggccccgtgctttcatggcagcgattgggttgcgggggcgttttgactttccgcgagcctgctgatgctgaaagagtgcttgctcaggctgatcacgaactccacggtgctcaactctctctgaggccagctccccccagggctccagctcgtttgctattgcagggccttccaccaggaacgacaccgcaacgcctggaacagcacgtccaggcactgctgcgggcctcagggttgcctgtgcagccctgctgtgcgctggccagtcctaggcccgacagggctttggtgcagctgccgaaaccacttagcgaggctgacgttcgcgtcctggaagaacaggcccagaatcttggtctggagggaacactcgtctcactggccagggtgccacaggcccgcgccgttagagtcgttggtgacggcgcgtctgtggacttgttgttgctcgaactgtacctggaaaacgagcgccgatccggcggaggaccgctcgaagacctgcagcgcttgcccggccccctgggtactgtggcgtcatttcagcagtggcaagttgccgaacgggtgctgcaacaggaacaccgactgcagggaagcgaactgtcgcttgtcccgcactacgacatactagagccggaggagttagccgaaaacacaagtgggggagatcatccctctacacagggcccacgagccacgaagcacgccctgctgcgcaccgggggcctcgtcaccgcactgcagggagccggcacagtgaccatgggatcaggcgaggaacctggtcagtccggagcctccttgaggacaggacccatggtccagggtcgcgggatcatgacaactggatcagggcaagaaccaggacagtccggtaccagtctccggacagggccaatgggctccctcggacaagcagagcaggtgtctagcatgcctatgggttctctcgagcacgaggggctcgtgtccttgagacccgtgggattgcaggagcaggagggccctatgtccctggggcctgtgggctctgccggccctgttgagaccagcaagggtttgctggggcaagaggggctggtcgaaatcgccatggatagtcccgagcaggagggcctcgttggacccatggaaatcaccatgggttctctagagaaagcaggaccagtgagtccaggttgcgtaaagctggccggacaggagggcctcgtggagatggtccttctgatggaacccggcgccatgcgattccttcagctgtatcacgaagacctgcttgctggcctgggcgacgtggctttactgccactggagggcccagatatgaccgggtttagactgtgcggcgcccaggcgagctgccaagcagcggaagagttcctgcgctcgctgttaggaagcatttcttgtcacgtgctgtgcttggagcatccgggcagcgcccggtttcttctcggccctgaaggtcaacacctcttgcagggcctcgaggcccagttccagtgcgtgtttgggacagagcgacttgcaacggctaccctagacacaggacttgaagaagtagaccccacagaagctcttcctgttctgccggggaatgcccacacattgtggacaccggactcgacaggcggcgatcaggaggacgtctccctggaagaagtaagggaactactggcgaccctggaggggctggatctggacggcgaggactggctgccacgggaactggaagaagaaggacctcaggagcagcccgaggaggaagtgacacctggacacgaggaggaagaacccgtggcgccaagcacggtggcccctcgctggctggaggaagaggctgctcttcagctggcgctccaccgctccctcgagccacagggccaggtcgcagagcaggaggaagctgcggctttgcgccaggccctaacattgtctctgttggaacaaccaccactagaggccgaggagcctcccgacggcgggactgacggcaaggctcagctggtggtgcactcagctttcgaacaagatgttgaagagctggaccgggcccttagagcagcactcgaagttcacgtgcaggaggagacagtgggcccctggcggcgaactctgccagcggaactgcgcgcacggctcgagaggtgtcacggtgtgtccgtggcccttcgcggcgactgtactatcttacggggttttggcgctcaccctgcccgggccgctcgtcacctggtggctttactggccggtccttgggatcagtctttagctttccctctcgcggccagcggacctaccctggctggacagactctgaagggcccttggaacaacctggagcgcttggctgagaacacgggagaatttcaggaggtggtacgggccttttacgacaccttggacgccgcacgatccagcataagggttgtcagagtcgaaagggtatcacaccccctgctgcaacagcaatacgaactgtatagggaacggctcctccagcgctgtgagcgcagaccagtggagcaggtgctgtaccatggtactacggctcctgccgtgcccgatatttgtgctcatggcttcaaccgcagcttctgcgggcggaacgcaacagtttacggaaagggagtgtatttcgcccgtcgcgcaagtctgtctgtccaggaccgatattctcctccaaatgctgacggacacaaggccgtgtttgtcgcaagggtcttgacaggggactacggtcaagggcgccgaggactcagagctcctcccctgcggggaccgggccacgtcttgctgaggtacgacagcgctgttgactgcatttgtcagcctagcatttttgtgatttttcatgatacccaagccctgcccacccacttaattacttgtgagcacgtgccaagggcatcccccgacgatccctctggtctcccaggcaggtcccccgatacctag

SEQ ID NO: 23410 - DNA, 390 bp, Artificial Sequence
  Description of Artificial Sequence: Synthetic coding sequence
atgagccacctgcagagcctgctgctggacaccctgctgggcaccaaacacgtcgactccgccgcactgatcaagatacaggagcgcagcttgtgtgtcgcttcgcctgggtttaacgttactccttcagacgtgagaactctggtaaacggtttcgcaaagaacccgttgcaggcacggagagagggactttactttaaaggcaaggactacaggtgtgtgcgagcagatgagtattctctgtatgctaagaacgagaataccggagtcgtcgtggtgaaaacccacctgtaccttctggtcgccacatacacggagggaatgtatccgtcaatatgtgttgaagccacagagagcctgggagactatctgagaaaaaaaggctcatag

SEQ ID NO: 23411 - DNA, 945 bp, Artificial Sequence
  Description of Artificial Sequence: Synthetic coding sequence
atgctgggcaagggcggcaagcggaagttcgacgagcacgaggacggcttggaaggcaagatagttagtccctgtgatgggccatctaaggtgagttatacactccaaaggcagacgatcttcaatatatccctgatgaagttatataatcatagacccctgaccgagccatctctccagaaaaccgtcctcatcaataatatgctgcgaagaatccaggaggaactgaaacaggaggggagcttgaggcctatgttcacaccaagctcacagccaactacagaacccagcgactcctatagggaggccccaccggctttcagtcatctggcgtcaccctctagccacccttgtgaccttggatccacaaccccgttggaggcgtgtctgaccccagcatctctgttagaagacgatgatgacactttctgtacttcgcaggccatgcagcctactgcccctactaagttgagtccccctgctctgttacctgaaaaggattctttttctagtgcactagatgagattgaagagctgtgtccaacaagcacatctaccgaggccgcaacagccgctacagactctgttaagggcacaagctccgaggcaggaacacagaagctcgatggcccacaggaaagccgggccgacgattctaagctcatggatagcctccccggcaactttgaaatcaccacgtcaactggattcttgaccgatctgacactggatgacatcctgttcgctgacatcgacacctcgatgtatgatttcgacccctgtacttcctcaagtggcactgcatcgaaaatggctccagtctcagctgatgatctattgaaaacactcgctccttatagcagccagccagtcacccctagtcaacctttcaagatggacctgaccgagctggatcacattatggaagtgttggtggggtcatag

SEQ ID NO: 23412 - DNA, 246 bp, Artificial Sequence
  Description of Artificial Sequence: Synthetic coding sequence
atgaagggcagccggatcgagctgggcgacgtgaccccccacaacataaagcagcttaagaggctgaaccaggttattttccccgtaagctataacgataaattttacaagaaattcggcttcgagatcattgagacaaagaagaattattataaacgcattgagccggccgatgctcacgtgctgcagaaaaatctaaaggtgcctagcggtcaaaatgccgatgtgcaaaagaccgacaactag

SEQ ID NO: 23413 - DNA, 1437 bp, Artificial Sequence
  Description of Artificial Sequence: Synthetic coding sequence
atggccagcgccaccgaggaccccgtgctggagcggtacttcaaggggcacaaggcggctataaccagcctggatctctccccaaacgggaagcaactagccaccgcctcctgggacacattcttgatgctgtggaatttcaagcctcacgcgcgggcctaccggtacgtcggacataaggacgtggttacatcagtacagttttcaccacatgggaacctactcgcctctgcaagcagagatcgcaccgtccgattgtggatccccgacaaaaggggtaagttctccgaattcaaagcacatactgcacccgttagaagcgtcgacttctccgcagatggacagttcttggccacagcctctgaagacaagtcgatcaaggtctggagcatgtaccggcagagattcctgtacagtctataccggcatacccattgggttagatgtgccaagttttctccagatggcaggcttatcgtgtcttgctctgaggacaaaacaatcaagatctgggacactaccaataagcaatgcgttaataatttcagcgacagcgtaggatttgccaatttcgtggactttaatcctagtggaacttgtattgccagtgccggctctgatcagaccgttaaggtctgggacgtgagagtgaacaagctgttacaacactatcaggtgcactcgggcggggtgaactgtatctcctttcatccgagcgggaactacctgataactgctagtagcgatggcaccctcaagatcctggatttactcgaggggcgactgatatacaccctgcagggtcatacgggacctgtgtttaccgtctcatttagtaaagggggcgaactgttcgcctcgggaggcgccgatacccaggtcctgctatggcgtacaaactttgacgaactccactgtaaaggccttacaaagaggaatcttaagcgcctgcacttcgattctcccccacacctgctggatatctacccccgcactccacacccccacgaagagaaggtggagaccgtggagattaatccaaaactcgaagtgatcgacctacagataagtactcctccagtcatggacatcttgtcgttcgacagcaccaccaccaccgaaaccagcggccggaccttgcctgacaagggggaagaggcttgtgggtacttcctgaacccgtccttaatgtcaccggagtgtctgccaacaaccaccaagaaaaagactgaggacatgtctgacttgccgtgcgagagccaacgatctatcccattagccgtgacagacgccctggagcatatcatggaacagcttaacgttctgacgcaaaccgtgtccatcctggagcagaggctcactcttacagaagacaagttgaaagattgtctagagaaccagcaaaaactgttctccgctgtgcagcagaagagctag

SEQ ID NO: 23414 - DNA, 1263 bp, Artificial Sequence
  Description of Artificial Sequence: Synthetic coding sequence
atgctgaaggccgtgatcctgatcggcggcccccagaagggcaccaggtttcgtcccctttcttttgaagtgcctaagccactgtttccagtggccggcgtgcccatgattcagcatcatattgaagcatgtgcacaagttccagggatgcaagaaatcctcctcatcggcttctaccagcccgacgagcctttgacgcagtttctcgaagccgctcagcaggaattcaacttaccagtcagataccttcaggagttcgctcctctgggtaccgggggcggactttaccatttccgcgaccagatccttgcaggatcacctgaggccttttttgtcctaaatgctgacgtttgttctgactttcccctctcggcaatgctggaagcgcatcgcaggcagcgacacccctttctgcttctcggtaccactgcaaacagaacgcaaagtttgaactacggatgcattgtggagaacccccagacgcatgaggtgctgcattatgtcgagaaaccgagcacattcatctccgatatcattaactgtggaatttatctcttttccccagaagctctgaaacccctaagagatgtctttcagcggaatcagcaggacggccagttggaagatagtcccggtctttggcctggggccggaacaattcgacttgagcaagatgtattttctgcactcgctggtcagggacagatctatgtgcatctgacagatggcatctggtctcagattaaatctgccggatctgccttgtacgcatcccgcctctacctgtcacggtatcaggatacgcaccccgaaaggcttgccaagcacaccccaggaggcccctggattagaggaaatgtctacatacacccaacggcgaaggtagcccccagcgctgttctgggccctaacgtgtcaatcggtaaaggcgtgacagtgggtgagggagtgagactccgggaatccatcgtactacatggcgcgacgcttcaggagcatacgtgcgtgttgcacagcatcgtcggttggggctccaccgttggccgctgggcacgggtggaagggaccccttcagacccgaaccccaatgacccccgcgcccgtatggactctgaaagcctgttcaaagatggaaaactactgcctgctataacaatcctgggatgtagagtgaggatccccgcagaagttctgattttgaactcaatcgtgctgccccacaaagaactgtcgagatccttcaccaaccaaatcattctatag

SEQ ID NO: 23415 - DNA, 1215 bp, Artificial Sequence
  Description of Artificial Sequence: Synthetic coding sequence
atggaccaggactacgagcggcggctgctgcggcagatcgtgatccagaatgaaaacactatgcctagggttacagagatgagaaggacccttacccctgcaagcagtcccgtgagctcgcctagcaaacacggagataggttcatcccctcccgtgccggcgccaattggtctgtgaatttccaccgcataaacgagaacgagaaaagcccctcccagaatcgaaaagctaaggacgccacctccgacaatggaaaggatgggttggcttactcagctcttctcaagaacgaactcctgggcgccggcattgagaaagtgcaggacccacagacggaggaccgcaggctgcagccttcaactcctgagaagaaaggactgttcaccgttacacgactgtgcgatttgtctgtggagggtgatagcgtgactagcgtgggatggagtgaacgggggaatctggtagctgtagggacacacaaaggctttgtccagatttgggacgcggcggcggggaagaagttatctatgctcgaaggccatactgcccgcgtcggagctctggcctggaatgcagagcagcttagcagcggcagccgcgatcgaatgatcctacaaagggatattagaacacctccactccaatcagagaggaggctccagggacacaggcaggaagtgtgcgggctgaagtggagcactgaccaccagctgctcgcaagcggcggtaatgataataaactcctggtgtggaatcacagctccctgagccctgtccagcaatacactgagcacttggctgcagtgaaggcaatcgcatggtcaccacatcagcacggcctcctggcctctggcggaggcacagctgatagatgtatcagattctggaacacactcacggggcagcccctgcagtgtatcgacactggctcacaggtctgcaatctggcctggtctaagcatgctaatgagctcgtatcaacccacggctacagccagaatcaaatccttgtgtggaagtatccatctctgacccaagtagctaagcttactggtcactcctatagagtgctttacctagctatgtcccctgatggcgaagctattgtaactggcgcaggagatgagacactacggttctggaacgtgttcagcaagacccggagcacgaaggagtccgtttcagtactaaacttattcacacgcatccggtag

SEQ ID NO: 23416 - DNA, 5892 bp, Artificial Sequence
  Description of Artificial Sequence: Synthetic coding sequence
atgaagcagcggaagggccagggcagcggcggcagccggggccggaaaaaacgaggcctcagtgatatcagtcctagcacaagtttaccccctctcgtggaaggacagcttaggtgcttcctcaagctgacggtgaatagagttatctggaagatagcgaagcccccgacttgcgttctggtacgagtgcggtggtggggagaaacctcggatggcacactgttttgtccccgtgatgctttgcagaccgagcccaaagcagtgcgcacgacgacgcgctacgccatacgctgtggaccaaaacaattcacttcttaccttaccgacatggcggtcctggtgctggaagtgatcacgaaactcgacggcctgccaataggccgcgtacagatcaatggactggcacagctttccccgactcaccagataaacggattcttcaccatcgtttcgagtacctctaaaaagttgggtgaattgcaggtatcattagccctggagccactttctgagacctatgactcttatcacccgctacctaccaccgacatgacagaaaacgtcctgctgagcaaacaggggttcagggagaataccgaacccagctctacacagtttcaggtgccgagccgtcctagagatattcacacgattaaaatcgatggtaaagaactggccgctaatagcagtcggagcaccactccaaggggtaaagaccatgtgtgttttgccgaaaaccctgacaccattaaagattccagctttggcttgcagcatagcctgaattccggacagagcctcgagtctgttaccctaaaaggacgggcgccacggaaacagatgtctctgctgaacagcagtgaattccagccacagataaggaccgttgccaagagtcattctgatagctgtatcctgtcttccaataacttacccactaaagaccttcttagtgccctattggagcagggcaacaaattgagaaatgcaatggtcatttccgccatgaaaagttcccccgagacatctatgctgcttgatcaggtgcatccccctatcaacgaggatagcttacgggccagcacccaaataagagccttctcccgaaaccgattcaaagaccacatagaagatcacctgctgccctctaccgagaatacattctggaggcatgacaccaaagccgacactagggctattcaactactcctgggctccgccgaactgtcccagggaaatttctgggacggcctgggatcacctcccgatagcccaagtcctgggtcagatgtctactgcatttctgagttgaatgacccacagtacgatcaaagcctgctggagaatctcttctacaccgcaccgaaatcagatacaagtatttctgattttctgtcggaagaagatgatatcgttcccagtaagaaaattagtcagtcgacagctttagctcgcagcagcaaagtccttgagtccagtgatcataagctgaaaaagagaagcgctggaaagaggaatcggaatctcgtggaacaacaaatgcttagcgaaacaccggaagacgcccagactatgaccctgtctgtcgacagactggctcttcttgggagaactcattccgtgcggattatcatcgagaccatgggtgtgcctcctgactccccacagatgacgccaggaaagaagtcatacgcaggacctcccccgaaggttacaaccgcaaaaaagaggacattttttgtggagtaccactttcctgtcggtttcagcgagtcaggcctagggaagacagccctgatcacggaggtcgtgaggttagcatcttcgaagatcactgacggcaaagtcaagttccagcaacgcttcgtttttcccgtgcagtttggcggccctatgatcgagcactggtggaattctaatctgactttccagatctatgtcaagaagacacctcagaaaaaaccagaagtgataggatccgtgagtctctccctgagagctgtgattcagtctgagctgctgagcttttctgaccagctgcccgttcaacaggagaacggccagtccccgttcggcccccttaaagtcacaatggagctgattaccgataacaaggacttcaccggaatcaatacaaagctgtcaggcaacactcactacactcctctgtgcgctccaacatccccaaataaggcactcccagaattaaaccaggatatgacttgtaccaaaaatcctcagaatctcaatcaaatccatgaagagacggccaaaaaggcccagaatttggtcctgcccaaccgaaaatccccctctcccgtggccccacacccgtctacgtttgtagcgacgcccgcctcacacaacctggtgaaccagacaaatgggaccacaaaggagagcgcactactccttcacgtgcttctgatggtccccgacggtaaagactttatcagcggggagtccgaaaaacagtccccgtgtaacgtgtatctgaactgtaaacttttcagcactgaggaagtcacaaggtcggtgatcgcctggggcactacccagcctgtatttaattttagtcaggtgatccccgtttcattgtcctcgaaatatctggagaggttgaagaacaatgtgatggtgattgagacatggaataaggtccggtcacccggccaggataagttactcggacttgtcaagttgccccttcatcagttctacatgagcttcaaagatgccaagatttccaggttgctcttggatgcccagtatcctgtggtcgccgtagatagttacatgccagtgatcgacgtgttcagcgggcatcagaacggctctcttagagtctttctagcgatgggctcctccaatcaaattatggctttacagcggcttaaaaacgaagaaggaaccctgccacccttttccccgaggcccgcgcactttctggatcagccaaccgccgctagtgtggcaatggcagaggacagaggcaatgggctgatggagcactgcttcgagatccacattgaaatggtgaagggcctcgctccattgcaagccacggtgtggggtgaagccgactgttatgtacagtattactttcccgttcagcacagccagtcctccgttctgaaaggacctgaattcctggaaaacgggatcacattgaagccctttcgaaccgcgactacgctctgcgtacccgacccaatcttcaactcagagcaccaccactccctgctgttgccagccgaagtgccggtgcaaagactgttgctgagcgcattcagcgcccagggcctcgtgcccgggggaggagtccagtttgaaatctggtgccggtattactaccccaatgtgagagaccaaaaagtcgccaagggtaccctgccgctgtcgagaatatgcgccatggttactacacagcaccgggaggacgtaggaatccagacgtttaacttacctctgacaccccggatcgagaaccggaaagagctgcgaaaccagagctctggcctgctcgacgtgggcttacgttaccgtcgaagcccccgcactgcagagggggtcctggctgcccgcactgtgagcatttcagtgcagatcattcgagcatgcggtctgcaggctgcggccaaagctctggcagaaagagagcctgcccttcagttcagcgctactgtcggtgtgaatgcatcagtcacgacgcatctgtcatttcttccccagggcgaacagcgcaggactcaccccgttgcttgctctttctgcccggaatttagtcatcatgtggaatttacatgtaatctggtcacacagcattgctccggcgaggcttgtttcctggctgaacttctggagtttgccgaggtcatttttgcagtctatcatgaaaatactaaatcagcttccgatataatctccatagagtcttgtaaggaatatctcctgggtgtggtgaaagtgcctacaaaagagctgttaatcaagcgttccggtatcacggggtggtatcctattatcctgcctgaagacggaggtctccctcacgggttggaactgatgcaaaaaatcgtcggcggactcgagctctccatctccttcactcatcggggtgaccgcgagcgagtactcgaggcagcagaacacttagggtggagtttcgaaaattcactaaaggacttcgtgaggatggatgagggcgagccagccaccgtgacaatatcaacccccagactgtggcttccaatccactgcgttcttttggcgggccacaatcacatccataaaaatacttactgctacttgcgctacaagttttacgaccatgaagccttctggacgcctctgaagaaaccaaaagagagcgtcaacaagaaacaaattatggttaccttcaaagcctccaaaagggcggaggtcaccaggggcccatccttgttatggtacttcagggaggagagactggaaattcaggtctggcgggcttatggtaatgatagcgtcgaaagaccccaccagactgactcctggataggatccgcatacgtagacttggccagactgggcgagcgttccgcccggactctcacggtttccggtgtgtacccactcttcggccgcaacgcgagcaacctgtcaggagcagccctgagggtgcatgtcgttctctcctccctcagcagccacctcgagcccacccacgagctcgatagtatggactgctctagccactccgagtcagagcaattaccccgtagaaatgatgaggtgcaattgagccctccagaagtgatctcctgtcaccagaagagtccggccagtacccaagtaccttgttcatctaccacagctgaagtgcgcctgactcaggagggccccgcagacctcgatggcacattcgctgtctccattctggttgagagggccatgcacctgagtctgaaagggtctcccctgaccgagagaaaggtgagcataccaagctgctgcgtctcttttgccaccgcagacgagagcagccccgtgtacacacaggttgtcgaaaacacggattctcccatttggaacttccagcagcagagcaggttgagcaaagagctcctgttggaccctcagcaaaccttggtgttcaaggtgtggcataagggcgacgaggagcgggtcataggttttgcaagtgtcgacctctcccccttgcttagcgggtttcaattcgtgtgcggatggtacaatattactgatttcagcggagaatgtcaaggtcagatcaaagtcgccgtctccccccttgagtccctcatccactttaaggaagagcgccaagcccgcaggggagttgaaacaagtaagagcctgatacctatatattctcctttttccttccccgcaagcgacacctacgcagcattttccagccacatggcccgccagactcttgaccagctggcccatgcgagttccaaggagctggacttcagtagccccggtcgcagcgacaccacgcgttcccaggcgtccagacatgaggaacatgttcagaacatcaggcggtttcacgaatcactgcacctgcagggtgaggccccccttccatgtgacgacaaactgacaacatcgcctctctcatctcagacatccatacttacctcgttgagaaaaaacctatctgagctggatcaaattcagaggtactttaggcagaagttaacaaagccgtttcttccattgtctccccagacccagacagcaatctcccagcatcaggagagctgtcgagaccatctgggacccggagcgagttcactagatcctggttcccagtgcattctagagaagtcatccaatctggtgttacaagtttcaagcctgattaccggttcatattag

SEQ ID NO: 23417 - DNA, 5586 bp, Artificial Sequence
  Description of Artificial Sequence: Synthetic coding sequence
atgaagcagcggaagggccagggcagcggcggcagccggggccggaaaaagcgcgggctgtccgacattagtcctagtacttcacttccaccgctggtagagggccagctgcggtgtttcctcaaactcacggtcaaccgcgtgatctggaaaatagccaaacccccaacgtgcgtgctcgtgcgtgtgcgttggtggggagaaacgagcgacggcacgctcttctgcccaagagacgctctgcaaactgagcccaaggccgtgcggacaacgacccggtatgctatccggtgtggccccaagcaattcacctcctacttgacagacatggcagtcctggtcctggaggttatcacaaaactggacgggctccccatcgggcgcgtccagatcaacgggcttgcacagttatctccaacccaccagattaacggatttttcactattgtatccagcacaagcaagaagctcggtgagcttcaggtgtctttggccctggaaccgctgtctgaaacatatgactcgtaccaccccctgcccactacggacatgaccgagaacgtgctgctcagtaagcaagggtttcgcgaaaatactgagccttcgtcgactcaattccaggttccttcgagaccccgggatatccatactatcaaaatcgatgggaaagagctcgcagcgaattcctcacggagcacaactccccgcggcaaggaccacgtgtgcttcgctgaaaatcccgataccattaaagattctagctttggtcttcagcatagtcttaatagtggacagtctctggaaagcgtgacactgaaaggtcgggctccaagaaaacagatgagcctattgaatagttccgagtttcaaccccaaattcgtacggtggcaaaatcgcatagtgattcttgtatcttgtcttccaacaacctgccaactaaagacctgcttagtgctttgttggaacagggaaacaaacttcggaatgcaatggtgatttctgccatgaagagctcacctgagacaagtatgctgcttgatcaggtccatcccccaatcaacgaagacagcttgcgagcatctactcagatacgcgctttcagcagaaataggttcaaagatcacattgaggatcatctgctgccatccactgaaaacactttttggaggcatgacacaaaggctgacactagggccatccaactcctgttaggatccgccgaactgtctcagggtaacttttgggacggtctcggatcccctccagactcaccgtcccctggcagcgatgtctattgcatatctgaactgaacgatccccagtacgaccagtccctgctggaaaatctgttttacacagcaccaaaatccgacacttccatctccgatttcctctctgaggaagatgacattgttcccagcaaaaagatctcacagtctactgcactggcccgctcctctaaggtgttggaatcctccgaccacaagctcaaaaagcgcagcgctgggaaaaggaatcgcaatttagtcgaacagcagatgctcagtgaaacgcccgaggacgcccagacaatgaccctgtctgtcgacagactggctctgttaggaaggacacactcggtgagaatcatcatcgagaccatgggggtgcctccagactcgccgcagatgacccccgggaagaagagctatgcagggccccccccgaaggttaccacggccaagaaaaggacgttttttgttgagtaccacttccctgttggatttagcgaatcagggctgggcaaaacagccttgataaccgaggttgtgagattagcctcctccaagattacagatgggaaagttaagttccagcagagattcgtattcccggtgcaattcggaggccccatgatcgagcactggtggaattccaatcttacattccagatttacgtcaagaaaacccctcaaaaaaaacctgaagtgattggtagcgtatcgctatcgctgagagccgtgatacagtccgagttgctttccttttctgatcaactgccagtccagcaggagaatgggcagtcgcccttcggccccctgaaggtgactatggaactcataaccgataacaaggatttcactggcattaacaccaaactcagtggcaacacacattatactcccttgtgcgcccctacctctcccaacaaagctctgcctgaattgaaccaagatatgacctgcactaaaaacccccaaaatctgaatcagatacatgaggagacagccaaaaaggctcagaatctcgtgttaccaaatcgaaagtccccctcgcccgtggcacctcatccttccacattcgtagccactcccgcctcccataatctggtgaaccaaaccaacggcacaacaaaggaatccgcactgctgctgcacgtgctcctgatggtgcccgatgggaaagacttcataagtggggaatcagaaaaacaaagtccctgcaacgtctatttgaactgtaaactcttctcgacagaggaggtcactagaagcgtaattgcttggggcacgacacagcccgtcttcaacttttctcaagtcatacccgtttcgctgagttccaagtatctggagcgactcaagaataacgttatggttattgagacctggaacaaagtccgctccccagggcaggataaattgctcggtttagtcaagttacccctgcatcaattctacatgtctttcaaagatgcaaagattagcaggcttctgctcgacgctcagtatccagtggtggccgtcgattcctacatgccggtgatcgacgttttttcggggcaccagaatggttcattacgcgtgttcctggcgatgggaagctcaaatcagattatggctttgcagcgccttaagaacgaggaggggacacttcctcccttctccccccggccagcgcacttccttgaccagcctactgcggcatccgtggcgatggcagaagatagaggaaatggcctgatggagcattgcttcgaaatccatatcgaaatggtgaagggcttagccccccttcaagccactgtttggggcgaagctgactgctatgtgcagtactactttccagtgcagcatagccagagcagcgtacttaaggggccagagtttctggagaatggcatcaccttgaagccttttcgcactgcaacaactctctgcgttcccgatcccatcttcaactccgaacatcaccatagcctgctactaccagccgaggtaccagtgcagcggctccttctgagtgcattttccgcgcaaggcctcgttcccggcggcggggtgcagtttgagatctggtgccggtattattaccctaacgtgagggatcagaaggtggctaaagggaccctgcctctgtcacgcatctgcgccatggtgacaacccagcaccgcgaggacgttggtattcagacgtttaacctgcccctgacaccgcgcatcgaaaaccgcaaggagctgcgtaatcagtcttccggtctgttagatgttggcctacgctatcgtcgatcacccaggaccgccgagggtgtcttagccgcccgcaccgtcagtatctccgtgcagataatccgggcctgcgggctgcaagctgcagccaaggcattggccgaacgcgagccagccctacaattctccgctaccgtgggagtgaacgcctccgtgacaacccatctgtcatttctccctcagggcgaacagaggaggactcacccagttgcttgctctttctgccccgaattcagccatcatgtcgagtttacttgtaatcttgtgacacaacactgtagcggtgaagcctgctttctcgcggagctccttgaatttgctgaagtgatctttgccgtatatcacgaaaatacgaaatcggcttccgacattatcagtatcgagtcttgtaaggaatatctactgggcgtggtgaaggtgcccacgaaagaattgcttatcaaacgaagtggaataaccggctggtaccctatcattctacccgaagacggaggattgccccatggacttgaactaatgcaaaagatcgtgggcggactcgagcacctgggctggtcctttgaaaactcactcaaggattttgtccgaatggacgagggagaacctgcaactgtcaccatctccactccaagactgtggctgcctatccattgtgtgctgctagcgggacacaaccatatccacaaaaacacttattgctaccttaggtataaattttacgaccacgaagctttctggacccctttaaagaagcccaaggaatcggttaacaagaagcaaattatggtcacttttaaggccagtaagagggcagaggtgacgcggggcccttccctgttgtggtattttagggaagagcggctggagatccaggtgtggcgcgcctacggtaacgattctgtggagaggccacaccagacagattcctggatcggtagcgcctacgtcgatcttgcccggctcggcgagcgcagcgccagaacactgacagtttcgggagtctaccccttgttcggccgaaatgctagcaatcttagcggagctgccctgcgtgtgcatgtggtgctgtccagtctgagcagccaccttgaacctacccatgaacttgactccatggactgctcctcacactcagagtctgagcaactcccacggagaaatgatgaagtgcagcttagcccacccgaggtgataagttgtcatcagaaaagcccagcttcaacccaggtgccttgcagttctactaccgcggaagtcaggctgacgcaagagggtcccgctgacttagatggaacctttgctgtttctatcctggttgagagggctatgcacctgtctctgaagggcagcccactgacagagagaaaagtgtcaatccccagctgctgcgttagcttcgcgaccgctgacgagtccagtccagtgtacacacaagtggtcgaaaacacagattcaccgatatggaatttccaacagcagtctagactttcaaaagagcttcttctggatccgcagcagaccctggtgtttaaggtctggcacaaaggcgatgaggaacgagtgattggtttcgcgtccgtggaccttagcccccttctgtcaggcttccagttcgtgtgtggctggtataacataacggacttctccggcgaatgccaggggcaaataaaagttgctgtaagtccgttggagtcactcatccacttcaaagaggagaggcaggcgaggcggggagtggaaacgtccaaaagtctgatccctatctactctcctttttcattcccggcatccgacacatatgcggccttttctagtcatatggcacgccagactcttgatcaacttgcgcatgcgagtagcaaagagctcgattttagctctcctgggcgaagtgacactacccgtagccaagcaagtaggcatgaggagcatgttcagaacatacgccgtttccatgaaagcctgcacctacagggcgaggctccattaccttgcgatgacaagcttactacatcccccctgtcctcccaaacttag

SEQ ID NO: 23418 - DNA, 1131 bp, Artificial Sequence
  Description of Artificial Sequence: Synthetic coding sequence
atgctgaccttcctgcagcagctgcgggtggactggcccgccgcctccgagagagccagttcccatacgctcaggagtcacgcactggaggaacttacatccgccaacgacggtcgaacactgagccccggcatcctggggagattatgtctgaaggagctagtggaggagcaggggcgaacggccgggtatgatcccaatctagacaattgcctcgtgacggaggacctgctgagcgtactagcggaattgcaagaagccctttggcactggccagaggatagccatcctggcctagccggcgcaagcgataccggtactggtggttgtttagtcgttcacgtggtgtcgtgcgaagaggagttccaacagcagaagctcgacctgctatggcagaaactcgtggacaaggcccccttacggcagaagcacctcatttgtggccccgtcaaggtggcgggagcaccaggtactctgatgacagccccagaatattacgagtttcggcacacacaggtgtgcaaagctagcgctctgaaacatggcggtgacctggcacaggatccggcatggacagaaatctttggtgtcttatcagtagccacaattaagttcgaaatgctgtccaccgcaccccaatctcagctcttcctcgccttggcggactcatctatatccactaaggggaccaagagcggtacctttgtcatgtataactgcgcccgcttggccacactgttcgagtcctacaaatgttcaatggagcagggcttgtatcctaccttcccccctgtttcttctcttgactttagtctcctgcacgatgagggagagtggctgctcctcttcaacagtatcctgccttttccagacctgcttagcaggaccgccgttttggattgcacagctcccggcctccacattgcagtccgcaccgagatgatctgtaagttcctcgtacagttgtccatggactttagctcctactacaatagagtccatattttaggggaacctaggcctcacttattcggccaaatgttcgtgcgtctgcagctcctgcgagcagtgcgtgaggtgctgcatacaggattggcaatgttagggctccctccactctctcacatctag

SEQ ID NO: 23419 - DNA, 1572 bp, Artificial Sequence
  Description of Artificial Sequence: Synthetic coding sequence
atgaaccagccctgcaacagcatggagccccgggtgatggacgacgacatgctgaaattggcggtcggcgatcaaggtccacaagaggaggccggccagctcgccaagcaagagggtatcctgtttaaggatgtgctctctttgcagctggatttccgcaacatcctccgaattgataacctctggcagtttgaaaacctaagaaagttacagctcgataacaacattatagaaaaaatcgagggcctcgaaaacttggcccatctggtgtggttggacctgtcattcaacaacatcgagaccatcgagggtctggacactctggtgaatctggaggatctgagcttgttcaataaccggatttctaagatagactccctcgacgcgcttgtaaagctacaggtcctttcactcggtaacaatcgcattgataacatgatgaacatcatttacctgagacgatttaagtgcctgcgtacactctctcttagccgcaaccctatctctgaagcggaggactacaaaatgtttatctgtgcttacctgccggacttgatgtacctggactaccgccggatcgacgaccataccaagaaactggccgaagccaagcaccagtattctatagacgagctgaagcatcaggaaaacctcatgcaggcccagctggaagatgaacaggcacagagggaagagctggagaagcacaaaaccgcattcgtggagcacctcaacgggtccttcttattcgactccatgtatgccgaggatagcgaaggcaacaacctgtcatatttgcctggcgtaggcgagctgctggagacctataaagacaagtttgtcatcatctgcgtgaacatttttgagtatggcttgaagcagcaggagaagcggaagacagaattagacaccttttccgaatgtgtaagggaagctatccaggaaaaccaggaacaggggaagaggaagattgccaagttcgaagaaaagcatctgagttcattatccgcaatccgcgaggagttagagcttcccaacattgaaaaaatgatactcgagtgcagtgctgacatttccgagctttttgatgctcttatgacgcttgaaatgcaactggtggaacagcttgaggaaacaattaacatgtttgaacggaatatcgtcgatatggtcggtttgttcatagaaaacgttcagtctctgatggctcagtgcagggacttggagaaccaccatcacgagaaactgctagagatttccatctcaacactggagaagattgtggaaggtgacttggacgaggatctcccaaatgatttgcgcgccctctttgttgataaggacacgatagtgaacgccgtaggagcttctcatgatatacacctgttaaaaatcgacaaccgcgaagatgaactggtaaccagaatcaacagttggtgcactagattgatcgaccgcatacacaaggatgaaattatgcgaaatagaaagagagtcaaggaaataaatcagtacattgaccacatgcagtccgaattggataatctggagtgcggggatattttggattag

SEQ ID NO: 23420 - DNA, 1680 bp, Artificial Sequence
  Description of Artificial Sequence: Synthetic coding sequence
atgaaggtgatcacctgcgagatcgcctggcacaacaaggagcccgtgtatagcctggactttcaacacggaactgctgggcggattcatcgcctggcttcagccggtgtcgatactaacgtccgtatttggaaggtggaaaaaggaccagatgggaaagccatcgtcgagttcttgtccaacctggccagacataccaaggctgtgaatgtggtccgtttctctccaacaggagaaattctggcctccggcggcgacgacgccgtcatcctgctgtggaaggtgaatgacaacaaagaaccagagcagatagcctttcaagacgaggatgaggcacagctgaataaagagaattggaccgtcgtgaagacattgaggggccacttagaagatgtatacgatatctgctgggcgactgacggaaatctcatggccagcgcctcggtagataataccgccatcatctgggatgtaagtaagggacagaagatctccatattcaacgagcataaatcgtatgtgcagggcgtgacctgggaccccctgggacagtacgttgcgaccctgtcctgtgacagggtgctgcgggtctactcaatacagaaaaagcgcgtggcgtttaacgtgtcaaagatgttatcagggatcggcgcagagggggaagctagaagttaccgcatgtttcatgacgactccatgaaatctttcttccgacgcttatcttttactcctgacggatccctgctgctgacacccgccggctgcgtggaatccggagagaacgttatgaatacaacctatgtattctcacgaaagaacctcaagagaccgatcgctcatctgccatgccctggtaaggcgacattagctgtccggtgctgccccgtgtacttcgaactgcgcccggtggtggaaacaggtgtcgagctgatgagtctgccctatcggttggtattcgcagtagccagcgaagactctgtgttactgtacgacacacagcagtccttcccctttgggtatgtttccaatattcactaccatacactttcagacatctcttggtcctccgacggagcatttctagccattagcagcactgacggttattgtagctttgtaaccttcgaaaaggacgaacttggtatcccccttaaggaaaaacctgtgctgaatatgcgaacacctgacaccgcaaaaaagacgaagtcccagacacatcgaggttcgtccccaggcccccgtccagtggaggggactccagcctctagaacccaggacccgtctagcccaggcaccacaccaccacaagctaggcaggcccccgcccccactgtgatccgggacccacctagcatcacccccgcagtgaagtcccctctgcccggtccttcggaggaaaagactctgcagccttcatcgcaaaacacaaaggcgcatccatccagaagagtgaccctcaacacgttgcaggcttggtctaaaactactccaaggcggatcaatctcacccctctgaaaaccgacactccaccaagtagtgttcctaccagcgtgatttccacacctagcactgaggagatccagtctgagacccccggtgatgcccagggcagtcctcctgagctgaagcgccccagactagatgagaacaagggggggaccgaatccttggatccttag

SEQ ID NO: 23421 - DNA, 1527 bp, Artificial Sequence
  Description of Artificial Sequence: Synthetic coding sequence
atggccgacggccaggtggccgagctgctgctgcggcggctggaggcttccgacggtggactcgattccgccgagttagctgctgaactgggtatggagcaccaggcggttgttggggcagtcaaatcgctgcaggctctgggcgaggtgatcgaagccgagctacgctctacaaaacattgggaacttacagccgagggcgaggaaatcgctagggagggctcgcatgaggcacgtgtattccgttccattccccccgagggactggcgcagtcggagctgatgaggttaccttctggcaaagttggattttccaaagcaatgtcaaataagtggatacgggtggacaagagcgctgcagacggcccacgcgtgtttagagttgtcgactcaatggaggatgaggtccagcgaaggctccagctcgtgagggggggccaggccgaaaagcttggagagaaggagagatctgagctccgtaaacggaaactgcttgcagaagttaccttgaagacatactgggtgtcaaaaggatccgcatttagtacctccatcagcaagcaggagactgaactgtccccggagatgatctctagcggctcctggagggatcggccctttaagccctataactttttagcccacggagtactgccagactcagggcatctccatcccctgttgaaggtgagaagccagtttcgccaaatcttcctggaaatggggtttacagaaatgcctacggataacttcatagagagttctttctggaacttcgacgccttatttcagcctcagcagcacccagcaagagatcagcacgacaccttttttctgagagatccagcagaggctctccagctcccaatggactacgtgcaacgcgtgaagaggactcattctcagggcggttacgggagtcaaggttacaagtataattggaagctcgatgaggcacgcaagaatctcctccggacccataccaccagcgcgagtgccagggccctttacagactggcacagaaaaaaccctttacccccgtgaagtactttagtatcgaccgggtctttaggaatgagactctggatgctacgcacctggctgaatttcaccagatcgagggggtcgtggcggaccacgggttgacactaggtcatcttatgggcgttcttagagaatttttcactaaactggggattacacaactacggtttaagccagcctacaatccttataccgagccttccatggaagtcttctcctaccatcagggattgaaaaaatgggtggaagtgggaaactccggagtcttccgccctgaaatgctgctgccaatgggactgcccgaaaacgtttcggtcattgcgtggggactgtcgctggaacgtccaactatgatcaaatacgggatcaacaacatccgcgagctggtggggcacaaggtcaacttacaaatggtgtacgactcgcccctgtgcagattggacgcagaacctcgccccccacctacccaagaagctgcctag

SEQ ID NO: 23422 - DNA, 1203 bp, Artificial Sequence
  Description of Artificial Sequence: Synthetic coding sequence
atgagcagccccctggccagcctgagcaagacccggaaggtgcccctgccaagcgaacctatgaaccctggcagaagagggatccggatttacggcgatgaagacgaagtggacatgctttccgatgggtgtgggtcagaggagaagattagcgtgccctcatgttacggcggtatcggtgcgcctgtgtcaagacagggagacagtctggcccctcctgaggtcgattttgatcgtctcctggctagccttcaggacctaagcgagctcgtcgtagagggtgacacccaggtcaccccagtgccaggcggagctagattgcgcactctggagcctattcccttgaagctatatcgcaacggtattatgatgtttgatggccccttccagcccttttacgatccaagcactcaaagatgtttgagagacattctcgacggctttttcccttccgaattacagagactctacccaaacggcgttcctttcaaagtgagcgatctacgcaaccaggtgtacctcgaggatggtttggacccttttcccggcgagggccgagtggttggacgacaactgatgcacaaggcactggaccgggttgaagaacacccagggtcccggatgactgctgaaaaattcctcaataggttacctaagtttgtgattcggcagggggaggtcatcgacatccgaggacccatccgggatacactgcagaactgttgccccctgcctgcgcggattcaggaaatagtcgtggaaaccccgacacttgcagctgagagagagcggagccaggaatctcccaacactcctgcacctcctctatctatgcttcggatcaagtccgagaatggcgagcaggcatttttgcttatgatgcagcctgacaacactattggtgatgtcagagctcttctggcccaagccagagtgatggacgcgtccgccttcgagatcttctcaacatttcctcccactttgtatcaggacgataccctcactctgcaagccgcgggtctcgttccaaaggccgcccttttgcttcgcgccaggcgcgcccccaagagcagtctgaagttcagcccaggaccctgtccaggaccgggccccgggccatcacctgggccaggaccaggacctagcccaggaccagggcccggaccctctccctgccctggaccgtctcccagtccacagtag

SEQ ID NO: 23423 - DNA, 1350 bp, Artificial Sequence
  Description of Artificial Sequence: Synthetic coding sequence
atggccagcgccctgcggcccccccgggtgcccaagcccaagggcgtactcccctcacactattacgaaagttttctggaaaagaagggtccgtgtgatcgggattacaagaaattttgggccggtctgcagggtctgaccatatacttttacaacagcaaccgggacttccaacatgtcgaaaaactgaacttgggtgctttcgaaaagctgacggacgagattccatggggaagctcccgtgatccaggcacacatttctctctcatcctgcgggaccaagagatcaaatttaaagtggagacacttgagtgccgggagatgtggaaggggttcattctcaccgtcgtggagttgagagtgccaacagacctaacactgctgccgggccacttatatatgatgtcggaggtgctggcaaaggaggaagcgcgccgcgctctggaaacgccctcctgtttcctgaaggtgtcacggcttgaagcccagcttcttctcgagaggtatcctgaatgcggaaatttgctcctgaggccttccggagacggcgccgatggcgtcagtgtaacaacacgacagatgcataacggtacacatgtcgtccggcattacaaggtaaagcgagaaggaccgaagtatgtaatcgacgtggaacagccatttagctgcacttcactggacgctgtggtcaattacttcgtgagtcacacaaagaaggccttggtcccatttcttctggatgaagattacgagaaggtactggggtacgtcgaagctgataaagaaaatggtgaaaacgtctgggttgccccgtccgcaccgggccccgggccagctccctgcaccggaggcccaaagcctctgtctcctgcctcctcacaagataagctacccccattgcccccactcccaaaccaggaagagaactacgtgacccccattggagacggccccgcagttgactacgaaaaccaggacgtggccagctcctcttggccagtaatcctcaaacctaagaagctccctaaacctcccgcaaaactgcccaaaccgccagtcggcccaaaaccagttgaaaagggctttcaccatgtggcacaggcaggcctcgagctattaacaagttctgatcctcctactagcgcttctcaaagtgccggtatcacgggcgtctcccaccacacatggccgcatctgtcctctctccctgaacctaaagtttttaatggtggactggggaggaaacttccggtgtcgtctgcccagcctctctttccaacggccggcctggctgatatgactgccgaattgcagaagaagcttgagaaaaggcgggcgctcgaacactag

SEQ ID NO: 23424 - DNA, 1239 bp, Artificial Sequence
  Description of Artificial Sequence: Synthetic coding sequence
atggaccccatccggagcttctgcggcaagctgcggagcctggccagtacattggattgtgaaacagcgagactgcagagggctctggacggagaggagtccgatttcgaagattaccccatgaggatcttgtacgacctacacagcgaggtgcagacactgaaggatgacgttaacatccttctggataaagcccggctggaaaaccaggaagggatcgactttatcaaggctaccaaagttttgatggagaaaaacagcatggacatcatgaaaatccgggaatacttccagaaatacggatattcaccccgcgtgaagaagaattctgtacacgaacaagaggcaatcaattcagacccagagttgagcaactgcgaaaatttccagaagacagatgtgaaagatgacctgagcgatccccccgtggcttcaagctgtatctccgagaaatccccccgttcacctcagctcagcgacttcggcctcgagagatacatcgtcagccaggtgctgccaaaccctccccaggccgtgaacaactacaaggaagagccggttattgtcactcctcccaccaagcagagcctcgttaaggtccttaaaacgccaaagtgtgcgctgaagatggacgacttcgagtgcgtaacacctaaacttgaacatttcgggatttccgagtataccatgtgcttgaacgaagattataccatgggactcaagaatgcccggaataacaagagtgaggaggcgatcgatactgagagccgtctgaatgataatgtcttcgcaaccccttctcccatcatccagcaactggagaaatctgacgccgaatataccaattccccactggtaccgacgttctgcactccaggtctgaagatcccatctacaaaaaatagtatcgcactagtgtccacgaactatcccctctcaaaaacgaacagctcctctaatgatttggaggtggaagaccgtacctcactggtccttaattccgatacttgttttgaaaatctgactgacccttccagccccaccatctcaagttacgaaaatctgttaaggacgcctacgcctcctgaggtgactaaaattccggaagacatcctacagttgctctctaagtataattctaacctagcgactcctatcgccatcaaggcagtgccaccttctaaacgcttcctcaaacacggccaaaacattagagatgttagtaacaaggaaaactag

SEQ ID NO: 23425 - DNA, 2583 bp, Artificial Sequence
  Description of Artificial Sequence: Synthetic coding sequence
atgaccgagggcaccaagaagaccagcaagaagttcaagttcttcaaatttaaaggcttcggttccctgtcaaatctgccacggagcttcacactacggaggtcttctgcctctatcagccgccagagccacctggaacccgacacattcgaagccacacaggatgatatggtaacggtccccaagtcacctcctgcctacgcccgatccagcgatatgtattcccatatggggaccatgccacggcccagcatcaagaaagcacagaatagccaggccgctcggcaagcacaggaggccggtcctaagcccaatctagtgcctggtggcgtccctgacccacccggactagaggccgctaaggaagtgatggtcaaggccacaggcccactggaggatacccccgccatggagcctaacccgtctgcagttgaagtcgatccaatccgtaagcctgaagtgcccacaggagatgtagaagaagagcggcctcccagagatgtgcatagtgagcgtgcagctggagagccagaagctggctcagattacgtgaagtttagtaaagagaaatacatcctggactcttcacctgaaaagctgcacaaggagcttgaggaggagctcaagctcagctccaccgacctgaggtcacatgcctggtatcatggtcggataccccgtgaggtaagcgaaaccctagtgcagcggaacggcgatttcctgatcagagattcccttacaagcttaggcgattacgtgctcacttgccggtggaggaaccaagccctccacttcaaaattaacaaggttgtggtgaaggcgggagagagttatacacacattcagtatctctttgaacaagaatcatttgaccatgtccccgcactggtacgataccacgtggggagtcgcaaggctgtgtctgagcagagcggcgctatcatttattgcccagtgaaccggaccttcccgctccgctacctggaggcttcttacgggctgggacagggcagttcgaagcctgctagcccagtatctccctcaggccctaaaggctctcatatgaagagacggagcgtaacaatgactgatggtctgactgctgacaaggtgaccaggtcggacggatgtccaaccagcacatcgctgccacgtcccagggacagcatcaggtcctgtgctctgtcgatggaccagatcccggacttgcactcaccaatgagccctatctctgaaagtccttcatcacccgcctacagcactgttacacgcgtgcacgccgctcctgccgcaccttctgcaaccgccctgccagcttctcccgtggcccgacgtagctctgagcctcagctgtgcccagggagcgccccaaagacacacggagaaagcgacaaggggcctcacacaagccctagtcacactctgggaaaagccagtccatctccctctctgagctcctatagcgacccggacagcggtcactactgtcagttgcagccgcccgtccggggatcccgagagtgggcagccaccgagacttcaagccagcaggcaaggtcttatggggagagactgaaggagctttcagaaaatggagcacctgagggagattggggaaagacatttaccgtcccaatagtcgaagtgacctcatcttttaatcctgctacttttcagtctctgctcattccacgggacaatcggcccctggaggttggcctgttgagaaaggtcaaagagctacttgctgaggtggacgctagaaccctcgccaggcatgtgactaaggttgactgtctggtggcccggattttgggagtgactaaagagatgcagactctgatgggagtgcgctgggggatggagcttctgactctgcctcacggccgtcagctcagactcgacttattggagcgctttcataccatgagcatcatgttggccgtcgatatcctcggttgcaccggttcagccgaggagcgcgccgcactgctgcataaaaccattcagctagccgcagaactcagggggacgatgggcaacatgttctcctttgccgctgtgatgggggcattagatatggcacaaatcagcagacttgagcaaacatgggtgacattgagacagagacacacagagggcgctattctctatgagaagaaactcaagccatttcttaaatccctcaatgaaggaaaggagggcccacccctgtctaataccactttcccacatgtccttcccctgataaccctgctcgaatgcgactctgctccacctgagggcccagaaccctggggttcaactgaacacggtgtagaggtggtgctggcccacctggaagcggccagaactgtcgctcaccatggcggcctttatcatactaacgcggaagttaagctgcagggattccaggccagacctgagcttttagaagtcttttccaccgagtttcagatgcgtctactgtggggctcccagggtgcatcatcatctcaggctcggaggtacgaaaagtttgataaagtgctcaccgccctttctcacaagcttgaacccgcggtgagatcctctgagctgtag

SEQ ID NO: 23426 - DNA, 573 bp, Artificial Sequence
  Description of Artificial Sequence: Synthetic coding sequence
atgaccgtgccctggcggcccggcaagcggcggatcacctacaaggaggaagaggacctaacccttcagccaaggcctgccagcagtgcacctgagagcctggtggggctgcaagagggcaaatcaactgaacagggcaaccatgatcagctaaaagaactttatagtgctgggaacctgacagtgcttgctactgacccgctgttgcaccaggaccctgtccagcttgacttccacttcaggcttacatcgcagacgagcgcacactggcatgggctgttgtgcgatcgtaggttgttccttgacataccttatcaggctcttgaccaagggaatcgggaatctctgaccgccacactggaatacgtcgaagagaaaactaatgtggattctgtcttcgtgaatttccagaacgaccgcaatgatcgaggggccctccttcgcgcgttttcctacatggggtttgaggtagtgcgccccgaccatccggcattgcccccactggataatgttatcttcatggtctatccacttgagcgcgacgtgggtcacctgccctctgaacctccctag

SEQ ID NO: 23427 - DNA, 1527 bp, Artificial Sequence
  Description of Artificial Sequence: Synthetic coding sequence
atggccaccgactggctgggcagcatcgtgagcatcaactgcggcgattcactgggagtctaccagggccgggtgagcgcagtggaccaggtgtcccaaaccatttctctcacacgtccattccataatggagtcaagtgcctggtgcccgaagtgacgttcagggccggagatattactgaactcaagattttagagatcccaggacctggagacaatcagcatttcggcgacctccaccaaaccgagctagggccgagcggtgcggggtgtcaggtggggatcaatcaaaacggaaccgggaaattcgtgaagaagcccgccagtagctctagcgctccccaaaacatcccaaaacgtacagatgtgaagagccaggacgtcgcagtgtcaccccagcagcaacagtgctcaaagtcttatgtggaccggcacatggagtcactctcccagtccaagagttttcggagaagacacaatagctggagttcaagctctcggcaccccaaccaggctacacccaagaagagcgggctcaagaatggccagatgaagaataaagatgacgagtgctttggcgacgacatagaagagattccagatacagactttgacttcgaaggcaacttggcgttgttcgataaggccgccgttttcgaagaaatcgatacctacgagaggagatctgggacacgatcaaggggaatacctaatgagcggccaaccagatacagacatgacgagaacatactcgagtccgagcctatcgtgtatcgacggatcattgtaccccataacgtcagcaaagaattttgcacagattctggcttagtcgttccttcaatcagctacgagcttcacaaaaagctgctgtccgtggctgaaaaacacggactcaccctcgaaagacggctcgagatgactggagtgtgcgccagccagatggcacttacgctcctcgggggcccaaatcgcttaaatcctaaaaatgtgcatcagcggcccaccgtggcactcctctgtggcccccacgtcaaaggcgctcaaggcatcagctgcgggcgacacttggccaatcacgacgttcaggtcatcttattcctcccaaattttgtgaagatgctggagagtataaccaatgagctctcccttttctccaagacacagggccaacaggtttcttccctgaaagatcttccgacaagcccagtcgaccttgtgatcaattgcctagattgcccagaaaacgtttttttgcgtgaccagccgtggtataaggcagcagtggcctgggccaaccagaatcgtgcccccgttctatccattgatccaccagtgcatgaggtcgagcaaggcattgacgccaagtggagtctcgcgctgggattgccactgccactgggagagcacgccgggagaatttacctttgcgatatcggcattccccagcaggtctttcaggaggtgggcatcaattatcactcccccttcggatgcaagtttgtgatacccctacactccgcatag

SEQ ID NO: 23428 - DNA, 1158 bp, Artificial Sequence
  Description of Artificial Sequence: Synthetic coding sequence
atgggccggtggtgccagaccgtggcccggggccagcggccccggacctctgccccttcccgcgcaggagctctcctattgctgctcctgttgctcaggagcgctggatgctggggagcaggggaggcccctggcgctctaagtactgccgatccagccgaccaaagtgtacagtgcgtgcctaaagcaacctgcccttcctctcgaccacggctgttgtggcagacaccaacaacacaaactcttccatccaccactatggagactcaatttcccgtgtccgaaggcaaagtcgatccttatcgctcttgcgggtttagctacgaacaggatccaacccttcgggatccagaagcggtggcccgtcggtggccttggatggtcagcgtgcgagcaaacgggacccacatttgtgcaggcacaattattgcgtcacagtgggtgctgactgtggcccactgcctgatttggcgagatgtgatttactcggtgcgcgtgggatctccctggatcgaccagatgactcaaactgcctctgacgtgcccgtcttgcaggttattatgcattcaaggtaccgggcccagaggttttggtcttgggttggacaggctaacgacatcggtctcctcaagctcaagcaggaactgaaatattctaactacgttagacctatctgcttgcctggtaccgactacgtactcaaagatcactcacgatgcactgttacgggctggggattaagcaaggcggacgggatgtggcctcagttcaggaccatccaagagaaagaggtcatcattttgaataataaggaatgcgataacttctaccataactttacaaagatccctacgttagtgcagatcataaagtcacaaatgatgtgcgccgaagatacccatagggagaaattttgctatgagttgacaggcgagcctctggtgtgctctatggaggggacatggtacttggttggtctggtgtcttggggggccgggtgccagaagtccgaagctccaccaatatatctgcaagtctcctcatatcagcactggatctgggattgcctgaacggacaggcactcgcactgcctgccccatcacgcactctgttactggcactgcctctccctttgagcctgctggccgcattgtag

SEQ ID NO: 23429 - DNA, 750 bp, Artificial Sequence
  Description of Artificial Sequence: Synthetic coding sequence
atggtggaccggctggccaacagcgaggccaacacccggcggatcagcatcgtcgagaactgttttggcgccgccggtcagccgttgacaatccctggcagggttctgattggggaaggagtgttaaccaagctgtgcagaaagaagcctaaggctaggcagtttttcttattcaacgacatcctggtttacgggaatattgtgatccagaaaaaaaaatacaacaaacaacatatcattccactggaaaatgtgaccatagactcgattaaggatgaaggtgatcttagaaatggctggctgattaaaactccaactaaaagctttgcagtttacgcggctacagccaccgagaaatccgagtggatgaaccacattaacaagtgcgtaactgatctactgagcaagtccgggaagactccgagcaatgagcacgccgctgtctgggtcccagacagcgaagcaacggtgtgcatgcgctgccagaaggcaaaattcactccagtcaacagacgccaccattgccgaaagtgcggttttgttgtgtgtggcccctgctccgaaaaacggttcctactaccttcccagagctctaagcccgtgagaatctgtgacttttgctacgatttgctctccgctggcgatatggcaacatgtcaacccgcccgatccgactcttactcccaatccttgaagtctcccctgaacgatatgtcggacgatgatgatgatgatgactcctccgattag

SEQ ID NO: 23430 - DNA, 2745 bp, Artificial Sequence
  Description of Artificial Sequence: Synthetic coding sequence
atgggcgacagccgggacctgtgcccccacctggacagcatcggcgaggtgacgaaggaggatctcttactgaaaagcaaaggaacgtgtcagagttgcggcgtgactggccctaacctgtgggcatgtctgcaggtcgcctgcccatatgtcggctgtggcgaaagtttcgccgaccattcaaccatacacgcgcaagctaaaaagcacaacctaaccgtgaatctgacaaccttcaggctgtggtgttacgcgtgtgagaaggaggtgttcttggagcagcgtctggcagctccccttctgggtagttccagtaaattcagcgagcaagacagtccacctcctagtcaccctctcaaagccgtccccatcgccgttgcggacgagggtgaatcggagagcgaggacgatgatctaaagcctcgtggcctcactggtatgaaaaacctcggcaactcatgctatatgaacgctgcattacaggccctgtccaactgtcccccactgactcagttcttcctggaatgcggcggcttggtgcgtacagataagaaacctgccttgtgtaagagctatcagaagttggtcagcgaagtttggcacaagaaacggcctagctacgtggttccaacatctttgagtcatggcattaaattagtgaatcccatgtttagggggtatgctcaacaagatactcaggaatttctgcgttgtctgatggaccagttacacgaagagctcaaggaacctgtcgtcgccaccgtagctttgaccgaggcacgtgattccgactcttccgataccgacgaaaagagggaaggtgatcggtcaccatcagaggatgagttcctgagctgtgactcctcatccgacaggggcgagggagacggacaggggagaggcggagggtccagtcaggccgagaccgaattactcatacccgatgaggctgggagggccataagcgaaaaggaacgaatgaaagataggaagttttcatggggacagcaacggaccaatagcgaacaggtggacgaagatgccgacgttgacactgcgatggcagcgctggacgaccagcctgcggaggcgcaacctccttcccctaggtcttctagcccctgccgaactcctgagcctgataacgacgcccacctgaggtcgtcatcccggccctgcagccccgtacatcatcacgaaggacatgccaaactgtcatcttctccacccagggcgtcaccagtgcggatggcaccaagctacgtgttgaaaaaggcccaggttttgagtgccggatcccgccggaggaaggaacagcggtacagatccgtgatatctgacatctttgatggcagtatcctctctttagtgcagtgcctgacatgtgatagagtttccaccactgtcgaaaccttccaggatttgtcacttcctatcccagggaaagaagaccttgccaagctgcacagtgcaatttaccaaaacgtcccagctaaacctggagcatgtggtgactcctacgcggcccagggctggctggccttcatcgtagagtatatcaggcgtttcgtcgtctcttgtacccccagctggttttggggcccagttgttaccctggaagactgtctagctgccttttttgctgccgacgaacttaagggagataacatgtattcttgcgaacggtgtaaaaagctgcggaacggcgtgaagtactgtaaggttctgagactgcctgaaatcttgtgtattcacctgaaaaggtttagacatgaagtgatgtactccttcaagatcaactcccatgtgagcttccccctcgaaggtttagacctgaggcccttcctcgcaaaggaatgcactagccagatcactacgtacgaccttctgtctgttatttgtcaccatggcacggctggatcgggccactacatagcctattgccagaatgttatcaatggacagtggtacgaattcgatgatcagtatgtgacagaggtgcatgagacagtggtgcaaaatgcagaaggctacgtgcttttctatcgaaagagcagcgaggaggccatgagggagaggcaacaggtggttagtcttgccgccatgcgggagccctcgttactgagattctacgtgtctcgcgaatggttgaacaagtttaacacattcgccgagccagggcccattactaatcagaccttcctgtgcagccacggaggaattcccccccataagtaccactatattgacgaccttgtggttatcctaccacaaaacgtatgggagcacttgtataatcgattcggtggagggcctgcagtgaatcatctatatgtctgctccatttgtcaggttgagatcgaggcccttgctaagcgccgccgaatcgagatagacacctttattaaactcaacaaggcctttcaggctgaggagtctcccggtgtcatttattgcatttctatgcaatggtttagggaatgggaagctttcgtgaagggaaaggacaatgagccgcccgggccaattgacaattctcgcatagcgcaggtgaagggcagcggccacgttcagctgaagcagggcgctgattatggccagattagcgaagaaacgtggacataccttaattcgctgtatggaggtggccccgaaattgctattcgtcagtctgtggcccaacccctgggcccagagaacctgcacggcgagcagaagatagaggccgagaccagggcggtctag

SEQ ID NO: 23431 - DNA, 1341 bp, Artificial Sequence
  Description of Artificial Sequence: Synthetic coding sequence
atgcgggccgcccggcggggcctgcactgcgccggcgccgagcggccccgcagaagaggtcgtctgtgggacagtagtggagtgccccagagacagaaacggccaggcccatggagaacccagactcaggagcagatgagccgagacgtatgcatccacacgtggccatgcacttactatctcgaacctaaacgtcggtgggtgacaggacagctatcattgactagcctcagtttgagattcatgaccgactctacaggggagattttagtgtcatttccactgtcatccattgtggagattaagaaagaggcctcccatttcatcttctccagcataactatcctggaaaagggacacgccaagcattggttttcctcactgagaccgtctaggaacgtggtgtttagtattatcgagcacttttggcgagagttgctgctctcacagcctggagccgtagccgatgcaagcgtcccacggacacggggagaggagctgactggccttatggccggctctcagaagcggctggaggacacggcacgggtgctccatcaccaggggcagcagctggatagtgtgatgagaggcctggataagatggagtccgatcttgaggtagcagaccggttgctgaccgaacttgagagccccgcatggtggccctttagtagtaaactctggaaaacccctcccgagactaagccacgcgaggacgtgtccatgacgtcttgtgagccctttggaaaagagggcatcctgattaaaattccagctgtgataagtcaccggacggagtctcatgtgaagccgggtcggctgaccgtgttagtgtccggccttgaaatccatgacagttcgagtctgctgatgcatcgcttcgaaagggaagacgttgatgatatcaaggtgcactctccttacgagatatcaatacgacaaaggttcattggcaaaccggatatggcatatcgactcatctccgccaagatgcctgaggttattcctatacttgaagtgcagttttccaagaagatggaactgctggaagacgccctcgttttaagatctgccaggacttcatcgccagcagagaaatcctgctcagtgtggcatgctgctagtggcctgatgggtagaaccttacatcgggagccgcctgctggcgatcaggaaggcactgctctgcacctccagacctccctccccgctttgtcagaagcagatacacaggagcttactcaggggttccgccccatgtcgctgtccacacagacagttctagtcatgctatgtagcgaaagcgccggcgccctatggcggcagcggttatcctag

SEQ ID NO: 23432 - DNA, 1896 bp, Artificial Sequence
  Description of Artificial Sequence: Synthetic coding sequence
atggccatcgtgcagaccctgcccgtgcccctggagcccgcccccgaggcagcaactgcccctcaagctcccgtgatgggctcagtgtcgtctctgatatccggcagaccctgtcccggcgggccagcccctcccagacaccatggccctccaggacccacttttttccgccaacaggacggactgctgcgaggcggatatgaagcacaagagcccctgtgtccagccgtgcctcccagaaaagcggtgcctgtgacctccttcacgtatattaacgaagatttccgcacagagagcccccccagtcccagtagcgatgtagaggacgcccgggagcagcgggcacataatgcacatttgcgaggcccgccgccaaagctgatcccagtgagtggcaagctggagaagaatatggagaagattctgatacgccctaccgcattcaagccagtactcccgaaaccacgcggcgcaccctctctgccgtcattcatgggacctagggccacaggattgagcgggagtcagggatcattaacacagctgtttggcgggccagcatctagctcttcgtctagttcaagtagctctgctgcggataagcctctcgctttttccggttgggccagtggctgcccatcaggaaccctcagtgattctgggcgtaattctctgtcatcccttccaacctacagcacaggcggagcggagccaacgacgtcttcgcctggtggacatctgcccagccatggatcaggcaggggcgctctgcccgggcccgctcggggagtgcccacaggaccaagccactctgactccggcagatcctcttccagcaagtctacaggctcactggggggccgcgtggctggaggcctgctgggctctggcacacgcgcctcaccagattcaagctcttgtggcgaacgtagccctccgcctccaccacctccaccatcagacgaggccttgttacattgtgtgctggaaggcaagttgagggacagggaggcagaactccagcagctcagggatagcctggatgagaacgaggccaccatgtgtcaggcttacgaggaaagacagagacattggcaaagagagcgcgaggccctgcgcgaagactgcgctgctcaggcccagcgggctcagcgcgctcagcaattgctgcagcttcaggtctttcagttacagcaggaaaagaggcagctgcaggacgacttcgcccagctcctccaggagcgggagcagttagaacggcggtgtgccacacttgaaagagagcagcgagagctggggccaaggctggaggaaacgaagtgggaagtgtgtcagaaaagcggcgaaatttccctgctgaaacagcagctgaaggaaagccaagctgagcttgtacaaaaagggtccgagttagtagcactgagggttgccctccgcgaggcccgggccacattgagagtgtccgagggccgcgcacgcggcctacaggaagctgcaagagcccgtgagctggagcttgaagcctgttctcaggagctgcaacggcatcgccaggaagctgaacaactgcgagagaaggccgggcagctcgatgcagaggccgccggcctgagagagcctcctgtccctccagcgacagccgacccctttttgctcgctgagtctgatgaagctagtgccactgcgaatccggtgcacaggcgctttcagcccacaccggcaaggggtgcggggaaaaagaagggactgccgcccctgcacataccacctgatcctaaagcaagagaatcccagatggctccagcggcgcccgatgtgcccgctcacatcggtgggcaggggagagcctgggcgagattccctggactgtcttccgccgcaagtttattagaatag

SEQ ID NO: 23433 - DNA, 1473 bp, Artificial Sequence
  Description of Artificial Sequence: Synthetic coding sequence
atgaacggcgccctggaccacagcgaccagcccgaccccgacgccatcaagatgttcgtcgggcagatcccccgctcttggagtgaaaaggagttaaaagagctttttgagccctatggagccgtctatcaaatcaacgttcttagggatcgcagccagaatccacctcagagcaaggggtgctgttttgtgacattttacacaaggaaagctgcgctggaagcccagaacgctttgcacaacataaagaccttgcctggcatgcaccatcctatccagatgaagcctgcggatagtgagaagtccaacgcagtggaagaccgaaaactgttcattggcatggtctccaagaagtgtaatgagaatgatattcgggttatgtttagccctttcggacagattgaggaatgcagaattttaagaggacccgacggactgtcacgcggatgcgccttcgtgacgtttagtacaagagccatggctcagaacgcaattaaggctatgcatcagagccagactatggagggatgttctagccctatcgtcgtaaagtttgctgacactcaaaaggacaaagagcaacgcagactccagcagcaactagcccagcaaatgcagcagctgaacaccgcaacctgggggaacctgacagggctcggtgggctgacccctcagtatctcgctttactgcagcaggccacctcctcatcgaacttgggggccttttctggcattcagcagatggccggcatgaatgctctccaattacagaatcttgctaccttggctgcagccgccgctgcggcccagaccagtgcaacatccacgaacgcaaaccccctgtcaacaaccagctcagccctgggggccttgaccagcccagtcgcagccagcactcccaactctactgctggagccgctatgaactctctcacttctctgggaactctccaagggttggcgggggctacagtagggctcaataacatcaatgccttggccgtggcccagatgttaagcgggatggcagccttaaacgggggcctgggtgctaccgggctaactaacgggaccgccggaaccatggatgccctcactcaggcttatagcggcatccaacagtacgcggccgcagccctcccaactctgtattcacagtcacttttacagcaacagagtgcagccggcagtcagaaggagggtcccgaaggagctaatcttttcatctatcaccttccccaagaattcggggatcaggacattcttcagatgttcatgcctttcggaaacgtcattagcgcaaaggtttttatcgacaaacagactaaccttagcaaatgttttggtttcgtgtcctacgataatcccgtttctgctcaagccgcgatccaagctatgaatggtttccagatcggcatgaagcgcttgaaggtacagctcaaacggagcaagaacgatagcaaaccttattag

SEQ ID NO: 23434 - DNA, 627 bp, Artificial Sequence
  Description of Artificial Sequence: Synthetic coding sequence
atggccgccagcgtggagcagcgggagggcaccatccaggtgcagggacaggcactgtttttccgcgaagccctccccggctcagggcaggctcgattcagcgtgttgcttctgcatggaatccgtttcagtagtgaaacttggcagaatctcggcaccctgcacaggcttgcccaggccggctaccgcgcagttgccatcgatctgcccggactgaagggggagcctcccgcccaggagcccttgttgtcacagagtcgggcatcatttctcgctgccgttgttgacgccctggagctaggaccacccgtcgttatctccccgtcattaagtggcatgtatagtctgcccttccttaccgcgcctggaagtcagctcccgggcttcgtgcccgtggctccaatttgcaccgacaagattaatgccgcaaattatgcttctgtcaaaaccccagcactgattgtctacggagaccaggacccaatggggcagactagcttcgagcatttgaagcaacttcctaaccaccgggtgctcattatgaagggagctgggcacccctgttatctagataaacctgaggaatggcataccggcctgctggatttcctgcaaggtctccaatag

SEQ ID NO: 23435 - DNA, 546 bp, Artificial Sequence
  Description of Artificial Sequence: Synthetic coding sequence
atggagagccggagcgtggcccaggccggcgtgcagtggtgcgacctgggctcgttgcaaccaccaccccctggatttaagcagttttcttatttttcccttcaatcttcttgggactaccgttacgttccaccctgcccagctaacttcgtgttccttgtagagatgggatttttacacgtggaccaggcaggattgaagttgttaacgagtggcatcgacttcgccactagaaagattgccaagcttcttaagccccaaaaggtgatagaacagaacggggattcatttaccattcacaccaattcatcattgcggaattacttcgttaagttcaaagtcggggaagaattcgatgaagacaaccgcggcctggacaatcgcaagtgtaaatcgctggtcatttgggataacgacagattaacatgcattcagaagggagagaagaaaaatcggggttggacgcattggatcgaaggagataagctccacttggagatgttttgcgagggtcaggtctgtaaacagacctttcaaagggcctag

SEQ ID NO: 23436 - DNA, 1647 bp, Artificial Sequence
  Description of Artificial Sequence: Synthetic coding sequence
atgagcgccagcctgaactacaagagcttcagcaaggagcagcagaccatggataacctcgagaaacagttaatttgcccgatttgtctcgagatgttcacaaagcccgtggtgattctaccctgtcaacacaatctgtgcagaaaatgcgccagtgacatatttcaagccagcaacccttacctgccgacaagaggaggtacaacgatggcctccggtggacggtttcggtgtccctcatgcaggcacgaggtcgtgctggaccggcacggagtctatgggctgcagagaaacttactggtggagaatatcatcgatatttacaagcaggaatccacgagaccagaaaagaaaagtgaccagccaatgtgcgaggaacatgaagaagaaaggatcaatatttattgccttaattgtgaagtgcctacctgctccttatgcaaagtgttcggagcccacaaggactgccaggttgctccactgacccacgtgtttcagaggcagaaatcagaactgtctgacggcattgccattctggtgggcagcaacgaccgcgtgcagggggttattagtcagttggaagatacatgcaaaactattgaggaatgttgcagaaaacaaaagcaagagctgtgtgagaagtttgactacttatacggtatactggaggagagaaagaacgagatgacgcaggtaatcactaggacccaggaagagaagctcgaacatgtccgcgctcttatcaagaagtattccgatcacttggagaacgtttcgaaactggttgaaagcgggatccagtttatggacgaaccagagatggcggtatttcttcagaacgctaagaccctcctgaaaaagatctccgaagcgagcaaagcgttccaaatggagaaaatcgagcatggatacgagaatatgaaccactttaccgtgaacttgaaccgggaggagaagatcattcgcgaaattgacttctatcgtgaagacgaggatgaggaggaagaggagggcggcgagggggagaaggagggggaaggagaagtaggcggtgaggcagtcgaggttgaggaggtggagaatgtacaaaccgaatttcccggggaggatgagaacccggaaaaagcgtcagaactttcccaggtagagttgcaggcagctcccggggcactgcccgtcagctctcccgagcccccacctgcgctcccccctgctgctgacgcccccgtgactcagggagaagtggtgcctacaggctcagaacagacaaccgaaagcgagacaccggtccccgcggccgccgagacagcggatcccctgttctatcccagctggtacaagggccagacaaggaaagctactaccaaccccccatgtaccccggggtcagaggggctcgggcagatcggtcctccgggtagtgaggattccaatgtgcggaaggccgaggtagcagccgcagccgcatccgagagagctgctgtgagtggaaaggaaacttccgctccggcggctacttcgcaaatcggattcgaagctccacccttgcaagggcaggccgccgcccccgcaagtggatccggtgcagatagtgagcctgcacggcacatattctccttttcgtggctgaactccctgaacgagtag

SEQ ID NO: 23437 - DNA, 1374 bp, Artificial Sequence
  Description of Artificial Sequence: Synthetic coding sequence
atgttccccaagttcagcctgcggagcatgttccacggcgccggcggagggaatgacattcagtggtgtttttcccaggtcaagggggcggttgatgacgatgtggctgaagctgacatcatctccacagtggagtttaaccactcaggggagctcctggcaacaggcgacaagggagggcgggtagttatattccagcaggaacaagagaataagatccagagccactcccggggcgaatacaatgtctacagtacatttcagagtcatgagcccgaatttgattacctaaagtccctggagatagaagaaaaaataaataaaatccgctggctcccgcaaaaaaatgcagcacaatttctcttgtctacgaacgacaagaccatcaagctatggaagatttccgagagagacaagcgaccggagggatacaatctcaaggaagaagatgggaggtatagggatcccaccacggtcacgaccctacgagtgcctgttttccgcccaatggatctgatggtcgaggcatccccccggaggattttcgcaaacgcccatacataccacattaatagcatttccattaattccgactacgaaacgtacctctctgccgatgacttacgaatcaacttgtggcacttggagattaccgataggtccttcaacatcgtcgacatcaaacctgccaacatggaggaacttaccgaggtgatcacagccgccgagtttcaccccaattcctgcaacacgttcgtgtactctagctcgaaggggactattagactgtgcgacatgagggcctcagccctttgcgatcggcattcaaaattgttcgaggagcccgaagatccctcaaatcggtccttcttttctgagattatctcttctatctcagatgtcaaattcagtcactcaggccgctacatgatgacgcgagattatttgtctgtgaagatttgggacctcaatatggaaaatcgtccagtggagacttatcaggtgcacgagtatctacggtcaaagctttgctctctttacgagaacgattgtatcttcgataaattcgaatgttgctggaacggctccgattcagttgttatgactggttcatacaacaattttttccgtatgttcgaccggaacacaaaacgcgatatcaccctggaagcatccagggagaataataagcctcggactgtcttgaagcctcggaaggtgtgcgcctccggcaaacgaaaaaaagatgagatctcagttgactccttggatttcaataaaaaaatcttgcacactgcatggcaccccaaggaaaatataattgctgtggcgaccactaataacctgtacatctttcaggataaggtgaactag

SEQ ID NO: 23438 - DNA, 738 bp, Artificial Sequence
  Description of Artificial Sequence: Synthetic coding sequence
atggccggcctggagctgctgagcgaccagggctaccgggtggacgggagaagagccggcgaattgagaaagatccaggcccgcatgggggtgtttgctcaggctgatgggtccgcttacatcgaacagggtaacacaaaggcacttgctgtggtgtatggcccccacgaaattcgcggctcgcgcgcacgggcgttgcctgacagggcgctggtgaactgtcagtactcaagtgctaccttctccacaggcgaacgcaagaggcgaccacacggtgatcgcaagagttgtgaaatgggcctgcagctgaggcagacattcgaggcggctatactcacacagctacatcccaggtcccagattgacatctatgtgcaagtgctgcaagccgatggcggcacttacgcagcatgcgttaacgctgcaaccctcgctgtgctggacgcggggataccgatgagagatttcgtgtgtgcctgtagcgcggggtttgtggatggcaccgcactagccgatctgtcccacgtcgaagaagcagctgggggtccccagctcgctttagccctgctgcccgctagcggccagattgccctgttggaaatggacgctagacttcacgaggaccacttggaaagggtcttagaagccgctgctcaggcagctcgggacgtgcacacccttttagacagggtggtacggcagcacgttcgtgaagcctcaatcttgctcggagactag

SEQ ID NO: 23439 - DNA, 2631 bp, Artificial Sequence
  Description of Artificial Sequence: Synthetic coding sequence
atgatggccgacggcgccgccgccggcgccggcggcagccccagcttgcgtgaactgagagctagaatggtcgctgctgctaacgaaattgccaaggaaagaagaaaacaggacgtggtgaacagagtggcaactcatagttcaaacatcagatccactttcaagccagtgatcgacggaagtatgctgaagaatgacatcaaacagcggctggcccgagaaagacgggaggagaagaggagacagcaggacgcgaacaaagagacccaactcctagaaaaagagcggaagactaaattgcagtatgagaaacagatggaggagcggcaaaggaagctgaaggagagaaaggagaaggaggaacaaaggagaatcgctgctgaggagaaacgccatcagaaggacgaggctcaaaaagagaagtttactgctattttatacagaacgttggaaaggagacgactggctgatgattaccagcagaaacggtggagctgggggggttccgcaatggcgaactccgagagcaaaacagctaacaaacgctccgcaagcacggagaaactcgaacagggaacatccgctctgatacgccagatgcccctctcttccgctggcctgcagaatagcgtggccaaaagaaagaccgataaggagaggagtagctcgttaaaccgccgcgattccaacctgcactccagtacagacaaggagcaggctgagcgcaaaccccgcgtcactggagtcacaaattatgtgatgcaatacgtgacggttccgctgcgtaagtgtacaagcgacgagctgcgtgctgtgatgttcccgatgtctacaatgaaaatccctcctcagaccaaggtagaagaatcccctcttgagaaggttgagacgcctcctaaagcctctgtggatgcaccacctcaggttaacgtggaggtcttttgcaacactagtatggaggcttcccccaaagcaggtgtgggaatggccccagaggtaagcaccgatagcttccctgtggtgagcgtggacgtctcccctgtggtcagcacatacgactctgagatgagtatggatgcctctccagagttaagtatcgaggctcttcctaaggtcgatttggagaccgtgcccaaagtgagtatagtggccagccctgaggctagcttggaggctcctccagaagtcagccttgaggcacttccagaagtatccgtggaggccgcgccagaggggtccctcgaggctcctcccaagggaagcgcagaagtagccccaaaggagagtgtaaaaggatcccccaaggaatctatggaggcgtctcctgaagcgatggtgaaggcgtctccaaagacatcactggaggcatcaatggaggcatccccaaaggccaaggcccgggatgctccaaaaaagagcgagatggataagcaggctttgatcccaatagctaagaagcggctttcctcctacaccgagtgttacaaatggtcttccagcccagagaacgcttgtggcttgccctcccccatatctaccaatagacaaatacaaaaaaactgcccgccctctcccctgccccttatctctaagcagagtcctcagaccagctttccctacaagatcatgccgatccagcataccctgtccgttcagtccgccagctctactgttaagaagaagaaggaaacagtatcaaaaactactaatcgctgtgaagctttgagccagaggcacatgatttacgaagagtctggcaataaaagcaccgccggaattatgaatgccgaggccgccactaagatactgacagagcttagacgcctcgcgcgggaacagcgtgagaaggaggaggaggagcgacaaagggaggaaatgcaacagcgtgtaattaaaaaaagcaaagacatggccaaggaggccgttggcgggcaggccgaggaccacctgaagctgaaagatgggcagcaacaaaacgagactaagaaaaagaaaggatggcttgatcaggaggaccaagaagccccactgcagaaaggtgatgcaaagataaaagcccaggaagaggccgacaagcgcaagaaggagcacgagcggattatgttacagaatctgcaggagagattggagaggaagaaacgaatcgaagaaatcatgaagagaacccggaaaactgatgtgaatgcaagcaaggttacggagacgtcttctcacgatatatacgaagaagccgaggctgataacgaagagtccgacaaagactcgctgaatgagatgtttccaagcgccatcctgaacggcaccgggtctcctactaaatttaagatgcctttcaataatgcaaagaagatgacacacaagctggtgtttcttgaagacggtacatcgcaggtccgaaaagagcctaaaacatactttaatggcgacctgaaaaattttcgacaaaagagcatgaaggatacttcaattcaagaggtggttagccgcccatcctctaagaggatgacctcccataccactaaaacacggaaggccgatgaaacaaatacaacaagccggagttctgcccagactaaatcggagggatttcatgacatactcccaaaatcctccgacaccttccgccagtag

SEQ ID NO: 23440 - DNA, 6291 bp, Artificial Sequence
  Description of Artificial Sequence: Synthetic coding sequence
atgtgcagcacccccggcatgcccgcccccggcgccagcctggccttgagagtgtcgttcgtggatgtgcatcctgatgtgattccagtacagctttggggactggtgggcgagaggaggggggaatatcttcgcttatccagagaaatccaggaagccgctgctacccgcggacagtgggccctgggcagcgcctcagcatctccgggagagctctgcctggttcaagtgggactgctgtggcacaggtgtcgggttgtgtctcggcaggcccaggagagtagggtttttctactcgacgaaggtcgcaccattaccgctggcgccggctcactggccccgggcagaagagaattttttaatctgccaagcgaggtgttgggatgcgtgttggcaggcctcgtcccggccgggtgcggtgctgggagtggggagcctccgcagcattggcctgccgacgccgtggacttcctgtctaatctgcagggtaaagaagttcatggctgtgtcttagacgtcctcttacttcaccgcctcgtgctgcttgaagtacctgacgtctttcagcagatgcgagaactgggactggcccggcgcgtccccgattctctgtttaggagcctgctggaaagatacctaacagcagccactgccagtgtgggcagtggcgttccagtgcttagcagagttcccctgaaacagaagcagcccggcctggattacttctacccacagttgcagctgggggtgaccgaggctgttgtgatcacccaagtgtgccatccccatagaatccattgtcagttacgctccgtgtcacaggagatccacaggttgagcgagtctatggctcaagtgtatcgcggatccacggggacaggagacgagaactccacatcagccacctgggaagagagagaggaatctcctgacaaacctgggtccccttgtgcaagctgtggactggatggccactggtatagagcgctgctcctcgaaacttttaggccccaaagatgcgcccaggtgctgcacgttgattatggtcggaaagaactggtatcttgcagcagcctgcgatatctgctgcccgaatacttccgcatgcctgtggtaacctatccgtgcgccctctacggtctttgggacggagggagagggtggtctagatctcaggtgggagatctgaaaaccttaatactgggaaaggccgtgaatgcgaaaattgagttctattgttcattcgagcatgtttactacgtgtctctgtacggcgaggatgggatcaatctcaatcgcgtgtttggagttcagtcttgctgtcttgccgatagggtgctccagtcacaggctaccgaagaagaggaaccagagacctcccagtcacagtcaccagccgaagaggtggacgaagagatcagcctgccagccttaagaagtattcggctgaagatgaatgcattttacgacgcccaggtcgaattcgtaaagaatccatcagagttttggatccgcctccgaaagcacaacgtcaccttttcaaagctgatgaggaggatgtgtggattttattcatctgcatcaaaactggatggtgtggtcctcaaacccgagcccgacgatctgtgctgcgtgaagtggaaggagaacggatattaccgggcaattgtcaccaaactggatgacaaaagtgtggatgtcttcctggtcgatcgtggaaattctgagaacgtggactggtacgacgtccggatgcttttgccacagttcaggcagctgcccatactcgccgtaaaatgcactctcgccgacatctggccactggggaagacctggagccaagaggcagttagttttttcaagaaaacagttctgcacaaggagttggttattcacatacttgacaaacaggatcaccaatacgtaatcgagatcctcgacgaaagcagaacaggggaggagaatatttcaaaggtgattgcccaggccggctacgctaaatatcaagaatttgagaccaaggagaacatcctggtgaacgcccatagtcccggacacgtgtccaatcatttcactaccgagtcgaataagatcccatttgccaagaccggcgaaggggagcagaaggccaagcgggaaaataaaaccacaagtgtgagcaaagctctgtccgacaccactgtggtcactaacggtagcacagagctggttgtccaggagaaagtcaagagagccagcgtgtacttcccactgatgcagaattgccttgagataaagcctggttcatcttcaaagggggagttagaggtggggagtacagtggaagtgagagtgtcatacgtagagaaccctggctatttctggtgtcagttaacacggaatatacagggcctcaaaactcttatgtcagacattcagtactactgtaagaacactgccgccccccaccagagaaacaccctggcctgtctggcaaagcggaccgtgaatcgtcagtggtctcgggctttgatatccggtattcaatcagtcgaacacgttaatgtgacctttgtcgattacggcgaccgtgagatggtttccgtgaagaacatctattctatatccgaggagtttctgaaagtgaaagcacaggcctttcgctgcagcctctacaacctcatccagccggtgggacagaacccttttgtgtgggatgttaaggcaatacaggcctttaacgagtttattgacaacgcttggcagaagaacctggagctgaaatgcaccatcttcgccttggccagtatcaacgaagaactttttaatattgtggacctgctcacacctttccagagcgcttgccacttcctcgtggagaagcgtttggcccgaccggtgaaactgcagaaaccattggaatcctctgtccagctgcacagctacttttactccacacacgacatgaagatcggaagcgaagagcttgtttatatcactcacatcgatgacccttggactttctactgccagttggctagaaatgctaacatcctggagcagctgagctgttcgattacacagctgtcgaaagttctgcttaacctcaagacaagtcctctcaatcccgggaccttgtgcctcgctaagtatactgacggcaactggtatcgcggcattgtgatcgagaaggaaccaaaaaaggttttctttgtggatttcggaaacatttacgttgtgaccagtgatgatctgctgcccattccatcagatgcctatgacgtcttactgctgccgatgcaggccgtccgctgctccctttctgacatcccagaccatattcccgaggaggttgtggtgtggtttcaggaaacaatccttgacaaaagtctaaaagcactggtggttgccaaggaccccgatggaaccttgatcattgaactgtacggggataatatccagataagcgcgagtatcaacaaaaagttgggcctgctctcctataaagatcgaatcaggaaaaaggaatccgaagtgttgtgctccacaaccgaaacactggaagaaaagaatgaaaatatgaagctcccttgtacagagtacttatctaagtccgtggggtacaagcttcccaacaaagagattctggaggagtcctacaaaccgcagatcaacagctcttataaggagttgaagttacttcaaagtcttactaaaacgaacctagttactcagtatcaggatagcgtcggaaataagaactcccaagttttcccactcactactgaaaaaaaggaggagatctctgcggagacccctttgaaaaccgctagagtcgaggcaacattgagtgagcggaagatcggcgactcctgcgacaaggatctgccgcttaagttctgcgaattccctcagaaaaccataatgcccgggttcaaaacgactgtctatgtgagtcatatcaacgacttgtcggacttttatgtgcagcttattgaggatgaagcggagattagccacctgtctgaaagactgaattccgtaaagacccgtcctgagtactatgtggggccgcccctacagagaggggatatgatttgcgccgtgttccctgaagacaatctgtggtatagagccgtgattaaagaacagcagcccaacgacctgctgtccgtgcagttcatagattatggcaacgtcagtgtcgttcataccaacaaaatcgggaggttggatctggtgaacgcaattctgcccggactgtgtatacactgtagcctccagggcttcgaggtccctgataataagaatagtaaaaagatgatgcattacttctcacagcggacctccgaagccgccattaggtgtgagttcgtgaagttccaggataggtgggaggtaatactggccgatgagcacgggatcatagctgacgacatgattagcaggtatgccctcagcgagaaatcacaggtcgagctgtccacacaggtaattaaatccgcttcttctaagagcgtgaacaaatccgatattgatacctcagtgttccttaattggtacaacccagagaaaaaaatgataagggcctacgccacagtcattgacggccccgagtatttttggtgccagtttgccgacaccgagaaattgcaatgtctcgaggtggaggtccagactgccggggaacaggtggctgaccgccggaattgcatcccttgtccatatatcggcgatccctgcatagtcagatacagggaggatggacattattaccgagctctcatcacaaacatatgtgaggattacctcgtttctgtcaggctcgtggatttcggcaatattgaagattgtgttgaccctaaggctttgtgggctatcccctccgagctgctttctgtgccaatgcaggcgtttccttgctgtctctcaggctttaatatatccgagggcctttgttcccaggagggcaatgactacttctatgaaattatcacagaagacgtactggaaattacgattttagagattagacgtgacgtttgcgacattcccctggctatcgtggacctgaaatccaaggggaagtctatcaacgagaagatggagaaatattctaagacaggtatcaaatctgcgctcccatacgagaacatagattctgaaattaaacagaccctgggctcatacaacttagacgtcgggctgaagaagctatcaaataaggctgtccagaacaagatctacatggagcagcagacagacgaactggcagaaattacagagaaagatgtgaacataatcggtaccaagcccagtaatttcagagatccaaagacggataacatttgcgaagggttcgagaatccctgcaaggataagatagatactgaagaactggagggtgagctcgaatgtcacctagttgataaggctgagtttgatgataagtatcttattacaggtttcaacacacttctgccacacgctaatgagaccaaagagattctggaacttaactctctcgaggttcccctttcccccgacgacgaatccaaggagtttctcgagctcgagtcaatcgaacttcagaactctcttgtggtagatgaggaaaagggtgagctgtcacctgtccctcccaatgtacccttgagccaggaatgcgtcacgaagggggctatggagctctttacactgcagctgcctctgtcctgcgaagccgagaagcagcccgaacttgaattgccgaccgcgcagctgcctctcgacgataagatggaccctctcagtcttggcgtgtcccagaaagcccaggaatctatgtgtacggaggacatgaggaagtcaagctgtgtggaaagttttgacgatcagaggcgcatgtctctgcacctgcacggagcagactgtgaccccaaaacgcagaatgaaatgaatatctgcgaggaggaatttgtggaatacaagaatagagacgcaatctcagccttgatgcccttgttctccgaagaggaaagctcagacgggtccaagcataataatggcttacccgatcacataagcgctcagctgcagaatacctatactctcaaagcttttacggtgggtagtaagtgcgtggtttggtctagtttaagaaacacctggtcaaagtgcgaaatcctagagacagccgaggagggcacccgcgtgttaaacctttctaatggaatggaggaaatcgtcaatcctgagaatgtatggaacggcatccctaaacttgacaagagcccacccgagaagcgaggactcgaggtgatggaaatctag

SEQ ID NO: 23441 - DNA, 690 bp, Artificial Sequence
  Description of Artificial Sequence: Synthetic coding sequence
atgggcaagagctgcaaggtggtggtgtgcggccaggccagcgtgggcaagacaagcattctggagcagctgctgtacggaaatcatgtagttggaagtgagatgatagaaactcaagaggatatctacgtgggatctatcgagactgatcggggtgtgcgtgagcaggttcgcttctatgacacccgcggactgagagatggcgcagagttgccccggcactgcttctcttgcaccgatggatatgtattggtgtacagcaccgattcccgcgaatcgttccaaagagtggagctgttgaagaaagaaatcgataagtctaaagacaagaaggaagggctcacgttgccaccacgattagagtgtagcggcatgataaccgcacactgctcactcaatctcccccggttgcggtggtcttcttgcctctccccacttcttagactacaggtcaccatcgtcgtgctcggaaataagtgtgatcttcaagaacagcggcgcgtggaccccgatgtggcccagcactgggctaagagcgagaaagtgaagctatgggaagtaagtgttgctgacaggcgatcattgctcgagcccttcgtgtacctggccagtaagatgacacagccccagagtaaaagtgcatttcccttgagtcggaagaataagggatctggctcattggatggttag

SEQ ID NO: 23442 - DNA, 2412 bp, Artificial Sequence
  Description of Artificial Sequence: Synthetic coding sequence
atggagagcggcccccgggccgagctgggcgccggcgccccccccgccgtcgtggcccggacgccacctgaaccacggcctagtccggagggggatccaagtcctcctcctccacccatgagtgccctggtgcctgatacaccacctgacacccctccagctatgaagaacgcgacaagctctaaacagttacctctggagcccgagtctcctagcgggcaggtgggaccacgccctgccccaccgcaggaggaatctccgagctccgaggcaaagagtagagggccgacaccacctgctatgggtcctcgtgacgctaggcctcctcggcgttcttcccagcccagccccacagcggtccccgcctctgatagtcctcctaccaaacaagaggtgaagaaggccggcgagcgacataagttggccaaagagagaagagaggagcgggctaaatatctggctgccaaaaaagctgtctggttggaaaaggaagaaaaagccaaagccctgagagaaaagcagctccaagagaggcgcagaaggctggaggagcaaagactgaaagcagaacagagaagggccgcgcttgaggagcggcaaaggcagaaattagagaaaaataaagagagatatgaggctgccattcagcgcagcgtgaagaaaacatgggcagagattaggcagcagcgctggtcatgggccggtgctctgcaccactcctctcccgggcataagacaaatcggtctctgcaactatctgcctgggaaagttccatcgtcgatcgcctgatgaccccaacactcagcttcctggcccgctctagaagtgccgtaaccctgcctagaaatggtcgcgaccagggccgaggatgtgaccccgggaggggccctacctggggacgagccggtgcgagccttgcccgagggccacagcccgacaggactcacccctcagcagccgtgcctgtttgtcctaggagcgctagcgcgtcacccctgaccccatgttccgtcacccgaagcgtgcaccgatgcgcgcctgcgggagagaggggcgagagacgtaaaccaaatgccggagggtcgcctgctcctgtacgccggcgcccagaggcttcaccggttcagaagaaggaaaaaaaagacaaagaaagagagaatgagaaagagaaaagcgcgttggcaagagaaaggtcactaaagaagcgacagtccttgcccgcttcgccaagagcaaggctgtccgcttcaactgcaagcgagctttcccctaagagcaaggctcggcccagctctccttcaacctcctggcatcgccccgcgagtccttgtccaagccccgggccggggcacactctgcctccgaagcctccaagcccgagaggcacgactgcctccccaaagggcagagtgcgccggaaggaagaggccaaggaaagcccgtcggccgcagggccagaggataagtcacagagtaagagaagggcctctaatgaaaaggaaagtgccgcacctgcctcacctgctccatccccggccccctctccaacacccgccccccctcagaaagaacaaccccccgccgagacaccaaccgacgcagcagtgcttacctcaccacctgcccctgccccacccgtgacaccatcgaaacccatggctggcactactgatcgggaggaggcaactaggctgttggcagagaaaagaaggcaggctcgagagcagcgtgagagagaggaacaggaaaggaggctgcaggccgagcgggacaaaaggatgcgcgaggagcagttggcaagagaggcagaggcaagagccgagcgcgaggctgaggctagacgtcgcgaggagcaggaagcaagggagaaagcccaggccgaacaggaagaacaggaacgactccaaaagcagaaggaagaggccgaggcccgcagccgggaggaagctgagagacagcggttggagcgggaaaagcatttccagcagcaggagcaagagcgccaagaacgcaggaagagactcgaggaaattatgaaacggaccaggaaatccgaagtatctgagactaaaaaacaggacagtaaggaggccaacgcgaatggctcgtctcctgagcctgtgaaggctgttgaggctcgtagtcctgggctacagaaagaggcggttcagaaagaagaacccattccacaggaaccacagtggtcgttaccatccaaggaactcccggctagcctcgttaacggccttcagcctctgcccgcccatcaagagaatggattttccaccaatggaccctctggcgacaaatcattgtcgcgaacacccgaaactctcctcccattcgctgaggctgaggcctttttgaaaaaggctgtggtgcagtctccccaggttaccgaggtgctctag

SEQ ID NO: 23443 - DNA, 1125 bp, Artificial Sequence
  Description of Artificial Sequence: Synthetic coding sequence
atgcgggcccccatgctgcagaagcagcaggccccccggatggacacccccccgcctgaggagcgcttagaaaagcaaaacgaaaaactgaacaatcaggaggaagagactgagttcaaggagttagacgggctgagggaggcccttgccaacctaagggggctttcagaagaggaaaggtccgaaaaggccatgctgcgatcccgcatcgaggaacaatctcagctcatttgtatcctcaaaagacgcagcgacgaggcactcgaacggtgtcaaatcctggagctgctgaacgctgagctggaggaaaaaatgatgcaggaggctgagaaactgaaagctcagggtgagtactccaggaaactggaagagcgcttcatgaccctcgctgcgaaccacgagctcatgctccgatttaaggacgagtacaagtccgaaaacataaagctgcgcgaagagaacgagaagctgcggttggaaaactctagcctgtttagccaggccctaaaggatgaagaggccaaagttctgcaactcacggttaggtgtgaagctctgaccggagagttggaaacacttaaagaaagatgcgcccaagacgcttgccaggcgcaggctcgcgagaaggaactactggaattgcaaagccaacaggcttgcacacataccaaagagacggaacagttgagatctcagctccaaactctgaagcagcaacaccagcaggcagttgaacaaattgcaaaagccgaggaaacccactcatcccttagtcaagagctccaagcaaggttacaaactgtaactagggagaaagaggaacttctacagctcagcatcgagcggggcaaggtgcttcagaacaagcaggcagagatatgtcaactggaagaaaagctggagatagcaaatgaagaccgaaaacatgctcttgaaaggttcgagcaggaggccgtggctgttgacagtaatctgcgagttcgggaacttcagcgcaaagttgacgggatccagaaagcctacgatgaactgcgcctgcagtccgaggcatttaagaagcatagcttggatctgctgagcaaggagcgagagctcaatggcaaactgcgtcacctttctccctag

SEQ ID NO: 23444 - DNA, 585 bp, Artificial Sequence
  Description of Artificial Sequence: Synthetic coding sequence
atggaggacggcctgctggagatcatgaccaaggacggcggcgacatgcctgcccccctagaggtcagcactgtcccagccgtgggagacgtcatctcaggcgaatacaacggaggcatgaaagagctaatggagcacttgaaggcacagctacaggctctcttcgaagacgtgcgcgccatgcggggggccctcgacgagcaggcctcgcatatccaggtactttccgatgacgtgtgcgctaaccagcgagctatcgtctctatgtgccagattatgactacagcaccacgtcagggaggactgggagtggtggggggcaagggatcctttcaatccgaccctcaggaaccagaaaccccaagccctgggataggcgatagcggcctgctcggcagagaccctgaggatgaggaggaggaagaggaggaaaaagagatgccaagccctgcgacaccctcgtcccattgcgagcgccccgaaagtccttgtgccggtcttctgggcggtgatggccctctggtggagcctttagatatgcccgacatcactttgctacagctggagggagaggcatcactgtag

SEQ ID NO: 23445 - DNA, 1281 bp, Artificial Sequence
  Description of Artificial Sequence: Synthetic coding sequence
atggcccacctgcggggcttcgccaaccagcacagccgggtggaccctgaggaactgtttactaaactagataggataggaaaaggctccttcggcgaggtgtacaaggggatcgataaccatacaaaggaggtggttgctatcaaaatcattgatttggaagaagcagaggacgaaatcgaagacatccaacaagaaatcaccgttttgtcccaatgcgactctccgtatatcacacgttatttcggatcctacctaaaatccacaaagctctggattataatggaatacctcggcggtggctcggcattggacctcttgaagccagggccactcgaggaaacgtatatcgccacaattctgagagagatccttaaggggctggactatttgcactccgaacggaaaatccacagagatataaaggcagccaatgtgcttctgagtgaacagggcgatgtgaaactggcagacttcggggtggcgggacagctcacagatacacaaatcaagagaaacacctttgtgggcactccattctggatggcacctgaagtgattaaacagtcagcctacgatttcaaggccgacatctggtcactcggcatcaccgccattgaactcgctaaaggcgagccacccaattctgacctgcatcccatgcgcgtgctgttcttgataccaaagaacagccctccaactctggaagggcagcacagtaaacccttcaaagagttcgtggaagcttgtctgaacaaagacccgagattccggcctacggctaaagagctcctgaaacacaaattcattacacgatatacgaagaaaacatccttccttaccgagttgattgacaggtataaacggtggaaaagcgaagggcacggtgaagaatcctcgtcagaggactccgacatcgatggcgaggccgaggatggcgagcaaggcccaatatggaccttcccacctacgatcagaccatcacctcattccaagctgcacaaagggactgctctgcacagtagccaaaaaccagcggagccagtcaaacgacaaccccgctcccagtgtttatccacactcgtccgtccagtcttcggcgaattgaaggagaagcacaaacagagcggagggtctgtgggggctctagaagagctggaaaacgcctttagccttgccgaggagagctgtcctggtatttccgacaaactaatggtacacctggttgaacgggtgcagagattcagtcacaaccgaaatcacctcactagtactcgttag

SEQ ID NO: 23446 - DNA, 1350 bp, Artificial Sequence
  Description of Artificial Sequence: Synthetic coding sequence
atgatgctgagcaccgagggccgggagggcttcgtggtgaaggtgaggggactaccttggtcttgctctgctgacgaggtcatgcggttcttctccgactgtaaaatccagaatgggacgagcggtattcgcttcatctatacaagagagggccgtcccagcggcgaagcctttgtggagctggagtccgaggaggaggttaaactcgcgctaaaaaaagatcgggaaaccatgggtcacaggtatgtggaggtgtttaagtcgaacagcgtcgaaatggactgggtgctgaaacataccggacctaattcacctgatacggctaacgatggtttcgtcaggctaagaggtttgccattcgggtgttcaaaagaggaaatcgttcagttcttttccgggctggagatcgtgcccaatggaatgacccttcctgtggatttccaaggacgatccactggcgaggcttttgtccagttcgccagccaggaaatcgccgaaaaggccttaaaaaagcataaggaacgcattggacacaggtacatcgagatctttaaatccagtagggctgaagtcaggacccactacgaccctccacgtaaattgatggccatgcaaagacccggtccgtacgatcgaccgggtgccggaagaggatacaacagtatcggccggggcgccggatttgagcggatgcgccgaggagcttatggaggaggctatggcggatatgatgactatggtggctacaatgacggctatggatttggatctgaccgtttcggccgggatctcaattattgtttttctggtatgagcgaccatcgatacggcgacggaggaagcagcttccagagcactaccggacactgcgtccacatgaggggcctgccttatcgggctaccgaaaacgatatctataacttcttctctcccctgaacccaatgagggttcatatcgagatcggccccgatgggagagtgacgggggaagccgatgtcgagttcgccacacacgaagacgccgtcgcggccatggccaaggacaaagcaaatatgcagcataggtacgtcgaattgttcttgaactctaccgcaggtacctcaggaggagcttacgatcatagctacgtcgaattatttctcaacagcacagccggtgcctctggaggcgcctatggaagtcagatgatgggcggaatgggcctgtctaaccagtcttcttatgggggtccagcgagccaacagctatccggcgggtatggtggcggttatggggggcagtcctccatgtcagggtacgatcaggtcttacaggagaacagcagcgattaccagtctaatctggcttag

SEQ ID NO: 23447 - DNA, 1317 bp, Artificial Sequence
  Description of Artificial Sequence: Synthetic coding sequence
atgtgccccaagaacgccagctactacggcaaccgggccgccaccctgatgatgctagggagattccgtgaagcgcttggggacgcacagcagagcgttcggcttgatgattctttcgtgcgagggcacctccgagagggcaaatgtcacctgtctctcggtaacgcaatggctgcctgtagaagcttccaaagggccttagagctcgaccataaaaacgcccaggcccaacaggagttcaagaacgccaatgctgtgatggagtatgagaaaatcgctgagaccgatttcgaaaaaagagacttccgaaaggtcgtgttttgtatggacagggctctcgaattcgctcctgcctgccatagatttaagattcttaaggctgaatgcttagcaatgctgggaagatatccagaagcccagagcgtagccagcgatatattaagaatggatagtacaaatgcagacgccctgtacgtaagaggtctctgcttatattacgaggattgtattgagaaagctgtgcagttcttcgtccaggcattgcgaatggctccggatcacgaaaaggcttgcattgcttgtcgtaacgctaaggcacttaaggccaaaaaggaggatgggaataaggcctttaaggaaggaaattacaaacttgcttatgaattgtacaccgaagctttgggcattgatcccaataacattaagaccaacgcaaagctatactgtaatcgagggacagtcaatagtaaactcagaaaactggatgatgcaatcgaggattgtacaaatgcagtcaaactggatgacacctacatcaaggcatacctacgccgcgctcaatgctatatggataccgaacaatatgaggaagctgttcgagactatgaaaaggtgtatcagacagaaaaaacaaaggaacataaacagctgctgaagaacgctcaactggaactgaaaaaatcgaagagaaaagactactataagatactgggagtggataagaatgccagcgaagatgagataaagaaggcttaccgcaaaagagccctcatgcatcaccccgaccgtcatagtggagcctcagccgaggtccagaaggaagaggaaaagaagtttaaggaagtcggcgaagccttcaccattctgtccgatccaaagaagaaaacccgctacgatagtggtcaggaccttgatgaggagggaatgaatatgggagacttcgatcctaacaacatcttcaaggcttttttcggcggcccgggtgggttttcgtttgaagccagtggtccaggaaatttcttctttcagttcggttag

SEQ ID NO: 23448 - DNA, 165 bp, Artificial Sequence
  Description of Artificial Sequence: Synthetic coding sequence
atgcccggcaagaaggcccggaagaacgcccagcccagccccgcccgcgctccagccgagctagaagtagagtgcgctacccaactcaggaggtttggcgacaaattaaattttaggcaaaagctgctgaatctgatcagtaaactgttttgtagcggtacgtag

SEQ ID NO: 23449 - DNA, 1404 bp, Artificial Sequence
  Description of Artificial Sequence: Synthetic coding sequence
atggccagcgtggccgccgcccgggccgtgcccgtgggcagcggccttaggggtcttcagcgcacgctcccgctggtggtgattctgggggctaccggcacgggaaaaagtaccctggcactgcagctgggacagagactcggaggcgaaatcgtctcagccgattccatgcaggtgtatgaagggcttgacatcatcacaaacaaagtgagcgcccaggagcaaaggatttgcaggcaccacatgatctctttcgtcgatccgctggtgaccaactacacagtcgtggactttcgcaaccgggcaactgccctgattgaagacatcttcgccagggataagatcccaattgttgtgggcggcactaattattacatagagagccttctgtggaaggtgctcgtcaatactaaacctcaggagatgggcactgagaaggtcatagacaggaaggtggagcttgaaaaggaagatggcctcgtgctgcacaaaaggctgagccaggtggatccggaaatggcagcaaagctgcacccacatgacaaacggaaggtcgcccgcagcctgcaggtctttgaagagactggaatctcacattcggagtttttacaccgtcagcacaccgaggaaggcggaggtcccctaggcggccccttaaagttcagcaatccctgcatcctgtggctgcatgcagatcaggcagtccttgacgagaggctggataaacgcgtcgatgacatgttggccgccggcctgctcgaagaactgagagattttcatcgacggtacaatcagaagaacgtcagcgaaaactcccaggactaccagcatggcatcttccaaagcattggatttaaagagtttcacgaatacctgatcacagaggggaagtgtacgctggaaacaagtaatcagctactgaaaaagggcatcgaggctcttaagcaggttacaaagcgctatgccaggaagcagaacaggtgggtcaagaaccgtttcctgagccgcccaggccccatcgttccacctgtgtacgggctggaggtctccgacgtgtcgaagtgggaggagtctgttttggagcccgccctagagatagtacagtcttttattcaggggcataaacctaccgccaccccaataaagatgccttacaacgaggctgagaacaaaaggtcgtatcatctgtgtgacttgtgtgatcggatcatcattggagatagagaatgggcggcccatataaaatccaagagtcatctgaatcagctcaagaagcgacggaggctggactcagatgcggttaacacaatcgagtctcagtcggtatcccccgatcataacaaggaaccaaaagagaaaggtagtccagggcagaacgaccaagagctaaaatgctcagtgtag

SEQ ID NO: 23450 - DNA, 558 bp, Artificial Sequence
  Description of Artificial Sequence: Synthetic coding sequence
atgggcgtgaacctgacccggagcaacaaggagaccgtgaagcactccgacgttctgttcttggcagtgaaacctcacatcatccccttcattctcgacgagattggcgccgatgtgcaggctcggcatattgtggtgagctgtgctgctggagtaactatttcctctgttgaaaagaaactgatggctttccaacctgcaccaaaggttatcagatgtatgactaacactccggttgtggtgcaggagggggcaactgtatacgctactgggacacatgcactcgtggaggatggtcagctgttggaacagcttatgtctagcgtgggcttttgtaccgaggtggaggaagacctcatagatgctgtcaccggcttatctggtagtggccccgcctatcagtcaatggcggatcaggaaaaaattagccctgccgcattgaaaaagaccctgctggaccgggtgaaattggagagccctaccgtgtccacgcttaccccgagctctcctggcaagctgttgactcggagcttagcgctgggtggcaagaaagactag

SEQ ID NO: 23451 - DNA, 960 bp, Artificial Sequence
  Description of Artificial Sequence: Synthetic coding sequence
atgagcgtgggcttcatcggcgccggccagctggccatgctgtggcgcggtgcatcccggccgcaacatccggtaggtagccaagacaactcccagctaccccgcaatgagccagctcacggcgtgagggcccaagaggatggttgcgagcccgatactcagcaacagggggatggcgaagcccagaggagacctgtgtcaggttgcgaggctcacattatccctttcattctggatgaaatcggcgctgatgtgcaagcccgtcatatcgtagttagctgtgctgctggtgtcaccatctctagcgtggaaaagaagttgatggccttccagccggcccctaaggtgatccgatgcatgaccaatacacccgtcgtggtgcaagaaggtgcaactgtttatgccaccggcacacacgctctggtggaggatggccagctcctggagcaactgatgtcctcggttggtttctgcaccgaagtcgaggaagacctaattgatgctgtgacaggactgtcgggaagtgggcccgcatacgcctttatggctctcgacgcgttggccgacggaggcgttaaaatgggactgcctcgccgcctggccatccagctgggggcgcaagccctgctgggcgccgctaagatgctccttgattctgaacagcatccttgccagcttaaagacaatgtatgttcccccggcggagccactattcacgcccttcacttcctggagtctgggggattcagatctctgctgattaacgctgtcgaagccagttgcatcaggacacgcgagctccaatctatggctgaccaggaaaaaatttcacctgcagcgctgaaaaagactctgctggatcgcgtgaagctggagtcccctacggtgtccaccctgacccccagtagccccggaaagttactgactcgatcacttgctctcggaggtaaaaaagactag

SEQ ID NO: 23452 - DNA, 708 bp, Artificial Sequence
  Description of Artificial Sequence: Synthetic coding sequence
atgctgagcgccacccggcgggcctgccagctgctgctgctgcactctctgttccccgtcccacggatgggaaatagcgcttccaacattgtgtcaccacaggaggcattacctgggcgcaaggagcaaacccctgtggccgcgaagcatcacgtgaacggtaatagaaccgtggagccattccccgaggggacccagatggcggttttcggaatgggatgcttttggggcgctgagagaaaattctgggttttgaagggcgtatacagtactcaggtcggctttgcggggggctatacttctaatccaacctacaaagaagtctgttccgagaagaccggacatgccgaagtggtccgggtcgtttaccagccagagcacatgagctttgaggagctgctgaaggtgttctgggagaatcatgatccaactcagggcatgcggcagggcaatgaccacgggacgcaataccgcagcgcaatctacccaaccagtgctaagcagatggaagcagcgctgtcgtccaaggagaactaccagaaggtgctgtccgaacacggctttggcccaattacaactgacatcagggaaggccagaccttttattatgctgaggactatcatcagcagtacctgagcaaaaacccaaacggctactgcggcttaggggggacaggcgtttcttgtcctgtggggataaaaaaatag

SEQ ID NO: 23453 - DNA, 3873 bp, Artificial Sequence
  Description of Artificial Sequence: Synthetic coding sequence
atgagcggccccctggagggcgccgacggcggcggcgacccccggccaggggagtcattttgccctgggggtgtcccctcccctggacctccccagcatcgaccctgccccggccccagccttgccgatgacacggatgccaacagtaatggcagtagcggaaacgagagcaacggacacgaaagtcggggggcctctcagcgatcatctcacagctcatcatctggcaacgggaaggatagtgctcttttagagacaacagaatcaagcaagtccaccaattctcagtctccctctcccccgtctagctcaatcgcctattcccttctcagcgcttccagcgagcaggataacccatcaactagcggatgtagttccgagcagtcagccagggcaagaacacaaaaagaactgatgacagcgctcagagagctcaaactgagactgcctcctgagcgccgggggaaagggcgcagcggaactctagcaacgcttcagtacgctttggcctgcgtaaaacaggtgcaggcgaatcaagagtattatcagcaatggagcctcgaggaaggtgaaccttgctccatggacatgagcacctataccttagaggaacttgagcatatcactagcgaatataccctgcagaatcaggacaccttctctgtggctgtgtctttcctgacggggagaattgtctacatcagtgagcaagcagcggtcttgctgagatgcaaaagggacgtcttccggggcaccagattctccgaactgctcgctccccaagacgtgggtgtattttatggcagcaccgccccctcacgcttgcccacttggggcaccggcgcaagcgctgggtctggtttgagggacttcacccaggagaaaagtgtattctgtaggattcggggaggtcccgacagagaccctgggccccggtaccagccctttaggttgactccctatgttacaaaaatcagagttagcgacggcgctcctgcacagccctgctgcctactgattgcggaacggatacattctgggtatgaggcccccaggatcccaccagataaaagaatatttaccacacgtcatacaccttcctgcctcttccaagatgttgacgagcgcgccgccccgttgcttggatacttgccccaggatttgctgggagcccctgttttgctctttctccacccagaagatagacctctcatgcttgccatccataaaaaaatcctgcagctcgcgggccagcccttcgatcactcccctatcaggttctgcgccaggaatggagagtacgttactatggatactagctgggccggcttcgtgcacccctggagccgcaaggtggcattcgtgctgggccgccacaaagtgcgaactgcgcccctcaacgaggatgtcttcactccacccgccccttcgccagccccaagtctggacacagatatccaggaattaagtgagcagatccaccgtctgctgctgcagcctgtgcactcccccagccccaccggcttatgtggggtgggagccgtaacctcccccggtccacttcacagtccgggcagcagctccgactcaaacggcggagatgcagagggtccggggccacctgcccccgtgacctttcaacaaatttgtaaagacgtgcatctagtgaagcaccaggggcagcaactattcattgaaagtcgcgcccgcccacaatccaggccaagactacctgcaacaggcacctttaaggcaaaagctctcccatgccaatcacctgatcctgagctggaagcaggctctgcccctgtccaggcccccctggccctcgtcccagaggaagctgagagaaaagaagcctccagctgctcataccagcagattaactgtctggattccatactgcgctatctggagtcatgtaatctgccgtccacaacaaagcggaagtgcgcctcctcctcctcatatacaacatcttctgcttccgacgatgacaggcagcgaacagggcctgtgagtgtcggcaccaagaaggatcccccatccgccgctctgagtggggagggtgccacacctcgcaaagagccagtggtaggcggcacactgtcccccttggctctcgccaataaggctgaaagcgtagtaagtgtaacctctcagtgcagtttcagcagtacaatcgtccacgtaggcgataagaagccgcccgaaagcgacattattatgatggaggacctgccagggctggcccctggcccagctccctctcccgctccatctccaacagttgctcccgatcccgcccctgatgcctaccggccggtgggtttaacaaaagccgtcctttccctgcacactcagaaagaggagcaggccttcttgagcagatttcgagacctcggcaggcttcgtggcctagattcctcgtctaccgctccatcagctctaggagagaggggctgtcaccacggcccggctccaccatctcggcggcatcactgtcgttctaaagctaagagaagcagacaccaccagaacccacgcgcagaagctccatgctacgtgtcacacccttccccagtgcccccctctaccccgtggccaactcctcctgctaccacaccctttccggccgtagtgcagccttatcccctgccagtattctctcctaggggtggcccacaacccctaccccctgctcccacaagcgtaccccctgctgctttccccgctcctctggtcacaccgatggtggctctggtgctgcccaactacctttttcctactccttctagttatccgtatggtgccttgcaaactccggccgaggggcctcccacacccgcttcccatagtccctctcctagtctgcccgcactggctccaagcccaccccaccggccagactccccgctttttaacagtaggtgttcttctccgctgcaattaaacctgctgcagctggaagaactgccacgggctgaaggcgccgccgtcgcaggtggaccaggctcaagcgcggggccgcctccacccagtgctgaggccgcagaacccgaagcaaggctggccgaagtcacagaatcctctaaccaggatgccctgtctggcagttcagacttgctggagctgctgctgcaggaggactcccgctccggcaccggtagtgcagcgtccgggtcactcggatccgggctcggcagcggtagtgggtctggctcccacgagggtggctccacgtcagcgtcaatcacccgctcttcacagagcagccatacttccaaatatttcggctccatcgactcttctgaggcagaggccggggccgctagagggggagcagaaccgggggaccaggtcatcaagtacgttctgcaagaccctatttggcttctgatggccaacgccgaccagcgagtgatgatgacatatcaggtgccatctagagacatgacctcagtcctgaagcaagatcgcgaacgtctgcgggccatgcagaagcagcagccccgttttagcgaggatcagcgccgcgagctgggggcagtccactcatgggtcaggaaggggcagctccctagggccctggacgtgatggcctgcgtcgactgtggtagctcaactcaggaccctggccatcctgacgaccccctcttctcagagttagacggcctgggtctcgagcccatggaggaagggggcggcgagcagggctcgagtggcgggggctcaggcgagggagaagggtgcgaagaggcccagggcggcgcgaaggcatcctcgtcccaggatctggctatggaagaagaagaggaagggcggtcttcttctagccccgcactgcccacagccggtaactgcacctcttag

SEQ ID NO: 23454 - DNA, 2022 bp, Artificial Sequence
  Description of Artificial Sequence: Synthetic coding sequence
atggagaaggccgtgaacgacggcagccacagcgaggagctgttctgccacctaaaaacaatcagtgaaaaagaagacctgcccaggtgcacgtcagaaagtcacctgtcctgcctcaaacaggacatacttaatgagaaaacagaactggaggctacactgaaagaggccgagctggttacccactctgtcgagctgctgctgcctttgtttaaggacacgatcgaaaaaattaacttcgagaatgccaatttgagcgcactgaatctcaagattagcgagcagaaagagattttaatcaaagagctggacactttcaagagcgtcaagctcgcccttgagcatctcctcagaaagcgagactacaaacaaaccggcgataacctgagctcaatgctcctggaaaacctgactgacaacgagtccgaaaatactaatctaaaaaaaaaagtgtttgagaaggaggcccatatacaggagctgtcttgcttgtttcagagcgagaaagccaacacgctcaaggctaaccgatttagtcaaagtgtcaaggtagtccatgagaggcttcagatccagatccacaaacgagaggctgaaaatgacaaactgaaggagtacgttaagtcattagagaccaagatagctaaatggaatctacaaagtcggatgaataagaatgaagccatagtaatgaaggaagcctcccgacagaagaccgtggcccttaagaaggcgagcaaggtgtataaacagcggctggaccattttaccggcgccattgaaaaactgactagtcagatccgcgatcaggaagccaaattatccgagacaatctcggcctcaaacgcatggaagagtcactatgagaaaatagtgatagagaagacagaactggaggttcaaatcgaaaccatgaagaagcaaataataaatcttttggaggaccttaagaaaatggaagaccatggaaagaattcatgcgaggagattttgcgaaaagtgcattcaatagagtacgagaacgaaaccttgaatttggaaaatacgaagttaaaactccgatttccttgccggattaccgagagtaagaatatgaatatactcatcgtccttgatatgctgtgctatatttcttctgaaaaaactactctggcagcactgaaggacgaagtagtcagcgtcgaaaatgaattgtccgagctgcaggaagttgagaaaaaacaaaaaactcttattgagatgtacaaaacccaggtgcaaaaactgcaggaagcggcagagattgtgaaatccagatgtgagaatttgcttcacaagaataaccagataactaagacgaagaacaagaacgtagagaagatgcggggacagatggagtcccaccttaaggaactggaacgagtgtgtgatagtctgacagcggccgaacggaggctccatgaatgtcaagaatcccttcaatgctgcaaggggaaatgcgcggaccaggagcacactatacgcgagcttcagggccaagtcgacggaaaccacaacctcttgaccaaactatcattggaggaagagaattgcctcatccagctcaaatgcgaaaatttgcagcagaaattagagcagatggatgcagaaaacaaggagctggaaaaaaaattagcaaaccaggaggaatgcttaaaacactcaaacctgaagtttaaggagaagtcagccgagtatacagctttagcccggcagcttgaagccgcccttgaagagggaagacagaaagtagcagaggagatcgagaagatgtcatcccgcgagtccgcactgcagatcaaaattctcgacctggagacagagcttcgaaagaaaaacgaagagcaaaaccagttggtctgtaagatgaattcgaaggcacagcatcaggaggtttgtcttaaagaagtgcagaatagtctggaaaagtcagagaatcagaacgagagtatcaagaactatctgcagttcctaaagacctcctatgtgacgatgtttgaatag

SEQ ID NO: 23455 - DNA, 798 bp, Artificial Sequence
  Description of Artificial Sequence: Synthetic coding sequence
atggacgacaaggccagcgtgggcaagatcagcgtgagcagcgacagtgtgagtaccttgaactccgaggacttcgtcctggtgagccggcagggagacgagaccccatctacaaacaacgggtcagacgatgagaaaacaggactcaaaatcgtgggcaacggatccgaacagcagcttcaaaaagaactagctgacgtactgatggacccacccatggatgatcagccaggtgagaaggagctggttaagcggtcacagcttgacggagaaggagatggccccctgtctaaccagctgtccgcctcgtcaactatcaaccctgtacccctcgtggggctgcagaagcccgaaatgagcctccctgttaagccgggccagggagattccgaagcaagctctccctttacgcctgtggctgatgaagatagcgttgtttttagcaagctgacctacctgggctgtgctagcgttaatgccccacgatctgaagtggaggctttgcggatgatgagcatcctgaggagtcagtgtcagatttccctagacgtgacattatcggtgccgaacgtgtctgagggcatcgtgagactgctggacccacaaaccaatacagagatcgctaactatcctatctataagatcctgttctgcgtgcgcggacacgatggaacacctgaatcagattgctttgcctttaccgaaagccactacaacgccgagttgtttagaatacatgtgttcaggtgcgagattcaggaggccgtcagtccccaggaaaaaaccctctgcaagtag

SEQ ID NO: 23456 - DNA, 636 bp, Artificial Sequence
  Description of Artificial Sequence: Synthetic coding sequence
atgtgggccagcctgagcctggaccaccccagcgccaaggagaaccaagctctccgactcatcgagatgcgtgaggaaaacggcaacgttcctaaaacagagcaggcaggaagcctgaagccgctgcgcgataccggaaagtctaacttaaaggaaaaaaaggccaacagcaaactcaagcaaatcgagaaggagtatacccagaagcttgctaaatcctcccagattattgccgagctccagacaacaattagtagccttaaagaagaaaattcgcaacaacagctggccgctgagcggagacttcaagacgtgagacagaagttcgaggacgaaaagaagcagcttattcgggataacgatcaggccattaaggtcctccaagacgagcttgagaaccggtcaaaccaagttcggtgtgctgagaaaaaactgcagcataaggaactagagagccaggagcagataacctatatccggcaggagtacgagacaaagctcaaaggacttatgccggcctctctgaggcaagagctcgaggatactatctcatcattgaaaagccaagtgaattttctgcagaagcgcgccagtatcctgcaggaagaactgacaacgtatcagggcaggaggtag

SEQ ID NO: 23457 - DNA, 867 bp, Artificial Sequence
  Description of Artificial Sequence: Synthetic coding sequence
atgagcagcagcatgtggtacatcatgcagagcatccagagcaagtattcactctcggaacgcttgatacgtacaatcgccgctatcaggagtttcccccacgataatgtggaagatttgatcaggggcggagcggacgtcaactgtacacatggtacccttaaacccttgcattgtgcttgtatggtctcagatgctgactgtgttgaactgcttctcgagaagggcgccgaggtcaatgcactggatggatacaatcggacagctttgcattacgcggcagaaaaggacgaagcctgtgtcgaggtcctgctcgagtatggagccaatccaaacgccttagacgggaaccgcgacactccactgcactgggcggccttcaaaaataatgcggagtgcgttagggcacttctcgaatccggtgcgagcgtgaatgcgctggattacaataatgataccccactctcctgggcagccatgaagggcaacctggaaagcgttagcatcttacttgattacggagcagaggtgcgagtaattaacttgatcggccagacaccgatatcgcggcttgtcgcactgttagtgagaggcctaggaactgaaaaggaggactcttgctttgaactgcttcacagagctgtgggacacttcgaactgagaaaaaacggcacaatgccaagagaggtggcaagagacccacagttgtgcgaaaagctcacagtgctgtgttcagcccctggcaccttaaagactcttgcaagatacgctgtgaggcgctccctgggtctgcagtacctcccagatgccgtcaagggcctgcctctcccagccagcctcaaggaatacctccttcttctggagtag

SEQ ID NO: 23458 - DNA, 1341 bp, Artificial Sequence
  Description of Artificial Sequence: Synthetic coding sequence
atgcgggagatcgtgcacatccaggccggccagtgcggcaaccagatagggaccaaattttgggaggtgatatcggacgagcacgggattgaccctgccggcggttacgtgggggattccgccttgcagctggagcggataaacgtgtactataacgaatcgtccagtcaaaagtacgtgccgcgggccgctctcgtggacctggaacctggtactatggattctgtgcgcagcggtcccttcggtcaactgtttcggccagataattttatatttggacagacaggggcgggcaacaactgggctaaaggccactataccgaaggtgctgaactcgtggacgcagttctggacgtggtgcgcaaggaatgtgagcattgcgactgcctccagggctttcaactaacccattcccttgggggcggaactggatcgggaatggggactctgctaatctcgaagattcgggaggagtttcctgacagaatcatgaacacattctccgtgatgcccagtcctaaggtttccgacacggtcgtggagccatacaatgctacactgtcagtgcaccagctggtggagaacaccgacgagacatactgcattgacaacgaggcactttacgacatctgttttcgcacactgaaactgacaacgccaacgtatggcgatctcaatcatctcgtgagcgccacaatgagcggtgttactacaagccttagattccccgggcaactcaacgccgaccttagaaagttagcagttaacatggtgccatttccccggctccatttcttcatgcccggctttgccccacttacctcaagagggtcccagcaataccgcgccctgaccgtgccggagctcactcaacagatgttcgacgctcggaatatgatggcggcgtgtgatccccgacacgggcgctacctcacggtagctaccgttttcagaggcccaatgtccatgaaagaggtcgatgaacagatgctcgctattcagagcaagaattcctcatacttcgtcgagtggataccaaacaacgtgaaggtagccgtctgcgacatcccacctagggggctgaagatggcctccacatttataggaaactccacagccatccaggagctattcaaacgcatttcagagcaattttctgccatgtttaggcggaaagcattcctccattggttcaccggcgagggcatggatgagatggagtttacagaagcagaaagtaacatgaacgaccttgttagtgaataccagcagtatcaggacgcaaccgcaaatgacggcgaagaagccttcgaagacgaggaagaagagattgatggatag

SEQ ID NO: 23459 - DNA, 792 bp, Artificial Sequence
  Description of Artificial Sequence: Synthetic coding sequence
atgctgagcagcaagggcctgaccgtggtggacgtgtaccagggctggtgcggaccctgtaagcccgtagtgtctttgttccaaaagatgcgaatagaggtgggactggatttgctgcactttgctttggccgaggcggatcggttggacgtattggagaaatacaggggcaagtgtgaaccaaccttcctgttttacgcaatcaaagatgaagccctgtccgatgaagatgaatgcgtgtcacatggaaagaacaatggcgaagacgaagatatggtctcctctgagcggacttgtaccttagcaatcattaaaccggatgcggtagcacacgggaaaactgacgagattatcatgaagattcaggaagctggctttgagatcctgactaacgaggaacggacgatgaccgaagccgaggttcgtctgttttatcagcacaaagcaggcgaagaggcgttcgagaagttggttcatcacatgtgctctgggccctcacacctacttatcctgacacgtacggaaggctttgaggacgtggtgactacctggaggacggtaatgggtccccgcgacccaaacgtggctaggagagagcaacctgaaagccttagagcgcagtacgggaccgaaatgccttttaatgccgttcatggatcaagagaccgggaggacgccgaccgggaacttgctctgctgtttcctagtctgaagtttagtgacaaagataccgaggcaccccagggggaatcttcgactcagccacgcttaaagattaccgacctggattag

SEQ ID NO: 23460 - DNA, 1089 bp, Artificial Sequence
  Description of Artificial Sequence: Synthetic coding sequence
atgctgaagaacaagggccacagcagcaagaaggacaacctggccgtgaacgccgtggccttgcaggatcatatcctgcatgacctgcagcttcggaatctcagtgttgccgaccactccaaaactcaggttcagaaaaaagagaataaatctctaaagcgtgatactaaagccatcatcgataccggcctgaaaaaaacaacacagtgtccaaagctcgaggatagtgagaaagagtacgtgctcgaccctaaaccccctcccctcactttggctcagaagctgggtttgattggaccgcccccccctcctctgtcctctgacgagtgggagaaagttaagcagagatcactgctccagggggattctgtgcagccttgtcctatctgcaaagaggaattcgagcttagaccgcaggtgcttctttcctgctcgcacgtttttcataaggcgtgtctgcaggcttttgaaaagtttactaataagaagacatgtcccctgtgcagaaaaaatcagtaccagacacgagtaatccatgatggggccaggttgttcaggataaagtgcgtgacgcgcatccaagcctactggcgagggtgcgtggttagaaagtggtacaggaacctcagaaagacagtgccccctactgatgctaagctgcgcaagaaattcttcgaaaagaagttcaccgagattagccatcggatactctgcagttataacacaaacattgaagagctattcgcagaaatcgatcagtgcttggccattaatcgaagtgtccttcagcagcttgaagagaagtgcggacatgaaatcacagaagaagaatgggagaaaatccaggtgcaagcccttagacgagagacccacgagtgcagcatctgtctcgctccactcagcgccgcagggggacagcgtgtaggggccggtcgccggtctagagaaatggcgctgctctcgtgcagtcatgtcttccatcacgcctgtctactggcgctggaagagttcagcgtgggagatcgcccaccgttccacgcctgccctttatgccggtcatgctaccaaaagaagatccttgaatgttag

SEQ ID NO: 23461 - DNA, 291 bp, Artificial Sequence
  Description of Artificial Sequence: Synthetic coding sequence
atgatcgagaagatgcagggcagccggatggacgagcagcggtgctccttccctccaccactcaaaaccgaagaggattatattccatacccttccgtccacgaagtgttaggcagagagggacctttcccactgatactgctgccacagtttggcggctattggattgaagggaccaatcacgaaatcacttctatcccggagaccgaacctcttcagtctccaacgacaaaagtgaagttagaatgtaaccctactgcccgcatctacaggaagcacttcctgggatag

SEQ ID NO: 23462 - DNA, 459 bp, Artificial Sequence
  Description of Artificial Sequence: Synthetic coding sequence
atggccggcctgccccggcggatcatcaaggagacccagcggctgctggccgagccagtcccaggcattaaggctgagcctgatgaatcgaacgcccggtattttcacgtcgtgattgccggcccacaggattccccgttcgagggaggcacctttaaactggagctgtttctaccagaagaatacccaatggcagctccaaaagtgcggtttatgactaaaatctaccaccctaacgtggataagctgggcagaatctgcctagacattctcaaagacaagtggagcccagctctgcagatacggaccgtgcttctctcaattcaggcactcctttccgctcctaaccccgatgatcctttagcgaacgacgtggccgagcagtggaagactaacgaagctcaggcaattgaaacagccagggcctggaccaggttgtacgccatgaacaatatttag

SEQ ID NO: 23463 - DNA, 3354 bp, Artificial Sequence
  Description of Artificial Sequence: Synthetic coding sequence
atgtaccggagcagcgcccggagcagcgtgagcagccaccggcccaaagatgacgggggtggaggaccgcgtagtggtcgttcctccggttcaagctccgggcccgcccgaagatccagtccccccccaccaccctcaggatcaagcagtcgtacacccgccaggcggcctcgatctccatctggacaccgcggccggagggcaagcccaagcccacctagaggccgaagagtgtctcctagcccgcctagggcccgtagaggcagcccttcccccccgcgaggtcggcgtttgttcccgcccggccctgcgggattccgaggcagctcacggggagagtctcgcgctgactacgctagggacggcagaggcgaccacccgggagactccggatctagaaggaggtctcctggcctctgtagcgacagccttgagaaatcgttaagaatcaccgttggaaacgatcacttctgtgtctcaacccccgaacgcagaaggctgagcgaccgacttggatctccagtggacaacttagaggacatggatcgcgacgacttgacagacgattccgtgtttacccgctcctcccaatgctcacggggcctggaaagatacatatcacaggaggagggcccattgtctccttttctcggccaactagacgaagactaccgcacgaaagagaccttcctgcatcgctccgattactcgccacacatctcctgccatgacgagcttctgagggggacggaaaggaaccgagaaaaactgaaaggatattcaatccgcagtgaggagcgctctcgtgaggctaaacgtcctagatacgacgatacagtgaagattaactccatgggaggggaccaccccagctttacatctggaacccggaattataggcagcggagacggagcccctccccccgtttcctggatcccgagttccgcgagctggaccttgctcgtcgcaagagagaggaggaggaggaaagatctagaagtttgagccaggagttagtgggcgttgacggtggcggcacagggtgctcaatccctggcttatctggagttctcactgcttccgagccaggctattccctgcacagacctgaggaagtcagcgtaatgccgaaaaagtcaatcctgaaaaagaggatcgaagtggacataatggagccaagcatgcagttagagagcttttctagctcaacatctagcagccaggaccacccactctatagcggccatcctagcctgcctctgagcggtgccatagccgccttcgctagcgagatcgagaacaaaggcaccatggtggagaccgcacttaaggagccacaggggaacctttaccagtgggggcccttacctggtattccgaaagataactcacctctcagggagaagttcggcagctttctctgccacaaggacaacctcgatctcaaggccgagggacctgagagacacactgactttctgctcccacatgagcgcgcttctcaggacgggtctggattctcgcggattttaagcatgcttgccgactctactagtactcaggagaaaagacggaggtccttccccgacattgaggacgaagagaaatttctgtacggggacgaggaggaagatctgaaggccgaaagtgtgccaaagcctttgggcagttctgaaagcgaggtcatgcgccaaaaggcaagtagcctccctagctctgccccagctgtgaagcttgagagcttggaggaaacgaatcccgaatacgctaaaatccatgacctccttaagactatcgggcttgacatcggggtggcagaaataagtcagctggccgctaggacccaagagaggttgcatggtaagaaacctagccttaggagttcggccgatcggcggagcagcgtcgaccgatatttctcagctgatcactgttcatccgtcgatcaccgattttcggcagaccgctgctccagtgtggaccactgcttcagtgctgatcgcagatcgagcgatcctcacagactcgagagtcgggaggcccaccactcaaatacgcactccccagaggtgtcccatccccatccaccaagcccagtcgacccttatctccttaccaaaaattccccgccatttttgaaatctgaccaccctgtgggacacattagcggtcccgaagtcgtgggaagtggatttcagtctagtgtggccgtgcgatgtatgcttccatcagcccccagcgctccaattcgactcccccataccgccgccttgagccagttccatatgccccgggcctcgcagtttgccgccgcaaggataccgcccaactaccaggggccagcaatcccaccggcctcattcgacgcttatagacactacatggcatatgccgcgtcacgatggcccatgtatcctacgagccagccttccaaccacccggtgcctgagccccacaggattatgcctatcaccaaacaggccacccgatcccggcccaacttaagggtgattcctacagtaaccccagataagcccaaacaaaaggagagcctgcgcggaagtataccagccgcgcaggttcccgtacaggtgtcaattcccagtctcattagatacaatcctgagaaaatttcagacgagaaaaacagagcgtctcaaaagcagaaagttattgaggaacgagaaaagctaaagaatgaccgagaggcacgccagaagaagatgtactatttaagaacagagctagaacgtttacataagcagcagggggagatgctgcgtaaaaagcggagggagaaggacggacataaggatccactgctggtcgaggtgtctcgcctccaggacaatatcatgaaagacatcgccgaactgaggcaagaggctgaggaagccgaaaagaaacagtcagaactggataaagttgctcaaatactgggtattaatatctttgacaaaagccaaaagtccttatccgacagtagggagcctaccgagaagcccggcaaagcagagaagtccaagagtcctgaaaaagtgtcctcgttcagtaactcctcatctaacaaagagagcaaggttaataatgagaagtttaggacgaaaagccctaaacccgcagagtcccctcagtctgctacaaaacagctggaccaacctacagccgcctacgaatactacgacgcagggaatcactggtgcaaagattgtaatactatctgtggcacgatgttcgacttcttcacccatatgcataacaagaaacatacgcaaggccaattccagaaatcgtccgattttcagaaagaagggttgcagcaaacatttttgccacccgaacggcagggatag

SEQ ID NO: 23464 - DNA, 576 bp, Artificial Sequence
  Description of Artificial Sequence: Synthetic coding sequence
atgtacgtgtgcctgtgcgtgagcgtggccaaggtgaccatggccgatagggccgcggctgagagggcttgtaaagatcctaatcccatcatagatggaagaaaggctaacgtgaatttggcctatctgggggccaaaccaagaatcatgcaacctggattcgcctttggggtgcagcagctgcacccggcactgatccaacgtccgtttggaatcccggcccattatgtgtatccacaggcctttgtgcagcccggggtcgtgatcccccatgtgcaaccaaccgctgcggcagcatctacaacgccgtacatcgattacacaggagctgcctatgcacagtattccgcggccgccgccgcagcagctgccgcagcagcctacgaccagtacccttatgctgctagcccggcagcggccggttacgtcacggcaggtggttacgggtacgccgtccagcagcctatcactgccgcagctccagggacggccgctgcagccgccgccgcagctgccgctgctgctgcatttggccaataccagcctcagcaattgcagaccgataggatgcagtag

SEQ ID NO: 23465 - DNA, 330 bp, Artificial Sequence
  Description of Artificial Sequence: Synthetic coding sequence
atggccggcgcccccaccgtgagcctgcccgagctgcggagcctgctcgcgtcaggccgcgccaggctgtttgacgtgcggtccagagaggaagcagccgcagggacaattccaggcgccctgaatatccctgtgagcgaactggagtccgcactgcagatggaaccagccgcctttcaggccctctatagtgccgaaaaacccaagctagaagacgaacacttggtgttcttttgtcaaatgggtaaacggggcctccaagctacccaactggctcggtctctggggtacactggttacggagaagtatggcttctggctggccgttag

SEQ ID NO: 23466 - DNA, 630 bp, Artificial Sequence
  Description of Artificial Sequence: Synthetic coding sequence
atggccctgctggccgagcacctgctgaagcccctgcccgccgacaaacaaatcgagacgggccccttcctggaggccgtgtcacatttgcctccctttttcgactgcttgggttcccctgtgtttactcccatcaaagcagacatcagcggcaatatcacgaagattaaggccgtgtatgatacaaatccagcaaaatttcgtaccctacagaatatcttggaagtggagaaggagatgtatggcgctgagtggccaaaggtcggcgcaacccttgcactcatgtggctgaagcgcggccttcggtttatccaggtctttctgcaatccatatgcgatggggaacgggatgaaaaccatcccaatcttatacgagtaaacgccaccaaagcctatgagatggctcttaagaagtaccacggttggattgtccagaaaattttccaggctgcactgtatgccgccccatacaaatctgactttttgaaagccctaagcaagggtcaaaacgtgaccgaagaggaatgtctggagaaaattcggctgttcctggtcaactacactgccactattgatgtgatctatgagatgtacactcagatgaacgccgaactgaattacaaggtgtag

SEQ ID NO: 23467 - DNA, 474 bp, Artificial Sequence
  Description of Artificial Sequence: Synthetic coding sequence
atggaggaggcccagcggaagcggacccagctgcgggaggccttcgagcaactgcaggccaagaagcagatggccatggagaagagacgtgctgtgcagaatcagtggcagcttcagcaggaaaagcacctccagcatctcgccgaggtgtcagccgaggtcagggagagaaagaccggaacccagcaggagctggatcgcgtcttccagaaactagggaatttgaagcaacaggctgagcaggaacgcgacaaattacagagataccaaacattcttacagctgctttataccctgcaggggaagcttctcttccccgaggctgaagctgaagcagaaaacctccctgacgataagccccaacaaccaacgcgtcctcaggaacagtcgaccggcgatacaatgggacgcgacccaggcgtttcttttaaagctgtgggactgcaaccagccggagacgtgaacctcccatag

SEQ ID NO: 23468 - DNA, 639 bp, Artificial Sequence
  Description of Artificial Sequence: Synthetic coding sequence
atggaggtgctgcggcggagcagcgtgttcgccgccgagatcatggacgcttttgatagaagcccaaccgataaagaattggtcgcacaggccaaggcactcggccgggagtacgttcacgctaggctgctccgcgccggcctaagttggtctgccccagagcgggcggcaccagtgcctggtagattggcagaggtttgcgccgttttgctgcggcttggtgacgaacttgaaatgatccgcccttctgtctacagaaacgtcgcccggcagcttcacatatccctgcagtcagaaccggtggtcacagacgcctttttggcagtagccgggcacatattcagtgcaggaatcacttggggcaaggtggtgtcactgtacgccgttgcagccggcctggcagtcgactgcgtgaggcaggctcagcccgcaatggtgcatgctttggttgattgcctcggtgagtttgtccgtaaaacgttggccacttggcttaggcgcagggggggatggacagacgtgctgaagtgcgttgtttctactgaccctggtctgcgctcccattggcttgtcgccgcactatgctctttcgggcgattccttaaagctgcatttttcgtgctcctgcccgagaggtag

SEQ ID NO: 23469 - DNA, 2148 bp, Artificial Sequence
  Description of Artificial Sequence: Synthetic coding sequence
atgagccagagcggcgccgtgagctgctgccccggcgccaccaacgggagtttgggaaggtccgacggtgtcgccaaaatgtctccaaaggatttgtttgaacagcgtaagaaatattctaactcaaatgtgatcatgcatgagacgagtcagtaccacgtccagcaccttgccacctttattatggataagagtgaggctatcacctctgtcgatgacgctatccgaaaactcgtgcaattaagcagtaaagagaagatctggactcaggaaatgctgctccaagtgaacgaccagagcctgcgcctcctagatattgaaagccaggaagagttggaggacttcccccttccaactgtccagcggagtcagacagtgctcaaccagctgcgttatcctagcgtactcttactggtctgtcaggactccgaacagtcgaagcctgacgtccactttttccactgcgacgaggttgaggccgagttggtacacgaggatatcgaatcagcattagctgattgccgtcttggcaagaagatgcggcctcagactctgaagggtcaccaggagaagattagacagagacaaagcatcttgccacccccccaggggccagcccctattccctttcaacatagggggggggactcacctgaggccaaaaaccgcgtcgggcctcaggtccctctttctgaacctgggtttagaaggagagaaagccaggaggagccacgcgctgtcctggctcagaagatcgagaaagaaacacagatcttgaactgtgccctcgacgatattgagtggttcgtcgcgaggctgcaaaaggccgcagaggccttcaaacaactgaaccagcgcaaaaaaggcaaaaagaaagggaagaaggcccccgccgaaggcgtcctaacactaagggccaggcctccatccgaaggcgaatttattgattgcttccagaagattaagcttgctattaacctgctggcaaagctgcagaaacacatccagaatcccagtgcggctgagctcgtccactttctgttcggcccgctcgacctcattgttaatacgtgcagcggaccagacatcgctagatcggtgagctgccccctcctcagtcgcgacgccgtcgattttctgaggggacatctcgtccccaaggagatgtcactgtgggagagcttgggtgaaagctggatgagacctcgcagcgagtggcccagggagcctcaagttcctctctacgtccctaaatttcacagtggatgggaaccacccgtagacgtgttgcaggaggcgccatgggaggtggagggactcgcctccgcgccgattgaggaagtgagtccggtgtcaagacagtcaattcggaattctcagaaacatagtcccacttcggaacctacacctcctggcgatgcattgcctccggtatcttctccacatacccatagaggctaccagcccacaccagccatggctaaatatgtgaagatcctgtatgatttcactgctcgcaacgccaatgagctgtcggtgctcaaagatgaagtgcttgaggtactggaagatggccgacaatggtggaagctccgctcccgttccggtcaggccgggtatgtgccatgtaatattttaggggaggcccggccagaagatgccggcgccccattcgaacaagcgggccagaagtactggggcccagcctctccgacgcataagttacctccatccttcccaggcaataaagatgagctgatgcaacatatggatgaggttaatgacgaactaatcagaaaaatttcaaacatccgtgcgcagccgcaaagacacttccgggtggagcgatcacaacctgttagtcagccattgacctacgagagtggacctgacgaagtgagagcctggctggaggctaaggcttttagtcctcgaatcgttgagaatcttggcatcctcactggcccacagttgttctctctgaataaggaggagcttaaaaaagtgtgcggcgaagagggggtgagagtctacagccaactgaccatgcagaaggcattccttgagaagcagcagagcggcagcgagctggaggaactcatgaacaaatttcactcaatgaaccagaggcgcggtgaggactcatag

SEQ ID NO: 23470 - DNA, 600 bp, Artificial Sequence
  Description of Artificial Sequence: Synthetic coding sequence
atggcctggccctgcatcagccggctgtgctgcctggcccggcggtggaaccagctcgatcgtagcgacgtggctgtcccccttactctgcatggctactcagacctggacagtgaggagccggggacgggcggcgccgcctcgagacgcggccagcccccagctggagcgagggacagtggcagagatgtgcctctcacccagtatcaacgagatttcggtctctggactactcccgcaggccccaaggatccacctccggggagaggtccgggcgctggaggaaggcgcggcaagtcgagcgcacagtcatccgcccccccggctcccggggcccgcggggtgtatgttcttcctataggcgatgctgacgctgcagccgcagtaacgacaagttatcgacaagaatttcaagcctggacaggcgttaagcccagtcgatccacaaagaccaagcctgcaagagtgatcaccacacacacaagcggctgggatagttcgcctggcgccggctttcaagtccccgaggtccggaagaagttcacccccaacccaagcgccatctttcaagcttcggccccccggattctcaacgtttag

SEQ ID NO: 23471 - DNA, 5106 bp, Artificial Sequence
  Description of Artificial Sequence: Synthetic coding sequence
atgggcaacagcgacagccagtacaccctgcagggcagcaagaaccatagtaacaccattacaggagccaagcagattccatgttccctcaaaataagaggaattcacgccaaggaagaaaagagtttgcacggttggggccatgggagtaacggagcaggatacaagagccgctctctcgctagatcctgtctgagtcatttcaaatctaatcagccctatgcctctcggctcggcggacctacatgtaaggttagccgtggtgtagcttacagtactcaccgaactaatgcccctgggaaggactttcaagggatctctgccgccttttccaccgagaacgggtttcactctgtgggccatgagctcgcagacaatcatataactagccgcgattgcaatggccacctcctcaattgctatgggagaaacgaatccatagccagcaccccccctggcgaagaccggaagtcacccagggttttaattaagacgctcggaaaactggacggctgcttacgggtagaattccataacggaggcaatccctcaaaggtgccagccgaggactgctccgagcccgtgcagctccttcgttacagccccactctggcaagcgagacaagccctgtacctgaagccagacgcggatctagcgcggactcccttccctctcatagacctagcccaacagacagtcgtctacggtcttcgaagggctcttctctgtcctctgaaagctcctggtatgattcaccgtggggcaacgccggcgagctgagtgaggccgaagggtctttccttgcacctggtatgcctgatccatcactgcatgcctctttcccacctggagatgcgaagaagccattcaaccagagctcgagcctgagctcactgagagagctctataaggacgcgaatctggggagcctttcccccagcggtataaggctaagcgatgagtacatgggtacccatgcgtcgctttccaatcgagttagtttcgcttctgacatagacgttccctcgagggtcgcgcacggcgatcccattcagtacagttcatttacactcccgtgtaggaagcctaaggcgttcgtggaagacactgccaaaaaagactccctgaaagcaaggatgcgtagaatctcagactggactggtagcctttctagaaagaagagaaagctgcaggagcccagaagcaaggaaggctcagattatttcgactctcggtctgatggcctgaacaccgatgtacaggggtctagtcaggctagcgccttcctgtggtccggcggctctacacagatcctcagccaaagaagtgaatccactcatgccatcgggtccgaccctctccggcagaatatatacgagaacttcatgcgggaactggaaatgagtagaaccaatactgagaatatcgagacgtctaccgaaaccgccgaatctagttcagaaagtctgtcatcgctggagcagctcgatctgctgtttgaaaaagagcagggtgtggtccgcaaggccggctggctgttctttaagccactggtaacagtgcagaaagaacgcaagttagaactcgttgctcggcgaaaatggaaacagtactgggtaacacttaaagggtgcactctgttattttatgagacatacggtaagaattccatggatcaatcgtccgctcccagatgtgctctctttgccgaggattcgatcgtgcaatctgtgcccgaacatcccaagaaagagaacgtcttttgtctgagtaactcctttggtgacgtttacctgttccaggcaactagtcagaccgatctggaaaattgggtgaccgcagttcactctgcttgcgctagcctgtttgccaagaagcatggcaaagaagatacactgagactgctcaagaaccagaccaagaatttattgcagaaaatagacatggacagtaagatgaagaaaatggccgaactgcagctgtctgttgtctccgaccccaagaatagaaaggctatcgagaatcagattcaacagtgggaacagaatctggaaaaatttcatatggacctttttcgcatgagatgctatttagctagccttcagggaggggagttgccgaaccctaagtcacttctagctgccgcttcccgcccatcaaaactagcattgggacggctgggcatcctttcagtttcaagctttcacgccctggtgtgctccagggatgattctgccctcagaaaacgcaccctgtccctgacacaacgggggagaaataagaagggcatattttcatccctgaaaggcctggataccctcgcccgtaagggaaaggagaaacgtccaagcatcacgcaggtagatgagctcttgcacatttacggtagcaccgtggacggggtgcccagggataacgcgtgggaaattcaaacctacgtgcactttcaagataatcacggtgtcacagtggggattaaacccgagcatagggtagaggatatcttgaccctggcctgtaagatgcgccagctggagccatcccactacgggcttcagctgcgcaaacttgtcgatgacaatgtggaatattgcattcctgcaccctacgagtatatgcagcagcaagtgtacgatgagattgaagtgtttccattaaacgtgtacgatgtgcagctgacaaagaccggttctgtttgtgatttcggatttgcggttactgctcaagtcgacgaaagacaacatctatcaagaatcttcataagcgatgtcctgcccgacgggcttgcttacggagagggcctgagaaaaggtaacgagattatgactctgaacggcgaggcggtgagcgatctcgaccttaaacagatggaggctctgtttagtgaaaagagcgtgggcttaacgttgatcgctaggccccctgacacgaaagcaaccctatgcaccagttggtctgacagtgacctgttcagccgagatcagaaaagtctgctacccccgcccaatcagagccagttgctggaagagttcttagataatttcaagaagaatacagccaatgattttagtaatgttcctgacatcactaccggcctgaaaagatcccagacagatgggaccctcgatcaggtgtcccacagagagaagatggagcaaaccttccgctccgccgagcagatcaccgccctgtgccgatcattcaacgactcccaggcaaacggaatggaaggcccccgggagaaccaggacccgccccccaggtctctcgcccgccacctctctgatgcagacagattacgaaaggttatccaagagcttgtcgacaccgagaagtcttacgtgaaggacctctcttgtctcttcgagctgtacctcgagcctttacagaatgaaacctttttgactcaagacgagatggagagcctcttcggtagtttacctgagatgctggaattccagaaagtcttcctggaaaccttagaagacggtatcagcgcctcttcagattttaatactctagagactccatctcagtttcggaaattactgttctctctcgggggatccttcttatactacgctgaccatttcaaactgtatagcggcttttgcgccaatcatatcaaggtccaaaaggtgctcgaacgagccaagactgataaagcatttaaggcgttcctggatgctagaaacccaaccaagcagcactcttcgacactggaatcatacctcattaagcccgtgcagagagtattgaaatacccacttctgttgaaggaattagtttcattgaccgaccaggagtccgaggagcactaccatttgactgaggcgttaaaagcaatggaaaaggtggccagtcatatcaatgagatgcagaagatttacgaagactacggtaccgtattcgatcagctggtcgccgaacagagcggtactgagaaggaagttacggaattgagcatgggcgaactcctgatgcatagcacggtgtcttggcttaatccttttctttccctgggaaaagctaggaaagacctggagctgacagtcttcgtgttcaagagggccgtcattctggtgtataaggaaaactgcaagctgaagaaaaagctcccgtccaatagccgccctgctcacaacagtacagacctggacccctttaagttccggtggctcatacccatatctgcgctgcaagtccgactgggcaacccagcagggacagagaacaactctatttgggagctgatacacactaaatctgagattgagggccgccccgaaaccattttccagttgtgctgttctgattcagaatcaaagacaaatattgttaaagtgatcaggtcgatcctccgggagaacttcagacgtcacatcaaatgtgagctgcccctggaaaaaacatgtaaggatcgtctggtgcccctgaaaaatagagtgcccgtgtcggctaagctggcatcttctagatcactaaaggtgttaaaaaacagctctagcaacgagtggaccggcgagaccggtaaaggaacactgctggattccgacgagggttccctctcttcgggtacccagagctctggctgccctaccgctgaaggacgtcaggattcaaaatctacctcacccggaaaatacccccatccaggtctggccgatttcgccgataatctcatcaaagagagtgacattctgagcgatgaggatgatgatcaccggcagactgtgaagcagggcagccccacgaaggatatcgagattcaatttcagaggttgagaatctcagaggatccggacgtgcaccctgaggccgagcagcagccaggtcccgagtcaggtgagggccaaaaaggaggagaacagcccaaacttgtgagagggcatttctgtccaattaagagaaaagctaactctaccaagagagaccggggcacacttctcaaggcccagatccgacaccagtcactggactctcagtcggaaaatgccactatcgacctaaactccgtgctggaaagagaatttagcgttcagagcctgacaagcgtagtgtccgaagagtgtttctacgaaactgaatctcacggtaagtcatag

SEQ ID NO: 23472 - DNA, 3177 bp, Artificial Sequence
  Description of Artificial Sequence: Synthetic coding sequence
atggacctgggccccctgaacatctgcgaggagatgaccatcctgcacgggggatttctcctggccgaacagctgtttcatcccaaggcactggccgagctgacaaagtccgactgggaacgggtcggccggccaattgtggaagctctccgtgaaattagttcagcagcagctcacagccagccattcgcctggaagaagaaagccctcatcattatttgggccaaggtactacagccccacccagtgacaccgtccgatacggagacgagatggcaagaggatctgtttttttcagtgggcaatatgatccccaccatcaaccacactattctgtttgagcttctgaaatccctggaggcgtcgggcctttttatccagcttctgatggccctgcctaccaccatttgtcacgcagagctggagcgatttttagaacacgttactgttgacactagcgccgaagatgttgcattcttcctggacgtgtggtgggaggtcatgaaacataagggccacccccaggatcccttgctgtctcagttctcagctatggctcacaagtatctcccagcactcgacgaatttccccacccccctaagagactccgtagtgatcctgacgcttgtcctaccatgcccctactcgccatgctcctgcgaggcctgacccagattcagagccggatactcggacctggtagaaaatgttgtgctctagcgaatttggccgacatgttgacagtcttcgcactgaccgaagacgatccccaagaagtttctgctaccgtctacctggacaaacttgcgaccgtgatctccgtctggaattctgatacgcagaacccttatcatcagcaggcactcgccgaaaaggttaaagaagcagagagggatgtcagcttgacttcactggccaaactcccctcggagaccatctttgttggatgtgaatttctgcaccacttgctccgggaatggggagaagaactgcaagccgtgttgcgttcatctcagggtacttcttacgactcttaccggctttgcgactccctgacctccttttcacagaatgctactttgtacctgaacaggacgtctttgtccaaggaggatagacaggttgtgtctgagctggctgagtgcgttagggactttctaaggaaaacctccactgttcttaaaaaccgtgccttagaggacattacagcctccatcgcaatggcagttatccagcagaaaatggatcgtcacatggaagtgtgttacatcttcgccagtgagaagaaatgggccttctcggacgagtgggtggcatgcctcggaagtaatcgagcactctttagacagcctgacctcgtcctgcggcttctggagaccgttattgatgtgagcaccgctgacagagcaatccctgaatcccagatcaggcaagtcatacatctcatcctcgagtgctatgcggatctgtctctgccaggaaagaacaaagtccttgcagggatcttgcggtcttggggcaggaaggggctcagtgaaaaactgctggcatatgtggaaggctttcaggaagacctgaatacgacgtttaatcagttgacacaatctgcttccgagcaggggcttgctaaggccgttgcatctgtggcccgccttgttattgtccaccctgaggtcacagtcaagaagatgtgctcacttgccgttgtcaatctgggcactcataagtttctcgctcagatcctaactgcgttccctgccctgcgattcgtggaggaacagggaccgaacagtagcgctacttttatggtaagctgtctgaaagaaacagtatggatgaaattttcaacacccaaagaagagaaacagttcctggaattgctgaactgtttgatgagcccagtcaagccacaggggataccggtggcagccctcctggagccggacgaggtcttgaaagaatttgttttgccgttcctcaggctcgatgtggaggaagtagatctaagcctgaggatcttcatccagacactagaggctaatgcctgtcgggaggagtattggcttcagacttgctctcccttccctctactgttctcactatgccagcttttggaccgctttagtaagtactggcaactccccaaggagaagagatgtttgtctctggacaggaaggatttggccattcacatcctcgaactgctatgtgagattgttagtgcgaacgctgagacttttagccctgatgtgtggataaaatctctgagctggctacacaggaagctcgagcagctggattggaccgtgggattacggctcaagtccttttttgaggggcattttaaatgtgaggtgcctgccactctatttgagatctgtaaactgagtgaagacgaatggacatcacaggcccaccctgggtatggagctgggaccgggcttctcgcatggatggagtgttgctgtgtgagcagtggcatctccgaacggatgctttcccttctggtcgtggacgtcggaaaccctgaggaagtccgtctgttctctaaagggtttctcgtggcattggttcaagttatgccttggtgcagtccccaggaatggcaaagactgcatcagctgacccggagactgctggagaagcagctgctgcacgtaccttactccctggaatatatccagtttgttcctctgttaaatctgaaaccctttgcccaggagttgcagctctcagtgctgttcctcagaacatttcagttcctctgtagccatagctgccgtgattggctcccactggaggggtggaaccatgtggtcaagttgctctgcggcagcctgacacgcctccttgacagtgtcagagccattcaggccgccggcccttgggttcaaggacccgagcaggatctgacccaggaagctctattcgtttacacccaagtcttctgccatgccctgcacataatggccatgctccacccagaggtgtgtgagccactgtacgtcttggcactggaaaccctaacatgttacgagacgctgtcaaagaccaatccttctgtatccagcctcctccaacgtgcccatgaacagaggtttctgaagtcaatcgcggagggtatcggccctgaggagcgtcgccaaacccttctacagaagatgagcagtttctag

SEQ ID NO: 23473 - DNA, 267 bp, Artificial Sequence
  Description of Artificial Sequence: Synthetic coding sequence
atgagcggcctgcgggtgtacagcaccagcgtgaccggcagccgggagatcaagtcccagcaatcggaggtgactcggattttagacggaaagcgcattcaataccagttagtggacattagccaggacaacgcactccgtgacgaaatgcgggctctggctggtaatcccaaggccactcctccccagatcgttaacggcgaccagtactgtggcgtgtgggcaggaggacggggtggaggcggctcagtgggacgtgggctgtag

SEQ ID NO: 23474 - DNA, 933 bp, Artificial Sequence
  Description of Artificial Sequence: Synthetic coding sequence
atggacggcagcttcgtgcagcacagcgtgcgggtgctgcaggagctcaacaagcagagggagaaaggccaatactgtgatgccacacttgatgttggcgggttggtgttcaaagcccactggagtgtgttggcttgttgcagtcatttctttcagagcttgtacggcgacggttccggcggtagtgtggtcctcccggccggtttcgccgagatattcggactcctgctggacttcttttatacagggcacctcgcccttactagcggtaatagggaccaggtactcctagctgcacgggagctgcgagttccagaagccgtggagttatgccagagctttaaacccaagacttctgttggacaggccgcgggtggtcagtccggccttggcccaccagcttctcagaatgtcaacagtcacgtaaaggaacctgccggactcgaggaagaggaagtgtctcgaaccctcgggctggtgccccgcgaccaggaaccccgcgggagccattccccccagagacctcagttacattctcccgcgcagtctgagggcccttcatctctttgtggaaaacttaagcaggcactgaagccgtgtccgctagaagacaagaaacctgaggattgcaaagtgccccctaggcccctggaggcagagggtgctcaactccagggcgggagtaacgaatgggaagtggttgtgcaggtcgaagacgacggggacggagattacatgagcgagccagaagctgttctgacccggcgcaagtcaaatgtaatccgaaagccatgcgccgcagagcccgcactgtctgccggtagcctcgcagcagagccggctgaaaatcgcaaagggaccgcggttccggttgagtgccctacttgccacaaaaaatttctgtctaagtattacttaaaggtccataattag

SEQ ID NO: 23475 - DNA, 600 bp, Artificial Sequence
  Description of Artificial Sequence: Synthetic coding sequence
atgagcagcggcaacgccaagatcggccaccccgcccccaacttcaaggctaccgcggtgatgcctgatggtcagtttaaagatatcagtctgtctgattataaaggcaaatacgtagtgttcttcttttatccactggactttacttttgtttgccccaccgagattattgccttctccgaccgcgctgaggaattcaagaagctcaattgtcaggttatcggtgcctccgtggactcccatttctgccatttggcttgggtcaatacgccaaagaagcaaggtggcttgggccctatgaacatccccttggtgagcgacccaaaaagaaccattgcacaggattatggcgtgctgaaagcggatgaagggattagtttcagagggctattcatcattgacgataagggtatactgcgccagatcactgtgaatgaccttcctgtggggagaagcgtggatgagacgcttagattggtgcaggcctttcagttcacagacaaacacggcgaagtctgccctgccggttggaaacccggcagtgacactattaaaccagacgttcagaaatcgaaggaatacttctccaaacagaaatag

SEQ ID NO: 23476 - DNA, 513 bp, Artificial Sequence
  Description of Artificial Sequence: Synthetic coding sequence
atgagcgtggccggcggcgagatccggggcgacaccggcggcgaggacaccgctgctccggggagattctcttttagtccagagcctaccttggaagacattcgtcggctgcatgctgagtttgcagcagagagggattgggagcagtttcatcaaccacggaacttgctgttggctttggtgggggaagtcggagagttagcagaattattccaatggaaaaccgacggcgagcctgggccacagggatggagtcccagagagcgggctgctctgcaggaggaactctccgatgtgctcatctaccttgttgcattagccgctcggtgcagagtggaccttcccttagctgtgctcagcaaaatggatattaacaggagacggtatcccgcacacctggccagaagttctagccgtaagtatactgagctgccacatggagctattagcgaagaccaagccgtgggaccagctgacatcccttgcgactcaaccggtcagacgtcaacctag

SEQ ID NO: 23477 - DNA, 702 bp, Artificial Sequence
  Description of Artificial Sequence: Synthetic coding sequence
atgagcgccaagcgggccgagctgaagaagacccacctgagcaagaactataaggcggtgtgtctggagctaaagcccgagcccacaaaaacgtttgactacaaggctgttaagcaggaagggcgcttcacaaaggccggagtcacacaagatttgaaaaacgaactgagggaggtcagagaggaattaaaggaaaaaatggaggagatcaaacagatcaaggacctcatggacaaagatttcgacaaactacacgagtttgtggaaattatgaaggagatgcagaaggatatggacgagaagatggatatcttgatcaatacgcaaaaaaattacaaacttccactccgccgggccccgaaggagcagcaggagctccgcctaatgggaaagactcatagggagccgcaactgcgccccaagaaaatggacggcgcttctggagtgaatggcgccccttgcgcactacataagaaaactatggcacctcaaaagactaagcagggctccctggatcctctgcaccactgtgggacgtgttgcgaaaagtgcctactttgcgcacttaagaacaactataacagaggcaatattcccagtgaggcaagcggactgtacaaggggggcgaggaacctgtaaccacacagccatcagtgggccatgctgtgcccgcccccaagtcgcagaccgaagggaggtag

SEQ ID NO: 23478 - DNA, 2196 bp, Artificial Sequence
  Description of Artificial Sequence: Synthetic coding sequence
atgagcgtgaccctgaccagcgtgaagcgggtgcagagcagccccaatcttctcgctgctggacgagattcccagtctccagactctgcttggcggagttacaatgatgggaaccaggaaacactaaacggagatgcaacttactcttctctggccgccaaaggcttccggagtgtaagacccaacctgcaagataaaagatcccctacccaatcccagatcaccgtgaacggcaatagtggcggagccgtgtctcctatgtcttactaccagcgtcctttttcccccagcgcttactcgctgcccgcatccttgaactctagcattgtcatgcagcacggtaccagtttagattcaacagatacctacccacagcatgctcagagcctcgatgggactacctcatcctccatccccctctatagatctagtgaggaggaaaaacgagttaccgtgattaaggctccccactacccaggaatcggccctgtcgatgaaagcggtatccctaccgcgatccgaaccacggttgatcgcccaaaagattggtacaaaacgatgttcaagcagatccacatggtgcataagcccgacgacgacacggatatgtacaacacaccttatacctataatgccggtttatataatccaccttactctgctcagagccatccggccgctaaaacccaaacatacaggcctcttagcaaaagccattcggacaattccccaaacgcctttaaggacgcatcttctccagtccctccaccgcatgttcctcctcccgtgccaccactgcgccctagggatcggtctagtacagagaaacacgactgggatcctcctgatcgcaaagtggacactcgaaaattcaggtccgaaccccggagtatctttgaatatgagcccgggaaatcttccatcttgcagcacgagcggcccccacctctgcccaccaccccaacacctgtgccaagggagccagggcgcaagccattatcctccagtcggctgggggaggtcactggttctccctcgccgcctccccgtagcggggcccctacacccagcagcagggccccagcactgtctccgacacgccccccgaagaaaccactggattatgtccaggaccattctagtggcgtgtttaacgaggcctcgttataccagtcatcgatcgaccgatccctggagcggcccatgagtagcgctagcatggcttcagatttcagaaagcgcagaaaatctgaacctgcagttggaccaccaagagggctgggagatcaaagtgcttcaaggacttcacccgggagagtggacctgcccggatccagcacgactcttactaagagtttcactagcagcagcccttccagcccctctcgagcgaaggatcgagagtcaccccgcagttacagttccactcttaccgacatgggccggtccgcccctcgcgaacgccgcggcacccccgagaaggaaaaattgcctgcgaaggcagtttatgattttaaagctcagacatccaaggaactgtctttcaagaagggcgataccgtttacatacttaggaagattgatcagaactggtacgagggcgagcaccacggacgcgttggtatattccctatctcgtacgtggagaagcttactccgccggagaaagcccagccagctagacccccaccacctgcgcagccaggggagatcggtgaggccatagcgaagtacaattttaatgctgatacgaatgtggagctgagtttgcgtaaaggcgatcgggttattttattgaaacgagttgaccagaattggtacgagggcaaaatcccaggtaccaaccggcagggaatcttccctgtcagctacgtggaggtggtaaagaagaacactaagggagccgaagattaccccgatcctccgatacctcattcatactcatcggatcgcattcacagcctatcttcaaacaagcctcagcggcccgtcttcacacacgagaacattcagggaggcggggagccatttcaggcgctatataactacaccccccgcaacgaagatgaactcgagctacgcgagtccgacgttattgatgtgatggaaaagtgcgacgatgggtggttcgtcggaaccagtagaagaactaaatttttcggaacctttcctggcaattacgtgaagcgcctatag

SEQ ID NO: 23479 - DNA, 969 bp, Artificial Sequence
  Description of Artificial Sequence: Synthetic coding sequence
atgaccctggaggccatccggtacagccggggcagcctgcagatccttgatcagctactcctgcccaaacagagtcgatacgaagcagtaggatctgtgcatcaggcctgggaggcaattcgggctatgaaagtgcggggggcacccgccatagctctggtgggctgcctgtccctggcggtggaattacaggcgggcgccggcgggccaggcctggctgccctggtggcctttgttcgggacaaactttctttcttagtgaccgcgcgaccaacagccgtcaatatggccagggctgccagagatctggcggatgtagctgcacgcgaggctgagagggagggcgccactgaggaagcggtgagagagcggcgcgagacggagttgtgcgagcactgggaagaacacactcgccagcgtgagctgcccctcaggggcccgcttgggggcactgtgctggagacccggccctataatcagggcgctcgtctgaccgcgttcgagttggtgtacgagcagatacctgccaccttgatcaccgacagcatggtggccgccgcgatggcacacaggggtgtgagtgccgtggtggtgggggctgacagagttgtggccaacggcgacacagccaataaggtcggaacataccagttagctattgtggctaagcatcacggcatccctttttacgtagccgccccatcttcgtcttgtgatttaagactggaaaccggcaaagaaatcataattgaagaacgtcctggtcaggaattgactgacgtaaacggcgtccgcatcgccgctcccggaatcggggtctggaatcctgccttcgatgttacacctcacgacctaatcactggcggcatcatcaccgaattgggggtgtttgcccccgaagaactacgcacggccttgacaaccaccatttcctcccgggatggcactctagatggacctcaaatgtag

SEQ ID NO: 23480 - DNA, 5169 bp, Artificial Sequence
  Description of Artificial Sequence: Synthetic coding sequence
atgggcaaccaggacggcaagctgaagcggagcgccggcgacgccctacatgaaggaggggggggcgccgaagacgccctggggccgcgagatgtggaggcgactaagaaggggagcggcggcaagaaggcgctgggtaagcacggcaagggtggcgggggtggcgggggggggggtgagagtggaaaaaagaagtcaaagagcgacagccgggctagtgttttctctaacctcagaataagaaagaatttgagcaaggggaagggtgccggaggctcaagagaagatgtgctagattcacaggccctccagacaggggagctggactcagctcatagcttgttgacaaagacccccgacttgagcctgtctgccgacgaggcaggtctgtctgatacagaatgcgcagatccgttcgaggttacaggccccggggggcccggccctgctgaagcgagagtcggaggtcgacccattgcggaagatgtggagacagccgccggcgctcaggatggtcagaggacatccagtggcagtgacacagatatctattcattccattccgcaacggaacaagaagatctgctctctgacattcagcaagccatccgtcttcagcagcagcaacagcagcagctgcagctgcagctgcagcagcagcaacaacagcagcaactgcaaggcgctgaggagcctgcggcaccccctactgccgtaagtccccaaccaggggcttttcttggtctagatagatttctgctggggcctagcggaggagctggagaggctcccggctcccccgatacagaacaagccctgagtgcgctttccgatcttcccgagtcactggccgccgagccgagagaaccacagcaaccacccagcccaggcggtctgccagttagtgaggcccccagcctaccagctgcccagcccgctgcaaaagattccccaagctccactgcattccccttccccgaagctggtcccggcgaggaagcagctggggcccccgtgcgcggggccggagacacagatgaagaaggagaagaagacgcgtttgaggacgcccctagaggatctcctggtgaggagtgggctccagaggtgggcgaggacgcaccccaacgcctgggggaggagccagaggaggaggcccaaggcccagatgctcctgctgccgcatccctgccgggctcacctgctccatcgcagagatgttttaagccttatccactgatcaccccgtgctatattaaaacaactacgcgtcagttatcttcccccaatcactccccatcgcaatctcctaatcagtctccccgcatcaagcgtcgtcctgaaccaagcctgagtcgagggtctaggacggcgctggcatccgtagccgcccccgctaagaagcaccgggcggatggaggactggccgcaggactttcccggtccgctgactggactgaggagctgggtgctcgcacaccacgggtcggcggtagcgcccacctgttggagcgaggcgtggcatctgatagtggtggcggggtgagcccggcgctcgcggccaaggcgagtggtgctccggctgccgcagacgggttccagaatgtgttcactgggcgtacccttctggaaaagttgtttagtcaacaggagaacgggccacctgaagaggccgagaaattttgttcgcggatcattgccatgggcctcctgctgccatttagcgattgcttccgggagccatgcaatcagaacgctcagactaacgctgccagctttgatcaagatcagctgtacacttgggctgctgtatcccagcccacccactccctcgactactcagagggccaattccccagaagagtcccaagtatgggccctcccagcaagccacccgacgaggagcacaggttggaggacgccgagactgagagtcaatccgccgttagcgaaactccacaaaagcggtcggatgccgtgcagaaagaagtggtggatatgaaatccgagggacaggcgaccgtaattcagcagctggaacaaaccatcgaggatctcaggactaaaatcgctgaactcgaaagacagtaccctgcacttgacacagaggttgctagcggacatcagggcttggagaatggagtgacagctagtggggatgtgtgtcttgaagccctgcgactggaagaaaaggaagtcagacatcaccgcatcctggaagccaagagcattcagacgtcacctaccgaggaaggaggggtgctcaccctacccccagttgatgggttacctggacggcccccttgcccccctggagccgaaagtgggccgcagacaaaattttgctccgaaatctccctgattgtgagcccacggcggattagcgtccagttggattcccaccagcctacccaatccatatctcaacctccacccccgcccagcctcttgtggtcagccggacaggggcagccgggtagccaaccgcctcacagtatttctactgagtttcagaccagccacgaacactctgtgagtagtgcttttaaaaactcctgcaacatccccagcccaccacctttgccgtgtacagagtcttcctcttccatgcccggcctcggcatggttcccccacctcctcctcctctccctggcatgaccgtccctactttaccttcaacagccatccctcaaccccctccattgcaggggacggagatgctgcctccgcctcctccgcctcttccaggggctggtattccaccacccccgccactgccaggtgccggtatactgcctctaccacccctcccgggcgctgggatccccccaccccctcccctccctggcgcggcaataccaccacctcctccattacctggcgccgggatcccgctgccaccccctcttccaggagctggaataccaccgccaccaccccttccaggtgccgggatcccgccacctcctcccctgcctggcgcgggaataccaccacctccacctctgcccggcgcaggaatccctccaccaccacctttgcccggcgcaggcatcccgccaccgccccccctgcctggagccggcattcctccccccccccctcttccaggagcgggaatacctccaccgccacccttgccgggagcaggtatcccaccacccccaccactaccaggagccgggattcctcctccgccacctttacccggtgccggaatacctccgccgccacctcttcccggagctgggatccctcctccaccccccctcccgggagcaggtataccacctcctcccccactgcccggcgtcgggatcccccctccacccccgctgcctggcgcgggcattcccccaccaccacctttgccaggggccgggatcccacctcccccacctctgcctggcgcgggtattccaccgcctcctcccctgccgagagtgggcattccccccccaccccctctgcctggcgcgggtattccccctccgcctcccttgcccggcgcaggcattcccccaccaccaccactgcccggagttggcatccccccccctcctccccttccaggagttgggatcccacccccacccccccttccaggtgccggcatacctccacctccacccctgccaggtatggggatccccccagctccagcccctcctctgccgccccctggtactgggattccaccacccccactcctgccagttagtgggccgccgctgcttccccaagtcggctctagtacactgcctacacctcaggtgtgcggatttctgccaccccctctcccatccgggttattcggcctggggatgaaccaagataaggggagccgcaaacagccaattgagccttgcaggcccatgaaaccattgtattggaccaggatccaactccactccaaaagagacagtagtacttcgctgatatgggaaaaaatcgaggagccatccatcgattgtcacgagttcgaggagttgttttcgaagactgcagtgaaggagcgaaagaagcccatctcggataccatcagtaagactaaggctaagcaggtcgttaaattactgagcaataaaaggtcacaggccgtgggcatactgatgtcctccctacatctggacatgaaggatatacaacacgccgtcgtcaacttggataactccgttgtggacctagagacacttcaggccctgtacgaaaatagggcccagagtgacgagttggaaaaaatagagaaacacggtcgatcatctaaggataaagagaatgctaaaagcttggacaaaccggaacagttcttatatgaattgtccctaataccgaatttctccgaacgagtcttctgtatactttttcagtcaacattttccgagtctatttgctccatcaggcggaaactcgagctgctgcagaaattgtgtgaaacattaaaaaacggaccgggagtgatgcaagttctggggctggtcctggctttcggcaactacatgaacggcgggaacaaaacaaggggccaggctgatgggttcggtctcgatattttaccgaaactgaaagacgtgaagtcatccgataacagccgtagcctgctgagctatatagtatcttactacttgcgcaatttcgatgaggacgcaggtaaagagcagtgtctgtttcccctgcccgaaccacaggatttattccaggctagtcagatgaagttcgaggacttccagaaagacctgaggaagttgaagaaggatctgaaggcctgtgaggtcgaagcgggaaaggtgtaccaagtctctagcaaggaacatatgcagccctttaaggagaacatggaacagtttattatccaggcgaagatcgatcaggaggcagaggaaaacagcctaaccgagacccacaaatgctttctcgagacgactgcttactttttcatgaaaccaaagttgggcgaaaaggaagtatcccccaatgcatttttctcaatctggcacgaatttagctccgactttaaggacttctggaaaaaagaaaacaaactactgctccaagagagagtgaaggaggctgaggaggtgtgcagacagaagaaaggcaagtctctgtataaaattaaacctcggcatgactccggaatcaaagctaaaatcagcatgaagacctag

SEQ ID NO: 23481 - DNA, 3048 bp, Artificial Sequence
  Description of Artificial Sequence: Synthetic coding sequence
atgaccgtgagccagaagggcggcccccagcccacccccagccccgcgggccccgggacccaacttggaccaattactggggagatggacgaggccgactcggcgtttctcaagtttaagcagacagctgatgatagtttaagtctcacatcccctaatacggagagcatttttgtcgaggatccgtacaccgcatccctcaggagtgaaattgagtccgatgggcatgaatttgaagctgagagctggagcctggctgttgatgccgcttatgcgaagaagcagaagcgtgaggtggtaaagcggcaagatgttctttacgagttgatgcagacagaggttcaccacgtgcgtacacttaagattatgctgaaggtgtactcccgcgcccttcaggaggagctgcaattctcgtctaaggcaatcggccggttatttccttgcgctgatgacctcctagagacacactcccattttcttgcacggttgaaggagcgccgccaggagagtctagaggagggctcagaccgcaactacgttatacagaaaatcggcgacttgcttgtgcaacagttttctggagaaaacggggaacgcatgaaagagaaatacggtgtcttctgctccgggcacaatgaggctgtgagtcattacaagctcctgcttcagcagaacaaaaaatttcagaatctcatcaaaaaaatcgggaatttttcaattgtccgccgactcggagtgcaagagtgcatcctactagttacacagcgcattacaaagtacccagtgcttgtggagaggattatacaaaatacagaggcgggcactgaagattatgaggatttgacacaggccctgaacctgatcaaggacatcatttctcaggtggacgctaaggtgtcagaatgtgagaaaggacaacgactcagagagattgccggaaaaatggatcttaaaagttctagtaagttgaaaaatggtctgacgttccgtaaggaggatatgcttcagcggcagctgcacttggagggcatgttatgttggaagacaacctcaggaagactgaaagatatcttggctatcctgcttactgatgtgctgttacttctgcaggagaaggatcagaagtacgtctttgcgagcgtagattctaagcctcccgtaatttccctccagaaactcattgtgcgtgaggttgccaatgaagagaaagcaatgtttctcatctctgcctcactgcagggccctgaaatgtacgagatatacacttcgagtaaagaggacaggaacgcttggatggctcacatccagcgcgccgtcgaatcctgtccagatgaagaagaggggccattctccctgcccgaagaggagaggaaggtcgtagaagccagagcaactagactccgagacttccaggagcgcctcagtatgaaggatcagttaatcgcccagtctctcctggagaaacagcagatctacctggagatggccgaaatgggagggctggaggacctcccccagcctcgcggcttgtttagaggcggggatccctcagagaccctgcagggagaactcattcttaaatcagcaatgagcgagatcgagggaatacagtcccttatctgtagacagttggggagtgccaacgggcaggcagaggacgggggatcctccacgggtccccccaggcgggccgagacttttgcaggttatgactgtacaaattcacctacaaagaacggctcatttaaaaaaaaggtgtcaagcaccgatccgaggccgagggattggcggggtcctcctaacagccctgacctgaagcttagtgacagtgacattcccggctcatcggaagagtctccgcaggtggtggaagcccccggaacagagagcgacccccgactccccacagtcctcgaaagcgagcttgtgcagagaatccagaccctgtcccagctacttctgaacttgcaggccgtcatagctcaccaagattcatacgtggaaacacagagagctgctattcaggagcgcgagaagcagttcagactgcagagcacacgggggaatttactactggagcaggagagacagcggaacttcgaaaagcagcgcgaagagagagctgcactggaaaagttgcaatcacagctgaggcacgagcagcagcggtgggagagggagaggcagtggcaacaccaggagctcgaaagggcgggggctcggctgcaagagagagaaggcgaggctaggcagctgcgcgaaaggcttgagcaggaacgagccgagctggaaagacagaggcaagcttatcagcacgacctggagcggctccgagaggctcagcgggccgtcgaacgggagcgtgaacggttggagctgctgcggagactgaaaaagcagaatacagccccgggcgcattgccacccgacacattggcagaggctcagcccccgtcacatccaccttccttcaacggcgagggcctggagggcccgcgagtcagtatgctccccagcggcgtcggaccagaatacgccgaacgccctgaggtggctaggagggacagtgcacctacagagaataggctagcaaagtccgacgtgccaatacagctgttgtcagccacgaatcagtttcagagacaggctgccgtccagcagcaaatcccaactaagctcgccgcctccaccaaaggcggcaaggataaaggcggtaaatcccgcggatctcagcggtgggaatctagcgcttcattcgatctgaaacagcagctccttctgaataaattgatgggaaaggacgaaagtacttctcgtaaccgaaggtcactgtctcctatcctcccagggaggcattcccctgctccacctccagacccagggtttccagctccctctccacctcccgcagacagtccctcagagggctttagtttgaaagctggcggtacagccttactgcctgggccaccggcccccagccccctcccggcgaccccgctgtccgccaaggaggacgcatccaaagaagacgtcatcttcttctag

SEQ ID NO: 23482 - DNA, 2544 bp, Artificial Sequence
  Description of Artificial Sequence: Synthetic coding sequence
atggaggccctgggccccggcggcgaccgggccagccccgccagctcaaccagcagcctggacctatggcatctctccatgagggccgattcagcttatagcagtttttctgccgcaagtggaggcccagagcccagaacccagtctcctgggacggatcttctgccctacctggactgggactacgtgagggtcgtttggggcgggccaggccctgctccaccagacgccgcactctgtacatctccccggcctagacctgctgtagctgccaggagtggccctcagcccactgaagtgcccggtactcctggacctctgaataggcaggccacccctttgctgtatgcactggcagctgaggctgaagccgctgctcaggcagcagagcccccgtccccccctgcttctcgagctgcttacagacagagactccagggcgctcagcgacgggtgctcagagagacaagttttcagaggaaggagcttaggatgtcactccctgcacgccttcggccgacagtaccagccaggccgcccgctacacatccacggtccgctagcttaagtcatcccggcggtgagggagagcccgcacgcagccgcgcacctgcacctggtaccgcgggcagaggacctttagccaatcagcagcgcaagtggtgtttctcagagcctggcaaactcgatagggtgggcagaggaggcggccctgcgagggagtgcctcggagaggcgtgttcatcgagtggcctgcccgggccggaacctctcgagtttcagcatccagcactggccaaattcgaggatcatgaagttggctggctgccagagactcagccccagggctccatgaatctcgactcgggatcattgaaactgggtgatgcttttcggccggcctcacgctctcgatccgcgtcaggggaggtgcttggctcctggggcggttccggcggcacaatccccatcgtccaagccgtaccccagggagcagagacgccacgaccactgtttcagaccaagctgtctaggttcttgccacagaaggaggctgcagtcatgtatcctgcagagttaccgcaatcgagccccgcggattctgagcagagagttagtgaaacctgcattgtccctgcttggttgccttctctccctgacgaagttttcctagaggaggccccactggtccgcatgcgcagtccccccgacccccacgcaagtcagggccccccggccagcgtgcatgcgagcgatcaaccatacggcactggactcgggcagcggaccggtcaggttaccgtgcccaccgaatacccactgcatgaatgccctgggacggccggggccgacgactgctggcaaggtgttaacggcagcgtcggtatctctcgccccacctctcatacccctaccggcacagctaacgacaatatccctaccatagaccccacaggcctgacgaccaatccccccactgccgccgagtcggatctgctgaagcccgtcccagctgacgccctggggttatcaggcaacgacacccccgggcctagccataatacagctcttgcacgagggacagggcagcccggatcaaggcccacatggccttctcaatgcctcgaagaacttgtacaagagctcgcgcgcttggacccctcgctgtgcgaccctttggcctctcaaccgtctcctgagcccccgttgggtctgctggacgggctgattccactggccgaggttagagccgccatgcgacccgcttgcggggaggccggggaggaagcggctagcacttttgaaccaggttcctatcagttttcatttacacaactcctgccagccccccgcgaggagacacgacttgaaaatccggctacccatcctgtgttagaccagccttgtggacagggactcccagcaccaaacaacagtatccagggcaagaaggtcgaactggccgccaggcttcagaagatgctgcaagatttacataccgaacaggagaggctgcagggagaggcccaggcgtgggctcgaaggcaggccgctttggaggctgcagtccgtcaagcttgtgctccacaggaactcgaaaggttcagtcgctttatggcagacctggaaagggtacttgggttactgctgctgctcggatctagactggctcgtgttcgtcgggccctagcacgggccgcctcagattccgacccggatgagcaacggctgagactgctgcagcgccaggaggaagacgccaaggaattgaaggagcatgtcgctagacgggagcgcgccgtccgggaggtgttggtaagagctcttcctgtggaggagttgcgcgtgtactgcgcactgctcgcaggcaaagcggctgtgcttgctcaacagcgaaacctggacgagagaatcaggttactccaggaccagctggacgcgatccgcgatgacctgggacaccatgctccctcaccctcccccgcaagaccacctggtacttgccctcctgtccagccacctttcccgctgctcttgacatag

SEQ ID NO: 23483 - DNA, 2502 bp, Artificial Sequence
  Description of Artificial Sequence: Synthetic coding sequence
atgaagttcaccaacaccaaggtgcagatgatgcagaacgtgcacctagccccggagaccgacgaagatgacctgtacagtggctacaacgactacaaccctatctacgacatcgaagaattagaaaacgacgccgcattccagcaggccgtgaggacgtcacatggtagaaggcctcccatcacagctaaaattagttccacagcagtaacgagaccaatcgcgaccggttatgggtcaaagactagcctggcttcctcaatcggaaggccaatgacaggagcgatacaggacggcgtcacccggcctatgaccgctgtgcgagctgcaggcttcactaaagccgcgcttcgaggcagcgcctttgacccactatcccagtctagggggccagccagtcctctcgaagccaagaaaaaggattctccagaggagaaaataaagcagctggagaaagaagtcaacgaattggttgaagagagctgcattgccaattcgtgtggagatctgaaattggcattggagaaggcaaaggatgcaggcaggaaggaacgagtgttagtcaggcaacgagaacaagtcaccacccccgaaaatattaatcttgatctgacatatagcgtcttattcaacctggctagtcagtactccgttaacgagatgtatgcagaggcacttaatacctatcaggtgatcgttaagaacaaaatgtttagtaatgcaggaatactgaagatgaatatgggtaacatttaccttaaacagcgaaattacagtaaggcaatcaagttttatagaatggcactcgatcaagttcccagcgttaacaaacagatgaggattaagataatgcagaacatcggggtcaccttcatccaagccggccagtatagtgacgcgataaactcctacgaacatatcatgtccatggcccctaacttgaaggcaggatataatctgactatctgctacttcgcgataggggatagggaaaagatgaaaaaggctttccagaaactcattacagtgccgcttgaaatcgatgaggataaatacatctcgccgagtgacgacccacacactaatctagtgacagaggctataaaaaacgaccacttgcgccaaatggaacgagaacgcaaagcaatggctgaaaaatacatcatgacctccgccaaactcatcgcacccgttatagagacatccttcgccgccggatacgactggtgcgtcgaggttgtaaaagcgtcccagtacgtggaacttgcgaacgacctcgagataaataaggccgtaacttacctgcgacagaaggactacaatcaggctgttgagatcctgaaggttctggaaaaaaaagattcccgggttaaaagtgccgctgccaccaacctgagcgctttgtactatatggggaaagatttcgcgcaagcttctagctacgcggatatcgccgttaattcggacagatacaatcccgccgccctcactaacaagggcaatactgtgtttgcaaacggtgattacgaaaaggcagcagaattttacaaagaagctctacgcaatgacagtagctgcaccgaagcactctataacatcgggctgacttacgagaagctcaaccgtctagacgaagccctggattgtttcttaaagctgcacgccattctgcggaactctgccgaggttctctaccagatcgcgaatatctacgaactcatggaaaatccttctcaggccattgagtggctgatgcaagtggtgagcgttatcccgactgacccccaggtgctgtcgaaactgggtgaactgtatgacagggaaggagataagagtcaggctttccagtactactatgagtcataccgatattttccatgcaatatcgaagtcatcgagtggctgggtgcttattacattgatacccagttttgggaaaaagccattcagtactttgagcgagcttcactaattcaacccacacaggtgaagtggcagctaatggttgcttcttgttttaggaggtccgggaactatcagaaggctttggacacgtacaaagatacccatcgaaaattccccgaaaatgtggagtgtctaagatttctagttcgtctgtgcactgacctcggattgaaagatgctcaagagtatgcaaggaaactgaaaaggctggaaaagatgaaagaaatacgggaacagagaatcaaatctggccgggatggttcaggtggttctcggggcaaacgagagggcagcgctagtggggattcaggtcagaactacagcgctagtagcaaaggcgaaagactgagtgcgcggctgcgcgcattgcctggaaccaatgagccctacgagagcagcagcaataaggagatagatgcctcctatgtcgatccgctaggtccccagattgaaagacctaagactgccgccaaaaagaggattgatgaagacgactttgccgacgaagagttgggagatgacttgttgccagaatag

SEQ ID NO: 23484 - DNA, 918 bp, Artificial Sequence
  Description of Artificial Sequence: Synthetic coding sequence
atggacctgagcggcgtgaagaagaagagcctgctgggcgtgaaggaaaacaataaaaaatcaagcaccagggctccttcacctacgaagaggaaggaccggagcgatgagaaatcgaaggaccgatccaaagacaagggggctacaaaggaatctagcgagaaagacaggggcagagacaagacacggaaacgccgcagtgcttcatctggctcatcatctacccgatcgcggtcctcctctacatctagctctggctcgagcacttccacaggaagtagctccggttcaagtagctcaagtgcctcttcaaggagcggctcctcatccacgtcacggtctagtagcagctctagtagtagtggatcgccttccccaagtcgccgtcgccatgacaacagaaggcgtagccgatctaaaagtaaacctcccaagcgcgatgaaaaggaaaggaagagacgcagcccttcgcctaagcccaccaaggtgcacatcggtagactgacgcgcaacgtcaccaaagaccacattatggaaatctttagtacatatggtaagataaaaatgatcgatatgcctgtggagcgcatgcaccctcacctgtccaagggttacgcttatgtggagttcgaaaaccccgacgaagccgagaaagctttaaagcacatggacggtggtcagatcgacggccaggaaattactgcaactgctgtcctcgcaccgtggcctagacccccacctaggaggttctctccccctaggcgtatgctaccacccccaccgatgtggcgtcggtcaccccccaggatgcgtcggcgtagtcgctcccctcggcgacggtcccctgtgaggcggcgcagccggtctcccggccgccgtcggcatcgcagcaggtcatcttccaattcctccaggtag

SEQ ID NO: 23485 - DNA, 1119 bp, Artificial Sequence
  Description of Artificial Sequence: Synthetic coding sequence
atggacgtgctgagccccctgagcttcatcaaggtgagccacgtgcggatgcaaggaatcctgttattggtattcgccaagtatcaacacttgccttacatacagattctgtcaacaaaaagcactccgacgggactgttcggttactggggcaataaaggcggggtcaatatctgccttaagctctatggctactatgtgtccatcatcaactgtcatctgcccccccatatttctaataattatcagagacttgaacactttgataggattttagagatgcagaattgcgagggtagggatattccgaatatcctggaccacgatctgataatttggttcggtgatatgaacttcagaatcgaggactttggactgcactttgtgagggagtcaatcaagaatcgatgttatgggggactctgggaaaaggaccagctgtcgatcgccaagaagcacgacccgctcttgcgggaattccaagaaggcaggcttctgttcccacctacgtacaagttcgatcggaatagtaacgactatgacacctcagaaaaaaagcggaaaccagcatggacagacaggatactgtggcggctgaaacgccagccgtgtgcaggcccagatacgcctataccccccgcgagccattttagcctatccctccgaggctattcctctcatatgacctatgggatcagcgatcacaaaccagtgtcaggtacgttcgacctagaacttaaacctttggtttccgctccccttattgtgctgatgcctgaagacctatggactgttgagaatgatatgatggtgtcttattctagcacgagcgactttccttcttccccttgggactggattggcctctacaaggtcggcctgagggatgttaacgattacgtatcgtacgcatgggtgggggactcaaaagtttcgtgctccgacaaccttaaccaggtttacatcgatatcagtaatatccctacgacggaggatgagtttctcctgtgctattatagcaactctctccgatcggtcgtcggaatttcccggcccttccagatacctcccggcagtctcagggaggacccactaggggaggcccagccccagatttag

SEQ ID NO: 23486 - DNA, 1692 bp, Artificial Sequence
  Description of Artificial Sequence: Synthetic coding sequence
atgcggctggacctggccagcctgatgagcgcccccaagagcctgggctccgctttcaagtcctggcggctggataaagcaccttctcctcagcatacgttcccttcaacgagtataccaggcatggcattcgctctcttggctagtgtgccacccgtcttcgggctttacacttccttcttccctgtgctcatctactccctgcttggaaccggcaggcatctgtcaactggtacttttgcgattctgtccctgatgactggctctgcagtcgagcggctggtccctgagcccctggtgggcaacctgtctggcattgaaaaagagcaactggacgcgcaacgagtcggcgtggctgcagcggttgcgtttggaagcggagcgctgatgctcggcatgttcgttcttcagctgggggttctgagcacgttcctctcggagcccgttgtgaaggccctgacatctggagctgcactccacgtgctgctgagtcagctgccaagcttgttaggtctgagcctgccgcggcagatcggctgtttttccctctttaaaactctggcctctctgctgacggcgctaccacggtcttcccctgcagagcttaccatcagcgcgcttagcctggcattgctagtgccagtgaaggagctgaacgtccggttccgtgatcggcttcctacgccgatccccggtgaggttgtgctagtcctgctggcctccgtcttgtgcttcacaagctcagtggatactcgctatcaggtgcagatagttggactgttgcctggaggtttccctcaaccgctcctgccaaatctcgcagaactcccacgaattctggccgatagtctacccatcgccttagtctcctttgcagtgagcgccagtctggcttcaatccacgctgataagtacagctacacaatcgattcaaatcaggagttcttagcccacggcgcttccaacctgatctcgtccctgttttcttgcttccccaactccgcaacgcttgccactaccaatctcctcgttgacgcaggcggtaagacacagctagcaggcctgttctcctgcacagtcgtcttatccgttctgctgtggctggggccgtttttctactacttgccgaaagctgtacttgcgtgcatcaatattagcagcatgcggcaggtcttttgccagatgcaggaattacctcagttatggcatatttcaagagtggattttctgctccaagtgccaggcttgtgcatcttgagctaccctacccctctgtatttcggcacccgtgggcagtttcggtgcaatctggagtggcacctaggcctgggggagggggagaaagaaacgagtaagcctgacggccctatggtggcggtggccgaacctgtgcgagtcgtggttctggacttctctggggtgacattcgcggacgcagcaggagctcgggaagtagtccaagtgcgagaacgcctggcctccagatgtagggacgccagaatccgattacttttggcacaatgcaatgccctcgtgcagggcaccctcacacgtgtgggcctgctggatagggtgactcccgaccagctgttcgttagtgtgcaggatgctgctgcgtacgcactaggttctctcctccggggtagttctaccaggtccggaagtcaagaggcccttgggtgcggtaaatag

SEQ ID NO: 23487 - DNA, 2892 bp, Artificial Sequence
  Description of Artificial Sequence: Synthetic coding sequence
atggccgagcggggcggcgccggcggcggccccggcggcgccggcggaggctctgggcagagaggaagcggggtggctcaatcaccgcagcagcctccaccgcaacagcaacagcagcagccaccgcagcagccaactccgcccaagttagcacaggctaccagctcatctagctcaacgtccgcagccgctgccagctcctcaagttcctccacctcaacgagtatggcagttgccgtggcaagcggctcggcacctccagggggcccagggccgggccggaccccggcgcccgtccagatgaacttgtatgcaacatgggaggtggatcgttcctcctcgtcatgtgtcccacgactgttcagtctgactctaaaaaagttagtaatgctgaaggaaatggacaaggacctgaatagcgtcgtcattgctgtaaaattgcagggatctaaacggattcttcgaagtaatgaaatcgttctgcctgctagcggactcgtcgagaccgaattgcaactgacattctcccttcaataccctcactttctaaagcgcgacgccaacaaactgcagatcatgctgcagagacggaagcggtacaaaaaccggaccattctcggatataagaccctggccgtgggcctcattaacatggccgaggttatgcagcatcccaatgaaggggccttggttttaggactgcactctaacgtgaaggacgtgagcgtcccggtagcagagatcaagatctattcactgagttctcagccaatcgaccatgagggaattaaaagtaagcttagtgataggtcaccagatatcgataattactctgaggaggaagaggagtccttttcctcagaacaggagggctccgatgaccctctccacgggcaggacctcttttatgaagacgaagaccttcgcaaggtgaaaaagaccaggcgaaagttaacttccacatctgcaattacaaggcaacctaacatcaaacagaagtttgtcgctttgttgaaacggtttaaggtgtcagatgaggtggggttcggtctcgagcatgtgagccgggagcagattcgggaagtagaagaggacctggatgagctgtatgatagcctggagatgtacaaccccagcgatagcggtcccgagatggaagagacagaaagtatcctctctacccctaagccgaagctgaagcccttcttcgagggaatgtcacagagtagttctcagacagagatcggctcactgaactccaaaggatcactgggcaaggatacaaccagccctatggagctagcggccctggagaaaattaagagtacatggattaagaaccaggacgacagcctgacagaaaccgacacactggagattaccgatcaggatatgtttggggacgcctcaacttctttggtggtgccagagaaggtcaaaacccccatgaagtcttccaagaccgatttgcaggggtcagcctccccatctaaagtcgagggtgttcataccccaaggcaaaaaaggagcacccccctgaaagagagacaactctccaaacctttgtctgaacggaccaatagtagcgacagtgagagatctccggatctgggccattctacccagatccctcggaaagtggtgtacgatcaattaaatcagatcctggtgtcagacgccgctcttcctgagaacgtgattctcgttaacaccactgattggcagggccagtatgtggctgaactcctccaggatcagaggaagcctgtggtttgtacttgttctacagttgaggttcaagcggtgctgtccgccctgttaaccagaatccaacggtattgtaactgcaattcctccatgccaagacctgttaaggtcgccgccgtcggaggccagtcatacctgtcgtccatactgcgcttctttgttaagagcttggcaaataaaacttctgattggctcgggtacatgcgctttctcatcattcctctgggctctcatcctgtcgcaaaatacctgggttcggtcgactccaagtactccagctcatttttggactccggatggcgagacctcttctctagatctgagccccctgtaagcgagcagttggatgtagcaggacgcgtgatgcagtatgtgaatggggctgctactacacaccagctacccgtggctgaggccatgcttacatgcagacataagtttcccgacgaagatagctaccaaaagttcattcccttcatcggtgtcgtaaaggtgggcctagtcgaggactctcctagcaccgctggcgacggcgatgattcacccgtggtttccctgaccgtgccatccacttctcctccatcctcttcaggtttgagccgggatgccactgcaacaccaccaagtagtccttccatgtcctccgcccttgcgatcgttggctctcccaatagcccttacggagacgtaatcggtctacaagtcgattattggctggggcatccaggcgaaaggcgccgagagggagacaagagggacgctagcagcaagaacactttaaaatctgtgtttagaagcgtccaggtgagcaggcttccacattccggcgaggctcagctgtcgggcacaatggctatgactgtggtcactaaggaaaagaataaaaaggtgcctaccattttccttagtaagaagccccgggaaaaggaggttgacagcaagtcccaggtcatcgaaggtatcagcaggctgatctgctccgctaaacagcagcagactatgctgagggtgagtattgacggggttgaatggtctgatatcaaattctttcagctggccgctcagtggcctacccacgtgaaacacttccctgtgggtttgttttctgggagcaaagcgacgtag

SEQ ID NO: 23488 - DNA, 546 bp, Artificial Sequence
  Description of Artificial Sequence: Synthetic coding sequence
atggaggagatccccgcccaggaggccgccggcagcccccgggtgcaatttcaatctcttgaaactcaatctgaatgtctcagccccgagccccagtttgtccaggatacagacatggagcagggtttaaccggagcccctccagtcccacaggtgccagccctgcccagggaaggcagccccggcgaccaggctgccgctctcctgactgctagatatcaggagttcgtcacattcgaggacgtggctgtgcatctcacacgtgaagagtggggttatctggatccagtccagcgtgacctgtaccgggaagtgatgctggagaattatggcaacgtggtgtccttgggaatcctcttgcggctgccaacgactaggatccacagcgttaatagttgccctgccctgtctcacacacaggcctcagcgttcagtggcgaaacactggcagtactgaccgcgggcatctccaaaaggtggccgaaatatcggctgcctatcgacatcgctcggccttgctccgagaccccattccctcggctgtag

SEQ ID NO: 23489 - DNA, 1410 bp, Artificial Sequence
  Description of Artificial Sequence: Synthetic coding sequence
atggtgctggagggcaaccccgaggtgggcagcccccggaccagcgatctgcagcatcggggtaacaaaggctcatgcgttctgagcagccctggtgaggacgctcagcctggagaggaaccaatcaagtacggagaactgattgtcctgggatgctgtgaggaagggggcgaagagacagaggcacagcggggcgaggtaaccggcccccgggctcatagctgctataatgggtgtttagccagcggcgataagggccgacgccgctctaggctggccctctccagacgctctcatgccaacggtgtcaaaccggacgtgatgcaccatatcagtacgccactggtgtcaaaggcgctctctaatagaggacaacatagcatctcgtataccctgagtcgatctcactcagtcatcgtggagtatactcatgactctgatactgacatgtttcagataggtcgctcaactgagaatatgatcgactttgttgtgaccgatacttcaccggggggcggagctgccgaaggaccttctgcccaatcgacaatctcacgatacgcctgccgcattctgtgcgaccgccgccccccttataccgctcgcatatatgccgctggttttgatgccagttccaacatcttcctcggggaaagagcagccaagtggcgaactcctgacgggcttatggatggtctgaccaccaacggagtgctcgttatgcaccctgccggcggctttagcgaagacagtgctcctggcgtctggagggagatttcagtatgcgggaacgtatacaccctccgggattcaaggagcgctcagcagcgaggaaagttggtagagaacgaaagtaatgtgctgcaggacgggagtctgatcgacttatgtggagctacactgctgtggagaacgccagcaggcctcttgagagctccgacacttaaacagctggaagcccagcgccaagaggccaatgctgcacgcccccagtgcccggtcggactgagcactctggcgtttcctagcccagccaggggaagaacggcaccggacaaacagcaaccctgggtatatgtacgatgcggccacgtgcacgggtatcatggctggggttgccggcgggaacgcggccctcaggaacgagagtgcccactgtgccggctcgttggtccatacgttccactttggctggggcaggaggcaggtctgtgcctcgatcctggacctccaagccatgcctttgctccctgtggccatgtgtgctcagagaagacggccagatactgggctcaaacacccttgccacacgggacacacgcttttcacgcagcatgtcctttttgcggcgcttggctaactggagaacatgggtgcgtgcggctgatctttcagggtccactggattag

SEQ ID NO: 23490 - DNA, 3312 bp, Artificial Sequence
  Description of Artificial Sequence: Synthetic coding sequence
atggccggcgccagcgtgaaggtggccgtgcgggtgcggcccttcaacgcccgggagacgagccaagacgcgaaatgcgtcgtcagcatgcaaggtaacacaacatccatcattaacccaaagcaaagcaaggatgcgcccaagtcatttactttcgactactcatactggagtcatactagtaccgaagatccccaattcgcgtcgcagcaacaggtctatcgggatatcggtgaagaaatgctgctccatgcctttgaaggctataatgtttgtatctttgcatacggacagaccggcgccggcaagtcctacactatgatggggcgacaggagcccggtcagcagggaatcgtgccccaattatgtgaagatttattttccagggtgtctgaaaaccagagcgcacaactgtcatacagcgtcgaagtctcatacatggagatatattgtgagcgagtgagggacttgttgaacccgaaaagccggggcagcctgagagtccgagaacaccctatcctgggaccttacgtgcaggatctaagcaaactcgccgtaacctcctatgctgacatcgctgatctcatggattgtggcaacaaggccaggacagtagctgcgaccaatatgaacgaaacctcaagccgcagccacgcagtcttcacaatcgtgttcacccaaagatgccacgatcagctgaccggcctggacagcgagaaggtgtctaagatctctctggtagatctggcagggtcagagcgggcagatagctccggagctaggggcatgaggcttaaagaaggagctaatatcaataagtccctcacaacacttggtaaagtaatcagcgccctggcagacatgcagtccaaaaagcgcaaaagcgattttatcccctacagggattctgtgctgacctggctcttgaaggagaatctgggcgggaattcaagaactgctatgatagccgctctgtctcctgcagatattaattacgaagagactttgagcacacttagatacgctgacaggactaagcagatacggtgcaacgcgatcatcaatgaggatccaaatgcccgcctaataagggagctacaagaagaggttgcgagacttcgggagctgctgatggcccaaggcttatcagcatcagcactagaaggcttaaaaacagaagaggggtctgttcgcggagccctccccgccgtgtcctctcctcccgctccagtatcgccaagtagcccaacaacccacaatggcgaactcgagccctccttctcgcctaacacagagtctcagattggcccagaggaggcaatggagcgtctgcaagagacagaaaagattatcgccgagctaaatgagacttgggaagagaagctgcgtaagacggaggctctgcgaatggagcgcgaagcattgctcgcagagatgggcgttgctgttagggaggacggaggtacagtgggagtgtttagccccaagaagacaccccatctggtgaaccttaacgaagaccctctgatgtctgagtgtctgttataccacatcaaggacggcgtaaccagagtgggacaggtcgacatggacattaagctgaccggacagttcattagggaacagcattgcctcttccgctcaataccccaacctgatggggaagtagtggtgaccctggaaccttgcgaaggcgccgagacttatgtgaatggcaaattagttactgagccactagtgctcaaaagtggcaaccggatcgtgatgggcaaaaaccatgtgtttaggttcaatcacccagaacaagcgcggttggagcgggaaagaggcgtccctcctcctccagggccccccagcgagcccgtggactggaacttcgcccagaaagagctgctcgaacaacagggcatcgacataaaacttgagatggaaaaacggttgcaagacctcgaaaaccaatatcgaaaagagaaagaggaagctgacctgttgcttgagcagcagcgcctctacgccgattcagacagcggcgatgacagcgataaaaggtcttgcgaggaatcttggcgacttatatcctcactaagggaacaactgccccctaccacagtgcagactattgtgaaaaggtgcggactgcctagctctggaaagaggcgcgcgccgagaagggtgtaccagattccacagcgacgacgcctgcagggtaaggatcctcgctgggccactatggcggacctcaaaatgcaggctgtgaaagagatctgttatgaggtggcccttgccgactttaggcatggtcgagcggagatcgaggcgctcgctgctctaaaaatgcgggaactgtgccggacttacggcaaacccgacggacctggagacgcctggagggctgtggctagggatgtatgggacacagtgggggaggaggagggcgggggcgcaggctcaggtggtggatctgaggagggcgctcgaggcgctgaggtggaagatctgcgggctcatatcgataagctgacaggtatattgcaggaagtgaagttgcagaattccagcaaagatcgggaacttcaggccctgagggataggatgctcaggatggaaagagtcataccactcgcacaggatcatgaagacgagaacgaagaaggcggagaagtgccttgggccccacctgaaggcagcgaagccgcagaagaagccgcgccgtccgatcgcatgccatctgcccgcccccccagccctcctctatcttcctgggaacgggtctcccggctaatggaggaagatccagccttcaggagggggagactccggtggcttaagcaagaacagttaagactccagggcttgcaggggtctggtgggcggggcgggggccttagacgcccgccagcccgcttcgtccccccccatgattgcaaactccgcttcccttttaaatctaatcctcagcaccgggagtcatggcccgggatgggaagtggtgaggccccaactcccctccagccccctgaagaagtgaccccccaccctgcaacgcctgcgcgccgaccgccgtctcccaggcggagccaccacccccggcggaattctctcgacggaggtggtcgctcccgcggcgcagggtcagcacagccagagccacaacacttccagccaaagaaacataatagctatccacaacccccccaaccgtatccagcccaacgtccaccgggaccccggtaccctccatacacgacgccccctcggatgaggaggcagagaagtgcccccgatctaaaggagagcggggccgctgtgtag

SEQ ID NO: 23491 - DNA, 1260 bp, Artificial Sequence
  Description of Artificial Sequence: Synthetic coding sequence
atggccgagcccgtgggcaagcggggccggtggagcggcggcagcggagcgggtcgaggagggaggggaggatgggggggaaggggaaggcggcctagagcacaacgctcaccgagtaggggaactctggacgtggtgtcagtggacttagtaaccgatagcgatgaggaaatcctggaagtggcgacagccagaggcgcggccgacgaagttgaggtggagccaccagaacctccaggtcctgtggcttcccgggataactcaaacagcgatagtgagggcgaggatcggaggcccgctggtcccccgcgagagcccgtgagacgtcggcggcgactggtgctggacccgggggaggctccattagtcccagtttactctggcaaggtgaagtcatctctgcgtctgattcccgacgacctgtcactgctgaaattgtatccacccggggacgaggaggaggcggagctggccgatagctccggcctgtatcatgaaggttccccctcccccggaagcccatggaaaacaaagctgagaaccaaagacaaggaggaaaagaaaaagactgaatttctcgatcttgataattctcccttgtcccctccatccccgcgcacaaagagcaggactcacaccagggccctcaaaaagctgtctgaggtaaacaagcgtctccaagatctaaggtcatgcctatcacctaaacccccccagggtcaggaacagcaggggcaggaggatgaggtagtgctcgtggaaggacctacgttgcccgaaacaccccggctttttcccctgaagatacgctgtagggccgatttagtgagactgccattgagaatgtccgagcccttacaaagtgtggtagaccacatggcaacacaccttggagtgtcgccgtccaggatcctgcttttgttcggcgagaccgagctgagcccaacggctacccccaggaccctaaaacttggtgtggcagacattatagactgcgtagtactgacatcttctccagaagcgacagagacgtcacagcaactccagctacgagtgcagggtaaagaaaagcatcagaccctggaagtcagcctgtcaagggattcaccattaaagaccctgatgtcccattacgaggaagccatgggcctatccggtcggaaactgagctttttcttcgacgggacaaagctcagtgggcgcgaactccccgccgatctgggcatggagtcgggagacctcattgaagtgtggggctag

SEQ ID NO: 23492 - DNA, 384 bp, Artificial Sequence
  Description of Artificial Sequence: Synthetic coding sequence
atgcggcccctggacatcgtggagctggccgagcccgaggaggtggaagtccttgagcccgaggaagactttgagcaatttttactccctgtgataaacgagatgcgcgaggacatcgccagcctgactcgggagcacggtagggcatacctgagaaacagaagcaagctttgggaaatggacaacatgctgatccagattaaaactcaggtcgaggcctctgaagaatcagccctcaatcaccttcagaatccaggcgacgccgccgaaggaagggccgctaaaagatgcgagaaggctgaggagaaagccaaggagattgctaagatggctgagatgttagttgagctggtgaggcgcatcgagaaaagcgagagctcttag

SEQ ID NO: 23493 - DNA, 1263 bp, Artificial Sequence
  Description of Artificial Sequence: Synthetic coding sequence
atgcccctgcaggtgagcgactacagctggcagcagaccaagaccgccgtatttctgtccctgccactgaaaggggtttgtgtcagagacacagacgtgttttgtactgagaactacctcaaagtgaacttccccccttttctgtttgaggccttcctgtacgcgcctatcgatgacgagtcttcaaaggccaaaataggtaatgatacaattgtgtttacactgtataaaaaggaggctgctatgtgggagacgttgtctgtcacaggcgttgacaaggagatgatgcagaggatccgggagaagtcaattctccaggcccaggagagggcgaaagaagcgactgaagctaaagccgcagctaagagagaggaccagaagtatgcgctgtctgtcatgatgaaaattgaggaggaggagagaaaaaagattgaggacatgaaagagaacgagaggattaaggcaactaaggcattagaggcttggaaagagtatcagaggaaggctgaggagcagaaaaaaattcaaagggaggaaaaactgtgtcaaaaggaaaagcagataaaagaggagcggaaaaaaatcaagtataaaagtctgactcgtaatctggcttcccgaaatctggcccccaagggccgtaacagtgaaaatatattcaccgagaaactgaaggaagacagcattccagcccccagatccgtgggcagcataaagatcaattttacgcctagggtgtttccaacagccctacgcgagagccaggttgcagaagaagaagagtggctgcataaacaagccgaggcacgcagagcaatgaacaccgacattgctgagctgtgcgacctgaaggaggaggagaagaaccccgagtggctgaaagacaagggcaacaaactatttgcaacagagaactacctcgccgccataaacgcatacaaccttgccatcaggctcaacaacaaaatgccactgctctatcttaatcgcgcagcctgccatctgaaactcaagaacctgcataaggccattgaagattcgtccaaagccctggagttactgatgccacctgttacagataatgctaatgccaggatgaaagcacacgtgcgccgcgggaccgccttctgccagttggagctgtacgtggaaggactgcaggactatgaggctgccctaaagattgacccctcgaacaaaatcgtgcagatcgatgcagagaagatcagaaacgtaatccaagggaccgaactgaagagctag

SEQ ID NO: 23494 - DNA, 348 bp, Artificial Sequence
  Description of Artificial Sequence: Synthetic coding sequence
atgcggtacgtggccagctacctgctggccgccctgggcggcaacagctccccaagtgccaaggatattaaaaagattcttgacagcgtagggatcgaggccgacgatgaccgcctgaacaaggtcattagcgaactgaacggcaaaaacatcgaagatgtcatcgcccagggcattgggaaacttgccagcgtccctgccggcggtgcagtggccgtttccgcagccccaggaagcgcggcccccgccgctggctccgcacctgctgctgcagaagagaaaaaggacgaaaagaaggaagagtctgaagaaagcgatgatgacatggggtttgggctgtttgactag

SEQ ID NO: 23495 - DNA, 1233 bp, Artificial Sequence
  Description of Artificial Sequence: Synthetic coding sequence
ctgaaccgggcctgcttctgcgtgaccggcgtgcccgagctggaggtgatatgcggactacaacaggctgagtggccaaggctcggcctgagtcatctgggcgccgtcggtggcgggtgggggggcctacctacttctacttgggtgtccctgcatactcaggaggttgacctggcctctgaggtcgcattagaagtcgtgaggaccgctgagccgggtgtgtggctcgaggcacaggcacccgtcgccctggtggcacagccggaaccattgccagctaccgccggagtcaagcgtgaatcagtgggtatggaggttgcagtgttgaccgacgatcccctcccagtcgtggatcagcagcaggtcctcgcaaggcttcagcttctggagcagcaggtggtgggaggtgaacaagccaaaaacaaagacctgaaagaaaaacataaacgaaggaagaggtatgccgatgagcgaagaaagcagctcgtcgctgccctccagaacagcgatgaggactccggcgactgggtactcctgaatgtgtatgactccatccaggaggaggttagagctaagagcaaactgctggagaaaatgcagcggaagcttcgagctgccgaggttgaaatcaaagacttacaatctgaattccagcttgaaaaaatcgactatttagcaacaatccgtaggcaagagcgggacagtatgttgctgcagcagctgctcgagcaggtccaaccactgattagaagagattgcaactactccaacttggaaaaaatactgagggagtcctgttgggacgaagataatggcttctggaaaataccacatcccgttattacaaagaccagtctgcctgtggccgtaagcactggccctcagaacaagcccgctcgcaagaccagtgccgccgataacggcgaaccaaatatggaggatgaccggtaccgcctcatgctgtctagatctaacagtgaaaacattgcttcgaattactttaggagcaaaagggcctcccaaattctgtccactgatgcacggaagagcctaacgcaccataactctcctcctggactgtcctgccccttgtccaacaattccgcgatccctccgacccaggcccctgaaatgcctcagccccgccccttcaggctcgaatccctagacattcccttcactaaagccaagcgcaaaaaatcgaagagcaattttggaagcgagccactgtag

SEQ ID NO: 23496 - DNA, 1353 bp, Artificial Sequence
  Description of Artificial Sequence: Synthetic coding sequence
atgcgggagtgcatcagcatccacgtgggccaggccggcgtgcagataggcaacgcatgctgggagctttactgcctggaacacgggattcaaccagacggccagatgccttccgacaagacaatcggtggaggagacgactcctttaacacctttttttccgaaaccggcgctggcaagcatgtaccacgggccgtgtttgtggacctcgagcctaccgttgtcgatgaggtaaggacaggcacttacaggcagttgttccatcccgagcagctgattactggcaaggaggatgcagcaaataactacgcaagaggccactatacaatagggaaggaaatcgttgatctggtgctggacagaatcaggaaattggctgacctttgtactggcctccaaggattcctgatctttcattcctttggaggtggaactggttccggttttgcttcactccttatggaacgcctctcagtcgactatgggaaaaaaagcaagttggagtttgccatctaccccgcccctcaggtgtcaactgcagtcgtggagccatataattcaatactgacaacccataccaccctcgaacacagcgactgcgcttttatggtggataatgaggcaatctatgacatatgtcgcaggaatctggatatcgaaaggcccacttatactaatctgaaccgcctgatcggacagattgtcagcagcattactgcctcactgcgttttgatggcgcattgaatgtggacttaacagaattccagacgaacctggtgccatatcctcgcatccatttccccctcgctacctacgcccctgtcatctctgccgagaaagcataccacgagcagctgtccgtggccgagattacaaacgcatgtttcgagcctgcgaaccagatggtgaaatgtgatcctcgccacggtaagtatatggcctgctgcatgctataccgcggcgatgtggtgcccaaagatgtgaatgcggcaatcgctaccatcaaaaccaagcgtacaatacaatttgttgattggtgtcccactgggtttaaggtgggcatcaactatcagccaccaacggtggtacccggaggagaccttgccaaagtgcagagagcagtgtgtatgcttagtaacaccacagccatcgcagaggcttgggccaggctggatcacaagtttgatctgatgtatgctaagcgcgccttcgtgcactggtacgtgggagaaggcatggaggaaggagaattctcggaggccagagaggacctggccgccctggagaaagattacgaggaggtgggagtggactccgtggaagctgaggcagaagagggagaggaatactag

SEQ ID NO: 23497 - DNA, 471 bp, Artificial Sequence
  Description of Artificial Sequence: Synthetic coding sequence
atgagcggcggcctgctgaaggccctgcggagcgacagctacgtggagctgtcacaatacagggaccagcacttccgcggtgataatgaggaacaggagaaactactcaaaaaaagttgcaccctgtacgtcggcaatctttctttctataccactgaggagcagatttatgagctattttctaaaagtggagatatcaagaaaatcattatggggctggataagatgaagaagactgcctgcggcttctgcttcgtcgagtactactctagagccgacgcagaaaatgcgatgaggtacataaacgggacccgcttggatgacaggattatcagaacagactgggacgccggcttcaaagaggggcgccaatacggcagaggacgcagcggaggccaggtgagggacgaatacagacaagactatgacgcaggccggggaggatatgggaaattagctcagaatcagtag

SEQ ID NO: 23498 - DNA, 996 bp, Artificial Sequence
  Description of Artificial Sequence: Synthetic coding sequence
atgggcggcgagcaggaggaggagcggttcgacggcatgctgctggctatggctcaacaacatgagggcggagttcaggagctggtgaatacgttcttttccttcctgagacggaaaacggatttctttatcggaggtgaggagggaatggctgagaaactgataacacagacattttctcaccacaaccaactggcccagaaaacacgcagagagaagcgagccaggcaggaggccgaaagacgtgaaaaggccgagcgtgccgcgaggctcgccaaagaagctaagtccgaaaccagtgggccgcagatcaaagagctgactgacgaagaggccgagagactccagttagagattgaccagaagaaggacgcagagaaccacgaagcgcagttaaagaatggctccctcgattccccagggaaacaggacaccgaggaagatgaggaggaggacgagaaggacaaggggaaacttaagccaaacctcgggaatggggccgacctgcccaactaccgctggactcagacgctgagcgaactggatttagctgtgccattttgtgtcaatttccgcctgaagggcaaggatatggttgttgatatacagagaaggcatctcagggtggggttaaaaggccagcccgccattatcgacggagagctgtacaacgaggtcaaagtggaagagtccagctggcttatcgaggatgggaaagtcgtgacagttcacctggaaaaaatcaataagatggaatggtggtctcgcttggtgtcatccgatcctgagatcaacacgaagaaaatcaatccagagaactccaaattgtcagatctggattcagagactcgcagtatggtggaaaagatgatgtatgaccagaggcagaaaagcatggggctgcctacatctgacgagcagaaaaagcaagaaatattgaaaaaattcatggaccagcaccctgaaatggacttcagcaaggcaaagtttaattag

SEQ ID NO: 23499 - DNA, 1860 bp, Artificial Sequence
  Description of Artificial Sequence: Synthetic coding sequence
atggccggccccggcgtgcccggcgcccccgccgcccggtggaagagacatattgtgagacagctgcggctccgagatcgcacccagaaagcattatttctggagttggtgcctgcgtacaatcacttgttggaaaaggctgaactcctggataagttcagcaaaaaactgcagcccgaacccaactctgtcactcccaccactcaccaaggaccatgggaggaaagcgagctagattctgaccaggtgccttctttggtcgcactaagagtcaagtggcaggaggaggaggaaggcctgcggctggtgtgcggtgagatggcttatcaggttgttgaaaagggcgctgctctcgggacgctcgagtctgagctgcaacagagacagagccgcctggctgcactcgaagccagagtcgctcagttgagagaagcgcgcgctcaacaagctcaacaagttgaggagtggagagcccagaatgctgtgcagagagctgcctatgaagctcttcgtgcccatgtggggttgagagaggcggcactgaggcgattacaggaagaagcccgagacctactggagagactggtgcagagaaaagcccgcgccgccgccgaacggaatctgagaaatgagagacgcgagcgagcaaagcaggctagggtcagccaagagctgaaaaaggcagccaagcgcactgtatccatcagcgaaggcccagatactttgggagacggtatgcgggagcggagagagacactagcccttgcccccgaaccagaacctctcgaaaaagaggcatgtgaaaagtggaagcgaccattccgatcagcatcagccacatccctcactctgtcccactgtgtggacgttgtgaaaggtctactggattttaaaaagcggcgcggtcatagtattgggggggcacccgagcagcggtatcaaattatccccgtttgtgttgcagcacggctccccactcgagcacaggacgtcctcgacgcccatctgtcggaggtgaacgccgtgcgctttggaccgaatagctccttacttgccactggcggggccgacaggctgatccatctttggaatgtcgtggggagtaggttagaggcgaatcagacactggagggcgcaggtggctctatcactagcgttgacttcgacccgtcaggctatcaggtgcttgccgctacatacaatcaggcagctcagctttggaaggttggagaggcccagtccaaagaaactctgtccggacataaggacaaagttacagcggccaagtttaagctgacaaggcaccaggcggtgacaggaagcagggaccgtactgtaaaggagtgggatctgggaagggcgtactgttccagaaccattaatgtgctgtcttattgcaacgatgtagtctgcggggaccacattataatctctggacataatgaccagaaaattcgattttgggactctcgaggcccccactgtacacaggtcatccccgtccaaggccgtgttacgtccctgtcactaagtcacgatcagctgcacctgctgtcctgctctcgcgataatacactgaaggttattgatctgcgagtctctaacatccgtcaggtctttcgcgccgatggatttaagtgtggctctgattggactaaagcagtattctcgcctgaccgctcttatgctctggctggcagttgcgacggtgccctgtacatctgggatgtggacaccgggaaactggagagtaggctgcaaggcccacactgtgctgctgtcaacgcagtcgcttggtgttacagtggaagccatatggttagtgtcgatcagggcaggaaggtggtgttgtggcagtag

SEQ ID NO: 23500 - DNA, 5049 bp, Artificial Sequence
  Description of Artificial Sequence: Synthetic coding sequence
atggagggcaacggcaccgagaacagctgcagccggacccggggctggctacagcaggataacgatgctaagccctggctgtggaaattcagcaactgcttcagccgcccggagcagactctcccccactctccacagaccaaagagtacatggaaaacaagaaggtcgcggtcgaacttaaggacgtcccaagccccctgcacgccggctctaagcttttccctgccgtgcccctccctgacatccggagtcttcagcagcccaagatccagttgtcatcggtgcctaaggtttcttgttgcgcccattgccccaatgaacctagcactagccctatgaggttcggaggaggaggagggggctcaggcggtacatcttcgctcattcaccctggcgcccttctggactctcagtcgacacggactatcacatgtcaggtgggttcgggatttgctttccagagtgcaagttctctccaaaacgctagcgccagaaataatctagcagggattgcatcagacttcccttccatgtgccttgagtccaacctttcctcatgcaagcatctgccttgttgtgggaagctccatttccagagctgccatggcaatgttcataagctgcaccagtttccatccctccaggggtgtacctctgccgggtactttccttgttcagattttacatcgggtgcccctggacatctggaagagcacatttctcagtccgaactaacaccccacctgtgtactaactctttgcacttgaacgtcgtcccacccgtctgtctgaaaggatctctttactgcgaagactgcttaaacaaacctgctagaaattccattattgatgcagctaaagtctggccaaacatccccccacctaacacccagccggcccctctcgctgtcccgttgtgtaacgggtgtggcacgaaggggacagggaaggagaccacattgctgctggctacaagcctagggaaggccgcctctaagttcggatcccctgaggttgccgtggctggccaggtcctcgaaaacctgccacctataggcgtgttctgggacatcgagaactgcagcgttccgtccggacgttccgcaaccgccgttgtacagcgcattagggagaagttcttcaaaggccaccgggaggccgaattcatctgtgtgtgcgacattagtaaggagaataaggaagtgatccaggaactcaataactgccaggtgactgtcgcacacataaatgcgacagcgaaaaatgccgcggacgataagctcaggcaaagcctgagacgcttcgctaatacccacaccgccccagcgactgtcgtgctcgtgagtacggacgtgaacttcgccctcgaactgtcagacctgaggcaccgccacgggtttcacatcatactggtccataaaaatcaagcttctgaagccctactccatcatgcaaacgagctgattcgatttgaggaattcatttccgacctgccccctagactgccccttaagatgccccagtgccacaccctgttgtatgtgtataatctgccagccaataaagatgggaagtcagtgagtaaccggttaaggcgcctgtccgacaactgtggaggaaaggtcctctccattacaggctgtagtgccatcttgcggttcatcaaccaggatagtgccgagcgggctcaaaagagaatggagaacgaggatgtctttggcaataggattattgttagcttcactccgaaaaaccgggagctttgcgagacgaaatcatctaacgccatagcagacaaagttaaatctcctaaaaagctgaaaaatcctaaattgtgcctaattaaagatgcgagcgaacaatcttcttctgctaaggccacacccggcaaggggagtcaggctaacagcgggtcagccacaaagaacactaatgttaaatcattgcaggaattatgcagaatggagtcaaaaaccggccataggaacagcgagcaccagcagggacacctgagactggtggtcccaacacacgggaactcatctgccgccgtgtctactccgaagaactccggggtagctgagccagtctataaaaccagccagaaaaaggaaaacttgtccgcgagatccgttactagctccccagtcgagaaaaaggataaagaagaaacagtctttcaggtgtcttatcctagcgcctttagcaaattggtcgcaagtcggcaggtctcacctttgcttgcgagccagtcatggtccagcaggtccatgtcccctaaccttttgaaccgcgcatctccgctcgcctttaacatcgctaattcctcatctgaagccgactgccctgatccttttgccaacggtgccgatgtgcaggtcagcaacatcgattatcgcctatcccgaaaagaattgcagcagttactgcaggaagcattcgccagacacggcaaagttaaatccgttgagctgagtccccacaccgattatcaattgaaggcagtggtgcaaatggagaatcttcaggacgccatcggagcagtcaattcgctgcataggtacaagattggatcaaagaagatcttggtttcactcgccacgggagccgctagcaagtctctttcgttactgtctgcagagacgatgtcagtacttcaggacgcacctgcttgttgtctccctttgttcaaattcaccgatatctacgagaagaagtttggccataagctgaatgtctctgacctgtacaagttgaccgacactgtagctatccgagaacagggtaatggtcgcctggtttgcttgcttccaagtagccaggctcgacagtcccctctggggtccagccaatctcatgatggaagttccaccaactgcagtcccatcattttcgaagagctcgaatatcacgagcccgtgtgccgtcagcactgctccaacaaagacttctcagagcacgagttcgatccggattcttacaagataccatttgtcattttgagcctgaagacatttgcaccccaggtgcactcactgctgcagacccatgagggaaccgtgcccctgcttgacccttggttactcagatcgaagagccctgtggggaatccacagcttattcaattcagcagagaagtcatcgaccttctgaagtctcaaccttcatgcgtgatcccaatctcccatttcatcccttcctaccatcatcacttcgctaagcagtgtcgggtctctgattatggatactcaaagttgatcgagctcctggaggcggttccacacgtgttgcaaatactggggatgggatctaagaggctgcttacgctgacgcacagggcccaggtgaagcgatttacccaggatctgctcaagctcctgaaatctcaagcctcaaaacaggtcattgtaagggagttctcccaagcctatcattggtgtttctcaaaggattgggacgttactgagtacggggtgtgcgaactgatcgatatcgtcagtgagattcctgacaccacaatttgcctctctcagcaggacaacgaaatggtcatttgtatacctaagagagagagaacacaggatgagatcgagcggacaaaacagttctccaaagacgtggtggacctactgaggcaccagccacacttccggatgccctttaacaaatttatcccctcctatcaccaccacttcgggaggcagtgcaagttagcctactatgggtttactaaactgctggaattgttcgaggccatcccggacactcttcaggtgctggagtgcggcgaagagaaaatactcaccttgaccgaggttgagagatttaaagccctggcagcccagttcgttaagttgctccggtcacagaaggacaattgccttatgatgacagatttgttgacagagtatgctaagacattcggttatacgttcagactgcaggactacgatgtgagttctatttcggcgctgacacagaagttgtgccacgtggtgaaagtcgcagatatagaatccgggcgccagatacaactgatcaaccgcaagagtcttcggtctttaaccgcccagctcctggtactgctgatgtcatgggaaggaacaacacacctttcagtcgaggagcttaaacgacattacgagtccactcataatacccccttgaatccatgcgagtatgggtttatgacactcactgaactgctgaagtccctgccttacctagtcgaggtattcaccaatgacaagatggaagagtgtgtaaaactgacaagcttatatctatttgccaagaatgtgcgaagcctcctacatacctaccactaccagcaaatatttctgcacgagttcagtatggcgtacaccaagtatgtcggcgaaactttgcagccaaagacatacgggcattcatcagttgaagaattgttaggagcaatccctcaggtcgtttggattaagggtcatggtcataaacggatcgtcgtcctgaagaatgatatgaaaagtcgtttgtcaagtctgagccttagtcctgccaatcacgagaatcagccgagcgagggcgaacggatcctcgaagtgccagagtcccatacagcgagcgaactcaagctaggggctgatggatcaggacccagccataccgagcaggagctgctccggttgacagacgacagtcccgttgacttgttgtgcgcacctgtgccctcctgtctgccatccccccagcttcgcccagatcctgtgatactgcagtcggcagacctgatccagtttgaagagcggcctcaagaacccagcgagatcatgattctgaatcaagaggagaaaatggaaattcccatcccaggtaaaagcaagacactaacctccgatagctcaagcagctgtatttccgcagcggtacccgtccctccttgtcccagcagtgagacaagcgagtctcttctctcgaaagatcccgttgaatcccccgcaaaaaaacaaccaaaaaatcgggtcaagctggccgctaacttcagtctggctcctataactaaactgtag

SEQ ID NO: 23501 - DNA, 735 bp, Artificial Sequence
  Description of Artificial Sequence: Synthetic coding sequence
ggcggcggctacgacctgaacctgttcgccagcccccccgacagcaactttgtgtgctctgtgtgtcacggggtccttaagcgacctgccagactgccttgcagccacattttttgtaagaagtgtattctgcgttggctcgcacggcagaagacatgcccctgttgccggaaagaagtgaagcggaagaaagttgttcacatgaataaacttagaaagactatcggaagacttgaggtcaagtgcaaaaacgcagacgcaggttgcatagtgacatgcccactcgcgcataggaagggccatcaggactcatgtccatttgagttgactgcttgccccaacgaagggtgtacctctcaagttccccgtggaaccctggccgaacatagacagcattgccagcaggggagtcagcagcgatgtccattgggctgcggcgctactttggaccctgctgagcgtgcgcgccataactgctaccgggaacttcacaacgcatggtcagtccgccaggagagaaggcgaccactgctactgagtctccttagaagggtgaggtggctggaccaggccacatccgtcgtacgccgagagttggcagagctttccaactttctggaggaggacacagccctccttgagggggccccccaggaagaggcagaggcagctcccgagggcaatgtgggagctgaggtagtcggcgaacctcgtgcaaacattccctgtaagtag

SEQ ID NO: 23502 - DNA, 705 bp, Artificial Sequence
  Description of Artificial Sequence: Synthetic coding sequence
ctgccctgcaagcggtgccggcccagcgtgtacagcctgagctacatcaagcgggggaagaccagaaactatctctacccaatttggtctccatacgcgtattacctgtactgttataagtacagaattacgcttagagaaaaaatgttgccccgctgctataagagcatcacgtacaaagaggaggaagacctcacgctccagcctcgatcttgcctgcagtgcgaatctctggtgggcctccaagaaggcaaaagcacagagcaagggaaccacgatcagctgaaagagctgtactcagcgggcaatctgaccgtcctcgctacagacccattactacaccaggacccggtgcaacttgattttcacttccgactaacatcacaaaccagtgcacactggcacggccttttgtgtgatcggcggctctttcttgacatcccctaccaagccttggatcaagggaacagggagtccttgaccgcaacattagagtatgtcgaggaaaagacaaacgtggactcagtgttcgtaaacttccagaacgaccgcaatgataggggggcgctgctgagggccttctcatatatgggattcgaggttgttcgacctgatcatccggcgttgcctcctctagacaacgttatcttcatggtctacccactagagcgggatgtaggtcacctcccctcagaaccgccctag

SEQ ID NO: 23503 - DNA, 2403 bp, Artificial Sequence
  Description of Artificial Sequence: Synthetic coding sequence
atggccgccgccgccagcgtgaccggccgggtgacctgggccgcctcaccaatgaggtctctgggccttgggcggagactttcactgcctgggcctagactggacgcagtgacagccgcggtgaatccctctttgagtgaccatgggaacggtctggggcgcgggacccggggatcaggatgcagtgggggctcactggtggccgattgggggggcggtgccgcagccgcagccgccgttgccctcgctctggccccagccctcagtaccatgaggaggggatccagcgaatcagaattagctgcgagatgggaggccgaagccgtggcagctgcaaaagccgctgctaaagcggaagccgaagccaccgcagagactgtcgcggaacaggtgcgagtcgatgccggagccgccggagaacccgaatgtaaggccggggaagaacaaccaaaggttctcgccccagcacccgcacagccatcagcagccgaggaaggcaatacccaggtcctgcagcgacccccccccacgctcccccctagcaagccaaaaccggtgcagggcttatgtccgcacgggaaacccagggacaaaggacgaagttgtaaaaggagctcaggccacggtagtggggagaatggatctcagcggcccgttaccgtggactcgtccaaggctcgcacgagtctagatgccttgaagattagtattaggcaattgaagtggaaagaattcccttttggacgtcgtcttccctgtgacatctactggcatggcgtatccttccatgacaatgacatcttttccgggcaggtaaacaagtttccaggaatgaccgaaatggtgaggaagataactttgtcccgggctgttcgcactatgcagaacctatttcctgaggagtacaacttttatcccaggagttggattttgcccgatgagtttcaactgttcgtcgcacaggtacagatggtgaaggatgatgaccctagttggaaacccacattcattgtcaaacctgatggcggttgccaaggagacggaatctacctgatcaaggacccgagcgatatacgactggctggcacgctgcaatccaggcctgccgtggtccaggagtatatatgtaagcctctgttaatcgataagctaaaattcgacatccgactgtacgtgctgctgaagtccctcgatcccctggagatatatatcgccaaagacggcctgtctcgcttctgtaccgagccttatcaggaaccaacaccaaaaaacctccaccgtatcttcatgcatcttaccaattacagcctgaatattcattctgggaactttatccatagcgattccgcatctacagggtccaaaagaacattttcttcaatcctatgtcgcctttctagcaagggtgttgacatcaagaaggtctggtcggatatcatctctgtggtgatcaagacggtcatcgcgctgacccctgagctgaaagtgttctaccaaagcgatattcctacgggacgacccggtccaacctgctttcagattttagggttcgatattctgcttatgaagaatctgaaaccaatcctactggaggttaatgccaaccccagtatgcgaatcgagcacgaacacgagctctcacccggtgtgtttgagaacgtccctagtctggtggacgaggaagtgaaagttgccgttattagggatacactccgtcttatggacccactgaaaaagaaaagagagaaccaatcgcagcagcttgagaagccatttgccggtaaagaagatgctctggacggagaactgacttctgcaccagattgtaatgcaaacccagaggcgcacctgccctccatctgccttaaacaggtgtttcctaagtacgctaaacagttcaattacctgcgcttagtcgaccggatggcgaacttgtttatcagatttctcggtataaagggcacaatgaagctgggacccactggctttcgcacctttattaggagctgtaaattatctagttcaagcctctcaatggctgccgtggatattctgtatattgacattactcgaagatggaacagtatgaccttagatcagagggatagcggcatgtgcttgcaggctttcgtggaggctttcttctttctcgcacagaggaaatttaagatgctgccactgcacgagcaggttgcttctctcattgatctatgcgagtatcacttatcactgctggatgaaaagcgcctggtgtgcggcagaggcgtgcccagcggaggtcggccaccccacaggggaccccctcaggagccaagccccagtgcccagccagcgggagacaacccacctccacgcacctcctgcgcgaataagctttcccatccacggcatacactgagttag

SEQ ID NO: 23504 - DNA, 981 bp, Artificial Sequence
  Description of Artificial Sequence: Synthetic coding sequence
atgcgggagtgcatcagcatccacgtgggccaggccggcgtgcagattggaaatgcctgttgggaactgtactgtctggaacatgggatccaacccgacgggcagatgccaagcgataagacgattggcgggggggacgacagctttaacacattttttagcgagactggtgcgggtaagcacgtgcccagggccgtattcgtggacctggagccaaccgtaatagacgaagtgcgaacaggaacctataggcagctgtttcaccctgagcagctgatcactggcaaagaggacgccgccaacaactatgcaagagggcactatacgattggaaaagagattatcgacctggtgctagacaggatcagaaagctgaaaagtttttttgctacaaagcccaggattcattttccactcgccacctacgcaccggtgatatctgccgaaaaagcctaccacgaacagctgactgttgcagagattacaaacgcctgtttcgagcccgcgaatcagatggtgaaatgtgatcctcgtcacggcaagtatatggcttgctgtctgctgtataggggagatgtggtgccgaaggacgtcaatgccgcaatcgcaacaattaagacaaagcgtaccattcaattcgtagattggtgccccaccggctttaaagtcggcatcaattatcagcctcctacagttgttcccggcggggatctggctaaagtgcagagagcagtttgcatgctctctaacaccaccgcggttgcagaagcgtgggcccgtctcgatcataaatttgacctcatgcccctcagaaggatcatgagaaggctggagcagatcgtgctcacagagagaatgcgggttaagtcgatcaatctgtgtgctgtattactgcatagttttgtgctggaactgtcttacttctgcagcgtgaacgtttactgcaggaaattgctgataaagctgaagtttccattctag

SEQ ID NO: 23505 - DNA, 1005 bp, Artificial Sequence
  Description of Artificial Sequence: Synthetic coding sequence
atggtgggccgggagaaggagctgagcatccacttcgtgcccggctcctgcaggctggttgaagaggaggtaaacatcccaaaccgccgcgttcttgtcacgggggcaacagggctgctgggtcgagcggttcacaaggagttccaacagaacaattggcacgctgtgggatgcggtttccggagggctcgtcccaaatttgaacaagtcaaccttctagattctaacgctgtccatcacattattcacgactttcaaccccatgtgattgtgcactgcgcagctgagcggcggcccgacgttgttgaaaaccagccagatgcagccagccagttgaatgtcgatgcatccggcaatctggcaaaagaagcagccgctgtgggagcattcttgatctacatttcctcggactatgtatttgatggcacaaatcctccttatcgggaggaagacatcccggcccctctcaacctttacgggaaaaccaaattggatggggagaaggcagtcttagagaataacctaggagccgcagttctcaggatacccattctgtatggtgaagttgaaaagctcgaggaatctgccgtgacggtcatgttcgataaggtacagttctctaacaaaagcgccaatatggaccactggcaacagcggtttccaactcacgtgaaagatgtggcgacagtctgccggcagctggccgagaagcgcatgctcgacccctctatcaaggggacatttcactggagcggtaatgagcagatgactaaatacgaaatggcctgtgcaattgccgatgcattcaacctgccaagttcccacctgaggccaattacagattcgccagttctgggggcccaacgccctcgaaatgctcagctcgattgcagtaagctcgagacattgggcatcggtcagcgaactccttttagaattggaattaaggagagcctttggcctttcttgatcgacaagaggtggcgtcagaccgtgttccactag

SEQ ID NO: 23506 - DNA, 513 bp, Artificial Sequence
  Description of Artificial Sequence: Synthetic coding sequence
atggccagcgaggccgagaagaccttccaccggttcgccgccttcggggaatcctcttccagcggcacagaaatgaataataaaaacttctctaaactatgtaaggattgcgggattatggacgggaagacggtgacaagtacggacgtggatattgtgttctcgaaagtcaaagctaaaaatgctagaacaataactttccaacagttcaaggaggccgtgaaggagctggggcagaagagatttaaggggaagtctcccgacgaagtgttagagaacatttatggactgatggagggaaaagatcctgccacaacaggggccactaaggcaactacggtgggcgctgtggacaggcttactgatactagcaaatacactggaactcacaaggagcggttcgacgaatcaggcaagggaaaaggaatcgcaggccgggaggaaatgaccgacaacacaggctacgtctccggctataagggtagcggaacatacgacaagaagacgaaatag

SEQ ID NO: 23507 - DNA, 3582 bp, Artificial Sequence
  Description of Artificial Sequence: Synthetic coding sequence
atgtggcgggtgaagaagctgagcctgagcctgagccccagcccccagacaggaaagccctccatgagaacaccactgcgtgagcttacattgcagcctggtgcactaactaattcaggcaagaggagtcctgcttgctcgtccctcacaccttccctgtgcaagctgggactgcaagagggcagcaataattcctctccagtggactttgtgaacaacaaaagaacagacctcagcagtgagcacttctcccatagctccaagtggctggagacctgccaacacgaatccgatgaacagcctctggaccccatcccacagatctcctcaacacccaaaacttctgaagaagccgtggatcccttaggaaactacatggtgaagacaatcgtgctagtacctagccctctgggtcagcagcaggacatgattttcgaggcacgtcttgatactatggccgagaccaattccatcagtcttaatggcccgctgagaaccgacgatctggttcgggaagaagtggccccttgcatgggagaccgcttttccgaagtggcagctgtttctgaaaagccaatttttcaggagagccccagccatctgctggaggagtcccccccaaatccatgcagcgagcagttgcattgcagtaaggagagcctgagctctagaaccgaggcggtgagagaggacctggttccgagcgaatcaaacgcctttttgccatcttcagttctttggctatctcccagcactgcccttgcagcagatttcagggtaaaccatgttgaccccgaggaggaaatcgtggaacatggagctatggaagagcgcgagatgagattccccacccacccaaaggaatccgaaaccgaggaccaagctctggttagctccgtggaggacatcctgtcgacctgtttgacgccaaatctggttgagatggagtcacaggaggcacctggtccggccgtcgaagacgtcggtcggatactggggtctgatacggagtcatggatgtcaccgctcgcctggttggagaagggtgtcaatacctccgttatgctggagaatttaaggcagtccctgagtctgccgagcatgttaagggatgctgctattggtaccaccccattctcaacatgttctgttggcacctggttcactccgtctgcccctcaggaaaaatcaacaaacacttctcaaacaggcttagttgggactaagcactctacctctgagaccgaacagttgctgtgcggcaggccccctgatctgacagcacttagcagacacgacctggaggataacctcttgagcagtctagtcattcttgaggttctgagtagacagctgagggattggaagtctcagcttgcggttcctcacccggagactcaggacagctccactcaaactgataccagccactccggaatcaccaacaagctacagcatcttaaagaaagccatgaaatggggcaagctctgcagcaagctaggaatgttatgcagagctgggtgctgatctctaaggaactgatctctttactgcatctgtccttgcttcacctggaagaagacaaaaccaccgttagccaagaaagtcggagggcggagaccctggtgtgctgctgctttgacctgctcaagaaactgcgggctaaattacaatctctcaaagccgagcgggaagaagccaggcacagagaggaaatggctctgcgcggcaaagatgctgccgaaatcgttctcgaagcgttctgcgcccatgcatcccaacggataagccaactcgagcaagacctggcctccatgcgggaattccggggcttgctgaaagatgcccagacccaattggtcggcttacacgccaagcaggaggagcttgttcagcagaccgtttcactcacaagcaccctgcagcaggattggcggagcatgcagttagattacacaacttggacagccctgcttagccggtcgaggcagttgacagaaaaactgacagtcaagagccagcaggcccttcaggagcgcgacgtagctatagaggaaaagcaggaggtgtctcgggtcttagaacaggtcagtgctcaactcgaagagtgcaaaggacagactgagcaactggaactggagaacagcagactcgcgactgaccttcgcgcccaactgcaaatcctggccaatatggactctcagctcaaagagctccagagccaacacactcactgcgcacaagatctggcaatgaaggacgagctgctatgccagcttacccaatcaaatgaggagcaggcagcccagtggcagaaggaagagatggccttgaagcacatgcaagcagagttgcagcaacagcaggccgttctggccaaggaagtccgggatttaaaagaaacactcgaatttgccgatcaagaaaatcaggtggctcatctggagttgggccaggtggagtgccagctcaaaactaccctggaggttctgcgtgaaagatccttacaatgcgaaaatcttaaggacacagtggaaaatttaacagctaagttagcatcaactatcgcagataaccaggaacaggacttggaaaagactaggcagtactctcaaaagctgggcctcctcaccgagcaattgcagagcctcacactgttcctccagacgaaactgaaggaaaaaacggaacaagaaactctactcctgagcacagcttgccccccaactcaggaacaccctctgcctaatgatcgcaccttcttaggctctatattgacagctgtcgctgacgaagagcccgaaagcacaccagtgccacttttgggttctgacaagtccgccttcactcgcgtggcctctatggttagtctgcagccggccgaaaccccgggaatggaagagtctctggccgagatgtcaatcatgaccacggaactgcagtctctgtgttcattacttcaagaatcaaaggaagaggctatccgaactcttcagcggaagatctgcgagctgcaggcgcggctgcaagcccaggaggaacagcatcaggaggttcagaaagccaaagaggcggacattgagaaactgaaccaggccctttgtctgcggtacaagaacgagaaggaacttcaagaggtcatacagcagcagaatgaaaagatcctagaacagattgataagtctggcgagctgatctcgttacgggaggaggtcacacatctgactaggtccctgaggcgggctgaaacggaaactaaggtacttcaagaagcccttgctggccaacttgatagtaattgccagcctatggccaccaattggattcaagagaaggtctggctaagccaagaagtcgataaactaagagtgatgttcctggaaatgaaaaatgaaaaagaaaaacttatgataaaattccagagtcacaggaacattctcgaggagaaccttcgtcggagcgacaaggagttggaaaagctcgacgatattgtccagcacatctataagacgcttttgagtataccagaggttgtaaggggatgtaaggaactccaagggttgctagaatttctttcttag

SEQ ID NO: 23508 - DNA, 9141 bp, Artificial Sequence
  Description of Artificial Sequence: Synthetic coding sequence
atgcggggccggcggggccggccccccaagcagcccgccgcccccgccgccgagaggtgtgctccggccccacctcctcctccccctcctcccacttcgggccccattggcggattacgttctcgccatagggggtccagtaggggacgatgggccgccgcccaggcagaagtggcccccaagacaaggctgtccagccctcgagggggatcctctagccgcagaaagcctcccccgccaccacccgctccgccatctacatcagctccaggcaggggcgggcgtggcgggggcggtgggagaacaggggggggaggtgggggggggcatcttgccagaacaaccgcggcacgtagagccgtgaacaaggtcgtttacgatgaccacgagagtgaggaggaggaagaggaagaggatatggtatctgaggaggaagaggaagaagacggcgacgccgaagaaacacaagacagcgaggatgacgaggaggacgagatggaagaggatgacgacgactctgactacccagaggagatggaagatgacgacgatgatgcgtcttactgtacggagagtagttttcggagccactccacttacagttctacccctggcagaagaaaaccacgcgtccacaggccccggtcccctatccttgaggaaaaagacattcctcccttggagtttcctaagagctccgaggacctcatggtgcccaatgagcacatcatgaatgttattgcaatttacgaagtgctgcgaaattttggaacggtgcttcggttgtctccatttcgatttgaggatttttgcgctgcactagtttctcaagaacaatgcacgctgatggctgagatgcacgtagtactcctgaaagccgtgctgcgggaggaagacacctccaacactactttcggtcctgcagatcttaaagactctgtgaacagcaccctttatttcatcgatggaatgacctggcccgaagtgctaagagtgtattgcgagtcagacaaagaatatcaccatgtgctcccgtaccaagaggcagaggactatccatatggtcccgtcgagaacaagatcaaagtcctgcagtttctggttgatcaattcctgacgacaaatatcgcacgggaggaactcatgtctgagggggtgattcaatacgatgaccactgtagggtttgccataaactaggagatctgctgtgctgcgaaacttgcagcgcggtctatcacttggagtgcgtgaagcctcctttggaggaggtgccagaagacgagtggcagtgtgaagtatgcgtggcacataaggtgcctggcgtgacagattgtgtggctgaaatacagaaaaataagccatatatccgtcacgagcctataggctatgatagatcaaggcggaagtactggtttctgaatcgacggttgataattgaagaggacactgaaaatgagaatgaaaaaaaaatttggtactattctacgaaggtacagctggcggagctgatcgattgtctggataaggattactgggaggctgagctgtgcaaaatcctggaggagatgcgcgaagagattcaccggcatatggacatcacagaggacctcactaacaaagcaaggggcagcaataaaagttttcttgcagcggccaatgaggaaatcctggagtccatacgtgcaaaaaagggcgatatagataatgtgaagagccccgaggagactgagaaagacaagaacgaaaccgagaatgactcgaaggacgctgaaaagaaccgcgaggagtttgaggatcagtccctggagaaggactcagatgataaaacccccgacgatgaccctgaacagggcaagagtgaggagcctaccgaggtgggggacaagggcaactctgtttccgccaatcttggggacaacaccaccaatgccaccagcgaggaaacgtctcctagcgaaggccgctcacctgttggatgcctttctgagaccccggactccagcaatatggccgagaaaaaagtcgcttcagagctacctcaggatgtaccagaggagcctaacaaaacctgtgagtccagcaacactagtgctacgacaactagcatccagcctaatcttgagaatagcaatagttcctcggagctgaattcatctcaatccgagagcgcaaaagccgcggacgaccctgagaacggcgagagggaaagtcataccccagtgagtatccaggaagagatagtgggggattttaagagcgagaaatccaacggagaactttctgagtcacctggcgccggcaagggcgcatccgggtccacccgcatcattacccggctacggaatcccgattctaaacttagccagcttaaaagccagcaggtcgctgctgcagcccatgaagccaataagctgttcaaagaggggaaagaggtgctggtcgtgaacagccagggggagattagtcgactctcaacaaagaaagaagtgataatgaagggcaatatcaacaattattttaaactgggtcaagagggcaagtatagagtctatcataaccagtatagcaccaattctttcgccctaaataagcaccagcaccgtgaagaccatgacaagcggaggcatctggcacacaagttctgcctcacacctgctggggagttcaagtggaatgggtccgtacacggttccaaggtgctcacaatttcaacgcttcgccttactataactcagctggagaataatattccgtcatcattcctgcaccctaattgggcgagccatcgtgctaattggataaaagccgtccaaatgtgttctaagcctagagagtttgcactcgccctggccatcttagaatgcgcggtaaaacccgttgttatgcttccaatctggagagagagcctggggcacacgcgactccacaggatgacttctatcgagcgggaggagaaggaaaaagttaaaaaaaaggagaagaagcaggaggaggaggagaccatgcagcaggctacgtgggttaagtatacgtttccagtgaaacatcaggtatggaaacaaaagggggaagaatatagggtgacgggatacggtggttggtcgtggatcagtaagactcatgtatatagatttgtccctaagctgcccggaaatacaaatgtaaactataggaaatctctcgaggggaccaagaacaacatggatgaaaatatggatgaaagcgacaaacggaaatgctctaggtctcccaagaaaataaaaatagaacctgactcagaaaaagacgaggtcaagggctctgatgctgcgaaaggagcagaccagaacgaaatggatattagcaaaattactgaaaaaaaggaccaagatgttaaggagctgctagacagcgattccgataagccctgcaaggaagaaccgatggaggtggacgatgatatgaaaacagagtcacatgtgaactgtcaagaaagcagccaggtcgacgttgtgaacgtaagcgaagggttccacctacgaacgagctataagaagaaaaccaagagtagtaaactggacgggctcctcgagcggaggatcaagcagttcacactggaggaaaagcaaaggctggagaagattaagctcgaaggtggcataaagggcattgggaagacttctaccaactcttcgaaaaatctttcggaatcccccgtcatcacaaaggccaaagaaggatgccagtcagatagtatgaggcaggagcagagtcctaatgccaataacgaccagccagaagacctaattcagggatgttcagagagcgatagctcggtgctgcggatgtccgacccctcacataccaccaacaagctctaccctaaagacagagtcctagatgacgtaagcatcagaagccccgagaccaagtgtcctaaacagaactcaatagagaacgatatcgaggagaaggtatccgacttggcgagccgtggccaggaaccctcaaagtctaaaacgaaggggaatgactttttcatcgatgactcaaaattggcttctgccgatgatataggaacactgatctgcaagaataaaaaaccgttgattcaggaggagagtgacactatagtgtctagctccaagagcgcgctgcactcctcggtcccaaaatccactaacgaccgggatgcgaccccactttctagggcaatggacttcgagggtaaactcggttgcgacagtgaatctaattcaactttggaaaacagctcagataccgtttccattcaggactctagtgaagaagatatgattgtgcagaatagcaatgagtccattagcgaacaatttcggaccagggagcaggacgtggaggtcctagagccgctgaagtgcgagctcgtgtctggggagtcaacaggcaattgcgaagatcgtctgccagtgaagggtactgaggctaatggtaaaaagccatcacagcagaagaagttggaagagagacctgtcaacaaatgctcggaccaaattaaactaaaaaatacaaccgataaaaagaacaatgagaacagggagtccgaaaaaaagggacaacggaccagtacctttcaaatcaatggcaaagataataagccgaaaatttatttgaaaggggaatgcctcaaggagatcagcgagtccagggtcgtgtccggaaatgtcgaaccaaaggtcaataatataaacaagatcatccccgaaaatgatatcaagtccctaacggtcaaggaaagtgctataaggccatttataaacggagatgtcataatggaagactttaatgagcgaaatagtagtgaaacgaaatctcacctactgtcgagttccgacgcagagggtaattaccgcgactccctggagactctgccttctacaaaagaaagtgatagtactcagacgacaacaccttcggcgagttgccccgagtcaaactctgttaatcaggtagaggatatggaaatagagacatccgaagtcaaaaaggtaacgtctagtcctataacctcagaggaagaaagtaacttaagcaatgacttcatcgacgagaacggcctccctatcaacaagaacgaaaacgtgaacggggagagtaaacgaaagaccgtcatcacagaagtaaccactatgacttccacggtggctaccgagagtaaaacagtaatcaaagtggagaaaggcgacaagcagaccgtggtatcttcaacagagaactgtgccaaatcaactgttaccacgacaaccacgacggttaccaaactgtcgacgccttctaccgggggaagcgtcgacatcataagtgtgaaggagcagtctaagacagtcgtgactacaaccgttacggatagcctgactactaccggcgggaccctcgtgacatctatgaccgtctccaaagaatacagtactagggataaagtaaagctcatgaaatttagtcggcccaaaaagacccgttctggtacggctcttccttcttatcggaagtttgtgaccaagagctccaaaaagagcatttttgtcctgcccaatgacgacttaaaaaaactggcaagaaagggagggattagagaagtgccctacttcaactacaacgccaagccagcccttgacatttggccgtacccctctccgcggccaacgtttgggattacctggaggtaccgactacaaacagtaaagagcctggccggcgtcagtctaatgttacggctgctttgggccagcctcaggtgggacgacatggccgctaaggctccaccaggtgggggcactactcgcacagagaccagcgaaacagagattactactaccgagattataaaacgtcgagacgtgggtccttacggaatccggagtgagtattgtataaggaagataatttgtcctatcggagttcccgagaccccaaaagagaccccaacacctcagcgtaaaggcctgaggagctctgctttgagaccaaagcggcctgaaacccctaagcaaacaggccctgtgatcattgaaacgtgggttgcagaggaagagttagaactgtgggaaattcgcgcctttgcagagagggtcgagaaagagaaagcacaggcggtggaacagcaggctaagaagcggctagaacagcagaagcctacggtgatcgctacttccacaacttctccaacatcctcaaccactagtacgatctctcctgcccagaaagtgatggtggcccctataagtgggtctgttactaccggaacgaaaatggtcctgacaactaaggtcggatcaccggctaccgtgacatttcagcaaaataaaaattttcaccaaactttcgccacctgggtgaagcaggggcagtccaacagcggcgtcgtacaagtgcagcaaaaggtactcggcattatccctagctcaaccgggaccagccaacagacatttacgagctttcagcccagaactgcaaccgtgaccattcgcccgaacacaagcggtagtggcggcaccactagcaattctcaagtcatcaccggaccccagatcagacctggaatgacagtgataaggacccccttgcagcagagcactttaggtaaggcaatcatacggacccccgtgatggtccaaccaggggcccctcagcaagtaatgacccagatcatccgggggcaacccgtttcaactgcggtgagcgctcctaatacggtgtcgtccacaccagggcaaaagagtcttacttctgcaacctcaacctcaaacatccagagctccgcttcccaaccgccccgcccgcagcagggacaggtcaaactgacaatggctcaacttacacaacttacgcaggggcacgggggaaaccagggcctgacggtggtcatccaaggtcagggccagaccaccggccagctgcagctcattccccagggggtgaccgtccttccagggccggggcagcagctaatgcaggcggcaatgccaaacgggactgtgcagcggtttctctttacaccactcgccaccacagcaactacagcatcgacgacaaccaccacagtttctaccacagctgcgggcaccggagagcagagacaatcaaagctgtccccccagatgcaggtacaccaggacaaaactttgccgccagctcagtcttccagtgtgggaccggcggaggcccagcctcagacagcccagccatctgctcagccacagcctcagactcagccgcagtcccctgctcagcccgaagtgcagactcagccagaggtacaaacacagaccacagtgagttcccacgtacctagtgaggctcaacctacgcacgcccagagttccaaaccccaggtggccgcccagtcccagccccagtcgaacgtgcaaggacaaagcccagtccgcgtgcaatccccctcacagactcggatccggccatccacccctagtcagcttagccctggccagcagtcccaggttcagacaaccacctctcaaccaatcccaatccagccgcacacgtctctgcagatccccagccagggccaaccacaaagtcagccacaggtccagtcctccacccagaccctgagctccggtcagactctcaaccaggtgacggtatctagtcccagcagacctcagctgcaaatccaacagccccagccacaggttatcgccgtcccccagctgcagcagcaggtccaggtgctaagccagattcagtctcaggtagtcgcccaaatacaggcacaacaatccggcgtgccccagcagattaaacttcagttacctatccaaatccagcagtctagtgctgtccaaacccaccagattcaaaacgtagtcactgtccaggcggcctccgtgcaggagcagctgcagcgtgtgcagcagttaagggaccagcagcagaagaagaagcaacagcagatcgagatcaagcgggaacatacattacaggcttccaaccagagtgagatcatccagaagcaggtagtgatgaaacacaatgcagttatcgaacatctcaagcagaaaaaatcaatgacaccggccgagagggaagaaaatcaaaggatgattgtgtgcaaccaggtaatgaaatatattttggacaaaatagacaaggaggagaaacaggctgccaaaaagcggaagagagaggagagcgtcgagcaaaaacgctccaaacagaatgctaccaaactgagcgctctgttattcaagcataaagagcagctgagagccgagattctgaagaagcgtgccctactggataaggatctccaaatagaggtgcaggaagaacttaaacgagacttgaaaatcaagaaggagaaagatctgatgcagctggctcaggcaactgccgtggcagcaccctgcccacctgtcactcccgctcccccggcccctcccgcacctcccccttccccgcctcctccacccgcagtgcagcacactggcctgttgtccacaccaaccctgcccgcagcctcacaaaagagaaagagagaagaggaaaaagactcttcatctaagtcaaagaagaaaaaaatgattagtaccaccagcaaggagaccaaaaaggacacaaagttatactgcatatgcaaaactccatatgatgaaagcaagttctatataggatgtgatagatgccagaattggtaccacggaagatgcgttgggatcctccagagcgaggcagagttgatcgacgagtacgtgtgtcctcagtgccagagcaccgaggacgcaatgaccgttctgacaccattgacggaaaaagactatgagggcctcaaacgggtgctgagatctctgcaagctcataaaatggcatggccgtttctcgagcccgtggaccccaatgacgcccccgattactacggagtgattaaagaacctatggacctcgctaccatggaggaaagggtccaacgacgctactatgagaaactaacagaatttgtcgcagatatgaccaagatcttcgataactgtcgctactataatccatcagactcacctttctatcagtgtgcagaagtactagagagctttttcgtacagaagctcaaggggtttaaggcttcccgcagccataacaacaagctccagtcaactgcatcatag

SEQ ID NO: 23509 - DNA, 927 bp, Artificial Sequence
  Description of Artificial Sequence: Synthetic coding sequence
atggccagcagcaacaccgtgctgatgcggctggtggccagcgcctactcaattgcacagaaggctgggatgatcgtccggcgggtgattgccgagggggacctgggtattgtggagaaaacctgtgccaccgatctgcagactaaggcagacaggctggcccagatgagcatttgcagctcactggcaagaaagttccctaagttgaccatcatcggtgaagaagatttgcctagcgaggaggtagaccaggaacttatcgaggacagccagtgggaggagatcctcaaacagccttgccctagtcagtactcggctattaaagaggaagatctggttgtatgggtggatcctttggatggaaccaaggaatataccgagggcctgctggacaacgtcaccgtcctaattggtattgcctatgagggcaaggcaatcgctggggtaatcaatcagccttattacaactatgaggctggccccgatgccgtcctggggcggactatatggggcgtcctaggcctgggtgcatttggtttccagctcaaggaggttcccgccggcaaacacattattaccactacccgctcacattctaataaacttgtcactgattgcgtggctgcgatgaatcccgacgcagtgttaagagtgggtggcgccggaaataagattattcagctgatcgaaggtaaggcgtctgcctatgtttttgccagccctggctgtaaaaaatgggacacttgcgctcccgaggttatcctgcacgccgtgggaggcaagctcacagatatccatgggaacgtgctgcaatatcacaaggacgttaaacacatgaacagcgccggggtgctcgcaaccctgagaaactacgattattatgctagccgtgtgcctgaaagcatcaaaaatgctctcgtgccatag

SEQ ID NO: 23510 - DNA, 1212 bp, Artificial Sequence
  Description of Artificial Sequence: Synthetic coding sequence
atgagcggcagcgacggcggcctggaggaggagcccgagctgagcattaccctgacattaaggatgctgatgcatgggaaggaggtcggctctatcataggcaagaaaggcgagacagttaagaggattcgagagcagagttctgcgaggattactatttccgagggttcctgccccgagagaatcactaccataaccgggtccacagcagccgtctttcatgcagtgtctatgatcgccttcaaactggatgaagacttgtgtgcagcaccggctaacggaggaaatgtgtctaggccacctgtgactctgcgcctggtgataccagcctctcagtgcggctcattgataggtaaggcaggcactaaaatcaaggaaatccgagagacaaccggtgctcaggtacaggtagccggtgaccttctccctaacagtacagaacgcgccgtgacagtcagtggggttccagacgcgattattctctgcgtccgacaaatatgcgcggtaatactggaatctccgcccaaaggcgctactattccataccacccctcacttagccttgggaccgtgctgctcagcgcgaatcagggctttagcgtccagggccaatatggggcagttactccggccgaggtgaccaaacttcagcagctgtcgagtcatgcagtgccgtttgccactccctctgtagtccccggattagaccctgggactcagacatcctcccaggagtttcttgtacctaacgatttgataggttgtgtgattggccggcagggctcaaagatcagcgagataaggcagatgagtggcgcacacataaagatcggaaaccaggccgagggtgccggagagaggcatgtgacaatcaccggcagccctgtgagtatcgctctggcgcagtacctgataacagcgtgtctggaaacagccaagtcgacgagtggcggtaccccttcttcagctccagccgatctcccagcgcccttcagccctcccctcacggctcttcccaccgcccccccagggctcctgggaacaccatacgcaatatcactatcgaactttatcgggttgaagccgatgccgtttctggctctgccacccgcgtcacccgggcccccacccgggctggcagcatatacagctaagatggccgccgcaaacggatctaagaaagctgagcggcagaagtttagcccgtattag

SEQ ID NO: 23511 - DNA, 654 bp, Artificial Sequence
  Description of Artificial Sequence: Synthetic coding sequence
atgagcagcaaggtgagccgggacaccctgtacgaggccgtgcgggaggtgctgcatggaaaccagagaaaaagacggaaatttttggagacggtggaattgcaaatcagcctgaaaaattatgatccccagaaggataagcgcttctccgggacagtccgcttgaaaagcacaccaagaccaaagtttagcgtgtgtgttcttggtgaccagcaacactgtgacgaggcaaaagcagtagatatcccccacatggatattgaggcattaaagaaactgaacaagaataagaagctcgtgaaaaaactggctaaaaagtacgacgcatttcttgccagcgagtcactcatcaaacaaatcccacgaatcctgggtcccggattgaataaggcaggaaagttcccgagtctgctcacacacaatgaaaatatggttgcaaaagtagatgaggttaaatccactattaagtttcagatgaagaaagtcctgtgtctcgccgtggcagtgggccacgtgaaaatgaccgatgatgaacttgtgtacaatatccacctcgcggtgaatttcttagtcagtcttcttaagaagaactggcagaatgtcagagcgctttatattaagagtacaatggggaagcctcagagactgtactag

SEQ ID NO: 23512 - DNA, 3159 bp, Artificial Sequence
  Description of Artificial Sequence: Synthetic coding sequence
atggagggcagcgagcccgtggccgcccaccagggcgaggaggcctcatgcagctcctggggcaccgggtctaccaataaaaacttgcccatcatgagtacagcctccgtggaaatcgatgatgcgctgtatagcagacaaaggtatgtgctgggcgatacagccatgcagaaaatggcaaaatcacatgtattcctgtcaggcatgggaggcttaggactggagattgcgaagaatctggtgctcgccgggatcaaggccgtcaccatacacgacactgagaaatgccaagcctgggacctgggtaccaattttttcctttcagaggatgatgtcgtaaataaacggaatcgggctgaggccgttctgaagcatattgccgaactgaatccgtacgtgcatgtcacgtcatcatccgtcccttttaacgagactacagatttgtctttcctcgacaagtaccagtgtgtggtgctgaccgaaatgaaactgccgctccagaaaaagatcaacgacttctgtcgcagccaatgtccacctatcaagttcatctcagcagacgtgcatgggatttggagccgccttttttgtgactttggggatgagttcgaggtactggacacaacgggagaggaaccgaaggaaatcttcatctcgaacattacacaagccaaccctggaattgtgacatgcttggagaatcacccacacaaactcgagaccggccaattcctgaccttcagggagatcaacggaatgaccgggctgaatgggtccatccagcagatcacagtcatctctcctttcagcttttccattggagatacaaccgagttagaaccatacctgcatggcggtattgctgtgcaagtgaagacacctaagaccgtgttctttgaaagcctcgaacgacaactcaaacatcctaagtgtctgattgtggactttagcaatcccgaggcccctctggaaatccatacagccatgctcgcactggaccaattccaggaaaagtattctcggaagccaaacgtgggctgccaacaggattccgaggaactattgaaactcgccactagcatctccgaaacgctggaggagaagcctgatgtgaatgctgatatcgtacactggcttagctggactgctcagggcttcctatcccctttagctgctgcggtcggaggtgtcgcttcacaggaggtgctaaaagctgtgaccggtaagttttctcccctctgtcaatggctctacttggaagccgccgacattgtggaaagcctcgggaaacctgagtgcgaagagttccttccaagaggggatcgttatgacgcccttagagcttgcattggcgatacactctgccagaagctgcagaacctcaacatttttcttgtgggttgtggcgcgattgggtgtgaaatgctgaagaacttcgctttgctgggagtggggactagtaaagagaaaggcatgattacagtcacagacccagacctgattgaaaaatctaacctgaacaggcagttcctcttcaggccacaccacattcagaaaccaaagtcttacacagctgccgacgccactctgaagattaactcccagattaagattgacgcacaccttaacaaagtctgtcctacgactgaaactatctacaacgatgagttttatacaaaacaggatgtaattatcacagcacttgacaacgtggaggcaagaagatatgtcgacagcaggtgcctcgccaatctgaggcctctgttggatagcggcacgatgggcacaaaggggcacactgaggtcatcgtgcctcacctcacagaatcttacaattcacatcgcgacccacccgaggaggagattcctttttgtactttgaaaagcttccccgctgcgattgaacacacaatccagtgggctcgggacaagttcgaatcatccttctcgcacaaaccatcactctttaataaattctggcagacatattccagtgcagaagaggtcttacaaaaaattcagagtggccacagcctggagggttgttttcaagtgatcaagctgctgtctcgacgtccccgtaactggtctcagtgcgtggaattagctcgcctgaaatttgaaaaatacttcaaccacaaggctctgcagttacttcattgctttcccctggatatccgcttaaaagatggcagcctattctggcagtcacccaagcgccccccctcccccataaagtttgatctgaacgagcctctccatctgtcgttcctacaaaatgcagccaagctgtacgccactgtctattgtataccgttcgctgaagaggacctgtccgctgacgcgcttctgaatatcctgtccgaagtcaagatccaagaatttaagccctccaataaagtggtgcagacagatgaaaccgcgaggaaacctgatcacgtgccaatttcttcagaggacgaaaggaacgcaattttccagctggaaaaggccatactatccaacgaggctaccaaatccgaccttcaaatggccgtgctctcatttgagaaagacgatgatcataacggccacatcgactttataacggctgctagcaatttacgggctaagatgtatagcattgagcccgccgatcgctttaagacaaagagaatcgccggaaagatcatccctgcaattgcaaccacaacagccacagttagcggactggtggccctggaaatgatcaaagtaaccggcggatatccctttgaggcttataagaattgttttctgaacctcgcaatccctatagtggttttcactgaaaccactgaggtgagaaaaacgaagataaggaatgggatctctttcacaatctgggatcgttggacagtgcacgggaaggaggattttaccctgcttgatttcattaatgccgtgaaggaaaaatatgggatcgaacctaccatggtagtgcaaggtgttaagatgctgtatgtaccagtcatgccgggacacgctaagcggcttaagctcacaatgcacaaactcgtcaaacctactactgagaagaagtatgttgaccttactgtcagtttcgctcccgacatcgacggcgatgaggacttaccaggtccgccagtgaggtattatttctcacacgacaccgactag

SEQ ID NO: 23513 - DNA, 1134 bp, Artificial Sequence
  Description of Artificial Sequence: Synthetic coding sequence
atgctgcggctggtgcccaccggcgcccgggccatcgtggacatgtcctacgcgcgtcattttctagattttcagggcagtgccatcccgcaggccatgcagaaactcgtggtcacgcgactgagcccaaatttccgagaagccgtgaccctatcacgcgactgtccagtcccgttgcccggggacggagacctattggtcagaaatagattcgtgggcgtgaacgcttctgacataaactattcagcaggtcgatatgaccctagcgtcaaaccacctttcgacatcggcttcgagggaatcggggaagttgtagcccttggcctgagcgcttccgcccggtacactgtagggcaagccgtagcctatatggcacccggatcttttgccgaatacacggtggtacctgcatctatcgccacacctgtgccctcagtgaagcctgaatacctgacactgcttgtctcaggaaccaccgcctatatttcattgaaggagctcggtggccttagtgaaggaaaaaaagttttggtgaccgcagccgcaggcggtactggccagttcgcaatgcagctgtccaaaaaagccaaatgccacgtgatcggtacctgcagctcagatgaaaagagtgcattcctgaagtccctgggctgcgaccgccctatcaactacaagaccgagccagtcggtaccgtgctgaagcaagagtatccggagggagtggacgttgtgtacgaatccgttgggggggcaatgttcgatctggctgtggacgctctggctaccaaaggcagacttatcgtaattggcttcatatcgggatatcagacaccaacaggactgagccccgttaaagctggaacattacctgctaagctcctcaagaagtcggcttccgtgcaggggttctttctgaaccactatctgtccaaatatcaggctgccatgtcccatctcctagagatgtgtgtatctggggatttagtgtgtgaggtcgatctcggcgacctttcacccgagggccgatttacaggattagaaagtatatttagagcagtgaattatatgtacatgggcaagaatacaggcaagatcgttgtggagctcccacactcagtgaattcaaaactgtag

SEQ ID NO: 23514 - DNA, 2538 bp, Artificial Sequence
  Description of Artificial Sequence: Synthetic coding sequence
atgagcaacagccggccccggagccggcgggacgccggcggcggcgcgggggctgcagggagggacgagctggtgtcccgctccctccagagcgctgagcattgtctcggcgttcaggacttcgggacagcatatgcacactacctgttagtccttagcctggcccctgaacttaagcatgacgtgaaggagacctttcagtacactctcttccgctgggcagaagagctagacgctctgagcagaatccaggatttgctaggctgttacgaacaagcgctggaactttttccggatgacgaggtgatttgcaactccatgggcgaacatctgttcagaatggggtttagggatgaggctgctggatatttccataaagcagtgaagctcaatcccgatttctccgacgcgaaggagaatttctatcgtgtggccaactggctggtagagcgctggcattttatcatgcttaatgacactaaaagaaacactatttacaatgctgctattcaaaaagcagtatgcctcggttcgaagtctgtgttggatatcggcgccggcaccggtatattgagtatgttcgctaaaaaagctggcgctcactccgtgtatgcttgcgagttgtctaaaactatgtatgaactggcatgtgatgttgtcgccgctaataaaatggaagcgggcatcaaactgctgcacaccaaatccctagacatcgagatccccaagcatattccagagagggttagccttgtggtgaccgagaccgtggacgctggtctcttcggggagggcatagttgagtccctcattcatgcctgggaacacctgcttctgcagcctaaaactaagggcgaatcagcaaactgcgagaagtatggaaaagtgattcctgcaagtgcagtcatcttcgggatggcggtggagtgtgcagagattaggcgccatcatcgcgtggggatcaaggacatcgcaggcattcacctccccacaaatgtgaaattccagtcacccgcgtattccagtgtagatacagaggagacgatcgaaccctacaccactgaaaaaatgtcccgagttcccggggggtatctggctctgaccgaatgctttgaaattatgacagtggactttaataaccttcaggagcttaaaagcctggccactaagaagcccgataaaatcgggatcccagttatcaaggaggggatactggatgcaatcatggtttggtttgtgctacagctcgatgatgaacacagtcttagtactagccctagtgaagaaacctgttgggagcaggcagtgtaccccgtccaggacctggccgactattggatcaaaccaggggaccacgttatgatggaagtaagctgtcaagattgctatctaaggattcagtccatatctgtcttgggcctggaatgtgagatggacgtagctaagagcttcacacagaacaaggaccttttgagcctgggaaatgaggccgagctgtgcagcgctttggcgaacctgcagaccagtaagcctgacgccgtggagcagacttgcattcttgagtcaacagaaattgcacttctgaataatattccttatcacgaaggcttcaaaatggcaatgtctaaagttttgtcctctcttaccccggagaaactctaccagacaatggatacacactgtcagaacgagatgtcgtccggcactggccagagcaacaccgtgcagaacatactggagcctttctacgtactcgacgtgtccgaggggttctcagtcctgcctgttattgcagggacactgggacaggttaaaccatacagctccgtcgagaaggaccagcaccggatcgccctggatttaatcagcgaggctaaccatttcccaaaagaaaccctggagttttggctgcggcatgtggaagacgaaagtgcaatgctgcagcgaccgaagtccgacaagctttggtccatcattattctggatgtgatagaaccgtcaggcctgattcagcaggaaattatggagaaggcagcgataagccgttgtttacttcaaagcggaggcaaaatattcccgcagtacgtcctgatgttcgggctgcttgtggagtctcaaacactgctggaagaaaacgccgtccaagggacggaaagaaccctaggacttaatatcgctccttttatcaatcagttccaggtgcctataagggttttcctcgacctatcatctttaccatgtattcctctatctaagccagtggagctgctccgcctggacttgatgactccatatcttaacacttctaaccgcgaggtcaaagtttatgtgtgcaagtcaggaagactcaccgcaatacccttttggtaccacatgtatttagacgaggagatcagactggacacaagctccgaggcttcacactggaaacaagcagccgtagtcctggataatccgattcaggtggagatgggcgaagagttagtgctgtctattcagcaccataagagcaacgttagcattacagtgaagcagtag

SEQ ID NO: 23515 - DNA, 756 bp, Artificial Sequence
  Description of Artificial Sequence: Synthetic coding sequence
atggccgacctgaccagcgtgctgaccagcgtgatgttcagccccagctcaaaaatgttcatcggaggtctatcctggcaaacctcacctgactcactgcgagactatttttcaaagtttggcgaaatacgggaatgtatggtgatgcgggatcctaccacaaagcggtcaagggggtttggattcgtgacattcgctgatcccgcctcagtcgacaaggttcttggccaacctcatcacgagctggatagtaagaccattgacccaaaagtggcatttccacgtagagcgcagcctaagatggttacccgcaccaagaaaatctttgtgggagggctatcagccaacaccgtggtcgaggatgttaaacagtatttcgaacagttcggcaaggttgaagacgccatgctgatgttcgataaaaccaccaataggcaccggggattcgggttcgtgaccttcgaaaacgaggacgtggtggagaaggtgtgcgaaatccactttcacgagataaataacaagatggttgagtgtaaaaaggctcagcctaaggaagtgatgtttcccccagggaccagaggtcgagcacgcggtctgccctatacaatggacgccttcatgctgggaatgggaatgctcggctacccgaattttgtggccacgtacggtaggggctaccccgggttcgcgccgtcttatggttaccaattccccgactacctcccagtgtcccaggatatcatattcatcaactag

SEQ ID NO: 23516 - DNA, 510 bp, Artificial Sequence
  Description of Artificial Sequence: Synthetic coding sequence
atggcccccaagcgggccaagcggcggaccgtggagggcggcagctcatctgtttttagcatgtttgatcagacccagatacaggagtttaaagaggcctttaccgtcatagaccagaatcgggacggaataattgacaaggaagacctgagagacactttcgctgccatgggccgcctgaacgttaagaatgaggaactggacgctatgatgaaagaggcatctggcccaatcaattttactgtgttcctgacaatgttcggcgaaaagttgaagggcgcagaccctgaggatgtcattaccggcgcgtttaaagtgctcgaccccgagggcaaggggacaatcaagaagaagttcctcgaggagttgctaactacccagtgcgatcggttcagtcaggaggagattaagaatatgtgggcagccttcccacctgacgtgggaggcaacgtggattacaagaatatttgctacgtgattacacatggcgacgccaaagaccaggaatag

SEQ ID NO: 23517 - DNA, 546 bp, Artificial Sequence
  Description of Artificial Sequence: Synthetic coding sequence
atggccaccgagcccgaggccgccgagcccgtggtgcccagcctggtcgaccgatatttcacgcggtggtataagcccgatgttaagggcaaattttgcgaagatcactgcatcctgcagcacagcaatcggatatgcgtgattacactggctgaaagccacccggttctccagtcaggtaagaccattaagtccattagttaccagatcagtacgaattgttcacgattgcaaaacaaagtgtctggaaaattcaagagaggtgcccagttccttacggagctcgcacccttgtgcaagatctattgctctgatggggaagagtataccgtgtcttcgtgcgtacggggtaggctgatggaggtgaacgaaaacattctgcataagcccagtattctgcaggaaaaaccctccaccgaaggatatattgctgtggtcctgccaaaattcgaagagagcaaaagcataacagaaggccttctcacgcaaaagcaatacgaggaggttatggtgaagcgcattaatgcaaccacagcaaccagctag

SEQ ID NO: 23518 - DNA, 2154 bp, Artificial Sequence
  Description of Artificial Sequence: Synthetic coding sequence
atggagctgcggtgcggcggcctgctgttcagcagccggttcgactccgggaatctggcgcacgtggaaaaagtggagtcccttagcagcgacggagagggcgtgggaggtggtgcaagcgcactgaccagcggaatcgcctcctctcccgattatgaatttaacgtctggactaggcctgattgtgccgagactgaattcgaaaatggaaatcgctcctggttctacttctcggtaagagggggaatgccaggcaaactgataaagataaacatcatgaatatgaacaagcagtcaaaactttactcccagggtatggctcctttcgtgagaacgcttcccacgaggccacgctgggagaggattcgcgacaggcctaccttcgaaatgaccgagacgcagttcgtgctgtccttcgtgcatcgctttgtggaaggtaggggtgcaactacatttttcgccttttgttacccatttagttacagcgattgtcaagagttactgaaccagcttgaccagaggtttccagaaaatcaccctacccatagctcacctctagacacaatctactaccatcgggagctcctctgttacagcctcgacggcctccgagttgacttactaaccattacctcttgtcacggcttaagggaggatcgcgaacctaggctggagcagctttttccagacacctccacaccgcgcccatttaggttcgctggaaaaagaatcttttttttaagcagcagggtccaccctggcgagacaccgtcaagtttcgtattcaatgggttccttgattttattctgcgcccggacgaccctcgcgcccagactctgcggcgcctctttgtgtttaagctgatcccgatgctgaatcctgacggagtggtgagaggtcactaccgcactgacagtagaggcgttaacctgaacagacagtacctgaagcccgacgccgttctgcaccctgcaatctacggtgccaaggctgtgctgttgtaccatcatgtgcattcccggctcaattcccagagtagcagcgagcaccagccttcatcttgtttgcctcccgacgcccccgtgagtgatctggagaaggccaacaatctgcagaatgaggcgcagtgtggccacagtgccgaccgacacaatgccgaagcctggaagcagacggagccggctgaacaaaaactgaactcagtgtggataatgccacagcagtctgcgggtctggaggagtccgccccagacaccatcccccccaaagagagcggtgtggcttactacgtggacctgcatggacatgcatccaaacggggatgcttcatgtacgggaactccttcagcgacgaatccacacaagttgaaaacatgttgtacccaaagctcatctccctgaactctgcccacttcgacttccaagggtgcaactttagcgagaagaatatgtatgctcgcgacaggcgcgatggacagagtaaagagggatcaggtcgggtggctatttacaaggcttcaggtatcatccactcttatacacttgaatgcaattataacacagggagaagcgtgaacagtattcccgccgcttgccatgacaatggaagagcttcacccccacccccacccgcctttcctagtagatacacagtggagctattcgagcaggtcggacgggccatggccatagccgcactggatatggcggagtgtaacccttggcctagaatcgtgctctcagaacactcatcactgacaaatctccgagcttggatgttgaagcatgtacggaactctcggggcttgtcctctacactcaatgtgggcgtaaataagaagcggggcctacgaaccccccccaaaagccataacggcttaccagtgagctgctcagagaatactttgagcagagcaagatcattcagcactggaacgtccgccggagggtccagttcaagccagcagaacagtccacagatgaagaatagcccttccttccctttccatgggagtcgtcccgcagggctgcccggtctgggctcctcgacccagaaggtgacgcacagggttctgggaccagtgagggggaaacccgtctgggagccgcttcagcacgtgtttggctgcctgggtcattgctggggaaagtag

SEQ ID NO: 23519 - DNA, 678 bp, Artificial Sequence
  Description of Artificial Sequence: Synthetic coding sequence
atggtgatggccgagggcaccgccgtgctgcggcggaaccggcccggcaccaaggcccaggacttttataactggcctgatgaaagctttgatgagatggactctacccttgcagtgcaacagtacatccagcagaacattagggcagattgcagcaacatcgataaaattctggaaccgcccgagggacaggacgagggggtctggaagtacgagcatttaaggcaattttgtctagaacttaacggtctagcggtaaagctgcagagcgaatgtcatcctgacacatgcacacagatgacagccaccgagcaatggatcttcttatgcgctgctcacaagacacccaaggaatgtcctgccatcgattacacccggcatactctggacggtgctgcctgtttgctgaactctaacaaatacttcccatccagggtgagcatcaaagaatctagtgtagcaaagcttggctccgtctgccgtaggatatacaggatttttagccacgcttattttcatcaccggcagattttcgacgagtacgagaatgagacgtttctctgccaccgcttcaccaagttcgtcatgaagtacaacctcatgtccaaggataatctcatcgtgccgatcctggaagaagaggtacagaatagcgtgtcaggggaaagtgaggcctag

SEQ ID NO: 23520 - DNA, 1173 bp, Artificial Sequence
  Description of Artificial Sequence: Synthetic coding sequence
atggccgcccagaaggacctgtgggacgccatcgtgatcggcgccggcattcagggatgcttcaccgcctaccacctggctaagcacaggaagcgcatcctgctcctggagcaattcttcctcccccactctcggggttcatctcacgggcagtcgagaatcattaggaaggcctacctagaggacttctacactaggatgatgcacgagtgttatcagatctgggcacagctggagcacgaagccgggacccaactccacaggcagactgggctcctcttactgggcatgaaagagaatcaggagttgaaaactatccaggccaatctgtcacgtcagagggtggagcaccagtgtctctcctccgaagaattgaaacagcgctttcctaatatcagactgcctcgcggagaagttgggctgctagacaattccggtggggtgatatacgcttacaaggcccttcgtgccctgcaggatgccattagacagttgggcggaatagtccgggacggggaaaaggtggtggagattaatcccggccttctcgtgacagtgaagaccacatcccgctcctaccaagccaagtccctcgtcattaccgccggcccgtggactaaccagctgctgagacctctggggattgagatgcccttacagacactgcggattaacgtatgctactggagggaaatggtcccaggttcttacggggtgagtcaggctttcccttgttttctgtggctcgggctgtgcccccatcacatttatgggctccccaccggggagtacccaggactcatgaaggtgtcataccaccatggtaatcacgccgatccggaagagagagactgccccaccgcacgcacggatattggagatgtccagatcctaagttcctttgtgagagaccatctcccggatcttaagccagagcccgccgtgatcgagtcctgcatgtatacgaacacccccgatgagcagtttatcctagatcgccaccccaagtacgacaacatcgtgattggcgccgggttctctggccacggtttcaaactcgcacccgttgtaggcaagatcctgtatgaactgagtatgaagctgacccctagctatgatctggcaccattccgaatctctcggtttccatctctcggaaaggcccatctttag

SEQ ID NO: 23521 - DNA, 135 bp, Artificial Sequence
  Description of Artificial Sequence: Synthetic coding sequence
atgagcgacaagcccgacatggccgagatcgagaagttcgacaagagcaaactaaagaaaacggagatgcaggagaagaatccactgcctagcaaggagacaatagaacaggagaagcaggctagcgagagctag

SEQ ID NO: 23522 - DNA, 1323 bp, Artificial Sequence
  Description of Artificial Sequence: Synthetic coding sequence
atgcccatcccccccccccccccccccccccccggccccccccccccacctactttccatcaggctaatacagagcagcctaaactttcccgggacgagcagaggggacgtggagccctcctacaggatatatgtaaggggaccaagctgaagaaagtaacgaatattaatgataggtcagcaccaatcctagaaaaacccaaggggtcaagcggcggctatggtagcggtggagcagccctacagccaaaaggagggctgttccaaggtggggtgcttaaacttagaccggtcggggccaaagatggcagcgagaacctggccggaaaacccgctctgcagatcccctccagcagggctgctgcacccagaccgcccgtgagcgccgcaagcgggcgcccccaggatgataccgactcctccagagcatccctccccgaactccctcggatgcaacggccatccctacccgacctgtcacgaccaaataccacaagctccaccggcatgaagcattcctcaagcgctcctccacccccccctcctgggcgtagggccaacgctccaccgacacccttgcccatgcacagttccaaggcacccgcctacaatagggaaaagccccttccccccactccgggtcagagacttcatcccgggcgcgagggcccacctgcaccaccaccggtcaaaccccccccctcacccgtcaatatccgtacaggcccttctggacaatcacttgcccccccccccccaccatatcggcagcccccgggcgtgccaaacggcccttcctcccccacaaacgaaagcgccccagagctgccacagcgtcacaactcgctgcatcggaaaacccctggacccgtacgtggtcttgcacccccccctccaacatcagcatcacctagtctgctgagtaacaggcctcccccccccgctagggacccgccttcccggggggcagccccccctcctccacccccggtcatccggaacggcgcaagagacgcaccccctcctccacctccttaccgcatgcatgggtcagaacccccttcccgcggcaaacctcctccacctccgagccggacaccagcggggcccccgcccccacctcctccgcctctcaggaacggccacagggacagtatcaccacagtcagatcttttcttgacgattttgaaagcaaatattctttccatcctgtggaggacttccccgcccctgaagagtataagcacttccagcggatttaccctagcaagactaaccgggctgcacgcggtgcccctcccctgcctccgatcctgcgctag

SEQ ID NO: 23523 - DNA, 2703 bp, Artificial Sequence
  Description of Artificial Sequence: Synthetic coding sequence
atgaactaccccggccggggcagcccccggagccccgagcacaacgggaggggaggcggagggggggcatgggagctgggatccgacgctcgcccggccttcgggggcggggtgtgttgctttgagcatctaccaggcggcgaccctgacgacggggatgtgccacttgccctcttgaggggagaacccgggttgcatctggcacctggcactgatgaccacaatcatcacctggcactagacccatgtctctcagatgagaattacgacttttcaagcgccgagagtgggagcagtctgcgctattactcagaaggcgaatctggaggaggcgggtcctcattgtcattacatccaccacagcaaccccccctagttccaaccaatagtggaggaggaggcgctacaggaggaagccccggtgaacgtaaacgcacacgcctgggcggtcctgccgctcgacatcgctacgaagtggtcactgagttgggccccgaagaggtgaggtggttctataaggaggacaaaaagacatggaaacctttcatcggctacgactccctgagaatcgagcttgcatttagaactcttctccaaaccaccggcgcgcgcccacagggcggcgaccgcgatggcgaccacgtttgcagtccgacgggaccagcctcctcaagcggggaagatgatgatgaagatcgggcctgtgggttttgtcagtctacaactggacatgaaccggagatggtcgagttggtgaatatagagcctgtctgtgtgcggggcgggctgtatgaagttgatgtgactcaaggcgaatgttacccagtgtattggaaccaagctgacaaaataccggtaatgagaggccagtggtttatcgatggaacttggcagcctctcgaggaagaggaaagcaacctgatcgagcaagagcatctaaactgcttcagaggacaacagatgcaggaaaacttcgacatcgaggtgagtaaatccattgatgggaaggatgcagtgcacagctttaaattgagcaggaatcacgtcgattggcacagcgtggatgaggtctacctgtacagtgacgccaccacctctaaaattgctcgtactgtgactcagaaactaggatttagcaaggcatcctccagtggtaccagactgcaccgggggtacgtggaagaggccaccctagaggataaaccttcgcaaacaactcatatagtatttgtggttcacggaatcggacagaagatggatcagggccgaattattaagaacacagcaatgatgagggaggccgcccggaagattgaagaacgacatttcagtaaccatgccacacacgttgagttcctgccagtcgaatggcgctccaaactcactctggacggtgatactgtggatagtattaccccagataaagtacggggtctcagggacatgctgaactcttcagcaatggatattatgtactacactagtcctctgtaccgcgatgaactagtcaaaggactgcagcaagagctaaataggctgtactctctgttttgcagcaggaaccctgactttgaagaaaaaggtggaaaggtgagcattgtaagtcatagtttagggtgtgtaattacatatgatatcatgaccgggtggaatccagttagactttacgaacagttgcttcaaaaggaagaggaactgcctgatgagagatggatgtcgtacgaagagaggcatctgctggatgagctgtacattacaaaacgccgcctaaaggaaatcgaagaaagactgcacggcctcaaggccagctcaatgactcaaacacctgctctcaaatttaaggttgagaactttttctgtatgggctctcctttggccgtattcctggccctgagaggcattcgccccgggaacacgggttcacaggaccacatccttcctcgagaaatctgtaataggctgttgaatatatttcaccccacggaccctgtggcttacaggctggaacccctgatccttaagcactacagcaacatctcaccagttcagatccattggtataacacctccaaccccctgccatacgaacatatgaagccctctttcctgaacccagctaaagaaccaacctcagttagtgagaacgaaggtatttctacgattccatcacccgttacatcaccagtcttgtcacggcgccactacggcgagtcaataaccaacatcggcaaagctagcatccttggcgcagcctccatcggcaaggggctcggaggaatgctgttctcgaggtttggaaggtccagcacgacacagtcatccgaaacatccaaagattccatggaagacgaaaagaaacccgtggcaagtccttccgcgacaacagttggtacccaaacactgccacacagctcatctggctttctggactccgcctacttcaggctgcaggagtcattctttaacttaccgcagctcttgtttccagaaaatgtcatgcaaaacaaagacaatgcccttgttgagttggatcacaggatcgatttcgaactgcgtgagggtttggtggagtcgagatattggtcagccgtgacttcacataccgcttactggtcctcattggatgtggctctctttttacttacgttcatgtacaaacacgagcatgatgacgacgctaaacccaacctcgatccaatctag

SEQ ID NO: 23524 - DNA, 1278 bp, Artificial Sequence
  Description of Artificial Sequence: Synthetic coding sequence
atgaacaagatgcccgccggcgagcaggagtgcgagtacaacaaggaaggtaaatactacagcaagggtgtaaaactggttagaaagaaaaagaagatcccaggctaccggtggggcgacattaaaatcaacattatcggtgagaaagatgacctccctatccacttttgtgacaagtgtgacctccctattaagatctacggccgtataatcccatgtaagcatgcattctgctatcattgcgccaacctttatgataaggtcgggtataaagtatgcccaagatgtagatatcccgtcttgcgaatcgaagcccacaaaagagggagcgtgtttatgtgttccatagtgcagcaatgcaagaggacttacctgagtcaaaagagcttgcaggcccacattaagcggaggcataaacgtgccagaaagcaggttacgagcgcctccctggagaaagtgcgcccccatattgcaccccctcagacggagatttccgacattccgaagaggcttcaggatagggatcacctctcctatatcccaccagagcagcacaccatggtctcgttgccctccgtccagcacatgttacaggaacagcataatcagcctcacaaagatatccaggcaccaccaccagaactgtccctgagtctcccgttcccaattcagtgggaaactgtaagtatcttcacaagaaaacacggcaatttaacagtggatcacattcagaacaattccgactcaggcgcaaaaaaaccaacaccacctgattattatccagagtgtcagtcccagccagctgtctctagccctcaccatataatcccacagaaacaacactatgctccacccccctcgccttcctcccctgtgaaccatcagatgccctatccaccccaggacgtagttacaccgaactctgttagatcacaggttccagccctgacgaccacctacgatcccagcagcgggtatatcatcgttaaagtgccccctgacatgaactcgccgcccctgcgtgccccgcagtcacaaaacggaaatcccagtgccagtgagttcgcaagtcaccactacaacctgaatatactgccacagtttactgaaaatcaggaaaccctttctccgcagttcacccaaactgatgccatggaccatcgccgttggccagcatggaagcggctctcaccctgcccacccaccagaagcccaccaccttctacactacatgggagatctcaccatagccaccagaggagacacaggcgctactag

SEQ ID NO: 23525 - DNA, 1926 bp, Artificial Sequence
  Description of Artificial Sequence: Synthetic coding sequence
atgggcccccccctgaagctgttcaagaaccagaagtaccaggagcttaaacaggaatgtattaaggattctcgactgttttgtgatcctaccttcttgcccgagaacgatagcctattttataatcgattactccccgggaaagtggtttggaagaggccacaggatatttgtgacgacccacatttaatcgtcggaaatatcagcaaccaccaacttacccaaggcagattagggcataagcctatggttagcgctttcagctgtctcgccgttcaggagtctcactggacaaaaaccatccctaatcataaggaacaagaatgggatccccagaagacagaaaaatacgccggtatattccacttcagattctggcacttcggcgagtggacagaagtggtcatcgatgatctcctgcccacaataaatggagacttagtttttagttttagtacctccatgaatgaattctggaacgcactgttagagaaggcttacgctaagctgcttgggtgttacgaggcattagacgggttaacgattactgatattattgtggactttacaggcactttggcggagacagttgatatgcagaagggacgctacaccgaactggttgaagaaaaatataagttatttggcgagctgtacaagacatttaccaaaggagggctgatttgctgttccattgaatccccgaaccaggaggaacaagaagttgagactgactggggcctgctcaaaggtcacacgtacactatgacagacatacgcaaaatccggttgggagagcgattagtcgaggtattcagcgccgagaaggtttacatggtgcgcctgaggaaccccctaggtaggcaggaatggtccggaccttggagcgaaataagcgaagaatggcagcagcttaccgcttctgatagaaagaatctgggtttggtaatgtctgacgatggtgaattctggatgagtctagaagacttctgtcggaacttccataaactgaacgtctgcagaaatgtcaacaaccccatcttcggccggaaggagctcgaatctgtcctgggttgctggaccgttgacgacgaccctctgatgaatagaagtgggggctgttataacaatcgcgacacctttctgcagaatccacagtacatattcaccgtgcccgaggatggccacaaggtcatcatgagtttgcagcaaaaggatctgaggacataccgtcggatggggcgtccagacaattacattatcggattcgagctattcaaggttgagatgaatcgtaaatttcgtcttcaccatctgtatattcaggagcgcgcagggacatcgacctacattgatacccgcaccgtgtttcttagcaaatacctgaaaaaggggaattacgtcctggttccaaccatgtttcagcatggacgcacgtctgaattcttacttagaatcttctcagaagtgcctgtgcaacttcgggaactgaccctagatatgccaaagatgtcttgctggaatctagccagaggataccccaaggtcgtgactcagatcacagttcactcagcagaggatctcgagaaaaagtatgccaacgagaccgtgaacccctacctggttataaaatgtgggaaggaagaggtgcgttcgccagtgcaaaagaataccgtgcatgcgatctttgatacccaggcgatcttttatcgaaggacgacagatattcctatcatcgtgcaagtctggaacagccgtaaattttgtgaccaattccttgggcaggttacccttgacgctgatccttcggactgccgggatctgaagtctctgtatctgcgaaaaaaagggggccctacagctaaagtgaaacagggacacataagtttcaaagttatcagttcagatgatctgacagaactgtag

SEQ ID NO: 23526 - DNA, 3180 bp, Artificial Sequence
  Description of Artificial Sequence: Synthetic coding sequence
atggccgccgtggccggcagcggcgccgccgccgcccccagcagcctcttgctcgtggtcggatccgagtttggatctcccggactcctcacctacgtgctggaagaactggagagagggattagatcctgggatgtcgaccccggtgtgtgcaatttagacgagcagctgaaggtgttcgtgagtaggcatagcgccactttttcttctatcgtgaaggggcagcggagcctgcaccaccgcggcgataacctcgagacacttgtgcttctgaacccaagtgataagtcactttatgacgagctgaggaatttattattggacccagcgtctcacaagctccttgtgttagccggaccttgcctggaagaaactggggaactgctgcttcagaccggggggttttcacctcaccacttcctgcaggtcctgaaggatagggagattcgcgacatcttggcaaccacacctcctcccgtccaacccccaattctgaccatcacgtgcccaaccttcggcgactgggcccagctagctcccgctgtgccaggcctccagggggctttaaggttgcagttgcgtctgaaccccccggcccagcttcccaatagcgaaggactgtgcgagttcctcgagtacgttgctgaatccctggagccgccttcacctttcgaactactggaaccgccaacaagcggaggattcctgcggctgggtagaccatgctgctatatatttcctggaggtctcggtgacgcggcctttttcgccgtgaatgggtttaccgtcctggttaacggcggctctaatccaaaatcctctttctggaagttagtgcgccacctggatcgggtggatgccgtattagtaacacacccaggcgccgattccctcccaggcctcaattctctgttgcggaggaaattggctgagcggtcagaggtggccgccggaggaggctcctgggacgaccgactgagaaggctgataagccctaacttaggggtcgtcttttttaatgcctgtgaagcagcctctaggttggcgaggggggaagacgaggccgagttagccctgtccctactggcacagctcggcatcacgcccctgccactgagccgcggccccgttccggctaaacccactgtcctctttgaaaagatgggggtggggcggcttgacatgtatgtgctgcacccgccgtctgctggcgcagagagaaccctggcttctgtgtgcgctctgctagtgtggcatccagctgggccaggcgaaaaggtcgtgagggtgctcttccccggttgcactccacccgcttgtctcctggacggcctcgttcgtctacagcatctgaggtttttgagagaacccgtggtgacaccgcaggacctagagggcccaggccgcgccgaaagcaaagagtctgttgggtctagagattccagtaagagagaggggctgctcgccacccaccccaggcccggccaagaaagaccaggggtggcgaggaaagagccagctagggctgaggccccacgaaaaacagagaaggaggccaagacaccccgagagctgaagaaagatcccaaaccctccgtgtctagaacccaacctagagaggtgcgccgggccgcttctagcgtgccaaacctcaagaagaccaacgctcaggcggctccgaagccgcgaaaggccccatctacttctcactcaggcttcccgcccgtggccaacggtcctaggtcacccccctccctccgatgcggtgaagcctcccccccctctgccgcgtgcggatcaccagcttctcagctggtggcaactccttcactggagctgggaccaattccagcaggcgaagagaaagctctggagctgcccttagcagcttcgagtatccccaggccgcgaactccctcccctgaatcacaccgttctccagccgaagggtccgagcggctcagcctctccccacttcgaggaggggaagcggggcctgacgcaagtcctactgtgaccacccctaccgtgacaaccccaagcctgcccgccgaggtcgggtcccctcatagtaccgaggtcgacgagagtctgtctgtgagtttcgaacaagtcctgccacccagcgctccaacctctgaggccgggctgagcttgcccctcagaggcccgagggcgcgaagatccgccagtccccatgatgtggacctttgcttggtaagcccgtgtgagttcgaacaccgaaaagccgtgcctatggcccctgccccagcctcccccggttccagtaacgattccagcgctagaagtcaagagagggccggcggattgggggcagaggagactcctcccacaagcgtgagcgagtctctgccaacactgtccgattcagaccccgtcccactcgcccctggtgcggccgatagtgatgaagacaccgagggctttggagttcctagacatgacccgctacccgacccactaaaggttccacctccactccccgacccgagctccatttgtatggtggatccagaaatgctgccacctaagacagcccggcagactgagaatgtgtcgcggacccgcaaaccccttgcccgaccaaacagccgagctgccgccccaaaggcaaccccggttgcggcggccaaaactaagggcttagccggtggggacagggcaagtagacccctctccgctagaagcgaaccctctgagaaaggggggcgggcaccactctcccgtaagagcagtacacctaagacagcgactaggggaccatctggttcagcttcttccaggcctggagtgtcagccactccaccaaagagccctgtgtacctggatcttgcctaccttccatctggcagcagcgcacaccttgtcgatgaggaatttttccagcgggtcagggcgctgtgctacgtcatttcaggacaggatcagaggaaagaagagggcatgagagccgttctcgacgccttactggccagtaaacagcattgggacagagacctgcaggtgaccctgattccaactttcgactccgtcgccatgcacacttggtacgccgagacccatgccaggcaccaggctctaggaatcactgtgctggggtcgaacagtatggtgtcgatgcaggatgatgcattcccggcatgtaaagtcgagttctag

SEQ ID NO: 23527 - DNA, 4734 bp, Artificial Sequence
  Description of Artificial Sequence: Synthetic coding sequence
atggaggccggcagcgtggtgcgggccatcttcgacttctgccccagtgtctctgaggaactgcctttgtttgtgggtgacatcattgaagtcctcgcagtggtggatgagttttggttgctgggaaagaaggaggacgtgaccggtcagttccccagttcgtttgttgagattgtcacaattcctagcttaaaggagggcgagcggctctttgtctgcatttgcgagttcacatcacaggagctggacaacctgcctcttcataggggtgacctcgttatattagacggcataccgaccgccggatggttgcaaggtaggtcttgttggggcgccaggggattctttccctccagttgtgtccgggaactgtgcctaagctcccagagcaggcagtggcattcacaatcagcactgttccaaatcccggagtactccatgggacaggccagagctctgatggggttaagtgcacagctggacgaggagctcgatttccgagagggagacgtgatcacaatcatcggagtccccgaacccggatggttcgagggagaactagaagggcgccgggggatctttcctgagggcttcgttgagctgttaggaccactgagaactgtggatgagtctgttagttccggcaatcaagacgactgcatcgttaatggggaggtagacacaccggtgggcgaggaagagatcgggccagacgaggacgaggaagaacccggaacctatggggtggccctgtaccgcttccaggcgctcgaacctaatgaactcgactttgaagtgggggataaaatccgcatactggcaactctcgaagacggatggctcgaggggagcctgaaaggcaggaccggtatattcccatacagatttgtgaaactgtgccccgatacgagagttgaggagactatggccctcccacaggagggaagcctcgcacggatcccggagaccagcctcgattgcttagagaacacactgggcgtagaggagcaaaggcatgagacttccgaccacgaagctgaagagccagattgtatcatcagcgaggcaccaacctctcctctgggccaccttactagcgagtatgacaccgataggaactcctatcaggatgaagataccgctgggggccccccacgttccccaggggtggaatgggaaatgcctctcgccactgatagtccaacctctgaccctacagaagtggtaaacggcatttcctctcagccccaggtgccgtttcatccaaatttgcagaaaagtcaatactattctacagtgggaggctctcacccgcactccgaacagtaccccgatctgctgcctttggaagcgagaaccagagactacgccagccttccaccaaagcgaatgtacagccaactcaagaccctacagaaacctgtcttgcccctttataggggttcgtccgtttctgcaagccgcgtagttaaacctaggcaaagctccccacagcttcataacttggctagctacaccaaaaagcaccacacaagcagcgtctatagtatttcggagcggcttgagatgaaacctggcccccaggcgcagggcctcgtcatggaagccgccacacactcacagggggatggatccacggatctggattccaaactgacacagcagctgattgagttcgagaaaagcctggcggggccagggacggagcctgacaaaatcctgcgtcacttttctattatggacttcaactccgagaaagatattgttcggggatcatctaagttgatcaccgagcaggaactcccggagcggcgtaaggccttgcgccctccaccccccaggccttgtactcctgtcagcacatcaccacatctgttggtggaccagaacttaaagccggctcccccgctggtggtcagaccatcccggcccgcgcccctgccaccatccgcacagcagagaacaaatgcagtgtcacctaagttgctctccaggcaccggccaacgtgcgagacactcgaaaaagaaggacctgggcatatgggcaggtcgcttgatcagacgtcaccatgcccacttgtcctagtgaggatagaggaaatggaaagggatctcgatatgtacagtagggcccaagaggagctcaacctcatgctagaagaaaaacaggatgaatcctcccgtgcagaaactcttgaagatctaaagttttgtgagtccaatattgaatccctcaatatggagctgcagcaattgagggaaatgacacttctgagctcacagtcaagctccctggtggccccttccggctctgtcagtgcggaaaaccctgaacagcgcatgttggagaagcgggcaaaggtcatcgaagagcttctgcagaccgagagagactatattcgggacctggagatgtgcattgagcgcattatggtccctatgcaacaggctcaggttccaaacatagattttgagggcctattcggcaacatgcaaatggtgattaaggtttctaagcagcttctggctgccctggaaatcagcgatgctgttggtcctgtgtttctgggacaccgagacgagttggaagggacctataaaatttactgtcaaaatcacgacgaggccatagccctgctggaaatttacgagaaggatgaaaagattcaaaaacacctccaggattcattggctgaccttaagtctctgtacaacgagtggggatgtacaaactatatcaacttaggtagcttcctcatcaaacccgtacagagagtcatgcgctatcctctgctgctgatggagctcctaaactctacccctgagtcccaccccgacaaggtccctttgaccaatgccgtactggcggtgaaggagataaatgtaaatataaacgaatataaacgccggaaggacctggttttaaagtatagaaaaggagatgaggattcactcatggaaaagatcagcaagttgaacatccattccattatcaaaaaatcaaatagggtgagctcacatctgaaacacctcaccggcttcgctccccaaatcaaggacgaggtgttcgaggagacagagaaaaactttaggatgcaggaacgactgataaaatctttcatccgggacctgtccctttatctgcagcatatccgagagtccgcctgtgtgaaagtggtggcagctgttagcatgtgggatgtgtgtatggagcgagggcatcgggatttggagcagttcgagagagtgcatcgatatatctctgatcagctttttactaacttcaaagaacgtaccgaaagacttgtgatcagccctttgaatcagctgctgagcatgtttactggacctcataaacttgttcaaaagcgcttcgacaagctccttgatttttataattgtacagagcgtgcagaaaaacttaaagacaagaaaacccttgaggaacttcaatccgcccgaaacaactatgaggcccttaacgctcagctgcttgatgaactgccaaaatttcaccagtacgcccaagggctttttacaaactgtgtccatgggtacgccgaggcccattgcgatttcgtccaccaggctctggagcagctgaagcccctcctctctctgctcaaggttgcggggagggaaggaaaccttatcgcaatctttcatgaggagcactctcgtgtgctccagcagctgcaagtgtttaccttctttccagagagcctacccgccacaaaaaaacctttcgaacgcaaaacgatcgataggcaatctgcacggaaaccactgctgggtttgcctagttacatgctgcagtccgaggagcttagggcctctctgctggcgaggtatccccccgaaaagctgttccaagcagaacgtaattttaacgctgcccaggacctcgatgtgtcgcttctggaaggtgaccttgttggcgtcatcaaaaagaaagacccgatgggttctcagaacaggtggttaatcgataatggcgtgaccaaaggcttcgtgtattcctcattccttaaaccatacaacccaaggcggagccatagtgacgcctccgtgggaagtcactcatctaccgaaagtgagcacggttcaagttctccccggttccctagacagaattcaggtagcaccctcacgtttaatccatcgtctatggctgtctcctttacttcaggaagctgccagaaacagccgcaagatgcgagcccacctccaaaggaatgcgatcaaggcacgttaagtgcttcactcaatccttctaatagcgagtcaagccctagccggtgccccagcgacccagattccacctcacagccacggagcggcgactccgccgacgttgcaagagacgtgaaacagccaacggcgaccccccggtcttacaggaactttagacatcccgagattgtggggtactctgtgcccggacgaaacgggcagtcacaagacctggtgaagggatgcgcccgcaccgcccaggcacccgaggaccggtctaccgagccagacggttctgaagccgagggcaaccaggtttattttgccgtgtatacgttcaaggcaaggaaccctaacgaactgtcagtatctgccaaccagaaactaaaaatcctggaattcaaagatgtgacagggaacactgagtggtggttggccgaggtgaacggtaaaaaggggtatgtgcctagcaattacattcggaagactgagtatacgtag

SEQ ID NO: 23528 - DNA, 3186 bp, Artificial Sequence
  Description of Artificial Sequence: Synthetic coding sequence
atgctgcggaccgccggccgggacggcctgtgccggctgagcacctatctcgaggagctcgaggccgtggaactaaaaaagtttaagctatacctcggtacagccactgagttgggagaagggaagatcccttgggggagtatggagaaagccggcccactggaaatggcgcaactcctcattacccatttcgggccggaggaggcttggagactggcattatcaacattcgagagaatcaatcggaaggatctttgggaaagagggcagagagaggacctcgtacgggacaccccccccggtgggccctcttctttagggaaccagagcacctgcctccttgaggtttcgcttgtgactccaaggaaggacccacaagagacataccgagactacgtgcgcagaaagttccgactaatggaggaccggaacgctcggcttggagagtgcgttaacttaagccaccgctatactcggctgcttttagtgaaagagcactcaaatcctatgcaggtccaacaacagcttctggataccggaagggggcacgctaggactgtcggtcatcaggcgtctccaatcaagattgaaaccctctttgaaccggacgaggaaagacctgaaccacctcggactgtcgtgatgcagggggccgccggaatagggaagtctatgctggcccataaggtgatgcttgattgggcagatgggaaactgttccagggaaggttcgattatttgttttacatcaactgtcgcgaaatgaatcagtccgccacggaatgctccatgcaagatctcatcttttcttgttggcctgagcctagtgctccgttgcaagagttaatccgcgttcctgagcgcttgttgttcatcattgatggcttcgatgagttgaagccgagtttccatgacccgcaaggtccttggtgtctgtgctgggaggaaaagcgacctacagagttgcttctgaattcactgatacggaaaaagctccttcccgagctctccctactcattactacgcggcctaccgcgctggaaaaactgcataggctgctggagcaccctaggcatgtggagatacttggattttcagaggcagagcgtaaagagtacttttacaaatacttccataacgctgaacaggccggtcaggtttttaattacgtccgcgataatgaacctctgttcacaatgtgtttcgtaccattggtgtgctgggtggtatgtacatgccttcaacaacagctcgaaggaggaggcctactgaggcagaccagccggacaactacagcagtgtacatgctgtacttactctctctcatgcagccaaagccaggagcgcccaggttacagcctcctccaaaccaacgcggtctctgctccctcgccgcggacggtctctggaaccagaagatcctttttgaagagcaagacctgaggaaacacggattagacggcgaggatgtatccgctttcctaaacatgaacatttttcaaaaagatatcaactgcgagaggtactacagcttcattcatctctctttccaagagttctttgcagcaatgtattacattttggacgagggggaagggggtgcaggtcctgatcaggatgtcactcgccttttgactgaatacgcgttcagtgagagatctttccttgccctcacaagtcggttcctcttcggcctcttgaacgaggagaccagaagtcacctagagaagtctctgtgttggaaggtgtccccgcatattaagatggacttgttacagtggatccagtccaaggctcagtctgacggaagcactctgcagcaaggtagcttagaattctttagttgtctctacgaaattcaagaggaggagtttatccagcaagctctgtctcattttcaggtcatcgtcgttagtaacatcgcttcaaaaatggaacacatggtttctagcttctgcctcaagcgttgccgatcggctcaggtgctccacttatatggtgcaacctatagcgccgacggggaagatagggcaaggtgttctgcaggcgcccatacattgcttgtacagttgccagaacggaccgtgttactggacgcatactcagagcacctggccgcggccctgtgtactaaccccaaccttattgagctgagcctgtacagaaacgccttgggcagcaggggtgtgaagctactgtgtcaagggctccgtcaccctaattgtaagctgcagaatctccgcttgaagcgctgccgcatctcttctagcgcctgcgaggacctgtccgctgccctgattgctaataaaaacctgactagaatggacttatcaggtaacggcgttggcttcccaggaatgatgctactgtgtgagggcttacgccatcctcagtgtaggcttcagatgatccaacttcgaaagtgccaactcgaaagtggcgcatgtcaggagatggcttccgtgttgggaactaaccctcatctcgtggagttggaccttactgggaatgctctggaggatctcggcttaagattgttgtgccagggtctgcgccacccagtatgccggctgcgaaccttgtggctcaagatctgccgcctcaccgccgccgcctgtgacgaacttgcttccacgctttctgttaaccaaagcctcagggagttggacctaagcctcaacgagctgggtgacctaggggtcttgcttctgtgtgagggactgaggcaccccacctgtaaacttcaaactctgaggctggggatctgccggctcgggtccgctgcctgcgagggacttagtgtggtactgcaggctaaccacaacctgagagagctcgatctaagtttcaacgacctcggcgactggggattgtggctactggccgaggggctgcagcatcctgcctgcaggcttcagaagctctggctggattcctgtggcctgactgctaaggcttgtgagaatctctatttcaccctgggaattaatcaaaccctgacggatttgtatctcaccaataacgcattgggggacacgggcgtccggttgctatgcaagcgactgtctcatcccggctgcaaattgcgtgttctgtggctcttcggcatggatctcaataagatgacgcattctcggttggcggcactcagggttaccaagccatacctagacattggctgctag

SEQ ID NO: 23529 - DNA, 3963 bp, Artificial Sequence
  Description of Artificial Sequence: Synthetic coding sequence
atggccaacgacagccccgccaagagcctggtggacatcgacctgtcatcactgcgcgacccggcaggcatcttcgagttggtcgaggtggtcggaaatggtacgtacggtcaggtgtacaaaggccgccacgttaaaactggccagctggccgccattaaggtgatggatgtgaccgaagacgaggaggaagagattaaattagagattaacatgttgaagaagtactcccaccataggaacattgccacatattatggcgcattcattaagaagtcaccgcccggacatgatgatcagctttggctggttatggaattctgtggggcagggtccataactgatctcgtcaagaatacaaaggggaatacccttaaagaagactggattgcttacatctcaagagagatcctgcgagggctggcacacctgcacatccatcacgtgattcacagggacatcaaagggcagaacgtcttgctcactgagaatgcagaggtgaagctcgtcgattttggggtgagcgcacagcttgacagaacggttggacgacggaatacctttataggtacaccatactggatggcccctgaagtcatcgcctgcgatgagaaccctgacgcaacctatgactaccggagtgatctctggagttgcggaattacagctatcgagatggccgaaggggccccaccattgtgtgacatgcatcccatgcgagctctctttctgatcccaagaaacccacccccccgcctgaagagcaagaagtggtcaaaaaagtttttctcttttatcgagggctgcctcgttaaaaactacatgcagcggcctagcaccgagcaacttttgaaacacccatttatcagggatcagcccaacgagaggcaggtcagaatccagctgaaggatcatatcgataggactaggaagaaacggggcgaaaaagatgagactgagtatgaatattctgggtccgaggaggaagaggaggaagttccagagcaggagggagaaccttcaagtattgttaacgttccaggggagtctaccctccgtagggatttcctgcgactgcaacaagagaataaagagcgctccgaggccctcaggcgccagcagctcttgcaggagcagcagctgcgggagcaggaggaatacaaaaggcagctcctcgcagagagacagaaacggatcgagcagcagaaggagcagcgaaggcgactggaggaacagcagagacgagagcgggaggcaaggcggcagcaggagcgcgagcagagacgtagggaacaagaagaaaaacgccgcctcgaggagctcgagaggcggagaaaagaagaggaggagcgaagaagagccgaggaagaaaagaggagagttgagcgcgaacaggagtacattcgccggcagctggaagaagaacagagacacctcgaagtgttgcagcaacagctgctgcaggaacaggctatgctcctcgagtgtagatggcgcgagatggaggagcacagacaggctgaacgcctgcagagacagcttcagcaggaacaggcatacctgctatccctccaacatgatcaccggagaccacatccccaacactcacaacaaccccctcctccccaacaagagcggagcaaaccatccttccacgcccctgaaccaaaagcgcattacgaacctgctgatcgggctagggaagtggaggataggttcaggaaaaccaaccactcctcaccggaagcacagagcaaacagaccgggagggtcctggagccacccgttccctccagaagcgaaagcttcagtaacggcaattccgagagcgtgcatccggccctgcaacgccctgctgaaccccaagtgcaatggagccatctggctagcttgaagaataacgtatctccagtgtctcgtagtcacagcttttctgatccttcaccgaagttcgcacatcatcatctaagaagccaggacccttgcccccccagcagatctgaggtgctctcgcaaagcagcgacagtaagagtgaagcccccgatccaacccagaaggcctggagtcgcagtgactcagatgaggttcctcccagagttcctgttagaacgacctcacgctccccagtgctgagtaggcgagacagcccactgcaaggcagtggtcagcaaaactcccaggccggccagcggaactccaccagctcaatcgagcctagattactgtgggaaagagtggaaaagctcgtccctagaccaggctctggaagttcctcaggatcctcgaattccggaagccagcctggcagccaccctggctcccagtctggcagtggcgaacggttcagagtcagatccagcagcaagtctgagggatcgcctagtcagcggctggagaacgccgtcaagaagccagaagacaaaaaagaagtctttcggcctctgaaacccgccgtgcgaatcgatctgactgcactagccaaggagctgcgcgctgtagaggatgtgcggccaccacacaaggtgacagactactcttcaagtagcgaggaatccggcacaaccgatgaggaggacgatgatgtggagcaggaaggggccgatgagagcactagcggaccagaggacacgagagccgcaagttcccttaacctctccaatggagaaaccgaatctgttaaaactatgattgtgcacgatgacgtcgaatccgagccagccatgactcccagtaaggaggggaccctgattgtgcgtcaaacccagtctgcatccagtacgctgcagaagcacaaaagcagctcttcatttactccattcattgacccccggctgcttcagatctctccttctagcggaacaaccgttacatctgttgtgggtttcagttgcgatgggatgcgaccagaagccatccgccaagacccaacccgtaagggctctgtcgtgaacgtaaatccaaccaatactagaccccagtctgacacccctgagatcagaaagtacaaaaagcgattcaattccgagatcctctgtgccgccctgtggggcgtgaatctgctggtcggcaccgagtcagggctgatgcttctcgacagatccgggcaaggcaaagtataccccctgattaaccggagaaggttccaacagatggatgtgttggaagggctaaacgttctggtcacaatcagcgggaaaaaagataaactgagagtgtactacctgagttggttgaggaataagatcctacacaatgatccggaagtggagaagaaacaaggttggacaactgtcggggacctcgagggatgtgtgcactacaaggtcgtgaaatatgagagaatcaagttccttgtcatagctctcaagtcatctgtggaagtgtatgcttgggcacctaagccctatcataagttcatggcgtttaagtccttcggcgaactggtgcacaagccgcttctggtagatcttaccgtggaagaagggcaacgtctcaaggtgatctatgggagctgcgctggatttcacgccgtggatgtggatagtgggtccgtctacgatatctatctccccactcacattcagtgcagcatcaaacctcacgcaatcatcattctccctaataccgatggtatggagttgctcgtgtgttatgaggacgagggagtgtatgtcaatacgtatggccggattactaaagacgtggtgcttcagtggggagaaatgcccaccagtgtagcatatattcggagtaaccagaccatgggatggggggaaaaggctattgagatacgatcggtggagaccggccacctagatggcgttttcatgcataaacgggctcagaggttaaaatttttgtgcgagcggaacgataaagtgttctttgccagtgtaagaagcggggggtcatcccaggtgtactttatgactctcggccgcacgagcctgctgtcttggtag

SEQ ID NO: 23530 - DNA, 606 bp, Artificial Sequence
  Description of Artificial Sequence: Synthetic coding sequence
atgtacaccctgctgagcggcctgtacaagtacatgttccagaaggatgaatactgtattttgattctgggcctcgataatgcaggaaaaaccacctttttagaacagtccaagaccaggttcaataagaattacaagggaatgagtctgtcgaaaattacaaccaccgtgggtctcaatatcggtactgtagacgtcggaaaagcccgactgatgttctgggatctgggcggtcaggaagaacttcaatcgctgtgggacaagtattacgccgaatgtcatggtgtgatctatgtcatcgatagcacagatgaggagcgattggcagaatctaagcaggccttcgagaaagttgttacttcggaagctctgtgtggagtccccgtgttggttctggcaaataaacaggatgtagaaacctgtctgtccattccagatattaagaccgcatttagtgactgtaccagtaaaatcggacggcgtgactgcctgactcaggcatgcagtgctttgactgggaaaggagtgagggagggtatcgaatggatggtgaaatgcgtagttcgcaacgtgcacaggcctcctcgccaaagggatatcacctag

SEQ ID NO: 23531 - DNA, 1329 bp, Artificial Sequence
  Description of Artificial Sequence: Synthetic coding sequence
atgcggggcgccatggagctggagcccgagctgctgctgcaggaggctcgcgagaatgttgaagccgcccagtcataccgacgcgagctcggacacaggctggaggggctgcgggaagcaaggcggcaaatcaaagaatctgcgtcgcagactagagacgtattgaaacagcatttcaacgatttgaaggggacattgggcaagctgttagatgaaaggctcgttactctgctgcaggaagtagacacaattgaacaggagactattaagcctttggacgattgccagaaattaatagaacatggcgttaacaccgccgaagacctggtccgcgagggcgagattgctatgctggggggtgtgggcgaagagaatgagaagctatggagctttaccaaaaaagcatctcacatccagttagacagtctgcctgaagtgcctcttctggttgatgtcccttgtctgtccgcccagttagacgactccatactaaacattgtgaaggaccatatcttcaagcacggcacagtggcttctcgcccccccgttcaaatcgaggaactcatcgagaaacctggaggaatcatcgtgagatggtgcaaggtggacgacgactttactgctcaggactatcgcttacagttccggaagtgcacctctaatcactttgaagacgtctatgtgggttctgaaacagaattcatagtattacatattgaccctaacgtcgattatcagtttagggtatgcgccagaggcgacggaaggcaggaatggtcaccatggtccgtacctcagatcggccattcaacactcgtgcctcacgaatggaccgcagggtttgaaggctattcactgtcctcaaggaggaacattgccctgcggaatgatagcgaatcatcaggtgtcctgtactctagggcaccaacctatttctgcggtcagactctcacatttcgggtggaaacagtaggccagccggacaggagagattccatcggagtctgcgcagagaagcaggacggttacgattcactccaaagggaccaagccgtgtgcattagcaccaatggcgcagtgtttgtgaacggcaaggagatgaccaaccagctccccgctgtgacaagcggctctaccgtgactttcgatattgaggctgttacactcggaaccaccagtaacaacgaaggtggtcatttcaaattacgggtcaccatctcctctaataaccgggaggtggtgttcgactggttgctcgatcagtcatgcggttccctctattttggatgtagtttcttctaccctgggtggaaggttcttgtgttttag

SEQ ID NO: 23532 - DNA, 1428 bp, Artificial Sequence
  Description of Artificial Sequence: Synthetic coding sequence
atggccgccctgaccaccctgttcaagtacatcgacgagaaccaggacaggtacattaagaagctagccaagtgggtggccatccagagcgtgtccgcttggcccgagaaaagaggagaaattcggagaatgatggaagtggccgctgccgatgttaaacagctcggcgggtcagtggagcttgtcgacatcggtaagcagaagctgcccgatgggtcggagattcccctgccacccattctcttgggtagacttggatctgacccacaaaagaagacagtctgtatctacggacacttggatgttcaacctgccgctttggaggacggttgggattccgagcccttcactctcgttgaaagagacggcaagctatacggccggggttccaccgatgacaaaggacctgtggccgggtggatcaacgccctggaagcataccagaagacaggacaggagatacccgtgaatgtgcgcttttgtctggaagggatggaggaatccggctcagagggtctggacgaactgatctttgcccggaaagatacattttttaaagatgtggattatgtgtgtatcagcgacaactactggctcgggaagaaaaagccctgcatcacatacggcttgcgcggaatatgctacttctttatcgaagtggagtgtagtaacaaagatctgcacagtggagtctacgggggctcagtgcacgaggccatgacagacctaatcctgttaatggggagtctggtggacaagcggggaaacattctcatccctggtattaacgaggctgtggccgctgtaacagaagaagaacacaagctgtatgacgatatcgacttcgatatcgaggagtttgccaaggacgttggcgctcagatcttgctgcacagccacaagaaggacattctcatgcatcgctggaggtatccgtctttgtcgctccacgggattgaaggagcgttctctggctccggcgcaaaaaccgtgatccctagaaaagtggtcgggaagttctcaataagactcgtgccaaacatgaccccagaggtggtcggggagcaggtgaccagctatctcacaaaaaaatttgccgagctgaggtcccccaacgaatttaaagtctacatggggcatgggggtaagccatgggtcagtgatttcagccacccccactatcttgctgggagacgtgccatgaagacggtctttggagtggaacctgacctgacccgcgagggcggctccatccccgtgactctgacttttcaggaagccacagggaagaacgttatgctgttaccagttggctctgctgacgatggtgcccattcccagaacgagaagctgaataggtataattacatcgagggaacaaaaatgctggccgcctacttatacgaggtaagtcagctgaaagactag

SEQ ID NO: 23533 - DNA, 6291 bp, Artificial Sequence
  Description of Artificial Sequence: Synthetic coding sequence
atggccgaggtgaccgtgccccgggtgtacgtggtgttcggcatccactgcattatggcgaaggcatccagcgatgtgcaggtatccggctttcacagaaagatccagcacgtcaagaacgagctgtgccatatgctgtccttggaagaggtagctcccgtgctgcagcagacccttctacaggataacctgctcggaagggtccatttcgaccaattcaaagaggcattgatcctcatcttgtctcggacactgtctaacgaggagcactttcaggagcccgattgtagccttgaagcacaaccaaaatatgtacgaggagggaaacgctacgggagacggagcttgcctgaattccaggaaagcgtcgaggaatttccggaagtgacagtgattgagccgctggacgaggaggctaggccaagccatattcccgccggagactgcagcgaacactggaaaacgcagcgttcggaagagtacgaagcagaaggccaactgaggttctggaatccagatgatctgaacgccagccaaagtgggtctagccctcctcaggactggatcgaagagaagttgcaagaagtatgtgaggatctgggcattaccagagacgggcacctgaatcgaaagaagctggtatcaatatgtgagcagtatgggctgcagaatgttgatggcgagatgctcgaggaggtttttcataacctcgatcctgatggcaccatgtcagttgaggattttttctacgggctgttcaagaacggaaaatcactgacaccctccgcatcaacaccttacaggcagttgaagcggcatctcagcatgcagagctttgacgaatcaggcaggcgtactaccacatcaagcgcaatgacctccacgattggctttagggtcttctcatgtctggacgacggaatgggacacgcatcagtcgagcggatcctcgacacatggcaagaagaaggtatcgagaactcacaggagattctgaaggccctggatttctcgctggatggtaatattaatctgaccgagctgacattggctctcgagaatgagctgttagtgacaaagaattcaatccatcaggctgccctggcctcattcaaagctgaaattaggcatctcctggaacgggtcgaccaggttgtacgggagaaagagaagctaagatcagaccttgacaaagcagaaaaactcaaaagtctgatggccagcgaagtcgacgaccaccacgccgccattgagagaagaaacgaatacaatttgcgcaaactcgatgaggaatacaaggaacggatcgccgctttgaagaatgaactgcgcaaggagagagagcaaattttgcagcaggccgggaaacagcgccttgagctggaacaggaaatagagaaggctaagaccgaggaaaactacattcgcgaccggctggcactctcactcaaggaaaacagtaggcttgagaatgagctcctggaaaatgctgagaagctggcagaatacgagaacctgactaataaactccagcgcaatctcgagaacgtcctcgccgagaagtttggggatctcgatccgagctcagcagaattcttcctgcaggaggaaagacttactcagatgaggaatgagtatgagcgccaatgtcgggtgttgcaagatcaggtggacgaactgcagagcgagctggaggagtaccgagcccagggcagggtcctgagactgcccctgaaaaattcaccttcggaggaagttgaagcgaattccggaggcatagagcccgaacatggcctcggaagcgaagaatgcaaccccctcaacatgtccattgaagcagaactggtcatagaacagatgaaagaacagcaccatagagacatttgttgtctgcgtttagagctcgaggataaggtgaggcattatgagaagcaactcgatgagacggtggtttcatgtaagaaggcccaagagaacatgaagcaaaggcacgaaaatgaaacacacaccttagagaagcaaatttctgacctcaagaacgagatagctgagcttcaaggccaagctgctgtgttgaaagaggcccaccacgaggcaacgtgtcgacacgaggaagagaagaaacagctgcaagttaaactcgaagaggagaagactcatcttcaggaaaagttgcggctccagcacgaaatggagttgaaggccaggttaacccaggcccaggcttctttcgagagggaaagggagggtctacagtcaagcgcatggacagaagagaaggttagggggttgacacaagagctggagcaatttcatcaagaacagctcacaagtctcgtcgagaaacatactctcgaaaaggaggagctgcgcaaagaactgcttgagaaacaccaaagggaattacaggaaggaagggagaaaatggagaccgagtgtaatagaaggacctcccagatagaggcccagttccaatcagattgtcagaaggtgaccgagaggtgtgaatctgcactccagagtctggaaggtaggtatagacaggaactgaaagatctgcaggagcagcagcgagaagagaaaagtcagtgggaattcgagaaagatgagctcacgcaggagtgcgccgaggcacaagagttacttaaagaaacactgaaaagagagaagacaaccagcctagtcctgacacaggagagagagatgttagaaaagacctataaggagcaccttaattctatggtggtggaacgtcaacagctgctgcaggacctggaggacctgcggaacgtgtccgagactcagcagtcacttctgagtgatcagatcctcgaactgaaatcaagccacaaacgagaactacgagaacgggaggaggtgctgtgtcaggctggtgcctcagagcagctggcaagccagcgattagaaagacttgaaatggagcatgaccaagagagacaagagatgatgtctaaactcttagccatggagaacatccataaggcgacctgcgaaacagcagaccgcgaacgcgcagagatgtccactgaaatctctcgattacaatcgaagattaaagagatgcaacaagcaacctccccattgtcgatgcttcagagcgggtgccaggtgattggagaagaggaagttgagggcgatggggctctctctcttcttcagcagggcgagcaattgctcgaagaaaacggagacgtcctgttgagtctgcagagggctcatgagcaggccgtgaaagaaaacgtgaagatggctaccgagatttccagactgcaacaaaggcttcagaaattggagcctggtctagtaatgagcagctgcctggacgaaccagcaaccgaattcttcgggaacactgcagaacagactgaacaattcctacagcagaacagaaccaagcaagtagagggtgtgacacgcagacatgtgctgtcagacttagaggacgacgaggtaagagacctggggtccacaggcacttccagcgtccaaaggcaggaagtcaagatcgaggaaagtgaggcttcagtcgagggcttctccgaattggagaattctgaagagacccgcaccgaaagttgggaattgaaaaaccagatctcccagctccaggaacagctcatgatgctgtgtgccgattgcgatcgagcctctgaaaagaagcaggaccttttattcgacgtctctgtcctaaaaaagaaattgaagatgctcgagcgcattccggaggcttctccgaaatacaaattattatatgaagacgtgagcagggaaaatgactgtttacaggaggagctccgtatgatggagacccggtatgacgaggctctagaaaataacaaggagctaacagccgaagtttttcggctccaggacgaactcaagaaaatggaggaggtgaccgaaacatttctgagcctcgaaaagagttacgatgaggtgaaaatagagaatgaaggcctgaacgtcctcgttttgcggctgcagggcaaaatagagaaactgcaggaatccgtagtccagagatgcgattgctgcctttgggaagcatcgctggagaatctggaaatagagcccgacggtaacatcctgcagctgaaccagacactcgaggagtgtgtgcctcgcgtgcggtctgtgcaccacgtgatagaggaatgcaaacaagaaaaccagtatctggaagggaatactcaactcttggaaaaagttaaggcccatgaaattgcttggctacacgggactattcagacccaccaagaaagaccacgagttcagaaccaggtcatcttagaggagaacacgactcttctcggtttccaggataaacactttcagcaccaggccaccatcgccgaacttgagctagaaaagacaaagctccaagagctgacccgcaagcttaaggagagagtgactattctagtgaaacagaaagatgtgctgagccacggcgagaaagaggaagaactgaaggctatgatgcatgatttgcagatcacatgcagcgagatgcagcagaaggtcgagctacttagatatgagtccgagaagctgcagcaagagaattctatactgcggaatgaaatcactacgctgaatgaggaggattcaatttccaatctgaagcttggcaccctcaacggcagccaagaggagatgtggcaaaaaacagagactgtgaagcaggaaaacgcagcagtacagaaaatggtggagaatctgaaaaaacagattagcgaactgaagataaaaaaccagcagctagacctcgagaatacagagctctctcaaaagaacagtcagaatcaggagaagctgcaggagctgaatcagcgattgactgaaatgttgtgtcagaaagaaaaagagccgggcaatagcgccttagaagaacgtgagcaggaaaagtttaacctgaaggaggagctcgagcgctgcaaggtgcagtcctctactctcgtcagcagtttagaggccgaactgagcgaagtcaagattcaaacacacatagtccaacaggagaatcatttgctcaaggacgaactggaaaagatgaagcagttgcaccgttgccccgatttgtcggacttccagcaaaaaatatcctcggtattgtcctataatgaaaaactcctcaaggagaaagaggcactatcagaggaactgaactcgtgcgtagataaactcgcgaagtctagtcttttggagcacaggattgccaccatgaagcaggagcagaaatcctgggagcatcagagcgcctcactcaaatcacagctggtcgcatcccaagagaaagtgcagaacttagaagatactgtgcagaacgtcaatttgcagatgagccgcatgaaatctgaccttcgggtcacccagcaggagaaagaagctttaaagcaggaagtcatgtcgctgcataaacagctgcaaaacgctggaggcaaatcatgggctcctgagatcgctacgcacccttccggacttcataatcaacagaagaggctgagctgggataaactggatcatctaatgaacgaggagcagcagctgttgtggcaggagaatgaacgcctccagacgatggttcaaaacactaaagccgagctcactcacagcagagagaaggtgaggcaactcgaatctaatctgttgcctaagcatcaaaaacatctgaacccttcaggaactatgaatcccactgaacaggaaaagctgtcactgaaacgggaatgtgatcagtttcagaaagagcagtcaccagccaataggaaagtgagccagatgaattcactggaacaggaactcgaaactatccacctggagaatgaaggtttgaagaagaaacaggtcaagttggacgagcagctgatggagatgcagcatcttagaagcactgcaacaccttctccgagcccccacgcctgggacctgcaactgctgcagcagcaagcctgcccaatggtgccacgagagcaatttttacagctgcagaggcagcttctgcaggcggagagaatcaatcagcacctgcaggaggaactggagaatcgcacatccgagaccaacaccccccagggtaatcaggagcagctggttacagtgatggaagaacgtatgattgaggtggaacaaaaactaaaacttgtcaaaagactgttacaggagaaagtgaatcaactgaaagagcaggtttctctcccgggtcacttgtgctccccgacgtcacacagcagtttcaattcaagcttcacaagcctctattgtcactag

SEQ ID NO: 23534 - DNA, 1176 bp, Artificial Sequence
  Description of Artificial Sequence: Synthetic coding sequence
atggccgccctgaccaccctgttcaagtacatcgacgagaaccaggataggtacattaaaaagctggccaagtgggttgccatccagtctgtcagtgcctggcccgagaaacggggcgaaattcgcaggatgatggaagttgccgccgctgacgtgaagcagctcggaggatccgtggagctggttgacatcgggaagcagaaggaaataccagtgaacgtccgattctgcctcgaggggatggaagaatctgggtcagaagggttagacgagttgatattcgctagaaaggatacattcttcaaagacgtggactatgtctgtatttccgataattactggctaggcaaaaagaagccctgcatcacttatggactgcgaggcatctgttacttcttcattgaggtcgagtgctcaaataaagacctccacagtggcgtctacggtggcagcgttcatgaggctatgaccgacttaatcttgttgatgggaagcctggtggataagcgcggcaatatactgatcccaggcattaacgaggcagttgcggctgttaccgaagaagaacataaactctatgacgatattgactttgacatagaagagttcgccaaggatgtgggggcacagattctccttcactctcacaagaaggacatcctgatgcataggtggcgctacccatcgctgagcctgcacggcatcgaaggagctttttcagggtcaggcgcgaagacggtaatcccaagaaaggtggtcggtaaattttccataagactggttcccaacatgactccagaggttgtgggcgaacaggtgacgagttatttaaccaagaaatttgccgaactcagaagcccaaacgaattcaaagtttatatgggacatgggggtaaaccatgggtgtccgatttctcgcacccccattacttggccggccgcagagccatgaagaccgtgtttggcgtggaacccgacctcacgcgtgaagggggctctataccagtgactctgacttttcaggaagccacgggtaagaacgtaatgctgctcccagttggctcagccgacgatggggcccatagccagaatgaaaaactgaatcgatacaactacatcgaaggcacaaaaatgctggccgcctacttgtacgaagtgtcccagcttaaggattag

SEQ ID NO: 23535 - DNA, 5970 bp, Artificial Sequence
  Description of Artificial Sequence: Synthetic coding sequence
atggacgaggtggagcaggaccagcacgaggcccggctgaaggagctgtttgacagctttgataccaccggaacaggctcactggggcaagaggagctgacggacttgtgccatatgctgtcactcgaagaagtcgcccccgtgctccagcagaccctgttgcaagataacctacttggacgcgttcactttgaccagtttaaagaggccctcattctaatcttatcacgtacattgagcaatgaggagcatttccaggaaccagactgcagtttagaggctcagccaaaatatgttagggggggcaagcgttacggacgacgcagcctgcccgaatttcaagagagcgttgaagaatttcctgaggtgacagtcattgagcctctcgacgaggaagcgaggccatctcacattcccgcgggagactgttcggaacattggaagacacagagatctgaagagtatgaagccgaaggccaactacgattttggaaccccgatgatttaaatgccagtcaaagcggcagctctccacctcaggactggattgaggagaagctgcaggaggtatgtgaggacctgggaattactagggacggccacctcaaccggaagaagctggtgtctatttgtgaacagtatggcttacaaaacgtagatggggagatgctggaggaagtcttccacaatctggatcctgacggaactatgtctgttgaggactttttttacgggctcttcaagaacggcaagtccctgacaccttctgcctccactccctaccgccagttgaaacggcatctgtctatgcagagctttgacgagtccggacggaggaccacaactagctcagctatgacatctaccatcgggttccgcgtgttttcttgcctcgatgatgggatgggccacgcttccgtcgagcgaattttggatacttggcaggaggaaggaatcgagaacagccaggaaatactcaaagccctggacttttcactagacgggaacattaacttgacggagcttacactggcactggaaaacgaacttctggtcacaaaaaactccatccaccaagcagccctagcttcctttaaggcagaaattagacatctgctggagagagttgatcaggtggttagggagaaagagaagcttagaagcgatctggataaagcagagaagctgaaatcactgatggcttcagaggtagatgaccatcatgcagccatcgaacgccggaacgagtacaacctacgcaaactcgatgaggaatacaaggagaggatcgctgcactgaaaaacgagctcaggaaggagcgcgagcagatacttcagcaggccggcaagcaaaggctggaactggaacaggagatcgagaaggctaagactgaagaaaattatatccgggatagattggctctgtcactgaaagagaactcccggttagagaatgaattgttggagaacgccgagaaactggctgaatacgagaacttgactaataagctgcagagaaatctggagaatgtactggctgagaaattcggcgacttggatccatctagtgcggaattcttcttacaagaagaacgcctgacccagatgcgtaacgagtacgagaggcaatgcagagtgcttcaggatcaggttgacgagctgcagtccgaactggaagagtatagggcgcaggggcgggtcctccgtctccccttaaagaatagcccaagcgaggaggtggaagccaactccggtggtatagagccagagcacggcctggggtccgaagagtgtaatcctttgaacatgagtattgaggcggaactcgttatcgagcagatgaaagaacagcaccaccgtgacatttgctgtctgcggctggagctggaagacaaggtccggcactacgaaaaacagctggatgaaacagtagtatcctgtaagaaagcgcaggagaacatgaagcagagacatgaaaacgaaacacacaccctggaaaagcagatctcagatcttaagaacgaaattgccgaactgcaggggcaagccgctgtgctcaaggaagcccatcacgaggcaacctgccggcatgaggaggaaaagaagcagctgcaggtgaagttggaagaggaaaaaacgcatctacaggagaagttaagattacagcacgaaatggaattgaaagctagattaacccaggcccaggcctcctttgaaagagagagagaaggccttcagtcctcagcatggaccgaagaaaaggtgcgcggcttaactcaggagcttgaacagttccatcaggagcagctcacatccctggttgaaaaacatacactggagaaagaggaattacggaaggaactgcttgaaaaacaccaacgggaactgcaggagggtagagagaagatggaaaccgagtgtaacagaagaaccagccaaatcgaagcccagtttcagtcggactgccaaaaagtgacggagagatgcgagagcgctttgcagagtctggagggtcgatatcgtcaagagcttaaagatctgcaggagcagcagcgcgaagaaaagtcccagtgggagttcgaaaaagatgaacttacccaggaatgcgctgaagcccaggagcttctgaaggagacccttaagagagagaaaacgacttcacttgtgttaacccaggaaagagagatgttggagaagacatacaaggagcacctgaactccatggtcgtggagcgacagcaacttctgcaggacctagaagacctgcgcaatgtcagcgagacccagcagtctctgttatctgatcagattctagaactgaagtctagtcacaaaagagaattgcgtgaacgggaagaggtcctatgccaagccggggccagcgagcagctggcctcccagaggctcgaaaggctggagatggagcacgatcaagagcgccaagagatgatgagcaagctgttagctatggaaaacatccataaggctacatgtgagacggctgatcgagagcgggccgaaatgagtaccgagatctcccgtctgcagagtaaaatcaaggaaatgcagcaagccactagcccgttaagtatgttacagtccggctgccaggtcattggtgaagaggaagtagagggtgacggtgctctgagtttacttcagcagggcgaacagttactcgaggagaatggcgatgtgttgctgtctctgcagagggcccacgagcaggcagtcaaggagaacgtgaagatggctacagagatcagcagattacagcaaaggctgcaaaaactggagccagggctggtaatgtcatcgtgtttggatgagcccgcaaccgagttttttggaaacaccgctgaacagacggaacagtttttacagcagaacagaacaaagcaagtggagggcgtgacgcggaggcacgtactctcggacttggaggatgacgaggtccgcgacctgggctctactggcacatcctctgttcaacggcaggaggttaaaatcgaggagtcagaagcgagtgtggagggattttccgaactggaaaacagcgaggaaacccggactgagagttgggaactgaagaatcagataagccagctgcaggagcagttaatgatgctgtgcgctgactgcgatcgtgcatctgaaaaaaagcaggatttactttttgatgtgtcagtcctcaagaaaaagctgaaaatgcttgagcgaataccggaggcctctccgaagtacaagcttctgtacgaagatgtgtccagagaaaatgattgtttgcaggaagagctccggatgatggaaaccagatatgacgaggctttagaaaataacaaggaactcactgccgaggtgtttagactgcaggatgaactgaaaaaaatggaggaggtgaccgaaacctttttgagcctggagaagtcttatgacgaggtcaaaattgagaacgagggactaaacgtgctggtactgaggctccaaggtaagatcgagaaacttcaggagtccgtggtccagcgatgcgactgctgtctgtgggaggcaagtctggagaatctcgaaattgagcccgatggtaacatcctgcaacttaatcaaactctcgaagaatgcgtgcctcgagtgcgtagcgtccaccatgtcatagaagaatgcaagcaagagaaccagtatttggagggcaatactcagcttctggaaaaggtgaaggctcatgaaatcgcctggctgcatggaactatccagactcaccaagagcgccctagagtgcaaaatcaggtgattttggaggagaacacgacccttcttgggtttcaagacaagcatttccagcaccaggctaccattgccgaactggagctcgaaaagacgaagctgcaagagttaactcgcaaactgaaagaaagagtgaccattttggtgaagcaaaaggatgtgttgtcccatggagagaaggaagaagagttgaaggctatgatgcacgatctgcagataacttgcagcgaaatgcaacagaaggttgaacttctccgatatgagagcgaaaaacttcagcaggagaactccatcctaaggaatgagatcaccactttaaatgaagaggactccatcagcaacttgaagttgggaacactcaacggcagtcaggaagaaatgtggcagaagacggaaactgtcaaacaggagaatgcggcggtgcagaagatggtggagaatttgaagaaacaaatttccgagctgaaaatcaagaaccagcagctggatctggaaaatactgagttgtctcagaagaattcccagaatcaggagaaattacaggagctcaaccagcggctgaccgaaatgctgtgccagaaggagaaagagcctggaaacagcgccctggaggagagagaacaagagaagttcaacctgaaagaggagttggagaggtgcaaggtgcaaagctcgactctagtgtcatcactggaggccgaacttagtgaagtgaagatacagacccacattgtccaacaggaaaatcatctcctcaaagacgagctggagaagatgaagcagctccatcgttgccccgacttatctgatttccaacaaaagatatcctccgtactttcttacaatgagaagctgctgaaagagaaggaagccctatctgaggagttgaactcttgcgtcgataagcttgctaagtcttccctgctcgagcatcgaatcgccacaatgaagcaagaacagaagagctgggagcaccagtcagcgtcactcaagtctcagctagttgcaagccaagaaaaggtccagaacctggaggacacagtgcagaacgtgaatctgcagatgagccgcatgaaatcggacttacgtgtgacccaacaggagaaagaagcactgaagcaggaggtgatgtccctgcacaaacaactgcagaatgctgggggcaaaagttgggctccagagatcgcgacccatccatcaggactccacaaccagcagaagcgcctttcatgggacaaactggaccatctcatgaacgaagaacagcaactgctctggcaggaaaacgaacgtctgcagaccatggttcagaatacaaaggcagagctcactcactcccgcgagaaagtgaggcagctagagtccaacctgcttcctaagcaccaaaagcatttgaacccctcgggaaccatgaaccccaccgaacaagaaaagttatccctaaaacgtgagtgtgatcaatttcagaaggagcaatcccccgctaaccgtaaggtctcacagatgaatagcctcgagcaagagttagaaacaattcacttggaaaatgaaggactgaaaaagaagcaagttaagctggacgagcagctaatggagaactccgtggttgggtcctctcgggagggctgcagttctttacccgagatcgtgtgtgaagatgcggcacctgaggtgcattgcgacgcttag

SEQ ID NO: 23536 - DNA, 915 bp, Artificial Sequence
  Description of Artificial Sequence: Synthetic coding sequence
atgggccagtgcgtgaccaagtgcaagaaccccagcagcaccctggggagcaagaatggcgatcgggagccctcaaataaaagccatagtagacgtggggcgggacatcgagaggagcaggtccctccgtgtgggaagcctgggggtgatattctggtgaatggcaccaagaaagctgaggcagccactgaagcctgtcagctgcctacatcatccggagacgcaggcagagagagcaagagtaacgcagaggagtcatccctccagcgcctggaggaactgttccgccggtacaaagatgagagagaggatgcaattctggaggaaggcatggaacggttttgtaacgatctctgcgtcgaccccactgagtttcgcgtcctgctcctcgcctggaagttccaggcggctacaatgtgtaagtttacacgcaaggaattctttgacggttgcaaagcgatctcggccgatagcattgacggtatctgtgccagattcccctcactccttaccgaagcaaagcaggaggataagtttaaggacctctaccggtttacttttcagttcggcctggacagcgaggaagggcaacggtccctccatcgtgaaattgctatagccctgtggaaactggtcttcacacagaataatcccccagttctggatcagtggctgaacttcctcaccgaaaacccgagcggtataaagggcatatcgcgggacacctggaacatgttcctgaactttactcaagtaattggccccgacctgtccaactatagcgaagacgaagcctggccatccctcttcgatactttcgttgagtgggagatggaacgcaggaaacgcgagggggagggcaggggagctctgtcctctggtcccgaggggttatgccccgaagagcagacttag

SEQ ID NO: 23537 - DNA, 1914 bp, Artificial Sequence
  Description of Artificial Sequence: Synthetic coding sequence
atggccgccatggccgtgggcggcgccggcggcagccgggtgagctctggacgcgatctgaactgcgttcccgaaatcgcggataccctgggtgccgtagcgaaacaaggcttcgatttcctatgcatgcccgtgtttcatccccgttttaaaagagaatttatccaagaacccgccaagaatagacctggcccccagactaggagcgatctgctgttgagtggtagagactggaacacactgatcgtcggtaagctcagtccttggattcggcctgactcaaaagtcgaaaagatccgacggaactcagaagctgctatgctacaggaactgaatttcggtgcctacctgggccttcctgcctttttgcttccactgaaccaagaggataacaccaacctcgctcgagtgctaacaaatcatattcacactggccatcactcctctatgttttggatgcgggttccattggtcgcccccgaggaccttcgagatgacattattgagaatgcccccaccacgcataccgaggagtactctggagaggagaaaacgtggatgtggtggcacaactttcggaccctgtgtgattactcaaaacgaattgccgtggcattagagattggtgccgatttgccaagcaatcacgtgatcgatagatggttgggcgagcctatcaaggcggccatactccccaccagtatatttctgaccaataaaaaagggtttcctgtccttagcaaaatgcaccagcggttgatttttcggctattgaagttagaagttcagtttattatcacaggcacaaatcatcactccgagaaagagttctgttcctatttgcaatatctggagtacctttctcagaataggccaccaccgaacgcgtatgaattgtttgccaagggctacgaagattatttgcagtcaccccttcagcctctgatggataatctggagtcacagacttacgaagttttcgagaaggacccaattaaatattcccagtaccagcaggccatctataagtgtctgctggacagagtccccgaggaagagaaagataccaacgtacaagtgctgatggtgctgggtgctggaagaggccctctggttaatgccagcctgagagcagccaagcaggcagatcgccgcatcaagctttatgctgtggagaagaacccaaacgctgttgtgactctcgaaaactggcagttcgaggaatgggggagccaggtgacggtggtgtcttctgacatgagggagtgggtcgcacccgagaaagcggatattatcgtgagtgagttacttgggagctttgcagacaacgaacttagtcccgaatgcttggacggggcgcagcactttctcaaagacgatggggtgtccattcccggggaatacacctcctttctggcacccatctcttcctccaaattgtacaatgaagtgcgtgcttgcagagaaaaagacagagatcctgaagcacagttcgaaatgccctatgtggtcaggttacacaacttccaccaactcagcgcccctcaaccttgctttactttctcccaccctaacagagacccgatgatcgataacaaccgctattgcacccttgagtttccggtggaggtgaacactgtgctccacggttttgctgggtatttcgaaacggttttgtaccaggatattaccttgagcatcaggccagagactcactcgccaggcatgttctcctggttccctatacttttcccaattaaacagccgattactgtgagggaaggacaaacaatctgcgtgcggttttggagatgctctaattctaagaaagtatggtatgaatgggctgttacggcacccgtgtgttccgccatccacaatccaacagggaggagctatacaataggcctgtag

SEQ ID NO: 23538 - DNA, 1041 bp, Artificial Sequence
  Description of Artificial Sequence: Synthetic coding sequence
atggcccccggcagcgtgaccagcgacatcagccccagcagcacctccactgctggtagctctcgctcccccgagagcgagaagcccggaccttcacatggaggcgtccctccaggcggcccaagtcactctagcctaccagtgggtcggaggcacccccctgtcctgcgaatggtgctggaggcattacaggccggcgagcaacgaagagggacatccgtcgctgcgataaagctctatatcctgcataagtatcccaccgtggacgtcctccgatttaaatacctgctcaagcaggcccttgctacagggatgcgacgcggactgctcgcccgtccgctcaactctaaagcccgcggggctaccggctcatttaaattggtacctaagcacaaaaaaaagatccagccacggaagatggcccctgcaactgctccccggcgcgcaggggaagccaaaggtaagggacccaaaaagccttctgaggctaaggaggacccgcccaacgtgggcaaggttaaaaaagccgccaaaaggccagcgaaagtacagaagccaccaccaaagccaggagcggcaactgagaaggctcgcaaacagggcggagccgctaaggatacgcgcgcccagagtggagaagctcgtaaagtccctccaaagccagataaagccatgcgcgccccaagcagcgctggtggcctctcccgaaaagcaaaagctaaggggtccagaagctcccagggagatgccgaagcatacagaaaaaccaaggctgaatcaaaaagctctaaacctacagcctctaaggtgaagaatggcgccgcaagtccaaccaaaaaaaaggtggtggccaaggcaaaggctcccaaggccggtcagggaccaaacacaaaagccgccgctccagcgaaggggtctgggtccaaagttgtgccggcccacctgtcccgtaagactgaggcaccaaaagggccacgtaaagccggattgccaatcaaagcttcatcttcaaaggtgtcctcacagcgcgctgaggcctag

SEQ ID NO: 23539 - DNA, 1869 bp, Artificial Sequence
  Description of Artificial Sequence: Synthetic coding sequence
atggccatggcccccagccccagcctggtgcaggtgtacaccagccccgctgcagtggcagtatgggagtggcaagatggcctcggaacctggcacccttattctgccactgtttgctcttttattgaacagcagtttgtgcagcagaaaggtcagcggtttggacttggctccttagctcatagcatacctctgggccaggcagacccctcactcgccccctacatcatagacttgccaagctggacgcagtttcggcaggacaccgggaccatgagggcagttagacgtcatttatttccccagcactccgcccctgggaggggcgtagtgtgggaatggctcagcgatgatgggtcttggacggcctatgaagcgagcgtgtgcgactatctggaacaacaggtggcccgaggtaatcagttggtggatttggccccgctgggctacaattacactgtgaactataccacgcatacacagacaaacaaaacctcgagtttttgccgttcggtacggaggcaggccgggccaccatatccagtcaccacaatcattgccccgccagggcatactggggttgcctgctcttgtcaccaatgcctcagcggtagccgcaccggcccggtaagtggcaggtaccgtcacagtatgacaaatctccccgcctatcccgtgccacagcatccgccgcatcgaactgcgtccgtttttggtacacaccaggccttcgccccatataacaaaccttcgctgtctggcgccaggagcgcccccaggctcaataccacaaacgcttggggcgcagcaccacccagcctaggctcgcaaccactgtaccgctccagtttgtcgcatctgggtccacagcatttgccccctggctcgtcaacgagcggggccgtcagtgcgtccttgcctagtggcccctctagttccccaggctcagtaccagcaactgtgcccatgcagatgcctaaaccgtctagagtgcagcaggcgcttgccggaatgacaagcgtccttatgagcgccatcggactgccagtctgtctgagtagggccccccagccgaccagccctcctgccagtagacttgcctcaaagtcccatggctccgtgaaacgcctgcgaaagatgtccgtaaagggggcaacccccaagcctgagccagaaccggagcaggtaattaaaaattatactgaagaactgaaggtgcctcccgacgaagattgcataatctgtatggaaaagctgtctacggcttcaggctattctgatgttactgactcgaaggccataggcagcctcgccgtgggacatctgacaaaatgctcccatgcgtttcacctgctatgtctcctggccatgtactgtaacggaaacaaggatggaagcctccaatgtcccagttgcaaaaccatttatggcgaaaagactgggactcaaccccagggtaagatggaggttctccggtttcaaatgtcacttcccggccacgaggattgtggaaccatactgatcgtttatagcattccgcatggtatccagggtcctgagcatcctaaccccggtaagcccttcacagctcgcggtttccctaggcagtgctacctgcctgacaacgctcagggtcggaaggtccttgaactgcttaaagtggcctggaagagaaggctcatattcacagtcggcacttccagcactaccggtgagactgataccgtggtctggaatgagatccatcataagacggagatggaccggaatatcactggtcacgggtatcccgatcctaactatctgcaaaacgtcctggcggaactggctgcccagggagtgactgaggactgcctggagcaacagtag

SEQ ID NO: 23540 - DNA, 786 bp, Artificial Sequence
  Description of Artificial Sequence: Synthetic coding sequence
atggccgccaccgcccgggaggacggcgccagcggccaggagcggggtcagcgagggtgcgagcattacgatcgaggatgcttactgaaagcaccatgttgcgacaagctctatacatgccgcctgtgccacgacaataatgaagaccatcaactggaccgcttcaaagttaaagaagtgcagtgtatcaactgcgagaaaatacagcacgcccagcaaacttgcgaggagtgttctacgctatttggcgagtactactgtgatatctgccacctgttcgacaaggacaaaaaacagtaccactgtgaaaattgcggcatctgcaggattggcccgaaggaggatttcttccactgtcttaaatgcaacctgtgtctggccatgaacttgcaggggagacataagtgcatcgagaacgttagccgccaaaattgtccaatctgccttgaagatatccatacctcacgagtagtggcccacgtgctgccttgtggacacctgctccatcgtacctgctacgaagaaatgctgaaggaaggatatagatgccctctatgcatgcactctgcgctggacatgacacggtactggaggcagttggacgacgaagtagcacagaccccaatgccctctgaataccagaacatgacggtggacatcctgtgcaacgactgcaacggcagaagcacagtgcaatttcacatcttgggaatgaaatgtaaaatttgtgagtcctataacacagctcaggccggcggccgccgaatcagtctggaccaacagtag

SEQ ID NO: 23541 - DNA, 1983 bp, Artificial Sequence
  Description of Artificial Sequence: Synthetic coding sequence
ctgagcctgcccagcgtgacctacctgctgctggaggtgatccccgacagcatgaggaagcaggaagtccgcaccggacgtgaggccggacagggccacggcacaggaagtccagcagaacaagttaaagcactgatggatctactcgctggcaaggggagtcaaggaagccaggctcctcaagcattagatcggacacccgacgcgcctctcggaccgtgctctaatgactcaagaattcagaggcatcgtaaagctctcttgagcaaagtggaggcaactcggggcggaggacatcctgctagaacagtggcactcgacagactgttccttcccctgtcacgtgtttccgtgcctcctcgcgtgtctattacaatcggagttgccggaatgggaaaaactaccctggttaggcacttcgtgcggctgtgggcccatggtcaggtggggaaagacttctctctagtccttcccctgactttccgagatctaaatacgcacgagaagctgtgtgccgatcgactcatttgttctgtgtttcctcacgtgggcgagccgtcactggccgtggccgtgcctgccagggctttactcatcctggacggattggacgaatgccggactccactagacttcagtaatactgttgcctgcaccgacccaaagaaagagattcctgtcgatcatctgattactaatataatccggggtaacctgttccccgaggtgagtatctggatcacctcaaggccgtctgcttccggccagatccccggggggctggtagaccggatgaccgaaattagaggctttaacgaagaagagattaaggtctgcttagagcagatgtttcctgaagatcaggctttactcggctggatgctctcacaggtccaggcagacagggccctatatctgatgtgcacggtccccgcattttgcaggctcaccgggatggcactcggtcacctgtggagaagtcggaccggtccacaggacgctgagctctggccccctcgcaccttgtgcgagctgtattcctggtacttcagaatggccctgtccggcgagggacaagaaaaaggcaaagcctcacctcgtattgagcaagtcgcccacggagggagaaagatggtcggaacgctcggacggttggcatttcacggactgctcaagaagaaatacgtgttttatgaacaggatatgaaagcttttggcgttgatctagccctgctgcagggagccccctgttcttgttttctacagcgcgaagagaccctggcctctagtgtagcttattgtttcacacacctgagcttgcaagaatttgtggcagctgcctactattacggtgcatcgcgccgcgccatcttcgatttattcacagagtctggagttagttggccacgcctgggtttccttactcacttccgttctgctgcccagcgggctatgcaggcagaagatggaagattagatgttttcctcaggtttctgtccggcctgctgtcacccagagtgaatgctctgttggccggatccctcctcgcacagggcgagcatcaggcttaccggacccaagtagcagaactcctccaagggtgccttagacctgacgctgccgtgtgcgcgagagccattaacgtgctgcattgtctccatgaactgcagcacaccgagctggcaagatctgttgaggaggcgatggagtcgggggctctagccaggctcaccggccccgcccacagagccgcccttgcgtatctcttacaggtttccgatgcctgtgctcaggaggctaatctgagccttagtcttagtcagggggtgctccagtccttacttccccagctgctgtactgtcgcaagctcagatggatccctggtcagggcgccggggccggggaaggagctgaggaacgcgctgaggcggttcctagcccacccccttcttttagcgtgagccttctagggctcccttag

SEQ ID NO: 23542 - DNA, 1152 bp, Artificial Sequence
  Description of Artificial Sequence: Synthetic coding sequence
atgctgagccggaagaagaccaagaacgaggtgagcaagcccgccgaggttcagggcaagtacgtcaagaaggagacgtccccactgctccgcaatctgatgccatcatttatacgccacggtccaacgattcctagacggaccgacatttgcttgcctgactctagcccaaacgccttctccacttccggagatgtggtgtccaggaaccaaagctttttaaggacccctatccaacgtactcctcatgagataatgaggagagagagcaacagactgtccgcacccagctatctggcccgttccctagccgacgtcccccgagagtacggatccagccagtccttcgttacagaggttagcttcgcagtcgagaacggtgattccgggtcccgctattactactcagataatttcttcgatgggcaaagaaaacggccgcttggggaccgagctcatgaggactacagatattacgaatacaatcatgatctgttccagagaatgccccaaaaccagggccgtcacgcgagcgggatcgggagagtggccgcaacaagtctcggtaatctgacaaaccacggctctgaggatctgcctttgccacctggttggtctgtcgactggacgatgagaggccgcaagtattacatcgatcacaacactaacacgacgcactggtcacatcccctagagcgcgagggcttgccgccagggtgggaaagggtggagagctccgaattcggcacttattacgtagaccacacaaataagaaggctcaatacaggcacccatgcgcaccgtcggttcccaggtatgaccaaccaccaccagttacttatcagccgcaacagacagagcggaaccaatcacttctcgtgcctgccaacccataccacaccgctgagattcccgattggttgcaggtttacgcccgagcgcccgttaaatacgaccacatccttaagtgggaactgttccaattggcagaccttgacacatatcagggaatgctgaaactcttgttcatgaaggagttggagcagattgtgaaaatgtatgaggcataccggcaagctctcctcaccgaactggagaaccgaaaacagcgacagcagtggtacgctcaacagcacgggaagaacttctag

SEQ ID NO: 23543 - DNA, 2376 bp, Artificial Sequence
  Description of Artificial Sequence: Synthetic coding sequence
atgagcaaccagcaggagaagtacgaggcccagaacatcgtgaactccacagaggaatcagacgacgcttttgatactgtgaccatccctgtgccctcagaagaaccacaggaaagtgaccaaacagaggagcacgagtccggtattgaacagttttccgagtcccacgcgattcacgtggaggagcagtccgatcagagtttttcgagtctggaacctgacaatgaacaacttatggaggaggttatctcacccaggcaggtatcttatactcctcaacatcacgaaaagcagtacgcaatgcaacgccccaatgacgatagcctggccttcctggacaagatcaagtccgttaaggagagcctgcaggagtcagtggaggattcactggcgaccgtgaaagttgtgctgattcccgtgggtcaggagattgtcatccctttcaaagtggataccattttgaaatacctgaaagaccatttcagccacctattgggtatcccccattctgtgctgcagattcggtatagtggtaagattctcaagaacaacgagaccttggtgcagcacggggtcaaacctcaggagatcgtgcaagtggagatattcagcaccaatcccgatctctaccctgttagacgcatagacgggctgacagatgtctcacagattattactgtaacggtccagactggtctagaccagtatcagcaagtgcctgtggagatagtaaaatcagatttccataagccattcctgggtggttttcggcataaagtgacaggggttgagtaccacaacgccggaacacagaccgtgcccaaacgcattcctgagcggctgagtatcttttgtcgcgatacacagactgtgttccagaagaaaaatctgcaacagacgacgaacactacatctacccagatgactaatatcggtgtgtacgtgagcaacatgacagacaagttagtgacgcccgggaaatacttttcagccgctgagtaccacgcccagcggcttaaggctgtgattgtaattcaaacatattaccggcagtggcacgccaagatcttcgtcgaaaatcttcggcggcagaagagtctgagactcgagtgggaaacgcagcaggagttgcgtaaaatcagagagaaagaagagtggataaagcttgattatcaccgccgccacaatccaaagactaacgaagacttcgagttcctctacaacgccttagagttttggagacaggaggagcttacaagaatcaaccaatcattcacaggtgctgaacgcaaggcagccctatgtgagctgctggaaaaggagacccagatcatcgcgagcattgggagacaccgctatatcgcatatatggctaatcaagaagcggcaattcaggccttcctggacaaatgctccgcacccaagatctggcgtacaccgaacggaaaaacaatcgagatggatacgcagttcacaatcagagcacgagagcttcagaatatctacaagtgcatcatgctgaagaacatcagccaggacgaaaggcttgatgtgctgctgaccctgaagcacaccgtgaaggagcacgagtgtaaattgacgcaagagatcttggagttgattgacagagaggtggatctcatgatgcgcggagtgaaacaccacaacctggagggtctacggaagcggattgccaccctgtttttccactacattaagactccacttttcaatcctgaggtcgccaaatacctgaaggtccctcaggatcccttgaaattctacaaaaagatatatttctgccatagttgccagctgtatctgccatcaaccgagttttctgtgagcagcacctcaaggagaatctatcgctgtcgcaattgtatcaacctgcaaaatgaagcccaaaagcgcgagtccttccttaaatataaatgcctgcttcaacagttatactatacggaagccgattatgaggatgacagcaagattgcatttctgatgcagcttcaggatatccagtacttgaccgagaatatttgggcaagccagtcagtcttgtctgcctgtgacaatttgagtgacctagtcatggtgcgctggaataaatcactggagtggagcccgtggaactgtattctcctgaccaaggacgaggccgcagcacatttaaaattgaccagcatcgaggagggctacgaaagaagctttattcacaaaataaagcataaacacattctggcaaaaaactatttttcgcaggtgcctgtgctagcgtcattcattctcgatgatggtgagatcgatgaaattagatggaagtaccactcggacactacccccaaaattatcgagagccagaggccaccacactag

SEQ ID NO: 23544 - DNA, 1767 bp, Artificial Sequence
  Description of Artificial Sequence: Synthetic coding sequence
atgagcagctgcgtgagcagccagcccagcagcaaccgggccgccccacaagatgaactgggcggacggggcagctcttctagcgaatcccaaaaaccctgtgaagctcttaggggactcagttccttaagtatacaccttgggatggaatcctttatcgtggtcactgagtgtgagccggggtgcgcagtcgatctcgggctggcacgggatcggcctctggaagctgacggtcaggaagtacctctagacaccagcgggagtcaggccaggccccacttatcgggtaggaaactatcactgcaggagagaagtcagggcggactcgccgcaggcggcagtctggacatgaatggtcgatgtatttgtccatccctcccttattcaccagtttcctcgccacagtcttccccccgcctccctcgacgccctacagtggaatcccatcatgtatctatcaccgggatgcaggattgcgtgcaactgaatcagtacacactcaaagatgagatcggcaagggtagctatggagtggttaagctggcctataacgagaatgataatacttattatgcaatgaaggttctgagcaagaagaagctgatcaggcaggccgggttcccgagacggccaccacctcgaggcaccagacctgctcctgggggatgtattcaaccacgcgggcccatagagcaggtttaccaggagatcgcgattctgaaaaaactcgatcatcctaatgtggtgaaattagtggaggtcctggatgacccgaacgaagaccacttgtacatggtcttcgaactcgtgaatcaagggccagtgatggaagttccaacactaaagccattgtcagaagaccaggcccggttttacttccaggatctgataaaggggattgaatacctccattaccagaagatcattcatcgcgatattaaaccttctaatctgcttgtgggggaggatgggcatattaagatagccgattttggcgtgagtaatgaattcaaaggctcggatgccctgttaagcaatactgttggaacaccggcattcatggctccagaaagcctgtccgagaccagaaagattttctcgggcaaagccttagacgtgtgggccatgggagtgacgctctattgcttcgtgttcggtcagtgcccctttatggacgaaagaatcatgtgcctccactctaagatcaagagccaggcactggaattccctgaccagccagatatagccgaagaccttaaggatctcattacccggatgcttgataaaaatccagaaagccgcatagtggttcccgagattaagttacatccctgggttactagacacggcgccgagccactccctagcgaggatgagaactgtaccctggtagaggtcacggaggaagaggttgagaattcggtcaagcacatcccatctctggccacagtaattctggtaaaaaccatgataagaaagagaagtttcggcaaccctttcgagggatctaggcgcgaggagcgcagtctctcggctccaggcaatctcttaactaagaagcccactagagagtgtgaatcactctccgagctgaaagaggccaggcaacgtaggcagccaccagggcaccggccagcgccaagaggcggcggagggagtgccctcgtgcgcggctccccgtgcgtggagtcgtgttgggccccagcccccggaagccctgcacgaatgcaccccctccgtccggaagaggctatggaacctgagtag

SEQ ID NO: 23545 - DNA, 2052 bp, Artificial Sequence
  Description of Artificial Sequence: Synthetic coding sequence
atggccctgagcaagcgggagctggacgagctgaagccctggatcgaaaaaactgtgaaacgtgtcctgggtttcagcgaacccaccgtcgtgactgcagcacttaactgcgtgggcaaaggcatggacaaaaaaaaagcagccgaccacctgaagccctttctcgacgactcaacactaagattcgtggacaaactcttcgaagctgtggaagaaggtaggtctagtaggcattccaaatccagttccgataggtcccgaaaaagagagctgaaggaagtcttcggggatgatagcgaaatctccaaggagtctagcggagttaagaaacgcagaatccctaggtttgaagaagtcgaggaggagccggaagtcatccctgggcccccttcggagtctcctggcatgctaacaaaattgcagattaaacaaatgatggaggctgccactcgtcagatcgaagagcgaaaaaagcagctcagttttatctcgccccccactccccagcctaagactccctccagttcccaacccgagcgactgcccatcggaaatacgatccagccgtctcaggccgcaacatttatgaacgacgcaatcgagaaggcccgcaaagcagccgagcttcaagcacgcatccaggctcagttggccctcaaacccggactcatcggcaacgcgaacatggtcggtttggcaaacctgcacgctatgggaatcgctcctcctaaggtcgaattgaaagatcagacgaagcctacgcccttgatactggacgagcagggcagaactgtggacgctacaggcaaagagattgagctcacgcaccgcatgccgacattaaaagccaacatccgcgctgtcaagagagaacaattcaagcaacagctgaaggaaaagcccagcgaggacatggagtcgaatacctttttcgacccaagagtgagcatcgcaccctctcagaggcagagacgtaccttcaagtttcatgataagggcaaattcgagaaaatagcacagcgcctgcggacaaaggcccagctggaaaagctccaggccgagatatcccaggctgctagaaagacaggcatccacacaagcacccggctggcactcatcgcgcctaaaaaggaattgaaggaaggggacataccagagattgagtggtgggatagctatatcattcctaatggcttcgatctgaccgaagagaaccccaaacgagaagactacttcgggattacaaatttggtagagcaccctgcgcagcttaatccgccggtcgacaatgatacacctgtgaccctgggcgtatacctgaccaagaaggagcagaagaaactccgccgccagaccaggcgagaggcacagaaagagcttcaagagaaagtcagattggggctgatgcctccaccagaacccaaagtgaggatctctaacctcatgagagttctgggaaccgaagccgtgcaagaccccacaaaggtggaagcccacgtgcgcgcacaaatggccaagcgtcaaaaagctcacgaagaagcaaacgcggctcggaagctgaccgcggaacagcggaaagtgaagaaaataaaaaaacttaaggaggatatatcacagggagtccatattagcgtgtatcgtgttcggaacctgtctaacccagccaagaaatttaaaatcgaagcgaatgctggacagttgtacctgacaggcgttgtcgtgctccataaggatgtcaatgtggtcgtagtggaaggtgggcccaaggcccagaaaaagttcaagagactgatgctgcaccgaattaagtgggacgagcaaacttctaatactaagggagacgacgacgaggagagcgacgaagaggctgtaaaaaaaacaaataaatgtgtcctggtctgggaaggcacagctaaagatagatcattcggcgagatgaaatttaaacaatgccctacagagaacatggccagagagcatttcaaaaagcacggcgccgagcattattgggacctggccctgagcgagtcggtgctggagagcacagactag

SEQ ID NO: 23546 - DNA, 1938 bp, Artificial Sequence
  Description of Artificial Sequence: Synthetic coding sequence
atgagcgacaagagcgacctgaaggccgagctggagcggaagaagcaacgccttgcccagatccgcgaagagaagaaaagaaaggaagaagaacggaagaagaaggaggccgatatgcagcagaagaaagagccagtacaggatgactcagacctcgaccggaaaagacgggaaacagaagctctgttgcagtccatcggcatctccccagagccaccactcgttcagcccctccacttcttgacatgggacacatgttactttcactacctggtgccaacacccatgagcccaagctcaaagagcgtgtcaaccccctctgaagccgggtcccaggactctggagatcttgggccgctcactaggacacttcagtgggacaccgatccttctgttttacagttacagtccgattcagagctcggaaggcgcctacataagctgggggtctcgaaagtaacacaagtggactttctccctagggaagtcgtcagctactccaaagaaacacaaactcctctggcaacacaccaatccgaggaggatgaggaggatgaagagatggtcgagagcaaggtagggcaagacagcgagcttgagaaccaggacaaaaaacaagaagtcaaggaagcaccccctagggaactgactgaagaggagaagcaacagatcctgcactcagaggaattcctcatctttttcgatcggaccatcagggttatagagcgagcacttgctgaggactcagatattttctttgattattcaggacgagagctggaggaaaaggatggagacgtgcaagccggggctaatttgtccttcaatcggcaattttatgacgaacattggtcgaaacacagagttgtgacatgcatggattggtctttgcaatacccagagcttatggttgcaagctacaataataatgaggatgccccccatgagcctgacggcgtggccctcgtgtggaacatgaagttcaaaaagacaaccccagaatatgtcttccactgtcagtcatctgtgatgagtgtctgctttgctcgatttcacccgaacttggttgtcggcggaacgtacagcggccaaatcgtcctgtgggacaaccgaagccacagaagaacaccagttcagaggacacccttgtctgctgcagcacacacgcatcctgtgtactgtgtcaacgtggttggcacccagaatgcccataacttgatcacagttagcaccgacgggaaaatgtgcagctggagcctcgatatgctgtctaccccgcaggagtcaatggaactcgtgtacaacaagtctaagccagtagccgtgactgggatggcgtttcctacaggagacgtgaacaacttcgtggtgggctccgaagagggaactgtgtataccgcctgtagacacggatccaaagctggcattggcgaggtgttcgaagggcatcagggtcccgtaacgggaatcaactgccatatggccgttgggcctatagacttctcccacctgttcgtgaccagctcttttgattggacagtgaagctgtggacaaccaaacacaacaagccgctgtatagttttgaagacaacgcggactacgtgtacgatgttatgtggagccctgtgcacccagctctgttcgcgtgcgttgacggaatgggccgcctggatctttggaacttgaacaatgacacagaggtgccaactgctagcgttgctattgaaggcgcgtcagcattaaacagggtgaggtgggcccaagctggcaaagaagtagcggtgggcgactctgaggggcgcatttgggtgtatgacgtgggcgagttagccgtgccccacaacgatgagtggaccagatttgctaggactcttgtggagattagagccaatcgcgccgacagcgaagaagagggaaccgttgaactctccgcttag

SEQ ID NO: 23547 - DNA, 7806 bp, Artificial Sequence
  Description of Artificial Sequence: Synthetic coding sequence
atgaagcggaaggtggtgaacacccacaagctgcggctgagccccaacgaggaggcttttattctgaaggaggactacgagaggagaagaaagcttcgcctcctacaggtgagggagcaagaacgcgacatcgccctgcagatcagggaggacatcaagcagaggagaaaccagcagtttacacggctcgccgaagaattacgagcagaatgggaggaatctcagactcagaagatacaaaacctggagaagctttacctagctagtttacgatcaatgggcgaggggcatcgccaggcgaaggaaaatgagccagatctggacgctttagcacaaagagctgccgagcggaagaggaaagccgacctgcgacacaaggaggcattaaaagttcagaagaaccagaaagagatcctgctgaaacagaagacctggcatattaaggcacgtaaagaggccctcctggtggaaaaggaacgatccgcaaagattacaagcttgcccccgccccccccaacgctgtttgaaaacatagaggtgaagagaatctcagctgtgaagactaattctagtacgtatcatcacctacacaccttcgtgaacagggagactgacacaaagagacctgacgctagattggccgccgaagaggaggccaagaggcttgaggaactgcagaagcaagcagcccaagagcggatggagaggttcgagaaagcccacgtccggggtttccaggccatgaagaaaattcatctggcccagaaccaggagaaactaatgaaggagctgaagcagttacagcaagaagacctcgccaggagaaggcaaactgtcgcacagatgcccccacagctggtggaactaccctacaaacggtcagagatgaaagaggattggcaacgggagttagagtttgcatttgaggatatgtacaacgccgaccggaaagtgaaaggcaacctaatcctgcacttggagcctgaaccacttccaaccgtcacaaaccagatccaagatgaagagttggatctgagcatggaacaagaaaacctgggggctgccgaagatttgcccgtgacggaagcagagatctgcagttcagaaacagatgtgccactcgtgatgaagacccagcagatcccaagcaaggtgctgttcaaaaaactcctcaacaagattagaagccagaaaagtctctggaccatcaagtcaatgtcggaagatgagtcagagatgataaccacagtgtcggaaatcgagtcgaaagcgcccacagttgagtccggtaccattgcatccaaagaacgcactttgtcttctggacaggagcaggtagtagaatcagacacgttaactatagagagtggtcctctggcctcagaagacaaacctttgagctgcggcacaaattccgggaaagaacaagagatcaacgaaaccctccccatcactactgtggcacagtcctccgtccttctgcatccccaggaagccgccgctagaatcaggatgagcgcccggcagaaacagatcatggaaattgaggagcagaagcagaagcagcttgaattgctggaacaaattgaacagcaaaagctccgcctcgagactgactgtttccgcgcccagctggaggaagaaaagcgcaagaagacacagcccaccggagtagggattgcccctgcatcttgtcccgttatctctgacgaagattcccacaggcagatgatacgaaactaccagcatcagctgctgcagcaaaacaggctgcacagacaatccgtggagactgccaggaaacagctactcgaatatcagacgatgttgaagggtagatgtcctagtgtgtcagctcccagcctgattactgatagcgtgataagtgtaccgtcatggaaatcagagaggccaaccgccatttcagaacactgggaccagggtcaaagacttaagctcagccctaacaaataccagcctattcagcccattcaaacctcaaagctggagcaggaccacttccaagtagccaggcagaaccacttcccccagaggcaggtggagacaactgagaccttacgggcgagcgacatactaacaaatcaggccctcgaaagtcaggagcatcttcgacaatttagccaaactgagacccagcagcgcgactacaagctcgtcccaaaagatagtgaaacgctctctagggctctttctcacgatcgccagcttattagccaggacgccaggaagatctccgagacatttggagccactacgttccagagcctcgagtctcagcagctgttctcagagaactccgaaaatattagttaccacttgactgaacctagctcattcgtcccactggtgcctcagcacagtttttccagtctgccagtaaaggtggaaagcggaaagattcaagaacccttttcagccatgagcaagtcaaccgtgtcaacctcccatagtatcatctcacagatgcatgaccgtccgctgctcccttcagagaacatcactgcccaacagggaaacatgaaggccttacaggagcagcttgatttgcagaagaaggtactccaggcgacacaggaagctcaagagcagctgctactatgcaagcaaaaggaagtagaacagcaaaccggcctttcagtcttcctgcccctagtgaccccagatagttcagctctcctcccttccgccaaggctgatctgggccgtattcaggaaagctcacccaccaaaaacaatatagctgtgtcctctgaccaccatgtgataagccagctgcaagataagcgcctatctctgtcgcagcccatactgtcccagcagaataattttaaatttctgcaggagcagctgaatattcagaaagactcactccaggctaggcgcgaagcccaagaggtgctctatgtgcacaagcagtcggagctggataggagagtttgtagtgagcaggccgaaccatcctttccttttcaagtggctcaacataccttcacctcgctcccatccgctgacactaaatctggcaagattcaggagcagcatagttccaaatccgaaaagggcttggtgagctgccaatctgacatcccaatttcccaggacggatcccttagcttcttgcagcaattccttcccctgcacgattccctcaagttattgcaggaacaattaacaaagcaacgcgacacactccaagctcgccacgaggcgcaggttgagctgttgctgcaccgtcagagggacctcggggactctaaatctgggttggtgagctcctcatcatccccagtggttgtgcagcacagcgtggctagtcaggcctccgcaaaggccgagcccagaaggattcaggaactgtacctgagcgaaaaagagaatgtaggtccttcctgccacctgatcattccaacctttcaagacaagtctctgtccttcccacagcactcgctggcccaacaggaaaacctaacaattcttcaggagcagagccagatccagcgcgtgatcttgggtgctaaagaggggacccaggagtttgtgcatacagagagcgagctcgaaaaacggatctcctctgaacaaaccgggaccagtagctctctctctcaagtggacgagagtgaacggtttcaagagtgcatcagcatcaagtcggactccactattccacttagtcaccccaagattcctagatgtcaggaaaggttgctcagagtttctcagcacatgctccccctgcaggacaatctggaagaacatcaggcatggctcgatacagagaaagaggctttccacttttcccagaagacacaggagaacaccagctccgagcaaacagggagcagcagcttcatcccccaactggtccagctgagctttacctcactcgcaagcgctgaatctggaactatacttgaacctctgtttacagagtctgagtccaaaatattctcaagtcacctgcagatcccccagcttcaagaccgcctcttaaggatcagtcaactgatccagcctcaacaggacaacttgaaggcattgcaggagcagctggccacacagcgcgaggccatcattctcgctagacaggaggcccgagaggaattactgctccatcaatcggaatgggaaggaaggattagcccggagcaggtggacacaagttctttaccactggtgcctcagcacagttttgcttcattgcctttgaacgagtcagaacgcaaccaggaaccatgttcaattaactctgataatatagtctcttctggacactctgagattcccactctgcctgacggtttacttggtctaagtcacctggtcctgccacagcaggataacctgatcgctctcgaggaacacctccatgcccagactgactttctcccttccattgaaaagactcaaaaagagttagtactgtcaaaaccgtgcaaattcgaagagaaggttagctctgaacactttatccagtcccatcacggtgatcttcaggccctgcaacaacagttggacacccaaaagaaggccatccgcagcatacaggaggtgcaagaggagctcctgctacagcgcctttccgagctggagaaaagagtatcttccgaacaggtctgtagctcatcattcgtctctcaggtgccagtagccgattcggaacggacccagaagtcatttcctacgaagagtaatgacacactgcctagtagccatagggagatcccccgcctgcaggatcggctgttgagcttgagtaaaccgattttaccacagcaggacaatatgactgcacagctggatgcccagcgcgaggttatgtattcctacgagaagcctcaggaagagctgagtttgaacaagcagagaaaattaaacaaatcagagtccgctgaacacactatcccttcactgtttctacccaaagaaacagaacatagctttattcccctgccctttgctgaggcaaaaccaaagagtacatgtgaattatacagttcccagaatgagcacgccgcaccgccctcaaacccggtcatccctggctttcaggataggttactaagcttcagccagagcgtcttgacccagcaggataatctgggcctgcagaagcaactggacctgcagcgggaggtgttgcattacagtcagaaggctcaggagaagctgttagtgcagcgtcagactgctctgcagcagcagatccagaagcacgaggagacactaaaagatttcttcaaggattcccagatcagtaaacccactgtggagaatgacttaaagacacagaaaatgggacagctgcgggattggtttccaaatactcaggatcttgctggaaacgaccaggagaatatcagacatgctgaccgaaacaattccgacgacaatcatcttgcctccgaggacactagcgcaaaacaatccggagagcatttagaaaaggacctcgggcggagaagcagcaaaccccctgtcgctaaagttaagtgcggtctggatctaaaccagcatgagttgtcagcgatccaagaggtagagtcacccgctatcgggcgaacttccatcctgggtaaacctgggatttacgaagaccgggaccctctccgtgtgtccatctccagagagcagtcctttttcggctcaccgctggctcatgatccattctcctgcctccagctggtcggccaggaaaacgtgtgtggtgatgattacgatgaggctgtaaagctcaaagaatcagtggtcgaaaatcatgccgttttgagttatgccgttgaggaagaacacgcctatcttggccccaccgtgaagcctgacgataaagccaaaacactgtcctacgagcccttgagctcagcaacagtgagcaccgggagtttgctatcatatgagaatactgatctctcattaaccgacccggagtccttcagcgagcatatggacgacagcaaacaggagtccaccacatctaaggaggaggagacaaacattatatcatcaatcgttccctccacccaggacatttatcagcggcagaatagcagtgatgttcacaagagtcttctgccagcggtggatgaaaccacatgcggtcacacacacttccagcaaatgatcgataaatatatcaacgaagccaatctgatccccgagaagacggatctgcaggagctcgaacacatttttccgaatctccaccaccagctctttaagccattagagccacatccagactttgatctgtccagctcttcgagtggcatctctcccgacaatagggacttctaccagaggtccgacagcagttctgaatcacattgtgccacggggttgtccaagtctacagtctacttcaccgctctgcgcagaacatccatgcattcttcactaaacacgtcaccaaatcaacagccagacaccaacctggcgcacgtaggcgcacactcttttgcaacggagaacattatcggtggtagtgaacagtgcttcgaacagcttcagccagagtattctagtcaggaagagtcacagcacgccgacctcccatctatcttcagcatagaggctagggacagttcccaaggaatgaagaatcagaattatccctcagaagaacacacagagatcctgcagaacaagaagaaaattgtccacttccagctaagcattgggaacctatcctctgtgtatagttcgagtgacgaagccaacgtgttcgatcaattaaacgtgcaacattcaacgccctgtggctctaattcttccgagtgctccactaaacaccaactggaatctaggaaggaatccatggggtttgaggagttaagtaagaggggcgtagtaactatgttgcaatcacagggtctgatcgaggacaataagaatgagacatgccgcgtactggacattaacccacaagtggaagaaacagactcccgtctgtgcgtccgcaccgttgagatgggcacttccatacaagcgccctactctctgacgacacagaatgaaaaatacttcgaaaattctgcagagacggatatacctaagatcacaaaaaagctatctcaactcggggaatctgaactctttgcctcgagcgggtctttcagcttgcagagcagcatccctgtgtgggaaactgaaaccggccatgggatcatggaggagccagagctgacactcatcagcactaccgacacatctatcgcagaaatggactttgccaatctgacactggaggagaaaagcgaaaacgaggctaaatgcttctttcaggtgagcgagttcctacccctcgtgtccgcaaccgaagctagcgactatcctgcagtaagcgagctgtccatcgaaaagcctaggacggcttccacagaaaccccacggcgcctcacaccagtcccagggagtctccaggaagcatttattaagcgcaaaaagtccttcatggaacggagtcaccaacggcagaaagaaattagaaataagatccatgtctcagagaacagccagatcaagaccgtgaaagagaaacccagtatatcttcttccgtgtcccgactgaaaggggtgaataaggtccgtgcctcctttcctgaggacagaaaaacgactcaggcattgcgacatcagcgcggactccggctgtacaatcagctcgccgaggttaaacagcaaaaggaggagaagaccaaacaagaggcctacgcgcagaatcgcgcccgggctaaggaattccataaaaagactctggaaaaactgcgggctaaaaatacttgttag

SEQ ID NO: 23548 - DNA, 2397 bp, Artificial Sequence
  Description of Artificial Sequence: Synthetic coding sequence
atggccgccagcctgcccggccccggcagccggctgttccggacctatggcgccgccgacggacgcagacagcggagaccgggacgggaggcagcacagtggttcccgccgcaggatagacgacggttttttaattcaagcggcagttctgacgcatctatcggcgatccttcacaatctgatgaccctgacgatccagatgaccctgactttccaggttcccctgtgcggagaagacgcagacggcctgggggacgcgtgcctaaggacaggccaagccttacagtcacgccgaaaagatggaagttacgagctagaccttctctgaccgtgaccccaagacggctggggctgcgggctaggccgcctcagaaatgctccacaccttgtggccctctccgccttccgccttttcctagtcgggattctggacggttgagccctgatctgagtgtgtgcggacagccccgggatggtgatgaactgggaatctccgcctccttgtttagttccctggccagtccatgtcccggctcccctactcccagagactcggtgatttccattgggacaagcgcatgcctggtggccgcctctgccgtgcctagtggactgcacctgcccgaggtctcgctcgaccgggcctccttgccgtgcagccaagaagaggcaactgggggagcaaaggacactagaatggtgcatcagacaagggcgagcctcagatccgtcctgtttgggctcatgaatagcggaacgccagaggattccgagttccgcgccgatgggaaaaatatgagggagagctgctgtaagcggaagcttgtggtgggaaatggaccagaggggccaggcctcagcagcactggcaagagacgcgccacgggccaggactcgtgccaggaacgcgggcttcaggaggcagttcggcgagagcatcaagaggcttctgtgcccaaagggcgcatagtgcctcgagggatcgaccggcttgagcggacacgttccagtcggaagagcaagcatcaagaggccacagagacctcgctgttacactcacaccgcttcaagaaggggcagaagttggggaaggactccttccccacccaggacctgacaccgctgcaaaacgtgtgcttttggacaaagacgcgcgcctcattttcctttcataagaagaaaatagtgaccgacgtgagtgaagtctgctccatctacactactgctacatctctatcagggtcactgctttctgaatgctcaaaccggcccgtaatgaaccgtacttcaggggcccctagctcttggcactcgtcctccatgtatttactctcgcccttaaatacgttgagtatcagtaataagaaagcttcagacgcggagaaagtttacggagagtgttcacagaagggacctgttccctttagccactgtctgcccaccgagaagctgcagcgttgtgagaaaatcggcgaaggggtgttcggcgaagtcttccagaccatcgctgaccacacacctgtagccatcaaaatcatcgcaattgagggacctgatctcgtgaacgggagccatcagaaaacgttcgaagagattcttcctgagatcatcatctcaaaagagctgagtcttctgtctggcgaggtatgcaatcgaaccgaaggcttcataggcctcaactcagtccattgcgtgcagggcagttaccctccactgctgctgaaggcctgggaccattacaattctacaaagggaagcgccaacgaccggcccgacttttttaaagatgatcagttgtttattgtgttagaattcgaattcggaggtatcgacctggagcagatgcgaacgaaactcagtagcctggcaactgccaaaagcatcctccatcagcttacagcttcgttggccgtggcagaagcatctctgagattcgagcaccgggatctgcattgggggaacgtcctactcaagaaaacctcacttaagaaactccactacacactgaatggcaagtcaagcactataccatcctgcggactccaggtgagtatcatcgactacacactttctcgtctcgagagggacgggattgtcgtgttctgcgacgtcagtatggacgaagacctttttaccggggatggggactatcaatttgacatttacaggctaatgaaaaaggagaataacaatcggtggggcgaatatcacccatactctaacgtcctgtggctgcactacctgacggataagatgctgaagcagatgacgttcaagaccaagtgtaatacacccgccatgaaacaaatcaaaaggaaaattcaggagtttcaccggaccatgttaaacttctcctcagccaccgatctactgtgccaacactcactctttaagtag

SEQ ID NO: 23549 - DNA, 765 bp, Artificial Sequence
  Description of Artificial Sequence: Synthetic coding sequence
atggtgcgggaggccaacatcaagcaggccaccgccgagaagcagctaaaagaagcccagggaaaaattgacgtgctgcaggcggaggttgcagcacttaaaaccttggtattgtcttcttcccctacttcccctacacaggagccattaccaggggggaagacaccattcaagaaaggccacaccaggaataagtccacttctagcgccatgtctggatcacaccaagacctctccgtgatccaaccaattgttaaggactgtaaggaggcagacctttctttgtataatgaattcagactgtggaaggacgaacctacaatggacagaacttgcccattccttgacaagatttaccaggaggatattttcccctgtctgactttttcaaagagcgaactagcctccgctgtcctggaggcagtggagaacaatactctgagtatcgaacccgtgggactgcagccaatcagatttgtgaaggcatccgctgtcgaatgtggcggacctaaaaaatgtgctttaactggacagtctaagtcttgcaagcatcgtatcaaactgggtgactcctcaaactattactacattagtcctttttgtcgatacaggattacttctgtctgcaatttcttcacctacataaggtacattcagcaaggcttggtaaagcagcaggatgttgatcagatgttctgggaagtgatgcaattgagaaaagaaatgtcgttagcaaagctcgggtactttaaggaagaactttag

SEQ ID NO: 23550 - DNA, 1077 bp, Artificial Sequence
  Description of Artificial Sequence: Synthetic coding sequence
atgtacgccagccagtggttcctgaccctgttcaccgccaagttcccactctgtatggtgtttcacattatcgatctgctgctgtgcgagggccttaacatcatcttccatgtcgccctcgctctgctgaaaacatccaaggaggacctgttgcaggctgattttgaaggggcacttaagtttttccgggttcaactgcccaagcgctatcgggctgaggaaaatgcccgccggcttatggagcaggcttgcaatattaaggtgcctacgaaaaagctgaaaaagtacgaaaaggaataccagaccatgcgcgaatctcaacttcagcaagaggatcctatggacaggtacaagagagaaaatagaagattacaggaggcaagcatgcgcctggagcaagaaaacgatgacttggcccatgaactggtcactagtaagatcgccctgcgaaacgacttggaccaagccgaggacaaagctgacgtgctgaataaagagctgctgcttaccaagcagcgcctcgtcgagaccgaagaagagaagcgaaaacaagaagaggagaccgcccagctcaaggaagtgttccggaaacaacttgagaaagccgaatacgaaatcaaaaaaaccactgcgattatcgctgaatataaacagatatgtagtcagttgagcaccaggttagaaaagcagcaagctgcctcaaaagaggaattggaagtcgtcaaaggcaagatgatggcctgtaaacactgctcagacatattttccaaagaaggcgccctaaaactggccgccacagggcgtgaggaccaaggaatcgagacggatgacgagaaagattctctcaagaaacaactgcgggagatggaactcgaattggcccagacaaagcttcaactcgtggaggcaaaatgcaaaattcaggagcttgaacatcagcggggcgcactcatgaatgagatccaggctgctaaaaatagttggttctctaagactctaaacagcatcaaaacagctacaggcacacagcctctgcagccagcccctgttacacagccaccaaaggaatcaacttag

SEQ ID NO: 23551 - DNA, 2436 bp, Artificial Sequence
  Description of Artificial Sequence: Synthetic coding sequence
atgcccctgagcagccccaacgccgccgccaccgccagcgacatggacaaaaattccgggtcgaatagttcaagtgcaagttccggaagctctaagggtcagcagcctccacgaagcgctagtgctgggcccgccggtgagtctaaacccaaatctgacggcaaaaatagttctgggagcaaacgttacaaccgcaaaagggaactcagttacccgaaaaatgaaagctttaacaaccaatctcggcgctcctcctcacaaaaatcgaagacttttaacaaaatgcccccacaaagaggcggggggagctcgaagcttttctcctcaagcttcaacggaggccgtcgtgacgaggtggccgaggcacagagagcagaatttagccctgctcagttcagcggaccgaaaaaaattaacctgaatcacctgctcaattttacttttgaacctcgaggccaaactggacactttgaaggctctggccatggaagctggggtaagagaaacaaatggggacataaacctttcaacaaggagctctttctgcaagcaaattgccagttcgtggtttcagaagatcaagactataccgctcatttcgcagaccctgacactctggtgaactgggactttgtcgagcaggtgaggatatgttcacacgaagttcccagttgtccgatatgcttgtaccccccgacggcagccaagatcacaagatgcgggcatattttttgctgggcgtgtatacttcattacctctcccttagtgagaaaacgtggagtaagtgtccaatttgttacagctccgtccacaagaaagatctaaaaagcgtcgttgccaccgagtctcatcagtacgtagttggtgacacaataaccatgcagctcatgaagcgggagaaaggcgtgctggtggctctgcctaagtccaaatggatgaacgtagaccaccccatccacctgggggacgagcagcatagtcagtacagcaagcttctgctggcgagtaaggaacaggtcctgcacagagtggtcctggaggagaaggtagcgctagagcagcagctggccgaggaaaaacatacacccgaatcgtgcttcatcgaagctgccatacaggagctgaaaaccagagaggaggccctgtcaggactcgccggctcaaggcgagaagttacaggggtggtggctgctctggagcagctggttcttatggcccctctcgccaaagagtcagtttttcagccgagaaaaggtgtgctggagtacctgagtgcctttgatgaagagaccaccgaggtgtgtagtctcgatacaccatcccggcctctcgccctgcccctggtggaggaggaggaggctgtatcggaacccgagccggagggccttcccgaggcatgcgacgatcttgaactagccgatgataatctgaaggaggggactatctgcacagagtcctcacagcaggaacccattaccaagtcaggctttactcgcttaagttcctcaccatgttattacttctatcaagctgaagatggtcagcacatgttcctgcatcccgtgaatgtccgctgtctggttagggagtacggtagtctggagagatcccccgagaaaataagcgctactgtcgttgagatcgccggctattccatgtctgaagacgttagacaacgccaccgatatcttagtcacttgcccctcacatgcgagttttccatctgtgagcttgccctccagccaccggtcgtgtccaaagagacattagaaatgttcagtgatgatattgagaagaggaagcgccagaggcagaaaaaggcaagggaagaacgtaggcgagagcggaggatagaaattgaagaaaacaaaaaacagggcaagtaccccgaagtgcacattcccttggaaaacctacaacagtttccagctttcaacagctacacatgcagctctgactcagcactgggccctaccagcaccgagggacatggagccttgtcaatctctccgctttctaggagcccaggcagccacgctgacttcctgctgacccctttgagccccaccgcttcgcagggcagtccttctttctgcgtaggatctctggaagaagactctccatttcctagctttgctcagatgctgagggtcgggaaagcaaaagctgatgtatggccaaaaaccgcgcccaagaaggacgaaaactcgctggttcctccagcacccgtggactcagacggcgaatcagacaacagcgacagggtccctgtcccgagtttccaaaatagcttttcccaggcaatcgaggcagcctttatgaaattggacactcctgcaaccagtgacccgttgagtgaggagaaagggggcaagaagaggaaaaagcagaaacaaaaactgttgttttccacctccgtcgtgcatactaaatag

SEQ ID NO: 23552 - DNA, 5826 bp, Artificial Sequence
  Description of Artificial Sequence: Synthetic coding sequence
atgaagaccagcgacctggtgcccagcttcggctacttcatccggtccccagagaaacgcgaacctattgcacttattaggaaatctgacgtgagcagaggtaacctggagaaggagatggctcatctcaatcacgatctgtactctggtgacctcaatgagcaaagtcaagcacaactcagcgagggctctatcacacttcaggtggaggcggtggaatcaacaagccaggtggacgagaatgacgttaccctcaccgcagacaagggcaagaccgaggacaccttcttcatgagcaataagccccagcgctataaggacaagttacccgactctggggatagcatgttacggatctctacaattgcctccgccattgctgaggcaagcgtgaacaccgatccttcacagctcgcagccatgatcaaggcgctatccaataagaccagagacaaaacttttcaagaagatgagaagcaaaaggattactcccacgtgcgacatttcctccccaacgatcttgaaaagtccaatggcagtaatgccctggatatggaaaagtacctgaagaaaactgaggtctccaggtatgagtctgccttggagaacttttcacgagccagtatgagcgacacctgggatctgtccctccctaaggagcagacaacccaggatatccatccagtcgatctatctgccacttccgtctccgtgcgggctcccgaagaaaacaccgccgcgatagtttatgtcgaaaacggggaaagtgagaatcaggagagttttcggacgatcaatagcagcaacagtgttaccaaccgtgaaaacaactccgccgttgtcgacgtgaaaacttgtagtattgataacaaactgcaggatgtcggcaatgatgagaaggccaccagcatctctacaccctccgactcctattcatcagtgaggaatccccgtattacatccctttgtctccttaaagattgtgaggagattcgcgataatcgagagaatcaacgacaaaatgagtgtgtgtcagaaatctccaattcagagaaacacgtaacctttgagaaccaccggatagtgtcccctaaaaattctgatctaaaaaacacctctcccgagcatggcggcaggggctccgaggatgagcaggagagttttaggccctcaacctcccccctttcccacagtagcccatccgaaattagcggtaccagcagcagcgggtgtgcactcgaatcctttggatccgcggcccagcagcagcagcctccgtgcgaacaagagctgtcccccttggtgtgttccccagcaggcgtctctcgcctcacgtacgtgtccgaacctgagtccagttaccccaccacagctaccgacgacgcacttgaagatcgcaaaagcgatataacctccgaattgagcacaaccattatccaggggagcccagctgctctagaggagagagctatggagaaactgagggaaaaggttcccttccagaatcggggaaaaggaacattgtctagtattatccagaataattcggatacccggaaagcaactgaaaccacctccctgtcatccaagcccgagtacgtcaaaccagattttaggtggtccaaagacccgagcagcaagagcggcaacctcctagagaccagcgaggtgggttggacctccaatcccgaagagctggatccaataaggctggccctgttaggtaagagcggcctgtcatgtcaggtcgggagcgctacatcccatccagtatcatgccaggaacccattgacgaagaccaaagaatctcacccaaggataagagcacagctggaagggaattctccggtcaggtttcccaccagacaacttctgaaaatcagtgcacccctatacctagctcaaccgtgcattctagtgtcgccgacatgcagaacatgcctgccgcggtccatgccctgctgactcagccaagcctgtccgccgccccattcgcccaacggtacctcggaaccctgccttccacgggttccactaccctccctcagtgtcacgcgggcaacgctactgtctgcggattttctggcggcctgccttatcccgccgtcgctggggagccagtgcagaacagcgtggccgtggggatatgcctcggtagcaacattggctccggttggatggggacttcctccctgtgcaatccgtactcaaacactctgaaccagaacctgctgtcgacgactaaaccatttcccgtgcccagcgtgggaacaaactgtggcatcgaaccctgggatagcggcgttaccagtggactaggctctgttcgcgtgccagaggaactgaaattgccgcacgcttgctgtgttggcatagcttctcagacccttctgtccgtgctgaatccaacggaccgctggctgcaggtgtctattggtgttttatctatcagtgtgaatggggagaaagtagacttgtcgacatatcgttgtctagtgttcaagaataaggccattattagaccccatgcaactgaggagatcaaagtgctgttcattccttcttctccgggcgtttttcggtgcactttttctgtcgcaagttggccctgttccaccgatgctgaaactattgtccaagctgaagcactggcctctaccgtaaccttgactgccatcgctgaatcgcccgttattgaagtcgagactgagaagaaggatgtcctcgacttcggggacctgacatacggaggatggaaggctctcccactgaagctgattaaccgcacacacgccaccgtgccaatccggcttattattaacgccaatgcagtcgcatggagatgtttcactttctccaaagaatccgtgcgggcccctgtggaagttgctccttgcgccgatgtcgtaactaggttggccggaccctccgtcgtcaatcacatgatgcccgcttcttatgacggtcaggaccctgagtttctgatgatctgggtcctgtttcacagcccaaagaaacaaatatcctcttcagatattctggacagcgcagaggagtttagtgccaaggtcgacattgaagtcgacagccccaacccaacaccagtgctgcgaagcgtcagtctccgcgcccgtgccggaattgccaggattcatgctccaagggatctgcaaaccatgcattttctggccaaggtggcttcctcacgcaagcagcacctccctcttaagaatgctggaaacattgaggtgtacttagatattaaggttcccgagcagggctctcatttctccgtggacccgaagaacttacttctgaagccgggagaggagcatgaagtgattgtgtccttcacgccgaaggaccctgaagcctgcgaggagcgaatcctgaagatctttgtgcaaccttttggaccacagtatgaagtcgtgctaaaaggcgaggttatcagttcaggtagcaaaccattatctccgggaccttgccttgacataccaagtatcctgtctaataagcagttcctggcatggggcggcgttccactcggccgtacccagcttcagaagcttgccctgcgaaataactcagcctccactacacagcacttgaggctgttgataagagggcaggaccaggactgctttcaactccagaatacattcggaagcgagcaacgattaactagcaattgtgaaatccggatccatcccaaggaggatattttcatctcagtgctgtttgcacccactagactcagctgcatgcttgcccgcctggaaattaaacaactgggcaaccgcagccagccgggtatcaagttcactatcccgctgtccggctacggaggcacttccaatttaatccttgaaggcgtgaaaaaattgagtgatagttacatggtaacagtgaatggtctggttcccgggaaagagtccaaaattgtgttcagtgtgcgcaacacgggctcaagagccgccttcgtcaaggcagtcggctttaaggattcacagaaaaaggttttgcttgatccgaaggtgctaagaatattcccagataaattcgttctcaaggaaaggacccaagagaatgtgacactgatctacaacccatctgataggggaattaacaacaaaacagccacagagctgagcacagtatatctcttcggaggtgatgagatatctcgtcagcagtaccgtcgggcattgcttcacaaacccgagatgatcaagcaaattttgcccgaacatagtgtgttgcagaacatcaactttgtggaggccttccaagacgagctgctagtgacggaagtctacgatcttccccagagaccaaatgacgtgcagcttttctacggttctatgtgtaagattatcctaagcgtgattggcgaatttcgtgattgcatatcgtctcgggagttccttcaacccagtagcaaagcatcgctggagtctacctcagacctcggcgcctctggcaagcacggcggaaacgtgtccctggatgtcctcccagtgaagggcccccagggcagtcccctgttgagccgagccgcccggcctcccctggatcagttggccagtgaggagccctggacggttctgccggaacatttgatcttagtcgcaccaagtccctgcgacatggcaaagactgggcgattccagatagtgaataatagcgttcgacttctgagattcgaattgtgctggccggcacattgtctgaccgtcacccctcagcatggctgtgtcgcccccgagtccaagctgcagattttggtgtcgccaaactcttctctgtccacaaaacaatccatgtttccctggtcagggctgatatatatccattgcgacgacggccagaagaaaattgtgaaggtgcagatcagagaggacctgacacaggtagaactgctgacaagactgaccagcaagccattcgggattttaagtccagttagtgagccttccgtcagtcacctggtaaaacccatgacgaaaccaccctcgaccaaagtggagattagaaataaatcaatcacttttccgaccactgaaccaggagaaacctccgaaagttgcctggagttggagaaccatggcactaccgatgtaaaatggcatttatcctcccttgctcctccctatgttaagggggtggacgagagtggcgatgtgtttcgggccacttatgccgcctttcgatgtagtccaattagtggcttattagagtcccacggcattcagaaggtgtcaattaccttcttgccacgagggagaggcgactatgcccaattttgggacgttgaatgccatcctttaaaggagcctcatatgaagcacactctgaggttccaactgagcggacaaagcatcgaggccgaaaacgagccagaaaatgcttgcctgtccaccgactcgctgatcaagatcgatcacttggtgaagcccaggcggcaggcagtatccgaggcgtctgcccgaataccagagcaactcgatgtaaccgcgcggggggtttacgccccagaggatgtctacaggttccgacccactagcgttggagagagccgtactttgaaggtgaaccttcgaaataattcctttattactcattctctgaaattcctgtcgcctcgggaaccattctacgtaaagcattccaaatactctctgagggctcagcattacataaacatgccagtccagtttaagccaaaaagcgccggtaagttcgaggccctgctagtaattcagacggacgaggggaaatctatcgccatccgtttaatcggcgaggccctcggcaagaactag

SEQ ID NO: 23553 - DNA, 4167 bp, Artificial Sequence
  Description of Artificial Sequence: Synthetic coding sequence
atggcccccggctgcaagaccgagctgcggagcgtgaccaacggccagtcgaatcaacccagtaatgagggggacgccatcaaagttttcgtgagaattcgacccccagcagaacgtagcggatccgctgatggcgagcagaacctgtgcctgtccgttttatcctccacgagcctacggttgcacagcaaccccgagcctaaaaccttcacgttcgatcatgttgctgacgtagataccacacaggaatctgtatttgcaacagtggccaagtcaatcgtggagtcctgtatgagcggatacaatggcaccatttttgcttacggtcagaccggttccggtaagacctttacgatgatgggccccagcgagtcggataatttttcccataatttgaggggtgtgataccgcggagctttgagtacctcttttctctgattgatcgagagaaggagaaagctggggcaggtaagagtttcttgtgtaaatgctctttcattgagatttacaatgaacagatctatgacttactggattccgcatcagcgggtttatatctgcgtgagcacatcaaaaagggcgtctttgtggtgggcgctgtggagcaggtggtaacaagtgcagccgaggcctatcaggttctatctgggggatggcgcaacagaagagtcgcgtccacaagtatgaacagggaatcttcccggagtcacgcggtgttcaccattaccattgagtctatggaaaaatccaacgagattgtgaatattcgaaccagcctgctgaacttggttgatcttgcggggtcagagcgccagaaagatacgcatgcagaaggcatgcgcctgaaggaagccggtaacattaacaggagcctttcttgtctcggtcaggtgataacagcgcttgttgatgtcggtaacggaaagcagcggcacgtttgttatcgggatagcaagctgacctttctgctgcgggattcactgggggggaacgcaaagacagcaatcatcgccaatgtgcatcctgggtcgagatgcttcggagagaccctgtccacattgaattttgctcagagagcaaagctgattaagaataaagccgtggttaatgaagacacacaaggaaatgtgtcacagctccaagccgaagtgaaacgccttaaagagcagcttgccgaacttgcttccggacagacaccacccgagtcctttctgacgagagacaagaagaaaactaactatatggagtacttccaagaggcgatgctgtttttcaagaagtcagaacaagaaaagaagtctcttatcgagaaggtgactcagttggaggacctgactctaaaaaaggaaaagttcattcaaagcaacaagatgatcgtgaaattccgggaagaccagatcattagactcgaaaagctgcacaaggagagtcgagggggatttctgccagaagagcaggacagactgctgtctgaattaaggaacgaaattcagactctgagggagcagatcgaacatcacccacgcgttgccaaatacgccatggaaaaccactccttaagagaggagaacagaaggcttcgcctactcgaacctgttaagcgcgcccaagagatggacgcgcagacaattgctaaactggagaaggctttcagtgaaattagcggcatggagaaaagtgacaaaaaccagcagggtttctcccccaaagcccaaaaagagccctgcttgtttgctaacacagagaagctgaaagctcagttgctgcaaattcaaacggaactcaacaactcgaagcaggagtatgaggaatttaaggagctgacccgcaaacgccagctggagctggagagtgagctgcagtcccttcagaaggcaaacctcaatctagagaacctgctggaggctacgaaggcttgtaagcgccaggaggtgtctcagttaaacaaaattcacgccgaaaccttgaaaatcatcactacccctaccaaagcctaccagctgcattctcgcccggtgcccaaactgagccccgagatggggtccttcggatccctctacactcagaatagttctattctggataacgacattcttaacgagcccgtgcctcccgagatgaacgagcaggcctttgaggctatttcagaagagttgagaaccgttcaggagcaaatgtcagcgctgcaagctaaactggacgaagaggaacacaaaaacctgaaactgcagcagcacgttgataagctagagcatcacagcacacaaatgcaggaacttttcagttctgaacgaatcgattggacgaagcagcaagaagaacttctctcccaactgaacgtattggagaagcagctccaagaaacacagacgaagaacgattttttaaagagcgaagtacatgacctgcgagtggtgctgcattccgccgataaggaactatcttctgtgaagttagaatactcgagcttcaaaacgaaccaggagaaggagtttaataaactgtccgaacggcacatgcacgtgcaactacagctggacaatctgcgacttgagaacgagaaactcttggaatccaaagcatgtctgcaggattcctacgacaacttgcaggagataatgaaattcgagatcgatcaattatcaagaaatctccagaactttaagaaagaaaacgaaaccttgaagtctgatttaaataatctgatggaactgctggaggccgagaaagagagaaacaacaaactgtcactgcagtttgaagaagacaaagagaatagcagcaaggaaatccttaaagtcctcgaagctgtaaggcaggagaagcagaaggaaactgccaagtgtgagcagcagatggccaaagtccaaaaactggaagaatctctgcttgcaactgagaaagtgatctcttcgttagaaaagagtagggattccgacaaaaaggtggtagcggatttgatgaaccagatccaagagcttaggaccagtgtgtgcgagaagaccgaaactatcgatacactgaagcaagagctcaaggatatcaattgcaaatacaacagcgccctggtagacagagaggagagccgagtactcatcaagaagcaagaagtagatatcctcgacctaaaggagacattacggctgcgcatactgagtgaagacattgagagggatatgctctgtgaagatctggcgcatgctaccgagcaattgaatatgctgactgaggcatctaaaaagcattctggtctcctacagtccgcccaagaagaactcactaagaaggaggcactgatccaagagcttcagcacaagctcaatcagaaaaaagaagaagtggagcagaagaagaatgaatacaactttaaaatgcggcagctggagcatgtgatggactctgcagccgaagacccacagagtcctaaaacgcccccgcatttccagacccacctcgcaaagctcctcgagactcaggagcaggagattgaagacggccgagcttcgaaaacaagtctggagcacttagtcaccaagctgaacgaagaccgtgaggtgaagaatgccgagatcttacggatgaaggaacagctgagggagatggagaacttaagacttgagagccagcagttgattgagaagaactggctgttgcaagggcaactggacgacattaagaggcagaaagaaaatagcgatcagaaccacccagataatcaacagctcaagaacgagcaagaggagtccatcaaagagagactggcaaaatctaagattgttgaggaaatgctcaaaatgaaggctgacttagaagaggtacaaagcgctctatacaacaaagagatggagtgcctccggatgactgatgaagtagaaagaacacagactctggaatcaaaagcttttcaagaaaaggagcagctgcgcagcaaacttgaagaaatgtacgaagaacgggaacgaacctcccaggaaatggagatgttgaggaaacaggtggagtgtttggctgaagagaacggcaaactcgtgggacaccagaacctccaccagaagattcagtatgtggtgaggctcaagaaggagaatgtacgcttggcagaggaaacagaaaaattgagagctgagaatgtgttcctcaaggagaaaaagcggagcgagagctag

SEQ ID NO: 23554 - DNA, 4767 bp, Artificial Sequence
  Description of Artificial Sequence: Synthetic coding sequence
atgctgccccccaagcacctgagcgccaccaagcccaagaagagctgggcgccaaacctgtacgaacttgactccgatctcaccaaggaaccagacgtgatcatcggcgagggtcctacagactcagagtttttccaccagcgattccgtaacctcatttacgtcgagttcgttggtcccaggaagaccttaatcaagctaagaaacctgtgcctagactggctgcagcccgaaacaaggacaaaggaggaaatcatagagctgctggtgctcgaacagtaccttaccatcatccccgagaaactgaagccttgggtgcgcgccaaaaagccggaaaactgcgagaagctggtgactctcctggaaaattacaaagaaatgtatcaacccgaagacgataacaattcggacgtgaccagcgatgatgacatgaccagaaatcgccgcgagtcttccccccctcattccgttcactcattctctgatagagactgggaccgcagaggtcgttctagggacatggaaccacgcgatcgctggagccacactaggaatccacggagccggatgcctccacgggatctgtctttacctgtggttgccaagacctccttcgagatggatcgcgaagacgacagagattctagggcatatgagtccagatcccaggatgctgagagttatcagaacgtggttgatctggccgaggacagaaaacctcataatactatccaggacaatatggagaattacagaaagttgctcagtctggtccagctggccgaggacgatggccatagtcatatgacccagggccattctagcagatcgaagcgtagcgcgtacccaagcacgtctcgtggactgaagaccatgcccgaggccaaaaagtcaactcatcgtagaggaatctgtgaggatgagtcatcccacggggtaatcatggagaagtttatcaaagacgtctcccgatccagcaagtccggacgcgcgagagaaagctctgaccgttctcagcgattcccgagaatgtctgacgacaattggaaggatatttccctcaataagagggaatccgtgatacagcaacgtgtttatgaaggtaacgcttttaggggcgggtttcggttcaactctacgttagtaagccggaagcgggtcttagaacgcaaacgcaggtatcattttgatactgacggaaaggggagcattcacgatcagaaagggtgtcctaggaaaaagccattcgagtgcgggagcgaaatgcgcaaggccatgtcagtatcctctttgtcaagtctgagctccccaagctttacagaaagtcagcccattgatttcggagcgatgccttacgtgtgtgacgagtgcggcagatctttctctgtcatatcagagtttgttgagcatcagattatgcacacccgagagaacttgtacgagtacggtgaaagctttattcatagcgtggcagtgtccgaagtgcagaagtcccaggtgggcgggaagcgatttgagtgcaaggactgtggagagacttttaataaaagtgccgccctggccgagcatagaaagatccacgcacgtggatatcttgtagagtgtaagaaccaggagtgcgaggaggccttcatgccttcacctacattcagcgagctccagaagatctatggtaaggataaattttatgagtgtagggtctgcaaggagacgtttttgcactcctcagccctgattgaacaccagaagatacacttcggtgatgacaaggacaatgaaagggagcatgaacgggaacgagagcgggagaggggcgagactttcaggccaagtccagcactgaacgagttccagaagatgtatgggaaagagaagatgtatgagtgtaaggtgtgtggggagaccttcctgcatagcagcagcttaaaggagcatcagaaaatacatacacgagggaacccattcgaaaataaagggaaggtctgtgaggagacattcatacctggtcagagcctgaagagaaggcagaagacgtacaacaaggagaagctgtgtgactttacagacgggagggacgcatttatgcagtctagcgagctgtctgaacatcagaagatccactctaggaaaaatctcttcgaggggcgcggatatgagaaaagtgtcattcattcaggaccattcactgaaagtcaaaagagccacaccataacacgccctctggagagcgacgaggacgaaaaagccttcacaatctctagtaacccatacgagaaccagaagatacccacaaaggagaatgtatatgaagcaaaatcctatgagaggtctgtcattcactcactagctagcgtggaggcacagaagtctcactctgtggccggaccctccaaacccaaggttatggctgagagtacgatccagagcttcgatgctattaaccaccaacgggtccgcgccgggggcaacaccagcgaaggtcgcgagtatagcaggtccgtcattcactccctggtggccagtaaaccccccaggagccataacggcaatgagctggtggagtcaaacgaaaagggggaatccagcatctatatatccgatttaaacgacaaaaggcagaaaatccccgctcgggaaaacccctgcgaggggggctcaaaaaacagaaactacgaagacagtgtgatacaatcagtgtttcgggctaaaccccaaaaaagcgttcctggcgaagggagcggggagttcaagaaagacggggaatttagcgtcccctcatccaacgtgagagagtaccagaaagctcgcgctaagaagaaatacatcgagcatcggagtaatgagacttcagtgatccatagcctgccatttggagagcagacatttaggcctaggggcatgttgtatgagtgtcaggaatgtggggagtgttttgctcattcttcagacctgacagagcatcaaaaaatccacgatcgcgagaagccatctggaagcagaaactatgaatggtccgtgatccggtccctggcccctacggatcctcaaaccagctacgctcaggagcaatatgctaaggaacaggctcggaacaagtgcaaggacttccggcagttcttcgctacaagcgaagatctaaacactaaccagaaaatctatgatcaggagaaaagccatggagaagagtcccagggagagaacactgacggggaggagactcacagtgaagaaacgcacggacaggagaccatcgaagacccagtcatccagggcagtgacatggaagatccacagaaagacgatcctgacgacaaaatctatgagtgcgaggattgtggactgggatttgtggacctgaccgacctgaccgatcaccagaaggtgcatagtcgaaagtgcctggtggactcacgggagtacacacattcagttattcacacgcacagcatctcagagtatcagcgtgattatacaggcgaacaattgtacgagtgtcctaagtgcggggagtccttcatccattctagttttttattcgaacaccagcggatccacgaacaggaccagctgtattcgatgaaagggtgcgacgatggctttatcgccctgttgccaatgaagcctcgccgcaaccgcgctgccgagaggaaccccgctctcgccggctctgcaattcgatgcctgttgtgtggccaaggattcattcatagcagtgctttaaatgaacacatgcggctgcaccgggaagacgatttgttggagcagtcacaaatggcggaagaggccatcatcccagggttagcactaaccgagtttcagcgcagccagaccgaggagcgccttttcgaatgtgctgtgtgcggcgagtcgttcgtcaaccccgctgagttagccgatcacgtgacggtacataaaaatgagccctatgaatacggtagcagctacactcacacctcgtttcttacagagccgctcaagggtgctatccccttttacgagtgtaaggactgcggtaaatccttcatccactctacggtgttgacaaaacataaggagctgcacctggaggaggaggaggaggatgaggctgcagctgctgccgctgcagcagctcaagaggtagaagcaaacgtgcacgtccctcaggttgttctgaggatccaggggcttaatgtcgaggctgcggaaccagaagtggaggcagctgagccagaagtcgaagcagcggaaccggaagtggaggccgccgagcccaacggcgaagctgaaggcccagatggagaggccgccgagcctattggcgaagctggccagcctaatggagaagcagagcaacctaacggagatgcggatgaacccgacggcgccgggattgaggatccagaggagagggcagaagagcccgagggcaaggccgaggaaccggagggcgacgcagacgaaccggacggtgtaggaatagaggacccagaagagggcgaagatcaagagatccaggtggaggagccttattacgactgtcacgagtgtaccgaaacttttaccagcagcacagctttttctgaacacctgaagacacatgcttcaatgattattttcgaacctgccaacgcctttggagaatgcagcgggtatatcgagcgggcctccacgtcgactggcggggcaaatcaggctgatgagaagtatttcaaatgtgatgtgtgtggccagctctttaacgacaggctgtccctggctcgccatcagaatacacacactggctag

SEQ ID NO: 23555 - DNA, 2508 bp, Artificial Sequence
  Description of Artificial Sequence: Synthetic coding sequence
atgggcaactacaagagccggcccacccagacctgcaccgacgagtggaagaagaaggtgtccgaatcctacgtgatcactatcgagcgcttggaagacgatctgcagattaaagagaaggaactcacagagctcaggaacatctttggcagcgatgaggcgttcagcaaagtgaacctgaattaccggaccgaaaatggcctcagcctgctgcatctatgctgtatatgcggcgggaaaaagtcgcacatcaggacgctaatgctgaaagggctccgcccttcccggctgacccgtaatggcttcaccgcgcttcatttagccgtttataaagacaatgccgaactgattacaagtctgctgcacagcggcgccgatattcagcaggtgggctacggcggcctgacagcccttcacatagccacaatcgccggtcatctagaagccgccgatgtgcttctgcaacatggagcaaatgtcaatattcaggatgccgtattctttaccccactgcatatagctgcttattatggacacgagcaggttacccgcctactcctgaagttcggcgccgacgtgaacgtgagtggcgaagtcggggataggcctctccatctcgcatcggcgaaaggctttctgaacattgccaaactgctgatggaggaagggagcaaagcagacgtgaacgcccaggacaatgaggatcacgttccccttcacttttgtagcagattcggccatcacgacatcgttaaatacctccttcagagtgatctggaagttcaacctcacgtcgtgaatatttacggcgacacaccgctgcacctggcttgctacaacggtaaatttgaagtggccaaggaaataatacagatctctggaaccgaatcactgactaaggagaacattttctcggagacagcctttcacagcgcctgtacctacggaaaatccatcgatctagtaaagtttcttttagaccagaatgtcatcaatatcaaccaccaggggagagacggtcacacagggttgcacagcgcatgctaccacggtcacataaggcttgtccaattcctgcttgacaatggagctgacatgaatctagtggcgtgtgatccctctcgaagctctggtgaaaaggatgagcagacctgtctcatgtgggcctacgaaaaaggccacgacgcgatcgtcacgctgctgaagcattacaaaaggccccaggatgagctgccgtgcaatgaatactcccagcccgggggcgacggtagctatgtgtccgtgcctagcccattaggaaagattaagagcatgactaaagaaaaagcagatatattactccttagagcgggtctacccagccattttcacctgcaattgtctgagatcgaattccacgaaattataggcagtgggtccttcggaaaggtttacaagggtaggtgtagaaataaaattgtcgccataaagcgatacagggctaacacctactgcagcaagtcagatgtggatatgttttgtagggaagttagcattctgtgccagctgaatcacccctgcgtgattcagttcgtgggagcctgtctcaatgacccatcacaattcgcgattgtgacgcaatatatctcaggcggttctctcttctcactcctccacgaacagaaacgtattctggaccttcagagtaagctgatcatcgccgtggatgtagccaaaggcatggagtatctgcacaaccttacgcagcctattattcacagagatcttaattcgcacaacattttattgtatgaggatggacatgccgttgtggcggattttggggaatccagatttctccagagcctcgatgaggataacatgactaaacagcctggcaacctgcgctggatggcacctgaggtattcacacaatgcacaaggtacaccataaaggccgacgtcttctcatacgcactatgcctctgggagattctgacaggggaaataccttttgcccacctgaaaccagcagccgctgcagccgacatggcatatcatcacatcaggccccccatagggtacagtatcccgaagcccatttcaagtctccttataagaggctggaatgcctgtccagagggcaggcctgagtttagtgaggttgtgatgaaattggaggagtgcctatgtaatatcgaactcatgagcccagcctcatccaacagctcaggcagcctgtcaccctctagttcgtctgattgtcttgttaaccggggtgggcctggtcggagccacgttgctgctttaaggagtcggttcgagctggagtacgctctaaatgcccgaagttatgctgctctaagccagagcgcaggtcaatattcctcccagggcttatccttagaggagatgaagcgcagcctacagtataccccgattgacaagtacgggtacgtgtctgaccccatgagttcaatgcactttcactcatgtaggaattccagctctttcgaggacagctcctag

SEQ ID NO: 23556 - DNA, 1767 bp, Artificial Sequence
  Description of Artificial Sequence: Synthetic coding sequence
atgaacaccagcatcccctaccagcagaacccctacaacccccggggatcgtctaatgtcattcaatgttaccgctgtggtgacacttgcaaaggagaggtagtgcgagtccacaacaatcattttcatattcgttgtttcacctgtcaagtgtgtggctgcggcctcgcgcagtctggctttttcttcaagaatcaagaatatatatgcacacaggattatcaacagctgtacggcactcgatgcgattcatgtcgagacttcattaccggagaggtgatttctgcgctggggcggacgtaccaccccaagtgtttcgtatgttcgttatgcaggaaaccgttcccgataggagataaagtgacattctccggcaaggagtgcgtgtgccagacctgtagccagtccatggcatcaagcaaacctatcaaaatacggggcccttcccactgtgcagggtgtaaggaggagatcaaacacgggcagtcccttttagcgttggataaacagtggcatgtgagttgcttcaagtgtcagacctgttccgttatcttgactggggagtacatctcaaaggacggggtaccctattgtgagtccgactatcacgcacagttcggcatcaagtgcgaaacatgcgatcgttatatcagcggaagagtcctggaggctggggggaaacactaccaccccacctgtgctcgttgcgtccgctgccatcagatgttcaccgaaggcgaagagatgtacttgacaggcagtgaggtttggcaccccatctgtaaacaagctgccagagcagagaaaaagttaaagcaccgtcgcacctccgagacaagcataagtcctcccggatcatcgatcggatcacccaacagggtcatctgcgatatctacgagaatctggatctcaggcagcgaagagctagctctcccggatacatcgactcccctacatactcccgacagggtatgagcccgacattttcccgtagcccgcaccattattatcggagcgccggcgactccaatatttaccgcaaaccccctatatataaaaggcacggggacctgtccacagcaacgaaatctaaaacaagcgaggacatcagtcaaacgtcaaaatactctcctatatacagccctgatccttattacgcctctgaatcagagtactggacatatcatggttcccccaaagtacctcgagctaggcgttttagttcaggtggcgaggaggacgatttcgataggagtatgcacaaacttcagtccggcatcggccggctaatactgaaggaggagatgaaggctcgctcatccagctacgccgacccgtggacccccccaaggtctagtacctcttccagggaagccttacataccgccgggtacgaaatgtccttgaatggaagtccacgctctcattatctggccgattcggaccctctgatcagcaaatccgcttcactgcctgcctacaggagaaatggccttcacaggacccccagcgccgatctgttccactacgatagcatgaacgccgtgaattggggaatgcgggagtataaaatttacccatatgaactgctactagtcaccacccgcggccgcaaccggctgcccaaagacgttgatcggacgcgcctcgagaggcatctgagtcaggaggaattttatcaggtgtttggcatgaccatttctgagttcgaccgcctggcactttggaagcggaacgagctgaaaaagcaggccaggctgttctag

SEQ ID NO: 23557 - DNA, 1050 bp, Artificial Sequence
  Description of Artificial Sequence: Synthetic coding sequence
atggccatccccatcaccgtgctggactgcgacctgctgctgtacggacggggccaccggaccttagatagattcaagcttgatgacgtcactgacgagtacctcatgagcatgtatggctttccacgtcaattcatttattacttagtagagctcctaggagcaaacctcagtaggccgactcagaggtcgcgcgccatttcacctgaaacgcaggtgcttgccgccctcggcttttacacatccggatccttccagactaggatgggagacgccattgggatttcacaggcctctatgagccgttgcgtggcaaatgtgaccgaggctttagtggagcgcgcgtcacagtttatcagattccctgcagatgaggcttcaattcaggccctgaaagatgagttctatggactagccggcatgcctggcgtcatgggggtcgtagactgcatacacgtggcaataaaagctcctaatgctgaggatctttcttatgttaacagaaagggcttgcacagcctcaattgcctgatggtgtgcgatatcagagggactctgatgacagtcgaaacaaattggccggggtccctgcaggattgtgccgttctgcagcagtcctccctctcgagtcagtttgaagcagggatgcacaaagacagttggctactgggggattcatcattttttctacgcacttggctgatgacccctcttcacattccggagaccccagcagagtacagatataacatggctcatagcgccacccattccgtgattgagaagacattccgaactctgtgtagcaggttcaggtgtctagatggcagtaagggagcattgcaatactcgcctgaaaagtcaagccacatcatcttggcatgttgtgtactgcacaatatctcccttgaacatggaatggacgtctggtccagtcccatgactgggccaatggagcagccaccggaagaggaatacgagcatatggagtcactcgatctggaagcggacaggatccggcaagagctaatgctgactcacttctcctag

SEQ ID NO: 23558 - DNA, 1794 bp, Artificial Sequence
  Description of Artificial Sequence: Synthetic coding sequence
atgagcagcaagggcagcagcaccgacggccggaccgacctggccaacggatcattgagtagctccccggaggagatgtctggggctgaggaaggccgcgaaacaagcagcggaatcgaagtggaggcttctgatctcagtctctccctgaccggcgacgacggcggacctaaccggactagcaccgagtccagaggtactgacaccgaatcgagcggggaggacaaggattcagattctatggaagataccggacattattccataaacgacgagaacagagtgcacgaccgctctgaggaagaggaggaggaagaggaggaagaagaggaggagcagcctcgacgaagggtgcagcgtaagagggcgaacagggatcaggacagcagcgacgatgaacgggccctcgaagactgggtgagcagtgaaacgtcagccctgcctcgtccaaggtggcaggccctcccagcgctgcgcgagagagagctggggtcatcggctcgcttcgtgtatgaagcttgtggggctcgagttttcgtgcagcggttcaggttacagcatggtctggagggccatacaggatgcgtgaatactctgcactttaaccaacgaggcacttggctggcatctggaagcgatgatctgaaagtcgtcgtgtgggactgggtgcgaagacagcctgtgctggatttcgaaagcgggcacaagtctaacgttttccaggctaagtttctgccaaatagcggggactctacactcgctatgtgtgcccgcgacgggcaggtgcgggtggctgagctgtccgcaacacaatgttgcaagaacacgaagagggtggcccagcacaaaggggcgtcacacaaactggccctcgaaccggactctccttgtacattcctgagtgcaggcgaagatgcagtggtcttcaccatcgacctccgccaggaccgacctgcaagcaaacttgtcgtgaccaaggaaaaggaaaagaaagtggggttgtacaccatttatgtaaaccccgctaacacacatcagttcgccgtggggggccgcgaccagttcgtgagaatctatgaccaaagaaaaattgatgaaaacgaaaacaatggggtgctgaagaagttctgtccacaccacttggtgaacagcgaaagcaaggcgaacatcacttgcctcgtctacagtcacgatggtaccgaactccttgcctcgtataatgatgaggatatctatcttttcaattcctcccacagcgacggggctcaatacgttaaacggtataagggccatagaaacaatgctaccgtgaagggcgttaacttttacgggcccaagtcagagtttgtcgtgtccgggtcggactgtggccacattttcctgtgggagaagtcttcctgccagatcattcaatttatggaaggcgacaagggaggcgtggttaactgtttggaaccccatccccacttgccggtgcttgccacctccggactggaccatgacgtcaaaatatgggcgcccacggctgaggccagcaccgaactaaccggactgaaggatgtgatcaaaaaaaataagcgcgaacgggatgaagactcgttgcaccagactgatctcttcgacagccatatgttgtggtttctgatgcaccaccttagacagagaagacatcacagacggtggcgggagcccggggttggggccaccgatgccgatagcgacgagtctcctagcagctccgacacgtccgacgaggaggaagggcctgatcgcgtacaatgcatgccgtcctag

SEQ ID NO: 23559 - DNA, 933 bp, Artificial Sequence
  Description of Artificial Sequence: Synthetic coding sequence
atgagccagcagctgaagaagcgggccaagacccggcaccagaagggactgggtgggagagcccctagcggcgctaaacccagacagggtaagagctctcaggatctccaggcagagatcgagccagtcagtgccgtctgggcattatgcgacggctatgtctgctacgagcctggaccacaagccctgggcggcgatgatttctctgactgctacattgaatgcgttatacgcggagagttcagtcagccgatattggaagaggattctctgttcgaatcactcgagtacctgaagaaagggtctgaacaacagctttctcagaaggtctttgaggcatcatccctagaatgcagcctcgaatacatgaagaagggcgtgaaaaaagaactcccacagaagattgtgggcgagaactccttagaatacagtgagtatatgactggcaaaaagctgcctcccggcggcatacccgggatcgacttaagcgatccaaagcaactcgcagagtttgcccgtaagaagcctcctataaacaaggagtacgactctctgtcagccatcgcttgccctcagtctggctgcactcggaagttgcggaaccgggcggcacttaggaaacacctcctgatccatggccctcgcgaccacgtgtgcgcagaatgcggcaaggcctttgttgagtcctccaaactgaaaaggcacttcctggtacatacaggagaaaaaccgtttagatgcactttcgaaggctgcggcaaaaggttctctttggacttcaaccttcgcactcacgttagaatccacactggtgaaaagaggtttgtgtgtcccttccagggatgtaaccggcggttcatccagtctaataacctcaaggcacatatcctcacccatgcgaacactaacaagaatgagcaggaggggaagtag

SEQ ID NO: 23560 - DNA, 1149 bp, Artificial Sequence
  Description of Artificial Sequence: Synthetic coding sequence
atgctgcggtggaccgtgcacctggagggcggcccccggcgggtgaatcacgctgcagtcgcagtcggccacagagtttattcttttggcggttactgcagcggcgaagattacgagaccctgcggcagatagatgtccatatctttaacgcagtgtccctccgctggacaaaactgccaccagtgaagtctgccataagagggcaagccccagtggtcccatacatgagatacgggcactctaccgtcctgattgatgacacagtgctcctttggggcggacggaatgacacagagggggcttgcaacgtcctctatgccttcgacgtgaacacacataaatggtttactcccagggtctctggaaccgttcctggtgccagggacggacatagtgcctgtgtgctgggcaaaataatgtatatcttcggcgggtacgagcaacaggcagactgtttttctaatgatatccacaaattggatacctctaccatgacctggacgctgatctgcacgaaaggctctcccgcccgttggcgggactttcattccgccacaatgctgggctcgcatatgtatgtgtttggcggccgcgcagatcgattcggcccgtttcactccaataacgagatctattgcaacaggatcagggtgttcgacacacggacagaagcatggctggactgtccacctacccccgtcctccctgagggtcggcgatcccatagcgcctttgggtacaatggtgaactgtacatctttggcggctataacgcccggctgaataggcactttcacgacctgtggaagttcaaccccgtgagttttacgtggaagaaaatcgaacccaaaggaaaaggtccctgtcccagacgccgccagtgttgctgcatcgttggcgataaaatagtgctattcggcggcacctcccctagcccagaagaaggtctgggggacgagttcgatttaatcgaccatagtgatttgcacatcctcgacttttcaccatctctgaagacactgtgtaaactcgctgtaattcagtacaatctggaccagtcctgcctgcctcatgacattagatgggaattaaatgccatgacaactaacagtaatattagtaggcccatcgtgagcagccacggatag

SEQ ID NO: 23561 - DNA, 1827 bp, Artificial Sequence
  Description of Artificial Sequence: Synthetic coding sequence
atggccgccgccgccgccgccgtgggccccggcgccggcggcgccggttccgctgtccccggcggggccggaccatgcgcaacagtgtctgttttccccggcgctcggctcttgaccatcggagacgccaacggcgaaattcagcggcacgccgaacaacaggctttaagactggaagtacgggcaggacccgactccgccggcattgccctgtactcccatgaagacgtgtgtgtgttcaagtgctctgtaagcagagaaactgaatgtagcagagtcggcaaacagtcctttatcatcaccttgggttgcaatagcgtgttgatacagtttgcaacccccaatgatttttgttctttctacaacattctcaagacctgtaggggacatacacttgagcggtccgtcttttccgaacgcacagaagaatctagtgccgttcaatatttccagttctacgggtacctgtcacagcagcaaaatatgatgcaggactacgtgcgaaccggtacatatcagagagctatcctgcagaatcacaccgattttaaagataaaatagtgcttgacgtgggatgtgggagtggaatcttgtcattctttgccgcccaagccggtgcccggaaaatttatgcagtggaagcttctacaatggctcaacacgctgaggtgctagtcaagagtaacaatttgacagacagaatcgtggtcattcctgggaaagtcgaggaggtgtcattacccgaacaagtggacatcatcatttccgagcctatgggctatatgctttttaatgagcgcatgctggagagctatctgcatgctaaaaaatatttgaaacctagcgggaacatgttccccacaatcggtgatgtccacctggctccctttacagatgagcagctgtatatggagcagttcactaaagccaatttctggtatcagccaagctttcacggcgttgatctgtcagcattacggggcgcagccgtggacgaatattttcgtcaaccagtcgtggacaccttcgatattagaatcctgatggcgaaatccgtcaagtacacggtaaacttcctcgaagccaaagagggagacctgcacaggatagaaatcccatttaagtttcatatgctacattccggcctggtacatgggctcgctttctggtttgacgtggcatttatcgggtcaattatgaccgtgtggttgtccaccgcacccacagagcccctgactcactggtatcaggtgagatgcctattccagtcacctctcttcgctaaggcaggagacaccctgagtggaacttgcctactgatcgcaaataagcgccaaagctatgatatatcaatcgttgcacaggtggaccagactggctccaaaagcagtaatcttctcgatctcaagaaccctttctttcgctacacaggcaccactcccagtcccccacctggttcacactacacgtcaccgtcagagaatatgtggaatacggggtccacctacaatctgagttccgggatggctgttgcaggaatgcccacggcctatgatttaagcagcgttatcgcaagcggatcttccgtggggcacaataacctgatccccctggccaatactggaatagtcaaccatactcacagcaggatgggatccatcatgagcacaggcattgtgcagggcagttcgggggctcagggctcaggaggcggtagtacctccgctcattatgcagtgaattcacagttcacaatggggggacccgctatatcaatggcctccccaatgagcatacccactaataccatgcactacggatcatag

SEQ ID NO: 23562 - DNA, 2913 bp, Artificial Sequence
  Description of Artificial Sequence: Synthetic coding sequence
atgcagagcaccgacctgggcaacaaggagagcggcaagatctggcaccgcaagccatcacctgctacccgcgatggcatcatcgtaaatatcatccacaacaccagcgattatcatcctaaagtactgagattcctgaacgtagccttcgatggcacaggagactgcttaatcgccggcgaccaccagggcaatatctacgtcttcgaccttcacggcaatcggttcaacctggtgcaaagaaccgctcaggcatgcacagccctggcctttaacttgagacggaagtcggaatttctcgtcgccctggctgactacagtattaaatgctttgacaccgtgacaaaggagttagtcagctggatgagaggacatgagtctagcgtgttcagtatttcagtccacgccagcggaaaatatgcaatcactaccagcagtgacacagcccagctgtgggatctcgatacctttcagaggaagaggaaactgaacattcggcaatcagtggggattcaaaaggttttctttctcccgctcagcaataccattctctcgtgttttaaagataacagcatcttcgcctgggagtgcgacacacttttttgcaagtaccagttgcctgcaccccctgaatcctcctccatcctgtacaaggtgtttgctgtgaccagggatgggcgcatcctcgccgccggaggcaagtctaaccatctgcacctttggtgtttagaggcccgtcagctattccggatcattcagatgcctacaaaggtgcgcgccattcgccacttagagtttctgccagactcctttgatgctgggtctaaccaagtgttaggcgtattgtctcaggatggtatcatgcggttcatcaatatgcaaacttgcaagctattgttcgaaatcggaagcctcgatgaaggcatctcctccagtgcaatctcccctcacggaaggtatattgcctctattatggaaaacggaagcctcaacatttactccgttcaggcactcactcaggagatcaacaaacccccacctcctcttgtcaaggtgattgaggacctgccgaaaaataagctgtcctctagtgacctgaagatgaaagttacatctggcagagtgcagcagcccgccaagtcccgtgaatccaaaatgcaaacacggatcctcaagcaagacctgaccggcgattttgagtccaagaagaacgagctgccagacggcctgaacaagaagaggctgcagatattactcaaaggttatggtgagtaccccaccaagtacagaatgttcatctggcgcagcttgttacagcttccagagaatcacaccgccttttctaccctcatcgacaaaggcacgcacgtggccttcctgaatctccagaagaagtaccctattaagtcccgaaagctgctccgggtgcttcaaaggaccctgagtgcacttgcacactggtcggtgattttttccgatacgccctaccttcctctgctcgcttttcctttcgtgaaattgtttcagaacaatcagttaatctgttttgaggtcatcgccacactgattattaactggtgtcagcactggtttgaatactttcctaaccctcccatcaatatcttgagcatgatcgagaacgttttagcatttcatgataaggagctcctacagcactttatcgaccacgacattacatcccagctttacgcctggcctctgctggagactgtgttctcagaggtcctcactcgtgaagagtggctgaaactctttgacaacattttttctaatcacccgtctttcttgctgatgacggtggtcgcctataatatttgcagtcgaaccccacttctgtcctgcaaccttaaggacgatttcgagttcttcttccaccaccggaacaatttagatatcaacgttgttatacggcaggtgtatcaccttatggagactacccctacggatattcaccctgactctatgctcaacgtgttcgttgcgctcacgaaagggcagtatcctgtgttcaaccagtaccctaagtttattgtcgattatcagacccaagaacgtgagagaatccgcaatgacgaactggattacctcagggagcggcagacagtggaggatatgcaggccaaagtagaccagcagcgagtggaggatgaggcctggtatcagaaacaggagctgctccgcaaggccgaagagaccaggagagagatgctcctgcaagaggaagaaaagatgatccagcagcggcagaggttagccgctgtgaagagagagttgaaagtcaaggaaatgcatctccaagatgcagctcgcaggaggtttctgaaattacagcaggaccaacaggagatggagttaaggcgactcgatgacgaaataggacgcaaaaatctgaccgaaaatcaggaagctctcgcgaaggagatgagggccgacgccgatgcttatcggcggaaggtggacctggaggaacatatgttccataagctgatcgaggcaggagaaacacaatcacagaaaacgcaaaaatggaaagaagctgaaggcaaggagttccggttaaggagtgccaaaaaagcctcagccctatctgatgcatctcgtaagtggttcttgaaacaggaaattaacgccgcagtggaacatgccgaaaatccatgtcacaaagaagaaccccgattccaaaacgaacaggactcaagctgcctgcctcgaacttctcaactcaacgatagctctgaaatggacccttccactcagatttccctgaatcggagggctgtcgagtgggacacaacaggacagaatttgatcaagaaggttagaaacctcagacaaaggcttacagccagagcacgccatagatgccagaccccccatctgttggctgcctag

SEQ ID NO: 23563 - DNA, 648 bp, Artificial Sequence
  Description of Artificial Sequence: Synthetic coding sequence
atgagctgcaccatcgagaaggccctggccgacgccaaggccctggtggagcgcctccgtgatcatgacgatgccgctgaaagtctcattgagcagaccaccgctctgaacaaacgcgtcgaggccatgaagcagtatcaagaagaaattcaagagcttaacgaggtggcccggcaccggcccagatccacactggtgatggggatacagcaagagaacagacaaatcagggaactgcagcaagagaataaagagctcagaaccagcctggaggaacatcagagcgccctggagctgatcatgtccaagtaccgtgagcagatgttccgcttgctgatggctagcaagaaagacgaccccggaataattatgaaactgaaggagcaacattccaaggagctgcaggctcatgtcgaccagatcaccgaaatggccgcagtcatgcgcaaagctatcgagatcgatgagcagcagggctgtaaagaacaagaacgcatttttcagctggagcaagagaataagggactgagagagattctgcagatcacccgcgaatccttcttgaacctcaggaaagatgacgcaagtgagagtacttccctgtcagctctcgtgacgaatagcgacctttccctgagaaaatcttag

SEQ ID NO: 23564 - DNA, 2676 bp, Artificial Sequence
  Description of Artificial Sequence: Synthetic coding sequence
atggccgtggcccgggtggacgccgccctgccccccggcgagggctccgtggtgaactggtctggccaagggctccagaagctcggcccaaatctcccttgtgaagctgatattcatacactcattctcgataaaaaccagataataaagctggaaaacctcgaaaaatgcaaaagactgattcaactctccgtggccaacaaccgtttggttcggatgatgggggttgccaaactaacactgctccgggtgctcaatttacctcacaattctattggatgtgtggaaggcctcaaagagctcgtccatttggaatggctcaacctggctggaaacaacctgaaggctatggagcagatcaacagctgtactgcgctccagcacctggatctcagtgacaataacatctcccagatcggggatctgagcaaactggtgtcacttaaaaccctgctcctccacgggaacattatcacctctctgcgcatggctcccgcatacctgcctcggagcctggctatcctttccctagccgaaaatgaaatccgggacctgaacgagatcagctttctcgcctctcttacagagcttgagcagctttctattatgaacaatccctgcgttatggcgaccccttccattcctgggttcgactacaggccttacatagtgagttggtgtctgaatttgagggtcttagatgggtacgtcataagccagaaggaaagcttaaaggctgagtggctctacagccaaggcaagggacgagcataccggccgggacagcatatccagctcgtacagtatcttgccaccgtttgtcctctgacctcgacactgggcctacagaccgctgaggacgctaagctagaaaaaatcctctctaagcagcggtttcaccagaggcagctcatgaaccagagccagaacgaagagctaagccctctggtgccggtcgaaaccagggcgtccctcataccagagcattcaagccccgtgcaagattgccagatctcccaggagtccgaacctgtgatacaggtgaactcgtgggtcggaatcaattcaaacgacgaccagttgttcgcagtgaaaaacaactttcccgcttccgttcacacaacacgatatagtcgaaatgacttacacctggaggatatccagactgacgaagacaaactcaattgcagtctcctctcatctgagtccacttttatgcctgttgcctccggtctctcacccctgagcccgaccgtcgaacttcggctgcaaggcataaatcttggtctcgaggatgatggcgtggccgacgaatccgtgaaagggctcgaatcgcaggtgttggataaggaagaggagcagccactctgggctgctaatgagaatagcgtgcagatgatgcggtcagagattaacaccgaagtgaacgagaaagctggtctgctcccctgtcccgaacccaccataatctccgcgatactaaaagacgataatcatagcttgaccttttttccagagagcacagagcagaaacagtccgatattaaaaagcctgaaaacacgcaaccagaaaataaggagacaatcagccaggccacttctgaaaaactgccgatgatcttaacccaacggtctgtggctctgggccaggacaaggtggcactgcaaaaactaaacgacgccgccacaaagttgcaggcctgttggcgggggttctacgcgcggaactacaaccctcaggcaaaagatgttcggtacgaaataagactccgccggatgcaggagcatattgtgtgtctcacagacgaaatcagacggctgaggaaagagagagatgaggaacgcatcaaaaagttcgtgcaggaagaagcattcagattcctctggaaccaaaagtggggtctggccatccttccaaggccagtatcgaatttttgggcacaggccgtctttcctcctcagccgccaaaagtccgaagcctgcaagtctggcagcagactgtggatcaacggctctcaagctggcataccgatgtgccacccattagctccacactggtgcctagcaaacatcctcttttcacccaatcccaggaatctagctgtgatcagaacgctgattggtttatagcgagcgacgtcgctccacaggaaaaaagtcttccagagtttcctgactccggatttcactccagcctcacagagcaagtgcatagcctgcagcactccctcgactttgaaaagtcaagcactgagggatctgagagttccattatggggaactctatcgataccgtgcgctatggtaaagagagtgatctgggcgatgtctccgaggagcacggggaatggaataaagagtcttcaaacaatgagcaggataattcgctgttggaacagtacctcaccagcgttcaacagttggaagacgctgatgaacggaccaattttgatacagaaacacgcgattctaaactacacatcgcctgctttcccgtccagttggacacactttccgatggcgctagcgttgacgagagccacggcatcagccccccacttcagggcgagatatcacagacccaggagaatagcaagttgaatgcagaggtccagggccaacagccagaatgcgactctacctttcaactgctgcatgtgggagtgacggtgtag

SEQ ID NO: 23565 - DNA, 828 bp, Artificial Sequence
  Description of Artificial Sequence: Synthetic coding sequence
atggccgagcccgccagcgtggccgccgagagcctggccggcagcagggccagggcggcaagaaccgtcttgggacaggtcgtactgccaggggaagagctattattacccgagcaggaggatgccgaaggtcccgggggcgcagtggaacgaccactctcactgaatgcgagagcctgcagccgcgtgcgcgtagtgtgtggccctgggctgcgtcgatgtggtgaccggctgctcgtcaccaagtgcggaagacttaggcacaaggagcccggatcgggctcaggcggcggcgtctattgggtggactcccagcaaaagaggtatgtcccggtaaaaggggaccatgtcattggcatagttaccgcgaagagtggcgatatcttcaaggttgacgtggggggatcggagccggcctccctgtcctatctgtccttcgagggcgcgaccaagcgcaataggccgaacgtccaggtcggcgacctcatttatggtcagttcgttgttgccaataaagacatggagcctgaaatggtttgtattgacagttgtggcagagctaatggtatgggagtgatcggacaggacggtctgctctttaaggttaccctcggacttatcaggaaattactcgctcccgattgtgaaatcatacaggaggtgggcaaactctaccctcttgagatcgttttcggtatgaacggaaggatctgggttaaggccaagacaatccagcagactttgatccttgcaaacatcttggaagcttgtgaacatatgacaagtgatcagcggaagcagatattttccagactcgccgagtcctag

SEQ ID NO: 23566 - DNA, 1620 bp, Artificial Sequence
  Description of Artificial Sequence: Synthetic coding sequence
atggccaccagcgcccccctgcggagcctggaggaggaggtgacctgcagtatttgtttggattacctgagagatcctgtcaccatagattgcggccatgtattctgtagatcctgtactacggatgtccggcccatttcgggatctaggccagtatgcccactctgcaagaagccctttaagaaagagaatattcgcccagtgtggcagcttgccagtctcgtcgaaaacatcgaacggttgaaagtggacaagggccggcaacctggcgaagttaccagggagcagcaggatgcgaagctctgcgagcgccacagggaaaaactccattattactgtgaggacgatggcaaactcctctgcgtaatgtgtcgggagtcgagggaacatcgaccccatactgccgtgctgatggagaaagccgcccagccacatagagagaagatactgaaccatctgagcaccctgagacgcgaccgggacaaaatccaggggttccaggccaagggggaggctgacatcttggctgccctgaaaaaactgcaggaccagcggcagtacattgtcgccgagtttgaacaagggcatcagtttcttagggagcgggaggagcacctgctcgaacagctagctaagttggaacaagaactgacggaaggccgggaaaaattcaagtcgagaggcgttggagaacttgctcgactcgccctggtaataagtgaactggaaggcaaagcccagcagccggccgcagagcttatgcaggacaccagagatttcctcaaccgttatccacgaaaaaaattctgggttggaaaaccaatcgcacgcgtcgtgaagaaaaagaccggcgaattttccgacaaactgctgtccctgcaacgaggactccgcgagttccaaggcaagttgctgagagatctggagtacaagaccgtgagcgttacactggaccctcaatctgctagcggatacttgcagttatctgaagattggaagtgtgtgacttacactagcctctataagtcagcctacttacatcctcagcagttcgattgcgagcctggagtacttggcagcaagggctttacctggggcaaggtgtattgggaggtcgaggtcgaacgggagggctggagcgaggacgaggaggaaggcgatgaggaagaggagggcgaagaagaggaggaggaggaggaagccgggtacggagatggctacgatgactgggaaactgatgaagacgaggaatcactcggcgatgaggaggaagaagaggaagaagaagaagaagaagtgctcgagagttgcatggttggggtggcaagagactcagtgaagagaaagggggatctgtccctacggccagaagatggcgtttgggccttaaggctttcttcatctggcatttgggccaacactagccctgaagcagaactttttccagcgctgcggccaagaagggtgggaatcgcactcgactacgagggcggcacagtaacattcacaaatgccgaatctcaggagctgatttatacatttacggctacttttacacgccgcttagttccctttctctggttaaagtggccagggacaagactcctgctgaggccctag

SEQ ID NO: 23567 - DNA, 1233 bp, Artificial Sequence
  Description of Artificial Sequence: Synthetic coding sequence
atgttcaacaacgagctgatggccgacgtgcacttcgtggtgggcccccccggcgctactagaacagtgcccgcccacaaatacgtactcgctgttggatcaagtgtattctacgccatgttctatggggatctggctgaggttaaaagtgaaattcacattcccgacgtagaacctgctgccttcttaattttgctgaagtatatgtattcggatgagattgacctcgaggctgatacagttctggcgactctatatgcagccaagaaatatatcgttccggcacttgccaaggcgtgcgtgaactttctggagaccagccttgaagccaaaaatgcttgcgtgctcttgagccagagcagactcttcgaagagccagaacttacccaacgttgttgggaagtgatcgatgcgcaagctgagatggctctccgtagcgaaggtttctgtgaaatcgaccggcagacactggagattatcgtcacacgcgaagctctgaatacaaaggaagctgtcgtgttcgaggcggtgttaaattgggctgaggcagagtgtaaacgacagggactaccgatcacgcctcggaacaagaggcacgtgctgggacgcgcgttatatctcgtgaggatccccactatgacacttgaggaatttgctaacggagctgcacagagcgacatccttaccctggaagagacccatagcatttttttgtggtatacggccaccaataaacctcgcctggactttcccttaaccaaaagaaaagggttggccccacagcggtgtcacagattccagtcctcggcctacaggagcaatcagtggagatatcgcggcagatgtgatagcattcagttcgccgtggacaggcgggtgtttattgccggactgggcctttacggatcctcatctggaaaagcggagtattccgtcaaaattgagcttaagcggctcggcgtcgtattagctcaaaacttgactaaattcatgtcagatggtagttctaatacatttcccgtatggttcgagcatccggtacaggtggagcaggacacgttttacacagcaagcgctgtgctggacggaagtgagctttcctattttggccaggaaggaatgacagaggtgcagtgcggtaaagtggcctttcagttccagtgcagttcggactctaccaatggtacgggtgtccagggcggtcaaatccccgaactcatcttctacgcttag

SEQ ID NO: 23568 - DNA, 966 bp, Artificial Sequence
  Description of Artificial Sequence: Synthetic coding sequence
atgcgggccctggccgccctgagcgccccccccaacgagcggctgctcccacgcgaccccgctgcaactagggatcccgatgccgctcggcccgcgagaaggtccgcagttgaacggttggctgccgaccgtgcaaaatatgtccggggccgccccggtactgggagaggagttgcctctgagggttccggaccaggtgctatcaagtgccccggcaatgaccctgggcctcctgcaagagcgcccgctcccgttgctagacgtgccatcgctcgcaagccgctgaggcccgatagcctaataatttaccgccaaaaatgcgagttcgtgaggggaagtggtgccgacggccctcgggccagtttagtgaagaagctgtttcagggacccgggaaagacaaagctccagtcccgcgcacaggagacgagggcaaagctggcaacccagaaacagtccctacaactcccggcccggccgccgatccagccattccagaaacacccgcccctgcagcccgctccgccgcgccctcaagtgtgcctgctgcaccaccaggtccagagccccgcgtcgtccgcaggagaggactacagcgctctcagtcagacctttccagcaggtactctgcagcattggcagagtccgacacctttttccagtactgcgggctggatccagaagtagtcgaggccctgggacgcgagaactttaccgcgggctccgactgcgtaactctaaaggtgcggtccgtgtctgttgcaacatctggctccgggttttccagacatagcggaggagatgacgaaggtttgcaggaagaggagcttatagaacaggttcccagtactacatccgtgattgaaagaaatgcccggatcatcaagtggctgtacacgtgcaagaaggctaaagaaacccctagccaggaacagtctcgaacgaggggttccaagccctcaagatag

SEQ ID NO: 23569 - DNA, 945 bp, Artificial Sequence
  Description of Artificial Sequence: Synthetic coding sequence
atgagcgagaacgccgcccccggcctgatcagcgagctgaagctggcagtgccttggggacacattgccgcaaaagcatggggcagcctgcagggccctcccgtgttgtgcttgcatggatggctggataatgctagcagctttgaccggcttattccactgctgccccaggacttttactatgtggctatggatttcggaggtcatggactgtcatctcattacagccctggcgtgccgtactacttacagacattcgtgtctgagatccgccgggtggtggcggccctgaagtggaaccggttctctatcctgggtcactcctttggcggtgttgtcgggggcatgttcttttgtactttcccagaaatggtcgataagctgatcctcctcgatacccccttgttcctactggaatcagacgagatggagaacttgctgacttacaagcggcgagcgatcgagcacgtcttgcaggttgaggcgtctcaggagccatctcacgtgttcagtctgaagcaactgcttcagcgtctcctgaaatccaatagccacctgtcagaagaatgtggcgagcttctgcttcagcgagggacgaccaaggtggctactggactggttttgaatagggatcagaggcttgcctgggctgagaacagcatagacttcataagcagggagttgtgcgcgcatagtatcagaaagctccaggcacatgtactgctgatcaaggccgttcatggctactttgattccaggcagaactattctgaaaaggagagcttgtcctttatgatcgatactatgaaaagtaccctgaaagaacagtttcagtttgttgaggtgcccggcaaccactgcgtgcatatgagtgagccgcaacatgtggcttccattatatcctctttcctccagtgtacacatatgctccctgcccagctgtag

SEQ ID NO: 23570 - DNA, 3945 bp, Artificial Sequence
  Description of Artificial Sequence: Synthetic coding sequence
atggccagcaagggcgccggcatgagcttcagccggaagagctaccggctgacgtccgatgccgagaaaagcagggtgaccggcatagtgcaggaaaagttattgaacgactacctgaacagaattttcagttcctccgagcacgcaccaccagctgcgacatcgcgcaaacccttaaatttccagaacctgcctgaacatctggaccaactcctccaggttgacaacgaggaggaagagagccagggacaggttgaaggaaggctcggccccagtacagtcgtactcgatcacaccgggggcttcgagggacttctgctcgttgatgacgacctgctgggggtgattggtcactctaactttggcactatccgttccacaacatgtgtgtacaaagggaaatggctttatgaagtcctcataagctctcaggggctgatgcaaatcggatggtgcacgatcagctgcaggtttaaccaagaagagggtgttggtgatacccacaattcttatgcctatgatggcaaccgtgtcaggaaatggaacgtgactaccactaactatggcaaagcttgggctgcaggcgacatagtttcgtgcctcatcgacttggacgatgggaccctgtcattttgcttgaacggggtttccctcgggaccgcctttgagaacctttcacgaggtcttggtatggcttactttccagccatctcactcagctttaaagagtctgtcgcgttcaattttggctcccggccgcttagatatcccgttgccggatataggccgctgcaagatccgccctccgctgaccttgtgagggcacaaagactgctgggatgctttcgggctgtgctgtcagtggagcttgatccagtggaggggcggctgctggacaaggaatcatccaagtggcggttgcgagggcagccgactgtgctcttgactttggcccacatttttcatcattttgcgccgctcctgagaaaagtctacctggtcgaagctgtcttaatgagcttcctcctgggcatcgtcgagaaaggaacacccactcaggctcagtctgtggtccaccaggtactggatctgctgtggctgtttatggaggactacgaggtgcaggattgccttaagcagctgatgatgagcctattgcgcctatatcggttcagccctatcgtcccagatctcggcctccaaattcactatttacggcttacaattgcaatcctgcgtcacgaaaagtccaggaagttcctgctctccaacgtactctttgatgtcctacgatctgttgtttttttctatatcaagagccccttgcgagtggaagaagccgggttacaggaactgatacctaccacctggtggccccactgctcctcacgcgagggcaaggaaagtactgaaatgaaggaggagacagcggaggaacggttaagaaggagggcatacgaaagaggttgccaacggctgaggaagcgtatcgaggtggtggaagagctccaggtgcagattctgaagttgctgctggataataaggatgataacggtggcgaggcttctcggtacatctttctgacaaaatttagaaaatttctccaggagaacgccagcggccgcggcaacatgcctatgctgtgccctcccgagtacatggtgtgttttctgcaccggctgatctcggcccttaggtattactgggatgagtacaaggcttcaaaccctcacgcctccttttccgaggaggcctatatcccgccacaggtcttctataacggcaaggtagactattttgatctccagagacttggaggactcctgtcacatcttaggaaaacacttaaagacgacttagccagcaaggcaaatatcgtgatagaccctctggagttacagagcaccgctatggatgatctcgacgaggatgaagaacctgctccagctatggcacaacgcccgatgcaagccctcgcagtgggcgggccccttccgcttccgcggcctggatggctgagctcaccgaccttgggcagagccaacagattcttgagcaccgccgcagtaagtctcatgactcccagaagacctctgagcaccagtgaaaaggtgaaagtccgcactctgtccgtggagcaacggactagggaggacatcgagggctctcactggaacgaagggcttctcttgggtagacctcctgaggagcctgaacagccattaactgaaaacagcttgctggaggtgctggacggtgcagtgatgatgtacaacttgtctgtgcaccagcagctaggtaagatggtcggcgtaagtgatgacgtgaatgaatacgcaatggctctcagagatactgaagataagcttaggcgatgcccaaagcggcgcaaagatatcctagcagagctgaccaagtcccagaaagtcttcagcgagaagcttgatcatctctctcggaggctcgcgtgggtccatgccaccgtatacagccaagaaaaaatgctcgatatctattggcttctgcgggtttgtctgcgaaccatcgaacacggggatcgaaccggctccttatttgcgtttatgccagagttctatctcagcgtggctatcaattcgtatagcgcactcaaaaattacttcgggcccgtccactcgatggaggagcttccaggctatgaagagactctgacacggctggccgcaattctggctaaacacttcgcagacgctcgtattgtggggactgatattcgcgattccctaatgcaagcacttgcctcctacgtatgttatccacactctctccgggccgtcgagaggatcccagaggagcagaggatcgcaatggtgcgcaacctgctcgccccctatgagcaacgcccatgggcccagacaaattggattctcgtgcgactctggcgcggatgtggtttcggctaccgctacacgcggctgccgcatttgctcaaaactaaactggaagacgctaacttaccctccttacagaagccatgcccatccacccttctccaacagcatatggccgacctgctacaacagggacctgatgtagctccgagctttctcaactccgttctgaaccaactcaattgggcattctcggagttcataggaatgattcaggagatccagcaagctgcggagcgtttggaacggaactttgttgactctcgacagcttaaagtgtgtgccacttgcttcgatctgagtgttagccttctgagagtgcttgagatgacaattactctagttcccgagatctttctcgattggacacgcccaacaagcgagatgctgttgcgccggttggcacaattactgaatcaggtcttgaatcgggtcacagctgaaagaaatctgttcgatcgggtggtgacactgaggcttcccgggctggaaagcgtcgaccactatccaattttggtcgcggtaactggtattttagtccagctcttggtcagaggtccagcatctgagcgtgaacaggccacgtcggtactgctggccgacccgtgctttcagctaagatcaatctgctaccttttaggccagcctgaaccacccgcacctggaaccgccttaccagctcccgataggaagagattcagcctacagtcttacgcagactatatatcagccgacgagctagcccaggtggagcagatgctggcccatcttaccagcgcttctgcccaggccgctgctgcctccttgccaacgtcggaggaggatctctgtcctatctgctatgcgcacccaatcagcgccgtttttcagccttgcggacacaagtcgtgcaaagcatgtatcaatcagcacctgatgaataataaggattgctttttctgtaagaccaccattgtgtcagtcgaggactgggaaaagggagctaacacctcgaccacaagtagtgccgcgtag

SEQ ID NO: 23571 - DNA, 2646 bp, Artificial Sequence
  Description of Artificial Sequence: Synthetic coding sequence
atggccggcgccgccccccgggtgcggtacctggccggcttctgctgtccgctaggaggcttggccgcaggaaaacccagagtgctatgccatgaggcggaagtgtttttatcaacaggttcagagctggtgtacgtatacgaccaggaggggggcttgctgactgccgcctttagattcccggatcaagtctggcacctggagctgctggcccctcgaagacttctctacgccctgtgtgcaagaaggggactatactgcctgtccctcgatcacccaggacggtcacggagtacctcccaagacgaccgggattctgaagatggcgaccagccctcccccgtgattcctgtcgatcccgacgcttgcattctgccagatgccgccctgtgtgcttttaccctgcttgattctgtgttggtgaccctggtccagggaccagccaggtggaagatgcagctgtttgagcaaccttgtccaggcgaggacccacggcctggtgggcagatcggtgaggtagagttgagcagctacacgcctcctgctggggttcctgggaagcctgcagctccgcactttctgcccgtcttgtgcagcgtaagccctagcggaagcagggtgccccatgacctgctggggggctctggaggctttaccctggaggacgctctgttcgggctcctctttggggctgacgcgaccctgctgcagtctcccgtggtgctatgtgggctgcctgatggacaactctgctgcgtgattcttaaggccttggttacgtctcgatctgctcccggcgatcctaatgctctggtgaagatcttgcaccacttggaagagcccgtgatctttattggcgcccttaagactgagccccaagccgcggaggcagctgagaatttcctgcctgacgaggacgttcattgcgattgtctcgtggcatttggccaccatgggagaatgctggccattaaagctagctgggacgaatcaggtaagctagtgccagagctaagggaatattgcttgccaggaccggtcttgtgcgccgcttgcggaggaggaggcagggtgtatcacagcacgcctagcgacctctgtgtggtggatttgtcgagaggctctacacctctgggccccgagcagccagaagaaggtccgggcggccttcccccaatgctgtgtccagccagcttaaatatatgttccgtcgtaagcttaagcgcatcccccagaacccacgaaggtgggaccaagttattagccctttctgctaagggccggctgatgacctgttccctcgacttggatagtgaaatgcccggacccgcccgtatgacaaccgaatccgcagggcagaaaattaaggagctactctccggcatcggcaacatctcagaaagagtcagcttcctgaagaaagctgtcgaccaaagaaataaggcgctgacaagcctcaacgaggcaatgaacgtgtcctgtgcactcctcagttctggcaccggtcctcgcccaatctcctgcactaccagcactacctggagcagactccaaactcaggacgtgctcatggctacttgcgtgctcgagaactcgagcagcttttcattggatcagggttggaccttgtgtatccaggtcttaacatcaagctgcgctctggacctagattccgcttgttctgcaattacttacaccatccccgtcgaccagctgggtccaggcgcacggagggaagtcaccctgcctctcggacctggtgagaacggtgggctggacctgccagtgactgtgagttgcactctgttctattctctgagggaggtcgttggcggtgccctggctccgagcgattccgaagacccattcctcgatgagtgcccatcagacgttctgccagaacaagaaggtgtttgtttacctctctctcgccacacagtggacatgctgcaatgcctgcggtttccagggctggccccccctcacaccagggcgccgagccccttgggccccacaagggatccagtggccaccttcttagagacatgtcgcgagccagggagtcaacccgcaggacccgcaagcctgcgtgcagaatacctgccaccttccgtcgcttcaatcaaggtgagcgcagaactccttcgggctgctctgaaggatgggcattcaggcgtacccttgtgttgcgctaccctgcagtggcttctggcggaaaatgcggccgtcgatgtggttcgtgctcgcgcactctcctctatacagggcgtcgccccagatggcgccaatgtgcatctcatcgtgcgcgaggtcgctatgaccgatctgtgtccggctgggcctattcaggcggtcgaaatccaggtggagtcctcgtccctcgccgatatctgtcgggctcaccacgccgtcgttgggaggatgcaaaccatggtcactgagcaagccacgcaggggagcagtgccccggatctgcgcgtgcagtacctccgccagatacatgccaatcacgaaaccctgttgagggaggtccagactctgagggatagactgtgcacggaagacgaagcctcctcctgtgccactgcccagcggctgctgcaggtgtatcggcagctgaggcacccctccctcatcctgctctag

SEQ ID NO: 23572 - DNA, 471 bp, Artificial Sequence
  Description of Artificial Sequence: Synthetic coding sequence
atgggcgacaagaagagccccacccggcccaagcggcagcccaagcccagctcagacgaaggctattgggattgctcagtgtgtacattccgcaacagcgcagaagccttcaagtgcatgatgtgcgacgtgcgaaaaggaacaagcacacggaaagagaagaaagataaggtagagaaggaaaaatccgagaaagaaaccacatcaaaaaagaacagccataagaaaacacgccctcgactgaagaatgtggatcggagcagtgctcagcacctcgaagtgacagttggtgacctgacagtcatcattactgacttcaaagaaaagaccaaatccccaccagccagtagcgcagccagtgccgatcagcacagtcaatcggggagctcctccgataatacagagcggggtatgagcaggagcagttcgccacggggagaagccagctctctgaacggagaatcccactag

SEQ ID NO: 23573 - DNA, 777 bp, Artificial Sequence
  Description of Artificial Sequence: Synthetic coding sequence
atgtgcgccctggagatggccgtgctggagatccagaccaacggcgatacaagagtgaccgaagaggccatcgctcgagctcggcacagcttgtctgatcccaatatgcgcgaatttatattgtgctgcctcgcccgcgaccctgcccggcgtccgtctgctcactcactgctgttccatagggtactgttcgaagtccactctctcaagctgctcgccgcacactgttttattcagcaccagtacctgatgcccgagaatgtggtcgaggagaagacaaaggccatggatttgcacgcagtcctggcggaactgcccagaccccgcaggccacccctccagtggcgttactccgaagtgagcttcatggaactggacaaattcctagaggatgtccgtaacggaatctatcccctgatgaattttgcggccacacggcccctcggtctacccagggtccttgcaccgcctcccgaagaggtgcaaaaagccaaaacacccaccccagaaccattcgactccgagacaaggaaggtgatacagatgcagtgcaatttggaaaggtctgaagataaagcccgttggcatctaacactccttcttgttctcgaggaccgccttcaccggcagctgacttacgacctgttgccgactgattccgcccaggaccttgcttccgaattagtgcattatggcttccttcatgaggatgatcggatgaagctggccgcatttctagagtccacctttcttaagtatcggggaacacaggcttag

SEQ ID NO: 23574 - DNA, 564 bp, Artificial Sequence
  Description of Artificial Sequence: Synthetic coding sequence
atgctgggccggtaccgggagtacagcaacggccaggccggcgccatcgaacacctcaaggagtccttagaacaaagcattgatcagctcagaagtcagcgcctgctgaggaactccggcggccgatcaatttcagttacgagtctgagcgctagcgatctggacgggggaacgggcagcgagctgcaccattttcccccaaccagcccccttaaagactatggcgacccacaggggataaaacggatgcggagtcgcaccggggtgcgattcgttcaagagacagacgacatgacccagctacatgggtttcatcagagcctgagagacctgagctcagagcaaatcagacttggcgacgatttcaacagagaattgtctcgtcgatcaagaagcgacgccgagacaaagagagcactcgaggaattaactgagaagctgaacgaagcacagaagcaggaggtattcttcgtgaagagcttgggtaaggttaaaatccaatgcctgagctccgcagaggtggacaatgtgtttcccataaatgtttggcagtgtggcatctag

SEQ ID NO: 23575 - DNA, 927 bp, Artificial Sequence
  Description of Artificial Sequence: Synthetic coding sequence
atgatggacgtgagcggcgtgggcttccccagcaaggtgccctggaaaaaaatgtcagccgaagagctcgaaaatcagtattgtccatcacgttgggtagtcaggctgggcgccgaagaggccctacggacatacagccagatcgggatagaggcaaccactcgcgcgagggcaactcgtaaaagcctcttgcatgtcccctacggcgacggcgagggagagaaggtagacatctacttccccgatgagtccagcgaggccttgcccttctttcttttttttcacgggggatactggcagtcgggaagcaaagacgagagtgcttttatggtgcaccccttaacggctcaaggcgtggctgtggtcattgtggcctacggcatcgcgccaaagggcaccctcgaccatatggtcgaccaggtcacacgaagcgtggctttcgtccagaaacggtatcctagtaacaaagggatttacctctgtggacactcagctggagcccatctcgccgccatgatgttgttagctgactggacgaagcacggggtgaccccaaaccttaggggcttcttcctcgtgagcggtgtgttcgacctggaacctattgtttatacctcccagaacgtcgcgttgcagttgactcttgaggacgcacagcggaactccccccaacttaaggtggctcaggctcaaccggtggatccaacttgcagggtacttgtggtcgtgggacaattcgactccccggagttccaccgacagtcatgggagttctaccaggtcctgccagtccagaccctctgccagggcgaatggaaagcttctttcgaagaattacatgacgtagaccacttcgaaattgtcgaaaatctgacccagaaggacaatgtgctaacccaaattatcctgaagaccattttccaatag

SEQ ID NO: 23576 - DNA, 1461 bp, Artificial Sequence
  Description of Artificial Sequence: Synthetic coding sequence
atgagcggcagcacccccttccagatgcggctggtgcacctggacctcaagggagcacctcctaaagttagctatttgagcgaaatttttcctctgttcagagccttgggagctaatggtctcctgatagagtacgaggatatgtttccgtatgaaggcccgctgcgcctattgcgtgccaaatacgcctactcaccgagcgagatcaaggaaatcctgcacttggccggactcaacgaacttgaggtgattccccttgtgcagacgtttggtcatatggaattcgtgctgaagcacacggctttcgcccatctgcgcgaagtgggatcatttccctgcaccctcaacccacatgaagccgaaagtcttgctctcgtcggagctatgatagatcaagttctcgagctgcacccaggcgcccagcggctgcacattgggtgcgatgaggtttactatcttggagaaggagaggcatctaggcggtggctgcagcaggagcagaactcaaccggaaaactctgcctctctcacatgcgggccgtcgcatcaggcgtgaaagctagaagaccatccgtaacacctcttgtgtgggatgatatgttgcgcgatctccccgaggatcagttggccgcctccggagtgcctcagctcgtggaaccagttctctgggactacacggccgacctggacgtgcatggcaaagtccttcttatgcaaaagtatcggcgttgcggcttcccccagctctgggcggcatccgcattcaagggcgctaccgggccgtctcaggcagttcctccagtagaacaccacctgagaaatcatgtccagtggctccaagttgccggatcaggcccaactgacagcctgcaaggaatcattttgacagggtggcagcgctatgaccactattccgtcctttgtgaactccttcctgctggcgttcccagcctggcggcctgtctgcagctgctccttcgcgggggctttgacgaagacgttaaagccaaagtggagaatctgctggggatcagttccctggagaaaaccgacccggtgcgcgagggggcaggctctttccctggctcgaacatcctggccctagtcacccaggtctcccttcacctgcggagcagcgttgatgctcttctggagggaaaccggtacgttactggttggtttagcccttaccatagacagaggaagttgatccatccggtgatggtacagcacatccagcctgctgctctcagcttgctggctcagtggtccacattagtgcaagagctcgaggccgctcttcagctcgctttctatcccgacgcagtagaggagtggcttgaggaaaatgtgcatccaagcctgcagaggctgcaggccctcctgcaagatctctccgaagtgagtgccccccctctgccccccacatccccaggccgcgacgtcgcccaggacccttag

SEQ ID NO: 23577 - DNA, 240 bp, Artificial Sequence
  Description of Artificial Sequence: Synthetic coding sequence
atgagcagccagcagcagcagcggcagcagcagcagtgccccccccagcgcgcccaacagcagcaagtgaaacagccttgtcagccacctcccgttaaatgccaagaaacctgtgccccgaagactaaggatccatgtgctccccaggttaaaaagcaatgcccaccaaagggtacaattataccagcccaacagaagtgccctagcgcccagcaggccagcaaaagcaaacagaagtag

SEQ ID NO: 23578 - DNA, 822 bp, Artificial Sequence
  Description of Artificial Sequence: Synthetic coding sequence
atgggccagaaggtgaccggcggcatcaagaccgtggacatgcgggacccaacctatagacctttaaaacaagagctgcagggcctcgactactgtaaacctacccggctcgaccttctgctggacatgccaccagtctcatatgatgtacaattgctgcactcctggaacaataatgaccggagcctgaatgtcttcgtgaaggaagatgataagttaatttttcaccggcatccggtcgcccagagtacagatgccatacggggtaaggtaggttacacccggggcctgcacgtgtggcaaattacttgggccatgcgtcagagaggtacccacgctgtggtgggggtggctactgccgacgcacccctacattctgtgggatataccaccctggtgggcaacaaccacgaaagctggggttgggatctggggagaaatcggttgtaccatgacggcaagaaccagccatctaaaacgtatcccgctttcttggaaccagatgaaaccttcattgttcccgactctttcctcgtggcactcgacatggacgacggtacgcttagctttatcgttgacggacagtacatgggcgtcgcctttcgtggactcaaaggcaaaaaactgtatcccgtggtgagtgccgtctgggggcattgtgaaatccgaatgagatacttaaacgggttggatcctgaaccattgccattaatggacctttgcagacgttctgtgcggctggccctcggtagggaacgactgggtgaaatccacacactgcctttgcccgccagtctaaaggcttatttgctgtatcagtag

SEQ ID NO: 23579 - DNA, 3315 bp, Artificial Sequence
  Description of Artificial Sequence: Synthetic coding sequence
atgggcaacgccgccggcagcgccgagcagcccgccggccccgccgctcccccccctaagcagcccgctcccccaaagcagcccatgcccgccgcaggcgagctggaggaacgcttcaatcgcgccctgaattgcatgaacctgcccccagataaagtgcaattgctctcacagtacgacaacgagaaaaaatgggaactaatttgtgatcaagagcgtttccaggttaagaatcccccagctgcatacatacaaaagctcaaatcctatgtagatactggaggcgtgtctcgcaaggttgctgccgattggatgtccaacctggggtttaagagaagagtgcaggagtccactcaggtgctccgagagctcgagacaagcttgaggacgaaccatattggctgggttcaggaatttctgaacgaggaaaatcggggactggacgtgctcctcgagtatttggccttcgcccagtgctcagtgacttacgatatggaatcaaccgataacggagcaagcaattctgaaaaaaacaagccgctggagcaatcagtggaagatcttagcaaaggacctcccagcagcgtgccaaagagtcgccacctgaccattaaactgactcctgcccattcccgtaaagccctgcgaaatagtcggatcgtgtcccagaaggatgacgtccatgtgtgcatcatgtgcttaagggcgattatgaattatcaatcaggtttcagcctggtcatgaatcatccagcgtgtgttaacgagatcgcgctgtcactgaataacaagaacccccgaaccaaggctcttgtgctggagcttctcgccgcagtttgcttggtgagaggcggacatgatatcatcctcgctgcctttgacaattttaaggaggtgtgtggagagcagcaccgattcgagaaactaatggagtacttccgcaatgaggatagcaacatagactttatggtagcctgtatgcagttcatcaatattgtggtccacagcgtggagaacatgaatttcagggtgttcctccagtacgagttcacccatctggggctcgatctctacctggaaaggctgcggcttacggagtccgacaaactgcaagtgcaaatccaggcctatctggacaacatttttgatgtgggagctcttctggaggacaccgagacaaagaacgctgttctcgagcatatggaggagctgcaggagcaggtggcactcttgaccgaacggcttcgagatgctgagaatgagtccatggcaaaaatcgccgaactcgaaaaacagctgagccaggcaagaaaggagctggaaacactaagagagagatttagcgagtctacagccatgggacccagcagaaggcctccagagccagagaaagcgcccccagctgctccaaccagaccctcagccctcgagttgaaggtcgaggaactggaagagaaagggctcatccggatcctcaggggccccggagatgcagtatcgatagaaatcctgcccgtagccgtggcaacgccttccggaggagatgctcccactcctggagtcccaaccggctcacccagccctgatctcgcccctgccgcagagcccgcgcctggagcagcgcccccgccgcctccaccactgcctggattgccctctcctcaggaagctcccccatccgctccacctcaggctccccctctcccaggtagtcccgagccccctcccgcccctccactgcccggtgatctacctccgccaccgcctccacctcctccaccacctggtaccgatggacccgttccgcctccacccccaccaccaccacctccccccggaggaccaccagacgctctgggacgacgcgacagcgagctcggcccgggagtcaaggccaaaaagcccatccagacaaaattccggatgccacttcttaattgggtcgccctcaagccctcccaaatcaccggaacagtattcaccgagttaaatgatgaaaaggtcctgcaggagcttgacatgagcgactttgaggagcagttcaagacgaagagccagggcccttccctagacctgagcgcactcaagagcaaagcggcacagaaggcaccgtccaaagccacgctgatcgaggccaacagagctaagaatctcgccataacactgagaaagggaaacctgggagccgagcgtatctgccaggccatagaggcttacgatctgcaagccctcggactcgattttctggaactgctcatgaggtttctcccgaccgaatacgaacggtctcttattacacggtttgaaagggaacagagacccatggaggaactgtcagaagaagacaggtttatgctgtgctttagtagaatccctcggctcccagaaagaatgactacattgacgtttttaggaaatttccccgacaccgcacagcttctgatgccccagctcaacgccattatcgcggcctccatgagtattaagagctccgataaacttaggcagatcttggaaattgtcttagcctttggtaactatatgaactcatcgaaacgcggagctgcctatggctttaggctgcaaagcctcgacgctctattagagatgaaatcaaccgaccgaaagcagactctgctccactacctggtaaaagtcattgcagaaaaatacccccagttgacggggttccattctgatctgcattttttagataaggcaggctctgtaagtcttgatagtgtcctggctgatgttcgtagcctccagcggggactcgagctcacgcagagagagttcgttcgccaggacgactgtatggtcctgaaagagttcctgcgagcaaattctcccacaatggataaacttttagctgatagcaagactgcacaggaggccttcgagagcgtcgtggagtacttcggggaaaatcctaagaccacctcccccgggctgtttttttctctgttctctaggttcattaaggcctacaagaaggctgaacaggaggtggaacaatggaaaaaagaagccgcagcccaggaagctggcgccgatacccccggtaaaggggaacctccagctcccaaatcacccccaaaagcccgccggcctcaaatggaccttatctccgagctgaagaggcgtcaacagaaggagcccctcatctacgagtcagatcgtgatggagccattgaggatataataacagacctgcgaaaccagccttatattagggctgacacagggcggcggtccgcaagaagacgacctccaggaccccccctgcaggttacttccgacttaagcctgtag

SEQ ID NO: 23580 - DNA, 603 bp, Artificial Sequence
  Description of Artificial Sequence: Synthetic coding sequence
atggaggagaagcccagcaaggtgagcctgaagagcagcgaccggcaggggtctgatgaggagtcagtccacagcgatactagggacctttggacgacaaccaccctgagtcaggcacaactgaacatgcctctcagtgaagtctgtgaagggttcgacgaggaagggagaaatatttctaagacccgaggctggcattcacctggccgcgggagcctagacgaaggttataaggctagccataaaccagaagaactcgatgagcacgctctcgttgagcttgaactgcatcgtgggtcgtcaatggaaatcaatctgggagaaaaggacactgctagtcagatcgaggccgaaaaatcaagctctatgagctccttaaacatcgccaaacatatgccacacagggcctactgggcggagcagcaaagtcgtctcccactgcccctaatggaactgatggaaaacgaggctctggagatactgaccaaggccctgcgatcttatcagctgggaatcggtcgagatcactttctaaccaaagaattgcagagatacatagagggactgaagaagcggaggagcaagcgtctgtacgtgaattag

SEQ ID NO: 23581 - DNA, 1044 bp, Artificial Sequence
  Description of Artificial Sequence: Synthetic coding sequence
atgaagctgaccagcgagaagctgcccaagaaccccttctacgccagtgtgagtcagtatgcagccaagaaccagaaattcttccaatggaaaaaggaaaagacggactatacccacgctaatctggtcgacaaggccctccaactattaaaagaaagaatcctgaaaggggacacccttgcctacttccttcgggggcaactgtacttcgaggaggggtggtacgaggaagctctagagcaattcgaagagataaaggaaaaggaccaccaggctacgtaccaactcggggttatgtactacgatggactgggcacaacactcgacgccgaaaaaggtgtagactacatgaagaagatcctcgattccccctgcccaaaagcaagacacctgaagttcgccgccgcctataaccttgggagggcctattacgaggggaaaggagtgaaaaggtccaacgaagaggccgaacgcttgtggctcatcgccgccgataatggcaatcccaaggcaagcgtcaaggcccagtctatgctggggctctactattcaaccaaggaaccaaaggagctcgaaaaggccttctactggcatagtgaagcctgcggcaacggcaacctcgaaagccaaggtgcgctgggcctcatgtatctctacgggcagggcatccggcaggacactgaggcggccctgcagtgcttgagagaagccgctgaaaggggcaatgtttatgcgcaaggtaacctggttgagtactattataaaatgaaattctttacgaagtgtgtggcattctctaagaggatcgcggactacgatgaggtgcacgacatccctatgattgcccaggtcacggactgtctaccagagtttattggcagagggatggccatggcctctttctatcacgcaagatgtttgcagttaggactaggcatcacaagggacgaaaccaccgctaaacattactattccaaggcatgtcggcttaatcccgccctggccgatgaactgcacagccttctcattcggcagcgtatttag

SEQ ID NO: 23582 - DNA, 3525 bp, Artificial Sequence
  Description of Artificial Sequence: Synthetic coding sequence
atgcccctgcccttcggcctgaagctgaagcggacccggcggtacacagttagctcgaagtcgtgtcttgtggctcggatccagctactcaataatgagttcgtcgagttcaccctcagcgttgagtctaccggacaggagagtttggaggcagtcgctcagcgtttagagctgagggaagtcacatacttctccctctggtattacaataagcagaatcagcggagatgggtggacctcgaaaaacccttgaaaaagcagttagataagtatgccttagagcctaccgtctactttggcgtcgttttttacgtgccttctgtgtcgcagctacagcaagaaataacacgttaccagtattacctccaactgaagaaagacatcctggagggtagtattccatgtaccttggaacaggcaatccagctggccgggctggccgtccaggctgactttggagactttgatcaatatgaatcacaggactttctgcaaaaatttgctttattccccgtggggtggctgcaggatgagaaggtgcttgaagaggctacccaaaaagtggcgctactgcatcagaaataccgaggactgaccgcacccgacgcggagatgctgtatatgcaggaagtagagagaatggacggctacggagaagagagttacccagctaaggactcacaggggagcgatattagtatcggtgcgtgtttggagggcatttttgttaagcataagaacggtcgacacccagtggttttccgatggcacgatatcgcaaatatgagtcataacaagagtttcttcgcgcttgaactcgccaacaaggaggagacaattcagtttcaaactgaagatatggagacagctaagtacatttggaggctatgtgtcgctaggcacaaattttaccgactgaaccagtgcaacctccagacacaaaccgtcaccgtgaaccccattcgacgcaggagctcttcgaggatgtctctgccaaagccacagccatacgttatgccccccccaccccagctgcactacaacggacactatacagaaccatatgccagtagccaggacaacctctttgtgccaaaccaaaatggctactactgtcactcccagacgagtctcgatagggcacagattgacctcaacggccgcatcagaaatggttccgtgtattctgcccattctaccaactcactgaataaccctcaaccttaccttcagccatcccccatgtcctctaaccccagtatcacaggttcagacgtgatgcggccggattacctgccttcccatcggcacagtgccgtaatccctccttcttacaggcctacccccgactacgaaaccgtcatgaagcagctaaatcggggcctcgtccatgccgagaggcagagtcatagcctacgcaatctcaatatcggttcttcatacgcttattcacggccagctgcgctggtctattctcaacctgagattagggaacacgcccagctcccatcccctgctgctgcgcactgccctttttcactgagctactcattccactcaccatccccatacccctaccccgccgaacgtcgcccagtcgtgggagccgtgtcggtcccagaactgaccaacgcacagctgcaggcccaggattaccctagccccaatatcatgcggactcaggtgtaccgtcctccaccaccctatccaccacccaggcccgccaattccacaccagatttgagtcgacacctttatatctcttctagtaaccccgacctgataacccggagagtgcaccactccgtccagacctttcaggaagactcactgcctgtggcgcactcccttcaggaggtatccgaaccactgacagctgcccggcacgcccagctccacaagcgcaactccatcgaagttgccggtctttcccatggattagagggactcagactgaaggagagaactctgtctgcatctgcagccgaggtggctccacgcgctgtttccgtcggaagccagccttctgtcttcacagagcggacccagcgggaaggccccgaagaggcagagggactcagatacggacacaagaagagtctctccgacgccactatgctcatccatagttcggaggaggaggaggacgaagactttgaagaagagagcggggcccgcgctccacccgctagggcacgtgagccccggcccggtttagcgcaagaccctcccgggtgcccccgggtgctgttggccgggcccctacacattcttgaaccgaaggcccatgtgcctgacgcagagaaaaggatgatggacagttccccagtacgtaccacagcagaggctcagaggccatggcgagatggattgcttatgccatccatgtccgagagcgacctgaccacctccggtcgctacagagcaagaagggattccctgaaaaaaagaccagtgtccgacttactcagcgggaagaagaatatagttgaaggcttgcccccactgggaggcatgaagaagacaagggtggatgccaaaaaaatcggccccctcaagctagcggctctgaatggcctgtccctcagtcgggttcctctgcccgacgaaggcaaggaggtggccactcgcgctactaacgatgagcggtgcaagatactcgaacaacggctggagcaaggaatggtgttcaccgagtatgagcgcattctgaaaaaaaggttggtcgatggtgagtgctcaaccgcccgccttcccgaaaacgcggaacgaaatcgatttcaggatgtgttgccgtatgatgatgtgcgggtcgagttggtgcccactaaggaaaacaatacgggctacatcaatgccagccacattaaggtgagtgtaagtggcatcgaatgggattatattgcaacacagggacccctacaaaatacgtgccaagatttttggcagatggtgtgggaacagggcatcgccatcattgccatggtcacagctgaggaggagggaggccgggagaaatctttcaggtactggccccggctcggctcccggcacaatacagtcacatacgggcgttttaaaattaccacaagattccgtacggactccgggtgctatgctacaacagggttaaagatgaagcatctcctgacaggacaggaacggaccgtctggcacctgcagtacaccgattggcctgaacacggctgtcccgaggacctgaaaggattcctgtcctatctcgaggaaatccagagtgtcagaagacatactaactcaacatccgatccacaatccccgaaccctcctctgctagtccattgctccgcaggggttggacgaacaggagtggtgattctcagtgaaattatgatcgcttgtttagagcacaatgaggtacttgacattccccgagttctggatatgctgcgtcagcagcgcatgatgctcgtgcaaacgctttgccagtatacctttgtgtatcgagtgctcattcagtttcttaaatctagcagactcatctag

SEQ ID NO: 23583 - DNA, 2235 bp, Artificial Sequence
  Description of Artificial Sequence: Synthetic coding sequence
atggccgccgacaagcccgccgaccagggcgccgagaagcacgaggggactggacaatccagcgggattacagatcaggagaaggagctgtccaccaacgcattccaggcattcacatcaggaaactatgatgcctgtttacagcatctcgcctgtctgcaggatatcaacaaggacgattataaaatcatccttaacacagcagtggcggagttttttaaatccaaccagaccaccacagataacttgagacagacactgaaccagctgaagaaccaagtccactctgcggtcgaagaaatggatggtcttgacgacgtggagaactcgatgctctactataaccaggctgttatcctgtatcaccttcgtcagtacacagaggcaattagcgttggcgaaaaactgtaccagtttattgaacctttcgaggagaaattcgcacaggccgtgtgttttctgttggtcgatctctatatcctgacttatcaggctgagaaagcactgcatttattggcagtcctcgagaagatgattagccaagggaataataacaagaacgggaagaatgaaaccggaaataacaacaataaggacggctccaatcataaggccgagtccggcgctttaattgaggccgctaagagcaaaatccatcagtataaagtcagagcttatattcagatgaaaagcctgaaagcttgtaaacgtgagatcaagagcgtaatgaacacagccgggaattccgcgccatcgttgtttctgaagtccaattttgagtatctacgcgggaattatcgcaaggctgtgaagcttctgaactcatctaatatagctgagcaccccggcttcatgaagaccggggagtgccttcgatgcatgttctggaacaacctgggatgcatccattttgcgatgtccaagcacaacctgggaatcttctacttcaagaaagcgctgcaggaaaatgataatgtctgcgcccaactcagcgcaggctccaccgatcccggcaaaaaatttagtggtcgtcccatgtgtaccttactcaccaataagcgatatgagctcttgtataactgcggaatccagctcctgcacattggaagacctctggcagctttcgagtgtctcatcgaagcagtgcaggtctaccatgcgaacccgcggctgtggctgagactggccgaatgttgtatcgccgccaataagggaacttcagaacaggaaaccaagggccttccctccaagaagggcattgtgcagtctatcgtaggccaaggctaccatcgaaaaattgttctggcaagccaatccattcagaacaccgtgtacaacgacggacagagctctgctatacctgtggccagtatggaatttgcagctatctgtctgcgcaatgccctcttgctgctgccggaagagcagcaagaccctaagcaggaaaatggcgccaaaaatagcaaccaactcggagggaacaccgagagttctgagagtagcgaaacatgctcgagcaaaagtcatgatggagacaaatttattcccgcacccccatcctcacccctccgcaaacaggaacttgaaaacttaaaatgttccatcttggcatgctcagcgtacgtggcgctcgctctaggggacaatctgatggcccttaatcatgctgataaactcctccaacagccgaaacttagcggtagtctgaaatttctggggcatctctacgctgccgaagctctgatttccctggatcgcatttctgatgctatcactcacctgaatcctgaaaacgtgaccgacgtgagcctcggtatatcctctaacgagcaagaccaggggtccgataagggcgaaaatgaggcaatggagagttcaggcaagcgggccccgcagtgctatccctcttccgtcaattcggccagaactgtcatgctctttaatttggggtcagcctactgtttacgctcggaatacgacaaagcaaggaaatgcctacatcaggcggcctcaatgatccatcccaaggaagtcccacctgaagcgatcctgttagccgtgtatctggaattgcaaaacgggaacacacagctagctcttcagatcattaagcgaaatcaactactacctgctgtgaaaacccattcagaggtcagaaagaagcctgtcttccaaccagtgcatcctatacagccaatacagatgccggcctttaccaccgtgcaacgcaagtag

SEQ ID NO: 23584 - DNA, 363 bp, Artificial Sequence
  Description of Artificial Sequence: Synthetic coding sequence
atgcacccccccccccccgccgccgccatggacttcagccagaacagcctgtttggttacatggaggacttgcaggaactcacaattattgagcgcccggtgaggaggtccctcaagacacctgaggaaattgaacgcctgactgtggatgaagacctctccgacatcgagcgggccgtctacttgctgagtgcaggccaagacgtccagggaacttctgtgattgccaatcttccgttcttaatgcggcaaaacccaacggaaaccctgcggagggtgcttccgaaggtccgtgtccacgaagatgcgcatctattcattcagagagtttggatctcccatatgtttgtgcagagagtttag

SEQ ID NO: 23585 - DNA, 1335 bp, Artificial Sequence
  Description of Artificial Sequence: Synthetic coding sequence
atgcgggagatcgtgctgacccagatcggccagtgcggcaaccagatcggagccaagttctgggaggtcatcagtgatgagcacgccattgactccgctggaacttaccacggggacagtcatttacaactcgaaaggataaacgtatactataatgaggcaagcggcggccgatacgtgccccgcgccgtgctcgtggatcttgaaccaggcactatggactcagttcggtctggcccttttggccaggtctttaggcctgacaacttcatttttggacagtgcggtgctggtaacaattgggccaagggtcattacaccgagggagccgagctaatggaatcagtgatggatgttgtccggaaggaggctgagtcttgcgactgcctccaagggttccagctcacgcactctttaggtgggggtaccggatctggtatggggaccttgctactcagtaagatccgcgaagagtatcctgatagaattatcaacacgttctccatcctgcccagccccaaagttagcgatacagtggtggagccatataacgcaacactttccgtgcaccagcttattgagaatgctgacgaaactttttgcatcgacaatgaagccctctacgatatctgtagcaaaactttaaagctgccgactccaacctatggcgacctgaatcatcttgtatctgccaccatgagtggggtcactacctgcctgagatttccaggacagcttaatgcagacctcaggaaattggccgttaacatggtacctttccctcggctccatttctttatgccaggctttgcaccgctgacgtcacgaggttcacagcagtaccgtgcccttaccgtagcagaactaacccagcaaatgtttgatgccaagaacatgatggccgcttgcgacccaaggcatggcaggtacctgactgctgcagcaatcttcagggggaggatgccgatgcgggaagttgacgaacaaatgttcaatattcaagacaaaaattctagttatttcgcagattggctgccaaacaatgtcaagacagccgtttgtgacatcccacccagaggtcttaaaatgtctgcaacctttatcggcaataatactgcgattcaagaactgtttaaacgggttagtgagcagtttacggccatgttcaggaggaaggcctttctgcattggtacactggggagggaatggacgaaatggagttcactgaggccgaaagtaatatgaatgatctggtttctgagtatcagcaatatcaggacgcaaccgctgaggaggaagaggacgaagaatacgccgaagaggaagtcgcatag

SEQ ID NO: 23586 - DNA, 915 bp, Artificial Sequence
  Description of Artificial Sequence: Synthetic coding sequence
atggccaagatcgagaagaacgcccccaccatggagaagaagcccgaattgtttaacattatggaagtggacggcgttccgacccttatcctgagtaaagagtggtgggaaaaagtttgcaatttccaggccaagcctgatgacttaattttggcgacttaccccaagagtggcacaacctggatgcatgagattctggatatgatcctaaacgacggggatgtggagaaatgcaaaagagcccagaccctggaccgtcacgccttcctcgagttaaagtttccgcacaaggagaagcctgacctggaattcgtcttagagatgtcaagcccgcagctcattaagactcacctgccctcacacctgatccccccttccatctggaaggagaactgcaaaatagtttatgtggcaaggaatcctaaggactgcctggtgtcatactaccactttcataggatggcatcctttatgcccgatccccagaacctggaggaattttacgagaagttcatgtctggcaaagtggttggagggtcctggtttgatcacgttaaagggtggtgggccgccaaagatatgcatcgaattctgtatctattctatgaggacatcaagaaagatccgaagagagaaattgagaaaattctcaaatttctcgagaaggatatcagcgaagaaattctgaacaagatcatttatcatacttcatttgatgtgatgaaacagaatcctatgaccaactacacgactctgcccacatctattatggatcattcaatttctcccttcatgcggaagggcatgcccggcgattggaagaactacttcaccgtcgcccagaacgaggagttcgataaagattaccagaagaagatggccgggagcactctgacattccgaacggaaatttag

SEQ ID NO: 23587 - DNA, 216 bp, Artificial Sequence
  Description of Artificial Sequence: Synthetic coding sequence
atgtgcggcagctactacggcaactactacggcacccccggctacggcttctgtgggtacggcgggctgggctatggttatggcggacttggatgtgggtacgggtcttgttgtggctgcggattccgccggctgggctgtggatatggctatggatcccgctcattgtgcgggtacggctacgggtgtggatctggttccgggtactactactag

SEQ ID NO: 23588 - DNA, 2094 bp, Artificial Sequence
  Description of Artificial Sequence: Synthetic coding sequence
atggacaagaagagcaccgccgagaagctgggcaaggagctgggccttcaggccaaagagttatccgccgtgcattcttcccaccatgagattggcgtcaacgatagtaacctgttttctctagagatgagggaaccactggaatccagcaatacgaaaagcttccactccgcggtcgagatcaagaaccgctctcagcacgagctcccctgtttccagcaccacgggatagatacacctacatccctccagaaaaggtccgcctgttgcccgccctctctgttgcgcctcgaggagacggcttcctccagtcaggatggtgatccgcaaatctgggatgatttgccattctcagagtcactgaataagtttcttgcggttttggaatcggagattgcagttacccaggccgacgtgagctcgcggaagcatcatgttgacaacgatatcgataaatttcatgccgatcatagtcgtctgtctgttaccccacagaggaccacaggcgccctgcatacccctccaatcgcactccggagttcgcaagtaattgtgaaagcgaactgcagtaaggatgacttcctcttcaattgcaaaggcaacctgtccccaagcgtggagaaagaatctcaacccgataataaagtcgaagccgtttcagtgaaccacaacggtcgtgatatgagcgaatactttttgcctaacccatatttgtccgccctgtcttcttcttccaaggaccttgagacgattgtgacattgaaaaaaacaattaggatatcaccgcaccgcgagagtgaccatagcagccttaacaataaatacttgaacggctgcggagaaatctctgtcagcgaaatgaacgaaaaattgaccaccctgtgttacagaaagtataatgatgtgtctgacctgtgtaaactagagaataagcaatattgccgatggtccaagaaccaagacgactcttttacaatctgcaggaaactgacttatccactggagaccttgtgcaattcccccaatcggtcgactaacactctcaaagagatgccttggggtcatattaataataacgtcactcaaagctatagtattggctacgaaggatcatacgatgccagtgcggatttgtttgatgacattgcaaaagagatggatatagccacagagatcactaaaaaaagccaggacatcttgctgaagtggggtacgtccctagccgagtcccacccttccgagagcgattttagtcttagaagcctcagcgaagacttcattcaaccttctcagaagttgtcactgcagtcactcagtgatagccgccactcccgaacatgcagtccaacgccacacttccaatctgatagcgagtataacttcgaaaattctcaagacttcgtgccctgcagccagtcaacacctatttcgggctttcaccagacaaggatacacggcatcaatcgagcgtttaaaaagcccgtattctatagtgacttggatggcaattatgagaagattcggatctttccagaaaacgataagcagcaggctagccctagctgtcctaaaaacataaaaaccccttctcaaaagatcagatcacccatagtctccggcgtgtcacaacccgacgttttcaaccactaccccttcgctgagtgtcacgagaccgatagcgatgagtgggtgccacccactacacaaaaaatctttcctagcgacatgctgggtttccagggaataggccttggcaagtgcctggctgcctaccactttcccgaccaacaggagctcccccgtaaaaagttgaaacatattcggcaggggactaataagggactcatcaagaagaaactaaagaacatgcttgccgccgtagtgacaaaaaagaagactcacaagtacaactgtaaatcatccggctggatctccaaatgtcctgacattcaggtgctggccgctccacagctgcatcccattctcgggccagattcctgtagtgaggtgaaatgttgcctgccattttcagaaaaggggcctccatctgtttgtgagaccaggtctgcatggtctccagaactgttctcctag

SEQ ID NO: 23589 - DNA, 306 bp, Artificial Sequence
  Description of Artificial Sequence: Synthetic coding sequence
atgagcaacacccaggccgagcggagcatcatcggcatgatcgacatgtttcataaatatacgggccgcgacggtaagattgagaaaccgtcattgctgactatgatgaaggagaactttcccaactttctgagcgcctgcgacaaaaaagggatccattatctagcaaccgtatttgagaagaaggataaaaacgaagacaaaaagatcgacttcagcgaatttttgtccctgctgggggacatcgccgccgattaccacaaacagagccacggtgctgccccatgtagcggtggcagtcagtag

SEQ ID NO: 23590 - DNA, 678 bp, Artificial Sequence
  Description of Artificial Sequence: Synthetic coding sequence
atggccgtgcggagcctgtgggccggccggctgcgggtgcagcggctgctcgcatggtctgcagcttgggagtcaaagggatggccactcccattttccacggccacacaaaggactgccggcgaagactgcaggtccgaggaccctcccgacgagctaggccctcctttagccgagagggccctgcgggttaaggccgtcaagctggagaaagaagttcaggacctgaccgtgaggtatcagagagccatcgccgactgtgaaaatatcagaagacgtacacagcgatgtgtggaggacgccaagattttcgggatccagtccttttgcaaggatttggttgaggtggccgacattctggagaagacaactgagtgcatctccgaggaatctgagccagaagatcagaagctaaccttagagaaggtgtttcgtggtctgttactccttgaagcgaagctcaagtccgtgttcgccaaacatggactcgagaaattgacccccataggggataagtacgaccctcacgagcacgaactgatctgtcacgtgcctgctggcgtgggcgtgcagcctggcacagtggcactagttagacaagacgggtacaagctccacggccggactattcggctcgccagagtcgaggtcgccgtcgagtcccaacgaaggctttag

SEQ ID NO: 23591 - DNA, 1203 bp, Artificial Sequence
  Description of Artificial Sequence: Synthetic coding sequence
atgaccaccaagaacctggagaccaaggtgaccgtgaccagcagccccattcgaggcgccggcgacggtatggagaccgaggagccacccaagtcagtggaggtgacttcgggtgtgcaatccagaaaacatcatagtttgcaaagtccctggaagaaagccgtgccgtctgagtcccccggagtcctccagctgggtaagatgctgacagagaaggcaatggaagtcaaggcagtgcggatcttggtgcctaaggctgctatcacccacgatatccccaataagaacaccaaagtgaaatcccttggccaccacaagggggaattcctaggacagtccgagggggtaattgagcctaacaaagagttgtcagaggtgaagaacgtgctggagaagcttaagaatagcgagagacggcttctccaggacaaggaggggctgtctaaccaactccgcgtccagacagaagtaaatagagaactgaagaaactcctggtggcctctgttggggacgatctccaataccatttcgaacggctggctcgggagaagaatcagcttattctagagaacgaagctctgggcaggaataccgcccaactctccgaacaactagagcggatgtccatccagtgcgacgtctggcgcagcaaatttttggccagccgagttatggcagatgagctgaccaactcacgagcagcgctgcaacggcagaaccgcgacgcacacggagctattcaggacctgctgagcgagagagagcagttcagacaggagatgattgcgacccagaagctcctagaagaactgttggtgtccctgcaatggggtcgggaacagacctactccccgtcagtgcagccccatagcaccgcagagcttgcactcaccaaccataagctagccaaagccgtcaacagccatctcctggggaacgttggaataaacaaccagaagaagattccaagcacagtggagttctgtagcaccccagcagagaaaatggctgaaacggtgctcaggatcctcgacccagttacttgcaaggaaagtagcccagacaaccctttcttcgagagctcccccacaacacttctggctaccaagaagaacatcggacgcttccatccctatacgaggtacgaaaatatcaccttcaactgttgtaatcactgtaggggagagttaatcgccttatag

SEQ ID NO: 23592 - DNA, 735 bp, Artificial Sequence
  Description of Artificial Sequence: Synthetic coding sequence
atggaccccggcgccgccctgcagcggcgggccggcggcggcggcggactgggcgccggttcgccagccctgagcggcggacaggggcggcgtagaaagcagcccccacggccggctgacttcaagttgcaggttataatcattggcagccgcggtgtaggaaagacttcattgatggaacgcttcaccgacgacaccttttgtgaagcttgtaagtccactgtgggggtagacttcaaaatcaaaacagtggagctgagggggaagaagattcggctgcagatatgggacaccgctggccaggaaagatttaacagtatcacatccgcctactaccggtcagcaaagggtattattctcgtgtacgacatcacaaagaaagaaacgttcgacgatctgcctaaatggatgaaaatgatcgataagtacgccagcgaagacgcggaactcttgttggtagggaacaagctcgactgtgaaacggacagagaaattacaagacagcagggagagaagttcgcacagcagataaccgggatgagattttgcgaagcctcggcaaaagataatttcaatgtggatgagatatttcttaagctggttgatgacatcctgaagaagatgccactggatatcctgcgcaatgaactcagtaattccatactgtctctgcaacctgagccagagatccctccagaattgcctccccctcggccccacgtgcggtgttgctag

SEQ ID NO: 23593 - DNA, 1158 bp, Artificial Sequence
  Description of Artificial Sequence: Synthetic coding sequence
atggccctgccccacgacagcaacgagaccagctacctgctgccccccaataacgaggattggggcaggcagactatacctgactttgtatacggacagaaagaccttatggccgagggaatccagtggcctaggaacgctccaggtatacccgatgcactgcctcaaagcccgttcgacgcagcactgtgtagtgcatggaaacaaagagtggagttaggtctgttccgatataggctacgcgagctgcagacacagatccttccaggggcagtaggttttgtcgcacagctcaacgttgaacgcggagtgcagagacgcccgccccagactatcaaaagtgtcagacaagccttcgaccctgttcagtttaattttaataaaattagaccaggcgaggttctctttcgattacatcgcgagcccgatttaccgggtacattactccaggaggatatcctggtcgtcattaatgtgtcacctctagaatgggggcatgtgttactcgtcccagaaccagcgcggcagctgcctcagcgcctgctccccggtgctttgcgggcggggattgaggctgtactcctgtctctgcatcccgggtttagagtggggtttaactctcttggcggcctggcctccgtgaatcacctgcacttacacgggtactatctggcccaccgacttcccgtggagcaggcaccctccgagcccctcgatccaggcggccacctgcacctgctgcaagatttgccggctcccgggttcctgttctatacgagaggcccggggcctgacctggagagccttattagtcgcgtgtgtagggcaacagactatttaactgaccacgaaatagcacataatcttttcgtcacaagaggggctcctccaggaaaaaccagcccatcaagtgccctgaccggagtgagagtaattctctgggcccgcaaaagtagcttcggcatcaaagacggtgaggcattcaatgtggctctatgcgagctggcaggccatttgcccgtaaagacttcccaagacttttcttcccttacagaggcagccgccgtagctctgatacaggactgccggttgcccccttcgcaggccgaagatgtccaagccgccctggtggcactgatgtcacaagaggaacagtag

SEQ ID NO: 23594 - DNA, 192 bp, Artificial Sequence
  Description of Artificial Sequence: Synthetic coding sequence
atgctgtgcgacaacttccccggcgccgtgttccccggctgctactggggctcatacggttaccctcttgggtactccgtggggtgtggatacggcagtacgtactcacctgttggctacggcttcggttacggctacaatgggtgcggcgcattcggctatcgcaggtacagcccattcgccctgtattag

SEQ ID NO: 23595 - DNA, 1083 bp, Artificial Sequence
  Description of Artificial Sequence: Synthetic coding sequence
atgctgggcagcggcttcaaggccgagcggctgcgggtgaacctgagactggtgattaataggcttaagttgcttgaaaaaaaaaagacggagttggcgcagaaggcaagaaaagagatagccgattacctcgccgccggaaaggatgaacgcgccaggatacgggtggagcacataatcagggaagattatcttgtcgaggccatggaaattctggagttgtactgcgatctgctcttggccagattcggcttaatccaaagcatgaaggaactcgactccggcttggcagaatctgtgagcacgctgatctgggcggcaccaagactgcagagtgaggtggccgaacttaaaatagtggcagatcagttgtgcgcaaagtatagcaaggagtacggcaagctctgccgaacaaatcagattggaacggtgaatgaccggctgatgcataaattgagtgttgaagcaccgccgaagatcctggtcgagcgttacctcattgaaattgctaagaattataacgtcccttacgaacccgattctgtagtgatggctgaagcgcctcccggagtcgaaaccgaccttattgatgtcggcttcacagacgacgtgaaaaaaggtggaccggggagaggcggcagtggaggctttactgcccccgtgggaggtccagacggaacagttcctatgcccatgcctatgcctatgccaatgcctagcgccaatacaccgttctcatatccgctcccaaaaggtccgtccgatttcaatggactccccatgggaacatatcaagctttcccgaatatccatccaccccagatacccgcaactccaccctcctatgagagcatgacgcttatgctaataagaatcagtctgctgcatagactgcttgtactcgatccgtcccaaaaacccttgcagagctttctccccgatctgcaaattacaatgactactttgagttaccagtcttgccacctctgtcagacccactatcagctgcacttgctggtcccagcccctcagcatttgaaaactcttaccctgatgatctttcccgggggactcaaaagctag

SEQ ID NO: 23596 - DNA, 528 bp, Artificial Sequence
  Description of Artificial Sequence: Synthetic coding sequence
atgcccaagcggagctgccccttcgccgacgtggcccccctgcagctgaaagtacgggtgagtcagagggaactgtccaggggcgtgtgcgctgaaaggtattcccaagaagtgtttgagaaaacgaaaaggctgctctttctgggcgcccaggcctacctggatcatgtctgggacgaagggtgcgcggtagtgcatctgcctgaaagccccaaaccaggtcctacgggagctccccgcgccgctcgtggccagatgctgataggccccgacggtcgtttaatccggagcctgggccaagcctcagaggcggatccctcaggagtcgccagcatcgcctgctcgtcttgcgtgcgtgctgtcgacggcaaagccgtctgcgggcagtgcgaacgggcactttgcggccagtgcgtgcgaacctgctggggttgtgggtcagttgcttgtactctatgcggcctggtggactgctctgatatgtatgaaaaagtgctctgcacaagctgcgcgatgttcgagacgtag

SEQ ID NO: 23597 - DNA, 366 bp, Artificial Sequence
  Description of Artificial Sequence: Synthetic coding sequence
atggaggccgaggtggacaagctggagctgatgttccagaaggccgaatcagacctagattatatccaatataggctggagtacgaaattaagacgaatcatccggactccgcaagcgaaaagaaccccgttactcttctaaaagagttgagtgttatcaaaagcaggtaccagaccctgtacgctcgattcaagccagtagccgtcgagcagaaggaatctaaaagtcgcatctgtgccacagtgaagaagaccatgaatatgatccagaagctgcaaaaacagacagacctcgagctgagccccttaaccaaggaggagaaaacagccgccgagcagtttaagtttcacatgccagacctctag

SEQ ID NO: 23598 - DNA, 1968 bp, Artificial Sequence
  Description of Artificial Sequence: Synthetic coding sequence
atggtgaccaccctgggccccaagatggccgccgagtggggcggcggtgttgggtattccgggtctggacccggccgaagccggtggcgctggagcggaagtgtgtgggtcaggtctgtgttgctcttgctcggcggactaagggcttccgccacttccacacctgtctcccttggaagttctcccccttgccgacatcatgtaccctcggacacagaagtaatcaataaggtgcacctcaaggcaaatcacgttgttaagcgagacgtcgacgaacacctgagaatcaaaaccgtgtacgacaagagtgtggaagaactccttcccgaaaaaaaaaacctggtgaaaaacaagctttttccacaagcaatcagctacttagagaagacgtttcaggttcggagacctgctgggaccatcttacttagtagacagtgtgctacaaatcaatatctccggaaggaaaacgatccacatcgctattgcaccggcgagtgcgcggcccacacgaaatgcggacctgtgatcgtacccgaagaacacctgcagcaatgtagagtgtatagaggaggcaagtggccccatggtgcagtaggagtccccgaccaggaaggcatctccgatgccgattttgttctgtacgtgggggccctggccacagagcggtgcagccacgagaacataatctcctatgctgcctactgccagcaggaagcaaacatggaccggcccatcgccgggtatgccaacctgtgtccaaatatgatcagtacccagccccaagaattcgtcggcatgctctccaccgtgaaacacgaggttattcatgctcttggattttcggctggactttttgccttttatcacgacaaggatggtaacccccttacaagccggtttgccgatggcctccctccatttaactactcacttgggctctatcagtggtctgacaaggttgtgagaaaagttgagagactgtgggatgtgagagacaataaaatcgtgcgacatacagtttatctgttagtgactcccagggtagttgaggaagcgcggaagcactttgactgtcccgtgcttgagggaatggagctggaaaaccagggcggggtcggtaccgagctcaaccattgggagaaaaggctcctcgagaatgaagcgatgacaggctcccacacgcagaacagggttctcagccgaatcactctagcgttgatggaggacacagggagacagatgctgagcccctactgcgacactctgcgctccaatcctcttcagctgacctgcaggcaggaccagcgggctgtggctgtctgcaatttgcagaaatttcccaaaccactgcctcaggagtatcaatactttgatgaactctccggcattcctgcagaggacctgccttactatggcggcagtgttgaaatcgctgattattgccccttttcacaggaattcagttggcatctcagtggcgagtaccaacggtcaagcgactgtcgcatcttggagaaccagccagagatcttcaaaaactatggggccgagaaatatggcccccactccgtctgcctcatccagaaatctgccttcgtcatggagaaatgcgaacggaagctttcttaccccgactgggggtcaggatgctatcaggtctcatgttctccccaaggccttaaagtctgggtgcaggatacatcctatctttgctcaagggcaggccaggttctgcccgtctccatccagatgaacgggtggatccatgacgggaatctgctttgtccctcttgttgggacttttgtgagctttgcccacctgagaccgacccccccgcaacaaacctcacacgagccctgcctctggacctctgttcttgcagttcatccctcgtggtgacgctttggcttttgctcggcaacctctttccactgttggcaggttttttgctgtgcatctggcactag

SEQ ID NO: 23599 - DNA, 408 bp, Artificial Sequence
  Description of Artificial Sequence: Synthetic coding sequence
atgggccgggtgcggaccaagaccgtgaagaaggccgcccgggtgatcattgagaagtactatacaaggctaggcaacgacttccacaccaacaaaagggtgtgtgaggaaatagccattattccctccaagaaactgaggaataaaattgccggctacgtaactcatctgatgaaacggattcagcgcggaccggtgagggggatcagcattaagttacaggaggaggagcgagagcgccgtgacaactacgtgccggaggtgagtgccctcgaccaggaaattattgaagtcgatcctgacaccaaggagatgctgaaactattagacttcggcagcctaagtaatctccaggtgactcagcccactgtgggaatgaatttcaaaacgccaagggggcctgtctag

SEQ ID NO: 23600 - DNA, 1119 bp, Artificial Sequence
  Description of Artificial Sequence: Synthetic coding sequence
atgaaccactgccagctgcccgtggtgatcgacaacggcagcggcatgatcaaggcaggtgttgcaggatgtagggaacctcagttcatctatcccaatattataggcagggccaagggccaatctagggctgctcaaggcgggctggaactgtgtgtaggggaccaggcccaggactggcgaagttccctgttcatctcttaccctgtcgaacggggcctcatcaccagctgggaagatatggagataatgtggaaacatatctacgattataatttgaagctaaaaccctgtgacggtcctgtattgataacagagccagcactgaatccactggctaacagacaacagattactgagatgttcttcgaacacttgggtgtgcccgccttttatatgtcaattcaggcagttctggcgttgttcgccgcaggtttcaccacaggactggtgttgaatagcggcgcaggcgtaacgcagagcgtgcccatttttgaggggtactgcctgcctcacggtgttcagcagctggacctcgctggactggatcttaccaattatttgatggtgttaatgaaaaatcacggcataatgctactctccgccagcgatcggaagatcgtggaggacatcaaggaatccttttgctacgttgccatgaattatgaggaagagatggcaaagaagccggattgtctggagaaggtgtaccaattgccagatgggaaagtcatccaattgcatgaccagctcttttcctgcccggaggcccttttcagcccatgccacatgaaccttgaggcacctggcattgataagatctgcttctcaagcatcatgaaatgcgataccggcctgcgcaattcctttttttccaatatcatcctcgctgggggctcaacctctttcccggggttagacaaacgtttagttaaggacatcgctaaggtcgcccccgccaatacagctgtacaggtgatcgccccccctgaaagaaagatttctgtgtggatgggagggagtattctggctagcctatcagcttttcaggacatgtggatcacagcggccgaatttaaggaagtcggccccaatatcgtccatcagagatgtttttag

SEQ ID NO: 23601 - DNA, 3072 bp, Artificial Sequence
  Description of Artificial Sequence: Synthetic coding sequence
atggacgccaacagcaaggacaagccccccgagaccaaggagagcgcaatgaacaacgccggcaacgctagcttcattctgggcaccggaaagatcgtgactccccagaagcacgctgaactgccacccaatccatgcacgcccgataccttcaaatctcccttgaatttttctacagtgaccgtggagcagctgggaattacccccgaatcatttgtacgcaattctgcgggaaagtcctcttcctatctgaaaaaatgcagacggaggtctgccgtcggagcacggggatcgcccgaaactaatcaccttatcaggtttattgccagacagcagaacatcaagaatgctcgtaagtcccctttggcccaggattctccatcgcaggggtcccccgccctctaccgcaatgtgaacaccctgagggagagaatttcagcctttcagtccgcctttcactccatcaaggagaatgagaagatgacaggatgcctggagttttccgaggcgggaaaggaatccgagatgactgacctgacgaggaaagagggcttgtctgcatgtcagcagtccggtttccccgctgtactcagcagtaaacgccgaagaatctcttaccagcgagactcagacgagaatctgacagacgcggagggcaaagtcatagggctgcagatttttaatattgataccgaccgggcctgtgctgtcgagacgtcagtcgatctctctgaaatttctagcaagctcggttccacccagagcgggtttctagtagaagaatcactccctctcagtgaactgaccgagaccagcaacgccctgaaggtggcagactgcgttgtcggtaagggaagcagcgatgctgtttcccccgatacctttacagcggaggtgtcttcagacgctgtccccgacgtccggtcacccgctacaccagcttgcaggagggacctccctacccccaagacattcgttctgagatcagtgctgaagaagccttcagtgaagatgtgtctggagagcttacaggagcactgtaataacctgtacgacgatgatggtacccatccgtctctgattagtaacctgcccaattgctgtaaagaaaaggaggccgaggatgaggagaacttcgaagcacctgcattcctcaatatgcggaaacgcaagagggtcacttttggtgaggacctgtcccccgaagtatttgacgaatccttgcccgcaaataccccacttaggaaaggagggactccagtctgtaaaaaagacttttccggcctgtccagcctcctgttggaacagtctccagttcctgagcctctacctcaacccgatttcgatgacaagggcgagaatcttgagaatatcgagccccttcaagtgagttttgctgtgctctcgtcgcctaataagagctccattagcgaaacactcagtgggaccgacacatttagctcgagcaataatcacgaaaagattagctcacccaaggtaggcaggattactagaacatccaatcggcgaaaccagctggtcagcgtagtcgaagaaagcgtgtgtaacttgctgaataccgaagtccagccgtgtaaggaaaaaaagattaacagacggaagagccaggaaaccaagtgtaccaaaagagcactaccgaaaaaatctcaggttttgaagagttgccgcaagaagaaaggcaagggcaagaagtcagtgcagaagagcctatacggagagcgagacattgcgtcaaagaagcccctgctctcacctattcctgagctgcctgaggtgcccgagatgaccccctccattccctcaatccgaaggctgggctccggctacttttcaagcaacgggaaactcgaggaagttaagactcctaaaaatcctgtcaaaagaaaggacctgttgcgccatgaccccgacctccacatgcaccagggatacgataagtacgatgtctctgagttctgtagctacattaaatcgagctccagcctcggcaacgccacttccgacgaggatcctaacaccaatatcatgaatatcaacgagaataagaacatcccgaaggctaagaataagtccgagtctgaaaacgaaccaaaggccggtacagacagccccgtctcatgtgccagcgtcactgaagagagggtcgcaagcgactcacccaaaccagccctgaccctgcagcagggacaagaattctctgccggaggccagaacgccgagaacttgtgtcagtttttcaaaatctcacccgatctgaatatcaagtgcgagcgcaaagacgactttttaggtgccgctgaagggaaactccagtgcaatcggctgatgcctaattctcagaaagattgtcattgcctgggagatgtactgattgaaaacacaaaagagtccaagtcgcagtcagaggatttgggacgcaagccaatggagtcatccagtgttgtgtcgtgccgcgatagaaaggaccgacgccggtccatgtgctattcagacggacgctcactgcatctcgagaagaacggtaaccacacacctagctccagcgtaggaagcagcgtcgagatttccctggagaactccgaactcttcaaggatctgagtgacgctattgagcagacatttcagaggcgaaattccgaaacgaaagtccgcaggtctaccaggctccagaaagacctcgagaatgagggcctcgtttggatctccctcccactgccctccaccagtcagaaggcaaagcgtcgaactatctgcactttcgactcatctgggtttgaaagcatgtctcctatcaaagaaaccgtgtcctccagacagaaaccgcaaatggcccccccagtgtccgaccccgagaacagtcaggggcccgccgccggtagttccgacgaacccgggaagcgtagaaaaagcttctgcatttctacacttgcaaatactaaggctaccagtcagtttaagggctaccgacgcagatccagcctgaatgggaaaggcgagtcctctctgaccgctctggagcgaatcgaacacaatggagaacgaaaacagtag

SEQ ID NO: 23602 - DNA, 963 bp, Artificial Sequence
  Description of Artificial Sequence: Synthetic coding sequence
atgagcaagagcgagagccccaaggagcccgagcagctgcggaagttgttcattgggggactgtcgttcgagacaaccgatgaatcattgaggtcacattttgaacagtgggggactctgaccgattgtgtcgtcatgagagatcctaatacaaagcggagcaggggttttgggttcgtaacttacgccaccgtggaagaagtggacgccgcaatgaacgcaagacctcacaaggtagatggtcgcgttgtcgaaccaaagcgcgcggtctcaagggaggactctcagaggcccggcgcgcatctaaccgtgaagaagatctttgtgggcggcataaaggaggataccgaggagcatcatctccgggactactttgaacagtacggcaaaattgaggtcatcgagattatgacagataggggctcaggtaagaaacggggctttgccttcgtgacatttgacgatcacgatagcgtagacaaaatcgtcatacagaagtaccataccgtgaacggccataactgcgaagtgcggaaggctttatcgaaacaagaaatggcctccgccagtagttcccaacgcgggcgcagcggatctggaaatttcggagggggacggggcggaggattcggggggaatgacaatttcggacgcggaggcaacttctctgggaggggggggttcggaggaagtaggggggggggaggatatggagggagcggggatgggtataatgggttcggtaacgatggcaataactttggcggcgggggctcctacaatgatttcggcaactataataatcagagctcgaacttcggcccaatgaagggcggcaattttggaggcaggtcttcaggtccttacggcggtggaggccagtacttcgccaaaccacgtaatcagggcgggtatggaggaagcagcagctcttcctcatacgggtctggcagacgcttctag

SEQ ID NO: 23603 - DNA, 141 bp, Artificial Sequence
  Description of Artificial Sequence: Synthetic coding sequence
atgtgcagcctggccagcggcgccaccggctacagccacctgctgaagaaacactttcatacagtctccttgtctatcagcttgatactgactgcttggttcattaacatggacttgaattttatggatacactaagttag

SEQ ID NO: 23604 - DNA, 198 bp, Artificial Sequence
  Description of Artificial Sequence: Synthetic coding sequence
atgtgctactacagcaactactacggcggcctgcggtacggctacggagtgctaggcggcggatacggctgtgggtgcgggtacgggcatggttacggcggcctggggtgtgggtacgggaggggctatggcggatacggctacggttgctgtagaccgtcctgctacggcaggtactggtcctgtgggttttattag

SEQ ID NO: 23605 - DNA, 7059 bp, Artificial Sequence
  Description of Artificial Sequence: Synthetic coding sequence
atggagaaggccaccgtgcccgtggccgccgccaccgccgccgagggggagggttcaccaccagccgtggcggccgtggccggccctccagccgctgccgaggtaggtggcggggtgggcggaagctcccgggcccgttcggcctctagcccgaggggcatggtacgcgtttgtgacctccttctcaagaaaaaacccccccagcagcaacaccataaggcaaagcggaataggacatgtcgcccccctagttcatccgaatctagctccgattccgataatagtggcggcggaggaggagggggaggaggcggtggcggcggaggcggaactagcagcaacaactctgaggaagaagaggatgacgacgatgaggaagaagaggttagcgaagtggagagttttatcctggaccaggatgacttggagaaccccatgttagaaacagcttccaaactgctactgagtggaactgccgacggcgcagacctgagaacagtcgatcctgagacccaggcccgtctggaagccttacttgaagcggccgggattggcaagctgtctactgctgatggcaaagcttttgcagatcccgaagtgttgcggcgactgacttcctccgttagctgtgccctggatgaggctgccgccgcactgacccgcatgcgagcagaatccacagccaatgctgggcagtctgataacaggagcttagctgaggcatgttctgagggggacgtcaacgctgtcaggaagttattgattgagggacgatccgtgaatgagcacacagaagaaggagaaagcttgctgtgcttagcatgcagcgctggctactatgaattggctcaggtgctgctagctatgcatgcaaatgtggaggatcgtgggattaaaggagatattaccccactcatggcagccgctaacggaggacacgttaaaattgtgaaacttctgctggcccataaagccgacgtgaatgctcagtcttcgactggcaacaccgccttgacctatgcttgtgccggaggttacgtagacgtcgtgaaagtactgctggaatcaggcgcctctatagaagaccacaacgagaacgggcatacccctctcatggaagccggttcagctggacacgtggaagttgctcgcctattactcgaaaacggcgctggcatcaatactcacagcaatgagtttaaagagagtgccctcaccttggcttgctacaagggccatcttgagatggtccgcttccttcttgaggcgggggccgatcaagagcacaaaactgacgagatgcataccgccctgatggaagcttgcatggatggccacgtcgaagtggcccgattactgttggacagcggggctcaagtgaatatgcctgctgacagttttgagtcccctttgacacttgcagcctgtggcggccacgtggagttagccgccttgttaattgagcgcggtgcctctctagaggaggtcaacgatgaggggtatacaccgctgatggaggctgcgagggagggccacgaagagatggtcgctttactgctgggccagggtgccaacatcaacgctcagaccgaggagacacaggagactgctctcacgctggcctgctgtggggggtttctagaagtcgcggactttctaattaaagctggggccgacatagagctgggctgctccacccccctaatggaagcggcacaggagggacacctcgaactggttaaatacctactggctgccggggccaacgtgcatgccacaaccgctaccggcgacactgccctgacgtacgcttgtgagaatggccacaccgacgtagccgatgtgttgctacaggccggggcagacctcgagcacgagtctgaaggcggcagaacacctctgatgaaagctgcccgcgccggtcatgtctgtacagtccagttccttatatcgaagggggcaaatgtgaatcgcactaccgccaataacgaccacaccgtgctgagtctggcctgtgctggtggacatctcgcagttgtggaactgttacttgctcatggcgcagaccccactcaccgcctgaaggacggcagtacaatgcttattgaagccgcaaaaggcggccatacttctgtcgtatgttatcttctcgattatcctaataacttgctgtccgctcccccacctgacgtcacgcaactcactccaccctcacacgatctgaatcgggcccccagggtccctgtccaggctcttcccatggtggtgccgccccaggagcccgataaaccaccggccaacgttgcgacgaccctaccgattagaaacaaagcggtgtcgggcagagcttcagctatgtcaaacacccctactcacagcattgcagcatccatttcacagccccagactcctactccatctcctatcatctccccctctgctatgctgccaatttacccagcaatagatatcgatgcacagaccgagtccaatcacgacaccgctctcaccctggcatgtgccggtggacatgaggaactggtgcagaccctactggagcgcggagcatccattgagcacagggacaagaaaggcttcacccccctgatattagccgcaactgccggacacgttggtgtggttgaaatcctgctggacaacggcgccgacattgaagcgcagagcgagcggactaaggacacccccctctctctcgcatgcagtggaggaaggcaggaagtggtggaactcctgctagcccgcggcgccaacaaggaacataggaacgtgtccgattatacacccctgagtctggctgcctccggcggatatgtgaacataattaagatattattaaatgcgggcgcagagatcaatagcagaactggctccaagctcggaatatcacctctgatgttagctgctatgaatgggcacaccgcggcggtgaagctcctgctcgatatgggttcagacataaacgcccaaattgaaacgaaccgaaacactgccctaacactggcctgttttcagggtcgcacagaggtggtctccctgctgctggatcggaaggcgaatgttgagcaccgcgcgaagaccggactgacccccctgatggaagcggcgtctggagggtatgccgaggtgggcagggttctgctcgataagggagctgatgtcaacgcccctcctgtgccaagtagcagagacaccgcccttaccatcgccgccgataaagggcactataagttctgtgaactactgattgggagaggagcccacattgacgttaggaacaagaagggcaatacccccctttggctcgctgctaacgggggccatttggatgttgtgcaactccttgtgcaagccggggccgatgtggatgctgcagataatcgcaagatcacgcctttgatggctgcttttaggaaaggccatgtcaaagtggtcaggtacctggttaaggaagtcaatcagtttccttcagactccgagtgtatgcgctacattgcaaccatcactgataaagaaatgctcaagaaatgccacctgtgcatggagagcattgtgcaggccaaagacaggcaggccgccgaagctaataagaatgcgagcatcctgctcgaggagctcgatctggaaaaactccgcgaggagtctcgacgcctggcattagccgctaaaagagagaagcgcaaggagaagcggaggaaaaaaaaggaggagcaaaggaggaaacttgaggagattgaagccaagaataaggaaaacttcgagttgcaggccgctcaggagaaggaaaagcttaaagtagaggatgagcctgaagttctgacggaacccccttccgccacaactacgacaacaatcggtatctcagcaacctggacaactctggcggggagtcacggaaagcgcaacaatacgataaccacaacatcatcaaaacgcaagaatcgaaaaaataaaattacacctgaaaacgtacagattatattcgacgatccattgccaattagctactcccagccagagaaggtgaatggtgaatccaaatcgagttccactagcgaatcaggtgattctgataacatgagaatcagttcctgctctgacgagtcgtccaactcaaacagtagtaggaagtccgacaaccattcacccgccgttgtgaccactacggttagctccaagaaacagccaagcgtccttgtcactttccccaaggaggagcggaaatccgtgtcaggtaaggcatccattaagttgagcgaaacaatttccgaggggacctctaattcactgtcaacgtgtaccaagtccggcccctcccctctgtccagcccaaacggcaaacttacggtcgcctcaccaaagagagggcagaagagagaagagggctggaaggaagttgtccgacgaagcaaaaaggtgagtgtacctagcacggtcatcagcagagtgattggccggggtggctgcaacataaatgcaatcagggagttcaccggtgctcatattgacatcgacaagcagaaagacaaaaccggcgatcgaattatcactattcgaggcggaaccgagtccacccgccaggcaacccaactgataaacgctctaattaaggatcctgacaaggaaatcgatgaactgattccaaaaaaccggctgaagtcttcaagcgcaaatagcaaaatcgggtcatcagctcccaccacgactgccgcgaacaccagtctcatgggaatcaaaatgaccacagtggcattgtcctctacttcacagactgcaacagccctaactgtgcctgccatcagctctgcatccactcataagacgatcaaaaacccagtaaataacgttcgccctggctttcccgtcagtctgcccttagcgtaccctccccctcagttcgctcacgcactgctggctgcgcagacgtttcagcagatcagaccaccacgattaccgatgactcactttggtggcacatttccgccagcgcagtcgacttggggaccctttcctgtgcggcctttatcccctgcccgagctactaacagccctaagcctcacatggtgccaaggcacagcaatcagaatagctcaggctcccaagttaactctgccggttccttgacatccagccctacgacaacaaccagctcttctgctagtactgtccccggaacttctacaaacgggtctccctctagtccttcagtgcggagacagttgtttgtgaccgtcgtgaagacgagcaatgccaccactacaactgtgacaacgaccgcatccaacaacaataccgcaccgaccaatgccacatatccaatgcccaccgctaaagagcactacccagtttcttccccgtcttcaccctccccaccggctcaaccaggaggggtctcgcgtaattccccactggactgcggcagtgcatcccccaataaggtagcaagcagcagcgaacaggaagcaggctctccaccagttgtagagacaacgaacaccaggcctcctaacagcagtagttcctcggggagttccagtgctcacagtaaccagcagcagccaccaggatctgtgagtcaggagccaaggcccccgctgcagcagtctcaggttcctcccccggaagttcgtatgacagtgccacccctcgccacttcctccgctccagtcgcggtccctagtacagctcctgtgacatacccaatgcctcagacacccatgggctgcccccagcctacacccaaaatggagacacccgctatcagacccccaccgcacgggacaactgccccacacaagaatagcgcttcggttcaaaactcgagtgtagctgttctgagcgtgaaccatatcaagagacctcacagcgtcccctcaagcgtgcagctccctagcacattgtcaacacagtcagcctgccaaaatagtgtccatcctgcaaataagcctatcgcaccaaacttttccgctcctttgccatttggcccattctccaccctgtttgagaactctcctacgagtgcccatgctttttggggcggctccgtagtgagctctcagtccacccctgagtcaatgttgagcggaaagtcatcatacctgcctaactcggatccgctacaccagtcagacacctctaaggcgcctggttttcgccctcccttgcaacgacctgcgccatccccctctggtatagtgaatatggattccccctatgggtcagttaccccctcctccactcacttagggaatttcgctagtaatatctccggcggccagatgtacggacccggggcccccctggggggcgcgcccgccgccgcaaactttaataggcagcatttttctcccctgtctttgttgactccatgcagttccgccagtaatgattcgagtgcccagtctgtcagctctggcgtgagagctcctagtcctgctccctcttctgtgccactggggtccgagaagcctagtaatgtgagccaggacagaaaggtgcctgtgccgataggcacagagcgatctgcccgcataaggcagacaggaacatcagcgccttccgttatcggttcaaacctgagcacctcagttgggcacagtgggatctggagctttgagggaattggtggcaaccaggacaaggtggattggtgtaatccagggatgggcaaccctatgatccatcgacctatgtccgaccccggcgttttctcccagcatcaggccatggagagagatagcactggtatagtgactccctcagggacctttcaccagcacgtgcctgccgggtacatggactttccaaaggtcggaggcatgcccttctcggtatacggcaatgcaatgattcccccggtcgcccccatacccgacggcgcagggggtccgatcttcaatggcccccatgcggccgacccttcatggaactcactcattaaaatggtatcctcctcgactgagaataatggacctcagaccgtgtggacggggccatgggccccgcatatgaattcggtgcacatgaaccagctgggatag

SEQ ID NO: 23606 - DNA, 1374 bp, Artificial Sequence
  Description of Artificial Sequence: Synthetic coding sequence
atgagcggcacccgggccagcaacgaccggccccccggcgccggcggagtgaagagaggcaggctgcaacaggaggcagctgcaactgggagcagagtaaccgtggtcttgggcgcccagtggggggacgaggggaagggaaaagttgtggacctgcttgccaccgatgccgacatcatctctcgctgccaaggcgggaataacgcaggtcacactgttgtagtggatgggaaagagtatgacttccacttgctcccttcaggtatcatcaacaccaaagccgtgtccttcattggaaacggggttgtcatccatctgccaggactgttcgaggaagctgagaagaacgaaaagaagggcctgaaagattgggagaaaaggctgattatcagcgacagagcccacctggtatttgattttcaccaggctgttgatggtctgcaggaagtccagagacaagcccaggaaggcaagaatatcgggaccacaaaaaagggcatcgggccaacatatagcagcaaagccgccaggacaggactccgcatatgcgacttgcttagcgacttcgacgagttttcctctcggttcaagaatctggcccatcagcaccagtctatgttccccactctcgagatagacatcgaggggcagctgaaacgcttgaaagggttcgctgagcggattagacccatggtgagagacggcgtctacttcatgtacgaggcactccatggcccaccaaagaaaattctcgtggaaggtgccaacgcagctctcctggatatcgactttggcacctaccccttcgtgacgtctagtaactgtaccgtggggggtgtgtgtaccggactgggtattcccccgcagaacatcggcgacgtctatggggtggtcaaagcctataccactcgcgtaggcatcggtgcctttccgaccgagcaaattaacgaaatcggaggcctcctacagactaggggacatgagtggggggtgacaaccgggcgtaaacgccgatgtgggtggctggacctgatgatactgcggtacgcacacatggtcaacggattcactgccttagctctgacgaagctagacattttggacgtgcttggagaagttaaagtgggcgttagttacaagctaaacggaaaaagaatcccctactttcctgcaaatcaggaaatgttgcaaaaggttgaggtggaatatgagacccttccggggtggaaagccgacaccactggagcccggaggtgggaggacctgccaccacaagctcagaactacattcgcttcgtggagaatcacgtcggggttgccgtgaagtgggttggcgtgggaaagtcccgtgagagtatgatccagttattttag

SEQ ID NO: 23607 - DNA, 1596 bp, Artificial Sequence
  Description of Artificial Sequence: Synthetic coding sequence
atgtgcagcctggccagcggcgccaccggcggccggggcgccgtggagaacgaggaggacctgcctgagctaagtgatagtggggatgaggcggcatgggaggatgaagacgacgccgacctgcctcatggcaaacagcaaaccccttgcttgttttgtaatcgtcttttcacctcagccgaagagacttttagccattgcaaaagtgaacaccagttcaacatcgactccatggttcacaagcatggattagaattctacggctatataaagctgattaattttatccgcctgaaaaatccaaccgttgagtacatgaatagcatatataacccagtcccgtgggaaaaagaggaatatttgaaacccgtgctcgaggatgatctcctgctccaatttgacgtggaggacctctacgagccagtcagcgtgccttttagttaccccaatggcctgtcagaaaacacttctgtggtggaaaaactcaaacatatggaggcccgggcattgagcgccgaggcagctctggctcgcgcgcgagaggacctccagaaaatgaagcagtttgcccaggacttcgtcatgcacaccgatgtccgtacttgcagttcgtcaacttccgtgattgctgatttacaagaagatgaggatggtgtgtattttagttcatatgggcactatggcattcatgaggaaatgctcaaggataagatccgaactgagtcatatagagactttatttatcaaaacccacacatctttaaagacaaagtcgttcttgacgtgggatgcggaactggtatactgtccatgttcgccgccaaggccggcgccaagaaggtgctaggcgtggaccaatccgagattctatatcaggcaatggacatcatacggttgaacaagctcgaagataccattactctcataaagggaaagatcgaagaggtgcacttgccagtcgagaaggtagacgtgattatttccgaatggatgggctactttctgctctttgaaagtatgctggattcagtcctgtatgccaaaaataagtacctcgctaagggcggctctgtttatccggacatctgcaccattagccttgtggcagtgagcgacgttaataaacatgctgacaggatcgctttttgggatgatgtctacgggtttaagatgtcatgcatgaaaaaagctgtcatccccgaggcagtggtagaggtgctggacccaaagacccttatttcagagccttgcggtattaagcatattgattgccatactactagtattagcgatttggaattcagcagcgatttcactcttaagatcactagaacttctatgtgcaccgctatcgcaggctacttcgatatttacttcgagaaaaactgccataaccgggtggtgtttagcacaggccctcagtccacgaaaacccattggaaacagactgtgttcctgctggaaaaacccttcagcgtcaaagctggcgaagccctgaaaggaaaagtgacggtgcataagtccaaaaaggatcccagatcactaaccgttacactcacgcttaacaatagcacccaaacctatggactacaatag

SEQ ID NO: 23608 - DNA, 1659 bp, Artificial Sequence
  Description of Artificial Sequence: Synthetic coding sequence
atgagcgtgctgagccccggcgacctgaagcccaagcggggcagcccacataggggatcgctggatcggacagacgctagcactgacctcgccatgaggtcctggcccagcgagctgggtagccggacatgttctacctctgctacaacgacagcaccatctaacagtactcctattgccagacacccaggccgcaccaagggatacaactccgatgacaatctgtgcgagcctagcttagagtttgaagtgcccaaccaccgtcagtatgtgtcacggcctagtagccttgaatctagccggaatactagctctaatagtagtccactgaatttgaaaggatctagtgaacaacttcacggtcgttccgaatcatttagttctgaagatctgattccttcgcgggatctggccacactgcccagagaagcatctactcccggtcggaatgcgcttggccgccatgagtaccccttgccgaggaatggccctttgcctcaggaaggggcccaaaaacggggaaccgcaccgccgtacgtgggcgtgaggccatgtagcgctagtccttcctcggagatggtgacgctggaagaatttcttgaggaatccaaccgatcaagtcctactcacgatacaccctcatgcagagacgaccttttgtcagactatttcagaaaagcctccgatcctccggccattgggggacaaccagggcccccagccaaaaaggagggggctaagatgcctacaaattttgttgccccgactgtgaagatggcggcccctacatccgaaggccgcccacttaaaccgggccagtacgtcaagcctaattttcgcctaacagaggcggaagcaccacctagcgtcgctcctcggcaggcacaacctccacagtcacttagtctcgggcgtccccgacaggcccccgtacccccagcaagccatgcccctgccagccggtccgcatctctgtctagagcattttctttggctagcgctgatcttctaagggcctctggccctgaagcctgtaagcaggaaagcccacagaaacttggagctccagaggctctcggaggtcgcgaaaccgggtcacacacattgcagtcaccggcgcccccatcatcgcactccttggctagagagcggacccccctcgtgggcaaagcaggttcttcttgccaggggcccgggccaagaagccgccctctggacacccggcggtttagccttgcccctccaaaagaggaaaggctggctccacttcaccaaagcgccaccgcacccgctatcgccacagccggcgcgggagctgccgctgcgggcagtggctcaaatagtcagctgcttcatttctcacccgccgcggctccagcagccagaacaaaacccaaggcccctccgagaagcggtgaagtggccacgattactccagtgcgcgcgggcctgtcgctgtcagagggcgatggagtccctggtcagggatgttccgagggcctgccagccaaatctccaggaagaagccctgacctagctccccacctcggcagagctcttgaagactgctcacgtgggtcggtgtcaaaatcatctcccgcatctccagaaccgggcggcgacccacagaccgtatggtacgaatatggctgtgtgtag

SEQ ID NO: 23609 - DNA, 774 bp, Artificial Sequence
  Description of Artificial Sequence: Synthetic coding sequence
atggccgacaagatggacatgagcctggacgacatcatcaagctgaatcgaagccagaggggaggcagaggaggcggtcgtgggcgcggacgggccggcagccagggtggacggggaggcggggctcaagctgccgcccgtgtgaatcgcgggggtggtcccatccggaacaggccagctatcgccaggggagctgctggcggcggcgggaggaatcggccggccccatattcccggccaaaacagctgcccgacaagtggcagcacgatctgtttgatagcggatttggcggaggagctggggtggagactgggggcaaactgctcgtttcgaacctcgatttcggtgtgtctgacgcagatattcaggaactgttcgccgaattcggaaccctaaagaaggcagcggtgcattacgatcggagcggcagaagtttgggcaccgctgacgttcactttgagaggaaggcagacgccctgaaagccatgaaacagtacaacggggttcctctggacgggaggcctatgaatattcagctggttacgtctcagattgacgctcagagaaggccagctcagagtgtcaataggggggggatgactcgcaacagaggggccggtggtttcggagggggtggaggcactcggagaggcacaagggggggtgcacggggccggggacgcggtgcgggtcgcaattccaaacagcagcttagcgcggaggaactggacgcccaactcgatgcttacaacgcacggatggatacgtcctag

SEQ ID NO: 23610 - DNA, 876 bp, Artificial Sequence
  Description of Artificial Sequence: Synthetic coding sequence
atgggcgtggccgcccggccccccgccctgcggcactggttcagccactctatacctctcgctatcttcgcccttcttttactttatctcagcgtgcgcagtctgggagctcgcagcggctgtggtcctagggcccagccgtgtgtcccgggagaaacggcgccttttcaagtccgccaggagagcggtacacttgaagcccctgagcggaaacagcccccgtgcctgggcccaagaggcatgctgggtagaatgatgcgccggtttcacgcgtcacttaagcccgagggggacgtggggctgtcaccctaccttgctggctggcgagcactcgtggagttcctgacccctttggggagcgtgtttgcctttgctacaagagaagctttcactaaggtgacggatctagaggcccgcgtgcatggcccagacgcggagcattactggtccctggtggccatggctgcgtgggaacggagagccggactgctcgaacagcctggtgctgcaccccgggacccaacaaggagctcaggctcacgcaccctgctgctcttacaccgcgctctgagatggtcccagctgtgtctgcatcgagtcgctacaggggccctcggaggtcctgatgccggagtacagtgctccgatgcttatcgggcggctcttggtccgcaccatccatggctggtgcggcagactgcccgcctggccttcctggccttcccgggtcgtaggcgactgttagagttggcatgtcccggcgcaacggaggccgaagcccgggcagcactagtgagggctgctggcaccttggaggacgtgtataaccgtacgcagtcactgctggccgagagagggctgctgcaacttgcatag

SEQ ID NO: 23611 - DNA, 3303 bp, Artificial Sequence
  Description of Artificial Sequence: Synthetic coding sequence
atgggcaacgccgccggcagcgccgagcagcccgccggccccgccgccccaccaccgaagcaacccgcccctccaaagcagcccatgcctgcagctggagaattagaagaacgatttaaccgggctctcaactgtatgaacctgccccctgacaaagtgcagctgctgagccagtacgacaatgagaaaaaatgggagctgatatgtgaccaggaacgtttccaggtgaaaaacccgcccgccgcgtacattcagaagctgaaatcttatgtagataccgggggggtcagtaggaaagttgctgcggattggatgtccaacctgggattcaagaggagagtgcaggaatctactcaagtcctgcgagagctggaaacctcgttgcgtacgaaccacatcgggtgggttcaggagttccttaacgaagagaacaggggcctggacgttctcctggagtaccttgcctttgcccagtgttccgtcacttacgatatggagagcactgacaacggcgcatcaaattcggaaaaaaataagccattagagcagtccgtggaggacctgtcaaagggcccgccaagctcagtccctaagtccagacaccttacaatcaagttaacacccgcccacagccgaaaagccctcaggaatagcagaatcgtgagccagaaggacgacgttcatgtctgtattatgtgtctccgcgccatcatgaactaccagagtggtttctccttagttatgaatcatcccgcctgcgttaacgagatcgccctgagcctcaataacaagaaccccagaacaaaggccttggttttggaactgctggctgctgtttgcctagtgcgcgggggccacgacatcatccttgcagctttcgacaatttcaaggaagtgtgtggggagcaacacaggtttgagaaactgatggagtattttagaaacgaggattctaacatcgacttcatggtggcctgtatgcagttcatcaacattgtcgtccactccgtggaaaatatgaactttcgcgtcttcctgcagtatgagttcacccacctcggtttggacctgtatctagagcgcctgaggctcaccgagtccgacaagctccaggtccagattcaagcatacttggataacatttttgacgtgggagcgctcctcgaggatactgagacgaaaaacgctgtgttagagcacatggaggagttgcaggaacaggtggccctactgaccgaacggctgcgcgacgccgaaaatgagagtatggcaaagatcgctgaattggagaagcagctgtcccaggcaaggaaggaattggagactctgagagaacggttctcagagtctaccgctatggggccatcccgaaggcccccggagcccgaaaaggcccctcccgctgctcctaccagaccgtccgctttagagctcaaggtggaggagctggaagaaaaaggcctgattcgaatcttgcgcggccctggggatgccgtctccatagagatcttaccagtcgcagtggctaccccatctggcggtgatgcccccaccccaggcgtgccaacaggatcaccttcccccgacctcgcccctgccgccgaaccagctcccggagctgcgccaccaccccccccaccactgcccggactgccatcccctcaggaggcgccccccagtgctcctccgcaggcaccgcccctccctggcagcccggaaccaccaccggcccccccactcccaggagatctcccgccccccccccctcccccacccccgcctcccgggactgatggcccagtcccccctccaccgcctccgcctccgccaccgccaggcgggccccccgacgctctgggccgcagggacagtgagctcggccccggggtgaaagcaaaaaagcccatacagaccaaattcagaatgccactcctaaattgggtcgctctgaagccctcccaaatcactggaacagtgtttaccgaactgaatgacgagaaggtattgcaggaactcgacatgtccgacttcgaggaacagttcaagaccaagtctcagggacccagcctggacctcagcgccctgaaatcaaaggctgcccaaaaggcaccatcaaaggccaccctcattgaagcaaaccgcgccaaaaaccttgcaatcaccctccggaaggggaatctcggggctgagaggatctgccaggccatagaagcgtacgatctccaggcactcggattagacttcctcgaactgctgatgaggttcctgccaacggagtacgagagatctctgataacccgtttcgagagggaacagcgaccaatggaggaattgagcgaagaggacaggttcatgttatgctttagtaggatccctcgcttgcctgaaaggatgactacgcttacattcttaggcaacttcccagacacagctcaactgctgatgccacagctaaatgccatcatagctgcttcgatgtcaataaaaagcagtgacaaacttcgacagattctggagatcgtgctcgcgttcgggaattatatgaactccagcaaaagaggtgccgcctatgggtttcggctgcaatctcttgacgcactcctcgagatgaaatccactgaccggaaacaaacattgctccattatctggtcaaggtcatcgctgagaaatatccacaattgaccggatttcacagcgatctgcatttccttgataaggccggctccgtttcactggattccgtgctcgctgatgtccggtctctacaacgaggactggagcttacccagagagagttcgttagacaggacgactgcatggtgcttaaggagttccttagagcaaattcacccactatggataagctgctggctgactctaaaaccgctcaggaggctttcgaatctgtcgtcgagtacttcggagagaatcccaagaccacgtcccctggtctgtttttttcattgtttagccggtttattaaggcatacaagaaagccgagcaggaagtggaacagtggaagaaggaagccgcagcacaggaagcaggtgccgatacccccggtaagggagagcctcccgcacctaaaagccccccaaaggccaggcgcccccaaatggatcttatctccgaactcaaacgccggcagcagaaagagccacttatctacgagtccgacagggatggcgccatagaggatatcattacagtgattaagaccgttccattcaccgctagaacaggaaaacggactagtcggctgctctgcgaggccagccttggcgaagagatgcctctgtag

SEQ ID NO: 23612 - DNA, 1839 bp, Artificial Sequence
  Description of Artificial Sequence: Synthetic coding sequence
atggagaaccagctggccaagagcaccgaggagcggaccttccagtaccaggattccttgcctagcctgccagtgcccagtcttgaggagtctctcaagaaatatctggagagtgttaaaccctttgctaaccaggaagagtacaaaaaaactgaggagatcgtgcagaagttccaatccgggatcggagagaagctgcaccaaaagctgcttgaacgtgccaagggcaagcgtaactggcttgaggagtggtggttgaacgtcgcttacctggacgtccgcattccaagtcagctgaatgtgaactttgctggccccgctgcccattttgagcactactggcctccgaaggagggcacccaattagagcgtggcagtataacactatggcataatctcaattattggcagcttctgaggaaagagaaagttcctgtccacaaggtggggaatacccccctagacatgaaccaatttcgcatgctgttcagcacatgcaaagtccccggtatcacccgcgactccatcatgaactatttccgcactgagtccgaaggtcgctccccgaatcacattgtggtgctgtgtcgggggagagcttttgtgtttgacgtcatccacgagggatgcttggttacacccccggagctgttgcgacaactcacttacatccataaaaaatgtcacagtgaacctgatggccctggtattgcagctctgaccagcgaggagaggactcgctgggccaaagccagggagtatttgatcgggctggatcccgaaaacctcgctttgttggagaagattcagtcatctctcctggtgtatagcatggaagatagttccccgcatgtaacacccgaggactactcagaaattatcgctgccatcttaattggcgacccgacagtcagatggggcgataaaagctataacttgataagcttctccaatggcgtcttcgggtgtaattgcgatcatgctccatttgacgcaatgatcatggtgaatatctcctactacgtggatgaaaaaattttccagaatgagggcagatggaaaggcagtgaaaaagtgcgggatatcccacttcctgaagaacttatctttatagtcgacgagaaagtactcaatgatatcaaccaggctaaagcacagtacctacgcgaggcctccgaccttcaaatagcggcatacgccttcacttcttttgggaagaaactaaccaagaacaaaatgctacacccggacacctttattcaactggcattgcagctagcatattatagactccacggccatccaggctgctgctacgagaccgccatgacacgacatttctatcatggccggaccgaaactatgagaagttgtactgtcgaggccgtgcggtggtgccaaagtatgcaggacccatccgtaaacctgcgagagagacaacagaagatgctgcaagcattcgctaaacataacaaaatgatgaaggactgctccgcgggaaagggatttgataggcacttactgggcttactcctgatcgccaaagaagaaggcctacccgtccctgagctgttcaccgacccgctgttcagtaaaagtggcggaggcgggaactttgtcttaagtacaagtctggtgggctatcttcgtgtccagggagttgtggtgcccatggttcataatgggtacggcttcttttatcacatccgggatgatcggttcgtcgtggcctgcagcgcgtggaaatcctgccccgagacagacgccgagaagctcgttcagctgacattctgcgcgttccatgacatgatccagctaatgaactccacgcatttgtag

SEQ ID NO: 23613 - DNA, 1773 bp, Artificial Sequence
  Description of Artificial Sequence: Synthetic coding sequence
atgagcgacagccccgccggcagcaacccccggacccccgagagctccgggtctgggagtgggggcggcggaaaaagaccagctgtcccggcagccgtaagtctattgcctcctgccgatcccctgcggcaggctaacaggctgccaattagggttctgaagatgttgagcgcccataccggccatctgttgcaccccgaatatttgcagcccctgtcatctacacccgtttcccctattgagttagatgctaagaaatcccctctcgccctgctggcccagacgtgcagtcagattggaaaaccagatccaccgccgtcttcaaaactcaattcagtcgcagctgcagccaatggtctcggggcagaaaaggacccagggcgctctgcacccggggctgcatccgcggcagcagctcttaaacagctgggtgattctccggctgaggacaaatccagtttcaaaccatactccaaggggagtggaggaggggattcacgtaaggacagcggttcctcaagtgtgtctagtacttctagctcctcttcgtcgtcccccggtgacaaagccgggttcagagtccctagtgccgcgtgcccccccttccctccgcacggggccccggtgtcggcgtctagcagttcctcctctcctggtggctcccgggggggcagcccgcaccacagtgactgtaaaaacggtggcggggtgggaggcggggagcttgacaagaaggaccaggagcccaagccctcgccagaacccgcggccgtgtccagaggtggtggcggagagccaggggcccacggaggcgcggagtcaggagcctccgggcgtaagtcagagcccccaagcgctcttgtgggcgcagggcacgtggctcctgtctccccctataaaccaggtcactcagtcttccccctgccgcctagttctatcggatatcatggttccatcgttggagcttacgctggatacccctcccagttcgtccctgggttggatccctccaagtcaggtctggtgggaggccagttgagtggtggattgggtttgccgcccggcaagcctccaagcagtagccccttaaccggggcctcccctccatcatttctccagggcctatgtcgggacccctactgtctggggggctaccacggggcttcccatttgggaggcagctcctgtagtacctgttctgcacacgaccctgcaggaccctccctgaaagctggaggatatccattagtgtacccaggccacccactccagcctgcagcactgtcgtccagcgctgcccaggcggcattaccgggccaccccttgtatacgtacggcttcatgttacagaatgaacctctgccacactcctgtaactgggtggccgcgtccggcccctgcgacaaaaggtttgccaccagtgaggagctcctgtcacacctcagaacgcatacagcacttccaggggccgaaaagctactggctgcctacccaggggcttccggactgggctccgcagctgctgctgccgccgctgccgcatcctgccacctgcacctccccccgcccgccgcccccggttctcccggaagcctgagtctaaggaatccccatacactggggctgagcaggtaccacccctatgggaaaagtcacttgtcaactgccggcggacttgctgtcccgagcttgccgacagccggtccctactattccccctatgctctctacggacaaaggttagccagtgctagcgctcttggctaccagtag

SEQ ID NO: 23614 - DNA, 1020 bp, Artificial Sequence
  Description of Artificial Sequence: Synthetic coding sequence
atgtggaccgcccggggccccttccggcgggaccggtggagcagcgaggacgaagaagcagcgggcccaagccaggctctgagccctttgctcagcgacactcgcaaaattgtttcagaaggagaactggaccagcttgcacagatcaggcctttaattttcaattttcacgagcagaccgctataaaggactgcctgaagatcctggaggagaagacagcagcttatgacattatgcaagaatttatggcactagagttaaagaacctgccaggggaattcaattccgggaaccagccatcgaacagggaaaaaaaccgttatagggatatcctaccatatgactcaacacgcgtccccctcggtaagtccaaagactatatcaacgctagctatatccgtattgttaactgcggagaagagtacttctacatagccacacagggaccacttctgagcaccatcgacgacttttggcagatggtcctagagaataatagcaatgtaattgcaatgattacccgagaaatcgagggtggaataattaagtgctatcactactggcctatatcacttaagaaacccctcgagctaaaacattttcgcgtgtttctcgagaactaccagattctacaatacttcattatccgaatgtttcaggtggtggagaaatctacaggcacctctcactcagtgaaacaacttcagttcacgaagtggccggatcatggtactcctgccagtgcagactcttttatcaagtacatccgctatgccagaaagtcccatctgaccggacctatggtcgtgcactgctccgcagggatcgggcggactggcgtgtttctgtgcgtggatgtggtattctgtgcaatagtaaagaactgcagcttcaatataatggacatagtggcccagatgcgggaacaacggagtggaatggttcagaccaaagagcagtatcatttctgctatgatatcgtgttggaggttctccgaaagcttctgaccctggactag

SEQ ID NO: 23615 - DNA, 1917 bp, Artificial Sequence
  Description of Artificial Sequence: Synthetic coding sequence
atgagcgccctggccggcgaggacgtgtggcggtgccccggctgcggagaccacatcgcaccctcacaaatctggtatagaacggtaaacgagacttggcatgggtcctgtttcagatgcagtgaatgccaggacagtctcaccaattggtattatgagaaggacggtaaactgtattgtccaaaggactactggggaaagttcggcgagttttgtcacggctgttctctgcttatgaccggcccattcatggtcgcgggcgaattcaagtatcatcctgaatgttttgcatgtatgagttgtaaggttatcatcgaggacggagacgcctacgcgcttgtgcagcacgccaccctctactgcgggaaatgccacaacgaagtggtactagcccctatgttcgagcggttgagcacggaatccgtgcaggaacagctgccgtactctgtcactctgatttcgatgccagctacaaccgaaggaaggagagggttctcagtgtctgtggagagcgcatgctcaaattatgctacgactgtccaggtcaaggaggtgaacaggatgcatatttcacccaacaaccggaacgctatccaccccggggaccggattctggagataaatggaacccccgtgaggaccctgcgcgttgaagaggttgaggacgccatcagccagacaagccagaccctccagctgctgatcgagcacgaccctgtatcccaaagactggaccagcttcgcctcgaggcccgcctcgcacctcacatgcagaatgccggccacccacacgccctaagtacgctcgacacaaaagaaaatcttgaggggactctccgccgtaggagcctcagaagatccaactccatttctaaaagtccaggtcctagttcaccaaaggagccgctgctgttttccagagatatctccaggtcagaaagtctcagatgttcatccagctacagccagcaaatctttcgcccgtgtgacctgatccacggagaagtgctgggcaaagggttctttggccaggcaatcaaggttacccacaaggccacagggaaagtgatggtgatgaaagagctgattagatgcgacgaggaaacccaaaagacattcctaaccgaggtgaaagtgatgcggtcattggaccatccaaacgtgctcaaattcataggtgtactgtacaaagataagaagttgaacttgctcactgaatacatcgagggtggtaccttaaaggattttctgagaagcatggatccttttccctggcaacagaaggtgagatttgctaagggtattgcaagtggtatggcctaccttcactccatgtgcatcattcaccgggacctgaacagtcataattgtcttatcaagctcgataaaactgtggtagtcgcagatttcggactctcccggctgatagtcgaagaaagaaaacgtgccccaatggagaaggcaactacaaagaagcgaacacttcgcaagaacgaccggaagaagcggtatacggtggtggggaacccttactggatggccccggagatgctgaatggcaagagctatgacgaaaccgtggatatattctcattcggcattgtgctgtgtgagataatcgggcaagtttatgctgatccagattgtctccctcgaactctggacttcggactaaatgtgaaactcttctgggagaagtttgttccaaccgattgcccaccagcattttttcctctcgctgccatctgctgcaggcttgaacctgaatctaggcctgccttttcaaagctcgaggacagcttcgaggccctctctttgtatcttggtgagttgggaatcccactccctgccgaactcgaagaactcgaccatacagtttccatgcagtacggcttgacaagggacagccctccctag

SEQ ID NO: 23616 - DNA, 606 bp, Artificial Sequence
  Description of Artificial Sequence: Synthetic coding sequence
atggccgccgccaaggacacccacgaggaccacgacaccagcaccgagaatacggacgagtccaaccacgatccacagtttgagcctattgtgagtctgcccgagcaggagatcaaaactcttgaagaagatgaggaagagctgtttaaaatgagggccaagctcttccgtttcgcctctgagaacgatttgcccgagtggaaggagagaggcacaggagatgtgaagctcctcaagcacaaggagaaaggcgccattcgcctgctcatgcgccgtgataagaccctgaagatttgcgccaaccactatatcactcctatgatggaactaaaaccaaacgcaggttccgatagggcctgggtgtggaatactcacgctgacttcgctgacgagtgccccaaaccggaattgcttgctatccggtttctcaatgcggagaacgcacaaaaatttaagacaaaatttgaagaatgtagaaaagaaatcgaggagagagaaaagaaggcaggatctggaaagaacgatcatgcagagaaggtcgccgaaaagttggaggcgctttccgtgaaggaggaaaccaaggaggatgcagaagaaaagcagtag

SEQ ID NO: 23617 - DNA, 2154 bp, Artificial Sequence
  Description of Artificial Sequence: Synthetic coding sequence
atggccgccgacaagcccgccgaccagggcgccgagaagcacgagggcaccgggcagtcaagcgggatcacagaccaggagaaagaattaagcactaacgccttccaggcatttaccagcgggaattatgacgcttgcctccagcacctggcatgcctacaggatatcaacaaggatgactacaagattattctgaataccgcagtggcggagtttttcaagtctaaccagactaccactgacaacctgagacaaacgctgaatcagcttaaaaaccaagtgcacagcgctgtagaagaaatggacggcttggacgatgtggaaaactccatgctttactacaatcaggcggtgatactttatcatttacgtcagtacaccgaagctatatcagtgggagaaaaactgtatcagtttattgaacccttcgaagagaagttcgcccaggccgtgtgcttcctgctcgtcgacctctacattctgacctaccaggcggaaaaggcgctccatctgctggctgtcctggagaagatgatctctcaaggcaacaacaacaaaaatgggaagaacgaaaccggcaacaacaacaacaaagatgggtctaaccacaaggcggaatccggtgctctcatcgaggccgctaagtcgaagattcaccagtataaagtgagagcctacatccagatgaaaagtctgaaagcatgtaagagggagatcaaatccgtgatgaatacagccggaaacagcgccccatccctgtttctcaagtctaactttgagtacctccgggggaattaccgcaaggctgtgaagctgctgaacagcagcaacattgctgagcatccgggatttatgaaaactggtgagtgcctgcgctgtatgttttggaacaacctgggctgtatccactttgccatgtccaagcacaaccttggcattttttacttcaagaaggcgctgcaggaaaatgacaatgtttgcgcacagctatccgctgggagcacagatccaggcaagaaattttctggccgccccatgtgcacattgcttacgaacaagaggtatgagctgttatataactgtggaatccagctgttgcacatcggccgtcccttggctgcattcgagtgcctgattgaagcggtgcaagtgtatcacgcgaatcccagactgtggttgcggttagcagagtgctgtattgcagcaaacaagggaacctcagaacaggagaccaagggtctgccctcaaaaaaggggattgtgcagtctatcgtgggccaggggtatcacagaaaaatagtattggccagtcagtctatccagaacacagtgtacaacgatgggcagagtagcgccatacccgtggcctctatggagtttgcagctatctgtctgaggaacgctttgcttttgcttcctgaggagcagcaagaccctaaacaggaaaatggcgccaaaaactccaaccagctcggcggcaataccgagagctcagaatcaagcgagacttgccggtgttctattttggcctgcagcgcctatgtggctctcgccctcggcgataacctcatggccctgaaccacgcagataaactgctgcagcagcctaaactatctggcagtctgaagttcctgggacatctgtacgcagctgaagcgctaatatcactcgatcgcatttcggatgccattacccacctcaaccccgaaaatgtgactgacgtgtccctgggaataagttccaatgagcaggatcagggatcggacaagggagagaatgaggctatggagtcctctggcaagcgggccccgcaatgctatccttcaagtgttaatagcgctaggactgttatgctgtttaacttgggaagcgcctattgtctaagatcagagtacgacaaggcacggaagtgtctgcatcaggcggctagtatgatccatccgaaggaggtgcctcccgaagcaatcctgctggctgtctatctagagttgcagaacgggaacacacagctcgccctccaaattataaaacggaatcagctgctgcccgcagtcaagacccactccgaggtgcgaaagaaacctgttttccaaccagtgcatcccatccaacccattcagatgcctgctttcacaaccgttcaacgaaaatag

SEQ ID NO: 23618 - DNA, 1488 bp, Artificial Sequence
  Description of Artificial Sequence: Synthetic coding sequence
atggaggccctgctggagggcatccagaaccggggccacggcggcggtttcttgaccagctgcgaagctgagctgcaggagcttatgaagcaaatagacatcatggtggctcataaaaaaagtgagtgggagggccggactcacgcccttgagacttgcctgaagatccgggagcaggagttaaaaagcctgagatcccagctcgatgtgactcacaaggaggtgggtatgttgcaccaacaggtggaggaacatgaaaagattaagcaggaaatgaccatggagtacaaacaggaacttaaaaaactccacgaagaactgtgtattttaaagcgcagctacgagaagctccaaaaaaaacagatgcgtgagttcagaggcaatacaaaaaaccatcgcgaagaccgaagtgaaattgagaggctgacagcaaaaatcgaggaattcaggcagaaaagtcttgattgggaaaagcagcgcctcatctatcagcagcaggtgagcagcctagaagcccagagaaaagcgttggccgagcagtctgaaatcatccaagcccaactggtaaatagaaagcagaagctggaatctgtggaactatcaagccaaagtgaaattcagcacctgagctccaagctggagcgcgcaaatgatacaatttgcgcgaatgagcttgagatcgagaggctgacaatgagagtgaacgaccttgttggcacatccatgaccgtgctgcaggaacagcagcagaaggaagaaaagctgcgagaatctgaaaagttgctggaggctctacaggaggagaaacgtgagctaaaggctgctctgcagagtcaagagaacctgattcatgaggcgcggatccaaaaggaaaagctgcaggagaaagtcaaagcaactaatactcaacacgctgtcgaagctattagtctcgaaagtgtatccgccacttgtaaacaactcagccaagagctcatggagaaatatgaagaacttaagagaatggaagcacataacaacgagtataaggcggagatcaagaagctgaaggaacagatacttcagggcgagcagtcatattcatccgccctggagggcatgaagatggaaatttctcacctcacccaagagctgcatcagagggatataactatagccagtactaagggaagtagcagtgatatggagaagagactgcgcgcagagatgcaaaaagctgaggacaaggcagtggagcataaggagattctggatcagctggagagcctgaagcttgagaatcgacatttaagtgaaatggtcatgaaattggagttgggtctccatgaatgcagccttcctgtctcacctctcggctccattgccaccagatttctggaggaagaagaattgcggagccaccacatcctggaacgactcgatgcacacatagaggagcttaagcgagagtccgagaaaactgtgcgccagttcacagctcttaagtag

SEQ ID NO: 23619 - DNA, 1962 bp, Artificial Sequence
  Description of Artificial Sequence: Synthetic coding sequence
atgatccccccccaggaggccagcgcccggcggcgggagatcgaggataaactgaagcaagaggaagaaacactatcatttattcgggatagcctggagaagtcagatcagcttaccaaaaatatggtctccatcttgtcatcctttgagagccgtctcatgaagctggagaattcaatcatacctgtgcataagcagacagagaatttacagcgtttgcaggagaacgtggagaagaccctgtcatgtctcgaccatgtgatctcctactaccacgtggcttccgacacagaaaagattattcgcgagggccctaccggtcgactggaggagtatcttggctcaatggcaaaaatccaaaaagccgttgagtatttccaggataatagtcctgattctcccgagctgaataaggttaaactgctctttgaaagaggcaaggaagcactagaatcagaattccggtcactgatgacccgccacagcaaagtggtttcccccgtcctgatccttgaccttatttcaggggacgacgaccttgaagcacaagaagacgtcacactagagcacctccctgagtcagtgttgcaggatgtcatccgcatctctagatggttggttgagtacggcagaaaccaggattttatgaatgtctactatcagatccgatcttcacagttggatcggtccataaaagggttgaaagagcactttcataaaagcagttcaagtagcggagtgccctactctccagctattcccaataagcggaaggacaccccaaccaagaagcccgtgaagaggcccggcagagatgacatgctggatgtggagaccgacgcctatattcactgcgtgtctgcctttgtaaagttggcacagagcgagtatcaactgctcgcagacattattcccgaacaccaccagaagaagaccttcgacagtctaattcaggatgccttggacggacttatgttggagggggaaaatatagtgtcagctgcccggaaggcaattgtgcgccacgacttttcaactgtgcttactgtgtttcctattctccgacaccttaagcagacgaaacctgagtttgatcaggtgttgcaaggcaccgcagcttctacgaaaaacaagctccccggtcttatcacatcaatggaaaccatcggcgcaaaggcccttgaggactttgccgacaacatcaaaaatgatcctgacaaagagtacaacatgcctaaagatggtacagtccacgagctcaccagcaacgctattctattcctacagcagctgcttgactttcaggaaaccgcgggcgctatgctcgcctcccaggaaactagtagtagcgccactagttactcctctgagttttcgaaacgtttactgtctacctacatttgcaaagtcctaggcaatctgcagttgaacttactctccaaaagtaaagtctacgaggacccagctctaagcgctattttcctccacaataattataactatatcctgaaaagcctggaaaaaagtgaactgattcaactggtcgccgtgacccagaaaaccgctgaaaggagctaccgcgagcatatagagcagcaaatccagacctaccagcggtcatggctaaaagtcaccgactacatagcggagaagaatcttccggtgttccagccaggggtaaaactgcgcgacaaggagcgccagataatcaaggagagattcaaaggtttcaacgatggcctcgaggagctgtgcaagatccagaaggcctgggccatccccgataccgagcaacgggaccgaattcgtcaggctcagaaaacgattgtgaaagagacctatggggccttcctgcagaaattcgggtcggtgccctttacgaaaaatcctgaaaagtatattaagtacggtgtcgaacaggttggcgatatgatcgacaggctttttgatacctctgcttag

SEQ ID NO: 23620 - DNA, 735 bp, Artificial Sequence
  Description of Artificial Sequence: Synthetic coding sequence
atggagctgaccatcttcatcctgcggctggccatctacatcctgacctttcccctgtacctgctaaattttctcggactgtggtcttggatttgcaagaaatggttcccttatttcttagtcagattcacagtcatctacaacgaacaaatggcctccaaaaagcgggagcttttctcaaacctccaggaattcgctgggccttcggggaagctgtctctactggaagtcggttgcggtacaggcgctaacttcaaattttacccgcccggttgcagagtcacttgtatcgatccaaacccgaatttcgagaaattcttgattaagtctattgccgaaaatagacacctacagttcgagaggttcgttgtggcggcgggtgaaaatatgcatcaggttgccgatggctcagtagacgtggttgtctgtacactggtgctttgtagcgttaagaaccaggaacgcatcttacgagaggtgtgcagggtgttgaggccaggaggtgccttctacttcatggaacacgtggcggccgaatgctctacatggaattacttttggcaacaggtgttggaccccgcctggcacctgttgttcgacggttgcaacctcaccagggaatcctggaaagctctggagcgggccagcttctccaaactaaagttgcagcacatccaggcaccactcagctgggagcttgtacgacctcatatatacgggtacgcagtgaagtag

SEQ ID NO: 23621 - DNA, 3522 bp, Artificial Sequence
  Description of Artificial Sequence: Synthetic coding sequence
atggccgtggagaccctgagccccgactgggagttcgaccgggtggatgacggaagccagaagatacacgccgaggtccaacttaaaaactatggaaagtttctcgaggagtatacctcccagctccgtcgaatcgaagacgcactggacgattccattggagatgtctgggatttcaatctggatcccatagccttgaagttacttccttacgagcaatctagcctactggaactaatcaagaccgaaaataaagtcttgaataaagtgataaccgtctatgctgctctgtgttgcgaaataaagaaactcaaatacgaggctgagaccaagttctataatggcctgctgttctatggggaaggagctacagatgccagcatggtggagggggactgtcagatccagatgggccgcttcatctcattcctgcaagagctcagttgctttgtaacacgatgctatgaggtggtcatgaacgtggtccatcaactcgcagctctgtacatctcaaataagatcgctccgaaaatcatagaaacaactggagtgcactttcagacaatgtacgaacacctgggagaacttctgacggtcctgttaacactggatgaaatcattgacaaccatattacgctgaaagatcattggacaatgtataaacgcctgcttaaatcagtgcatcataacccgagcaaatttggcatccaggaggagaagctgaagccatttgagaaattcctccttaaactcgagggccaactactagatgggatgatttttcaggcctgcatcgagcagcagttcgattcattaaatggaggcgtgtccgtcagtaagaactcaaccttcgccgaagagtttgcccattccattaggtcaattttcgccaacgttgaggccaagctcggcgagccttccgaaattgaccaacgggataagtacgtgggcatttgcggcttgtttgtgctgcacttccagatattccgtacgatcgacaagaaattttacaagagcctactggatatctgtaaaaaggtcccagcaatcacacttactgccaatattatttggttccccgacaattttctgatccagaaaatccctgcggcagccaagctcctggacagaaagagcctacaggcgatcaagatccaccgggatacgttcctgcagcaaaaggctcagtctctgaccaaggatgtccagagctattacgtctttgtttcctcttggatgatgaaaatggagtccatcttgtcaaaggagcaacggatggataaattcgccgaggatcttactaaccggtgcaatgtgttcatccaaggatttctgtacgcctactcaatcagcacaataatcaagactacaatgaatctctacatgtctatgcagaagcctatgactaagacatctgtcaaggccctctgccgcttagtcgaactcctcaaggcaattgagcacatgttctaccgacgctcaatggttgtggccgactcagtttcgcacataactcaacatctccaacatcaagctctgcattccatctccgtagccaagaagagggtgatttccgataagaaatactccgaacagcgactggacgtgctctcagctctagtgttggcggaaaacactctaaacggaccctccaccaagcagcggcgattgatcgttagtcttgccttgagcgttgggactcagatgaaaaccttcaaggacgaggagctctttccactgcaggtggtgatgaagaagctggacctcataagcgagctccgcgagagagtacagacccagtgtgattgctgcttcctttactggcatcgagcagtgtttcccatttacctcgatgacgtgtacgagaatgcagtggacgctgcgaggctccactacatgtttagtgcactgcgggactgtgtgccagcgatgatgcacgcaagacatctcgagtcttacgagatcctcctcgattgctacgataaagaaataatggaaatcctgaacgagcacttgctggacaagctgtgtaaggagattgagaaagatctgaggctgtcggtgcacactcatttgaaacttgatgatagaaacccgttcaaggttggaatgaaagatcttgcacttttttttagtcttaaccccatcaggttcttcaaccgcttcattgatatcagagcctacgtcactcactatctggataagaccttttataacctgaccacagtggcgctccatgactgggctacgtactctgaaatgaggaatttggcgacgcagaggtatggcctggttatgacggaggcacacctgccttctcagactttggagcagggactggatgttcttgaaattatgcgaaacatccacatctttgtgtcaagatatttgtacaatctgaacaaccaaattttcattgagcgtactagcaataataaacatttgaatacgatcaatattcggcacatcgcgaatagcatcagaacgcacggtacaggcatcatgaatacgactgtcaattttacctaccaattcctgaagaaaaagttctatatctttagtcagtttatgtacgatgaacacattaaaagccgcctcatcaaggacatccgatttttccgtgagatcaaggaccagaacgaccataaatacccatttgaccgggctgaaaaatttaaccggggcatcagaaagctgggtgtcactcccgaaggccagagctatctggatcagttccgtcagctcatctcacagatagggaatgccatggggtacgtaagaatgatccgctccgggggcctgcattgttcgtccaatgctatcagatttgttcctgacctggaggacattgtgaactttgaagaacttgtgaaggaggaaggcctcgccgaagagaccctgaaagctgcaaggcatctggattccgtattatcggatcatacgcgaaattcagcagagggtacggaatactttaaaatgttagtggatgttttcgctccagagtttcggcgccccaaaaacatacacctgagaaacttttatataatcgttccccctctgaccctgaactttgtggaacattccatcagttgcaaagaaaagttgaataagaaaaataaaatcggagccgctttcacggacgatggctttgctatgggagtagcttacattctgaagcttctcgaccagtatagagaatttgattctctgcactggttccagtctgtgagggaaaagtacctgaaagaaattagagcagtggccaagcagcagaatgttcaaagcgcctcacaggatgaaaagttactccaaacgatgaacctgacccaaaagcgactggacgtatacctgcaagaatttgaactcctctattttagcctgagctcggctaggatttttttccgggccgacaaaactgctgccgaggagaaccaggagaaaaaagagaaggaagaagaaacaaaaactagcaatggtgatctttccgatagcaccgtgtctgccgaccccgttgtgaagtag

SEQ ID NO: 23622 - DNA, 972 bp, Artificial Sequence
  Description of Artificial Sequence: Synthetic coding sequence
atgctgcggtggaccgtgcacctggagggcggcccccggcgggtgaatcacgccgctgtcgctgtaggacaccgagtatacagtttcggcggctactgcagcggggaagactatgaaaccctgcggcagattgatgtgcatatttttaatgctgatacgcacaagtggttcacccccagggtcagcggtacagtgccgggagccagggatggtcactccgcttgcgtcctcggcaaaatcatgtatatcttcggaggctatgagcaacaggctgactgcttcagcaacgacattcacaagcttgacaccagtacaatgacgtggactctcatttgcactaaagggtccccggcccgatggcgagatttccattccgcaaccatgctgggctctcacatgtacgtttttgggggaagggccgaccgattcggaccctttcacagcaacaacgagatctactgtaatcgaatccgcgtttttgacacgaggaccgaggcctggcttgactgccctccaacacctgtactccctgagggtcgtcggagtcactccgcttttggatacaatggcgaactttatatcttcgggggttacaacgcccgactaaaccgccactttcatgacctttggaagtttaatccagtgtctttcacctggaaaaagatagaacctaaaggcaaggggccctgccctcggaggcgacaatgctgctgtattgtaggagacaaaattgtgctcttcggcggcaccagtccatccccagaggaaggcctgggcgacgagttcgatctgatagaccacagtgatctgcatattttagacttcagtccttcattgaagacactgtgtaagctcgccgtgatccagtataacctggatcaaagctgccttcctcatgacattagatgggagttgaatgctatgaccacaaattccaacatcagcaggccaatagtgtcttcccatgggtag

SEQ ID NO: 23623 - DNA, 2517 bp, Artificial Sequence
  Description of Artificial Sequence: Synthetic coding sequence
atgaccggcgccgagatcgagcccagcgcccaggccaagcccgagaaaaaggcaggcgaagaagtcatcgccggcccagaacgcgaaaatgatgtgcccctcgtagtgaggccaaaggtccgaactcaggctaccaccggcgctcggccgaagaccgagacaaaatctgtccctgcagctagacccaagaccgaggctcaggcaatgtcaggagcccggccaaagacagaggtccaggtgatgggcggggctcgtcctaaaactgaggcgcagggaataacaggagctaggcctaagaccgacgcgcgcgccgtgggaggcgctcgctccaagaccgatgccaaggctatccctggcgctcggcctaaggatgaggcgcaggcatgggcccagtcagaattcggtacagaggccgtgtctcaggccgaaggggttagtcagacaaacgcggtcgcatggcctcttgcgactgctgaatcaggctccgtcactaagagcaaagggttgagcatggatcgagaactggtcaacgtggacgcagaaacttttccagggacacagggacagaaaggcatacaaccatggtttgggccaggcgaggagaccaatatgggctcttggtgttacagtaggccccgggcccgcgaggaagcgagtaacgaaagcggcttttggagcgccgacgaaacttccacagcatctagcttttggactggagaagaaacaagtgtgcgctcatggccaagggaggagtcaaacacgagaagcagacaccgcgctaagcatcaaactaacccaaggtcaagaccaagatccaagcaggaagcttatgtcgacagttggtcagggtctgaggacgaagcaagcaatccattttccttttgggtcggagaaaacactaacaacctgtttagacctcgcgtgcgggaggaggcgaacattagatccaagctgagaaccaacagagaagattgttttgaaagcgagtctgaggacgaattctacaaacaatcctgggtgttgccaggagaggaagctaatagccgcttccgccaccgggacaaggaagaccctaacaccgcattaaaattaagagcacagaaagatgtggacagtgatcgtgtgaagcaggaacccaggtttgaggaggaagtcatcatcggctcatggttttgggctgagaaggaggccagtctcgagggcggggcttcagccatctgtgaatcagagccgggcactgaggagggagctataggcggcagcgcatattgggctgaggagaaatcctctttaggggctgtggcgcgcgaggaagctaagcctgagtccgaggaagaagccatcttcgggtcttggttctgggatagggacgaggcctgcttcgatctaaacccttgcccagtctacaaggtgtctgatcggtttcgcgatgccgctgaggagctaaacgcgtcgtcaagacctcaaacctgggatgaagtgacagtagagtttaagcccggcttattccatggagtgggcttccgtagcaccagccccttcgggattcccgaggaagcttcagagatgctagaagccaagcccaagaacctagagctctcccccgaaggcgaggagcaggagagcctcctccagcctgaccagccctcccccgagttcactttccagtacgacccctcttatcgaagtgtgagagagatacgggagcatctacgtgccagggaatcggcggaaagcgaatcctggagctgctcatgcatccaatgcgagttaaaaatcggatcagaggaatttgaagaatttctactgctaatggacaaaatacgagaccctttcatacacgagatctcaaaaattgccatgggtatgcgatccgccagccagttcacacgggactttatacgggactccggagtagtctccctgatcgaaaccctgctaaattatccttcttccagggtccggacaagtttcctcgagaacatgatccacatggcgcccccttatccgaacctgaacatgattgaaacctttatttgtcaagtttgtgaggagaccctcgcgcactccgtagactcactcgaacagcttacgggaatccgcatgctgagacacttgaccatgaccattgattaccatacattgatcgctaattacatgtccgggttcctctccctcctaactacagctaatgccagaacgaaatttcacgtgctgaaaatgctgctgaacttgtcagaaaatcccgcagtcgcaaaaaaactattctcagccaaagcgctgagcatattcgtgggcctgttcaatatcgaagagactaatgacaatatccagatagttattaagatgttccagaacatctcaaacattataaaatccggcaaaatgtcccttatcgacgatgatttttcgttggagccattaatctccgcctttcgtgagttcgaggaacttgccaaacagctccaggcccagattgataaccagaacgatcctgaggtggggcagcagagttag

SEQ ID NO: 23624 - DNA, 2649 bp, Artificial Sequence
  Description of Artificial Sequence: Synthetic coding sequence
atgcccggccgggcccggacccgggcccggggccgggcccggcggagggagagctaccaacaggaagcacctggcgggccacgggctccaggatcagcaaccacacaggaaccgccccagttgcagtccacaccacggcctctacaggaagaggtgcccgtggtcaggcccctccagcctagggcagccagaggaggcgccggagggggagcacaaagccagggcgttaaggagcctggaccggaagcggggttacataccgcccctctgcaggaacggagaattggtggagtcttccaggacctcgtggtgaacacgcgccaggacatgaaacacgtcaaggactcaaaaaccgggtccgagggtactgtggttcagctgctggccaaccatttccgggtgattagtcgcccccagtgggtcgcatataaatataatgtggattacaaacctgacattgaggatggcaatctgcggaccatcctcctggaccagcaccggcggaagtttggagagcggcacatcttcgatggtaacagcctgttgctctcaaggcccctcaaggaaaggcgtgtggagtggctctccacaacaaaggataagaacattgttaaaatcactgtagaatttagcaaggagttgactcccaccagccctgattgcctcagatactacaatatcctcttcaggcggactttcaagctattggactttgagcaggtgggccgcaactactacacgaagaagaaagccatccaactttataggcacggaacctcgcttgagatctggctgggctacgtaactagcgtgctccaatacgaaaactccatcactctttgcgccgacgttagccataagctacttaggatcgagaccgcctatgacttcatcaagcgcacatctgcccaggcacagactggcaacattcgggaggaggtgactaataagctgatcgggtctattgtcctaacaaaatataataataagacctatcgggtggatgatatcgactggaagcaaaatccagaggatacattcaataaaagtgacggctcaaaaataacttatatcgactactatcggcaacagcataaagagatcgtgaccgtgaagaagcagcccctcctggtctcccagggcagatggaagaagggactaactggaacgcaaagggaacctatcctcctgatcccccagctctgtcatatgaccggcctcaccgacgagatatgtaaggattactcgattgttaaggagctcgcaaaacatacccggttgagtccacggaggaggcatcacactctcaaggaatttataaatacgctgcaagacaataaaaaagtgagagaactgctgcagttgtgggatctgaagtttgacaccaatttcttgtctgtaccaggtcgggtcctgaagaacgcaaatattgttcaaggcagaaggatggtcaaagctaatagtcagggggactggtctcgtgaaatccgcgagctccccctcttgaacgctatgcccctacatagttggttgatactgtactcccggtcgagccaccgagaagccatgtcccttaaaggccaccttcaatctgtgaccgcccccatgggcatcacaatgaaacccgctgagatgattgaggtagacggggatgccaacagctacatcgatacgttgcgcaagtacacacgccccaccctccagatgggaatgagctgcctgctcgtatttaaggtgatctgcattctgcccaatgatgataaacgccgctacgatagcatcaaacgatacctttgtacgaaatgcccaatcccttcccagtgcgtggtgaaaaaaactctggaaaaagttcaggctcgtaccatcgttaccaaaatcgctcaacagatgaattgcaaaatgggaggggccttatggaaagtagagaccgatgtgcagaggactatgtttgtgggcattgactgctttcacgatattgtgaacagacagaagtccatcgccggtttcgtggcatcaaccaatgcagaactaacaaagtggtactcacagtgcgtgatccagaagaccggagaggagctggtgaaggagctggagatctgtctgaaagccgccttagatgtgtggtgtaagaatgagagcagtatgccacatagtgtcattgtgtaccgtgatggtgtgggggacggacaactgcaggccctgctggaccatgaggctaaaaagatgtccacgtatctgaaaacgataagcccaaataatttcaccctcgcttttatagtggtcaagaagcgcattaatacacgattctttctcaaacacgggagtaattttcagaatcctccccctggcactgttatagatgttgagctgacacggaacgaatggtacgacttttttatcgtgagccaaagtgtacaggatggtacggttacacctacccactacaatgtcatatatgacactatcggcctctccccagacacggttcagaggctgacatactgtctctgccatatgtattataacttacctgggatcattagggtcccagctccctgtcactacgcccataagctggcctacttagtcggtcagagtatccatcaggagccaaatcggtcccttagcacacgcctgttttacctgtag

SEQ ID NO: 23625 - DNA, 1917 bp, Artificial Sequence
  Description of Artificial Sequence: Synthetic coding sequence
atgaaccggcaggtgtgcaagaagagcttcagcggccggagccaggggttttctggcaggagcgctgtggtttccggaagctctcggatgagttgcgtagcgagaagcggaggagccggcgggggagcatgcggcttccgctccggagcaggcagcttcggatcaagatctctgtacaacttggggtctaacaaaagtatttctatatcagttgccgcagggtctagccgagctggcggattcggggggggaaggtcatcctgcgggttcgcaggcgggtacggcggcggcttcggaggctcttatggaggcggcttcggcggcggtaggggtgtgggcagcggtttcgggggggctggcggtttcgggggggccggcgggttcggcggaccaggggtgttcggaggcccagggtctttcggcgggccaggcgggttcggcccaggcggcttcccagggggaatacaggaggtcattgtgaatcagtcactcttgcaaccccttaacgttgaaatagacccgcagatcggccaggttaaggcccaggagcgggagcaaataaagacgcttaacaacaaattcgcgagttttatcgacaaagtcaggtttttggagcagcagaataaggtgttagaaacaaagtgggagctgctgcagcagcagacaaccggctctggcccttcttcactcgagccctgttttgagtcctacattagcttcctctgtaaacagctcgactctctgctgggggagcgtgggaacctagagggcgagctaaagtcgatgcaggatctcgtggaggactttaagaaaaagtacgaggacgagattaataagcggacagcggcagagaatgaattcgtcggcttaaagaaggacgtggacgccgccttcatgaacaaggttgagctgcaagcaaaggtggacagcctgaccgacgaggtgagtttcctacgaacgttgtatgagatggaactgtctcagatgcagagccacgcatcagataccagcgtcgtgctgagtatggataacaacagatgcctagatttaggaagtattatagccgaagtgagggctcagtacgaggaaattgcacagcgatctaaaagcgaagcggaagccctctaccagaccaaactcggcgaactgcagactacagcagggcgacacggagacgaccttcggaacactaagagcgaaatcatggaacttaaccgtatgatccagagacttcgtgccgagatcgaaaacgtgaagaaacaaaacgcaaatctccagaccgcgatcgccgaggccgaacagagaggggaaatggcactcaaagacgcgaacgccaaactacaggatcttcagactgctctgcagaaggccaaggatgacctggcacggctcttgcgcgattatcaggagctgatgaacgtcaaattggccctcgacgttgaaattgccacctatcgaaagctgctagagggcgaggaatgccgcatgagtggcgaatgtcagagtgccgtctgcattagcgttgtgtcaaatgtgaccagcaccagtggctcttcaggaagtagtcgtggcgtgttcgggggtgtcagcggcagcggctctgggggttacaagggcggttctagcagttcgagtagcagtggctacggtgtctccggcggatctggctccgggtatggcggggtgagctcaggttctacgggcggacgcgggagctcgggttcatatcagagctctagtagcggaagccggctcgggggggccggatctatatctgtgagccactccggcatgggctcttctagtgggtcgatccagacatctggcggaagcgggtataagagcggcggcgggggttccacttccattcggttctcacaaacaacctctagctctcagcactctagcaccaagtag

SEQ ID NO: 23626 - DNA, 1080 bp, Artificial Sequence
  Description of Artificial Sequence: Synthetic coding sequence
atggccgagcccttcctgagcgagtaccagcaccagccccagacctccaactgtactggagccgcagctgttcaggaagaactcaatcctgagaggcccccaggcgctgaggagcgtgtgcccgaggaggactcgagatggcaatctagagctttcccccaacttggcggaaggccaggcccagaaggcgaagggtctctagagagtcaaccacctcctttgcaaactcaagcatgccctgagtcatcatgcttaagggagggtgaaaaggggcagaacggagacgatagcagtgccggcggagacttccctcctccggcggaggttgagcctaccccagaggccgaacttctggctcagccgtgccatgactcagaagctagtaagctgggcgcacccgcagccggtggcgaagaggaatggggccagcagcagagacaattaggaaaaaaaaagcaccgccgccggccttctaagaaaaagagacactggaagccctactacaaactaacctgggaggaaaaaaaaaagttcgatgaaaagcagtccctgcgcgctagtcgcattagggctgagatgttcgccaagggccagcccgtcgcaccttataacactacgcagttcctaatggatgatcacgaccaggaggaacccgacctgaaaactggcctgtactccaaacgagccgcggctaagtctgatgatacaagcgatgacgattttatggaggaaggaggagaggaagatggaggctctgatggaatgggcggcgacggctctgagtttttgcagcgggatttttcagagacctacgagaggtaccacacagaaagtcttcagaacatgagtaagcaggagctcataaaagaatacctggagctggaaaaatgcttgtctcggatggaggatgaaaacaatagattaagactggagagcaagcgattgggcggagacgatgccagggtgcgggaacttgagctcgaactggatagattacgagccgaaaatttacagctgttaactgagaacgagctccacagacaacaggaaagggctcctctgagtaaatttggagactag

SEQ ID NO: 23627 - DNA, 2889 bp, Artificial Sequence
  Description of Artificial Sequence: Synthetic coding sequence
atggacgagcaggccctgctgggcctgaaccccaacgccgacagcgacttccgtcaacgtgcattggcctatttcgagcaactcaaaatctcccctgacgcttggcaggtctgcgccgaagctctagcccagcgaacatacagcgacgatcacgtaaagttcttctgtttccaggtgctggaacaccaggttaagtataaatactctgagttaacaactgtccagcagcagttgatccgtgagaccttaatcagctggctgcaggcccagatgctgaatccccagcctgagaaaacatttatccggaataaggccgctcaggtgtttgcactgctgttcgtcactgaatacttgactaagtggcccaaattcttttttgacatcctcagcgtcgtcgatctgaatcccagaggtgtggatctttacttgcggatccttatggccatcgattcggagcttgtggatcgggatgtcgtccatacgagtgaagaggcgaggagaaacacattaataaaagacacaatgagagaacagtgcattccaaacctggtcgaatcatggtaccagattttacaaaactaccaatttaccaattcagaagtaacgtgtcagtgtttagaggtggtgggcgcctatgtgtcttggatcgatctcagtcttatcgccaacgatcggtttatcaacatgctgctgggacacatgtccatagaagtgctgcgcgaagaagcatgcgattgcctgttcgaggttgttaataaaggtatggaccctgtggacaaaatgaagcttgtcgagtctctgtgtcaagtactccaaagcgcaggtttcttctccatcgaccaggaagaagacgttgactttctggctcggttcagcaagctggtcaatggcatgggtcaaagcctgatagtgagttggtccaagctgataaagaacggggacattaaaaacgctcaagaggcactgcaagctattgaaactaaggtggcattgatgctgcagcttctcattcatgaggatgatgacatctcctctaacatcatcggattctgctatgattatctgcacattttgaagcagctgacggtcctgtctgatcagcagaaggccaatgtggaagctatcatgctggccgtgatgaagaagctcacctatgatgaggagtacaactttgaaaatgagggtgaggatgaggcaatgttcgtggaatataggaaacaattaaaattactgcttgatcgtttggctcaggtttcccccgagctgctgttggctagcgtccgacgggtgttttcctcaaccctccagaactggcaaacaaccaggtttatggaggttgaggtggctatcaggctcctctatatgctcgccgaagccttaccggtcagccatggggcccatttcagtggagacgtgtccaaagcctccgcactccaggacatgatgcgtactctagtgaccagtggagtgagctcatatcagcacacttccgtgacattggaattcttcgaaacggtggtgcggtacgaaaagttctttacagtcgaaccccagcatattccctgtgttctgatggcctttcttgaccatcggggcctccgtcattccagtgcaaaggttagatcacgtactgcctatttattcagccgcttcgtcaaatctttgaataaacaaatgaatccattcatcgaggacatcctgaacaggatccaggacctgctggagctctcccctccagaaaacggccaccagagtctcctgtctagtgatgatcaattgttcatttacgaaacggccggagttctaatcgtgaatagcgaataccctgctgaaagaaagcaggcactgatgcgcaacctgctgactcccttaatggaaaagtttaaaatccttctcgagaaactcatgctggcccaggacgaggaacgccaagcctccctggcagattgcctgaatcatgctgtgggattcgcctccaggacgtccaaagccttctccaacaagcagactgtcaaacagtgcggatgctccgaagtgtacctcgactgcctgcaaacctttctaccggcactgtcctgcccactgcagaaagatattctgcgatccggggtgcggaccttcctccaccggatgatcatatgtctggaggaggaagtgctgccgtttatccccagcgcgagcgaacacatgttgaaagattgtgaagccaaagacttgcaggagtttattcctctgatcaaccaaataactgccaagtttaagattcaagtgtctcctttcctgcagcagatgttcatgccccttcttcacgccatttttgaggtgctcctccgccctgccgaagaaaacgatcagagtgctgccctcgaaaaacagatgcttcggagatcctacttcgcgttcctgcagacagtgacaggctccggcatgagcgaagttattgctaaccagggagccgagaatgtggagagagttctcgtgacagtcatccagggagcagtagagtacccagatcccattgctcaaaaaacatgctttattatcctgagcaagttggtcgagttgtgggggggtaaggacgggcccgtgggcttcgccgacttcgtgtacaagcacatcgtgccagcttgctttctagcacctctgaagcagacatttgatctggccgacgcccaaactgtactcgcgcttagtgagtgtgcagtgactttgaagacaattcacctgaagcgtggtccggagtgtgtacagtacctgcagcaagagtacctgccatcactacaggttgctccagagatcatccaggagttctgtcaggccctccaacagccagatgcaaaagtctttaaaaattacctcaaggttttttttcagcgagccaagccgtag

SEQ ID NO: 23628 - DNA, 2976 bp, Artificial Sequence
  Description of Artificial Sequence: Synthetic coding sequence
atggccgagagcttcttcagcgacttcggcctgctgtggtacctgaaggagctgagaaaggaggaattctggaagttcaaggaattgttaaaacaaccactcgagaaattcgaattgaaacccattccttgggctgagcttaaaaaggcttcaaaggaagatgtagctaagctcctggataaacactatccaggaaaacaggcctgggaggtgacccttaatctgttcctgcagatcaatcggaaagacctgtggactaaggcgcaggaggaaatgcgaaacaaacttaacccgtatcgcaagcatatgaaagaaacgttccagctaatctgggaaaaagaaacatgtctccacgtgccagaacacttctacaaagagactatgaagaatgagtataaagaattaaacgacgcttatacagctgccgcccgcaggcacacagtcgttcttgagggtcccgatggaattggtaagacaacactgctccgtaaggtcatgctggattgggccgagggcaacctgtggaaggacagattcacctttgttttctttcttaacgtgtgcgaaatgaacggtattgctgagacgtcgctgcttgagctgctgtcccgcgattggcccgaatccagcgagaaaatcgaagacatcttctctcagcccgaaaggatcttatttatcatggacggcttcgaacagcttaagtttaacctgcagcttaaggccgatctgagtgatgattggcgacaaaggcagcccatgcctattatcctttcctctctgttacaaaagaagatgctgccagaaagctctctgcttattgcattggggaagctcgccatgcagaaacattacttcatgctgaggcacccgaaattaataaagttgctcgggtttagtgagagtgaaaagaagagctacttctcatacttttttggggaaaagtcaaaagcattgaaggtattcaacttcgtaagagacaacgggccactgttcattctgtgccataaccccttcacttgttggctagtgtgtacttgtgtcaaacagaggctggagaggggcgaagacctcgaaatcaattcccaaaacactacttatctatacgccagcttcctgaccacagttttcaaagcgggcagccagagcttccctccaaaagtaaatcgcgcccggcttaagtcactttgtgctctcgcggccgaggggatctggacttatactttcgttttttcccacggtgatctgaggaggaatggactatcggaaagcgagggggtgatgtgggtgggaatgcggcttcttcagcggcggggtgactgctttgcttttatgcatctgtgtatccaggagttctgcgccgccatgttctacttactgaaacgccccaaagatgaccccaatcctgctatcggttccattactcaactcgtgagggcatcagtcgtccaaccccaaacgcttcttactcaggtcggtatcttcatgttcggcatttcgacagaagaaattgtatcaatgctagagacctccttcggatttcctctgagcaaagatctgaagcaagagatcacacagtgcctggagtctctcagccagtgtgaagccgacagagaggccatcgcctttcaggagctgtttattggactgttcgaaacccaggagaaggagtttgtcaccaaagtgatgaatttctttgaggaggtcttcatctacatcgggaatattgaacatctggtgattgcttccttttgtctgaagcactgccagcacctgaccacactgagaatgtgtgtcgaaaacatctttccagacgatagcggttgcatcagtgactacaatgagaagttggtctattggagagagctgtgcagcatgtttattactaacaaaaacttccagattctcgatatggagaacacatctcttgatgatccatctctggctattttgtgcaaggccctggctcagccagtatgtaaactgcgtaaactgatatttacatcggtttattttggccacgactctgagctttttaaggctgtgctgcataacccccacctgaagctgctgtccctgtacggcacatcactttcacaaagtgacatcaggcatctctgcgaaaccctcaagcatcctatgtgtaaaatagaagagctgattctcgggaagtgcgacatctccagcgaagtctgcgaagacatagcctcagtgctggcctgcaacagcaaactgaagcatctgtctttggtcgaaaacccgcttagagatgaaggcatgactcttttgtgcgaagcactgaagcactcccattgtgctctggaacggctcatgctgatgtattgctgtctcacctcagtgtcctgtgatagtatcagcgaagttttactgtgctctaaaagtttgtcactgctggacctgggctctaacgctctggaagacaacggagttgcctccctatgtgccgcactgaaacacccgggttgctcaatccgggagctgtggctgatgggatgtttcctaacttcggattcctgcaaggacatcgcggctgtgcttatctgtaacgggaaactcaagaccctgaaactcggacataacgagattggggatacaggagtgcggcaactctgcgctgctctgcagcatcctcattgtaaactagaatgtctgggtctgcagacatgtccaatcacccgggcatgctgcgatgatatcgctgcagcgctgattgcttgcaagacactgcggtctctcaacctggactggatagcgttggacgcagacgccgttgtagtcctctgtgaggctctcagccaccctgattgcgctcttcagatgcttggacttcataagtctggatttgacgaggagacccaaaaaattctgatgtctgttgaagagaaaatccctcatttgacgataagccatggcccttggattgacgaggagtataagattcgtggcgtgcttctctag

SEQ ID NO: 23629 - DNA, 534 bp, Artificial Sequence
  Description of Artificial Sequence: Synthetic coding sequence
atggccgccgtgaaggccagcaccagcaaggccacccggccctggtatagccatcctgtgtacgcccgctactggcagcactaccaccaggctatggcatggatgcaaagccaccacaatgcttatcgaaaggcagtggagtcctgtttcaacctgccttggtacttaccctccgctctactgccccagtcctcgtatgataacgaagccgcctacccccagagcttctacgaccaccacgttgcctggcaggattatccatgctctagcagtcatttccggcggagtgggcagcacccaaggtacagctccaggatccaggcaagtacgaaggaagatcaggcactaagcaaagaggaggagatggagaccgagtccgacgccgaggttgagtgtgacctgagcaatatggaaatcacagaggagctgcgccagtatttcgcagaaactgaaagacatcgcgaggagaggagaagacagcaacagctggatgccgaacgtctggatagttacgtgaatgccgaccacgactag

SEQ ID NO: 23630 - DNA, 1503 bp, Artificial Sequence
  Description of Artificial Sequence: Synthetic coding sequence
atggtgggccggagctgcggcgtggccacccagcggcagggcggcgggcagcgaccaacaaatctcgcccttactctgagctccagccctgcccatagtacagcactgccatggctaccaccccgctcccttcagctgctatcagggcacagtgtgccagcacagcccacaccccacctgccttctgcctgtggtggacccacaagagtcacccttggcgaggaaagggcatggcgctcgcatgggagcaacgcaggtggccacacatgtctgccgaggcgcaccgccggcgctggctcactcacgcccggcggtgaaagaggaggaaataacgctggacacacagtcgtggtggacggtaaggagtatgattttcacctactcccctctggtattattaataccaaggccgttagctttatcggaaacggagtggtgatccacttgcccggcttattcgaagaagccgaaaagaatgagaagaaaggtctgaaagactgggagaaacggctgatcatctccgatcgagctcacctggtgtttgatttccaccaagctgttgacggcctgcaggaggttcagcggcaagcacaggagggaaaaaacatagggactaccaagaagggaatcggccctacttactccagcaaggccgcacgaacggggctcaggatttgcgatctcctttcagacttcgatgaattttccagcaggtttaaaaacctggcccaccagcatcagtccatgttcccgactctggagatcgacatagaaggccagctgaaaagactgaagggcttcgctgagagaatccgccccatggtccgagatggcgtctattttatgtacgaggcactgcacggaccccccaagaaaattttagtggagggagccaatgctgcgctgctggacatcgacttcggcacatatccatttgttacgtccagtaattgcactgtgggcggtgtctgcacagggctcggaataccacctcagaacataggagacgtgtatggagtggtcaaagcctacacaaccagggtgggcataggagcttttccaaccgagcagattaatgaaatcggcggcctgctgcagactagaggacacgagtggggagtgaccactggccgcaagcgaagatgcggatggttggatctgatgatcctgcggtatgctcatatggtgaacggcttcactgctctggctctcacaaaactagatatactggatgtcttgggagaagtgaaggtcggagtatcttacaagctcaacggcaagcggatcccatattttccggcgaatcaagagatgctgcaaaaggttgaggttgaatacgagactttgcctggatggaaagcagataccacaggagccagacggtgggaggatctcccaccacaagctcagaactacattcgcttcgtggagaaccacgtgggtgtcgcggtgaaatgggtcggagtcgggaagtctagagagtccatgattcagctgttttag

SEQ ID NO: 23631 - DNA, 468 bp, Artificial Sequence
  Description of Artificial Sequence: Synthetic coding sequence
atggtgaacagctgctgcggcagcgtgtgcagcgaccagggctgcggacaggatctgtgccaagaaacctgctgttgcccatcgtgttgccaaacgacctgttgtcgtacgacatgctacagaccatcctatagcgttagctgttgttgcagaccccagtgctgccaaagcgtgtgttgccagcccacctgctgcaggccgtcttgttgtgtgcctacctgctgtcatccctcgtgctgtatcagcagttgctgcagaccaagctgctgtgtctcctcctgctgtaagcctcaatgttgccagtccgtatgctgtcagcccaactgctgtaggcccagctgttgtcgcccatgttgctgcctcaggcccgtctgtggcagggttagctgtcataccacatgttatcggcccgcttgcgtgatttccacctgccccagacccgtgtgttgcgcaagttcttgctgctag

SEQ ID NO: 23632 - DNA, 2124 bp, Artificial Sequence
  Description of Artificial Sequence: Synthetic coding sequence
atggccgccgaggccctggccgccgaggccgtggccagccggctggaaagacaggaagaggatattaggtggctctggtccgaagttgaacggctcagggatgaacagttgaacgctccttactcctgtcaggccgaggggccctgcctcacccgggaagtggcacagctgcgtgcggagaactgtgaccttcgacatcgactttgttctttacggctgtgtttggccgaagagcgaagtagacaggcaactctggaatctgcggaactggaggcagctcaggaagcgggggcgcagccgcccccctctcagtcccaggataaggacatgaaaaagaaaaaaatgaaagaatctgaggcagactccgaggtgaaacatcagccaatctttattaaggaacggctgaaactattcgagattctcaaaaaagaccaccagcttttactggctatctatggcaagaaaggcgatacgtccaatatcattactgtgcgtgtcgccgacgggcaaactgtccagggtgaggtctggaaaaccaccccatatcaagtagccgctgagatctcacaggaactggctgaatcaaccgtgattgccaaggtaaatggagagctgtgggaccttgaccgtcccctggagggcgactccagcttagagctcctgacgttcgacaacgagaaggtaaatacagcgactaccacggtctaccgatgcggtcccctgattgatctttgtaaaggcccccatgtgcggcacacggggaagataaaaactataaaaatttttaagaattcatctacctattgggagggcaacccagagatggagacactgcagcgcatttatggtatttcttttccggacaacaagatgatgcgtgattgggagaagttccaggaggaggccaagaacagggaccacagaaagatagggaaggagcaggaactcttcttctttcacgacctctccccaggctcctgtttcttcctgcctcggggagccttcatatacaacactctgacggattttatacgtgaagagtaccacaaaagggattttacggaagtgctgtcccccaacatgtacaattcaaagctgtgggaagcatcaggacattggcagcattatagtgagaacatgtttacctttgaaattgagaaggatacgtttgcgctcaaacccatgaactgccccggccactgcctgatgttcgcacacaggccccgcagctggcgggaaatgccaatcaggttcgctgatttcggcgtgctccaccgaaacgaactcagcggcaccctgtccggcctgacgagggtgcggagatttcagcaggatgatgcacatatattctgtacagtggaacagattgaggaagagattaaaggctgcctacaattccttcagagcgtctattccacctttggctttagctttcagttgaacctatcaactaggcccgagaatttcctgggagaaatagaaatgtggaatgaggccgagaaacagctgcagaattctttgatggatttcggcgagccatggaagatgaacccaggagacggcgccttctatggtccaaagattgacatcaagataaaggacgctataggccgctaccaccagtgtgccactatacagctggacttccagctgccgattagatttaacttaacatacgtaagcaaggacggggacgacaagaagcgccccgtgatcatccacagagccatattgggcagcgttgagaggatgatcgccattttaagcgagaattacggcggcaaatggcctttctggttatctccaaggcaggtaatggtcattccagtgggccctacctgtgagaaatacgcattacaagtgagctccgagttcttcgaggagggcttcatggccgatgtcgacctggaccattcctgcacacttaacaaaaagatccgcaacgcgcaactcgcccaatacaattttatattggtagtcggcgagaaggaaaaaatcgataatgcggtcaacgtccgcactagggataacaaaattcacggcgaaatcttggtgacaagcgctatcgacaaacttaaaaatctccgaaagacacggacgctcaacgccgaggaggccttttag

SEQ ID NO: 23633 - DNA, 816 bp, Artificial Sequence
  Description of Artificial Sequence: Synthetic coding sequence
atggccggcctggaggtgctgttcgccagcgccgcccccgccatcacctgccgccaagacgccctggtttgtttcctacattgggaagtggtcacgcacggttatttcggcttgggcgtgggtgaccagcccggtccaaacgataaaaagagcgagctcctccctgccggatggaacaacaacaaggatctctacgtgctcaggtacgagtacaaggacggctcccggaagttgcttgtgaaggcaatcacagttgagtccagcatgattctcaacgtcctggagtacggaagccaacaggtggccgacctgacactgaatcttgatgattatattgacgctgaacacttgggggattttcatagaacgtacaaaaattccgaggagctgagatcccgtatagtctcagggattattacccccatccatgaacaatgggagaaagccaatgtgtcctccccccaccgtgagttccctcctgcaacagctcgggaggtggaccctttgcggattccaccccatcacccacacacatcacgccagccgccctggtgcgatcctctgggtccatttgtcgtgggaggcgaggatttggatccttttgggcctagaagaggaggtatgattgtcgatccactccggtccggatttccccgtgcgctcatcgatccatcctctgggctgcccaatcgcttaccacccggcgctgtccctcctggtgcccgctttgacccattcggaccaatcggtaccagcccccccggacccaacccggatcacctcccaccacctgggtacgatgacatgtatttgtag

SEQ ID NO: 23634 - DNA, 474 bp, Artificial Sequence
  Description of Artificial Sequence: Synthetic coding sequence
atggccaccccccccaagcggcgggccgtggaggccaccggcgagaaagtcttgagatacgagaccttcatctccgatgtgctgcagcgcgatcttcgaaaagtgcttgaccatagagataaagtttacgagcagctggccaaatacctacaattgcgcaatgttatagaacgcctccaggaggcaaaacattccgagttatatatgcaggtggaccttggatgcaatttctttgtggataccgtcgttccagacaccagcagaatctacgttgccctgggatacgggttcttcctggagctgaccttggccgaagcactgaaatttatagataggaagtcctctttgctgaccgaactgtccaactcccttactaaagatagtatgaacattaaagcacacatccacatgctcctggagggcttacgggaactccaagggctccagaatttcccagaaaagccccatcattag

SEQ ID NO: 23635 - DNA, 543 bp, Artificial Sequence
  Description of Artificial Sequence: Synthetic coding sequence
atgcaggccgagggccggggcaccggcggcagcaccggcgacgccgacggcccgggaggacccgggattcccgatggacctggaggcaatgccggagggccaggtgaggccggagctactggaggcagaggcccccggggggcaggggcagcccgtgcttcgggtcctggagggggtgccccacgcggccctcatgggggagccgcttcagggctcaacgggtgctgtcgatgcggagctagaggacccgaaagccggctgctcgagttctacttggctatgccttttgccactccgatggaggccgagctggcccggcgtagcctcgcccaagatgcaccccccctgccagtgcccggcgtgctgctcaaggaatttactgtgtctgggaacattctcaccatccggctgacagctgccgaccatcgccagctgcagctcagtatctccagctgcttacagcagctctctctgctgatgtggatcacacagtgttttttaccagtgttcctagcccaacccccaagtgggcagcgtagatag

SEQ ID NO: 23636 - DNA, 621 bp, Artificial Sequence
  Description of Artificial Sequence: Synthetic coding sequence
atgaccgccagcgtgctgcggagcatcagcctggccctgcggcccacatcagggctcctggggacatggcagacccagctccgcgagacccaccagagagccagcctgctatccttctgggaacttatcccaatgcggagcgaacctttacggaaaaagaagaaggtagaccccaagaaagatcaagaggcgaaagagaggctaaaaaggaagatacggaagctggaaaaggccactcaagaactgattccaattgaagactttatcacccctctcaaatttctggataaggctcgggagaggccacaggtggagctgacttttgaggaaaccgagagacgagccttgctgctaaaaaagtggtcattatacaaacagcaggagcgcaagatggaacgggataccatcagggcaatgctcgaggctcagcaggaagcattggaggagctccagctagaatcacctaaactgcacgcagaggccatcaaacgcgatcccaacttgttccctttcgagaaggaaggtccacactacacccctccaattcctaactatcagcccccagaaggaagatataacgacataactaaagtatacacccaagtggaatttaagaggtag

SEQ ID NO: 23637 - DNA, 6963 bp, Artificial Sequence
  Description of Artificial Sequence: Synthetic coding sequence
atggccgagcccagcagcgcccggcggcccgtgcccctgatcgagtccgagctatacttcttgatcgcacggtacctttctgctggaccatgccgacgggcagctcaggtgttagttcaagaattagaacagtaccagctcctcccaaagcggctcgactgggaaggcaacgaacacaatcggagctatgaagagctggtcctttctaataaacatgtggctcccgatcatctactgcagatatgccaaaggatcggtccaatgctcgataaagagatccctcccagcatcagtagagtgacttcattgctgggagctggccgacaatctctcctacgcaccgccaaggactgtcgccatacagtctggaaagggagcgctttcgcagcgcttcatcggggccgtccaccagagatgccagtgaattacgggtcaccccctaacctggtcgaaatacaccggggtaaacagctgacgggatgtagcactttcagcaccgcgtttcccggcacaatgtaccagcacataaagatgcatagaaggatcctcgggcacctgagcgcagtttattgcgtagcttttgacagaaccggtcaccgcatattcaccggcagcgatgattgcctcgtcaagatctggtctacacacaacggacggttgttgagcaccctgagagggcactcggccgaaatttctgacatggctgtgaactatgagaatacgatgatcgcggctggatcctgtgacaagatcatccgcgtctggtgcctgaggacgtgcgcccccgttgccgtgctgcaaggccacacaggcagcatcacttcattgcagtttagtcccatggctaaaggcagccagcgttacatggttagcaccggcgctgatgggaccgtctgcttctggcagtgggacctggagtcacttaaattctccccaaggccgctcaagtttacggagaagcctcgacctggcgtgcagatgctgtgctccagcttttctgtgggcggcatgttcctcgcaactggatcaaccgaccatgtcatccgaatgtattttctcgggtttgaggcgcctgagaagatcgccgaactggagagtcacacagataaggtggattccatccagttctgcaacaacggggacagattcctgagcggatcaagggatggtacagctcgaatctggcggttcgagcagctggagtggagatctattctcctcgatatggctaccagaatttccggcgacctaagctccgaagaagaaagatttatgaaaccaaaggtcaccatgattgcgtggaaccaaaatgattcaatcgtcgtgaccgctgtcaatgaccacgtgttgaaggtgtggaattcatacactgggcagcttttacacaatctaatgggacacgctgacgaagtgtttgtcctggagacacatccctttgattcccggattatgctgagcgctggccatgatggctccatattcatttgggatatcaccaagggcactaagatgaagcactacttcaacatgattgaggggcaaggacacggagcggttttcgactgtaagttcagccaagacggccagcacttcgcctgtaccgactcacacggacatttacttattttcggctttgggtgctccaagccgtacgaaaaaatccctgatcagatgttcttccacacagattacaggccactgatcagagatagcaataactacgttttggatgagcagactcaacaggccccacatctcatgccgccgccatttcttgtcgacgttgatggaaatcctcaccccaccaaataccagaggctcgttccagggagagaaaattctgccgacgagcacctcatccctcagttgggatatgtcgctacttctgatggggaggtcatcgagcagatcataagtctacagactaacgacaacgacgagcgttccccagaatccagcattctggacggcatgattaggcagttacagcagcagcaggatcagcgaatgggcgcagaccaggatacaatccctcgcgggctgtctaatggcgaggagaccccaaggcggggattccgcagattaagcctagatatacagtcgccccccaacattggactgcggcgcagtggccaagtggagggtgttagacagatgcaccagaatgccccccgaagtcaaattgccacagagagagatcttcaagcatggaaaaggcgcgtcgtggtccccgaagtccctctgggtatcttcaggaagctagaggactttagactagagaagggcgaagaagaacggaacctttatatcatcggccggaagagaaaaaccctacagctgtcacataagtcagatagcgtggtgcttgtgtcccagagccgccaacgtacttgtaggcggaaataccctaactacggacggcggaacaggtcatggcgcgagttatctagtggaaatgaatcgtcttcaagcgtgcggcatgagacgtcctgtgatcagagcgagggatctggttctagtgaagaagacgaatggagatctgaccgtaaatccgaaagctattccgagtccagcagtgattccagctcgcgctacagcgattggacagccgacgcaggaatcaacctgcagccgcccctgaggacctcctgcagacgcagaattaccaggttttgttcatcttctgaggacgaaattagcacagagaacttaagtccacctaaacggcgcagaaaaagaaaaaaggagaataaaccaaagaaagagaatcttcgtcgaatgactccagcggaactggcaaatatggagcatctctacgaatttcaccctccagtgtggattacagacacaaccttgagaaagagcccctttgtgccgcaaatgggcgacgaagtaatatacttccgacaaggtcatgaggcttatatcgaggctgtgaggcgcaacaatatctatgaacttaatccaaataaagaaccatggaggaaaatggacttaagagatcaagagttggtgaagattgttggaatcagatacgaggtcggacctcctacactgtgttgtctgaaactcgcatttattgaccctgctactggaaaattgatggacaagagcttctcaatccgctatcatgatatgcccgacgtgatcgatttcctggtactcagacagttctacgatgaggccagacagaggaattggcagagttgtgaccgctttaggagtattattgacgacgcgtggtggttcgggacagtgttgtctcaggagccataccaaccccagtatccagacagtcatttccagtgttatatcgtgagatgggacaacactgagatagaaaaattgagtccttgggatatggaacccatcccggacaatgtagatccccccgaggagctgggagccagtatctccgtcacaaccgacgaactggagaaactgctgtacaagccccaagcaggagagtggggacagaagtctagggacgaggagtgtgacagaattatttcaggaattgaccagttgcttaaccttgacatcgctgccgcatttgctggccctgtggatctatgcacctaccccaagtactgcactgtggttgcctatcctaccgacctgtacaccattcggatgagactggtgaacaggttttaccggcgcctttccgcccttgtctgggaggtcagatatattgaacataatgctcgaacattcaatgagcccgagtccgtaatagcacgaagcgccaagaaaattacagatcagctgcttaagttcataaagaatcaacactgtacaaatattagcgaactaagtaacaccagtgagaacgacgaacaaaatgcagaggacctggacgattcagacctgccaaagacctccagtggacggaggcgggtgcacgatgggaagaaaagtataagggctacaaattatgtcgaatcaaactggaaaaagcagtgcaaagaactcgttaatctcatcttccagtgcgaggatagtgagcctttcaggcaaccagtggacctcgttgagtaccccgactaccgagatattattgatacccccatggactttgggaccgtccgtgagactctcgatgccgggaactatgactcaccccttgaattctgtaaagacatacggctgatcttttccaacgcaaaagcctacacccctaacaaacgcagtaaaatatatagtatgaccctgcgcttgagcgccctgtttgaagaaaagatgaagaaaatttccagcgatttcaagattggtcaaaagttcaacgaaaaattacggcggagtcaaagatttaaacagaggcagaattgtaaaggcgacagccagccaaataagtcaattagaaatctcaaacccaaacgccttaagagccagaccaagatcattcctgagctagtcggaagcccaacacagagcacatcttcccgtacagcctacctgggcactcataaaacctctgcgggaatcagctctggggtcacttctggagactcgtctgacagcgcggaaagctctgagcgcagaaagcggaatagacccatcaccaacgggagcacattgtccgaatctgaagtagaagattcactggccacgagtctgtccagctctgcctcaagtagttctgaagagtctaaagaaagctctcgagcgagggaaagctcaagcaggagcggtctctctcgaagctcgaatctgcgtgttactcggactcgggccgctcaaagaaagacgggccccgtgagtctggccaatggatgtgggcgcaaagctacacgaaagcgcgtgtacctctcagactccgacaacaattctctcgaaaccggagagatcctcaaagctagggctggcaacaaccgaaaagtgctgaggaagtgcgcagctgtcgcagctaacaaaatcaagttgatgagcgacgttgaagaaaactcttcctctgaaagcgtgtgttctggtcgaaagctccctcacaggaatgcctctgctgtggcaagaaaaaagttgttacataacagtgaagacgaacagtcactgaagtcagagatcgaagaggaggagttaaaggacgaaaatcagctgttgccggtaagttccagccacactgctcagagcaatgtggacgaatccgagaatcgggacagcgagtctgagagcgacctgcgtgtggctcggaagaattggcacgccaacggttacaagtcacacactcccgctcccagcaagacaaaatttttgaagatcgaatctagcgaggaagattccaaatctcatgattcggatcacgcttgtaacagaaccgctggccctagcacctcagttcagaaactgaaagcggagagtatcagtgaggaagcagatagcgaacccggacgctctggggggcgaaagtataacacatttcataaaaatgcctcattcttcaaaaagactaagattctaagcgattctgaggattcagagagcgaagaacaggatcgagaagatggtaagtgccacaaaatggaaatgaacccgatatccggcaacctgaattgtgatcctatcgccatgtctcaatgcagctctgaccacggttgtgagacggatcttgactcggacgatgataaaattgaaaagccgaataactttatgaaagacagcgcaagccaggacaatggcctgtctcgcaagattagtcgaaagcgtgtgtgttcttccgactccgatagcagtctgcaggtcgttaagaaaagtagcaaagctaggacagggctccttaggatcaccagacgctgtgccgccactgcggccaacaagattaaactgatgagtgacgtggaggacgtttccctagagaacgtccacaccaggagtaagaacggccgcaagaaacccttacacctggcttgcaccactgccaaaaagaaactgagcgattgcgaggggtctgtgcattgcgaggtgccctcagagcagtatgcttgcgaaggcaagcctcccgatccagacagtgaaggatccacgaaagtcctgtctcaagctcttaatggggactctgattctgaagacatgctaaattctgaacacaagcaccgtcacactaacatccacaagatcgatgcgccaagcaagcggaaatcgagcagcgtgaccagcagcggtgaggacagtaagagtcatatacctggtagcgaaacggacagaactttctcctcagaatccaccctggcccaaaaagccaccgccgagaacaactttgaggtcgaacttaattacgggcttcgtcgatggaatggacgccgcttaaggacgtacggtaaggcgcccttctccaagacaaaagtcatccacgattcccaagagactgctgagaaggaagtgaaaaggaaacgttcacacccagagcttgaaaatgtgaaaatctctgaaacgactggcaattctaagtttcgccccgatactagttccaaaagttctgacctggggtcggtgaccgaatccgacattgactgtacagataacacgaagacgaaacgccgtaaaacaaaggggaaagccaaggtcgtgaggaaggagtttgtgccccgcgaccgggagcccaacaccaaagtacgcacctgtatgcataaccagaaagacgcggtacagatgccttctgagaccctgaaagctaaaatggtgccagagaaggtgccccgcaggtgcgctacagtggctgctaataagatcaaaattatgagtaacttgaaggaaacaatcagcggcccggaaaacgtgtggatccgaaagtcttccagaaaattgccccacagaaatgcttccgcagctgcgaagaaaaaactcctgaacgtctacaaagaggacgatacaacaataaactctgaatccgaaaaagaactggaggacataaatcgcaagatgctgttccttagaggctttagatcatggaaagaaaatgcacagtag

SEQ ID NO: 23638 - DNA, 2961 bp, Artificial Sequence
  Description of Artificial Sequence: Synthetic coding sequence
atggccgagagcttcttcagcgacttcggcctgctgtggtacctgaaagagttgagaaaagaagaattctggaagtttaaggagctgctaaagcagcctcttgagaagttcgaactgaagccaatcccctgggctgagctgaagaaggccagtaaagaagacgttgccaaactgctcgataaacattacccagggaagcaggcgtgggaagtgactctgaacctctttctgcagattaaccgaaaagatttatggacaaaggcccaggaggagatgcgcaataagttgaacccataccgaaagcatatgaaggagactttccagttaatttgggaaaaggagacctgcttgcacgtgcccgagcatttttataaggaaacaatgaagaacgagtacaaggagctgaatgacgcctacaccgccgccgctaggcgacacaccgtggttctggagggacccgatgggatcggcaagacaacccttctgcgaaaggttatgttagactgggccgaagggaatctgtggaaagacagatttacttttgttttcttcctgaacgtgtgtgagatgaatggcattgcggaaacctctcttctcgaacttctgtctagggactggcccgagtctagcgagaaaatcgaagatatctttagtcaacccgaacggattctctttatcatggatgggtttgagcaacttaaatttaacctccagcttaaagcggacctttctgatgattggaggcagcgacagccaatgcctataattctgtcttccctgctccaaaagaaaatgctcccggaatcttctcttctgatcgccttgggaaagcttgccatgcagaaacactacttcatgctgaggcaccccaagcttatcaaacttctcggcttttctgaatcagaaaagaagtcttactttagttacttttttggcgaaaaatccaaggccctgaaggtttttaactttgtacgcgataacgggccccttttcattctgtgccacaatccgttcacctgctggctcgtgtgcacgtgtgtgaagcagaggcttgaacggggcgaggatttggaaatcaacagtcagaataccacatacctctatgcttcattcctcactactgtattcaaggcgggatcacaaagctttccccccaaagtgaatagagcccggctgaagtctctgtgtgctctggcggctgaaggcatttggacatatactttcgtgtttagtcatggggatttacgacgaaacggcctgtccgagtctgaaggagtcatgtgggttggcatgcgactgctgcaaaggcgtggcgattgttttgccttcatgcacctgtgtatccaggaattttgtgccgcgatgttttacctgctcaagagaccaaaagacgatcctaaccccgctatcggctctattacacagctggtgcgcgcgtctgtcgtacagccccagactctcctaactcaagtggggatctttatgttcggaatatccacggaggagattgtctccatgcttgagacctccttcggcttcccactgtcaaaagatctcaagcaggaaatcactcagtgcctggaatcactgtctcagtgtgaggcagatcgagaagcaattgcattccaagaactttttattggactgttcgaaacacaagaaaaggagtttgtgactaaggttatgaacttctttgaagaagttttcatttacattggcaacatcgagcatctggtgattgccagtttttgcctgaagcattgccagcacttgaccacgctgagaatgtgtgttgaaaatatctttcccgacgacagcggctgcatatctgattacaatgaaaagcttgtatactggagagagctgtgttcgatgtttattactaacaaaaactttcagatattagatatggagaatacctcgttggacgacccaagtctggctatcctgtgcaaggcgctggctcagcctgtgtgcaaactgcgcaaactcatcttcacctcggtgtatttcggtcatgattcagaattgttcaaggcggtgctgcataatcctcatttgaagttactgtcattatatggaaccagcttatcgcagagtgatattcggcacctgtgtgaaacgctcaagcatcccatgtgtaagatcgaggaattgatactgggcaagtgcgacatctcaagcgaagtgtgtgaagatatagctagcgtacttgcttgtaacagcaagctcaaacatctgtctctggttgaaaaccccctgcgcgacgaaggcatgacacttctgtgcgaagcactgaaacatagccactgtgccctggagcgacttatgctcatgtactgttgtctgaccagcgtgtcttgcgactctatctctgaggtgctgctgtgtagtaagagtcttagcctgctggatctgggatctaatgctcttgaggataacggggtggcgtctctgtgtgcagcgttaaaacatcccggatgtagcatacgggaattgtggctcatggggtgttttttgacgtcagactcatgtaaggatatcgctgccgtactcatctgcaatggcaagttaaagaccctgaaactggggcacaacgaaatcggagatactggcgtgaggcagctgtgtgctgcgctacagcacccccactgtaagcttgaatgcctggggctccaaacctgcccaatcacccgggcctgttgcgacgacatcgcggctgcactgattgcatgtaaaaccctacgatctctcaatctcgactggattgccctggatgccgatgctgtagtagtgctgtgcgaagctctgtcccaccccgactgcgccttacaaatgctcggtaattgccaaaaaagtttgggcgacaccgttgcaccaggtgagaatcattgttctattaaacatctcctgctgacacttcccattaatatgcaaaggcagctaagattacaaaaatag

SEQ ID NO: 23639 - DNA, 3039 bp, Artificial Sequence
  Description of Artificial Sequence: Synthetic coding sequence
atggacgccctggacgccagcaagctgctggacgaggagctgtactcccgccagctctacgtactggggtcccctgcaatgcagcgaatccagggagcacgggttttagtttcaggactccagggcctgggggcagaggtggcaaaaaacttggttctgatgggggtcggctccttgacactccacgatccccacccaacatgttggagcgatttggcagcacagttcctgctaagcgagcaggatctggagaggtccagggccgaagccagtcaggagctgctggcgcagctaaaccgtgcggttcaggttgtggtgcatactggcgacatcaccgaggatcttcttctcgacttccaggtggtggtgctgacggctgcgaagttggaggaacagttgaaggtgggcactttatgtcacaagcacggggtgtgtttccttgcagctgacacgaggggcttggtcggacagctgttttgcgacttcggagaggattttactgtgcaggacccaaccgaggcagagcccttgaccgctgccattcaacatatatcccagggatcgccaggcatcttaaccctccggaaaggtgcgaacacccactattttagggacggtgatctggttacgtttagcgggattgaagggatggtggaactgaatgattgtgaccctaggagcattcatgtgagggaggatggaagcctcgagataggtgatacaacaacattctctcgttacctacgcggtggagccataactgaggtgaagagaccaaagacagtgcgacacaagtcactggataccgcactgctgcagccgcatgtagtggctcagagctcacaggaggtacatcatgcccactgccttcaccaggcattttgcgcccttcacaaattccagcacctgcacggcagacctccacagccttgggacccagtggacgccgaaaccgtcgtcggactggctcgggacctcgaacctttgaagcgaaccgaggaggaacccctcgaagaaccattagacgaggccttggtgaggaccgtggctctgtcaagtgccggtgttcttagtcctatggttgctatgcttggggccgtggctgcccaagaggtcttgaaagccatctcacggaagtttatgcctctggaccagtggctgtatttcgacgcgctggattgcctccccgaagacggggaactgttgccttccccagaggattgcgccctgcgtgggtctcggtacgatggacagattgcagtgttcggcgcaggatttcaagagaaactgcgacgtcaacactatctgttagtcggcgcgggagccatcggatgcgagcttctcaaggtcttcgctttggtaggcctcggcgccgggaactccgggggactcactgttgtggacatggaccacatagaacggagtaatttgtccagacagttcctgttccggtcccaagacgtgggccgaccgaaagctgaggttgctgctgctgctgctcgcgggctgaatcccgatctccaggtcatacctctgacatatcccctggatccaactaccgagcacatatacggggataactttttctcaagagttgatggggttgctgctgctttggactcctttcaggcgagacggtatgtggccgcccgatgcactcactacttaaaaccccttctggaggctggcacaagtgggacctggggctcagccacggtctttatgccacatgtgaccgaagcttacagagctcccgcctcagcagccgcatcggaggacgcaccataccccgtgtgcaccgtgaggtatttcccctctaccgccgagcacaccctgcagtgggcaagacatgagttcgaggaactgtttaggttgagcgcagagacgattaatcaccatcaacaggcccacacgtcacttgctgatatggacgagcctcaaactctcactctgctgaagcctgtcttgggagtcctgagggttcgcccccagaactggcaggactgcgtcgcctgggcacttggccattggaaactttgtttccattacggtatcaagcaactgctccgccactttcctccaaacaaagtcctggaggatgggactccattttggtctgggcctaagcagtgccctcagccactcgagttcgatactaatcaggacactcacctgctatatgtactcgcagccgctaatctttacgctcagatgcatggcctgcccgggagccaggattggacggctctgcgggaacttctgaagctgctgccgcagcccgatccacagcagatggcacctatattcgcctccaatctcgaactggctagcgcatcagctgaattcgggcccgaacagcaaaaggaattgaacaaggcattggaggtgtggagtgtgggcccaccgctgaaacccctgatgttcgagaaagatgacgacagtaatttccatgtggatttcgttgtggctgcagcgtccctaaggtgccaaaattatggaatcccaccggtgaatagagcacagagcaagagaattgttggccaaattattcccgccatagcaactactacagctgctgtcgcagggcttctgggcctcgagttatataaggtcgttagtggcccccgcccccgctctgcctttaggcattcctacctccatcttgccgaaaattaccttataagatatatgccattcgcacctgctatccagaccttccaccacttaaaatggactagctgggatagactcaaagtaccggctggtcagccagaacggactctcgaatccctgctagcgcatctgcaggaacagcatgggctgcgggtgcgcatcctccttcatgggagcgccttgctgtacgctgccggatggtcgccagagaagcaggcgcagcaccttccccttagagtaacagaactggttcagcagttgacaggacaagcgcccgcacctggacagcgtgtgctggtgctggaactcagttgtgagggggatgacgaagatactgcattcccgcctcttcactacgaactgtag

SEQ ID NO: 23640 - DNA, 360 bp, Artificial Sequence
  Description of Artificial Sequence: Synthetic coding sequence
atggtgcggaccaagacctggaccctgaagaagcacttcgtgggctaccctaccaactctgactttgagttgaaaacagcagagctgccgccactgaagaatggagaggtcctacttgaggcactgttcttaacggtggatccctacatgagagtggttgagagcaagaatgttgctcttcccaaggggacaatagtgcttgcgagccctggatggactacgcattcaattagcgatggaaaagacttggagaagctgctgaccgagtggcctgacacaattccgttatctctggccctgggaactgtgggaatgccagggctgacggcctattttggactgctggagatttgcgggtag

SEQ ID NO: 23641 - DNA, 1797 bp, Artificial Sequence
  Description of Artificial Sequence: Synthetic coding sequence
atgggcggctgcttcagcaagcccaagcccgtggagctgaagatcgaagtggtgctgcccgaaaaagaacgaggcaaagaagagctcagcgcatcaggaaaaggtagcccccgggcctatcagggcaacggtactgccagacattttcatacagaggagcgcctcagtacaccccatccttacccaagcccccaggactgcgttgaggcggccgtctgccacgtaaaggatctcgaaaacgggcagatgcgggaggtcgagctcggctgggggaaagttctgttagtgaaggataatggagaattccacgcactgggtcataaatgcccgcattacggggcaccactagtgaaaggcgtgctgtctcgcggaagagtgcgctgcccttggcatggggcatgcttcaacatcagcaccggcgatctagaggactttccgggcctggatagcttacataaatttcaagtgaagatagagaaagaaaaagtttatgttcgggctagcaagcaagctttacagttgcaacggcgcaccaaagtaatggccaagtgcatctctccgtctgcgggctattcttcctctactaacgtcctcatcgttggagcaggagcagccggactggtgtgcgcggagacacttaggcaggagggattttcagatcggatcgtcctgtgtacactggatagacatctcccttacgatagaccaaaactgtcaaaaagccttgacacacagccagagcagttggcactgcgacctaaggagtttttccgcgcctacggaatagaggttctaacagaggcccaggtcgtgacagtggacgtgagaacaaaaaaagtggtgtttaaggacgggttcaagctggaatatagcaagttgctgttggctccggggagttctccgaaaactctcagctgtaagggcaaggaagtagaaaacgtctttacaatccgcacacctgaggatgccaatcgggtcgtgagattggctcgggggcggaatgtcgtggttgtaggagctgggtttctgggcatggaggtggcggcttaccttacagagaaggcacactcggtgagcgtagtggagctggaggagacaccattccgccgcttcctgggtgaacgggtgggtcgtgctctgatgaagatgttcgaaaacaaccgagtgaagttctacatgcagacggaagtaagcgaactgcgaggccaggaggggaaactgaaggaagtggtgttgaagtcctctaaagtggtgagagccgacgtctgtgtcgttggtatcggcgcagtacccgctactggcttcttaagacagagcggcatcgggcttgatagtaggggctttatacccgttaataaaatgatgcagacgaacgtgcccggggtcttcgccgccggcgatgcagtcacattccctttggcatggagaaacaacaggaaggtgaatatccctcactggcagatggcacacgcacagggaagggttgctgcccaaaatatgctcgcccaggaagcagagatgtcaaccgttccctacctgtggacagcaatgtttggcaaatccttacggtacgccggctatggcgagggcttcgacgatgtcatcattcagggcgatctggaggaattaaaatttgtggccttctacaccaagggggacgaagttatcgccgtggcgtccatgaactatgatcctatcgtgtccaaagtagccgaggttttggccagcggccgagccattcgtaaaagagaggtggagacgggagatatgtcttggttgaccgggaagggctcttag

SEQ ID NO: 23642 - DNA, 1854 bp, Artificial Sequence
  Description of Artificial Sequence: Synthetic coding sequence
atgggcagctacctgagcgtgcccgcctacttcaccagccgggacctgtttcggtgcagcgagtgtcaagacagccttaccaactggtactacgaaaaagacggcaaattatattgtccaaaggattactggggcaaattcggagaattttgccatgggtgcagcctcctgatgacgggaccgtttatggtggcaggggaattcaagtatcaccccgagtgcttcgcctgtatgtcatgcaaagtaataattgaagacggagatgcatatgcgctcgtgcagcacgctactctatattgtggcaagtgccacaacgaggtggtgttagcccctatgtttgagaggctgagcacggagtcggtgcaagagcagttaccgtactcagttaccttaatttcgatgcccgcaacaaccgagggaagaagaggattttcagtctctgtcgaatctgcatgctctaactacgccaccacggttcaggtgaaagaggttaatcgaatgcacatctctccaaataataggaacgcaattcacccgggcgaccgcatcctagagataaatgggacacctgtccgtaccctacgggtggaagaggtggaagacgctatctctcagacctcccaaacacttcagctgttgattgaacatgacccagtttctcagcggctggaccagcttagactggaagctcggctcgcaccacacatgcagaacgccgggcatccacacgctctaagcactcttgataccaaagaaaatctggagggcactctgcgtcgccgcagtctgcgccgcagcaatagcatctctaagtcccccggcccttcatctcccaaagagccccttctgtttagcagggatataagccggagcgagagtttgcgttgcagctccagttattctcagcaaatcttccgcccttgcgaccttattcacggggaggtgctcggaaaggggttcttcgggcaggccataaaagtaactcataaagcaaccgggaaagtgatggtgatgaaagagctgatcaggtgtgatgaagagacccaaaagacattcctgactgaggtgaaagtcatgcgatcgctggatcaccctaatgtcctgaagtttatcggggtcctttataaagataagaaactgaacttgttgacagaatatatagaaggtggaaccctaaaggatttcctcaggagtatggacccctttccttggcagcaaaaagtcagattcgcgaaaggtatcgcttctggaatggcctatttgcattctatgtgcatcattcaccgcgacctcaactctcataactgcctgataaagctggacaagaccgttgtggtggccgattttggcctgagccgattgatcgtagaggaacgaaaaagagcgcccatggaaaaagctacaaccaagaagaggacacttagaaagaacgatcggaagaaacgttacacagttgtgggtaatccctattggatggcccccgagatgcttaacgggaaatcatatgatgaaactgtcgacatcttttcctttggaatcgttctgtgtgagatcatcgggcaggtgtatgcagacccggattgtctgcctagaacactggactttggcctgaacgtgaagctgttttgggagaaattcgttcctaccgactgccccccagcctttttccctctcgcagcaatctgctgccgcttggagccagagtcccgcccagctttcagtaagctggaagactcttttgaggcactatccttgtatctgggcgaactcgggattccgctgcccgcagagctggaagagttggatcatactgtaagtatgcagtatgggcttactcgggactcaccaccatag

SEQ ID NO: 23643 - DNA, 1338 bp, Artificial Sequence
  Description of Artificial Sequence: Synthetic coding sequence
atgcgggagatcgtgcacatccaggccggccagtgcggcaaccagatcggagccaaattttgggaagtcataagcgacgagcacggaatcgacccaacaggatcttatcacggtgattccgacctccaactcgagagaattaatgtgtattacaatgaagccgctggcaacaagtatgtgcctagagctatcctggtcgacttggaacccggtacaatggactcagtgcggtctggcccattcggacagattttcagacctgacaactttgtgttcggccagagtggcgctggtaacaactgggccaaaggacactacacagagggtgccgaactcgtcgatagcgttctggatgtcgttagaaaggagtctgagagctgcgactgcctacaaggctttcagctcactcactctctggggggcggcactgggagtggcatggggaccctgctgatcagtaaaatacgggaagagtaccccgaccgcatcatgaatacattctctgtaatgccttcacccaaggtctcagatactgtggtcgagccttataacgccactctttctgtgcatcagttggtagagaataccgacgagacctatagcattgacaatgaggccctttatgacatatgttttcgaactttgaagctgacaacccccacctacggagacctaaaccacctcgtttctgcgactatgagcggcgtcaccacttgtctgcgtttccccggccagttgaatgccgatctgcggaagttagccgtaaatatggtgcctttcccaaggcttcattttttcatgcctggatttgcccctctaaccagtaggggcagccagcagtacagagccctgactgtacccgaacttacacagcagatgttcgattctaagaatatgatggctgcctgcgaccctcgccacgggagatatctgacggtggcggccatcttccggggccgcatgtcgatgaaggaggtggatgaacaaatgctgaacgtgcagaataagaatagttcctatttcgtggagtggattccaaacaacgtgaaaaccgctgtttgtgatataccacctcgcgggctgaaaatgtcagctacgttcatcggaaattccacagcgatccaggaactgttcaaacggatttccgagcagttcaccgccatgttccgcagaaaagcttttctgcactggtatacgggggagggtatggatgagatggagttcacagaagccgagtctaacatgaacgatttagtctccgaatatcagcaatatcaggacgccacggctgacgagcagggcgagttcgaggaggaggagggtgaagacgaggcctag

SEQ ID NO: 23644 - DNA, 2028 bp, Artificial Sequence
  Description of Artificial Sequence: Synthetic coding sequence
atggccaagcacggcgccgacgagcccagcagccggagcggcagccctgacagagaagggagagcgagtgaggacagatcgctgctccatcagcggctggccgtgagggaactgatcgacaccgaagtgagttaccttcatatgttgcagctgtgcgcatctgatattaggtcccgtctgcaacagctgccccagggagatctggacgtattgtttagtaacatcgatgacataatcaaggtcaatagcaggttcctgcacgatttgcaggagacggcctcaaaggaagaggagcaggtccagctggttggtaatatttttctggaattccaggaagaactcgaacaggtttataaggtctactgtgctagctacgatcaggccctgctgttggtggatacctaccgcaaagaaccagaattgcaaaggcacatacagggaatcgtggaagctgtagttccacaagctgggtcttccgggctgtccttcctcctggtcatcccattacagcggattactcgctacccgttgctccttcaaaaaattcttgaaaataccgtgccagatgcatctgcctaccctgtattacagagagctgtgagtgctctgcaggacgtgaacacaaacattaatgaatataaaatgcggaaggaagtggcaagtaagtataccaaggttgagcagttgacgctgagggagcgtcttgccaggattaacacacacaccttgtcaaaaaagactaccaggctgtcacaactgctcaagcaagaagcaggcctcattccgcgaaccgaggacaaggagtttgacgacctggaggaaaggttccaatgggtgtccctgtgcgttaccgaactaaagaataatgtagccgcctacctcgataatctccaagcttttttatatttcaggccccatgagtacaacctggatatcccagaaggccccgctgtccaatattgtaatttagccagggatcttcatctggaagcgttcctgaaatttaagcagcggctggagggcctggtctggcagcccctctgttctctcgccaaggcgttgctcgggccccaaaacctgatcaaaaagcgattggacaaactcttagacttcgaaagggtcgaggaaaagctgctggaggttggctcggtcacttatcaggaggaggccgcccggcacacctatcaagccttgaactctctcctggtggctgagctgccacagtttaaccagctagtcatgcagtggctcggacagatcatgtgcactttcgtaacgctgcaacgggacctggcaaagcaggtgctccagagggcagagggctcaatggctcagttgccccaccaccatgtacccgaacccgctttccggaagctggttgaagacgccctcggaaggacttccaaccagctcagaagctttcaggaaacctttgaaaaggtccaaccacctcctacgacacagcccctattgcccggatctgagcgtcaggtgcaggcactgttgtctcggtatggcccaggaaagctttatcaggtcactagtaacatttccggcacaggcacacttgatcttacgttacccagagggcagatcgtcgccatcttgcagaataaagacaccaaggggaattccgggcgctggcttgtagatacaggcgggcataggggctatgtgccagcaggtaagctccagctgtatcacgtggtcccttccgccgaggagttaagacgccaggccggtttgaacaaggatccgcggtgtctgacccccgaaccaagtcccgcactggttcctagtattcctaccatgaaccaagtaattgcggcctacccgtttgtagcccgctctagccacgaagtgtccctgcaggcggggcaaccagttacaattctagaggctcaggataaaaagggcaacccggagtggagtctggtggaagtgaatggccagagaggctacgtcccttctggattcctagccagagcccggtcaccagtcctctgggggtggagccttccctcctag

SEQ ID NO: 23645 - DNA, 3399 bp, Artificial Sequence
  Description of Artificial Sequence: Synthetic coding sequence
atggccagcgacggcgccagcgccctgcccggccccgacatgagcatgaaaccctcagccgccccatcaccttctccagcgctgcccttcttgcctcccacgtccgaccctcccgaccaccctccgagggagcccccaccacagcccattatgcctagtgtgtttagtcccgacaatcccctgatgttaagtgcctttccttcctccttactggtgaccggcgacggaggaccatgcctgtctggagcaggggcaggaaaggttattgtcaaagtgaaaacagagggcggttcggctgagccatctcagactcagaattttatcctcacgcagaccgccctgaattctacagcccctggaaccccttgtggcggactggaaggacccgcaccacctttcgtcactgctagtaacgttaaaacgattctcccatctaaggctgtgggggtgagccaagagggtcctcctggtctacccccacagccccctcctcctgtggcgcagcttgtgcccatcgtgccattagagaaggcttggcccggcccccatggaacgacaggagaaggcgggccagttgccactctgtccaagccctcactcggcgacagatccaagatttcaaaagatgtgtatgagaattttcgtcagtggcagcgatataaggcactggctcgacgccacctgtcccaatcgcctgataccgaggctctgtcttgtttccttattcctgtcttacgttcactggccagactcaagcccaccatgacccttgaggagggcttgccactggccgttcaggaatgggaacatacgtctaacttcgacaggatgatcttctacgagatggcagaaaggtttatggaatttgaggccgaggaaatgcagatacaaaatacacagttgatgaacggctcacaaggattgtctcctgcaacaccccttaagcttgaccctctgggaccgctggcctccgaagtgtgccaacagcctgtgtatatccccaagaaagcagccagtaagacacgagcacccagacgtagacagcggaaagcccagagaccacccgcccccgaggcccccaaagaaatccctccggaagccgtgaaagaatacgtcgatattatggagtggttggtgggcacccacctggcaaccggcgaatctgatggaaaacaggaggaagaaggacagcagcaagaggaggagggtatgtaccccgatccaggccttctgagctacatcaacgagctctgttcccagaaagtgtttgtctcaaaggttgaagccgtgattcatccacaattcctcgctgacttgttaagtccagagaaacagcgggaccccctggcattgatcgaggagctagagcaagaggaaggtcttactctggcccagttggtccaaaagaggctcatggcccttgaagaagaggaggatgccgaggcccctcctagtttttctggggcccaactagatagcagcccctccggtagcgtcgaagatgaggacggtgatggacggctgaggccatctcccggtctccaaggagcaggcggggcagcctgcctgggcaaggtctctagctcaggcaaacgggcaagggaggtccacgggggccaggagcaggctttagatagcccgcgaggaatgcacagggacggcaacacccttcccagtcccagttcctgggacctgcagcctgagctggccgcccctcagggcacccctgggcctttgggagtggagcgaagaggctccggaaaggtcattaatcaggtatcacttcatcaggatgggcatctcggaggggcgggccctccgggccattgtttggtggcagaccgcacatcggaagccttacccttatgttggcagggcggtttccagccagagtccacgccatcgctggacgccggactcgccgagctggcccctctacagggccaaggcctcgaaaaacaggttctggggctccagaaaggccagcagaccgggggccgtggcgtgcttccacagggaaaagagcccttagccgtgccttgggaaggatcctctggggctatgtggggagacgatcggggaactccaatggcccagtcttacgaccagaatcctagtccacgcgccgcaggggagagagacgacgtgtgcttatccccgggcgtgtggctgtcgtcagagatggatgccgtgggactcgagctgccggtccagattgaagaagtgatcgaatccttccaagttgagaagtgcgttacagagtaccaggagggctgccagggcttgggatcacggggaaatatctccctaggcccaggggagacattggtgcctggagatacagaaagctcggtgataccgtgcggcggcactgtagcagccgctgctctggaaaaacgcaactactgttctctacctgggcccttgcgggcaaactcccctcccctcaggtcgaaagaaaaccaggagcagtcttgtgagactgtcgggcacccctcggatctgtgggcggagggatgctttcctcttctggaatcaggcgactctacgctcggaagctctaaggaaacactaccgcccacttgccagggaaaccttctcattatggggactgaagatgcctctagcctcccagaggcatcccaagaggccggctcaagaggaaattcttttagccccctgttggaaacgatcgagcctgtgaacatactagatgttaaggacgactgtggactccagctgcgtgtttctgaagatacatgccctcttaacgtgcattcatacgaccctcaaggggagggacgagtggatccggacttatctaaaccgaagaaccttgcccccctgcaggaatcgcaggaaagctatacgacagggactcccaaggctacatccagtcaccagggactgggctctacactgccgcgtcggggcacccgcaatgccatcgtcccaagggagacatctgtatcgaagactcaccgcagcgccgatcgtgctaagggaaaggaaaaaaaaaaaaaggaggctgaggaggaggacgaggagttgtctaatttcgcctacttgctggcctcaaaactctctctgtcaccacgagaacaccccttgtcccctcaccatgcctcaggtggacagggaagtcagcgcgcgagccatctgctacctgcgggggccaagggcccatctaaactcccttacccagtagcaaagtctggcaaaagagcactagccggcggccccgcaccgactgagaagacgcctcactcaggggcgcagcttggcgtgccacgagagaaacccttggctcttggtgtggtacgtcccagccaaccaagaaaacgaaggtgcgacagcttcgttaccggtcgcaggaagaagaggagacgatcccagtag

SEQ ID NO: 23646 - DNA, 522 bp, Artificial Sequence
  Description of Artificial Sequence: Synthetic coding sequence
atggccgtggccgtgggcgtgcgggccgcccccgtgctgggcctggcccgcgcactcgttctgggtcttaggggaagccaggccgcccgctggcgcgggtggggcacggccgcacccggttcattgtgggcactgtgtgaatgccccgctgggtgtcgcgagctatggtttcggggtcgagcggcctgggccgcacgatcagaaagactgcttcaccccgcacaggactctgacggcgagcgggaggattccgccgcagagcgggctaggcagcagctagaagcgctgcttaataaaaccatgcgcatcagaatgacagacgggagaactcttgtaggatgctttctgtgtacagaccgagattgtaacgtgatcctcggaagcgctcaggagtttctgaagcccagcgactcattctctgcaggggaacccagggtgctcggactcgctatggtacccggccaccatattgtgtctatcgaggtccagcgtgagtcgcttaccggacccccttacttgtag

SEQ ID NO: 23647 - DNA, 558 bp, Artificial Sequence
  Description of Artificial Sequence: Synthetic coding sequence
atggtgaacagctgctgcggcagcgtgtgcagcgaccagggctgcggtcaagacttgtgtcaggagacttgttgttgcccatcatgttgtcagaccacttgttgccggactacatgctacaggccctcttattctgtcagctgttgctgccgccctcagtgttgccagtcagtttgttgtcagcccacttgttgccgtccctcttgttgcgtttcctcttgctgcaaacctcagtgttgccagtctgtctgttgccaacccacctgttgtcacccctcgtgctgcatcagttcttgctgtagaccttcatgttgtgtgtcatcttgctgcaaacctcaatgttgccagagtgtgtgttgtcagccaaactgttgtaggcctagctgctccatttcctcatgctgccgaccctcttgctgtgagagcagctgttgcaggccatgttgctgcttaagacccgtctgtggccgcgtctcatgccacaccacatgctaccgtcccgcttgcgtcatctctacatgtccgcggccggtgtgctgcgcaagttcctgttgttag

SEQ ID NO: 23648 - DNA, 252 bp, Artificial Sequence
  Description of Artificial Sequence: Synthetic coding sequence
atgtgctgcaactactaccggaactgctgcggcggctgcggctacggatctggatggtcctctggatgtggctacggctgtggatacggctgtgggtacggttccggctgtagatacggaagtggatacggaacaggctgtggatatggatgtggatacggcagtggatgtgggtacggatgcggctacagctcctcttgctgcggatacagaccgctctgttaccggcggtgctactcatcgtgttattag

SEQ ID NO: 23649 - DNA, 993 bp, Artificial Sequence
  Description of Artificial Sequence: Synthetic coding sequence
atgggcagccggaagaaggagatcgccctgcaggtgaacatcagcacgcaggagctttgggaggagatgctcagttccaaaggtttgactgtggtcgacgtgtaccaggggtggtgcggcccttgtaagcccgtagtttctctgtttcagaaaatgagaattgaggtcggtctcgacctgctacattttgcactggctgaagccgacaggctggatgtgctggagaagtataggggcaagtgtgagccgaccttcctgttctacgccggtggcgaattggtggccgtggttcggggagcgaacgcacccctgctgcagaaaactattctcgaccaacttgaagctgaaaaaaaagtactggccgagggccgagagcgcaaggtgatcaaagatgaggccctgtcagacgaggatgagtgtgtttctcacggtaagaataacggcgaggatgaagatatggtgtcttcagagaggacctgtacactggctatcattaagcctgatgccgtcgcccacgggaaaactgacgaaattataatgaaaattcaggaggcagggttcgagatactaacaaacgaggaacggactatgaccgaggcggaagtgcggttgttttatcaacataaagccggtgaggaggccttcgagaagctggttcatcacatgtgcagcggtccatcccatctgcttatcctgacccgtactgaggggtttgaggacgtggtgactacatggcgcactgtgatggggccacgagatcccaacgtcgcccgtcgtgagcagcctgagtcgctgagggcccagtacggtactgagatgccatttaatgccgtgcatgggtcccgggaccgcgaagatgcggaccgggagctggcactgctgtttccatctctgaagttctcagacaaggacactgaggcccctcagggtggtgaagctgaggctacagctggcccaacggaggcactgtgtttccccgaggatgttgattag

SEQ ID NO: 23650 - DNA, 606 bp, Artificial Sequence
  Description of Artificial Sequence: Synthetic coding sequence
atggtgagcagctgctgcggcagcgtgtgcagcgaccagggctgcgggcaggatttatgtcaggaaacatgttgcaggccaagctgttgcgagaccacctgttgcagaactacatgctgtaggccctcatgctgcgtgtcctcatgctgtcgtcctcaatgttgtcagagtgtttgctgccagcccacatgtagtcgaccatcttgttgtcagaccacctgttgccgaaccacctgttatcggccgtcctgctgtgtgtccagttgttgcagaccccagtgctgccagcccgcctgttgccagccgacctgttgccggcctccacgttgctgtatttcctcctgctgccgtcctagttgctgcgtctcaagttgctgcaagccccagtgttgccagagcgtttgctgtcagcctaactgctgcaggccaagttgctctatttcatcatgctgtagacccagctgttgcgagagttcctgctgtcggccatgttgctgtgtccgtccagtctgtgggcgcgtgtcttgccacactacttgctaccgccccacttgtgtgatctcatcttgtcctagaccattatgctgcgcatcttcgtgttgctag

SEQ ID NO: 23651 - DNA, 792 bp, Artificial Sequence
  Description of Artificial Sequence: Synthetic coding sequence
atgggcgacatccccgccgtgggcctgagcagctggaaggccagccctggcaaagtcaccgaggcggttaaagaggctatcgatgcagggtaccgccactttgattgcgcctatttctaccataatgagagagaagtgggtgcgggcattcgttgcaagatcaaagagggggcagtgcggcgagaggatctttttatagcaaccaagctgtggtgcacatgtcataagaagtctctagtggaaacagcgtgccgcaaatctctcaaagccctgaagcttaactacttggacctctacctgattcactggcctatgggctttaagccaccgcaccccgagtggattatgtcctgcagtgagctatctttctgcctctctcacccgagagtccaggatctcccccttgatgagagcaacatggtgattccctccgacaccgacttcttggacacctgggaagccatggaggacttggtgatcaccggcctggtaaaaaacattggtgtgagcaactttaatcacgagcagctcgaacgtctgcttaataaacccggactgcggttcaagccccttaccaaccagatcctcattagatttcagatccaacgaaacgttattgtgattcctggttcgattactccttctcatatcaaggaaaacatacaggtgttcgattttgagctgactcagcacgacatggataatatcctttctctgaataggaacctccgtctggctatgttcccaatcacaaagaaccataaggattacccatttcatatcgagtactag

SEQ ID NO: 23652 - DNA, 177 bp, Artificial Sequence
  Description of Artificial Sequence: Synthetic coding sequence
atgcggtactacggcagctactaccggggcctgggctacggctgcggcggttttggcggccttggctacgggtgtgggtgcgggggctatcgctacgggagcgggtatggcggatatcgctatggctgctgtcgcccctcatgccgggagggctatggcttttctggattctactag

SEQ ID NO: 23653 - DNA, 159 bp, Artificial Sequence
  Description of Artificial Sequence: Synthetic coding sequence
atgtgctacggctacggctgcggctgcggcagcttctgccggctgggatatggatgcggctatgagggatgtcgatacggatgcggacatcggggatgtggcgacggttgctgttgtccgtcatgttacaggagatacaggttcacaggcttctattag

SEQ ID NO: 23654 - DNA, 255 bp, Artificial Sequence
  Description of Artificial Sequence: Synthetic coding sequence
atgagctactacggcagctactaccggggcctgggctacggctgcggtggttttgggggactagggtatgggtacgggtgcggctgcggaagcttccgcagactcggctatgggtgtgggtttggcggcaacgggtatggatattgcagaccaagttgctacggtggatacggcttctcaatcctgctcaaatcctatcccgaggataccatcagcgaggtcatacggcggtccttcaatctgaccaaatactag

SEQ ID NO: 23655 - DNA, 246 bp, Artificial Sequence
  Description of Artificial Sequence: Synthetic coding sequence
atgagctactacggcagctactacggcggcctgggctacggctgcggaggcttcggcgggcttgggtacggctatggctgtgggtgtggctctttccggcgcctaggctccggctgcggctacggtggctacggatatggcagtggtttcggtggctacggctacggttctgggtttggcggctacgggtatgggtgttataggccctcttattatggaggctatggtttctcaggtttctattag

SEQ ID NO: 23656 - DNA, 414 bp, Artificial Sequence
  Description of Artificial Sequence: Synthetic coding sequence
atgagctacaactgcagcagcggcaacttcagcagctgctgcttcgggagttacctgaggtatcctgttagcacgtacaacctgttttacccctctaatgccatctactctcccaatacctgccaactcggctcctccctgtataacggatgtcaggaaacttactgtgagcccacatcatgtcagacatcttgtactctggccagaagctatcagacaagctgttactgtcccaagaacagcatcttttgctcaccacgacaaaccaactacatacgtagcctcggctgcggcaacacggggctcgggagtttgggctgtggttccactggctttcagtcactggactgtggttcctctttctaccacccaacaacattttcctcccgaaactttcaggcaacatgctactag

SEQ ID NO: 23657 - DNA, 483 bp, Artificial Sequence
  Description of Artificial Sequence: Synthetic coding sequence
atgagctacaactgctgcagccggaacttcagcagccggagcttcggagggtatttgtattatccgggcagctacccttctagcttagtatattccactgctctgtgctccccatccacctgccagctacggagctccctgtaccgagattgtcagaagacgtgctgggagccagcctcttgtcagaaatcatgttacaggccaagaacaagcatcctctgctgcccttgtcaaactacttgctctgggagcctgggatttagatcttcttcttgccggtcccagggctacggctctcgctgctgttactccctaggtaacggatcctccggatttcgtttcctgaagtatggcggatgcggttttccttccttgtcatacggctcccgcttctgctaccccaactatcttgcctctggagcatggcagagtagctgctaccgtcccatctgtggcagccgcttctatcaatttacctgttag

SEQ ID NO: 23658 - DNA, 684 bp, Artificial Sequence
  Description of Artificial Sequence: Synthetic coding sequence
atgctgaaccccgacggcgtgtacctgggcaactaccggtgcagcctgatgggattcgacctcaatcgccactggctggatccatcgccatgggttcatcctacattacacggggtcaagcagctcatcgtgcaaatgtataatgaccccaaaacttcactggagttctatatcgatatccatgcacactccacaatgatgaatggatttatgtatggcaacattttcgaggacgaggagcggtttcagcgacaggccattttccccaagttgctctgtcagaacgccgaagacttctcctattcaagcacatcctttaaccgagatgccgtcaaagcagggacggggagaaggttcctgggggggcttctggaccacacctcctattgctatacgctggaggtgtcattttactcttacataattagcggcaccaccgctgctgttccatacacagaagaagcgtacatgaaactgggacggaatgtcgctaggaccttcttggactactatcgcctgaaccctgtcgtggagaaggtagctatccctatgcctcgtttgcggaaggagaagtctcccccatataagcatcccctgcttagagggccggcaagcaactatccgaacagcaagggggacaaaaagtctagtgtcaatcacaaggacccctctacccctttttag

SEQ ID NO: 23659 - DNA, 465 bp, Artificial Sequence
  Description of Artificial Sequence: Synthetic coding sequence
atgacccactgctgcagcccctgctgccagcccacctgctgccggactacttgttgccggacaacttgctggaagccaacgacagtaactacctgtagctcaaccccctgctgtcagccttcatgctgcgtgagcagctgctgtcagccatgctgtcggcctacttgttgccagaacacatgctgccaaccaacgtgcgtgacatcatgctgccaaccctcttgctgcagtactccctgctgccagcctacctgctgcggtagttcctgtgatcagagctctagctgtgcaccagtatactgtcggcgcacatgttattatcctacaacagtgtgtctcccagggtgccttaatcaaagttgtggttcaaactgctgtcagccctgctgccggcccgcttgctgcgaaaccacatgtttccagcctacatgcgtgtcctcgtgttgccaaccattttgttgttag

SEQ ID NO: 23660 - DNA, 7062 bp, Artificial Sequence
  Description of Artificial Sequence: Synthetic coding sequence
atgaagcagcggaagggccagggcagcggcggcagccggggccggaaaaaacgcggtttgtccgatatctcccctagcaccagcctccctcccctagtagagggccagcttcgatgctttctcaagctaaccgtgaacagggtcatctggaaaattgccaagcctcctacatgtgtcctcgtgcgggtgagatggtggggcgagacttctgatggaactctgttttgcccaagagacgcccttcagacggaaccaaaggccgtacggactactacccgctacgccataagatgcggccccaagcagtttacatcgtatttaacagatatggctgtgctcgtgctggaagtaatcactaaacttgacggcttacctataggcagagtccagatcaacggcctcgcacagctgagtccaacgcaccagatcaacggctttttcacaatcgtgagttctactagtaagaaactgggggagctgcaggtgagcctagcattggaaccgctgagcgaaacctacgactcataccatccactaccaacgaccgacatgacggaaaacgtcttgttgtcgaaacagggcttcagggaaaataccgagccctcaagcacacagttccaggttccctcgaggcccagggacatccacacaattaagattgatggcaaggagctagctgctaatagctcccgcagcactacgccgaggggcaaggaccacgtgtgcttcgcagagaaccctgataccatcaaggactcatctttcggcctgcagcattcattaaacagcggccagagtctcgaatctgtgactttgaaagggcgcgctcccagaaaacagatgtcgctcctcaacagctcggagttccagcctcaaatccgcactgtggccaaatcccattcagactcctgcatcctgagttctaataacttacctacaaaagatctgctcagtgccctcctggaacagggaaacaagttgcggaacgcaatggtgatcagtgccatgaagtcatcacctgaaacttcaatgctcttagatcaagtacacccgcccatcaacgaggactccctgcgggcctctacccaaattagggccttttcccgaaatcgctttaaggaccacatcgaagatcacctgctcccatccacagaaaatacattctggcggcacgacacaaaggcggacacacgtgctatccaactcctcctgggaagtgccgaactgtcccaaggcaatttctgggatggtctgggctccccgcccgattcacccagcccagggtcggatgtctattgcattagcgagctgaatgatccccagtacgaccagtccctcctagaaaacctgttttatactgcccctaagagcgacacctcgatttctgacttcttgagcgaggaggatgacattgttcctagtaagaagatctctcagagtaccgctctagccaggtcctctaaggtgttagaatctagtgatcacaagctcaagaaaaggtcagccgggaagcgcaaccgaaacctcgtggagcagcagatgctttcagagaccccggaggatgcccagaccatgactctgtcagtggatcggctcgccctccttggcagaacacacagtgtgagaatcataattgaaacaatgggagtcccccccgacagcccccaaatgacgccagggaagaaatcttatgctggcccccctccaaaggtgaccactgccaagaaacgcacctttttcgtggagtaccacttcccagtcggtttctccgagtctgggttaggtaaaacagctctgattactgaggtcgtgcgccttgctagtagtaagattacagatggtaaggtaaagtttcagcaaaggttcgtatttcccgtccagttcggtggccctatgattgagcattggtggaacagcaatctgacctttcaaatctatgtgaagaagactccacaaaaaaagccagaggttattggctcggtctctctgtcactacgtgcagtaattcaatcagagcttttgagctttagtgaccagctgcctgtgcagcaggagaatggccaatctcccttcggtccactaaaggtcacaatggagctgataacagataacaaagatttcacaggaatcaacaccaaactgtcggggaatacccattatacacccctctgcgctccaacttcgcctaacaaagctctgccagaacttaatcaggacatgacatgcaccaagaatcctcaaaatttgaatcagatccacgaagagacggccaagaaagctcagaacttggtgttacctaacagaaagagcccaagtccagttgcaccccatccatccacgttcgtcgcgactcccgcttcgcacaatctggttaatcagaccaacgggaccacaaaggagagcgctttgctgctccatgtgctgctgatggtccctgacggcaaggacttcattagtggagaaagcgagaaacagtctccgtgcaacgtctatttgaactgcaaattattctccaccgaggaagtcactcgatcagtgatcgcctggggcactacccagcctgtgtttaacttctcgcaggtgatccccgtgagtctgtctagtaaatatctggaacgtctgaaaaataacgtaatggtcatcgagacctggaacaaagtgaggagtcccggccaagacaaattactggggctggtcaagctcccgctgcaccaattttacatgagcttcaaggatgcgaaaatcagtcgcttgctgctagacgctcaataccccgtcgttgccgttgacagctacatgccagtgattgatgtgttttccggacaccagaatggcagcctcagagtgtttttggcaatgggatcatccaatcagatcatggcccttcagcgcctgaagaacgaggaaggaacactgccaccgttttcaccacgacccgcacatttcctggatcaacctactgccgcttcggtggcaatggccgaagatcgcggtaacggcctaatggaacattgctttgagattcacattgagatggtgaagggccttgcccctctccaggcaaccgtctggggggaggcagattgttacgtgcagtactactttccggtgcaacacagccagtcctccgtgctgaaagggcctgagttcctcgaaaatgggattactctgaagccctttcggacagccacaactctttgcgtaccagatccaatcttcaatagcgaacatcaccacagccttctcctccctgctgaagttccggttcaacgattgttattgagcgcgttctccgcccaaggcctcgtccccggggggggtgttcagttcgagatttggtgccgctattattatcctaatgtccgcgatcagaaggtcgcgaagggaacactgcccctgtctcgcatctgcgctatggtgacaacacagcaccgggaggacgttgggattcagaccttcaatctgccattgacgcctagaattgagaaccgaaaggagttgaggaaccaatctagcggcctgctcgatgtaggcctgcgttatcgacggtctccccgtaccgcagagggggtgctggcagccagaacagtctcaatatcggtccagattatccgggcatgtgggcttcaagctgcggcgaaggccctggcagaaagagagcccgcgttacagtttagcgccaccgtgggagtgaacgccagtgtcacaacgcatctctcctttctcccccagggagaacagcgcaggacccaccccgtcgcctgttccttctgcccagagtttagtcatcacgtagagttcacttgtaatctggttactcaacattgctcaggggaagcttgctttctggcagagttattggagttcgcagaggtaatatttgcggtgtatcacgagaacacgaagagtgcgtccgacatcatctccatcgaatcttgcaaggagtatcttctcggtgtggtgaaggtgcccacaaaggagctcttgataaaacggtctggtatcacgggttggtaccccatcatactgcctgaagacggaggcctcccacacgggcttgagttgatgcagaaaatcgtcggtggtcttgaactctcaatcagtttcactcaccggggggatagagaacgcgtgttagaggcggccgagcatttaggatggagtttcgaaaattctctgaaggacttcgttagaatggatgagggcgagccagcgacagtcacaatctccacacccaggctctggctgcccattcattgtgttctcttagcaggacacaaccatatccacaagaatacttactgctatctgcggtacaaattttacgatcacgaagccttttggacgcccttaaagaagccgaaagagagcgtgaataagaaacagattatggtgacattcaaggctagcaaacgggctgaggttacaagaggtcctagcctgctgtggtactttcgggaggagcgcttagaaattcaggtctggcgtgcttatggcaatgattccgtggaacgtccccaccagacagactcttggattggatctgcgtacgtagatcttgcaaggctgggggagaggagcgctcggacactcaccgtgtctggggtgtatcccctttttggtagaaatgcctcaaacctatccggcgccgctctgagagtccacgtggttctctctagcctgtcctcacacctcgagcccacgcatgagctggactcgatggactgttcttcacacagtgagtccgaacaattacctaggagaaacgacgaggtgcagctttctccccctgaagtgatcagctgccaccagaagagtccagcaagcactcaagtgccatgctcctccacaactgctgaagtacggctaacccaagaagggcccgctgacttagatggcactttcgcagtgagtatcttggtggaaagggcaatgcatcttagcctgaaggggtcccccctcacggagagaaaggtgtcaatccccagctgttgtgtgtccttcgccactgcagatgagtcatcacctgtgtatacacaggtggtagaaaatacagacagccctatttggaacttccagcagcagagtcgcctgtcaaaggaactgctgctcgacccgcagcagactctcgtgttcaaggtttggcataaaggagacgaggagagagtgatcggattcgcttcagttgacctgagtccactcttgagcgggttccagttcgtctgcggctggtataatatcactgatttctccggcgagtgccaaggtcagatcaaggtagccgtgtcaccgctggaatcactgatccacttcaaagaagagcgacaggcaagaagaggcgtggagacgtcgaaaagcctgattcccatttattcccccttcagcttccccgctagcgatacatacgccgccttctctagtcatatggcccggcagaccctagatcagcttgcccacgctagtagtaaggagctggacttttccagtccaggcagatcggacaccaccagatcacaagcatcccgccacgaggaacacgtgcagaatattcgacgcttccatgaatcactgcacttgcagggcgaagcccctcttccatgtgacgacaaactcaccacttccccattgtcctcgcaaaccagcatcctgacttcactaagaaagaatctgtctgaactggaccaaattcagaggtattttagacagaagctcactaaacccttcctgcctttgtccccacagacccaaactgccatttcacagcaccaagaatcttgtcgcgatcacctggggccgggggcaagcagcctggatcccgggtcgcagtgcatcctggaaaagtcaagcaatctcgttctacaagtgagctccctcatcactgacctgcagaccatcacgcgagactctcaagcagctctgagctctcacagagccagatcccggtccaacaaggcaacaacgctacccgatgcccaggatacagaggccttgcaggagcggtgtactatgccagacgagccccttgtgagggcgccggacaagggtaccgattccccttccccaccccccttagaagaaacaagcaacggcggacgtatgctccatgagagccttagacatgccgtcccaatcactcgtatgcagtcgtcagaggataccgaagccggacctgcctacagcgatgaggattacgaagaagacattattgagcctcgcactttgaatgaaatcactacggtgaccgacaagacatccccatggagtagcgtgatctccgacacatctgaggtgatttcgccgcaacccgacgaggtgcagagggaaggtccctcctgcccatcacccggtcctttttgccgcgaggagctgatggtgaagtctagcttcctgtcttcccccgaacgcgcagttaacccccatctgccgagacaaggctccccgtcccaatcactcgtcgcctgtgaatgtgaggcctccaaggcccgtgtgggtggggagtccgcctccgccaacccccaacctataccctgcccaaccctcagtggagctcagcagagcagtacctttgtgggatggtcgagcccccagacagatcagaataaggaacccaaatcagaggctcccgctgagaacgaggctgcgaccagcgaacttggggactccgctgatagcttcaagaaactgcccctaaaccttgcttcgcagtctagacgggaaaaccataagggaccacctattgactcctctgatattcgccaaaggcaggtcacgaccgggagcgaaacctctaccaaacaatcgctcctcctgccaggccccattgtagtgccgaacttctttttgcccccccagcagctggaagcttctctgcgtatgctctcgctgagcgccaccctgccacctgccgccacaacggatcaggacaagtcggaagctactcggggggctctcagccagcggccatgccgaccaaggcccaattccctgccacttaacttgccagaggaagaaacactcaggatcgcgcgcatcttctcttcacaatatagccaaaaggactag

SEQ ID NO: 23661 - DNA, 219 bp, Artificial Sequence
  Description of Artificial Sequence: Synthetic coding sequence
atgaactactacggcaactactacggcggcctgggctacggctacggtggctttgacgacttaggatatggatacgggtgtggctgcggctccttccgaaggctgggttacggaggcggatacggcggctatggttacggctctgggttcggggggtacggttatcggagctgtaggcctagctgttatggcggctatgggttttcagggttctactag

SEQ ID NO: 23662 - DNA, 198 bp, Artificial Sequence
  Description of Artificial Sequence: Synthetic coding sequence
atgagctacaactgctgctgcggcaacttcagcagccacagctgcgaagggtatctttgttactctggttactctcgagggggttcctcttacccctctaatttagtgtatagcacagaaccactcatttcccagcatctgccggcgggcttcttgagtctacaggggctttctggagatctgctaggaaacccatag

SEQ ID NO: 23663 - DNA, 384 bp, Artificial Sequence
  Description of Artificial Sequence: Synthetic coding sequence
atggtgaacagctgctgcggcagcgtgtgcagcgaccagggctgcgaccaggggctctgccaagagacttgctgtagaccatcctgctgccaaaccacgtgctgttgtccaagttgtgtggtgtcctcctgttgtcggccatcctgctcccaaacaacctgttgccagactacctgttgcaggccttcttgttgtcaccccgtgtgttgtcagacaacatgcaggcccagctgtggagtgtcaagctgttgccgtccactatgctgtcagactacctgccgccccagttgcggggtatcgagttgctgtagacccctgtgctgccagaccacatgttgcagggcaacgtgctgccgtccatcctgctgcgggagctcctgctag

SEQ ID NO: 23664 - DNA, 318 bp, Artificial Sequence
  Description of Artificial Sequence: Synthetic coding sequence
atgggctgctgccccggcgactgcttcacctgctgcacccaggagcagaattgctgcgaagaatgttgctgccagcctggctgttgcgggtgctgtgggtcatgctgcggatgcggaggctctggatgcggaggctccggttgtggcgggagttgttgtggatcatcatgttgtggcagcgggtgcggagggtgcggggggtgtgggggatgcggtggaggctgctgtggatctagttgctgcggatcatcctgctgcgggtcagggtgttgtggtcccgtctgctgccaacctacccctatctgcgacaccaagtag

SEQ ID NO: 23665 - DNA, 3915 bp, Artificial Sequence
  Description of Artificial Sequence: Synthetic coding sequence
atggaggagatccccgtgaaggtggccgtgcggatccggcccctgctttgtaaagaagcactgcacaaccatcaagtttgcgtgagggtgattccgaacagccaacaggttataatcggaagggatcgcgtgttcacctttgacttcgttttcggcaagaattctacgcaggatgaggtatacaacacctgcatcaagccactagtcctgtcgctaattgaaggatataatgcaactgtcttcgcctacgggcagacaggctcagggaaaacatacaccattggcggggggcacatagcgtccgtcgtcgaaggccagaaaggcattatccctagggccatccaagaaatttttcagagcatctcagaacatccttcaattgacttcaacgtgaaggtgagctatattgaagtctacaaggaggatttgagagacctgctggaattagagacttcaatgaaggacctccacatcagggaagacgagaaaggaaacaccgtgatagttggagccaaagagtgccacgtggagtcggcgggtgaggtcatgtctttgcttgagatgggtaatgcagctcgtcacacaggcactacccaaatgaatgagcacagttcacggagccatgccatcttcactatctcaatatgtcaggtccacaaaaacatggaagcagctgaggacggttcctggtattcaccccgacatattgtgtccaagtttcattttgtggatctggccggctcggaacgcgtgaccaaaacaggaaacaccggcgagagattcaaagaaagtatccagataaattcaggcctcctcgcactgggaaacgtgatctctgcgctgggggatccgaggcgaaagtcatctcacatcccctacagggatgccaagattacacgcttgttgaaggatagcctgggaggcagtgcaaaaaccgtaatgatcacatgcgtgtcacctagctcttccaacttcgacgagagtctcaactcccttaagtatgcaaaccgcgctaggaacatcaggaataagcccactgtgaattttagccccgaatcggatcggatcgacgaaatggagttcgagattaaactcctgcgcgaggcgctccaatcacaacaggccggagtttcccagacaacccagatcaaccgcgaagggagcccggacactaaccgtatccacagcttggaggaacaggtcgcccaactacaaggcgagtgtctgggataccaatgttgtgtggaagaagcttttacattcctggtggacctgaaggacacggtgaggctcaatgagaaacaacagcacaagctccaggaatggttcaacatgatccaggaggtccgcaaggccgtgctgacctcattccgcgggattggaggaaccgccagcctcgaggaagggcctcagcacgttaccgttttacagttgaagcgggagctgaaaaaatgccagtgcgtgttagccgcagatgaagtcgtattcaaccagaaagagctcgaggtgaaagagctgaaaaatcaagtccagatgatggtccaggagaacaagggccacgccgtctctttgaaagaagcccaaaaggtcaatcggctgcagaacgaaaaaatcatcgagcagcagctgctggtcgaccaacttagtgaagaactgacaaagttgaacctgagcgtgacctctagcgccaaagagaactgcggtgacggacctgatgctcggatccccgagaggcggccatacaccgtcccattcgatacacatctcggtcactacatatatatcccgtcgcggcaggactctagaaaggtgcacacctcacccccaatgtactcacttgatagaatctttgccggattcaggacccgaagtcagatgctgctggggcacatagaagaacaggacaaggtcctccattgtcagttcagtgataattccgacgacgaggagagcgaaggccaggagaagagcggaactcgatgcagatcaagaagttggatacagaagcccgactcagtttgctctttggttgaattgagcgatacgcaggacgaaacacagaaatctgacctggaaaatgaagacctcaaaatcgactgcttgcaggaaagccaggaactgaacctacagaaactaaagaacagcgagagaatcctgaccgaagcaaagcaaaagatgcgtgagctcaccattaacatcaagatgaaagaggacctgattaaagagcttatcaagaccggcaatgatgctaaaagcgtctccaagcaatattcactgaaggtgaccaaactcgaacatgacgccgaacaggctaaggtcgagcttatcgaaacgcagaagcaactccaagaacttgagaacaaggacttaagcgatgtggcaatgaaggtcaagctccagaaggaattccggaagaagatggacgccgcgaagctccgagtgcaggttctgcagaagaagcagcaggactctaagaaacttgctagtttgagcatccagaatgaaaaacgggccaacgagctcgaacagagtgttgaccacatgaaataccaaaaaatccaactccagcggaaattgcgcgaagagaatgaaaagcggaaacagcttgacgctgtgatcaagagagaccaacaaaaaattaaggccctcaacactgatagcctcaaaattagcacacgcctgaacctgttggagcaagaattatccgagaagaatgtccaattacaaacatctacagcggaagaaaaaactaagatctccgagcaggtggaagttcttcagaaggagaaggaccagctgcagaagcggcgccacaatgttgacgagaaactcaaaaatggacgtgtgctaagtcccgaggaggagcacgttctgtttcagctggaagagggaattgaggcactcgaagcagctattgaatataggaacgagagcatccagaaccgccagaaaagcctgcgtgcgtccttccacaacctttcacggggtgaggcaaacgttctggagaaacttgcctgcctatcgcccgtggagatcagaacgattctctttcgttacttcaataaggttgtgaatctgcgcgaggcagagcggaagcagcagttgtataatgaggagatgaagatgaaggtattggaaagggataacatggtccgcgagctggagagcgcactggatcacctgaagctccagtgcgataggcggctcacactgcagcagaaagagcacgagcaaaaaatgcagctgctcttgcatcactttaaagaacaggacggagaaggcatcatggaaacctttaagacgtatgaagataaaatccagcaactcgagaaggacctgtacttttataaaaaaactagccgggaccataagaaaaaactaaaagagctggtgggtgaggctatccgcagacaactggcaccaagtgaatatcaagaggcaggagacggcgtattgaagcctgagggaggcggcatgctttctgaagaactgaaatgggcctcgcgtccagaatccatgaagctgagcggacgtgagcgtgagatggatagcagcgcatcttctctgcggacacagccaaacccccagaaactctgggaggacattcctgaattgcccccgattcatagtagcttggctccaccttcaggccacatgcttgggaatgagaataaaaccgaaactgacgataaccaattcactaaaagtcattcaaggctgagcagccagattcaggtcgtgggtaacgtcgggcgcctgcacggggtcactcccgtcaagctctgccgcaaggaactgcgtcagatttccgctttagagctgagcctccggaggtccagcctgggcgttgggattgggtccatggccgctgactctattgaagtgagccgcaagccaagggatctgaagacttag

SEQ ID NO: 23666 - DNA, 903 bp, Artificial Sequence
  Description of Artificial Sequence: Synthetic coding sequence
atggaggaggaggccagcagccccggcctgggctgcagcaagccccatctggaaaagctgacactagggatcacacgcattcttgaaagctctcccggggtgactgaggtaaccatcatcgagaagcctccagctgagcggcacatgatttcaagctgggagcagaagaacaactgcgtgatgcctgaagacgtgaaaaacttctatctgatgacaaacggctttcacatgacctggagtgtaaaactggacgaacacattattcccttggggtccatggcgatcaattctattagcaagctgacgcagcttactcagtcctccatgtattctctgcctaacgcccccacccttgcagacctggaggacgacacccatgaggcttccgatgatcagcctgaaaaaccacactttgattcaagatcagtcatcttcgagctggactcttgtaacggctccggaaaggtatgtcttgtgtataaaagcgggaagcctgctctggccgaagacacagagatctggtttctggatagagctctctattggcacttcttaactgatacgtttacagcttattatcggctgctgatcactcacctgggcctgccacaatggcagtacgccttcacaagctacgggatctctccccaggcaaaacagtggttttccatgtacaaacctatcacgtataacacgaaccttctgaccgaagaaacggatagctttgtgaataagctagacccctctaaagtgttcaagtccaagaataagatcgtcatccctaaaaaaaagggccctgtgcaaccagccggggggcagaaggggcctagtggcccatctggcccgagcacaagtagtacgagcaaatccagtagcgggtcaggaaaccccacacgaaaatag

SEQ ID NO: 23667 - DNA, 390 bp, Artificial Sequence
  Description of Artificial Sequence: Synthetic coding sequence
atgatgaccgacctgaagcagagccacagcgtgcggctgaacgacggaccttttatgcccgttctgggcttcggaacatacgcccctgatcacaccccaaaatcgcaggcagctgaggctaccaaggtggctatcgacgttggctttcggcacattgacagtgcttacctttaccagaacgaagaagaggtcggacaggcaatttgggaaaagatcgccgatggcaccgtaaaaagggaggaaatcttctacaccatcaaattgtgggctactttcttccgagctgagctcgtccaccctgcactagagagaagcctgaagaagttagggcctgattacgtcgatctctttatcatacatgtgcccttcgcgatgaaaggcagtagttag

SEQ ID NO: 23668 - DNA, 1257 bp, Artificial Sequence
  Description of Artificial Sequence: Synthetic coding sequence
atgcaccccgagcccagcgagcccgccaccggcggcgccgccgagctggactgtgcacaggaacctggcgtcgaagagtctgcaggtgaccacggcagtgccggcagaggtgggtgtaaggaggagataaacgacccgaaagaaatatgtgtgggctctagtgacacatcctaccactctcagcagaagcagtccggggacaatgggtccggtggccatttcgcccacccacgcgaggatcgagaggacaggggccctcggatgacgaagtccagcttacaaaaactctgcaaacagcacaagttgtatataacccccgccttaaatgataccctgtacctgcacttcaagggatttgatcgcatcgagaatctggaggaatatacaggtctgcgctgtctgtggctgcagagcaacggaattcagaagattgagaatcttgaggctcagacagaactccgatgccttttcctacaaatgaaccttttgcgaaagattgaaaatttggaacccctgcagaagttggacgccctcaacttgtctaataattatatcaaaacaattgagaatctttcgtgtcttccggttctaaacacgctccagatggcccacaatcatctggaaaccgttgaagatattcagcacctccaagaatgtctccgactgtgtgtgctggacctgtctcacaacaagctaagcgacccagaaatcttgagcatcttggagtccatgccggatctgagagtgctgaacctgatggggaaccctgtgataaggcagattccaaactatagaagaactgtgacagtccggctgaaacatttgacttatttggatgataggcccgtcttccctaaggacagagcctgtgcggaggcgtgggcccgtggcggctacgccgcggagaaggaagagcggcagcagtgggagagtcgtgagcggaagaagatcacagacagcatcgaagctctagctatgatcaagcagagggccgaggagcgcaagcgacagcgggagtcacaggagcggggcgaaatgacatcttctgatgatggcgagaatgtccctgcctcagccgaggggaaggaggagccacccggggaccgcgagactaggcagaagatggaacttttcgttaaggaaagcttcgaagccaaagatgagctgtgcccagagaaaccatccggagaggagcctcctgtcgaagctaaaagagaagatggagatccagctaccgtaacagcgtgtgaaggctag

SEQ ID NO: 23669 - DNA, 2472 bp, Artificial Sequence
  Description of Artificial Sequence: Synthetic coding sequence
atgggcaagaagcggaccaagggcaagaccgtgcccatcgacgactcctccgagacccttgaaccagtctgtaggcatattcgcaagggactggagcaagggaacctgaaaaaggcactggtgaatgtggaatggaatatttgtcaggattgtaagacagacaacaaggtgaaagataaggccgaggaagagaccgaggagaagcctagcgtttggttgtgcttgaagtgtggacaccaggggtgcggtcggaactcgcaggagcagcatgccctgaaacactacctaactccaagaagcgagccacactgcctcgtcctcagcctagataactggagcgtgtggtgctatgtatgcgataatgaggtgcagtactgttcctctaaccagctgggccaggttgtagactacgttaggaaacaggccagcataaccaccccgaagccggccgagaaagacaacgggaacatcgagcttgagaacaaaaaattggaaaaggaatccaagaacgagcaggagcgggagaaaaaggagaatatggctaaggaaaatccgccgatgaattccccatgtcagataactgtgaaagggttgtccaatcttggaaacacttgctttttcaacgctgttatgcagaacctgtcccagacacccgtgctcagagaactcctgaaggaggtgaagatgagcggcactattgtgaaaattgaaccgcctgatctggctttaaccgaacctctcgagataaacttggaacctccaggcccgctgaccctcgccatgtcacagttcctcaacgagatgcaagaaaccaagaagggggtggttactcctaaggaattgtttagccaggtgtgcaaaaaggccgttcgcttcaagggctatcaacagcaagatagccaggaactcctgaggtatctattagatgggatgagagcagaggaacaccagcgtgtcagtaaaggcattctcaaggcatttggtaattctacagagaaacttgacgaggagctgaagaacaaagtgaaggactacgaaaagaagaagtctatgccctcattcgtggaccgaatctttggaggtgaactgacatctatgattatgtgtgaccagtgtcgcacggtgagtcttgttcacgagtcctttcttgatctttccctaccagtgttggacgaccagagtggtaagaagtccgttaacgataaaaacttgaaaaagacagttgaagacgaagatcaggacagcgaggaggaaaaggataacgattcctatatcaaagaaagaagtgatatcccgtcaggcacctccaaacaccttcagaagaaggccaaaaagcaggccaagaaacaggcgaagaatcaacgtcggcaacagaagatccaaggcaaggtgctgcatctcaacgacatctgcaccatcgatcaccccgaggacagcgagtatgaggccgagatgtcgcttcagggagaggtaaatattaaatcaaatcatatcagccaagaaggcgtgatgcataaggagtactgtgtgaatcaaaaggatcttaacgggcaagccaagatgatagagtcggtgacagacaatcaaaagagcacagaagaagttgacatgaagaacatcaacatggacaacgatctggaggtgcttacaagctctccaaccagaaacctcaacggagcgtacttgacagagggctctaatggcgaggtggacatcagcaacggcttcaaaaaccttaatctgaacgctgccttacaccccgatgagattaatatcgagatactgaacgactcacacacccctgggacaaaggtttacgaagtcgtgaacgaagaccccgagactgcgttttgtacccttgccaaccgcgaagttttcaacacagacgagtgtagcatccagcattgcctatatcagttcacacgcaacgaaaaactgcgggacgcaaataagcttctttgtgaggtgtgtacgcggagacagtgtaacggaccaaaggccaatatcaagggtgagcggaagcacgtatacaccaatgccaaaaagcagatgctcatttccctggctccccccgtgctcacactgcatctaaaaaggtttcagcaggctggattcaacctccgcaaggtgaacaagcacatcaagttccctgaaatcctggatctggcacctttctgcacactgaaatgcaaaaacgtggcagaggaaaacacccgtgtgctctatagcctctacggagtcgttgagcacagcggaacaatgcgatcaggccattatacagcctatgcgaaggccagaactgcgaatagccacctgtcgaatctggtgctgcatggagatatacctcaggatttcgagatggagtccaaggggcagtggtttcacatctctgatacacacgtccaggccgtgcccaccactaaggtcttgaactcccaggcataccttctattctatgaacggatcttatag

SEQ ID NO: 23670 - DNA, 3204 bp, Artificial Sequence
  Description of Artificial Sequence: Synthetic coding sequence
atgaacagcatggaccggcacatccagcagaccaacgaccggctgcaatgcatcaagcagcatctccagaatccagctaactttcacaacgcagcaacagagctcctggactggtgcggcgatcccagagcctttcagcgacctttcgaacagtccctcatggggtgcttgaccgtagtgagccgagtggccgcccagcaggggtttgacttggacctggggtacaggctgttagccgtgtgtgcagccaatcgagacaagtttacacctaaatccgcagccctccttagttcatggtgcgaagagttaggaagacttcttctcttacgtcaccaaaaaagtcgacagagcgaccccccaggtaaattgcccatgcagcccccgctgtcatccatgagctctatgaagcccaccctgagtcactccgatggctccttcccctacgactccgtgccttggcagcagaataccaaccaaccgcccggtagccttagcgtggtaacaacagtgtggggggtgacgaatacttctcagtctcaagtcctgggaaatcctatggcaaatgcaaacaatcccatgaaccctgggggcaaccctatggcttctggcatgaccacttccaaccctggattgaacagccctcagtttgcaggccaacagcagcagttcagcgccaaggccggcccagcacagccatatatccagcagagcatgtacgggagaccaaattacccgggatccggcggttttggagctagctaccctggggggcccaacgccccagccggtatgggtatcccaccccacactcggcctcccgccgatttcacacagccggccgccgctgccgcagctgcagccgtggcagccgccgctgcaacggcgacagctactgctacggctaccgtggccgcgttgcaggagacccagaacaaggatatcaaccagtatgggccaatgggccctacccaggcatataattcacaattcatgaaccaaccagggccccggggtcctgcttcaatgggcggcagcatgaatccggccagtatggcggccggcatgacaccctccgggatgtcagggcctcccatgggcatgaatcagccccgacccccaggcatctcccccttcgggacccatggacagagaatgccacaacaaacgtaccctggcccaagacctcagtctttacccatacagaacatcaagaggccttaccccggagagcctaattacggcaatcagcaatatggtcccaactcccagtttcctacacaacccggccaatacccagctcccaatcctccacgccccttaacatcccctaactatcccggccagaggatgccttcccaaccaagttcaggtcaataccccccacccactgtgaatatgggacaatactacaagccggaacaattcaatggtcagaacaacactttttcaggctcttcttacagtaattatagtcaaggtaatgtgaatagaccaccccgccctgtgcccgtcgccaactaccctcactcccccgttcccggtaacccaactccgcctatgactccaggctcctctattcccccgtatttgtctccaagtcaggatgtgaaaccacccttcccccccgatatcaagccgaacatgtccgctctgcccccccctccagcaaatcataatgacgaactgaggctgacttttcctgtacgcgatggtgtggtgctggaaccttttaggctggagcataacctcgccgtttcaaatcatgtgttccatcttagacccaccgtgcaccagactcttatgtggcgctctgatctggagctgcagtttaagtgctatcaccatgaggataggcagatgaatacaaattggccagcctccgtgcaggtcagcgtcaacgcaacacctctcactattgagcgcggcgacaacaaaacgtcccacaagcccctgcatctgaagcacgtgtgtcagccaggacgcaacacgattcagattaccgttacagcctgctgttgctcccatctcttcgtcctgcagcttgtacatcgcccctcggtgagatccgtactccagggcttattgaagaaaagactactgcctgcagaacattgcattaccaaaatcaaaaggaatttttcatctgtggcagcttcatcgggaaacacgacactcaatggtgaagacggtgtggagcagaccgccatcaaggtctctttgaagtgcccgatcacttttcgccggatccagctgccagcccggggccacgattgcaaacacgtgcagtgcttcgatctggaatcctacctgcagctgaactgcgaaagaggtacctggcgatgtccagtttgcaacaaaacagctcttctcgagggcctagaggtcgatcagtacatgtggggaattctgaatgctatccagcactctgaatttgaggaagtgaccatcgaccctacatgtagctggagaccagtccccatcaagtcagatctccatattaaagatgaccctgacggtatccctagcaagcgatttaaaactatgagcccgtcacaaatgataatgccaaacgtcatggagatgatcgccgccttaggtcctggtccaagcccctacccactgcccccaccccctggtggcactaatagcaatgactattctagccagggaaacaattatcagggccatgggaacttcgactttccccacggcaaccccggggggaccagcatgaatgacttcatgcatggacctccccagctgtctcatcctcccgatatgccaaataatatggcagccttggagaagccactcagtcaccccatgcaggagactatgccacacgccggctccagcgatcaacctcaccctagcatccagcaggggttgcacgttccccatccgtccagccagagtggccctccactccatcactccggagcaccccctccacctccctctcaaccaccccgacagccccctcaggccgcaccctccagccatcctcactcagacctgacatttaaccccagctctgccctggaaggacaggccggcgcacagggggcatcagacatgccagagccaagtctcgatctattacccgaactaacaaacccagacgagttactatcttatctagatccacccgacttgccttcaaatagtaatgatgacctgctgtctctgtttgagaacaactag

SEQ ID NO: 23671 - DNA, 1038 bp, Artificial Sequence
  Description of Artificial Sequence: Synthetic coding sequence
atggacggcgaggacatccccgacttcagcagcctgaaggaggagacagcctactggaaagagttaagcctcaaatataagcagagctttcaggaagccagggatgaactggtagagttccaggagggatccagggagctcgaagccgagctggaggcccaactggtacaggccgagcaaaggaatcgtgacttgcaagccgataatcagagactgaaatacgaggtcgaggcgctcaaagagaagttagaacatcagtatgctcagtcctacaaacaggtctctgtgctggaagatgacctttctcagacccgcgccatcaaggagcagttgcataagtacgtgcgtgagctcgagcaagcaaacgatgatctggaacgagcgaaacgggctaccattgtcagtttagaggactttgaacagcggcttaatcaggcgatcgagcggaatgcctttctggagagcgagctggacgaaaaggagtccctgcttgtctcagtccagcgattgaaggacgaggcccgagacctccgccaggagcttgcagtgagggagagacaacaagaagtaactcggaaatctgcacctagcagcccaacgctggactgtgaaaagatggattcagctgtgcaggccagcctctcactccccgccacccctgtgggaaagggaactgagaacacgttcccctcacctaaagccattcccaatggctttggaacgtctcctttgacaccgtccgcccgtatttctgctctgaatattgttggtgacctgttacgaaaagtgggtgccctcgaatccaaactggctgcctgtcgcaatttcgccaaagatcaagcctcgcggaagtcctacatctcaggtaatgttaactgtggggttctcaatggaaacggcactaagttcagccgctctgggcacacttcgtttttcgataaaggtgcagtgaacggctttgatcctgctcccccccccccagggttaggatcttctagacccagttcagcgccagggatgctgcccctcagcgtgtag

SEQ ID NO: 23672 - DNA, 588 bp, Artificial Sequence
  Description of Artificial Sequence: Synthetic coding sequence
atgggcagccgggccagcaccctgctgcgggacgaggagctggaggagataaaaaaagaaactgggttcagtcactcccagatcaccagattgtattccagattcacaagtctagataaaggcgaaaatggtacactatctagggaggattttcagcgaatccccgagttggctattaacccgttgggcgatagaatcatcaacgcttttttccctgaaggcgaggaccaggtgaatttccgcggctttatgaggacgcttgctcactttagacctattgaagacaacgagaagtcaaaggatgttaatgggcccgaacctctaaattccagaagtaataaactgcatttcgctttcaggctgtacgatctggataaggacgagaagatatctagggacgagctcctgcaagttctacgtatgatggtgggtgtgaacatctccgacgagcaattaggttctatcgcggataggaccattcaggaagctgatcaagacggcgacagtgccattagcttcacggaatttgtcaaggttctcgagaaagtggacgtcgagcagaagatgagtattcgattcctgcattag

SEQ ID NO: 23673 - DNA, 780 bp, Artificial Sequence
  Description of Artificial Sequence: Synthetic coding sequence
atggccgacgcctgctgcacccggacctacgtgatcgccgccagcactatgtccgtctgctcctcggatgtcggtcatgtgagcagagtatcaagcccttccacatgcacgggctccagctggcaggtggacaattgccaggagagttgttgtgagcccaggtcatgcgcaagtagttgctgcacaccaagctgctgcgctccagccccatgtctggctttggtgtgtgcccctgtgagctgtgaaccctccccttgccagagtggttgtaccgactcctgtaccccttcttgttgccagcagtcctcttgtcagcccgcctgctgtaccagttctccatgccagcaagcatgctgtgtgcccgtttgttgtaagagtaattgttgtaagccagtgtgttgtgtgtccatttgttctggggcctcgtcaccctgctgccaacagtctagctgccaatcagcttgctgcaccttttctccttgtcaacaagcatgttgcgttcctatctgttgtaagccaatttgttgtgttcctgtgtgctcaggggcgtcgagcctgtgctgtcagaaaagctcctgccagccagcttgttgcacaacgtcttgctgtaggccctcatcctctgtgtccttgctgtgtcgccctgtatgccgcccggcatgctgcgtaccagtgcctagttgctgcgtacccgcatcttcctgccaacccagctgctgccatccagctagctgcttgagttttctttgcaggcccgcgtgctcacgcctcgcctgttag

SEQ ID NO: 23674 - DNA, 171 bp, Artificial Sequence
  Description of Artificial Sequence: Synthetic coding sequence
atgatctactacagcaactactacggcggctacggctacggcggccttggatgtggttatggctgcgggtaccggggctacggttgcggctatggtggatacggcgggtatggtaatggatattattgcccatcctgttatggtcgttattggtcttacggcttctactag

SEQ ID NO: 23675 - DNA, 897 bp, Artificial Sequence
  Description of Artificial Sequence: Synthetic coding sequence
atggccgccagcaccatgagcgtgtgcagcagcgcctacagcgacagctggcaagtggatgattgtcccgaatcatgctgcgagccaccctgctccgcacctagctgctgcgcccctgccccatctctgtcactggtatgtacgccggtgtcttgtgtgagtagtccttgttgtcaggcagcgtgtgagccatccgcgtgtcaaagtggatgtacttcaagctgcacgcctagctgttgtcaacagagcagctgtcaacctgcctgttgcactagcagtccctgccagcaggcttgttgcgtgcccgtctgttgcaagactgtgtgttgtaaaccggtctgttgtgtgcctgtgtgctgcggcgcagccagttcttgttgtcgtcagagttcctgccagcctgcctgctgcgcttcaagctcatgccagcccgcttgctgtgtccctgtttgttgtaaaccggtgtgttgtgtgagcacatgctccgaagattcctcgtcatgctgtcagcagagctcatgtcagccggcctgctgcacatcctcatcttatcagcaggcgtgttgtgttccagtgtgctgtaagactgtgtactgtaagcctatttgctgtgtgcctgtctgcagcagggccagctccagtagatgccaacaaccatcgtgccaacccgcgtgttgcactacaagctgctgtaggccatcttcatctgtgtcactgttgtgtcatcctgtgtgcagatccacatgctgcgtcccagtttcctcctgctgtgcccctacaagcagctgtcaatcatcctgttgcaggccggccagttgtgtgagtctgttgtgcaggcctgcctcttcccggcttgcatgctattcactgtgcagtggtaagaagtccagctgctag

SEQ ID NO: 23676 - DNA, 567 bp, Artificial Sequence
  Description of Artificial Sequence: Synthetic coding sequence
atgaccgcccccagctgcgccttccccgtgcagttccggcagcccagcgtctccggactatcccagataaccaagagtctgtacatctctaacggagtggccgctaataataagctgatgctcagcagtaaccagattacaatggtgatcaatgtcagcgtagaggtggtcaatacactgtacgaggatattcagtacatgcaggtgcctgtggctgactcccccaatagcagactttgcgatttttttgacccaatcgccgaccacattcattcagttgagatgaaacaggggaggacactgctccactgcgcagctggcgtcagcagaagcgcagcactgtgcttagcttacctgatgaaataccacgccatgtcactgttggacgcccacacttggacaaaaagctgccggcctatcatccgcccaaactccgggttctgggaacaactcatacattacgagttccaactcttcggtaaaaataccgtacacatggttagctcccccgtcggcatgatccccgatatatatgagaaggaagtaagacttatgatcccactgtag

SEQ ID NO: 23677 - DNA, 147 bp, Artificial Sequence
  Description of Artificial Sequence: Synthetic coding sequence
atgagcttcgacaacaactaccacggcggccagggctacgccaagggaggtttgggatgttcttacgggtgtgggctgtctggctacggttacgcctgctattgcccctggtgctatgagagatcttggtttagcggatgtttctag

SEQ ID NO: 23678 - DNA, 192 bp, Artificial Sequence
  Description of Artificial Sequence: Synthetic coding sequence
atgagctacagcggcagctactacggcggcctgggctacggctgcggcggattcggcggcctcggatacggatattcctgtggatgtggcagttttagacggctgggctacggctgcggttatggcgggtatagatattcatgttgtcacccaagttgctatggcggatattggagcagcggcttctattag

SEQ ID NO: 23679 - DNA, 189 bp, Artificial Sequence
  Description of Artificial Sequence: Synthetic coding sequence
atgtgcggcagctactacggcaactactacggcgaccacggctacggctgttgtggttatgaggggttaggctatggttatggctctctccgctgcggatactcttcatgttgtgggtacgggcacgggtacggatcccgatttttctgtggctgcgggtatggctgcggctcgggctattattactag

SEQ ID NO: 23680 - DNA, 4227 bp, Artificial Sequence
  Description of Artificial Sequence: Synthetic coding sequence
atgtggagcctgaccgccagcgagggcgagagcaccaccgcccacttcttcttgggtgctggggatgaggggttagggacccgggggatcggaatgagacctgaggaatcagattccgaactgctcgaggatgaggaagacgaagtgccgcctgagccccagatcatcgtcgggatttgcgctatgaccaagaaatccaaatccaagcccatgactcagatcctggaaagactgtgccgctttgactacctaaccgttgtcatactcggtgaggacgtaatccttaacgaacctgtagaaaactggccctcatgtcactgtctgatttcgttccattccaagggcttcccactagataaagcggtggcttatagcaaactgcgcaaccccttcctgatcaatgacctcgcgatgcagtattacattcaggatcggcgtgaggtttaccggattctccaggaggagggtattgatctcccacgctacgccgtgctcaatcgtgatccagcccggcccgaagagtgtaacttaattgaaggggaggaccaagttgaggtgaacggggctgttttccccaagccattcgtagagaagccagtttcagcggaggatcacaatgtgtacatctattatcctagctctgcaggaggcgggagtcagcgactcttccgcaagatcggatcccgttcttctgtctactcacccgagtcatccgttagaaaaaccggtagttatatctatgaggaatttatgcccacagatggaactgacgtgaaggtatatacggtcggccccgactatgcacatgcggaggcacgcaagagcccagctctggacggcaaagtggagcgagacagtgaggggaaagaaatcagatatccagtgatgctcaccgccatggaaaagctggtggcccgaaaggtatgcgtcgcctttaagcaaaccgtctgcggattcgatctcctgagagccaacggacacagctttgtgtgtgacgttaacggcttttccttcgtcaaaaattccatgaagtactacgatgactgtgccaaaatcctagggaataccatcatgcgggagcttgccccccaattccagattccttggtctatccctacagaggccgaagatatccccatcgtgcctaccacaagcggtactatgatggagcttaggtgtgtaatcgccatcatcagacatggcgaccgtacacccaagcaaaagatgaaaatggaagttaaacatcccaggtttttcgccctcttcgaaaagcacgggggctataaaactggaaagctgaaactgaagcgaccagaacagctgcaggaggtcctggatataacaagactgctgttggccgagctggagaaggagccaggcggggaaatcgaagaaaaaacaggcaaattagaacagctgaagagcgtgctggaaatgtatggtcacttctctggcattaaccgtaaggtgcaactgacttactacccacatggcgtgaaagcctccaatgaaggacaggatcctcagagggaaaccctcgccccctcactgctcctcgtcctcaaatggggaggagagttgaccccagctggccgggtgcaggctgaagagctgggtagagcctttcgctgtatgtaccctgggggtcagggagattacgcgggattcccgggttgtggattactgcgacttcatagcaccttccgccatgatctgaagatctacgctagcgacgaggggcgggtacagatgaccgcagctgcattcgcaaaaggcctgttggcattggaaggcgaactcaccccaatcttggtgcagatggtaaaatccgcgaatatgaacggattactggattccgatggcgacagcctctccagctgccagcacagggtaaaagcacgcctccaccacattctccagcaagatgcaccatttggtcctgaagactatgatcaacttgcccctacacgaagcacatcccttctgaactcaatgaccataatccagaatcctgtaaaagtttgcgaccaggtcttcgccctgatcgaaaacctgactcaccaaatccgcgaaagaatgcaggatcctcgctctgtggatcttcagttgtatcactctgagaccctcgagctgatgttgcaaagatggtccaaactggagcgcgactttaggcagaaaagcggacggtatgatatctctaagattcctgacatctatgattgcgtgaagtacgatgtgcagcacaacgggtcattaggcctgcagggcacggctgagcttctgcgcctctccaaggccttggccgacgtcgtgatcccacaagaatacgggatttcccgagaggaaaaactggaaatagcggtcggcttctgcctccctctgcttcgcaagatcctgcttgatctccagaggacacacgaggacgaaagcgtcaacaaactgcatcccctatacagtcggggagtcctgtcccccggacgccatgtgcgcacccggctgtactttacatcagagtcccatgttcacagcctgctgtctgtcttcaggtacgggggactgctggacgagacccaagatgctcagtggcagagggccctagattacttgtctgccatctcagagttgaattacatgacccagatagtgattatgctgtatgaggacaatactcaagatccactgtctgaagagcggtttcatgttgagctgcacttttcccctggcgtaaaaggtgttgaggaagaagggtccgcccccgccggatgcggtttccgacctgccagctctgagaatgaagagatgaaaacaaatcagggaagtatggaaaacttatgccctggcaaggcttctgacgagcccgatagagccctccagacatcccctcagcctccagagggccccgggctgccccggcgcagcccgttgattaggaataggaaggccggctccatggaagtcctatctgaaacgtctagctcgagaccaggtggctatcgacttttcagtagttccaggccaccgaccgagatgaaacagagcggactgggctcgcagtgcaccggtctattctctactactgtactgggagggagttcctcggcccctaatctgcaggattacgctcgttctcacggaaagaaactaccccctgcctctctgaagcatagggacgggttcgagggatgttccatggtgcctactatctatccacttgagaccctccacaatgccttaagtctgcggcaggtgtccgagttcctatcacgagtgtgccagcgccacactgatgcgcaggcccaggcttcagcagctctttttgactccatgcacagctcacaggctagcgacaaccccttttccccgcctcggaccttacattctccaccactgcagctgcagcagagaagcgagaaacccccgtggtactcgagtgggccctcgagcaccgtgtccagtgccgggcccagcagtcccactacagtcgacggcaacagccagtttggcttctccgaccagccatcactgaactctcacgttgccgaagagcatcagggtctgggtctgttacaggaaacccccggctctggggctcaggaactgtcaatagagggggaacaagagttgttcgaacccaaccagagccctcaggtgcctcccatggaaacctcacagccatatgaggaggtgagtcaaccctgccaggaagtaccggacatttcgcagccatgccaagatatttccgaagctctttcgcagccgtgtcagaaggtacccgacatatcccaacaatgccaagaaaaccacgataacggtaatcatacttgccaggaggtgccacacattagccagccatgccagaagtcgtcgcaactgtgtcaaaaggtgagcgaagaagtttgccagctgtgtctagagaattcagaagaagtgtctcagccctgccagggggtgagcgtggaggtgggcaaattggtacacaagtttcatgttggagtgggttcacttgtccaagaaaccctggttgaagtgggcagcccagccgaagagatacccgaagaggttattcagccttaccaggagttctccgtggaggtcggacgcctcgcccaggagacctcagcgatcaatctactttcgcagggcattcctgaaatcgacaagccctcccaggaattcccagaggagatcgacctgcaagcacaagaagttcctgaggagatcaactag

SEQ ID NO: 23681 - DNA, 705 bp, Artificial Sequence
  Description of Artificial Sequence: Synthetic coding sequence
atggagggcgccagccggaacctggccagcaccccccgggtgcacgcaaaggttatgatgtaccgcaaggagcagtatcttgatgtgctgcacgcactgaaggtcgtaaggtttgtgagcgacgcaactcctcaggccgaagtttatctccggatgtatcagttggagtcagggaaactgccgaggtccccgtctttcccattagagcccgacgacgaggtgttcctagcaattgccaaggcaatggaggaaatggtcgaggacagcgtggattgttactggatcacacgccggttcgtgaaccaactgaacactaaatatagagattcactccctcagctccccaaagcctttgaacagtatctcaatctagaggacggcagactgctgacgcacctccgcatgtgcagcgctgctcccaagctcccttatgacctgtggtttaaaagatgctttgctggatgtttgcccgagtccagcctccaacgtgtttgggacaaagtcgtctctggcagttgcaaaattctcgtcttcgtggcagtcgagatcctcctgacattcaagataaaggtgatggccctaaatagcgctgaaaaaatcacaaagttccttgagaacatcccgcaggattcctctgacgctatagtgtccaaggcaattgatttatggcataagcactgtggtacccccgtacactcttcatag

SEQ ID NO: 23682 - DNA, 537 bp, Artificial Sequence
  Description of Artificial Sequence: Synthetic coding sequence
atgaccaccctgcgggccttcacctgcgacgacctgttccggttcaacaacatcaacctcgatccgctgaccgagacctatggcattccattctatctgcagtacctggcgcactggccagagtacttcatcgtggcagaggccccgggtggtgagctgatgggatatattatgggcaaggcagaggggtccgtggccagagaggagtggcatggtcacgtaactgccctatccgttgctcccgagtttcgtaggctcggcctggcggctaagctaatggagctattggaagagatatccgagaggaagggggggttcttcgtggaccttttcgttagagtgtcaaatcaagtggccgttaacatgtacaaacagttgggctattctgtgtatcgtacagtcattgaatactactctgcaagtaacggggagcccgacgaggatgcgtatgacatgcggaaggccctatctcgggatactgagaagaaatccataataccactcccgcaccctgtgcgccccgaagatatcgaatag

SEQ ID NO: 23683 - DNA, 2373 bp, Artificial Sequence
  Description of Artificial Sequence: Synthetic coding sequence
atgggcacccggaagaaggtgcacgccttcgtgcgggtgaagcccactgacgactttgcccacgagatgatacggtacggggatgacaaaagaagtatcgacatacatctgaagaaggacatccgcaggggggtggtgaacaatcagcagaccgattggtcttttaagctggatggagtgctccacgatgcaagccaggatctggtttatgagaccgtcgccaaggatgtggtctctcaggcactggacggatacaatggcaccattatgtgctatgggcaaacaggtgcaggcaagacttacactatgatgggagccacagagaattacaagcacaggggcattctgccaagagcactacaacaggtgtttagaatgatagaggagagacctacccatgccatcaccgtgcgcgtttcttatctggagatctacaacgaaagcctatttgatctgctgtccacattgccatatgtaggtccgtccgtcactcctatgaccatcgtggaaaaccctcagggcgtgtttattaaaggtctatctgtgcacttgacttctcaagaagaggacgctttcagcctgctcttcgaaggggagacgaatagaattatagcctcacacactatgaataaaaattcttctcgatctcactgcatcttcaccatctacctagaggcacactcgaggactctgagtgaggaaaaatacataacgtcaaagatcaacctcgtagatctggcaggttccgagcgactgggcaagtccggaagcgagggacaggtgctcaaagaggccacttacattaataagtccctatccttccttgaacaggccatcattgcgttgggcgaccaaaaaagggaccacattcccttccggcagtgtaaactgacccacgccctgaaagacagtctgggagggaactgtaacatggtcctcgttaccaatatctacggggaggccgctcagctcgaagaaaccttgtcgagtctaaggtttgcttcccggatgaagttagtgaccacggaaccagctatcaacgaaaaatacgatgcagaaaggatggtgaagaacttagaaaaagaactagccctcctgaagcaggaactcgcgatccacgattctttaaccaaccgcacctttgtgacttacgatcccatggatgagatccagatcgccgaaattaatagtcaggtcaggcggtacttggaaggaaccctagacgaaatcgatatcatcagcctgcgtcagatcaaagaggtttttaaccagtttagagtcgtgctcagtcagcaagagcaggaggtggagtctacgttaagaaggaagtataccctgatagaccgaaatgattttgcagccataagtgcaatacagaaagcaggactcgtagacgtggatggtcacctggtcggcgagccagagggtcagaacttcggactgggcgtggcgccgttttctaccaagccggggaagaaggctaaaagcaaaaagaccttcaaggagccgctctcctccctagcgagaaaagagggcgcttcatctcccgtaaacggaaaagatctggactatgtgagtacgtctaagacccagttggtgccttcgagcaaagatggggacgttaaagacatgctatcccgcgatagagagaccagcagcattgaacctctgccgtccgacagtcctaaggaagaactgcgccctatcagacccgacaccccgccttcaaagccagtcgccttcgaggaattcaagaatgaacaaggcagtgagatcaacaggattttcaaagagaataaaagcattttaaacgagagaaggaagcgcgccagtgaaacaacgcagcacatcaacgcaattaagcgcgagatcgacgtgacaaaggaagcactgaactttcagaaatcattaagagaaaagcagggtaagtacgaaaataagggactgatgatcatcgatgaagaggaattcttgcttatccttaagctgaaggatcttaaaaaacagtatcggtctgagtaccaagacctgagggacttacgcgccgagatccaatactgtcagcatcttgttgatcagtgccggcatcgcctgctgatggaatttgatatatggtacaacgaatccttcgtaattcctgaggacatgcaaatggcccttaaacccggaggctcaataagacctgggatggttccggtgaaccggatcgtaagcctgggggaagacgaccaggataagttctcgcaacttcaacagcgggtgctgcccgagggtcccgactctataagtttttataatgccaaggtaaagattgagcaaaagcacaattacttgaaaacaatgatggggcttcagcaagcccatcgaaaatag

SEQ ID NO: 23684 - DNA, 3588 bp, Artificial Sequence
  Description of Artificial Sequence: Synthetic coding sequence
atgtggagcctgaccgccagcgagggcgagagcaccaccgcccacttcttcttgggcgctggggatgaaggccttgggaccaggggtatcgggatgagaccagaagagtcagactccgagctgctcgaggacgaagaagacgaggttcctccagagccacagatcatagtgggcatttgcgccatgaccaaaaagagcaagtcgaagcccatgacccagattctcgagaggctgtgtaggtttgactacctgaccgtggtgatactcggcgaggatgttatcttgaatgagccagtggaaaactggccctcctgtcattgcttaatctcctttcacagcaagggctttcctctggacaaggccgtggcatactcaaaactgcggaacccatttctgattaacgacctggctatgcagtactacattcagggcgacagacgagaagtgtatcggatcctgcaggaggagggcatcgatctgccgcggtacgccgtgttgaatcgagatccggcaagacccgaggaatgtaatctaattgagggcgaggatcaggtcgaggttaacggcgccgttttcccaaagccctttgtcgagaaacccgttagcgccgaggaccacaatgtgtacatctactatccctcgtcagctggaggtggaagtcagcgtctgttcaggaagattggaagtcgctccagcgtgtattcgcctgagagttccgtacgcaagaccggcagttacatctacgaagaatttatgcccaccgatgggactgacgtgaaggtgtatacagtcgggccagattacgctcatgccgaggcccgcaaatcacccgctctcgatggcaaagtggaacgggattctgaggggaaggaaatcaggtaccccgtcatgctaacggctatggagaaactggtcgctaggaaggtatgtgtggcttttaaacagactgtatgcggatttgacctcctccgggcaaacggccattcattcgtgtgcgacgtgaacggctttagctttgtgaagaactcaatgaaatattacgatgattgcgcaaagattttggggaacaccataatgcgtgagttggctccccaattccagataccttggagcattccaactgaagcagaggacatcccaatagtcccaacaacgtcaggaacaatgatggagttgcggtgtgtcatcgcgattattagacatggagatcgcacaccaaagcagaagatgaagatggaagtgaaacacccccggttctttgctcttttcgaaaagcatggaggatataaaaccgggaaactgaaacttaagaggccagagcaattacaagaagtgttagacatcacacgactactcctcgcggagctcgaaaaagagcccgggggagaaatagaagagaaaactgggaaattggagcagctcaagtccgtgctggagatgtatggacatttttcgggaattaaccgaaaagtgcagctgacttattacccacatggcgtcaaggcttcgaacgagggacaggatccgcagcgggaaacgcttgccccatcgctcctcctcgtgcttaaatggggcggggaactgacacctgcaggtagggtacaggccgaagagctgggaagagcgttccgatgtatgtatccaggcgggcagggcgattacgccggctttcctggttgtggtctcctgagacttcatagcacatttagacacgacttaaaaatttacgcttctgacgagggccgtgtacagatgacagctgctgctttcgccaagggcctgctggcgttggaaggtgagctgacgcccattctggtgcagatggttaagtcagctaacatgaatgggctgttagactctgacggagatagcctgagtagctgccaacatcgtgtcaaagctcgactgcaccacattctacagcaggatgccccatttggcccagaggattacgatcaactcgctccgactaggtcaaccagcctgctcaatagtatgactataatccagaatccagtaaaagtgtgtgatcaggtgttcgcacttatcgaaaacctgacacaccagattcgagagagaatgcaggacccaaggagcgtggatctccagctttatcatagcgagaccctggagctgatgctacagagatggagtaaactcgagagggatttccgtcaaaagagtggccgctatgacatatcaaaaatacctgatatctatgactgcgtcaagtacgatgtgcagcacaacggttcactggggttacaaggaacggctgaactgctgcgcctgagcaaggcactggccgatgtggttatccctcaggagtacggtatctctcgcgaggagaaattggaaattgcggtcggcttctgtctcccactgctgcggaagattttactggatctccagcgtactcatgaggatgaatactcaagaggggtgctctcccctggccgacacgtccggacgcgcttatatttcacatccgagtcccacgtgcattcgctgctatccgtgttccgatatgggggtctgctcgacgagactcaggatgcagacagggccctgcaaaccagtccccaacccccggagggaccaggcctgccacggaggagccccctgatccgcaacaggaaggctgggtcgatggaggtactgtcagaaaccagctctagtagacctggaggatacagactgttcagctcctcccgtccccctaccgaaatgaagcagtcaggtctgggctctcagtgcacaggcctgttttccaccacggtgctaggtggttcctcctcggcacctaacctacaggattacgccagatcccacgggaaaaagttgcctcctgcctcattaaaacacagagacgagctgttatttgtacctgccgtaaagcgcttctccgtgagctttgccaaacacccaactaacggattcgagggctgttccatggtgccaacgatttatcctctggaaacactgcacaatgccctttcactgcggcaggtacccccaatggagaccagccagccatacgaagaggtgtctcagccttgccaggaagttcctgatatctcccaaccttgccaagacatttctgaagccctcagccagccatgtcagaaagttcccgatatctctcagcagtgtcaggaaaatcacgataacgggaatcacacatgccaggaggtgccacatatctcacagccctgtcagaagtcgtctcagctctgtcaaaaggttagcgaggaggtttgtcagttgtgtctagaaaactccgaggaagtttcgcaaccatgccagggggttagcgtggaggtggggaagctggttcataaattccatgtaggtgttggctcgctagtgcaagagacactcgttgaggtcggctcaccagccgaggaaatccctgaggaagtgatacagccatatcaagagttctccgttgaggtgggtaggctggcccaggagaccagcgccattaatcttttgtcacaggggattcctgagattgataagcctagccaggagttccccgaagagatcgatctgcaggctcaagaggtgccagaggaaatcaactag

SEQ ID NO: 23685 - DNA, 240 bp, Artificial Sequence
  Description of Artificial Sequence: Synthetic coding sequence
atgtgctgcaactactacggcaacagctgcggctacggcagcggctgtggatgcggatatggttccggatccggatgtggttgcggctacggcacaggatatggctgcggttatggttgtggctttgggtctcactacggctgcggatatggcacaggctacggctgcggatatggatcaggctctggatactgtggttaccggcccttttgtttccggaggtgctattccagttgctag

SEQ ID NO: 23686 - DNA, 1767 bp, Artificial Sequence
  Description of Artificial Sequence: Synthetic coding sequence
atgaagctggagttcaccgagaagaactacaacagcttcgtgctgcagaatttgaatcgacagagaaagaggaaagaatattgggacatggcattgagtgtagataaccatgttttctttgcccaccgcaacgtgctggcagccgtgtctccgctcgttagatcgttgatctcatctaacgacatgaaaacagccgacgagctgttcattaccatcgacacgtcatacctgtcacccgtgacagtagaccagctgctcgattacttttattcaggaaaagtcgtgatctccgagcagaatgtggaggagctgctccggggggcccagtactttaacactccccgactgcgcgttcattgcaacgacttcttgatcaaatctatctgcagagcaaactgtttaaggtatctgtttttggcggaactttttgagcttaaggaggtgagtgatgtggcctatagcgggatccgggataatttccattattgggccagcccagaaggctccatgcactttatgagatgtccccctgttatcttcggacggctgcttcgggatgagaacctgcacgtgctcaatgaggatcaggcactgtcagccctgataaactgggtctattttcgcaaagaagacagggagaagtatttcaaaaagttcttcaattacatcaaccttaacgccgtatcaaataaaactcttgtattcgccagcaacaagctcgtcggaatggagaacactagtagtcatacaacactgatcgaatccgtgctgatggacagaaagcaggagaggccttgcagtttgctggtgtaccagagaaaaggcgccctgctggacagtgtcgtaattctgggcggccagaaagctcacgggcagttcaatgatggagtgtttgcctatattattcaggaaaatctgtggatgaagctgtcagatatgccctatagggccgccgccttgtccgcaacctccgctgggagatacatttatatctcaggcggcactacagaacagatttctggacttaagacagcttggaggtacgatatggatgacaactcatggacaaaattgccagatctgcccattggtcttgtgtttcacacgatggtcacgtgtgggggaaccgtctattcagtaggcggaagcatcgctccccgccggtatgtgtcaaatatttatcgatacgatgaaaggaaagaggtatggtgtctggccggcaagatgtctattcccatggatggcaccgcggttattacaaagggcgataggcatctttacatagtgacagggcgctgtttggtcaagggttatatctctagggtgggtgttgtggattgtttcgacaccagcactggagacgttgtgcagtgcattacctttccgattgagtttaatcaccgccctttattgtcttttcagcaggataatattctgtgtgtccattcccaccggcagtcagtggaaatcaatctgcagaaagtcaaagcaagtaagaccacgacgagcgtcccagttctgcccaacagctgtccactggatgtctctcacgcaatttgtagtatcggcgatagtaaagtttttgtgtgtggtggcgtgactacagctagcgacgtgcagactaaggactacaccatcaaccctaatgccttcctgctcgaccaaaaaactggtaagtggaaaactttggctcccccccctgaggccctggactgccctgcttgctgcctggctaagctcccgtgtaagatacttcagcggatttag

SEQ ID NO: 23687 - DNA, 2208 bp, Artificial Sequence
  Description of Artificial Sequence: Synthetic coding sequence
atgatccccccccaggaggccagcgcccggcggcgggagatcgaggacaaactcaaacaagaggaggagaccctgtcttttatccgcgactctctcgaaaaatcagaccagctgaccaaaaacatggtgtcaatactctcaagtttcgagtcgcgcctgatgaagctggaaaattctatcatccctgtccacaaacagactgaaaacctacagagactgcaggagaacgtagagaagacactcagctgtctggaccacgtcatttcttactatcatgttgcatctgacaccgaaaaaattatacgcgaaggccctaccggccgcctagaggaatacctaggatcaatggctaaaattcagaaagccgtggagtattttcaggacaactccccggacagtcctgagttgaataaagtcaaacttctgttcgagcggggcaaggaagccctggagtccgagttccggtccctgatgacacgacactccaaggtcgtgtcccccgtcttgatcctggacctcatctctggtgatgatgacctagaggcgcaggaagacgttactctcgagcatctccccgaaagtgtgcttcaggacgtcatcaggataagtagatggctggtggaatacggccgcaaccaggacttcatgaatgtgtattaccagatacggtccagccaactggatcgcagcatcaaaggccttaaggaacattttcacaaaagctcaagttcgagcggtgtgccttactccccagctatacctaataagcgaaaagataccccaacaaagaagccagtgaagcgccctggcaccattcggaaggcccagaatcttcttaagcaatactcacagcacggcctggatggtaagaaaggaggaagcaatctcattccattggaaggcctgctcccttgcacccctaggggcgggttaccggggccttggataaacgccgcttgcgtttgtgctgccgacatttctcctggtcacgagcatgatttccgcgtgaaacacctgtcagaagcactgaatgacaaacacggtcctttagccggccgggacgacatgttggacgtggagacagacgcttatatacactgcgtttcggcctttgttaaactggctcagtctgagtaccagctcctggctgatatcatccctgagcaccaccagaaaaagacttttgactccctgatccaggacgctcttgatggacttatgcttgagggggaaaatatagtttctgccgctaggaaagctattgtacgccacgacttctcaactgtgctgacagttttccccatactgcggcacttgaagcagaccaagcctgagttcgaccaggtcttgcaaggcacagccgctagcactaagaacaagctgccaggactgatcaccagcatggagactataggcgcaaaggccctggaggactttgcggacaatatcaagaacgatcccgataaggaatataatatgcctaaagacgggactgtccatgagctgacctctaacgcaatactgttcctccagcaattgctggacttccaagagaccgccggcgccatgctggcctcccaagagaccagttccagcgccacatcatattcaagcgagttcagcaagcgcttactcagcacctacatctgcaaagtgctagggaacctgcagttgaatttactgagcaagtctaaagtctacgaagatccagctttgtctgcaatttttctccataacaactacaactacattctgaaatccctggagaaaagtgagctgatacagctggtggctgtgacccaaaagacagcggaaaggagctaccgggagcacattgaacagcagatacagacctaccagcgatcttggttgaaagtgactgactatatcgctgagaagaacctgcccgtgttccaacctggggttaaactacgagataaggaacgccagatcattaaagagcgatttaagggttttaatgatggactcgaggaactctgcaaaatacagaaggcgtgggccatacctgacaccgaacagagagatagaattagacaggcacagaagactatcgtaaaggagacatatggtgcatttttgcagaaatttggcagcgtccccttcacgaaaaatccggaaaagtatattaaatacggcgtcgagcaggtaggcgatatgatagaccgactatttgatacgtccgcatag

SEQ ID NO: 23688 - DNA, 378 bp, Artificial Sequence
  Description of Artificial Sequence: Synthetic coding sequence
atggccggcgccggccccaccatgctgctgcgggaggagaacggctgctgctctcgtaggcagtcttcatcatcagctggtgacagtgacggagaacgagaagactccgctgccgaaagagcaaggcagcagctcgaggccctgctgaataaaactatgagaatcagaatgacggatgggcggacactcgtcgggtgttttctttgcaccgaccgtgactgcaacgtcatactgggttctgcacaagaatttctaaaaccatctgacagttttagcgcgggcgagcctagagtgctgggattggccatggttccggggcatcatattgtcagtatcgaggttcagagggagagcttgacaggcccgccttacttatag

SEQ ID NO: 23689 - DNA, 477 bp, Artificial Sequence
  Description of Artificial Sequence: Synthetic coding sequence
atgctgctgctggactgcaaccccgaggtggacggcctgaagcaccttctggaaaccggagcgtccgtaaatgccccacccgatccatgtaaacaaagtcccgtacatctagctgccggatccggattggcatgctttctcctgtggcagctgcagacgggcgcggacctgaatcagcaggatgtacttggcgaggccccactccataaagccgccaaagtcgggtccctcgagtgcctaagcctgctggtggccagtgatgctcaaatagatttatgcaataagaatggccaaacagcagaggacctcgcctggagctgtggatttccggattgcgcgaaatttttgacaacgataaagtgtatgcagacaattaaggctagcgaacatcctgaccgaaacgactgtgtggccgtgctgcggcagaaaagatctcttggaagcgtcgaaaacacttctggtaaacgtaaatgctag

SEQ ID NO: 23690 - DNA, 8712 bp, Artificial Sequence
  Description of Artificial Sequence: Synthetic coding sequence
atgcggggccggcggggccggccccccaagcagcccgccgcccccgccgcagagaggtgcgccccagctccacctccgcccccgcctccccctactagtgggcctatcgggggcctgaggagtcggcacagaggctctagcagggggcgttgggccgcagcccaggccgaggtagcaccaaagactaggttgagtagccctaggggcggcagcagctctaggcggaagccccctccaccaccacctgctccgccgtcaacaagtgccccgggtcgcggtgggagaggcggtggcggcggccgaacaggcggcgggggaggtggagggcacctggcgcgaactaccgccgctcgtagagccgtgaataaagtagtgtacgatgatcacgaatctgaggaggaagaagaggaagaagatatggtctctgaggaagaagaggaagaggatggggacgcggaagagacccaggatagcgaggatgacgaagaagatgaaatggaggaagatgacgacgattctgattacccggaggagatggaagacgatgatgacgatgccagttactgcaccgaaagttcctttagaagccactcaacctacagctctaccccagggcgccgaaagcctagagtgcaccgcccacggagccccatattagaagaaaaggatattccgcccttggagttcccaaagagctctgaggacctgatggtgcccaatgaacatatcatgaatgtgatcgccatttacgaggttctcaggaactttgggaccgttctgcgacttagcccttttaggttcgaggacttctgcgcagctctcgttagccaggagcagtgcacactaatggccgaaatgcacgtagtcctccttaaagcagtattaagagaagaggatacatccaacaccacgtttggccccgcggacctgaaggactcagttaattccaccttgtactttatcgatgggatgacttggccggaggtcttacgggtatactgcgaatccgacaaggaataccatcatgtgctcccttatcaggaagcagaggactacccatatgggcctgtcgaaaacaagatcaaagtgctccagttcctcgtggatcagtttctgactacaaacatcgctagggaggagctgatgtcagaaggggtgattcagtatgatgatcattgtagagtgtgccacaagttaggggacttgctgtgctgtgagacctgtagcgccgtttaccacctcgagtgcgtaaagcctcctctggaggaagtccctgaagacgagtggcagtgcgaggtgtgcgtggctcataaagtgcccggggtgacagactgtgtggccgagattcaaaagaataaaccttatatccggcatgaacctattggttacgaccgtagtagacggaagtattggttcttaaatcgaagattaatcattgaagaagacactgaaaacgaaaatgagaaaaaaatatggtattattccacaaaagtgcaactggctgaactcatcgactgcctggacaaggattactgggaagctgagctctgtaagatactggaagaaatgcgcgaggagattcaccgccatatggacatcaccgaggatctgaccaataaggcacggggcagcaataagagctttctggcagccgcgaacgaggagatcctcgaatcgattcgagccaaaaaaggggatatcgataatgtgaaaagccccgaagagaccgaaaaggataagaacgagacggaaaacgacagcaaagacgctgaaaagaatcgcgaagaatttgaagaccagagcttggagaaggactcagatgataagactccagatgacgacccagagcagggcaagagcgaggagccgacggaagttggcgataagggaaatagtgtgtctgcaaatctgggggacaacaccacaaacgcaactagtgaggagacatcccctagtgaaggccgatcaccggtcggctgcttgtccgaaacccctgactcctcaaacatggcggagaagaaagttgcctccgaacttcctcaggacgttccagaggaacctaacaagacatgtgaatcttccaatacatccgccacaaccacatctatccaaccaaacttggagaatagcaactcttcttctgagctaaactcatcacagagcgagagcgccaaggccgccgacgacccagaaaacggtgagcgggagtctcacactccagtcagcatccaggaggagatcgtaggtgatttcaagtctgaaaagagcaacggcgagctgtctgagtccccaggcgcaggcaagggggcctcaggctcaactcggattattactagattacgtaaccccgacagcaaactatcccagctcaaatcccagcaggtggcagctgccgctcatgaggccaataagctgtttaaagaaggtaaagaagtgctcgtagtgaatagccaaggcgagatatcacggctgtcaaccaagaaagaggtaatcatgaagggaaacattaacaattacttcaaactgggccaggaggggaagtacagggtataccacaatcagtacagtaccaactctttcgccttaaataagcaccaacaccgggaggatcacgacaagcggaggcatctggcccacaagttttgccttacccctgccggtgaatttaaatggaacggaagcgtgcacggctccaaggtcctaaccatctccacgctgcggcttaccatcactcagttggaaaacaacatcccttcctctttcctgcatccgaactgggctagtcacagagcaaactggattaaagctgttcaaatgtgctccaagccacgggaattcgccctcgccctggccattctggagtgtgctgtcaaaccagttgtaatgctgccaatttggagggagtcactcggccatactcggcttcaccggatgacatctattgaacgcgaggagaaggagaaagttaagaaaaaagagaagaaacaggaggaagaggagacgatgcagcaagcaacttgggtaaaatacactttcccagtgaagcaccaggtgtggaaacagaaaggcgaggaatatagggtcacaggctacggtgggtggtcatggattagtaaaacgcacgtgtacaggttcgttcctaagttgcctggtaacactaatgtcaattaccgcaagtccttggagggaacgaagaacaatatggatgagaatatggatgaatccgataagcgcaaatgttcgcgctcccccaagaaaataaagatcgaacccgattccgaaaaagacgaggtgaagggcagcgatgcggccaaaggcgcagaccaaaacgagatggatattagtaagattaccgaaaaaaaagaccaggatgtgaaagaacttctcgacagtgacagcgacaagccttgcaaagaagaacccatggaggtggacgatgacatgaaaaccgaaagccacgtaaactgccaggaatcctcccaggttgatgtagtgaatgtgtctgagggttttcatcttaggacttcatacaagaagaaaacaaagtcgtccaagctagacggcctgttggagaggcgcataaaacagttcaccctggaggagaagcagcggcttgagaaaataaagctggagggtggaattaagggcatcggcaaaacttcaaccaacagcagcaaaaacctgtcagaatcgcccgtgatcacaaaggccaaggaaggatgccagtctgactcaatgcgccaggagcagagccccaatgcaaacaatgaccaacccgaagatctgattcagggatgtagcgagagtgatagctctgtcctgcggatgtcagaccctagccacacgacgaataagttgtaccccaaggacagggtactggatgacgtgagcattagatctccagagacgaagtgccccaaacagaatagtatcgagaacgatattgaggagaaagtatctgacttagcttcacggggacaagaacctagcaagtcaaagactaaaggtaatgattttttcattgacgattccaagttagcttcagctgacgatattggtacactgatatgtaagaataagaaaccgcttattcaagaagaatccgatacaatagtttcctcctccaaaagcgcactgcatagctctgtgcccaaatcaaccaacgatagagatgcaacccccctatcacgagccatggattttgaggggaaacttgggtgtgactccgagtccaacagcactctggaaaacagctctgacaccgtgtccattcaggattcatcggaggaggatatgatagtgcagaattccaacgagagcatctcagaacagttcagaactcgggagcaggatgttgaagtcctagagccactcaagtgtgagctagtgtcaggggaatcaacggggaactgtgaggatcgcctgcccgttaagggtaccgaggctaatggaaagaagcccagccaacagaaaaaattggaagaaagacccgtaaacaaatgcagcgatcaaattaaactaaagaacactacagataagaagaacaatgagaatagggagagtgaaaaaaaaggacaaagaacatccaccttccagatcaatggaaaggacaacaagccgaagatctatctaaagggcgagtgcctgaaggagatctccgagtccagagttgtcagtggtaacgtcgaacctaaagtcaacaatatcaataaaatcatccctgaaaacgatatcaagtcattgactgtgaaggagtcggccatccgtccttttatcaatggtgacgtgatcatggaggactttaatgagagaaattctagtgaaacaaagagtcacctactgtcctccagtgacgctgagggtaactaccgggactccctcgaaaccctgccttctactaaggaatctgattcaactcagacaactactccgagtgcatcttgcccggagagtaactcggtgaatcaggtggaagacatggaaatcgagacctcggaggttaagaaggtaaccagtagtccgattaccagcgaagaggagagcaacctgtccaatgattttattgacgaaaatgggctaccaatcaacaagaatgagaatgtgaacggcgagtcgaagagaaaaaccgtgatcacagaagttaccacaatgacctcaactgtggctaccgagtcaaaaaccgtaatcaaagtcgaaaagggggataagcagaccgttgtgtcttctacagagaattgcgcaaaaagcacagtgactacaactactaccacagtcacaaagttgtctaccccaagtaccggggggagtgtggacatcatctccgttaaagaacaatcgaagactgtggtgacaaccaccgtaactgatagtctgacaactaccggtgggactttggtaacttctatgactgtgagtaaggaatacagcactagggataaagtcaaactgatgaaattcagtcgacccaagaagactcgcagcggaacagccctccctagctataggaagtttgtgactaagagtagtaaaaagagcattttcgtgctgcctaatgacgacctaaagaaactcgcacgcaaaggtgggataagggaggtgccctacttcaattacaatgcaaagcccgccctggacatctggccctacccttcacccaggcccacattcggcattacttggcggtaccgtctgcagacagtcaagagtcttgccggtgttagccttatgctgaggctgctttgggcatcacttaggtgggacgacatggccgccaaggcgcctcccggcggcggcacaactagaaccgagacgagcgaaaccgagataacaactactgagattataaagaggcgcgacgtagggccctacggcattcgatcagagtattgtataaggaagataatctgtccaattggggtcccagagacaccgaaagagacacccacccctcagagaaagggactccggtcaagcgccctccgtcccaaacgcccagagaccccaaagcagactggtcctgtgatcattgagacctgggtggctgaggaggagctcgaactgtgggaaattcgcgctttcgcagagcgtgtggaaaaagagaaggctcaggccgttgaacagcaagccaagaaacgtcttgagcagcagaagccaacagtgatcgcaacttcaacaacaagccccacaagcagtactacaagcactatcagtccagctcaaaaagtcatggtggcgcccatatcgggcagcgtgaccactgggaccaagatggtgcttactacaaaggtgggcagcccagctacagtcacctttcaacagaacaagaactttcaccagacattcgccacttgggtgaagcagggacagtccaattctggagtagtacaggttcagcagaaggtgctggggattatcccaagttccaccggcacctctcaacagacctttacttccttccagcctcgcacagctacagtgacgatccgccctaatacctctggctctgggggcacaacctccaactcccaggtcataactgggccacaaataagaccagggatgaccgtaattagaaccccacttcagcagtccaccctgggcaaagccatcattcggacccccgtcatggtgcaaccgggcgcgcctcagcaggttatgacccagattattaggggacagcccgtgtcaacggcagtctctgctccaaatacagtaagctcaacccccggccagaagagtctcaccagcgcgacttctacatctaacatccagtcttctgcatcacagccgcctcgtccccaacaggggcaagtgaaacttaccatggcccagctgacccaactgactcagggtcatggcggaaatcagggcttaaccgtggtaatccagggacagggccagactacaggtcaactgcagctgataccccaaggggtgacagtgttaccgggaccgggccagcaattgatgcaagcggctatgcccaacggcacggtgcagcgctttttgtttacccctctcgccaccaccgcaacgacagccagcaccacaacaaccacggtctctacgaccgcagccgggactggcgaacaaagacagagcaagcttagccctcagatgcaggttcaccaggataaaacccttccaccagcccaatcttcctcagtcggccctgctgaggcccagcctcagaccgcacagccctctgcgcagccacaacctcagactcagccacagtcccctgcacaaccggaagttcagactcagcccgaagtccaaacccagaccacagtctcctcccacgttccctccgaagctcagcctacacacgcgcagtccagcaaacctcaagtcgccgcgcagtcccaacctcagtcgaatgtgcagggacagagccccgtgagagtgcaatcaccctctcagacccgcattagaccatctaccccatctcaactgagcccagggcagcaaagccaggtgcaaacgaccacctctcagccaattcctatccaaccccacacctcgcttcagatcccaagccagggccagcctcagtcccagcctcaggtagttatgaagcacaacgccgttatcgagcacctgaagcagaaaaaatctatgacccccgccgaaagggaagaaaaccagaggatgatcgtctgcaaccaggttatgaaatacattctggataaaatcgacaaagaggagaaacaagctgctaaaaaacggaagagggaggaaagcgtcgaacagaaacgatccaaacaaaatgcaacaaagctctctgccctgctctttaagcacaaagagcagctgagggcggagattctcaagaaacgcgcgctgctggataaggaccttcaaatcgaagtgcaggaagaactgaagcgtgacctgaaaatcaaaaaagagaaagacctcatgcagctggcccaggcaacagcggtagctgccccatgtcctcccgtaacacctgccccacctgcccccccggcgccacccccaagcccaccgcccccaccagctgtccagcataccggactcctgagcacccccacattaccagcagcaagtcagaagcgcaagcgggaggaggaaaaagatagcagctccaaaagcaagaagaaaaaaatgatctcaacaacgtccaaagagacaaagaaggatacaaagctgtactgtatctgtaaaaccccctacgacgagtcaaagttctatatcggctgcgatcgctgtcagaattggtaccacggtagatgtgtgggtatactccagtcagaggcagagctaatcgatgaatacgtttgtcctcagtgtcagagcacagaggatgcaatgaccgtattaacccctctgactgagaaggactacgagggcctgaagcgcgtactacggtccctgcaggcccataaaatggcctggccattcctcgaaccagttgaccccaacgatgcacccgattattacggggtcattaaggaacctatggacttggcaacaatggaggagagagtacaacgaagatactacgagaaattgacagagttcgttgccgacatgactaaaatcttcgataactgcaggtattataacccttccgattccccattctaccaatgtgctgaagtgctggagagtttcttcgttcagaaactgaagggttttaaagccagccgtagtcacaataacaagctgcaatcgactgcgtcctag

SEQ ID NO: 23691 - DNA, 2628 bp, Artificial Sequence
  Description of Artificial Sequence: Synthetic coding sequence
atgaacttccaggccggcggcggccagagcccccagcagcagcagcaacttgcaggggggcctcctcagcagttcgccctgtccaactccgcagccatccgcgcagaaattcaaagatttgagagcgtgcaccctaatatctatgctatctatgacctcatagaaaggatcgaggatctcgccctccagaaccagatcagagagcacgtgatctcaatagaggactcgttcgtcaactctcaagagtggacactgtctaggtccgtgcctgagctcaaggtgggtattgtaggcaacctgagttccggcaagtcggccctagtacatagatacttgacaggcacttacgtgcaggaggaatctcccgagggaggaaggttcaaaaaagagatcgtcgtcgatggacaatcctacctcttgttgatacgggacgaaggcggcccacctgagctccagttcgcggcgtgggtggatgccgtggtattcgtgtttagcctagaagacgaaataagttttcagaccgtttacaactattttctccggttatgctctttccggaatgcatcggaggtgcccatggtgctggttggcactcaggatgccatttccgcggctaatcctcgcgtgattgatgatagtagggcccggaagttatcaactgacttgaaaagatgcacctattacgaaacatgtgccacttacggactcaacgtcgagagagtcttccaggatgtggcacagaaagtggtggctctgaggaagaaacagcagctcgctatcggtccatgcaaatctctcccaaatagcccttcccatagtgccgtctctgccgctagcattcccgcggtccacattaatcaagccaccaacgggggaggttctgccttctctgattattcttcttcggtacccagcaccccgtccatctcccagcgcgaacttaggattgaaaccatcgcagcttcatctactccgacacctatcagaaaacaatctaaaaggcggtcaaatatctttacatctaggaagggagctgacctggaccgggaaaaaaaggccgccgaatgcaaggtagacagcatcgggtccggaagagccattcccatcaaacaggggatactgctcaagcgatctggcaagagcctgaacaaagagtggaagaagaaatacgtcactttgtgcgataacgggctactaacatatcatcccagccttcatgattatatgcagaatattcacggcaaagagattgatctgttacgcaccaccgtcaaggttcctgggaagcgtttgcctagggcaacacccgccaccgcccccggtacatcccccagagcaaatgggctttctgtcgaaagatccaatacccagctgggcggcggaactggggcacctcacagtgcctcttctgcgagtctccactcagaacgaccgcttagctcatcggcgtgggccggcccgcgaccagagggcttgcatcagcggtcctgttctgtttcaagcgcagaccagtggagcgaagccacaacctctctccctcctggaatgcagcacccagcctcaggcccagcggaggtgctctcctcttctcctaagctcgaccctccgccaagcccacatagcaaccggaagaaacataggagaaagaaatccactggcactccacgccctgatgggccgtcctccgctaccgaagaggctgaagagagctttgagtttgtggtggtgagcctcaccggccagacctggcactttgaggcctctaccgccgaagagcgagagctttgggtgcagtcagttcaagcacaaattctcgcctccctgcaaggatgcaggtctgccaaagataagactcggctgggtaaccaaaatgccgctctggccgttcaggccgtgcggacagtccggggaaactctttttgcatagattgtgatgcacccaatcccgactgggcatccttgaacctgggtgctctcatgtgtatcgagtgcagtggcatccatagacacctgggggcacacctgagtcgcgtgcgcagtctggacctcgatgactggcccccagagcttctggcagttatgactgccatgggcaatgcccttgccaactcagtgtgggaaggcgccctgggaggctattctaaaccaggccccgatgcttgtcgggaagagaaagaaaggtggatacgggcaaagtacgaacagaagcttttcctcgcacccctgccttcttccgatgtgcctctcgggcagcagctgttacgagccgtagtagaggatgatctgaggctgctggtgatgctgctagcacatggcagtaaagaggaagttaatgaaacctatggcgacggagatggacgaaccgcgttgcacctctcatccgccatggctaacgtcgtgtttactcagctgctcatctggtatggcgtggacgtgaggtccagagacgcccggggactgacacctctggcctatgcaagacgtgccggctcgcaagaatgtgcagacatcctcattcagcacggatgtcctggtgaaggctgcggtctggccccgacaccaaatcgagaacccgctaatggaacaaatcctagtgccgagctacataggtcccctagtctactgtag

SEQ ID NO: 23692 - DNA, 1761 bp, Artificial Sequence
  Description of Artificial Sequence: Synthetic coding sequence
atgggcggcgccctgggcctgcggcagctgcccatctgcgcccccgcatgcagaccaagttctgggcacagtccatgggctgctgcctctccaaatcctaaccagtggtcatctcgctcacgctggtgttgtctccgccgctccgaagctcgacggagctgccgccccgttggccgcgccgcccccgggccgacccgcgccatggcgcgtccagccaccagcacacggagatccgcatgcccaccactgacccccactccagccctgcgtattgcgtggcgactcctgtcagcaactagtaggacaagccgaatggcctcagtgctctcacgcggtcgtgtacgctgcccgtggcacggggcatgttttaatatatccacaggggacctggaggactttcccgggctggattccctgcataagtttcaagtgaaaattgaaaaggagaaagtttacgtgagagcatcaaaacaggccctgcagcttcagagacggacaaaagttatggcaaagtgtataagcccctccgcaggttacagctcaagtactaatgtgctgatcgtgggggcaggcgcagctggactggtgtgcgccgagactttgcgccaggaaggtttttctgaccgcatcgtgttatgcactctggacagacacctgccttatgaccggccaaagcttagcaagagtctggatacgcaacctgagcagctggcacttcgcccaaaagagttcttcagagcgtacggtatcgaagtgctgacagaagctcaggtagtgactgtggatgtgcggaccaagaaggtagtgttcaaagatgggttcaagctggagtacagtaagctcttattggctcccgggtcttctcctaagacactgagctgcaaaggcaaagaagtggaaaatgtcttcacaatccgcactcccgaagatgcgaaccgagtggtaaggctggcaagaggacgcaatgtggtggtcgttggcgcgggcttcctgggaatggaggtcgccgcgtatttgaccgagaaagcgcattctgtgagtgtcgtggagctagaggagacgcccttcagaaggttcttgggcgagcgcgtgggacgggctttaatgaagatgttcgaaaataatcgcgtgaagttctatatgcagacagaggtttccgagctgcgaggtcaggaaggcaaactaaaggaagtggtactaaagtcttcaaaggttgttcgggccgacgtgtgtgtggtgggcatcggagccgtacccgctactggctttctgagacagtccggcattggcttagatagtcggggcttcattccagtgaataagatgatgcagactaacgttccaggggtgtttgccgccggtgatgccgtcaccttccctctagcgtggcgtaacaatcgaaaggtgaacattcctcactggcagatggcccacgctcagggcagggtcgccgcccaaaacatgctggcgcaggaagccgagatgagtaccgtaccttacctgtggacagcaatgtttggaaaatcactgaggtatgccggttacggcgagggattcgacgatgtgattatccagggcgacctggaagaattgaagttcgtcgcgttctatacaaaaggtgacgaggttattgctgtggccagtatgaattacgatccaatcgtgtccaaggtggccgaagtcttggcaagcgggcgggccattcgaaaacgcgaggtggaaacaggggacatgagctggctaaccggaaagggcagctag

SEQ ID NO: 23693 - DNA, 1521 bp, Artificial Sequence
  Description of Artificial Sequence: Synthetic coding sequence
atgcccgtgcaggccgcccagtggaccgagttcctgagctgccccatttgctataatgagttcgacgagaacgtgcataaaccaatcagtctcggctgctcacacacagtttgtaaaacctgcctcaacaaactacataggaaagcctgcccctttgaccaaacggccataaacacggacattgacgtgctgccagtcaacttcgccttactacagctggtgggtgcccaggttccggaccatcaatctataaaactctctaacctcggagaaaataaacactatgaagtcgcaaaaaaatgtgtggaggatcttgctctctacctgaaaccactgtccggaggtaagggtgtggcttccttaaatcagagtgctctttcacgacccatgcagcgcaaacttgttacattagttaactgccagctggtggaagaagaaggacgcgtccgcgcgatgagagccgctcgctctctgggcgagcgtactgttacagagctgattcttcagcaccagaacccgcagcagctttctgccaacctgtgggctgcggttcgggcccgggggtgccagttcctggggccagctatgcaggaggaagcactgaaactagtgctgcttgcacttgaagacgggagcgccttgtcacgtaaggtcctggtgttattcgtagtgcagcggctcgaaccaagattcccgcaggccagcaaaacttccattggtcacgtagtgcagctcctttaccgcgccagttgcttcaaggttactaagcgcgacgaggattccagcctcatgcagctaaaggaagaattcagaagctacgaggcgctacggcgggaacatgacgcccaaatcgttcatatcgcgatggaagctgggctgaggattagccctgagcagtggtcttcactgctgtatggggacctcgcgcataaaagtcacatgcagtctatcatcgacaagttgcaaagccctgagtccttcgccaaaagcgtccaggaacttactattgtgctgcaaagaaccggcgaccccgccaaccttaaccgactgaggccccacttagagttactggcaaatattgaccccaacccagacgcagtgagccccacctgggagcagttagagaacgctatggtcgctgttaagacagtggtgcacgggttggtcgactttatccaaaactacagtagaaaaggtcacgaaacgcctcaaccccagcccaattccaagtataagacttcaatgtgtcgggacctccgccagcaggggggctgccctagggggactaactgcacgtttgcacactcacaagaagaattagagaaatgtaaccccagagggttgtacctccactgttgtttgctgagctcggtggctagtctgggtacggtgcataacgagctgtataaacagcagcactgcgaccgtgaaaagatcagtgtgtgtgccgtcaaaagagctgagacctgcttcagctcccaattcttctctcccctggaggttccgagagaggaggactag

SEQ ID NO: 23694 - DNA, 783 bp, Artificial Sequence
  Description of Artificial Sequence: Synthetic coding sequence
atgccccgggcccggagcggccggcggagccggggcgccggcggcagggaagagacctttctgagggtcagggccaaccggcagacacggttgaacgcccgcatcgggaagatgaagaggcggaaacaggatgagggccaggtttgcccactgtgtaaccgtcccttggctgggtcagagcaggagatgtctcggcatgtggagcattgtcttagcaaacgcgagggcagttgcatggcagaagatgatgcagtggatattgaacacgaaaacaataatcgtttcgaggagtacgaatggtgcgggcagaaacgtataagggcaactactctacttgagggcggtttccggggctcaggttttatcatgtgcagcggcaaagagaaccccgatagcgacgccgacctggatgtggacggagatgacactctagagtatggaaaaccacagtacacagaggccgatgtcataccgtgtaccggagaggagcctggggaagccaaagagcgggaagcgctcaggggagccgtccttaatggtgggcccccttccaccaggattacaccagagttttccaagtgggccagcgacgagatgcctagtacgagcaatggtgagtcctccaagcaggaagcgatgcagaagacttgtaaaaatagcgatatagagaagatcaccgaggattccgctgtgaccacatttgaggcattaaaggcaagagttcgcgaactggagcgacaactgagtcggggcgaccgttacaaatgcctgatatgtatgtag

SEQ ID NO: 23695 - DNA, 1461 bp, Artificial Sequence
  Description of Artificial Sequence: Synthetic coding sequence
atggccgccgtgaagaccctgaaccccaaggccgaggtggcccgggcccaggccgcactagctgtcaacatttcagccgcccgaggcctccaggacgtgctgagaaccaatctgggtcctaagggtacaatgaaaatgctcgtgagcggagctggagatatcaagctgaccaaagacggtaacgtgctgttgcatgagatggggctccatcctaggattattacagaaggctttgaggcggccaaggagaaagcattacaatttctagaggaagtgaaggtgagccgggaaatggatcgcgagactctgattgacgttgcacgcacatcattgcggacgaaagttcacgcagaattagcagacgtgttgaccgaagccgttgtggactctattctggcgatcaaaaaacaggatgagcctatcgaccttttcatgatcgagatcatggagatgaaacataaatctgaaaccgatacatctttgatccgtggcttggtgctcgaccatggggctagacacccagacatgaaaaaacgagtcgaggatgcctatatcctgacatgtaatgtaagcctagagtatgagaagactgaggtcaattctggcttcttctacaagtccgccgaggagcgagagaagctagtgaaagccgaacggaaatttatcgaggatagggtaaaaaagataatagagctgaaacgtaaagtctgtggtgactccgacaagggattcgtggtgatcaaccagaagggcatagacccgttctcattggatgctctgtccaaagagggaattgtggctctcaggcgggctaaaaggcgaaatatggagcgactgacacttgcatgcggcggggttgccctgaattcctttgatgatctttccccagattgcttaggacatgcgggcctggtgtacgagtatacacttggagaagaaaagtttacattcattgaaaaatgcaacaaccctcgaagtgtgactctgctgatcaaaggtcctaataaacacaccttaacacaaattaaagatgctgtcagggacggcctgcgggcggtgaaaaacgccatagacgacggttgcgtggttccgggcgctggggcagtggaggtggccatggccgaagctctcattaaacacaaaccaagcgttaagggaagggctcaactcggagtacaggcgtttgcagacgcactgctcatcatcccgaaggttttagcccagaatagtggttttgatctgcaggagacacttgtgaaaattcaggcagagcactccgaatcaggtcagttggttggggttgacttaaacactggggagcccatggtggcggctgaggtgggagtgtgggacaactactgtgtgaaaaagcaactgctgcattcctgtaccgtgattgctacaaacatccttttggtggacgaaattatgagagccggtatgagctcactcaagggatag

SEQ ID NO: 23696 - DNA, 1407 bp, Artificial Sequence
  Description of Artificial Sequence: Synthetic coding sequence
atgagcttccggctgagcggcggcagccggcggatctgcagccggacaggctctggaagactctcaggaggggggaccggatttgttgcagggaatgtgtgcgtaggaagtggcgcccgaagtagcttctcttgtaccctggaaggcatcagcagcggtgggagcttttgtaactctggcggtgggctagggagcggcgcatgcgccggctttttgggtaacgagcattccctactctccggcaacgaaaaggtaaccatgcagaacctgaatgataggctagccagttatctggaccacgtccacgccttggaagaagcaaatgccgacctggagcagaaaataaagggctggtacgagaagtgcgaacctggctcgagcagggagcacgaccacgattattctaggtacttttctgttattgaggacctgaaaagacagattatctctgcgaccatctgcaacgccagcatcgttctccagaacgataacgcacggctaaccgcggatgatttcagattaaaatatgagaatgagctcgccctccatcattctgtggaggcagacacaagtgggctccgcagagttctggacgaattgaccctgtgcacgaccgatctcgaaattcagtgtgaaaccctctcagaggagcttacctatttaaagaagtcacatgaagaggagatggaagtgcttcaatatactgccggaggcaatgttaacgttgagatgaatgctacgcccggtgttgatcttacagttctgctgaataacatgagagctgagtacgaggacctcgccgaacagaatcgcaaagacgctgaggcatggttcaatgaacgtagcgcaaccctgcagcagcagatttcagaccacgaaggtgctgctacagcagcaagaaacgagttgacagagctgaagcgcaacttacaaactctggagatagagctgcagtcactgatggcagttaagcacagttatgagtgcagcctggccgaaacggaagggaactactgcaatcagttgcagcagattcaggatcagatcggggtcatggaggagcagctgcaacagataagaactgagacagaggggcagaagttggagtatgagcagctcctcgacgtgaagatattcctcgagaaagagatcgatatctattgcaatctgctggacggagaggaacgcaaatcaaagagcacctgctacaagtcaaagggctaccgcccagtcaacagtggcaatcaggccaaggactctaccgaggaaacgatagttaagaccgttgtcgaggagttggatcaaattggaaatctgctgagtctgagggtgcatagcgtagaggagaagtcgagcaaaatctccaacattaccgtcgagcagcgggtgccttcgaaggctccgtag

SEQ ID NO: 23697 - DNA, 816 bp, Artificial Sequence
  Description of Artificial Sequence: Synthetic coding sequence
atggccggcctggaggtgctgttcgccagcgccgcccccgccatcacatgtcgccaggacgccctggtatgtttcctgcattgggaagtggtcacacatgggtattttgggctaggagttggggatcagcccgggccaaacgacaagaagtcagagttactgccggccggctggaataacaataaggatctatacgtcttgcgctacgagtacaaggacgggtcacggaagctgctggtgaaagctataacagtcgaatccagcatgatattaaatgtactcgaatacgggagtcaacaagtagccgatctgacactgaatttggacgattacattgacgcggagcaccttggcgattttcataggacctacaagaattctgaggagctgcgaagtcggattgttagtggaatcattacgccaattcacgaacagtgggagaaagccaatgtttccagcccccacagagaatttccgcctgctaccgcgagggaggtcgaccctctgcggattcccccccatcatcctcacacttcgagacagccaccttggtgtgaccctttgggccccttcgtagtggggggggaggatctcgacccttttggcccccggcgcggaggcatgatcgttgacccactccggtccgggttccccagggccctgattgaccccagctcggggttgcctaatcgactccctcctggagcagtcccccccggcgccagatttgaccctttcgggcctattggaacctccccaccaggcccaaacccggaccacctccctcctcctggctacgatgacatgtacttgtag

SEQ ID NO: 23698 - DNA, 753 bp, Artificial Sequence
  Description of Artificial Sequence: Synthetic coding sequence
atgagcgagaacgccgcccccgacttctactacgtggccatggactttggagggcatggattatccagccattactcaccgggtgtaccatattacctgcagacctttgtgagcgagatcaggagggtggtggccggtggtgtggtgggggggatgtttttctgtacttttccagagatggtagacaaactcatcctactggatacacccctgtttcttctggagtctgatgagatggagaatctcctcacttacaaaagaagagccattgaacatgtgttacaggtggaggcgtcccaagagccttctcacgtgtttagtctaaaacagctgttgcagaggctcctgaaatccaactctcacctgtccgaggagtgcggggagttattgctgcagaggggaaccactaaagtggctacaggcctcgtgctgaatagagatcagaggctggcctgggccgaaaactcgatcgatttcatcagtagagagttgtgtgctcacagcatacgaaagttacaggcccacgttctgctcataaaagcggttcacgggtatttcgacagtcggcaaaactactctgagaaggagagcctgtccttcatgattgacaccatgaaatctactttgaaggaacagttccagtttgtagaagtccctggcaatcattgcgtgcatatgtccgagcctcagcacgttgcttccatcatcagtagctttctccaatgcactcatatgctacctgcccagttatag

SEQ ID NO: 23699 - DNA, 510 bp, Artificial Sequence
  Description of Artificial Sequence: Synthetic coding sequence
atggtgttccccctgcccaccccccaggagcccatcatggccacccctcccaagagacgagctgtagaagcgaccggtgagaaggttttgaggtacgaaacctttatctcagatgtgctccagagggatctgagaaaggtgcttgaccacagggacaaagtgtatgagcagttggccaaatatttgcaattgcgcaatgtgatcgagcgtctgcaggaagcaaagcactcagaactgtatatgcaggtggacctaggctgcaacttttttgtagatacggtggtgccagacacatcgcgaatatacgtggccctggggtacgggttctttctagaactaactctcgcggaggcactcaaattcattgatcgtaaatcctcgctgcttactgagttatcaaactccctaacaaaggatagcatgaacattaaggctcatattcacatgttactcgaagggcttagggagttgcaggggctgcagaacttccccgagaagcctcaccactag

SEQ ID NO: 23700 - DNA, 3177 bp, Artificial Sequence
  Description of Artificial Sequence: Synthetic coding sequence
atgaccaccgtggtggtgcacgtggacagcaaggccgagctgaccactcttctagagcaatgggaaaaagaacatggatccggccaggatatggtgccgatccttactcggatgtcccaacttattgaaaaggagactgaagaataccgcaaaggtgatccggatcccttcgatgataggcaccctggtagagccgaccctgaatgcatgctgggccatctgctgcggattctgtttaagaacgacgacttcatgaacgctcttgtgaatgcctacgtcatgactagcagggagccccccctcaataccgccgcctgcaggctgttgctagacattatgccgggcttagagactgcagttgtcttccaagagaaggaagggatagttgagaacttgttcaagtgggctcgcgaagcagaccaacccctcagaacgtacagcacgggccttcttggaggggccatggagaaccaagatatagccgccaattacagggacgagaacagtcaacttgtggcgatcgttctccggcggctccgcgagctccagctccaggaggttgcgctcagacaggaaaacaagaggcctagcccccggaagttgtcgagtgaacctctgctgcctttggacgaagaggccgtggatatggactatggtgacatggctgtggacgacgcggaaattcagaaatcggctctacagattatcattaactgcgtgtgcgggccagataacaggataagctctatcggcaagtttatatctgggacaccacgaaggaaactgcctcaaaatccaaagtcatctgagcataccctggccaagatgtggaatgtagtgcagtccaataacggaatcaaggtcctactgtctctgctcagcatcaaaatgccaattacagacgctgaccagatacgagccctggcgtgcaaggctctcgttggactgagcagatcttctaccgtgcgtcaaatcataagcaaattgccgctattctcatcttgccaaattcagcagttgatgaaggaacccgtcctgcaagataagcgctccgaccatgtcaaattctgcaaatatgctgctgaacttatcgagcgggtcagtgggaaacccttgctgattggcacggacgtttccttggcaagattgcagaaagcagatgtggtagcacagagtcgcatctcatttcccgagaaagagctcttattactgataaggaaccacctgatttcaaaggggctcggagagaccgcaacggtgctcacaaaggaagccgacctgcccatgacagctgccagtcacagttctgcatttacaccggttactgcagctgccagtcccgtgtctctaccgcggactccccgcatagccaacgggatcgccaccaggttagggagccacgctgctgtcggtgccagtgcccctagtgcgccaacagcgcatcctcagcctcgccccccacaagggcccctggcactgccgggtccctcatatgcaggtaatagccctctcataggacgtattagcttcatcagggagagaccctcaccctgcaatggaaggaagatccgcgtgctgcgacaaaaatctgaccatggcgcatatagccagagtccagccatcaagaagcaactggacaggcacctgcccagtccaccgaccctggactccatcattacggaataccttagggagcagcacgcacggtgcaagaaccccgtggccacctgtcctcctttctcactctttactccacatcagtgtcccgaaccaaagcaacggagacaagcccccattaattttacatcgcgcttgaacagaagggcctcctttccaaagtatggcggtgtcgacggaggctgctttgatcgccacctgatcttttctaggtttcgtcccatctccgtgtttcgggaagccaacgaggatgagagcggctttacatgctgcgcattttctgctagagaacgctttcttatgctcgggacttgcacgggacagctcaagctatacaacgttttctctggtcaggaggaggcgtcttataactgtcacaattctgctataacacacctggagcctagcagagatggctccctactactgacttcagctacatggagtcagccactcagcgcactgtggggcatgaaaagtgtgtttgacatgaaacactctttcaccgaggaccattacgtggaattttcaaagcacagccaggaccgcgtgattgggaccaaaggcgacatcgcgcacatctacgatatacagacagggaataaattactgactctgtttaatcctgatctggcgaacaattataagaggaactgcgcgacattcaacccgacagatgaccttgttttgaacgacggcgtcttgtgggatgtacgctccgctcaggccatacataaatttgacaagttcaatatgaatatctctggtgtgttccacccaaatggtttggaggtcattatcaataccgaaatctgggatcttcgaaccttccacctgctacacactgtccctgccctagatcagtgccgcgtcgtgttcaatcacacaggcaccgtgatgtacggggccatgcttcaggctgacgacgaggacgatctcatggaggagagaatgaaatcccctttcggtagttcgttcagaacattcaatgctaccgattacaaacctatagccaccattgatgtcaaacgaaacatattcgacctgtgtacggataccaaagactgctacttagccgtgattgagaaccaggggtcgatggatgctttgaatatggatactgtctgtcgcctttacgaagtggggcggcagcgtctggccgaggacgaggacgaggaagaggaccaagaagaagaagagcaagaagaggaggacgacgacgaggacgacgacgacacagatgacctagatgagttggataccgatcagctgcttgaggcagaattggaagaagatgataataacgaaaacgcaggagaggatggagataatgatttctcacccagcgatgaagaattggctaaccttctcgaggaaggtgaagatggcgaggacgaagatagtgatgccgacgaggaagtggagttgatcctgggggatactgacagcagtgataattcggacctggaagacgatatcatcctgtctttaaacgagtag

SEQ ID NO: 23701 - DNA, 2409 bp, Artificial Sequence
  Description of Artificial Sequence: Synthetic coding sequence
atggccgccgaggccctggccgccgaggccgtggccagccggctggagcggcaggaagaagacattaggtggttatggtctgaggtggaaagattgcgggacgagcaacttaatgctccgtacagctgtcaggctgagggtccttgcctgacaagggaagttgctcaactgcgcgccgagaactgcgatttgcgccaccgcctctgtagtctgcgactttgcctagctgaggagcgctcccgacaagccacactcgagtctgcggagctcgaggccgcacaggaggccggagctcagccacctcctagtcagagtcaggacaaagacatgaaaaagaagaaaatgaaagagagtgaggcggattccgaggtaaaacaccagcccatcttcatcaaagaaagattaaaacttttcgaaattctgaagaaggaccaccagctgctgctggctatctatggcaaaaaaggggatacttccaacattatcaccgtgcgcgtggctgacggccagactgtgcaaggcgaggtgtggaaaacaaccccctatcaggtggcagctgaaattagccaagagctggcagaatctaccgtgattgccaaggttaatggggagctgtgggacctcgaccgacctctggagggtgatagctcgctggaacttctgacgtttgataatgaagaggcccaggccgtctactggcatagcagtgctcacatcttgggcgaggcaatggagctgtattacggagggcacctgtgctatgggcccccaattgagaacgggttctattatgatatgttcattgaggatagagcagtgagctcgacggagttgtccgcactggagaatatctgtaaagccataatcaaggagaaacagccttttgagcggttggaggtctcaaaagaaatcctgctggagatgtttaagtacaacaaattcaagtgtcgaatcctcaatgagaaggtgaataccgcaaccacaacagtatacaggtgcggacccctcatcgacctctgcaagggtccccacgtcaggcatacagggaaaatcaagacaatcaaaatcttcaagaattcatctacatactgggaggggaaccccgagatggagacacttcagcgaatttacggaatcagcttccctgataataagatgatgcgcgattgggaaaaatttcaggaggaagccaaaaacagagatcatagaaagatcggcaaggagcaagagctgttcttcttccatgatctgtcaccaggtagttgttttttcctgcccaggggcgcgttcatctataacacgttgacagacttcatcagagaagagtaccacaaaagggatttcactgaagttctgtcgcccaacatgtataattctaagttatgggaagcctccggacactggcaacattatagcgaaaacatgttcacttttgaaatcgaaaaggataccttcgcactgaaacctatgaactgcccagggcattgcctgatgtttgcccatagaccacggagttggagggagatgccaattaggtttgctgacttcggcgtgctccaccgcaacgagctttcaggtaccttgtctggactgacgagggttaggcgattccaacaggatgacgcccacatcttctgcacagtggagcagatcgaggaggaaattaaaggctgcctgcagtttcttcagtccgtgtactctacattcggattttcgttccaattaaatctatcgaccagaccagagaatttccttggggagattgaaatgtggaacgaggctgaaaaacagctgcagaattcgctcatggacttcggagaaccatggaagatgaatcctggtgatggagcgttctacggtccaaaaatagatatcaagatcaaggatgcaatagggagatatcatcagtgcgccactatccagttggactttcagctccctatcaggttcaatctgacatatgtgagcaaggacggtgacgataagaaaagaccggtgataatacatagagcaatactggggtcagtggagagaatgatcgctatcctaagcgagaactatggcggaaaatggccattttggctgagtcccaggcaggttatggtgattcctgtgggaccaacctgcgagaagtacgccttacaggttagtagcgaattcttcgaagaaggattcatggccgacgtagaccttgatcacagctgtacccttaacaagaagattcgcaatgcccagctggctcagtacaattttatcctggtcgttggggagaaggagaaaatcgataatgctgtgaacgttcgtaccagggacaacaaaatacacggggagatcctggtgacgtccgccatcgataagctgaagaacttgcggaagacaagaaccctgaatgctgaagaagcgttctag

SEQ ID NO: 23702 - DNA, 1149 bp, Artificial Sequence
  Description of Artificial Sequence: Synthetic coding sequence
atgttcaagatccagctggagcccctgaagctgcgggcctggaccctcaacggctttgtgaagtttcgcaacaaagagacatctgcaggacccgtcgccgtgatgggaaaagattattacaagatcctgggcattcccagtggagctaatgaggatgaaatcaagaaggcctaccgtaaaatggcacttaagtaccatccagataagaacaaagaacccaacgctgaagagaagtttaaggagatagcagaggcatacgacgtacttagtgaccccaaaaaacgcggcctgtatgaccagtatggagaggaagggctgaaaaccgggggtggaacctccggcggatcgagcgggtcatttcattacacattccacggggatcctcacgctacttttgcatccttcttcggagggagtaaccctttcgatatcttttttgcaagctcccgctctacccgcccatttagtggatttgatccagacgacatggacgtggatgaggatgaggatccatttggcgcctttgggagattcggctttaatgggctgtcgagaggccccaggcgagcccccgaaccgctgtatcccaggcgaaaagtccaggacccccctgtggtgcacgaactgagggtgtctttagaggagatctatcatgggagtactaagcgcatgaagatcacacggaggcgtctgaaccctgatgggcggacagtgcggaccgaggacaagatcctccatatcgtgatcaagagggggtggaaagagggaacaaaaattacctttccgaaagaaggcgacgcgacccccgataacattccagcagacatagtgtttgtgctgaaagacaagcctcatgcccacttcaggagagacggaacaaatgtgctgtattcagccctgatttcacttaaggaagccctgtgcggatgcacagtcaacattcctaccattgacggaagagtgatcccactcccctgcaatgacgtgattaagcccggcactgttaagcgtttacggggagaagggctgccatttccaaaggtgccaacacagcggggggatctcatcgttgagtttaaggtccgcttcccagatcgactaacgccccagacaagacagattctgaagcagcatttgccatgcagctag

SEQ ID NO: 23703 - DNA, 1356 bp, Artificial Sequence
  Description of Artificial Sequence: Synthetic coding sequence
atgcgggagtgcatcagcatccacgtgggccaggccggcgtgcagatcggcaatgcctgctgggagctgtactgcctggagcacggcatccagcccgacggtcagatgccttcagacaagactatcggaggaggagatgactccttcaacacctttttctcagagacaggcgcggggaagcatgtgccccgcgcagttttcgttgatttagagccaaccgtgattgacgaagtcaggactggaacatatagacagctatttcatcctgagcagctaataaccggaaaagaagatgccgctaataactacgcaagaggccattacaccattggcaaggagatcatcgatctggtgctggatagaatcaggaaactggcagatcagtgcactggattgcaaggattcctggtcttccacagcttcggaggcggaactggctccggcttcactagtctacttatggaaaggctgagcgtcgactatggaaagaaatccaagctcgagttctctatctacccagcaccccaggtgagtactgcagtagttgaaccatacaactctatcctgaccacgcatacaacactggaacatagcgattgcgcatttatggtggacaacgaagcaatttatgatatctgtcggcgaaatctggatattgagaggccaacctatactaatttgaatcgattgataagccaaatcgtgtcaagcattacagcttccttgcgattcgatggtgcactcaatgttgatctgaccgagttccagacaaaccttgtgccttacccccgcattcacttcccactggccacctacgcacccgtcatctctgccgagaaggcctaccacgaacagttatccgttgccgaaatcactaacgcttgtttcgagccggctaatcagatggtgaaatgtgatccccgccacggtaaatacatggcctgttgtctgctttacaggggggatgtagtccctaaagatgtcaatgccgccatcgctacaataaaaacaaaaaggtcgatacagttcgtggactggtgtcctaccggattcaaagtcggtattaactaccaacctcctaccgtcgtgcctggaggcgacttagccaaggtgcagagggctgtgtgcatgctgtccaacaccacggcaatcgctgaggcttgggcaaggttggatcataaatttgatctgatgtacgctaaaagggcatttgtccattggtacgtgggagagggtatggaggagggggagttctctgaggctcgcgaagacatggctgctctcgagaaggactatgaggaggtgggagttgactcagtggaaggggagggagaggaggagggagaggaatactag

SEQ ID NO: 23704 - DNA, 444 bp, Artificial Sequence
  Description of Artificial Sequence: Synthetic coding sequence
tgaaccgcccggggccccgagcccgagcagatgggcctggccccctgctgtacccaggccctgtgtggattggccctccgccatcatagccatctccaacagatccgattagagtttcatcgactctcggaagaaaacacgttgttgaaaaatgacctcggacgagtcaggcaggagctggaggcggcagagagcacacatgacgcccagcgtaaggaaatcgaagtgttgaaaaaagacaaagagaaagcatgttctgagatggaggtgcttaataggcagaatcagaactacaaggatcagctaagccaattgaatgtcagagtgctgcagctcggccaggaagcctccacccaccaggctcagaacgaagaacatagggtcacgatccagatgcttacccagtcactagaggaagtggtgagatctggccagcaacaatag

SEQ ID NO: 23705 - DNA, 771 bp, Artificial Sequence
  Description of Artificial Sequence: Synthetic coding sequence
atggccacccagcggaagcacctggtgaaggacttcaacccctacatcacgtgttatatctgtaaagggtacctaatcaagcctacaacagtgactgagtgcttgcacactttttgcaagacgtgcattgtacagcactttgaggatagtaacgattgtccacgctgtggcaatcaagtccacgaaaccaaccccctggagatgctccgtttagacaacaccctagaggagatcatctttaaactggtccccgggctgcgggagcaggaactggaacgcgaatcagagttttggaaaaagaataagccccaagaaaacggacaagatgacactagcaaggccgacaagccgaaggtggacgaagaaggggatgagaatgaggacgacaaggactatcataggagtgatccacaaatcgcaatctgtctggattgtttaaggaacaacggtcagtcaggcgataacgtggtgaaaggcctgatgaaaaagttcattaggtgctcaacccgcgtgaccgtaggaactataaaaaaattcctgagcctcaaattgaaactgccctcttcctacgagctggatgtcctctgcaatggcgagataatgggtaaagatcatacaatggagttcatctatatgacgcggtggagacttaggggcgagaacttccgatgcctgaattgttccgcgtcccaagtgtgttctcaagacggccccctgtatcagtcctatccaatggtgctgcagtatagaccgcggattgattttggttag

SEQ ID NO: 23706 - DNA, 6672 bp, Artificial Sequence
  Description of Artificial Sequence: Synthetic coding sequence
atggcccccaagaaggagaagggcggcaccgtgaacaccagcagcaagatttgggaaccctctctgattgccgcacagttcaatcaaaacgactggcaggcctccatcgccttcgttgtaggcaatcagattgaagacgatctgttgatccaggcgctcaccgtcgctgtccaggtgccacagagaaaactgttctccatggtttcgtggcaggatatccttcagcagattaacgaaataaacacgctggtgggctcagccagctcaaagaaagctaaaaaaccagttgggggtaacgcccctctttactatgaggtcctgacggctgctaaggcaatcatggatagtggagaaaagttgaccctgcctctgatcggcaagttactaaaatttcagctcctgcagattaagtttaaagaccagcagagacgggaaaacgaaaagaaagtcattgaggataagccgaaactcgagaaagataaaggaaaggctaaatctcctaaggagaagaaagcccctagcgcaaagcctgctaaaggcaaaggtaaggaccagccagaggctaacgcacccgtgaagaaaaccacacagctgaagcgccggggcgaagatgatcacacgaacagatatatagatgacgaaccagacgacggcgcccagcactatattattgttgttggctttaacaatccacagctattagcgataatggccgagttaggaattccaattacgagtgtcatcaagatcagcagtgagaattatgagccactccagacacatctcgcagccgtcaaccaacagcaggaggtgctcctgcagagcgaggacctggaggctgaaaaattgaagaaagaaaacgcaatcaaggaacttaaaacattttggaaatatctcgaacctgtactgaataacgaaaagccagagaccaatttattcgacgtggcccgcttggaatatatggttaaagctgcggatttcccttctgattggagcgatggagagatgatgttgaaattgggtaccgacattttcgagaacatcgcctgtctcatgtatgacatcctggattggaaacggcagcatcagcattacttagaatctatgcagctaatcaacgtgccacaggtggtgaatgaaaaacccgtactggaagctatgccaacttccgaagcgccccagcccgccgtgcccgcccccggaaagaaaaaggcccagtatgaggaaccacaggctcccccccccgtgactagcgtcatcacgacggaggtcgatatgcgctactacaactatttactgaatcctatccgggaggagttcatctcagtcccgctcattctgcattgcatgctggaacaggtggttgccaccgaggaagaccttgttcctccaagtcttcgcgagccatcccctagagctgatggcctcgaccataggattgctgcacacatcgtgtccttattaccttctctctgtctctctgagagggaaaagaagaatctccacgatattttccttagcgaagaggaaaacgagtccaaggccgtgccaaaagggcctctgctcctgaactatcacgatgcccacgcacataagaaatacgccctgcaggatcagaagaatttcgatccagtgcagatcgagcaagaaatgcagtccaagctgcctctgtgggaattcttgcagtttcccttgccccccccctggaataacaccaagcggttagctacaatacacgaactaatgcacttctgtactagtgacgtgctgtcatggaatgaagtggagagagcatttaaagtgttcaccttcgagtcccttaagctgagtgaggtggacgaaaagggtaagctgaagccatctgggatgatgtgcggttccgactccgaaatgtttaacatcccatgggacaatcctgcaagatttgcaaagcagatccggcagcagtatgtcatgaagatgaatactcaggaggccaagcagaaggctgacatcaagatcaaagacaggaccttattcgtggatcagaatttgtctatgagtgtccaagacaatgagtcaaatagggaacctagcgatcccagtcaatgcgatgccaacaatatgaaacacagcgatcttaataatttgaagttaagtgtacccgataatcggcagctcttggagcaggagtcaatcatgaaggcgcagccccaacatgaaagcctggagcagaccactaataacgagattaaggatgatgcagtgacaaaggccgattcacacgagaagaaacctaagaaaatgatggttgaagcagacctggaggatatcaaaaaaactcagcagagaagcctcatggattggtcattcaccgagcactttaagcccaaagtgttattgcaggtcctccaagaggctcacaaacagtaccggtgtgtggactcttactatcacactcaggacaactctctgctgttggttttccataatcccatgaatcggcagcggcttcactgcgagtactggaatatcgctctccattcaaatgtcggattccgcaattacctggagctggtggcaaagtctatccaagattggattacaaaggaggaggcgatttatcaagagtcaaagatgaacgaaaaaatcattaggactagagcagaactggagctgaaatctagtgctaatgcgaagcttactagcgcttcaaaaattttctccatcaaggaatcgaaatcaaacaagggcatcagcaagactgaaatctcagatcaggaaaaggaaaaggaaaaggaaaaaattcccttcatcttagagggcagtcttaaggcctggaaggaagagcagcaccggctagctgaggaagaacggctgcgtgaggagaaaaaagctgagaaaaagggcaaagaggccggcaagaagaagggcaaagacaacgcagaaaaggaggatagccgctccctaaaaaagaaatcaccctataaagaaaaaagcaaggaagagcaggtgaaaattcaggaagtcactgaagaatcgccacaccagcctgaacctaagatcacatatcccttccacggttataatatgggcaacatcccgacccagattagtggctctaattattacctgtatccatccgatgggggccagattgaagtggagaaaactatgttcgaaaaaggaccgacgttcatcaaggtgcgcgtggtgaaagacaatcacaatttcatgatacacctgaacgaccctaaggagatcgttaaaaaggaagagaaaggcgactattacctggaagaagaggaggagggagatgaagagcagagcctcgagacagaagtgagcgatgcaaagaacaaggccttctccaagttcggctcgttcagcgccaccttagaaaatggaatctgtctgtctatatcttattatgggagtaacgggatggcaccagaggacaaggatccggatctggaaaccattctgaacattcccagcgctcttacaccgacagtagtgccggttatagtgacggtacctcagtctaaagcaaaaggtaagatcaaaggaaaggagaaacccaaggagagccttaaagaggaagagcatcctaaggaggaggagaagaaggaagaggaagtcgagccggagcctgttctgcaggaaaccctggacgtgcccacattccagagcctcaacgtatcctgtccttcaggcttactcttaactttcattgggcaggaatcaaccggtcaatacgtaatcgatgaggaacccacgtgggatatcatggtgagacaatcttaccctcagcgcgttaagcattacgagttctataaaactgtgatgccgcctgccgagcaggaggcatcccgggtgatcacttcccagggtaccgtcgtcaagtatatgctggacgggagcactcaaatcctgttcgccgacggagccgtgtctagatcgccaaattccgggctgatttgcccccccagtgaaatgcctgccacgccacattctggtgatttgatggacagtatatcccagcagaagtcagaaaccattcctagcgagatcacaaatacaaaaaaagggaaatcccacaagtcgcagtcatctatggcccataagggagaaattcacgacccaccccccgaggctgtgcaaaccgtgacccccgtagaagtgcatattggcacctggttcacaaccacccctgaaggcaatcgcataggaaccaaggggctggagcgcatcgctgatctgactccactcctgtcatttcaggccacagatccagtaaatgggactgtaatgacgaccagggaagataaggtggtaatcgtcgaaaggaaggatggtactcgaatcgttgaccatgccgatggcacacgaattaccactttctatcaagtgtacgaagatcagataatcctgccagacgaccaggaaacaacagagggcccccgaaccgtgacacggcaagtgaagtgtatgcgagttgagtcctcccgatacgctacggtgattgctaactgtgaggacagctcctgttgcgccacttttggtgacggcacaactataatcgcaaagcctcagggaacataccaagtcctgccgcccaacaccggctctctgtacattgataaggactgctcggctgtctattgccatgagagcagtagtaatatctattatccttttcagaagcgcgagcagctgcgagcaggccgatatataatgaggcacacctccgaggtgatctgcgaagtgttagacccggagggcaacacattccaagtcatggctgatggatcaataagcactatactcccggaaaagaagctcgaggacgatctgaatgagaagaccgaggggtacgattccttatcaagcatgcaccttgaaaaaaaccaccagcagatctatggagagcacgtccctcggttcttcgtaatgtacgccgatggctccggcatggaacttttgcgtgactcagacatcgaggagtatctaagccttgcatacaaggaaagcaatacagtggtacttcaggaaccagtccaggagcagcccgggactcttaccattacagtgttacgtccttttcatgaggcttctccatggcaggttaagaaggaggatacaattgtgccccccaacctgaggtcacggagttgggagacctttccctcagtagaaaaaaaaactccaggaccaccttttggcacccagatatggaagggcctgtgcattgagagcaagcaactcgtgtccgcccccggagccatcctgaagagtccgtccgtgctgcaaatgagacagttcatccaacacgaagtgattaaaaatgaagtaaagttaaggttacaagttagcttaaaggattacatcaattacattctgaaaaaggaagacgagcttcaagaaatgatggtcaaagatagccgcaccgaagaggagagaggtaatgctgccgacctgctcaaattggtgatgtctttccctaaaatggaagagacaactaagagccacgtgacagaagtggcagcccatctgacggacctcttcaagcagagcctggctaccccgcccaagtgtccacccgacacatttgggaaagacttttttgagaaaacatggcggcacacagccagttccaaacggtggaaagagaaaatcgataaaacacgaaaagagattgagaccactcagaactacttgatggacatcaaaaacaggatcattccgcctttctttaaatctgagctgaatcagttgtatcagtcgcagtataatcatctcgattctttatccaaaaaacttccaagttttacaaaaaagaacgaggatgcgaacgaaaccgccgtgcaagatactagtgacctgaaccttgacttcaagccccataaggtgagtgagcaaaaatcttcttccgtcccctcgctgccaaagccagagatatctgcagataagaaggacttcaccgcccagaaccaaactgaaaatctcactaagagcccggaggaagcagagagctacgaaccagtgaagattccaactcagtcactgctgcaggatgtggcgggccagacacgaaaggaaaaagttaagctccctcactatttactgagtagcaagcccaagagccagcccctggctaaagtccaggacagcgtggggggcaaggtaaatacttcaagtgtcgccagtgctgcaataaataatgcaaagagttctctgttcggcttccatctcctgccctcctccgtcaaattcggtgtgctgaaggagggtcacacctacgctaccgtggtgaagttgaagaatgtcggagtagacttttgcagatttaaggtgaagcagccgccccccagtactggcctgaaagttacctacaagcctgggccagtggcagccggtatgcagactgagcttaacatcgagctgtttgccaccgccgtgggcgaggacggagccaaaggatcagcccacatatctcacaatatcgaaataatgacggaacatgaggtattatttttaccagtggaggcaacagtgctcaccagtagcaactatgacaaaaggccaaaagacttccctcagggcaaagagaatcctatggtgcagcggacctccacgatctatagttctacacttggtgtctttatgagtcgtaaggtgtcaccccattag

SEQ ID NO: 23707 - DNA, 2337 bp, Artificial Sequence
  Description of Artificial Sequence: Synthetic coding sequence
atgcccgccttcctgggcctgaagtgcctgggcaagctgtgcagcagtgaaaagtccaaagtgacttcttcagaacgcaccagtgctcgcgggagtaaccggaaacgcctgatcgtcgaagaccggcgcgtgagtggcaccagttttacggcccatagacgtgcgacgattactcacctgttatacctgtgtccgaaagactactgtccaagaggacgggtatgtaatagtgtggatccattcgttgcacacccgcaggacccccaccacccctccgaaaagcccgtcattcactgccataaatgtggcgaaccttgcaaaggcgaggtcctcagggtacaaacaaagcactttcatatcaaatgcttcacgtgtaaggtgtgcggctgcgatctggcccagggtggcttttttatcaagaacggcgagtatctgtgcactctcgattatcagcggatgtatggcacccgatgtcatggttgtggcgaattcgttgagggggaagtggtaaccgcgctaggcaaaacttatcatcctaattgttttgcctgcacaatttgtaagagaccattcccacccggcgacagagtcaccttcaatggcagagattgcctctgtcagctgtgcgcccagcccatgagctctagcccgaaggaaacaacttttagctccaactgcgccgggtgcggccgggatatcaaaaacggacaggcactcctggctctcgataagcagtggcacctgggctgctttaaatgcaagagctgcgggaaggttttgacgggggaatatatctcaaaggacggggccccgtattgcgagaaggactaccaagggctgttcggagtcaagtgtgaggcctgtcaccagttcataacgggaaaggtgctagaagctggcgataagcactatcacccttcttgtgccaggtgcagtcgctgcaatcaaatgtttacagaaggggaggagatgtatctgcaggggagcactgtttggcatccagactgcaagcagtcgaccaagacggaagaaaagctgaggcccacccggacgagcagtgaatctatctattcgcgccccggaagttccatccctggctctccagggcacaccatctatgccaaggtcgataacgaaattcttgactacaaagaccttgcagccattccaaaagtcaaggcgatctacgatatcgaacggccggatttgatcacctacgagcctttttacactagcggctacgacgataagcaggaacgccagtccctcggagagtcgcctagaacactctcacccacgccttctgctgagggatatcaggatgtcagagaccgaatgatccaccgttccacaagtcagggcagtattaactctcctgtctacagtcggcattcctacacgccaacaacatccaggagcccccagcattttcacagacccggcaatgaaccctcgagtggacgcaacagcccactgccctaccggcccgactcacgtcctttgactcctacctacgctcaggcccccaagcatttccatgtgcccgatcagggaatcaacatctatagaaagccccctatctataaacagcacgctgcgctggctgcacagagcaagtctagcgaagatatcattaaattctctaagtttccagctgcccaggccccagatccctcagagactcccaagatcgaaactgaccactggccagggccaccctcctttgccgtggtcggacccgacatgaagcgccggagttcaggaagagaggaggatgatgaggaattgcttcggcggcgtcagctgcaggaagaacagttgatgaagctcaattcagggttgggtcagctaatcctgaaggaagagatggagaaggaaagtagagagcggtcatcacttctggcctcaagatatgactcgcctattaactctgcatctcatatcccaagctcaaaaactgcttccctgcccggttatggaagaaacggcctgcatcgcccagtgagcacagactttgcgcaatataactcgtacggggacgtgtccggcggtgtgcgcgactatcagacactaccggatgggcatatgccagccatgaggatggaccgcggagtatcaatgcctaatatgctggaacctaaaatttttccatatgagatgctaatggtgactaataggggacggaacaaaatcctgcgagaggtcgatagaactaggctggaaagacacctcgcccctgaggtgttccgagaaatctttggaatgagcatccaagaatttgataggctaccactgtggcggagaaatgacatgaaaaaaaaggccaagctgttttag

SEQ ID NO: 23708 - DNA, 1689 bp, Artificial Sequence
  Description of Artificial Sequence: Synthetic coding sequence
atgaaccccctgttcggccccaacctgttcctgctgcagcaggagcagcaagggctggcaggaccactcggggactcactggggggcgaccactttgccggggggggcgacctgccacctgctcccctttccccggcaggacccgcagcttactccccaccaggacccggaccggccccccccgctgcaatggcgctcagaaacgacctgggaagcaatataaatgtgctgaagaccctgaatctgcgctttaggtgtttcttggccaaggtgcacgaactggagaggcgcaaccggctgttggagaagcagctccagcaagccctggaggaaggtaaacaggggcggcgcggactgggccggcgtgaccaggcggtccagacgggcttcgtaagtccaattcgcccacttgggttacagctcggcgcccgccccgctgccgtgtgcagtccaagcgcacgagtgctcggaagccccgcaaggtcacccgctgggccactggctccttcagcggcgtccctgtcctcatcatcaacatctacttcaaccacatactctagttctgctagattcatgcctggaactatatggtccttttcacacgctaggaggcttggtccgggcctggagcccacacttgtgcaaggtcctggcttaagctgggtccacccagacggcgttggggtgcagatcgataccattacacccgaaatacgggctctgtacaatgtcctcgctaaagttaaacgggagcgagatgaatataagcgaaggtgggaagaggagtatacagtccgaatccaactgcaggatcgcgtcaacgagctgcaggaggaagcccaggaggctgatgcctgtcaagaggagctcgccctgaaggttgaacagcttaaagccgagttggttgtattcaagggactgatgagcaataatctcagcgagctggataccaaaatccaggagaaggccatgaaagtggatatggatatatgcaggcgtatcgacattactgctaaactctgcgatgttgcccaacaacgaaactgcgaggatatgatccagatgtttcaaaaaaaactggtgccctccatgggaggacgcaaacgtgaacgaaaggctgcggtcgaggaagatacaagcctgtccgaatcagagggaccccggcaaccggacggcgacgaggaggagtccactgcactgagtattaacgaggaaatgcagagaatgctgaatcaactgcgcgagtatgattttgaggacgactgtgattccctgacttgggaagagactgaggaaaccctcctgctgtgggaggatttcagtggatatgcgatggcagccgctgaagcgcagggcgagcaggaggactccctggaaaaggtcattaaggacacagagagtctgtttaagacaagagagaaagaatatcaggagacaatcgatcaaattgagttggagctggccaccgccaagaacgacatgaatcgccacttacacgagtacatggaaatgtgctccatgaaacggggtctggatgtgcagatggagacttgccgccgcctgattacccagtctggcgacagaaagagcccagcatttaccgctgtgcccctgtcagaccctcctcccccaccatccgaagcggaggactcagaccgggatgtaagctctgattcatcaatgcggtag

SEQ ID NO: 23709 - DNA, 2415 bp, Artificial Sequence
  Description of Artificial Sequence: Synthetic coding sequence
atgaactaccagcagcagctggccaacagcgccgccatccgggccgagatacaacggttcgagtcagtgcacccaaatatttatagcatatatgaactgttggagagggtggaagaacccgttctccaaaaccagatccgcgaacacgtgatcgctattgaagatgcttttgtgaatagccaagaatggaccctatcaaggagcgtccccgagctgaaggttggaatagttgggaatctagcgtctgggaaatctgcactggtacataggtatctgacagggacctacgtgcaagaggagagccccgaaggcggtcgctttaagaaggaaatcgtggttgatgggcagagctatctcctcttgatcagagacgaggggggccccccagaggcacagttcgctatgtgggtggacgctgttatatttgtattttccctcgaggacgaaatcagtttccagaccgtctaccactactatagccgaatggcaaattatcggaacacttcggagataccactcgtgcttgtgggcactcaagatgcaatcagcagcgccaacccacgggtgatcgatgatgcacgggcaagaaaactgtctaatgacttaaaaagatgtacatattatgaaacctgtgctacatacggcctgaatgtagagagagtatttcaagatgtggcacaaaagattgtggccacccggaaaaaacagcagctttctatagggccttgtaagtctctccctaatagcccttcgcattcatctgtctgttcggctcaggtctctgcagtgcacattagtcaaacatctaatggcggtggaagtctgtcagattatagctcatcagtgcctagcaccccaagcacatctcagaaggaacttcggatcgacgtcccaccaaccgcaaatacccctacacccgtgaggaaacagagcaaacgccgctcaaacctgttcacctccagaaagggaagcgatccagacaaggaaaaaaagggcctagagagtagagccgactccattgggagcgggcgggcaataccgataaaacaagggatgctcttgaagcggtctggaaagtcattaaataaggagtggaagaagaaatatgtcactctctgcgacaatggcgtgttaacttatcacccctcactgcatgattatatgcagaacgtccacgggaaagaaatagacctgctgcggacaacagtgaaagtcccaggtaaaagaccaccaagggccacatctgcgtgcgctcctatttcttctcctaagaccaacggactctccaaggatatgagttcattgcatatctcaccgaatagcgatactgggctaggagattccgtgtgctcatcaccctctattagctccaccacttctcccaagttggatcctccaccctccccccacgccaaccgcaaaaagcacagaaggaagaagtcaacctcaaactttaaagctgatgggctgagtggcaccgccgaggaacaagaggagaattttgagttcataatcgtgtctctgactggtcaaacttggcactttgaagctacaacctacgaagagcgcgacgcttgggtccaggccattgagtctcagatattggccagcctgcaatcatgtgaatccagcaaaaacaagagtcggttgaccagtcagtcagaggcaatggctctgcaaagcatccggaacatgaggggcaattcccactgcgtcgattgtgagactcagaaccccaattgggctagtctgaacttgggcgctttgatgtgcattgagtgttctggcattcaccgcaacctcgggacccatctgtcccgtgtgagatccctggacctagatgactggcccgtggagctgattaaagtgatgtcgagcatcggaaatgagttagctaattcagtgtgggaagagtctagtcagggcagaaccaaacctagtgttgactctactcgggaggagaaggagcgctggatccgggcaaaatacgagcaaaagctattccttgcacccttgccctgtaccgagctgtctctgggccaacatctgttgcgagctacagcagatgaagatctccggactgccatcctcctgctggcccacggttcaagagatgaagtaaatgagacctgtggcgaaggagatggaaggaccgccctgcaccttgcttgtcgcaaagggaacgtggtgctggcacaattgcttatctggtacggggtcgacgttaccgcccgtgacgcccacggcaataccgccctcgcttatgctagacaggcgtcctctcaggaatgtattgatgttctccttcagtacggatgccctgacgagcggttcgtactgatggccacccccaacctgtcgcgcagaaataataaccggaataatagctcaggccgagttccaacaatcatctag

SEQ ID NO: 23710 - DNA, 2712 bp, Artificial Sequence
  Description of Artificial Sequence: Synthetic coding sequence
atgcccgagcagttcagcgtggccgagttcctggccgtgaccgccgaggatttgagttcacctgcgggggcagcagccttcgcagcgaagatgccgcgctatcggggagcggcgctcgcccgggaggaaatacttgaaggtgaccaggccatactccagcgcataaagaaagccgttagggcaattcattcctccggtctgggacacgtagaaaatgaagaacaatatcgcgaagctgtcgaatccctgggcaactcacatctgtcccagaactctcacgaactgagtacgggctttttgaacctagcggtgtttacacgggaggtggctgcgctctttaaaaatttaatacagaatcttaacaatatcgtctcctttcctctggattccctcatgaaggggcagctcagggatggcaggcaggacagcaaaaagcagctggagaaagcctggaaggattacgaggctaagatggccaagcttgagaaggagcgtgatcgagcaagagtgaccggcggcatccctggggaggttgctcaggatatgcagcgcgagagacggatttttcaacttcatatgtgtgaatacctgttgaaagcaggagaatctcaaatgaaacaaggtccagattttctccaatccttaatcaagttttttcatgctcagcataacttctttcaagacggctggaaggctgctcagtctcttttcccttttatcgaaaagctcgccgccagcgtccacgctttgcaccaggcgcaggaggatgaactccagaaactaacgcagctaagggatagtctccgcggtactctgcagctggagagccgtgaagagcatctgagccgcaagaactctggctgtggttattccatacatcaacatcaaggaaataagcaatttggcacagaaaaagtggggtttttatacaaaaagagtgacggtattaggcgcgtgtggcaaaaacgaaaatgtggggtgaaatacggctgcctcacaatcagccactctacaattaataggccgcctgttaagctcacccttctaacctgtcaggtgcggcccaaccccgaggagaaaaaatgttttgacttggtgactcacaataggacgtaccattttcaggccgaggatgagcacgagtgtgaggcctgggtctctgtattgcagaactcaaaggatgaggccctctcctccgctttcttaggggagcccagtgcaggccccggaagttggggttctgcgggccatgacggcgaaccacacgacctgaccaaactgcttatagcagaggtgaagtccaggccagggaacagccagtgctgtgattgcggagcagctgatcccacctggttgtctacaaacttgggtgttttgacatgcattcagtgttcgggagtgcacagggaactgggcgtgaggttcagtcgtatgcagtctttaacgctggacttgctgggcccgtcagaactgctcttggcccttaatatgggaaatacatctttcaacgaagtaatggaggcccagcttccatcccacggtggaccgaagccttcagccgagtccgacatggggactaggcgagattatattatggccaagtatgtagagcatcgcttcgctagaagatgcactccagagccgcaacgcctgtggactgccatttgtaatcgcgatttactctctgtgctcgaagccttcgcgaatgggcaggacttcggccaacctcttcctgggcccgacgcccaggcgcccgaggagcttgtactgcaccttgccgtaaaagtcgctaaccaagcctcattgcctttagtagactttataattcagaatggaggccaccttgacgcaaaagccgccgatgggaacaccgctctgcactacgcagccctgtacaatcagccggactgcctcaagcttctgttgaaagggcgagctctagtgggcacagtgaatgaagcaggcgagaccgcacttgatatagcaagaaaaaaacaccacaaagagtgcgaggagcttttggaacaggcccaggctggtacattcgcgtttcccctgcatgtggattactcctgggtgatctcaaccgaacctggcagtgacagcgaggaggacgaagaagaaaaacggtgtctgctgaaactccccgcccaggctcattgggctagcgggaggctggacatatccaataaaacatacgagaccgtggcctcactgggtgccgccaccccccagggggaatccgaagactgccctccccccctgcccgtgaagaattcttccaggaccttagtgcagggttgtgcgcggcatgcatctggagacagaagcgaggtctcttctctgagttccgaggcaccagagacaccggagtcactggggtcacctgcctctagcagctcgctgatgtcccccctggaacctggagatcccagtcaggcgccacctaactctgaagagggcttacgggaacctcccggcaccagtagaccgagcctgacctcagggacgactcccagtgagatgtacttaccagtccgttttagcagtgagtctacaagatcctaccgaagaggcgcgagatcccctgaggatgggccatccgcccgacagccactgccaagacgcaacgtcccagtaggtataacggagggtgacgggtcacgaacaggttccctccctgcaagctccgtgcaactgttgcaggactag

SEQ ID NO: 23711 - DNA, 1359 bp, Artificial Sequence
  Description of Artificial Sequence: Synthetic coding sequence
atgatgaagcggcagctgcaccggatgcggcagctggcccagaccggtagcttggggcgcacgcccgagaccgctgagtttctgggagaagatttactgcaggttgaacagcgcctagagccagcgaagagagccgcacacaatatccacaaaagactgcaggcctgcttgcagggacagagtggggcggatatggataaacgtgtgaagaaactacccctgatggccctgagcaccactatggcggagagctttaaagagctggacccggatagctcaatggggaaggcgctcgagatgagctgcgctatccagaaccagctggctagaatcctcgccgagtttgaaatgacattagagagagatgttttacagcctttatcacggcttagcgaggaggagcttccagcaatcctgaaacataagaagagtctgcaaaagctcgtgagtgattggaacaccctgaaatctaggctctcacaggccactaagaattctggctccagtcagggtcttgggggtagcccaggctctcacagccacactacaatggctaacaaagtggagacattgaaagaggaagaagaagagttaaagcgcaaggtagaacaatgtcgcgatgagtatctagcagatttgtatcacttcgttaccaaagaggattcttacgcaaattatttcataaggttgctggagatccaggctgactatcatcggaggtctctcagctcactcgataccgccctcgccgaactgcgggagaaccatggacaagccgaccattccccttcaatgaccgcaactcactttccaagagtgtacggggtgagcctggctacccacttgcaggagctgggccgtgagatcgcgcttcccattgaggcctgtgtcatgatgctcctgagtgaaggcatgaaagaagagggcctctttaggctggccgccggtgcgtccgtactcaagcgattaaagcagacaatggcatccgaccctcactcgctcgaggagttttgttcagatccccatgccgtcgctggagccctaaaatcataccttcgggaactgccagagcctctgatgaccttcgacttgtacgacgactggatgcgcgcagctagcctcaaagagccaggggctcggctacaggcgcttcaggaggtgtgcagccggttgccgccggaaaatctcagcaatcttaggtaccttatgaagtttcttgccagactagccgaggagcaggaggttaacaaaatgacaccttcaaacatcgccatcgtgctgggtcccaaccttctgtggcctcccgagaaagagggcactgagccagcgagggaattgggtagtcaaacactctgttag

SEQ ID NO: 23712 - DNA, 1137 bp, Artificial Sequence
  Description of Artificial Sequence: Synthetic coding sequence
atgaacaacagcggcgccgacgagatcggcaagctgttcgtgggcggtctggattggtccacaactcaagagaccctgagatcatatttttctcagtacggggaagttgtggattgtgtgatcatgaaagataagacaaccaatcaatcacgtggttttgggttcgtgaaatttaaagatccaaactgcgttggtacagtgctcgcaagtcgtcctcacacccttgacggaagaaatatcgatcccaagccatgcacccctaggggtatgcaaccggagaggacacgacctaaggagggctggcagaagggcccacgcagtgataactctaaatctaataagatctttgtgggaggcatcccacataactgcggcgagacggagctgcgtgagtacttcaagaaatttggagtcgtcactgaggttgttatgatttacgatgccgagaaacaacgtcccaggggctttggattcataacctttgaggacgaacagtcagtagatcaggctgtaaacatgcatttccatgatataatgggtaagaaggtcgaggtgaaaagggccgagccgcgtgacagtaaaagccaagcacccggacagccgggagcgtctcaatgggggtctagagtggtccccaatgcagccaacggctgggctggtcagcctcctcccacctggcagcaaggttacggaccccagggcatgtgggtccctgctggccaggctatcggaggttatggtcctccacctgcaggtagaggtgcgcccccacctcctccacccttcacgagctacatcgtctctactccaccgggcggttttccaccaccacagggctttcctcagggatatggagcgcccccccaattttcatttggatacggcccccccccaccgcctccagaccagtttgcacctcccggcgtcccgccccccccagctacccccggagcagctcctcttgcttttcccccgcccccatcccaagcagctcccgatatgtctaagccgcccacagctcagccggattttccttacggtcagtacggcctgggatcctacagtcctgccccgcccggatgtggtccccatttcgtgtattctctgatggttcgtttgtcatcagatgtcgcatag

SEQ ID NO: 23713 - DNA, 2430 bp, Artificial Sequence
  Description of Artificial Sequence: Synthetic coding sequence
atggaggtgctgcgggagaaggtggaggaggaggaggaggccgagagggaggaggccgcagagtgggcagagtgggcccgcatggaaaaaatgatgcgcccagtggaggtcagaaaagaggagataactcttaaacaagagacactgcgggatcttgagaagaagctgagcgagattcagatcacagtaagtgccgaactgcccgctttcaccaaggacacaattgatattagtaagctgcccatttcatataagacaaacaccccaaaagaagagcatctgctccaggtggcagacaatttttctagacagtactcacacctctgtccagatagggtgcctctcttcctccatccactgaatgaatgtgaagtgccaaagttcgtatcaactacgttgcggccgacgttaatgccataccctgaactctataactgggattcttgtgcccagtttgtttccgactttctgacaatggtgccactgcccgaccctctaaaacccaccatcaaaaaagaagagaaagtgctgcccaagaaatacacgataaagcccccccgcgatttatgcagtcgctttgaacaggagcaagaggtgaagaagcagcaggaaatcagagctcaagagaagaagcgtctgcgggaggaggaggaacgtttgatggaggccgaaaaagcaaagcccgatgctctgcatggattgcgcgtgcatagttgggtgttggtgctcagtgggaagcgggaagtccctgagaacttttttatcgatccttttactgggcattcctatagtacccaagatgagcacttcctcggaatcgaatctctctggaatcataaaaattattggatcaatatgcaggactgttggaactgctgtaaagacctcattttcgacctgggcgatcctgtacggtgggaatatatgctgctgggtaccgataagagccagttaagcctgacagaggaagatgacagcgggattaacgacgaagatgacgtggagaacctcggaaaagaggacgaggacaagtccttcgacatgccacactcttgggtggagcagatagagatctcccctgaagctttcgagacccggtgtcccaatgggaagaaagtgatccagtacaagcgggctaagcttgagaagtgggctccctatctgaactctaacgggctcgtttcaaggcttacgacttacgaggacttacaatgcacaaacattcttgaaatcaaagaatggtatcagaatagggaggatatgttggaactgaaacatatcaacaagaccaccgacttaaagactgattacttcaaaccaggccacccccaggcccttcgtgtccattcatataaaagtatgcagcctgagatggatcgcgtgattgaattctatgaaaccgctagggtagacgggctcatgaagcgggaggagaccccaagaacaatgaccgagtattatcagggacgcccagacttcctgagctacaggcacgcatctttcggcccccgtgttaaaaaactcaccttgagcagcgcagaatccaaccctaggccgatcgtgaaaatcaccgagcgattctttagaaaccctgctaaaccggcggaagaagacgttgccgagcgagtgttcttggtcgccgaggagcggatccagctcaggtaccactgtagggaggatcacatcacagcctcaaaaagagaattcctgcggaggaccgaggtggactctaagggaaacaagatcattatgacccctgatatgtgcataagtttcgaggtggagcctatggaacataccaagaaacttttatatcagtatgaagctatgatgcatttgaaacgggaagagaagcttagccgacaccaggtctgggagtccgaactagaggtattggaaatccttaaactgagagaggaagaggaagctgcacataccctcacaatcagcatctacgatacaaagagaaacgagaagtcaaaggagtaccgcgaagctatggagaggatgatgcatgaggagcatttgaggcaggtcgaaacacaattggactatctggctccctttctggctcagctgccgccaggtgagaagctcacttgttggcaggctgtaagactgaaggacgaatgcttgagtgacttcaaacagagactaattaacaaggccaatctaattcaggcccggttcgaaaaagagactcaagaactgcagaagaaacaacagtggtaccaagaaaatcaggtcactcttacccctgaagacgaggatctgtatctgtcctactgcagtcaggctatgttccgaattcgcattttggagcagaggctgaatcggcataaggagctggcgcccctgaagtacctggccctggaagaaaagttgtacaaagatcccagattgggggagctccagaagatctttgcgtag

SEQ ID NO: 23714 - DNA, 828 bp, Artificial Sequence
  Description of Artificial Sequence: Synthetic coding sequence
atgtggcccctgaccgccctgctgctgctggtgcccagcagcggccaggcggccactctggagaaacctatcctgtccctgcatccaccctggacaactatttttaaaggcgagagggtcacccttaaatgcgatggatatcatcctctgttgctcgaactccagcccatttctaccctgtggtacttgggccatctgcttctcccttcccacaaaaagtcaattgaagtgcagactcctggcgtgtacagatgccagactagaggcgcccctgtgtctgatcctatacaccttagcgtgtcgaatgattggctcattctgcaagtaccatacgcacctgttttcgagggggagcctttggtcctgcgctgccgcggctggtacgacaaggtggtgtacaaacttcactattaccacgacgggcaggcggtccggtacttccactcttctgccaactatacggtcttgcaggcccgagcttctgactccggacgctaccaatgcagcggcaccatgcgaatacccgtggagagtgcccctatgttctctgcgaaagtagctgtgacagtgcaggaggcacggcatgccgctgctgtccgggtgcttcaggtccagccacgaggagctcccctgcgactgggacggcgcgtacatagcccaggcgcaaggggacgcggagcccggatagttctggtaagggggggctaccgacaccctcaatgccctgagacacagtccgtcgctgctgcgcccggggctggattcagccctggtccaggtttgcatcaccgtccatcgtctatgggcagaagcctggggtcatggtag

SEQ ID NO: 23715 - DNA, 657 bp, Artificial Sequence
  Description of Artificial Sequence: Synthetic coding sequence
atgaactgccggagcgaggtgctggaggtgagcgtggagggccggcaagtcgaagaagcaatgctggcagtgctgcacactgtgcttcttcatcggagcaccggaaaatttcactacaaaaaagaaggtacctatagcatagggacggttgggactcaggatgttgactgcgactttattgactttacatacgtcagggtttccagcgaggagctggacagagctttgcgcaaggtggttggtgagttcaaagatgctctgcgcaactccggcggcgatggtcttgggcagatgtctctcgagttctaccagaagaaaaaaagccgctggccattctctgacgaatgcatcccgtgggaagtctggactgttaaggtacacgtcgttgccttggccactgaacaggaacgtcaaatatgccgagaaaaagtgggagagaagctgtgtgagaagatcatcaacattgtagaagtgatgaacagacatgagtacttacccaaaatgcctacccagagtgaggttgacaatgtgttcgatacaggactcagggacgtgcagccctatctgtataaaatcagcttccagatcaccgatgcactaggcacctctgtgaccacaacgatgcgaagactaattaaggacacactagcactctag

SEQ ID NO: 23716 - DNA, 552 bp, Artificial Sequence
  Description of Artificial Sequence: Synthetic coding sequence
atgatgcagatctgcgacacctacaaccagaagcacagcctgttcaatgctatgaatcgatttattggcgcagtgaacaacatggaccagaccgtcatggtgccaagtctgctgcgagatgtccccctcgctgaccctgggctggataacgacgtcggggtggaggttggaggaagcggcggttgtctggaagagaggaccccccccgtgccagatagtggctcagctaatggtagctttttcgcacctagccgtgatatgtactcgcattatgtactacttaaatcaatacggaacgatatcgagtggggagtgctacatcaacccccgccacccgccggatcagaggaagggagtgcctggaagagcaaggacatactcgtagacctgggacacctggaaggagccgatgcaggggaagaagatttggagcagcagttccactaccacttgcggggtctccataccgtcctttccaagctcacaagaaaggcaaacatcttgaccaaccggtacaagcaggagatcggatttgggaactgggggcactag

SEQ ID NO: 23717 - DNA, 369 bp, Artificial Sequence
  Description of Artificial Sequence: Synthetic coding sequence
atgctgttcgccccctgctgccaccagtgcggcgagttcatcatcggaagagtaattaaagccatgaataactcctggcatccagagtgtttcaggtgcgacttgtgtcaggaagtccttgccgacattgggtttgtcaaaaatgccggacgacacctgtgtcgcccatgtcacaatagagaaaaagcaagagggcttggcaaatacatatgccagaaatgccacgcaattatcgatgaacagccccttatcttcaaaaatgacccctaccaccccgatcatttcaattgtgctaattgcgggcaggaggggtccgattgtcgctgtaccggggctgagagaggagcaatccttcctgctatgccttag

SEQ ID NO: 23718 - DNA, 1083 bp, Artificial Sequence
  Description of Artificial Sequence: Synthetic coding sequence
atggacagcgagctgatgcacagcatcgtgggcagctaccacaagccgcctgaacgggttttcgtaccttccttcacgcagaatgagccctcacagaattgtcaccctgccaacctggaagttacgtctcctaagatattgcactccccaaactcgcaggagaaacagctggagtatacaaaaaggatggtacttaatgtggagcgggagaaaaacatgatacttgagcaacaggcacagctccagagggaaaaggaacaagatcagatgaagctatacgccaagctagaaaagctggatgtcctggaaaaagaatgttttcggctgactactacacagaaaactgccgaagacaaaatcaaacatctggaggagaaattgaaggaagaagagcatcaacggaagctctttcaagataaagctagcgagctacagactggtcttgagatcagcaagataatcatgagctccgtgtccaacctgaaacatagtaaagaaaagaagaaaagcagtaagaagacaaaatgtattaagcgccgccccccttggcagatctgtagcaagttcggcgctctgcctttcgtggctgagaagcctagtcgcacaacttcatggtgcaaggccatccccccggactccgagaagtctatatccatctgtgataatttatctgagttactgatggccatgcaggacgaactggatcagatgtcaatggaacatcaggaactgttgaagcaaatgaaagagactgagtcacattcggtgtgtgacgatatcgagtgcgagttggaatgcttactgaaaaagatggaaatcaagggtgagcagattagcaaactgaaaaaacaccaggacagcgtgtgtaagttacagcagaaggtgcagaattccaagatgtctgaggcctctggcatccagcaggaagactcatatcccaagggtagcaaaaacattaagaactcacctaggaaatgtctgactgacacgaatttattccaaaagaactctagcttccacccaattcgcgtccacaacctgcaaatgaaactgcgccgggacgacatcatgtgggagcaatag

SEQ ID NO: 23719 - DNA, 1758 bp, Artificial Sequence
  Description of Artificial Sequence: Synthetic coding sequence
atgagcggcagcacccccttccagatgcggctggtgcacctggaccttaaaggtgctccaccaaaagtctcatacctttccgaaatcttcccactcttcagagccctgggagcaaatggacttttaatcgagtacgaggatatgttcccctacgaggggccgctgcgcctcctgcgcgcaaagtatgcatactccccatctgaaatcaaggaaattcttcaccttgctgggcttaacgagctcgaggttatcccactcgttcaaacctttggtcatatggagtttgtgctcaaacataccgcttttgcccatttgcgggaagtgggctcttttccttgcactttgaatcctcacgaagcggagagtttagctctggtgggggcaatgatcgatcaggttttagagttgcacccaggcgcccaacgcctgcatattgggtgtgatgaagtgtattacttaggagaaggtgaagcaagccgccgttggttgcaacaggagcagaactccacagggaaattgtgtctgtcccacatgagggcagtggccagtggcgtgaaggcaagacgacctagcgttacgccattagtctgggacgatatgctccgggatcttccggaggaccagcttgctgccagcggggtgccacagttggtggaacctgtcctctgggactatacggccgatttagatgtgcacgggaaagttctgcttatgcagaaatatcgccgatgtggcttcccccagttgtgggcagcctctgcatttaagggtgccacaggcccctcccaggccgtgccacccgtggaacaccatcttaggaatcacgtgcagtggttacaggtggctggatctgggcctactgacagcctgcagggaatcatcctaacaggctggcagagatacgatcattattctgtgttgtgtgagctgctccctgctggcgttccttcgctcgctgcttgtttgcaactccttcttcgcggaggctttgatgaggacgtgaaggcaaaggttgagaacctgctggggatctcaagcttggagaaaaccgacccagtcaggcaggccccttgctctccaccatgccccctcctgccactgcccttccccagaccatggcggcagttgttcagcgcgggcttgtccgcagggagagggccagcacctagtctcgctgctacgagtcttcctctgagccataagagtgcgtctatctgtgcggcactgtggatgcgctgctggcgggccaccggtatgagcctcgcaggcagtgcaccaaccaccgccagtggctcatcatccacccggagctggtttagcactagctctccccaaagaagtgcatcttggcactccggcgcgccctcttgtagatcgtggagactcccctgcagctggctgagcaccaggatgccttggagaagcggctggcgcaagacctgtacccctgcttgtagtgggtgcaagctttgctgtaggacctctgctaggtgtcttcctccgcgctgccacccgcccgccctggccgggacactgttaaggactccagagggacgggctcacgctagagggctgcttctagaggcaggaggcgcgctccattgtcaaatggcatgggcaattcgggcccacgtgggagtcgtccccagtggcccggcagtgtcctgccctcattccgtgcccgagggacccggacagccactcggggagcggctggagaacacagaaggtagctccaccggaaggcctgctctctag

SEQ ID NO: 23720 - DNA, 2112 bp, Artificial Sequence
  Description of Artificial Sequence: Synthetic coding sequence
atggaggccctgctggagggcatccagaaccggggccacggcggcggtttcctaacctcatgtgaggcggagttgcaggagttgatgaagcagattgacattatggtcgcgcataagaagtctgagtgggaggggcgcactcacgcactcgaaacatgtctgaagattcgggagcaagagctgaaatcacttcggtctcaactggacgttacacataaagaagttggaatgctgcaccagcaggtggaagagcatgaaaagataaaacaggagatgaccatggagtataagcaggagctgaaaaagctgcacgaggagctgtgcatcctcaagcggtcttacgaaaaactgcaaaaaaaacaaatgcgcgaatttcgcggcaacaccaagaatcatagagaagatcgcagcgaaatcgagcgtttgactgcaaagatcgaagagtttcgtcagaagtctcttgattgggagaagcagaggctgatttatcagcagcaggtatccagtctggaagcccagcgcaaggcccttgccgagcagagcgaaatcatccaagctcagctggtgaacagaaagcagaaactggaatccgtagagctgtcttctcagtctgaaatacaacatctgtcaagcaaattagagagagctaacgacaccatctgcgccaatgaactggaaatagagcggctgacgatgcgtgtgaacgacctggtcgggacctcaatgacagtactccaggagcaacagcagaaagaagaaaagctgagagagagcgagaaactcttggaggccctccaggaagaaaagagagagctgaaggccgccctgcaaagtcaggagaacttgattcatgaggcaagaattcagaaggaaaaactgcaagaaaaggtgaaagctacaaacactcagcatgcagtagaggcaattcgccctagagaggagtcgctagccgagaaaaaatacacatcgcagggacaaggcgacttggacagcgtgttaagtcagctgaactttactcatacttctgaggacctgttacaagccgaggttacctgtttggaaggctcactggaatccgtctcggccacatgtaagcagctgtcgcaggagctcatggaaaaatacgaagaactcaaaagaatggaagcacacaacaatgagtataaagccgagatcaaaaagttgaaggaacagatactccagggtgaacagtcttactccagtgccttggagggaatgaagatggagatctctcacctgacccaagaactccaccagcgagacattaccatcgcctccacgaagggatcatcttctgatatggaaaagcgcctgcgcgccgaaatgcagaaagctgaggataaagccgttgagcacaaggagatcctagaccagctggagagcctgaagcttgagaacaggcacttaagcgagatggtaatgaagctggaactaggactccacgaggccaaggagatcagtctggccgatctgcaggagaactacattgaggccctgaacaagctcgtctctgaaaatcagcagctccagaaagatttgatgaacaccaagtctcagctagaaatatctactcagatgtgcaagaaacagaatgatagaatcttcaaacctactcatagcagaaccaccgagttcaaaaacacagagtttaagcctacacacggccagcaccgacatgatggaattaagacggagcactataagactgatctgcactccccacgagggcaggcttctgacagtattaacccgatgagccgggtactgtctcctttgtctccccagattagtccttgttctagcacaagatccctgacgagttacagcctctgtaaaacccatagtctgccctcagcgcttgacactaacgaggccaatttctccgacaccatgagcgagagcatgaacgatcaagaggaattcatctcttcgtgtagtctgcctgtctcccctctggggtcaatcgccaccaggttcttggaagaagaggagcttaggagccaccacattctggagagattggatgcgcatatcgaggaactaaagagagaatctgaaaagacggtgaggcaattcaccgccttgaaatag

SEQ ID NO: 23721 - DNA, 1626 bp, Artificial Sequence
  Description of Artificial Sequence: Synthetic coding sequence
atgagcagctgcgtgagcagccagcccagcagcaaccgggccgccccccaggatgagctagggggccgcgggtcaagctctagcgagagccagaagccctgcgaagcattgagaggattgagctccctgtccatacatttgggaatggagtcattcatcgttgtaacagaatgtgagccaggctgcgctgtggatctggggctggctcgtgatcgtccattggaggccgatgggcaggaggttccactagatacctccggctcccaggccaggccccatctgtccggacgcaagcttagtctgcaggagcgtagtcaggggggtcttgctgctggtggtagcctggatatgaatggcaggtgcatctgtccttccctgccctatagcccggtgtcttctcctcagtcatcaccacgattacctcgcagaccgaccgtggaatcacatcatgtgtctattacagggatgcaggattgcgtgcagctgaatcagtatacgctgaaagacgagattggcaaaggctcatatggggtggttaagctggcctacaacgagaatgacaatacatactacgctatgaaggtgctttctaaaaagaagctgattcggcaggccggctttcctcgcaggcctccacctagagggacgagacccgccccaggaggctgtattcagcccagaggtccaattgagcaggtctaccaggaaatcgccatcttaaaaaaacttgaccaccccaacgttgtgaagctggtcgaagtcctggacgatcccaacgaggaccacctttatatggtattcgaactagttaatcaaggacctgtgatggaagttccaactctgaagcctctatccgaagatcaagccaggttctactttcaggatctgatcaaaggaatcgagtatctccactatcaaaaaatcattcaccgggacatcaaaccatctaacctgctcgttggagaggacggacatataaaaatcgctgatttcggtgtgagtaacgaattcaaaggctccgacgcactgctaagcaacacagtggggacccctgccttcatggctcctgagtctctctcggaaacaaggaagattttttcaggaaaggcactggatgtctgggccatgggggtaaccctgtattgcttcgtcttcggtcagtgtcctttcatggacgagagaatcatgtgccttcactcaaaaataaagagccaagctctggagttccccgatcagccagacatagcagaggacttaaaggatctgataactcggatgctcgacaagaaccctgaatctcggattgttgttcctgaaattaaactgcatccatgggtcacaagacacggggctgagccattgcccagcgaagatgagaattgtactctggtggaggttactgaagaagaggttgaaaattcagtcaaacatattccctccctagccaccgttattctggtgaagacaatgatccgtaaacggtcttttggtaaccccttcgaaggaagtcggagagaggagcgaagcctctcggcccctggtaatttgctgactaaacagggttcagaggacaatctccaggggactgacccacctcctgttggagaagaggaggtactgctttag

SEQ ID NO: 23722 - DNA, 2463 bp, Artificial Sequence
  Description of Artificial Sequence: Synthetic coding sequence
atgaccgacacccggcggcgggtgaaggtgtacaccctgaacgaggaccgccaatgggatgaccgggggaccggtcacgtctccagtgggtatgtggagcgcctgaaagggatgtcattactggtccgggcagaatcagatggcagcttgctgctcgagtctaagatcaatcccaatacggcctatcagaaacagcaggacaccctcatcgtctggtccgaggccgaaaactatgatcttgccttatcattccaggagaaggctggttgcgacgaaatttgggagaaaatctgccaggtgcagggtaaagatccttcagttgacattacccaggatttagttgatgagtctgaggaggagcgctttgacgacatgagcagccccggcctcgaactccccagctgtgagctttctaggctagaggaaatcgccgagctggttgcctctagtcttccttcacccctgagacgggaaaaactcgcattggctctcgagaatgagggatatattaagaaactcttggagctgtttcacgtctgcgaagacctcgagaacattgaaggcctgcatcacctgtatgaaatcattaaaggcattttcctgcttaacaggacagctctgttcgaggtgatgttctctgaggaatgtattatggacgtgatcggttgtctggagtacgatcctgcgctcagccagccacgtaaacaccgagagttcttgactaaaactgcaaagtttaaagaggtcattcctatctccgatcctgaactcaaacagaagatccatcaaacttacagagtacaatacatccaagacatggtgttgccaaccccaagcgtatttgaggagaacatgttatcaactctgcactcttttatattcttcaataaagtggagatagtcggtatgctccaagaagacgagaagtttctgacagatctgtttgcccagctgaccgacgaggccacagacgaggaaaagcgccaagaactcgtgaacttcctgaaagagttctgcgccttttcacagactcttcagccacagaaccgcgatgcgttttttaaaactctaagtaacatgggcatcctccctgccctggaagtgatactgggaatggatgacacacaagttagaagcgccgccacggatatcttctcttatttggtggaatacaacccctcgatggtcagggaattcgtcatgcaggaggctcagcagaatgatgacgacatcttattaataaacctgatcatcgaacatatgatctgcgataccgaccccgaactcggaggagcggtgcagctcatggggcttctccggactttggtggacccagagaacatgctggcgacggcaaataaaaccgaaaaaacggaatttcttggctttttttataaacattgtatgcatgtgctgaccgccccccttctggccaacactacggaagataaaccatccaaggatgatttccagactgcacagctcctcgcactggttctggagctcttgacattctgtgtggagcatcacacctatcacataaaaaactacattataaacaaagatattctgcgaagggtgttggtgctgatggcttctaagcatgccttccttgcactgtgtgccctcagatttaaacgcaaaattattggcctaaaagatgaattctataatcgatatatcatgaagagttttctgtttgagcctgtggtgaaggccttcctaaacaacggcagtcgctacaacctgatgaattctgccatcatcgagatgtttgagtttatcagggtcgaggacatcaagtccctgacggcacacgtcatcgagaattattggaaagccctggaagatgttgactatgtccagaccttcaagggtttaaaactgcgcttcgagcagcagcgggaaagacaggacaatccaaagctcgactccatgcggtccatcctgaggaatcaccggtacagacgggatgccaggacccttgaagacgaggaagaaatgtggttcaataccgacgaagatgacatggaagacggcgaggctgtggtcagtccttccgacaaaactaagaatgatgacgatataatggaccccatttccaagttcatggagagaaaaaagttgaaagaatcagaggagaaggaagtcctgctaaagaccaacctgagcgggagacaatcaccatccttcaagctgagtctctcttctggcacaaagaccaatctcacaagccagtcttccaccacaaatctccccggttccccggggtcaccaggttctccggggtcgcccgggtcacctggctcagtgccaaaaaatacgtctcagactgccgccatcacaacaaagggcggcctggtgggtctcgttgattatcctgacgacgacgaggacgacgacgaggacgaagataaggaggatactcttcctctgtctaaaaaggccaagttcgacagttag

SEQ ID NO: 23723 - DNA, 2382 bp, Artificial Sequence
  Description of Artificial Sequence: Synthetic coding sequence
atgagcgagcagggcgacctgaaccaggccatcgccgaggagggcggcacagaacaagaaacggccacccctgagaacggcattgtgaagtccgaatccctggacgaggaggagaaactggaactgcaacggagactcgaggcgcagaaccaggagaggcgcaaatcaaaaagtggagccggaaaaggtaagctgacccggagtctggcagtttgtgaggagtcaagcgcaagaccaggaggtgagtcccttcaggaccaagagagcattcatctacagctgtcaagtttctctagcctgcaggaggaggacaaaagccggaaggatgactccgaacgagagaaagaaaaagacaaaaacaaggataagaccagcgaaaagcctaaaataagaatgctgtccaaggactgttcccaggaatacactgactcaacgggaattgatttgcatgaattcctgataaatacgctgaagaacaattctcgagacagaatgatactgctgaagatggaacaggaaatcatcgatttcatcgcagataataataaccactacaagaagttcccacaaatgtccagctaccaaaggatgctcgtgcacagagtggccgcctattttgggttagaccataacgtcgaccagacagggaagtctgttataatcaacaaaacctctagcacacggattccagagcagagattctgcgagcacctgaaagatgaaaaaggcgaggagagtcagaaaagatttattctcaagagagataactccagcatagacaaggaggacaaccagtccgtttgttctcaggaatccctcttcgtggagaatcgcgggaacagagacggctctggccggacgtcaggatcccgccaaagcagcagcgaaaatgagctcaaatggagcgatcatcagcgggcgtggtcatccaccgatagcgattcaagcaaccgcaatttgaaacccgccatgactaagactgcgtcctttggaggcatcaccgtcctgacccgcggcgactcaacgtcctctactcggtccaccgggaaactgtcaaaagctggttctgagagttctagctctgcgggatcttccggaagtctgtcacggacacacccccctctgcaatcaacacccctggtctccggtgtcgccgcaggtagccctggctgtgttccgtacccagagaatggcatcggaggacaggttgcaccaagttctacctcctacattcttctgcccctggaggctgctactggcatacctcctgggagcatattgctgaatccacacacaggccaaccctttgtgaatcccgatgggacgccagccatctataatccccccacaagtcagcaacccctacggagtgccatggtggggcagtcccagcagcagcccccccagcagcagccgtcaccccagccacaacagcaagtgcagcctccccagccacagatggcagggccattggtcacccagtccgtgcagggcctacaggcctcttcccagagcgtacaatatccagccgtgtcttttcctccccaacacctcctgccagtatctccaacccaacactttccaatgcgtgatgacgtggctacccagttcggccagatgaccctctcccgccagtcctccggcgagactccggagccgccgtccggccccgtttatccaagttcgctcatgccccaacccgcacagcagccttcatatgtgatcgcatcaaccgggcagcagctgccaactggagggttcagcggcagtggaccccctatcagccagcaggtcctgcagccgcctccctccccccaggggtttgtccagcagcctccccccgcacaaatgcctgtgtactattatccttccggccaataccctacgagcaccacacaacagtaccggccaatggcaccagtgcagtacaatgcccagagaagtcagcagatgcctcaggccgcccagcaggctggataccagcccgtgctgagcggacagcagggctttcagggtctgatcggagtgcagcagccacctcagagccagaatgtcattaataatcaacagggcactcctgttcaaagtgtgatggtatcttatcctacaatgagctcatatcaggttcctatgactcaggggtcacagggcctcccccagcaaagctatcagcagcccatcatgttacctaatcaggcaggacaaggctcattgcctgccaccggcatgccagtctactgtaacgtaacgccacctacaccacagaataatttgcgtttgataggcccgcactgcccgagctccactgtgcctgtgatgtccgcgagctgcagaacgaactgtgccagcatgtcaaacgccggttggcaggtcaaattctag

SEQ ID NO: 23724 - DNA, 1467 bp, Artificial Sequence
  Description of Artificial Sequence: Synthetic coding sequence
atgcggttccactggctgcccaccctgagcgagcccttcgaccggaaccaggagcttgagacgtgcataagacccctgtggacaccaagtggctctgcctgcgagactgagcacaacaaaagtatggacatgggcaaccagcatccatcaatttcacggttgcaggagatacaaaaagaggtgaaatcagtggaacagcaggtaataggattctctggtctctctgacgacaagaactataagaaactggagcggattctaacaaagcagctattcgagatcgactctgtcgatactgaggggaaaggagatatccagcaggcccgtaaacgagcagcccaagagactgaacggcttcttaaggaactcgaacaaaatgctaatcatccccatagaatagagatccagaacatcttcgaagaagcgcagtccctcgtgcgagagaagatcgtacctttttacaacggcggtaattgtgtaaccgacgaattcgaagaagggatccaagatataatcctcaggctgactcatgtaaagacaggcggcaaaattagcctgagaaaagccagatatcatacacttacaaagatttgcgcagtgcaggaaatcatcgaagactgtatgaaaaagcaacctagcctgccattgtctgaggatgcccacccttccgtggccaaaatcaatttcgtcatgtgcgaggtcaataaggcaagaggcgttctcatcgcactcctgatgggcgtgaacaataatgaaacctgccggcacctttcctgtgtgctcagcggccttattgccgacttggacgcgcttgatgtttgcggcagaacagagataaggaattaccgaagagaggtggtggaggatatcaacaagctgttgaaatatctcgacctggaggaggaagccgacacaacaaaagccttcgatttacggcagaaccacagcatcctaaagatcgaaaaggtgctgaagcgaatgagagagattaagaacgagttgctgcaagcccaaaacccgtccgagttgtacttgtcctcgaagaccgagctacagggactgatcggccaacttgatgaagtttcattagagaaaaatccttgcatcagagaagcccgcagacgcgcagttatcgaggtgcaaacgctgattacctatattgatcttaaggaagcactggaaaagcgtaagctcttcgcctgtgaagagcacccgtcacataaggccgtgtggaatgttctggggaatttgtctgaaatacaaggggaagtactgtctttcgatggtaaccgcacagacaagaattacattagactggaagagctgctcactaaacagctactcgcgcttgacgcggttgaccctcagggagaagagaagtgcaaagctgctagaaagcaggcggttagactggcacagaacatcctgagttacctggacctgaaatccgatgaatgggagtattag

SEQ ID NO: 23725 - DNA, 978 bp, Artificial Sequence
  Description of Artificial Sequence: Synthetic coding sequence
atgggcaagatggtgagcgtgatcaacaccgtggacaccagccacgaggatatgatacatgatgcccaaatggattattacggcaccaggctagcaacgtgtagttctgacaggtctgtgaagattttcgacgtgaggaacggcggacagatcctaatcgccgatttgcgaggacacgagggccccgtgtggcaagtggcttgggcacaccctatgtatggaaatattctggcatcgtgcagttacgatagaaaggtgattatctggcgcgaggaaaatggaacctgggagaagagtcacgagcatgctgggcacgactccagcgtgaacagtgtctgttgggcgccacacgactacggcctgatcttggcctgcggcagttccgacggtgccattagcctgttgacttacacaggagaaggacaatgggaggtaaaaaaaataaacaatgcccacaccattggatgcaacgcagtaagttgggcccctgctgttgtgcccgggagcctcattgaccatccaagcgggcaaaaacctaactacatcaaacgctttgcaagtggaggctgcgataatctcattaagctatggaaggaagaagaagacgggcagtggaaagaagaacagaagctcgaggctcactcagattgggtgcgcgacgtcgcttgggccccttccattggcctaccaactagtacgattgcctcttgttcgcaggatgggcgggtctttatctggacatgcgacgatgcttcgtcaaatacatggtcccccaaattgctgcataaatttaacgatgtcgtgtggcatgtctcttggtcaatcactgccaacatcctcgccgtctccgggggggacaataaagttactctgtggaaggagtccgtggatggccagtgggtctgcataagcgacgtaaacaagggccagggtagcgtcagcgcatcagtaacggaaggccagcaaaatgagcaatag

SEQ ID NO: 23726 - DNA, 846 bp, Artificial Sequence
  Description of Artificial Sequence: Synthetic coding sequence
atgctgttcatcttccccctgagcctgccctggcggcccagctgctggaaggagtcttgctcgacaggccagagacaggcaggcaggtcaagagaggacagtgttacgccacctccatctagtccctggcctaccccaccagcaggagcgatgtccacgaaacaggaggcccgtagggatgaaggtgaggcccgcacacggggccaagaggcccagcttcgcgatagggcccacttgtcccaacagcgaaggttgaaacaggcgacacagtttctgcacaaggactcagcggacctactcccccttgattctctgaagagacttggtaccagcaaggatttacagccccggtctgttatccagaggagactagtagagggtaatccgaattggctacagggggagcccccaaggatgcaagatctgattcacggccaggaaagccgtagaaagaccagtaggactgagatccctgcacttttagtgaattgtaagtgccaagatcaattgctccgagtcgcagtcgatacgggtacacagtacaatcgcataagcgccggctgtttaagcagactgggattagagaagagggtgctgaaagcgtcagcaggagatctggctccaggcccccctacgcaggtcgagcagctggaactccagttagggcaggaaaccgtggtgtgcagtgcacaggtagtcgatgcggagtcccccgagttctgcctcgggctgcagacactgttgagtttaaaatgctgcatcgatttggaacacggcgtgttgcgactgaaagctcctttttccgagctgccatttctacccttgtaccaggagcctggacagtag

SEQ ID NO: 23727 - DNA, 1533 bp, Artificial Sequence
  Description of Artificial Sequence: Synthetic coding sequence
accggcggcggcgtggcccccgccggccaggtgcggaccgccacctgggctaggcgggcacgaccttatcggaagatggccgctagaaccggcaccgagctggccagtgcagccagcactacagccccaggatccagtaagcgtaggaagcgtcacccatggcatacggtgtctcgccgtcctgggcgaacccccaagtggaggctgccacggatttctgctcgcgcaccttataggttgaggcggctgcgccgccacacatattggccaccacggcgtcccgtggctgcgtctagatgctggcccgtgggggctacccctcttgggtccgtagggggacggaccggtaaaatggatgcagccacgttaacatacgacacgctgcgctttgctgaatttgaagattttcctgagaccagcgaacctgtctggatcctggggcggaagtactcaatcttcactgaaaaagatgagatcctatctgatgtggcgtcccgcctgtggttcacatataggaagaatttccctgccatcggcggcacaggcccaaccagcgatactgggtggggatgcatgttgcggtgtggccaaatgatctttgcacaagcgctggtgtgtagacatctgggccgggattggcgctggacacaacgaaaacgccagcccgactcctacttctcagttttgaacgcattcatcgaccgaaaggattcatactattccatacaccagattgctcagatgggcgtgggggaaggaaagtcgatcggacagtggtatggcccaaatacggtggcccaggtcctcaagaagctggcagtgttcgatacttggtcgtcccttgccgttcatattgcaatggacaacaccgtggtgatggaggagataaggaggttgtgtaggacctccgtcccctgtgcaggcgccacagctttccccgcagactcagaccggcattgtaatggctttccggcaggagccgaagtgacaaatcgcccatcaccatggcgacccctggtgctgctaattcccctccggctgggcttgacagatatcaacgaagcttatgtagagacgctaaagcactgtttcatgatgccacaatcactcggagtgatcgggggaaaaccgaacagcgcgcactactttatcggctatgtaggggaggagttgatttatcttgaccctcataccactcagccagccgtggaaccaaccgacggatgctttatcccagacgagtctttccattgccagcacccaccgtgtaggatgtccattgcggaacttgaccccagcatagcagttgggttcttttgtaaaacggaggatgacttcaacgactggtgtcaacaagtgaagaagctgtcccttctcggcggtgccttgcccatgttcgagctggtcgagctgcagcccagccacttggcttgtcccgatgtgctgaacctctccttagatagctcagatgtggaaaggctggagcgcttctttgactcggaagacgaagacttcgagattctgagtttatag

SEQ ID NO: 23728 - DNA, 552 bp, Artificial Sequence
  Description of Artificial Sequence: Synthetic coding sequence
atggccagcaacaagaccaccctgcagaagatgggcaagaagcagaacggcaagagcaagaaggttgaggaagcagaacctgaggagttcgtcgtcgagaaggtgcttgacagacgcgtggtgaacggtaaggtggaatacttcctgaaatggaaaggttttacagacgcagacaacacctgggaaccagaggaaaacttggactgcccagagctcatcgaagcattcctgaacagccagaaggccggaaaggaaaaggatggcaccaaacgtaagagcctatccgatagcgagagtgacgacagtaagtcaaaaaaaaaaagggatgcagcggacaagccacggggttttgccaggggcttggatcccgagagaattatcggcgcaacggacagcagcggggaattaatgttcctcatgaaatggaaggacagcgatgaagctgatttggtgttagctaaggaggctaacatgaaatgccctcagatagttattgcgttctacgaggagcggctgacttggcattcttgtcctgaggatgaagcccagtag

SEQ ID NO: 23729 - DNA, 1464 bp, Artificial Sequence
  Description of Artificial Sequence: Synthetic coding sequence
atggagcggagcggccagcgggtgaccacctgggactgcgaccaggggaagcactctgactctgattaccgcgaagatggaatggacctgggatcagacgcgggctccagcagcagtagctccagggcaagttcccaatcaaatagtactaaagtgaccccctgtagtgagtgcaaaagtagcagtagtccaggcggctccttggatctggtctctgctttggaagattacgaagagccttttcccgtgtatcagaagaaggtgattgacgaatgggcccctgaggaagacggcgaagaggaggaggaggaagacgaaagagatcagcgaggttaccgcgacgatcgtagccctgccagggagcctggagacgtgagcgctcgcactcgatcaggaggcggcggtggccgctctgccactacagcaatgccaccccctgttcccaatggcaatcttcatcagcatgatcctcaggacctgagacataacggtaatgtcgtggtggccgggcgcccttcttgttcccgcggccccaggcgggcaattcagaagccccagcccgccggaggccggagatctgggcgggggcccgctgcgggagggttgtgccttcagcctcctgatggagggacttgcgtgccagaagagccgccagtgcccccaatggactgggaagctctcgagaaacacctcgctggccttcagttcagagagcaggaagttcgaaaccaggggcaagcacgaacaaatagtacatccgctcagaaaaacgaaagagagtccatccggcaaaagctggctctgggttccttctttgatgatgggccagggatatatacctcttgttccaaatcaggcaagccatccctgtcttcgagattgcagtcagggatgaacctgcagatctgctttgtgaacgattcaggatccgataaggactctgacgcagatgacagtaaaactgaaacttcccttgacaccccactctctccgatgagcaaacagtctagttcttactcggatcgtgataccactgaagaggagtctgagtccttggatgatatggactttctgaccagacaaaagaaactccaggcagaggccaagatggcgttagcgatggcaaagcccatggccaagatgcaggtggaggttgagaaacagaataggaaaaagagcccagtggcagacctgttgccccatatgcctcacattagtgaatgcctcatgaagcgctccctgaagcctaccgaccttcgggatatgactataggccagctgcaggttatcgtgaacgatctccactcgcaaatcgagtctctgaacgaggaactggtgcagttgcttttgatccgcgacgaattacacaccgaacaagacgcaatgctggtggacatcgaggatctgacccgccacgccgaatcccagcaaaaacacatggcagagaagatgcccgctaaatag

SEQ ID NO: 23730 - DNA, 927 bp, Artificial Sequence
  Description of Artificial Sequence: Synthetic coding sequence
atgaagcgggcccaccccgagtacagcagcagcgacagcgagctggacgagacaatcgaagtagagaaggaatctgccgacgagaacgggaatttgagcagtgccctcggctcaatgagtcccacaacaagctcccagattctagcgaggaagcgacggcggggaattatagaaaaacgtagaagggaccgaatcaataattccctgtctgagctcaggcgcctagtaccgagcgcattcgagaagcaggttatggaacagggcagtgcaaagcttgagaaagccgaaattctgcaaatgacagtggaccatctgaaaatgctccacacagcaggcgggaagggatattttgatgcacacgcccttgccatggactaccgaagcttagggttcagggagtgtcttgccgaggtagcacggtatcttagtataatagagggcctagacgcctctgacccactgagagtcaggttggtgtcacaccttaacaactacgctagccagcgcgaagcggcctccggagcccatgctggtctgggacatattccatgggggaccgtatttgggcaccaccctcacatcgcccacccgttgctgctgccacagaacgggcacgggaatgcgggaaccacagcctctcctacagagccacatcaccagggtcgccttggatctgcccaccccgaagctcccgcccttagggcgcctcccagcggctccttgggccccgtgctgccagtggtgacgtccgccagtaaattatctccacccttgctcagttccgtcgctagtctatctgcattccctttctcatttggctcattccatcttttatcaccgaatgctttgtctccctctgcacccactcaggccgccaatctagggaagccctatcgtccttggggtaccgagataggagctttttag

SEQ ID NO: 23731 - DNA, 1338 bp, Artificial Sequence
  Description of Artificial Sequence: Synthetic coding sequence
atgagcgtgacctacgacgacagcgtgggcgtggaggtgagcagcgactccttttgggaagttgggaattacaaaaggaccgtgaagaggatagacgacgggcacagattgtgctctgatttgatgaactgtcttcatgaacgggctaggatcgagaaggcttatgctcaacagctcaccgagtgggctcgccgctggcgccagctcgttgagaaaggccctcagtacgggacagtagagaaggcgtggatggcattcatgtctgaagccgagcgggtgagcgagctgcacctggaagtgaaggcatcccttatgaacgatgacttcgagaagattaaaaattggcagaaggaggcttttcataaacaaatgatgggagggttcaaagaaacgaaggaggccgaggatggtttccgtaaagcacagaagccatgggctaaaaagctgaaagaagtggaagcggctaaaaaggcccaccacgcagcttgcaaggaggaaaaactggcaatttctcgtgaggcgaacagtaaagctgacccgtccttgaaccccgaacaactgaaaaagttacaggacaaaattgagaagtgcaaacaggacgtgcttaaaacaaaagaaaaatacgaaaaatccctgaaggagcttgatcagggcacaccccagtatatggagaatatggaacaggtgtttgaacagtgccaacagtttgaagagaaaaggctgagatttttccgggaagttctgcttgaggtgcagaagcacctggatctctctaatgtggcaggctacaaggcgatttaccatgatcttgagcagtcaatcagggcagcggatgccgtagaggaccttaggtggttccgcgccaatcacggccctggaatggcaatgaattggccccagttcgaggaatggtcagcggaccttaaccgcacactgtctaggcgtgaaaaaaagaaagccacagacggcgtaacattaactggaatcaaccaaaccggtgaccaatcccttccaagtaagccctcctctgtctcctcttatgagaagacccaaagctacccaaccgactggtccgacgacgagagcaataatcccttcagcagcaccgacgctaacggggattccaatccttttgacgatgacgcgacctctggcaccgaagtgagagtccgagcattgtatgactacgagggccaggagcacgatgagttgagcttcaaagcaggcgacgagctcacgaagatggaagacgaagatgagcaaggatggtgtaagggtaggttagacaacgggcaagtagggttgtatccagccaactatgtggaggccatccagtag

SEQ ID NO: 23732 - DNA, 1248 bp, Artificial Sequence
  Description of Artificial Sequence: Synthetic coding sequence
atgatgctgggccccgagggcggcgagggcttcgtggtgaagctgcggggcttgccttggtcatgtagtgtcgaggatgttcaaaattttttgtcggattgcaccatccacgatggagcagcaggagttcactttatttacacacgcgaggggaggcagtctggtgaggccttcgtggagttggggtccgaggatgacgtgaaaatggctctaaagaaagatagggaaagtatgggccacagatatattgaggtgttcaagtcccatcggaccgaaatggattgggtactgaagcatagtggtcccaacagcgctgactcagcaaatgacgggtttgtgcgactacgcggtctgcccttcggatgcacaaaggaagagatcgtccagttcttctcggggctggaaatcgtaccgaacggtatcacccttcccgtggatccagagggcaagattaccggagaagccttcgtgcagtttgccagtcaggagctggccgagaaggcactcggcaagcataaagaacggattgggcacaggtatattgaggtcttcaagagttcacaggaggaagtccgctcctactccgatccacccctaaagtttatgagcgtacagagaccagggccctatgaccgacccggtaccgcccggaggtacatcggtattgtgaagcaagccggcctcgagcggatgaggccaggcgcttattcgactggctatggcggttacgaggagtatagcgggttatctgatggatatgggtttaccactgacctctttggtagagatttatcatactgcttaagtgggatgtacgaccaccgctacggcgacagtgagttcacagtgcagagtactactggacactgcgtgcacatgcgggggttgccatacaaagccacagagaacgacatctacaattttttctccccactcaacccggtccgtgtgcatatcgaaataggccctgatggaagagtgaccggtgaagctgacgtggagtttgcaactcacgaagaagctgtcgctgccatgtccaaagatagggcaaacatgcagcatcggtacatagaactgttcctgaatagtactaccggggcctccaacggcgcctatagttcacaggttatgcagggtatgggagtctctgccgcccaagccacgtactctgggctagaatcgcagtccgtgagtggctgttacggagctggttattccggacagaactctatgggaggatacgactag

SEQ ID NO: 23733 - DNA, 1770 bp, Artificial Sequence
  Description of Artificial Sequence: Synthetic coding sequence
atgagcgtgagcgtgcacgagacccggaagagccggagcagcaccggctccatgaatgtaacgttgtttcacaaggcctctcaccctgactgcgtgctagcccacttgaacactctgagaaaacactgtatgttcacagatgtgacactctgggctggcgaccgggcttttccttgccatcgcgcagtgctggcagcaagcagcagatattttgaggcgatgttttcgcacggcttacgtgagtcccgggacgataccgtgaactttcaagacaatttgcaccccgaagtattagagttactgctagactttgcctattcttcacgcatcgccatcaacgaggagaatgctgagagcctgttagaggctggcgacatgctacagttccatgatgttcgcgacgcggcagccgagttcttggagaagaatctgtttccttcaaactgtctgggaatgatgctcctcagtgacgcccaccaatgccggcggctgtacgaattttcatggaggatgtgccttgtgcactttgagaccgtgaggcaaagcgaagacttcaactctctttctaaggacactctcttggacttgataagcagtgatgagctggaaacagaagacgagagagtggtgttcgaggcaatcctccagtgggtcaaacatgacttagaacccagaaaggtgcatctgcctgaactgctgcgcagcgttcggctcgcactgctgccatcagactgcctgcaggaggccgtgtcctctgaagcattgttgatggccgacgaacggaccaagctgatcatggacgaagcactccgctgcaagactcgtatactacagaacgatggcgtcgttacaagtccttgtgcccgccccagaaaggcggggcacacactgctgatactgggaggacagaccttcatgtgcgataagatctaccaggtcgaccacaaagctaaggagatcataccaaaggccgaccttccatctccgcggaaggagttctcagcatccgctattggctgcaaggtgtatgtgaccggcggccgaggctcagagaatggcgtgtccaaggacgtgtgggtctatgacacggttcatgaggagtggagcaaagcagccccaatgctgattgcaaggtttggacacgggagcgcagaactggaaaattgcctgtacgtcgtaggaggccatacttccctcgcaggcgtgtttccagcaagccccagtgtatctttgaaacaggtagagaagtatgaccctggcgccaataaatggatgatggtggccccactgcgagatggagtgtccaatgcagccgtggtatctgcaaagctgaagctgtttgtattcggcggcacctcgatccatcgcgacatggtctccaaagtgcagtgttatgacccgagtgagaacagatggaccatcaaagccgaatgtcctcagccgtggcgctacaccgctgcagccgttctaggcagccaaattttcattatgggcggagataccgaattcacggccgcaagcgcgtatcgttttgattgcgagacgaatcagtggacaagaatcggagacatgaccgctaagaggatgtcctgtcacgctcttgcctctggaaacaaactttatgtggtaggggggtatttcggaacccaacgttgcaagacactggactgctacgacccaacttccgacacatggaattgcattaccaccgttccatattctctgatcccaactgctttcgtttctacttggaaacatttgccagcgtag

SEQ ID NO: 23734 - DNA, 1311 bp, Artificial Sequence
  Description of Artificial Sequence: Synthetic coding sequence
atgatgggcgaggccgccgtggccgccggcccctgccccctgcgggaagactccttcacaagattcagttcccagagcaacgtgtatggcctcgccgggggcgccggtggacgcggagagctcctggctgccaccctgaaagggaaagttttaggctttaggtaccaagacttgaggcaaaagatcagaccggttgccaaggagctacagttcaactatatacccgtggacgcagagatcgtctcaatcgatacctttaataaatcacccccaaagcgcggactagtggtcggcatcacctttatcaaagattccggggacaagggctccccctttctaaacatttattgtgattatgaaccaggttcagagtacaacttggattcgatcgctcagtcttgcttaaatctcgagctgcaattcacaccttttcagttgtgccacgctgaggtgcaggtgggtgatcagctagaaacagtctttctcctatctggtaacgacccagccattcatctatacaaggaaaacgaaggcctgcaccagttcgaggagcagccagtagaaaacctctttcccgaacttacaaatctgacatcaagcgtcctctggttggatgtgcacaattttcccgggacttctaggagacttagcgccctgggctgtcagagtggctatgtgcgcgtggcacacgttgaccagaggtcacgggaggtactacagatgtggtcagttctgcaggatggccctataagcagagtgattgtgttcagcctttccgctgccaaagagaccaaagatcgccccctccaggatgaatacagcgtgctcgtggcaagtatgctggaacctgctgtggtttaccgtgatttgctgaatcggggtctcgaggaccagctgcttctgccaggttccgatcagttcgacagcgtactttgctcactcgtcaccgatgtcgatttggacgggcggccagaagtcctcgtggctacctatggccaggagctcctgtgctacaaatacaggggtcccgaatctggcctccctgaagcgcagcacgggtttcacctgctgtggcaaaggtccttctccagtcctctgctcgcgatggcccatgttgacctgaccggggacggattacaggagctcgcagtggtgtccttgaaaggcgtgcatattctgcaacacagccttatccaagcttccgaacttgtcctgactcgactccgacatcaggtggagcagaggcgaagaaggctacaggggctcgaggacggtgccggggccggaccagcagaaaatgctgcttcatag

SEQ ID NO: 23735 - DNA, 642 bp, Artificial Sequence
  Description of Artificial Sequence: Synthetic coding sequence
atgctgctgcccttcatccggaccctgcccctgctgtgctacaaccatctgctggtctcgccggatagcgccacgctttcccccccatacagcctcgagaagatgacggacttagtggccgtgtgggatgtggcactgtcagacggagtccataaaattgagtttgaacacggaacaacttcaggtaagagagtcgtgtacgttgatggaaaagaggagatccgtaaggaatggatgtttaagttagtgggaaaggaaacgttttacgtcggcgctgctaagactaaggccacgatcaacatcgacgccatatctggctttgcgtatgagtacacactcgaaatcaatggaaaaagcttaaagaagtatatggaggacaggtctaaaaccacaaacacctgggtgctccacatggacggtgaaaattttcgtatcgtactagagaaggacgcaatggacgtgtggtgtaatggaaagaaactggagacagcaggagaatttgtcgatgatgggacagagactcacttttccatagggaatcacgattgttacataaaagctgtgagttcaggaaaacgcaaagaaggaatcatccatactctcatcgtagataatagggaaatcccagaaatagctagttag

SEQ ID NO: 23736 - DNA, 663 bp, Artificial Sequence
  Description of Artificial Sequence: Synthetic coding sequence
atgaccagcggcgaggtgaagaccagcctgaagaacgcctacagctccgccaaaaggctctctcccaagatggaggaagagggtgaggaagaagactactgcaccccaggcgcttttgaactcgaacggctgttctggaaaggcagcccgcagtacacccacgtaaatgaagtgtggccaaagctctacataggcgacgaggctacagcactggatcgttatcggctccagaaggccgggtttacccacgtcttaaacgctgcacacggccggtggaacgttgatactggaccggactattatagggatatggacattcagtatcacggtgtggaggccgatgatctgcctacattcgatttatccgtgttcttttatccagccgccgctttcatcgacagagccctctccgacgaccacagcaaaatcctggtgcattgtgttatgggtcggagcagaagcgcgacacttgtgcttgcctatttgatgatccacaaagacatgaccttagtcgatgctatacagcaggtggccaagaatagatgcgtgttgcccaaccggggatttctcaagcaactgagggagttagacaagcagctggtgcaacagcggcgtagaagtcagcgccaggacggcgaagaggaggatggaagggaactatag

SEQ ID NO: 23737 - DNA, 1845 bp, Artificial Sequence
  Description of Artificial Sequence: Synthetic coding sequence
atgagccccgccgaccggtgccggagcgccaacaccatcgagcccgctactaccagttcactggcactatttcttctactgcagcgggaccagtcgtcacgaacacgcggtctccctgaagagaaggaggaggtgactatggatacctctgaaaatcgtccagagaacgacgtacctgagcccccaatgcctatcgccgaccaagtcagtaatgatgatcgaccggagggcagtgtggaggatgaggagaagaaggaatcatccctccccaagagcttcaaacgaaagatatcagtggtcagcgcaacaaagggggtccccgccggcaactcagatactgagggaggccagccaggtcggaaacggcggtggggcgcaagcactgccactacccagaaaaaaccctctattagcatcacaacggaaagcttgaagtctcttatccccgacataaagcctctcgctggccaggaggccgtcgtggatctgcacgccgacgacagcagaatcagcgaggatgagacagagcgaaatggagacgatgggactcatgacaaggggttaaagatctgtcgcacagtcacccaagtcgtgcccgccgaagggcaggaaaacgggcagcgcgaagaagaagaagaggagaaggaacccgaggctgaaccacccgtgcccccccaggtttccgtggaggtcgcgctacctccccctgccgaacacgaagttaaaaaagtcacattgggcgacactctcaccagaaggtctatcagtcagcagaaaagtggtgtgtccatcacaatcgatgatcccgttaggaccgctcaggtgccaagcccacctagaggcaagatcagtaatatcgtgcacatatccaacctcgtgcgccctttcaccttaggacagctgaaggagctcctcggacgaactggcaccctcgtggaagaggccttttggatcgataaaatcaagtcccactgctttgtgacttactcgactgtagaggaggcagtggcaacgagaaccgccttacacggcgtcaagtggccgcaatctaatcctaagtttttgtgtgcggactacgcagaacaggatgagttagattaccacagaggcttactcgtagaccgcccaagcgaaacgaagactgaggaacaaggcattccacgcccgctccatcctccccccccaccacccgtgcagcctcctcaacacccgcgagctgaacagcgagagcaggagcgggccgtccgcgagcagtgggcggagcgtgaacgcgaaatggagcgacgggagcggactcggagcgagagggaatgggaccgtgacaaggtgcgggagggaccaaggtcaaggtcaagaagcagggacaggcgccgcaaggaacgagcgaagtccaaggagaaaaagagcgagaagaaggagaaagctcaagaagaaccccccgcaaaacttttggatgatcttttcaggaagaccaaggccgcaccttgtatctactggttaccactcaccgactctcaaatagtccagaaggaggctgagcgcgcagaacgagcaaaggaaagagaaaagcgtaggaaagagcaggaggaggaggaacaaaaagaaagagaaaaagaagctgagagggaacgaaatcgacagttggaacgggagaaaagacgggagcactcccgcgaacgtgaccgcgagcgtgagagggaacgggaaagggataggggggacagggatcgcgaccgggagcgggacagagaaaggggtagggagagggatcggcgggatactaagaggcatagccgttcgcgaagccggtcaactccagtcagggatcgcggtgggagacggtag

SEQ ID NO: 23738 - DNA, 1203 bp, Artificial Sequence
  Description of Artificial Sequence: Synthetic coding sequence
atgaagaacgagcccctgacccccggctaccacggcttccccgccagagatagccagggtaatcaggaacccacgacaactccggatgctatggttcagccttttaccactatccctttcccgcctcccccacagaatgggatacccacagagtacggtgtgccccatacgcaagactatgccggacaaacgggggagcacaatctcacactctacggatccacacaggctcacggagaacagtctagcaatagcccaagcactcagaacggcagtctgacaaccgaaggtggcgcccagaccgacggccagcaatcacagacacaaagttcagagaattccgagagcaagagtactcctaagaggcttcacgtgtccaacattccattcagattcagagatcccgacctgcgacagatgtttgggcagttcggaaagatcttggatgttgagatcatctttaatgagagaggctctaaaggcttcggattcgttaccttcgagaattccgcagatgccgaccgggctagggaaaaactccacgggaccgttgtcgaaggacgaaagattgaggtgaataacgcaacagcaagggtgatgacgaacaaaaaaatggtgactccctatgccaacggatggaaactgtctccggtagtgggtgctgtctatggacctgaactgtatgccgcatcttcattccaggccgacgtgtcactgggtaacgacgcggcggtgcccctctctggaaggggaggtattaacacttatattcccctcattatcccaggcttcccatatcccacggccgctactaccgcagctgcctttcgaggggcccacttgcgtggtcgcgggaggacggtttacggggctgtgcgcgctgtcccacctaccgctatcccagcctaccctggcgtcgtataccaagacgggttctatggcgccgacctgtacatcgagtccgccaattgtttcagatcaaaccgcgtagacatgcagcccacggacatgcacagtctgctgcttcagccacagccccccctcctgcaaccgctgcagccactgacagtcactgtgatggcggggtgcactcaaccaacacctactatgcctctgccattgccactggctatggagttagccctctggcgtgtttataccgaagtggctactgccgatctgcccccaacagaggtaacatag

SEQ ID NO: 23739 - DNA, 1545 bp, Artificial Sequence
  Description of Artificial Sequence: Synthetic coding sequence
atggacgagggcatggagatcagcagcgagggcaacagcctgatcaaagcagtgcaccagtctcgactgagactgacaagattattgctggaagggggtgcctacattaacgagtctaacgatcgaggcgagacacctctgatgatcgcatgtaaaactaaacacgtagatcaccagagcgtctcaaaggcaaaaatggtcaagtacctcctagagaataatgctgatcctaatattcaggataagtccggtaaaacagcgctaatgcatgcatgcctcgagaaagcagggcctgaggtagtgagcctcctactcaaatccggagcagacttaagtctacaagatcactccagctactcagccctggtgtatgcgatcaactcagaggacactgagacgctgaaagtcctgcttagcgcttgcaaggccaagggaaaggaggttataatcatcacgaccgctaagctgccctgtggaaagcacaccacaaagcaatacctaaatatgcctccggttgacatcgatggatgccattcacccgcaacctgcactacccctagtgaaatcgacataaaaacagcctcatctccactctcccattctagtgaaactgaactgaccctgttcgggttcaaggacctcgagctggccggctccaatgacgatacatgggatccggggtctcctgtcagaaagcctgcactcgccccaaaagggcctaaactgccgcatgcgcccccttgggtcaagtctcccccactcctgatgcaccagaatcgcgtggcttccctgcaggaagagctgcaggacataactccggaagaggagctctcgtataaaaccaatggcctcgccctcagtaagcgttttattacaagacaccaaagtatcgacgtgaaggacacagcgcacctgctgcgcgcgttcgaccaggcaagctccagaaagatgtcctatgacgaaataaactgccagagctacctgtcagagggtaatcagcagtgcatagaggtgcccgtcgatcaagatcccgattcaaaccaaactatttttgctagtactctgcgcagtattgtgcaaaaaaggaatttaggcgccaaccactactccagtgattcacagctgagcgccgggctgacccctcctacctcagaagatgggaaggcgttgattggaaaaaagaaaatccttagtccaagcccatctcagctctcagagtctaaggaattgcttgaaaatattccacccggtccccttagcaggagaaaccatgctgtactggagcgtcgtggatctggggccttcccacttgaccactccgtcacccagactcggcaagggtttctgccacccctgaatgtcaatagtcacccccccatttcggatatcaacgtgaacaacaagatctgttccctcctgtcctgtggccaaaaggtactgatgccaactgtcccaatttttccaaaagaatttaaatccaagaagatgctattacgtcggcagagtcttcagaccgaacagattaagcagttggttaacttctag

SEQ ID NO: 23740 - DNA, 1674 bp, Artificial Sequence
  Description of Artificial Sequence: Synthetic coding sequence
atggaccagagccgggtgctgctgtgggtgaaggccgagcccttcatcgtcggagcgctccaagttcctcccccgtccaagttctcgctgcattacttaaggaagattagcacgtatgtgcagattagagcgaccgaaggggcctatccccggctgtattggagcacttggaggcatatagcttgcggaaagcttcagctggctaaagacttggcatggctttacttcgagattttcgattctctgtcgatgaagacacccgaagagcgtttggaatggagcgaggtgttatccaactgcatgtcagaagaagaagtcgagaagcagagaaaccaactgtccgtggataccctgcagtttctcctcttcctgtacatccagcaacttaacaaagtctcattgagaaccagcctcatcggcgaagagtggccgtcccccaggaacaagagccagtcccccgatctcacagagaaatcaaattgtcataacaagaattggaatgactacagccatcaggctttcgtttacgatcacttgtccgacctgttggaactcttacttgacccgaaacaactgaccgccagttttcactctactcattcatctctggtgtcaagggaggcggtggttgcgctgagctttctgatcgagggcacaatttctcgcgcacgaaaaatttaccccttgcacgaactcgctctctggcagccactgcacgctgacagtgggttctcaaagatttctaaaacttttagtttctataaattggagacttggctgcggtcttgccttactggaaacccttttggtacctcagcctgcctgaaatcaggcaagaaactggcctgggcccatcaggtggaaggtacaacaaagcgtgccaagatcgcttgtaacacacatgtggcacctcgcatgcaccgcctggtggtgatgtcgcaggtgtacaagcagaccctggcaaagagctccgacaccctcgcgggcgcccatgtcaagatacatcgctgtaacgaatctttcatttatttgttgtccccattgagatccgtcaccatcgagaaatgtcggaacagcattttcgtgctggggccagttggcaccacccttcacctccattcttgcgataatgtgaaagtaatcgctgtgtgtcaccgcctgtcaattagctccactacaggatgcatattccacgttttgacccctaccaggcccttgatcctcagcggcaatcagactgtaacattcgccccattccacacccactaccccatgctagaagatcacatggcgaggaccggactcgcaaccgtgcccaactactgggacaaccccatggtagtgtgtcgcgagaacagcgacaccagggtgttccaattactgcctccctgcgaattttacgtgtttatcataccttttgaaatggaaggggacaccacagaaattcctggaggcctgccaagtgtgtatcagaaggcccttggccagcgtgaacaaaagatacagatatggcagaaaaccgtaaaagaggcccacctgacgaaggaccagcgcaaacaattccaggtgctggtagaaaacaaattttacgagtggttaataaacacgggtcatcggcagcagctggacagccttgttcctcctgctgccgggagtaaacaggccgccgggtag

SEQ ID NO: 23741 - DNA, 648 bp, Artificial Sequence
  Description of Artificial Sequence: Synthetic coding sequence
atggtgttccggcggttcgtggaggtgggccgggtggcctacgtgagtttcggacctcacgctggcaagctggtggctattgtcgatgtgatagatcagaaccgagccctggtggatgggccatgcacgcaagtgcgtcgccaggccatgccttttaagtgcatgcagctgaccgactttatcttgaagttcccccattcagcccaccaaaagtacgtccggcaggcctggcagaaagctgatatcaacacaaagtgggcagcgacacgttgggccaaaaagattgaagctcgtgagaggaaagcaaaaatgaccgacttcgataggttcaaggtaatgaaggccaagaagatgcgcaaccgtataatcaagaacgaagtgaaaaaactgcagaaggccgcactcctgaaggcatctccaaagaaggcccccggcacaaaagggaccgctgccgccgccgcagccgctgcagccgcgaaggtcccagctaaaaaaatcaccgcagcatcaaagaaggcacccgctcagaaggtacccgcacaaaaggcaactgggcagaaggccgcccccgcacctaaagcgcagaagggccagaaggccccagcacaaaaagccccagcccccaaggcaagcggcaaaaaggcatag

SEQ ID NO: 23742 - DNA, 888 bp, Artificial Sequence
  Description of Artificial Sequence: Synthetic coding sequence
atggagctgatccaggacaccagccggccccccctggagtacgtgaaaggggtgccccttataaaatacttcgcagaggctctgggtcccctgcagtcctttcaggctcggcctgatgatttgctaattaacacctaccctaaaagtggaaccacatgggtgtcccagattctggatatgatttatcaggggggcgatctggagaagtgtaaccgcgcccccatatacgtgcgcgtacctttcctggaggtgaatgatcccggcgaaccaagcgggctggaaaccctgaaagacactccacctccccggctaattaagagtcatttgccgctggcactcttgccccaaaccctactggaccaaaaggtgaaagtagtttacgttgcccggaacccgaaggatgttgcagtgtcgtactaccacttccacagaatggagaaggctcatcctgagccaggtacttgggatagttttctggagaagtttatggctggagaagtaagctatgggagctggtaccagcacgtacaggagtggtgggagctgagcaggacacatcctgtgctatatctgttttatgaggatatgaaagagaatccaaaacgcgagattcaaaagattctggagtttgtgggcagaagcctgcctgaggaaaccatggacttcatggtccagcacaccagcttcaaggagatgaagaaaaaccccatgaccaactacacaactgtgcctcaggagcttatggaccactctatcagcccatttatgcgtaaaggaatggccggggattggaagacaacgttcacagttgctcagaatgaacgattcgatgcagactatgcagaaaaaatggccggctgttcactgtcctttcggagtgagctctag

SEQ ID NO: 23743 - DNA, 1368 bp, Artificial Sequence
  Description of Artificial Sequence: Synthetic coding sequence
atgagcagcctgggcgccagcttcgtgcagatcaagttcgacgacctgcagttcttcgagaattgtggtggagggtcatttggttctgtctatagagcaaagtggatttcccaagacaaagaagtcgctgtgaaaaagttattgaagatcgagaaggaagcagagattctgagtgtgctgagccatcggaatataatccaattctacggtgtgattttggaacccccaaactacgggattgtgactgaatacgctagtctgggaagcttgtacgactatattaactctaatcgaagtgaggaaatggacatggatcatattatgacatgggccacagatgttgccaagggaatgcattaccttcacatggaagcacctgttaaggtgatccaccgtgaccttaagagtcgtaatgtggtgatcgccgccgacggggtcctaaaaatctgtgactttggcgctagccgcttccataaccacactacccacatgagtctggtgggcaccttcccttggatggctcctgaagttatacagtccttgcccgtgagcgaaacttgtgacacatacagttacggtgtggtgctctgggagatgctgactcgcgaggtcccctttaaggggctggagggccttcaagtcgcatggctggtcgtggagaagaacgagcgactgactatccctagctcatgtccacgctcattcgctgagctgcttcaccaatgttgggaagctgatgcaaaaaaacgaccctcttttaagcaaatcatatcaatattggagagcatgtcaaatgacacgagcctgcccgataaatgcaacagtttcctgcacaacaaggccgaatggcggtgtgaaatcgaagctaccctagagcgactaaagaagttagagagagacctgtcctttaaggagcaagagctcaaagagcgcgagcgaagactcaagatgtgggagcagaagctcactgaacagagtaatacaccattgctgttgccactggctgccagaatgagcgaagagagttattttgagtccaagacagaagagtcaaattctgctgaaatgagctgtcaaatcactgcaacctctaatggcgagggacacggcatgaatccatcccttcaggccatgatgttgatgggctttggcgacatcttcagcatgaacaaggctggcgcagttatgcactcgggcatgcagatcaacatgcaggcaaaacaaaactcttccaaaacaaccagcaagcgccggggaaagaaagttaacatggcactgggcttttctgactttgatctgagcgagggcgatgatgacgacgatgatgacggggaagaggaagataatgatatggacaacagtgagtag

SEQ ID NO: 23744 - DNA, 423 bp, Artificial Sequence
  Description of Artificial Sequence: Synthetic coding sequence
atgcggttccggttctgcggcgacctggactgccccgactgggtgctggcagagataagcaccctcgcaaagatgtcctctgtaaagctccgacttctgtgtagccaagtgttgaaagaactgcttggccaaggcattgactatgagaagattctgaagcttacagccgacgccaagttcgaatctggcgacgttaaggccacagtggcagtccttagtttcatactgagcagcgccgctaaacatagcgttgacggcgagtcactcagcagcgagctgcagcagctcggcctgcccaaagaacacgcggcctcgctatgcaggtgttacgaggaaaaacaaagccctctccagaagcatctgcgcgtttgttctctgcggaaactgaagcaggcccaaaccctgatgagcagtctggggtag

SEQ ID NO: 23745 - DNA, 573 bp, Artificial Sequence
  Description of Artificial Sequence: Synthetic coding sequence
atgaccgccagcgccagcagcttcagcagcagccagggcgtgcagcaaccctccatatacagcttcagccagatcactcggtccctgttcctgtccaatggggtcgctgccaatgacaaactcctgcttagcagtaatcgtatcactgctatcgtcaacgcctctgtcgaagttgtcaacgtatttttcgaggggatccagtacattaaggtccccgtgactgatgcacgagactctcgcctgtatgacttcttcgaccccatcgcagaccttatccatacaatcgacatgcgacaaggaaggaccctgttgcactgtatggcaggagtgtccagatcagcttccttgtgtcttgcttatctgatgaaatatcacagcatgtctttactggacgcccacacttggactaagtccagacgacctatcatccgccccaataatggcttttgggagcaactcataaattatgaattcaaattatttaacaataacacagtccggatgattaatagtcctgtgggaaacattcccgacatatatgagaaagacctgcggatgatgataagcatgtag

SEQ ID NO: 23746 - DNA, 3576 bp, Artificial Sequence
  Description of Artificial Sequence: Synthetic coding sequence
atgctgcggaagctgaccatcgagcagatcaacgactggttcaccatcggaaaaactgtgacaaatgtggaactgcttggagcccctcccgccttccccgcaggggctgcccgggaggaggtgcagagacaggacgtcgctccaggtgcaggccccgcagcgcaggctcctgcacttgcacaggcccccgccaggcctgcggccgcgttcgagcgatccctgtcccagcggtcatcagaggtggaatatattaacaagtacaggcagttagaggcgcaggaacttgatgtatgcaggtccgtgcagccgacctccggccctggccctagaccctccctggcaaagctgtcaagtgtgacatgtattccgggtactacgtataagtatcctgacctgccaatcagcaggtataaggaagaagtcgtgtccctgatagaatctaatagcgtcgttatcatccacggcgcgacggggtcgggcaagtccactcagctgccacagtacattctggatcactatgtgcagcgaagcgcttactgttcaatcgtggtgacccagccacgaaagatcggcgccagctccatcgcaaggtggattagtaaggagcgcgcctggacactggggggtgtggttggttatcaagtgggtctggagaagattgccacagaggacactcggttgatctacatgaccaccggagttctgctgcaaaaaatcgtgtccgcaaagagcttaatggaatttacacatataatcatcgacgaggtgcatgaacgcactgaagaaatggacttcctgttactggtcgtcagaaaactgctgagaaccaattcacgctttgtcaaggtcgtgctcatgtctgccacgatcagttgtaaggaattcgcggactactttgcggtacccgtgcaaaacaagatgaacccagcgtatattttcgaagtagaagggaagccacacagtgtcgaagagtactacctcaatgatctcgagcatatccatcattccaagctcagcccacacctgttagaagaacccgtgattaccaaggatatctatgaagtagccgtatctctgatccagatgttcgacgatctggatatgaaagaaagcggaaacaaggcatggtctggcgcacaattcgtcctggaacgctcctcggtccttgtctttctcccaggccttggtgagattaactatatgcacgagttgctgacctctctggtccataagaggctgcaggtgtaccctctgcacagtagcgtggcgttagaagagcagaataacgtgttcctgagtccagtgcccgggtatagaaagatcattctaagcacaaacatcgctgaatcttcagtgacagtgcccgatgttaagtatgtaattgacttttgtctgacacggacgctcgtgtgtgacgaggataccaactaccaatccttacgactgagctgggcaagtaagacatcttgcaaccagcgaaagggcagagccggccgcgtcagccgggggtactgttacaggctcgttcacaaagacttttgggacaactcgattcctgaccatgtcgttccggaaatgcttcgctgcccactcggctctacaatcctgaaggttaaactgttagatatgggagaaccgagagctctcctcgcaaccgctctctcgccacccggactgagcgatattgaaaggactattctgctgttaaaagaagtgggcgctttggctgtctccgggcagagagaggacgagaaccctcatgacggtgagctgacttttttgggccgcgtgctggcacagctgcctgtgaatcagcagttgggcaaactaatagtactgggacacgttttcggttgcctggacgaatgcttaatcatcgccgccgcattgagcttaaagaacttcttcgctatgcccttccgccaacacttggatggctataggaacaaggttaactttagtggctctagcaaatctgattgtatcgcgttagtggaggcgttcaagacgtggaaagcctgtcggcagaccggcgagctaaggtaccccaaggacgagctcaattggggcagattgaactacattcagatcaagcgtatacgggaggtggctgaactgtacgaggagctgaaaacaagaatttcccagttcaatatgcatgttgacagcagacggccagtcatggaccaggaatatatctataaacagcgcttcatcctgcaggttgtactcgcaggggccttctatcctaattacttcacatttggtcagcccgacgaagaaatggctgtgagggagcttgccggcaaagatccaaaaactactgttgtgctgaagcatatccctccttatggctttctgtactataagcagttgcagagtctgtttagacaatgtggtcaggtgaaatccattgtgttcgatggagctaaggcgtttgtggagttctctagaaatccaactgaacggttcaaaaccctgccagccgtatatatggctattaaaatgagccagctgaaggtgagcttggaactaagcgtccactcagccgaggaaattgagggaaaggtgcaaggcatgaatgtgagcaaactgcgcaatacccgggtcaacgtggatttccaaaagcagaccgtggaccccatgcaggtcagtttcaacacttcagaccgttctcagactgttactgatctgcttctgacgatcgatgtaacagaagtggtggaggtgggacacttttggggttatagaatagatgagaacaactctgagattctcaaaaaactcactgccgaaattaaccaactcactctggtccctctccccacccacccgcacccagacctcgtctgtctggccccctttgcggacttcgacaaacagaggtactttcgagcccaggtgctgtacgtttccggtaatagtgccgaagttttctttgtggattacggcaacaagtcgcacgtggatctccacctcctgatggagatcccttgccagttcctggaattaccctttcaagcgctcgagtttaaaatctgcaaaatgcggccatctgccaagtccctggtttgcgggaaacattggtccgatggagccagccagtggttcgcttctctggtgtcaggatgtacgctattggtcaaggtattttctgtggtacactcggtgcttcacgtagatgtatatcagtacagcggtgttcaggatgctatcaatatcagagacgttttgattcaacaaggctacgctgaactgacagaggagtcttacgagtctaaggtgaacattctacgcgccgcaataaataaattagtttgtgatggcccaaatggatgtaaatgcctcggacctgagcgggtggcccagctgcaggacatcgccaggcagaagttgctgggattattttgccagtctaagcctcgcgagaagattgtgcctaaatggcacgaaaagccatatgaatggaaccaggtcgatcccaaactggtcatggaacaagctgatagggaaagcagtcgcggcaagaacacttttctttaccagctgcacaagctggttgtcctaggaacctag

SEQ ID NO: 23747 - DNA, 906 bp, Artificial Sequence
  Description of Artificial Sequence: Synthetic coding sequence
atgacccggcacggcaagaactgcaccgccggcgccgtgtacacctatcacgaaaagaaaaaagataccgctgccagcgggtacgggacccagaacattagactctcgagggatgcggtgaaagattttgactgttgctgtctgtccttgcaaccatgccacgaccctgtagtgacaccggatggatatctatatgagagagaggcaatcctggagtatattttgcaccagaagaaggagatcgcccgccagatgaaagcttatgagaagcagcgaggcactcgacgagaggaacagaaggaactgcaacgcgccgcatcacaggatcatgttaggggcttcctggagaaggaatcagctatcgtctctagaccacttaacccttttacagccaaggccctgagcggtacgtccccggacgacgtgcagcctggaccaagcgtggggccgccgtccaaggataaggataaggtgttgcctagtttttggataccctctctcaccccagaagccaaggcaaccaagcttgaaaagccttcaaggactgtgacctgcccgatgtccggaaaacccctgcggatgtctgacctaacacctgtccacttcacgccactggattcctccgtggatagggtgggtctgatcacacggagcgagcgatatgtttgcgcagtgaccagagactctctctccaatgctacaccatgtgccgtcctcaggccaagcggcgctgtcgtaaccctggagtgcgtagagaaactcatacgcaaggatatggttgacccagttaccggtgataagttaacagatcgcgacatcattgttctgcagaggggaggtactgggttcgcaggatcgggagtcaaacttcaggctgagaagagccgccccgtgatgcaggcatag

SEQ ID NO: 23748 - DNA, 1509 bp, Artificial Sequence
  Description of Artificial Sequence: Synthetic coding sequence
atgcagagctgcgagagcagcggcgacagcgccgacgaccccctgtcacggggtctccgtagacggggccagccaagagtcgtggtgattggagcgggattggcaggacttgccgctgccaaggcattgcttgaacagggattcacggacgtcactgtgttagaggcttctagccatatcgggggaagggttcagtcggttaagcttgggcatgcaaccttcgaactgggcgcaacatggatacatggatcacacggcaaccctatataccacttagctgaggcgaatgggctgctggaagagaccacagatggtgaacgaagtgtaggccggatcagtctgtactcaaaaaacggagttgcctgctatctaaccaaccacggccgcagaattccgaaagatgttgtggaggagttttcagatctttacaatgaagtgtataaccttacccaggagttttttcgccatgataaaccggtgaacgcagagtctcagaacagtgtgggggtattcacacgtgaggaggtccggaataggatcaggaacgatcctgacgacccggaagctacgaagcgcctaaaacttgcgatgatccagcagtatttgaaggtggaatcttgcgaaagcagcagccactccatggatgaagtatctctttccgccttcggtgagtggaccgaaattcccggggctcatcatataatcccctccggatttatgcgagtagtggaattgctggcagaaggaattccagcccatgtgatccagttaggaaagcccgttcggtgcattcactgggatcaggcttcagcacgcccgcgaggtcctgagatcgaaccacggggagtcctgaagagacaatacacaagcttttttcgcccaggactgcctaccgaaaaagtcgccgcaatccatcgtctgggtattgggacaaccgacaaaatttttctggagtttgaggagcccttttggggtcccgagtgtaactctctccagtttgtgtgggaagacgaggctgaaagtcacaccttgacatacccccccgaactatggtaccgaaaaatctgcggtttcgatgtactttacccaccagagcgctacggccatgttctctcaggatggatctgcggtgaggaagccctggtgatggaaaaatgtgacgatgaggcggtggccgagatttgtaccgagatgctcaggcagttcacaggcaatccaaatatacccaagcctcggcggattttgcgctccgcatgggggtctaatccctactttcggggatcttactcctacactcaggttgggagttccggcgccgacgtggagaaactggccaaacctttgccttataccgagagttccaagaccgcccctatgcaagtgcttttctccggcgaagccactcatagaaagtactatagcacaactcatggggcattgctgtcaggtcagagagaagctgctagactgatcgaaatgtaccgtgatctgtttcagcaaggaacctag

SEQ ID NO: 23749 - DNA, 579 bp, Artificial Sequence
  Description of Artificial Sequence: Synthetic coding sequence
atgggcaccttcgacctgtggaccgactacctgggcctggcccacttggtgcgtgctctgagcggtaaggaaggacccgagacaagactttctccccagccagaacctgaacccatgcttgaacctgtatctgccctcgagccaatgccggcgcctgagtctgtaccagtccctgggccaaaagatcagaaacggtccctcgaatcgtctccggcccccgagcgcttgtgtagtttctgcaaacacaatggcgaatctagagcaatctaccaatctcacgtgctgaaggatgaggctgggagagttctatgcccgatcctacgcgactacgtgtgcccacagtgtggcgccacccgagaacgagcgcacaccaggcgcttttgccctttaactggacaagggtacactagtgtttacagtcataccacccgtaatagcgccgggaagaaacttgtccggcccgacaaggcaaagactcaggacactggtcacagaagggggggtggcgggggcgcgggcttcagaggtgctggaaagagcgagccatctccctcctgttcacctagcatgtcgacttag

SEQ ID NO: 23750 - DNA, 2568 bp, Artificial Sequence
  Description of Artificial Sequence: Synthetic coding sequence
atggccgtggaggacagcaccctgcaggtggtggtgcgggtgcggcctcccacaccacgcgaactagatagtcagcgtaggcccgtcgtacaagtcgtcgacgagcgggtgctggtgttcaaccccgaggagccggacggcggattccccggactgaagtggggcgggacgcatgatggacccaagaaaaagggaaaggatctgaccttcgtttttgacagggtgtttggcgaggcagctacccaacaggacgtgtttcagcatacaacccactccgttttggactccttccttcaggggtacaattgctccgtttttgcctacggcgctacaggagccggaaaaacgcataccatgctcggtcgcgagggagacccaggaatcatgtacctgactactgtcgagttgtatcgccggctggaggcacggcagcaggagaagcatttcgaagtattaatcagttaccaagaggtctacaacgaacagatccatgatctgctggagcccaaaggacccttggcaatacgggaagatcctgacaagggggttgtggtacagggtctttcatttcatcagccagcctcagcagagcaactacttgagatccttactcgtggcaaccggaatagaacccaacatcccacggatgcgaatgccacctcgagccgctcccacgcaatcttccagatattcgtgaagcagcaagatagggtgcccggcctgacacaagctgtccaagttgcgaagatgtccctcatcgacctggctggatcagaacgggccagtagtactcatgccaagggcgagcgtctgagggagggagctaatatcaatagatccctcctcgcgttaataaacgtcctgaacgccctggctgacgcgaagggtagaaagacacacgtgccctatcgcgactccaagttaacacggttactgaaagatagcctgggcggaaactgcaggactgttatgattgccgctatctctccctcctcgctgacatatgaagacacttacaacacgctcaagtatgccgatagggctaaggaaatcaggttgtcactgaagagtaatgtcacgtccctggattgtcatatcagccagtacgcaaccatctgtcagcaactgcaggcagaagttgcagcactgcggaagaagcttcaggtttatgaaggcggcggtcagccccctccgcaggacctccccggtagccctaaatcaggcccccccccagaacatcttccatcctcccccctccccccgcacccaccttcgcagccatgcacccccgagctcccagccggaccacgcgcactgcaggaggagtccctagggatggaagcgcaggtggaacgcgccatggagggcaatagcagtgaccaagagcaatcccccgaagacgaggacgagggacctgccgaagaggtgcctacacaaatgccggaacaaaatcctactcacgcactcccagagtctccacgactcactcttcagcccaagcctgtagtggggcacttctctgccagggaactggatggcgatagaagcaagcagttggccctaaaagtgctgtgcgtggcccagagacagtacagtttgttacaggccgctaatctgttaacacctgacatgataacggagtttgagactcttcagcaactcgtacaggaggagaagatcgaacccggcgcagaagccttaagaacctctggactggccaggggcgcccctctcgcccaggagctttgctccgaaagcaagccacccggttatactgggccagtcacgagaacgatggcacgccggctgagtgggccgttacatacgctgggtatccctccaggaccaaactgtacgcccgctcagggctcaagatggccgatggaaaagaaacggaggcgcccctcagctctcgaagcagactctcctatggcgcctaaacgtggtactaagagacaaaggcagtcatttctgccttgtctacgccgcgggtctctgcctgatacacagccttcacaaggcccttccactcccaagggagagcgagcctcgagcccctgccactcaccaagggtctgtcctgccactgtgataaagtcgagggtacctctgggccccagcgccatgcagaactgtagtaccccccttgctctgcccaccagagacttaaacgccacatttgacctgtcggaagagcctccatctaaacccagcttccatgaatgtattgggtgggacaagattccacaggagctgtcaagactggatcagccctttataccaagagcacccgttccactgtttacaatgaaaggccccaagccaactagctccctaccaggcacctccgcttgcaagaaaaaaagagttgcctcaagttctgtgtcacacggccgttcgcgaatcgcccggctcccgtcttcaactttaaaacgccccgcgggtcccctcgtcttaccagaactgcctttgtcacctctctgcccttctaatcgccgaaacggtaaagatctcatccgcgtgggaagggccctgtctgccggcaatggcgtgaccaaagtgagctag

SEQ ID NO: 23751 - DNA, 444 bp, Artificial Sequence
  Description of Artificial Sequence: Synthetic coding sequence
atgtggaagttccccggcggcctgagcgagcccgaggaggacatcggtgacaccgcagtccgtgaagtgttcgaggagacaggtattaaaagcgaattccgctccgtactgtctattcgccagcagcacacaaaccccggggccttcggtaagtctgatatgtacatcatttgtaggctaaagccatatagttttactatcaacttctgccaagaggaatgcctgcgatgcgaatggatggatctgaacgatctggccaagacggagaatactaccccaatcacttccagagtcgcaagactactcctttatgggtacagagaaggctttgataaaattgacttaacagttgaagaactccccgcggtctacaccggcctattctataagctgtatcacaaagagctccccgagaattataaaactatgaagggcatcgactag

SEQ ID NO: 23752 - DNA, 3327 bp, Artificial Sequence
  Description of Artificial Sequence: Synthetic coding sequence
atggccctgcggcccggcgccggcagcggcggcggcggcgccgccggggccggcgccgggagcgccggcggcgggggtttcatgttccccgttgctggcggtatccgacccccccaggccgggctgatgcccatgcagcaacagggcttccccatggtgtctgtgatgcagcccaatatgcaggggatcatggggatgaattattctagtcagatgagccagggacccatagcaatgcaggcgggaatccccatgggacccatgcctgcagctggaatgccatacttgggccaagcacccttcctgggtatgcggcctccagggccccagtatacacctgatatgcagaaacagtttgccgaagagcagcaaaaaaggttcgaacagcagcaaaaactcctggaggaggaacggaaacgaaggcagtttgaagaacagaaacagaagctgaggttactcagttctgttaaacccaaaacgggagaaaagtccagagatgatgctctggaggctatcaagggaaacctggatggcttcagtcgtgacgcaaagatgcacccgacacctgcttcgcaccctaagaagcccggtgtgggtgtgtttcccagccaagatcccgcacaaccacgcatgcccccttggatttacaatgagtcccttgtgccggacgcgtacaagaaaatcctggagaccactatgacccctactggtattgacacagccaagctttaccctatcctgatgtcaagcggtctgcctcgtgagaccctgggacagatctgggctctcgcgaaccggacaacgccaggaaagttgacgaaagaagagctgtatacagtcctggctatgattgctgtaactcaagtggtgaagccggaggaagacgattttcaggattttcaggacgcctctaagtctggctcattggatgattctttctctgactttcaggaattacctgcttcctccaaaacttccaacagccagcatgggaactccgctcccagccttctcatgcccctccccggcacgaaagccttacccagcatggataaatacgcggtctttaaaggcatcgctgccgacaagtcttccgaaaataccgtgccaccgggggacccaggcgacaagtactccgcgtttcgcgagctggagcagacagcagaaaacaagcccctcggggaatcattcgcggagttccgctctgccggaacagatgatggttttaccgatttcaaaaccgccgactccgtgtctccactggagccaccgaccaaagacaaaacatttccaccttctttcccctctgggaccatacagcagaagcaacaaacacaggttaagaatcctctgaatctagcagacctggatatgttttcatccgtaaactgctctagtgagaagccgctgtctttctcggctgtgttcagcacttccaagagtgtgtccactcctcaatctacaggctctgctgccacaatgaccgcactggctgctactaagacctcatctctagccgacgatttcggcgagttttctctctttggcgaatactccggccttgcaccagtgggagaacaggatgactttgctgacttcatggccttttccaatagcagcattagcagcgagcagaagcctgatgacaaatacgacgctctgaaggaggaggccagtccggtcccgttgaccagtaacgtcgggagtacagttaagggggggcagaattctactgccgctagtacgaaatatgacgtgtttcggcagctgagccttgagggaagcggtttaggtgtagaagatcttaaagacaacaccccttccggcaaaagtgacgacgactttgccgactttcactcctcgaaattttcctccatcaattctgataaatccttaggtgaaaaggccgtcgcgttccgtcatacaaaggaagacagcgccagcgtgaaaagcctggacctgccatctatcggaggctcatctgtgggcaaggaagatagtgaggacgccctcagtgtgcagtttgacatgaaattggcagacgtgggcggggatctgaaacacgtgatgagcgactcgtccttggacttaccaacagtgtccggtcagcatccacctgccgctgctggatctggcagcccttctgcaacatcaatactgcagaagaaagagacttcattcggctcttcagaaaatattactatgacttcccttagcaaggtcacgacattcgtctccgaggatgctttgcctgagactacttttcctgctctggcctccttcaaggacacaattccccaaacctccgaacagaaggagtatgagaaccgagattataaggatttcacaaagcaggacttacccacggcggaaagaagtcaggaagccacttgccctagccctgcttcatccggggctagtcaagaaaccccaaacgagtgttcagacgacttcggcgagtttcagtccgaaaagcccaaaatttcgaagtttgatttcttggtggccacctcccaaagcaaaatgaagagtagcgaagagatgatcaagagtgagctggccacctttgatctgagcgtgcaggggtctcacaaaagatccttgtctctgggggacaaagaaatcagcaggtctagcccatccccagcgttggaacaaccgtttcgagacagatcaaataccttaaatgaaaagccggcattaccagtaatccgggataagtacaaggaccttactggcgaggtagaggagaatgagaggtatgcctacgaatggcagagatgtctaggctcagccttgaatgtcatcaagaaagccaacgacacgctaaacggaatttcttcttcctcggtttgtaccgaagtaattcagagcgctcaagggatggaatacctgttgggtgtcgtggaagtgtaccgcgtgactaaacgagtcgagttaggcataaaagccacagcggtctgcagcgagaagctccagcagcttctgaaagatattgataaggtctggaacaaccttattggctttatgtcattagcaactctgacccccgacgagaattccctggacttctcctcttgcatgctcaggcctgggattaagaacgctcaggagctggcctgcggggtgtgcttgctgaacgtcgattccagaagtcgcaaggaagaaaaaccagccgaagagcaccccaagaaggcattcaattccgagactgacagcttcaaactagcatacggaggacaccagtaccatgcaagctgcgcgaatttctggattaactgtgtggaaccaaagcctcccgggctggttctgcctgacctactttag

SEQ ID NO: 23753 - DNA, 1257 bp, Artificial Sequence
  Description of Artificial Sequence: Synthetic coding sequence
atggagacccacatcagctgcctgttccccgagctgctggccatgatttttgggtatttagacgtgcgagacaaggggagggccgcccaagtgtgcactgcatggagagacgctgcgtaccacaagagtgtatggcggggggtggaggccaagcttcacctgcggcgggctaatcctagcctattcccatcccttcaagcacgcggcatacgccgtgtccagatactttccctccggcgatccctgtcctacgtaatccaaggaatggctaacatcgaatctctgaacttgtccggatgttataatttgactgacaacggccttggccatgcattcgttcaggaaattgggtcgttaagggctctaaatttgtctctgtgtaaacaaatcaccgacagctccctgggaaggatcgctcaatacctgaaaggcctggaggtcctggagttgggaggttgttccaacatcactaacacaggtctgttactgatcgcctggggcttgcaacgacttaagagtctgaatctgaggagctgtaggcacttatctgacgtcggcattgggcatttggcggggatgacgagaagcgccgccgagggatgtttgggcttggaacagctcaccttgcaggactgccagaagctcacagacctgtcgctgaaacatataagcaggggcctcaccgggctcagattgctgaatctgtcattctgcggcggaatcagcgacgccggtttactccacttgtcacacatgggaagcttgaggagtttaaaccttcgctcctgtgacaatatttcagatactgggataatgcatctggccatggggagcttgcgtctgtctgggctcgatgtgagcttttgtgataaggtgggagaccaaagtctcgcctacatcgcacagggattggacggtctaaaatctttaagcctgtgttcatgccatattagtgatgacgggattaacaggatggtaagacaaatgcatggtcttcggacactgaatatagggcagtgcgtccgaattactgataaaggactagaattgatcgcagaacatctaagccagttgaccggaatcgacttgtacgggtgcacacggatcaccaaacgcggtttggaaagaattactcagctgccatgcctcaaggttctgaatctcggcttgtggcagatgacagactccgagaaggaagccagaggcgacttctcgcccctattcactgtacgcaccaggggaagttcacggcgctag

SEQ ID NO: 23754 - DNA, 1371 bp, Artificial Sequence
  Description of Artificial Sequence: Synthetic coding sequence
atggccgccgccctgaagtgcctgctgaccctgggccggtggtgccctgggctgggagtcgctccccaggcccgcgctctcgctgccctggttcctggcgttacacaagttgataataaatccggtttcctacagaaaagaccacataggcagcatccaggcattctgaaactacctcacgtcagacttccacaggctctcgcaaacggggcgcagttgctcctgctgggctctgcaggacctacgatggagaatcaggtacaaacactcacttcgtacctctggtctcggcatctgcccgtcgaaccggaagagctacagcgccgcgccaggcatctggaaaaaaagttcctcgaaaatccagacttaagtcagacagaggagaagctaaggggtgctgtactgcacgcattaagaaaaaccacctatcactggcaggaactttcttacaccgaggggctgtcgctggtgtacatggcagcaaggttagacggcggatttgctgccgttagccgggcttttcacgaaattagggcaagaaaccctgcttttcagccccagactcttatggattttggatccggaaccgggtcagtaacgtgggccgcacacagtatctgggggcagtctttgcgggaatatatgtgcgtagataggtccgcggctatgcttgtgcttgccgaaaagctgctgaagggcgggtccgaaagtggggaaccttatatcccaggagttttctttcggcagtttttgccggtgtcccccaaagtgcagtttgacgtggtggtttctgcatttagtctttctgaattgccatctaaagcggatcgcaccgaagtcgtgcagaccttgtggagaaagaccggccactttctggtcttggttgagaatgggactaaagccggtcactccctcttgatggatgcgagagacctggttttgaagggaaaagaaaagtccccactggaccctcgcccaggattcgtgtttgctccctgtccccacgagctgccttgcccacagctaacaaacttagcttgttctttctctcaggcctaccaccctataccattcagctggaataaaaaacccaaagaggaaaagttcagtatggtgatattagcacggggtagcccggaggaagctcaccgttggcctcggataacccagccggtgctgaaaagaccgagacatgtgcactgtcacctctgttgtcccgatggccacatgcagcacgcagtccttaccgctcggcggcatggcagagatctctaccgctgtgcccgcgtctcgtcttggggtgacctgctgcccgttttgacacctagcgcctttccaccatcgactgcccaggatccttcggagtcgtag

SEQ ID NO: 23755 - DNA, 756 bp, Artificial Sequence
  Description of Artificial Sequence: Synthetic coding sequence
atggacatgaagcggcggatccacctggagctgcggaaccggaccccagctgctgttcgagagttggtcctggataactgcaagagcaacgacggtaaaattgaggggctgacggccgagttcgtcaatctggaatttcttagcttaatcaacgttggtctgatttccgtctccaacttacctaaacttccaaaacttaagaagttagagctcagcgaaaatcgtatttttgggggtctggatatgctggccgagaaattaccgaaccttactcacctgaatctttcgggcaataaactgaaggatatttcaactctcgagcctctcaaaaaattggaatgcctgaaatctcttgacctgttcaactgcgaagtgacgaatctaaacgattacagggagtccgtcttcaagttgttaccgcagctcacatacctagacggatacgaccgggaggatcaggaggcccctgattctgacgcagaggtggacggagtcgacgaagaggaagaggacgaagagggcgaagatgaggaagatgaggatgacgaggacggcgaggaagaggaattcgacgaggaagacgatgaggatgaagacgtggagggggacgaggatgatgatgaagtttctgaagaagaggaagaattcggattagacgaagaggacgaggacgaggatgaagacgaagaggaggaagaaggaggcaagggggagaaaaggaaacgagaaaccgatgacgagggtgaagatgactag

SEQ ID NO: 23756 - DNA, 510 bp, Artificial Sequence
  Description of Artificial Sequence: Synthetic coding sequence
atgagcgccccccccgccctgcagatccgggaggccaacgcccacctagcggccgtccaccgccgcgccgctgagctggaagctagactggatgcggcggaacgaacagtgcacgcgcaggcggagcggctggcgctacacgaccaacagttaagagcagcactcgatgagcttgggagagcgaaggatagggagattgctacactgcaagaacagcttatgacatcggaggccaccgttcactctctgcaggcgacagtacaccagagggacgagctcatccgtcagctgcaaccgcgggccgaactgcttcaggacatttgtagacgccgcccaccattggccggcctactcgacgctctggccgaggcagaacgcttaggacccctgccggctagtgatcctggtcatccccctccaggcgggcccggacctcccctggataactcgacaggtgaggaggcggatcgcgatcacttgcagcctgccgtctttgggacaactgtgtag

SEQ ID NO: 23757 - DNA, 2079 bp, Artificial Sequence
  Description of Artificial Sequence: Synthetic coding sequence
atgaagatcttctgcagccgggccaaccccaccaccggcagcgtggagtggctggaagaggatgagcactacgactaccaccaggagatcgctaggagttcctacgccgacatgctacatgataaagatcggaacgtcaaatactatcagggcatcagggccgcggtgtctcgcgtgaaggaccgcggacaaaaggctctcgtgctggacatagggactgggaccggcctgctgagcatgatggcagttacagccggtgctgacttttgctatgcaatcgaggtgttcaagcccatggcagatgcagccgtgaagatcgtcgaaaagaacgggtttagcgacaagatcaaagtgattaataagcattctactgaggtcacagtgggccctgagggcgatatgccctgtcgtgcaaacatcttggttactgagctatttgacaccgagcttattggcgaaggcgccttgccaagctacgagcatgcacatcgacatctggtcgaagagaattgtgaagctgtcccacatagggcgacagtctacgcgcagctggttgaatcaggaaggatgtggtcgtggaacaagctgttcccgattcacgtccagacaagtctgggcgaacaggtgattgtgccacccgtcgatgtcgagagctgcccgggagctccgtctgtgtgcgatatacaactgaaccaggtgtccccagcagattttacagtactgagcgacgtgctaccaatgttctccatcgactttagcaaacaggtctcctcctccgccgcttgtcattccaggcgatttgaacctcttacaagcgggagagcacaggtagtcctgtcgtggtgggatattgagatggaccctgagggaaaaatcaagtgtactatggctccattctgggctcactcagaccccgaagagatgcaatggcgcgatcactggatgcagtgcgtctactttctgcctcaggaagaacccgtggtgcagggatcggcactgtatctcgtggcccaccacgatgactattgtgtgtggtatagtctacagcggacatctccagagaagaatgaaagagttcgccagatgcggcccgtctgtgactgccaagcccatttactgtggaaccggcctcgatttggggagatcaacgatcaggataggaccgatcgatatgttcaggccctgcggacagtccttaagcccgacagtgtgtgcctttgcgtgtccgacggaagcttgttgtctgtccttgcgcaccatttaggcgtcgaacaggtgtttaccgtcgagagctcagccgcttcccacaaactgctccgcaaaattttcaaagcaaatcatctggaagacaaaattaatattattgagaagagacctgagctcctgacaaacgaggacctgcaaggccgcaaggtaagtctcctgctgggggaacccttcttcaccacctcactgttaccctggcacaatctctacttctggtatgtgcggaccgccgttgatcagcacctcggcccgggcgccatggtgatgccccaagccgcaagcctgcatgctgtggtggtggaattcagggacttgtggcgcatccggtcaccatgtggagactgtgaaggatttgacgttcatatcatggacgatatgatcaaacgggccctggatttcagagagagtagagaggcagagccccacccgctctgggagtacccctgtcgtagcctctctgagccttggcagattttgaccttcgacttccaacagccagtccctttacaacccctttgcgccgaaggcacagtggagctccggcgtcctggtcagagccacgccgccgtgctgtggatggaatatcatctgactccagagtgcactctgtccaccgggctactcgaacccgcagaccccgaaggcgggtgttgctggaacccacactgcaaacaagctgtctatttcttttctccggcgcctgacccacgggccctgcttggagggcctcggactgtaagttatgccgtggaattccaccccgatactggcgacattattatggagtttaggcacgccgacacacctgactag

SEQ ID NO: 23758 - DNA, 468 bp, Artificial Sequence
  Description of Artificial Sequence: Synthetic coding sequence
atgaccgtggagggccccccccccaaggacaccggcatcgcccgggtccctctcgcaggggccgcaggcggccccgggattggtcgagctgcgggcaggggcatacccgctggagtccccatgcctcaagctcctgctggactggcgggacccgtgagaggggtgggggggccctcacagcaggtcatgaccccacaggggagaggcaccgtcgctgcggccgctgccgctgcaacggcttctatcgcaggcgccccaactcagtatccgcccggtcgaggggggcctcctcctcccatgggtcgcggcgcgcctccgcctggcatgatgggcccgcctcctggcatgaggccaccaatgggccctcccatgggcattcctcccggaagggggactccgatggggatgccgcccccaggaatgaggcctcccccacccgggatgagaggaaaatgcctccagtggtag

SEQ ID NO: 23759 - DNA, 402 bp, Artificial Sequence
  Description of Artificial Sequence: Synthetic coding sequence
atgacccggggcaaccagcgggagctggcccggcagaagaacatgaagaagcagtccgattcagtgaaaggaaagcgccgggatgacggcctgagcgcagccgcaagaaaacagtctgctccctcgtctcttcctcccgggactagaagaagctgttcgcgcagccgtaaaagacagacgagacgcagacgaaacccgtcttcatttgtggcctcttgccctacactgctgccatttgcgtgtgtgccgggcgcgagcccaacgaccctcgccttccctcccgtcgtgcttaccgggcccagcactgatgggatcccgtttgccctgagcttgcagcgcgtgccgttcgtgcttccatcccctcaggtggccagcctgcccttaggtcactcgagaggctag

SEQ ID NO: 23760 - DNA, 1809 bp, Artificial Sequence
  Description of Artificial Sequence: Synthetic coding sequence
atggccgagttccgggtgcgggtgagcaccggcgaggccttcggcgccggtacttgggataaagttagcgttagcattgtagggacaaggggcgaaagcccacctcttcctctggacaacctgggtaaggagtttaccgcaggggccgaggaggactttcaagtaaccctgcccgaagatgtgggcagggtgttattgctaagagtccacaaggcgccaccggtattgccccttcttggccctttggcccctgatgcctggttctgtcgctggttccaattgaccccccccaggggaggacacctgttattcccttgttaccagtggctagagggcgcgggtacactggtgctgcaagagggtaccgcaaaggtaagttgggccgaccatcaccccgtgctgcagcagcagcgacaggaagaactccaagcacggcaggagatgtaccagtggaaagcctataaccccgggtggccacactgccttgacgagaagacggtagaggatttggagcttaatataaaatatagcacagcgaagaatgccaacttctacctacaggccgggtcagccttcgccgaaatgaaaatcaagggactcctcgatagaaagggtctgtggcgcagcctcaacgaaatgaagagaatcttcaacttccggaggacccccgctgctgagcatgcttttgagcattggcaggaagatgccttttttgccagtcagtttttgaatggcctcaatccagtcctgattcgcaggtgccactacctgcctaagaactttcctgttacagacgcaatggttgcttccgtgctgggtcctggcaccagcctgcaagctgaactggagaagggtagcctatttcttgtcgatcacggaattctctcaggtatccagacgaatgtaattaatgggaaaccgcagttttcagccgcaccaatgactctgttgtaccagagcccgggatgcggccccctgttacctctggccatacaattgagccagaccccaggccctaatagtcctatctttctgcctacagacgacaagtgggactggttgctggcaaagacctgggtccgaaacgccgagttctcttttcacgaggcgcttacacacctcctccatagccatctccttcctgaagtgttcacattagccacgctcaggcagctgccccattgccatccactgttcaagtctacaggcatcgggattgaaggtttcagtgagctaatacagcgcaacatgaaacaactgaactacagcctgctgtgtctgcccgaggacattcggactaggggtgtcgaggacattcctggttattactaccgcgacgatgggatgcagatctggggtattccctcaagcctagaaacccgggaggctctggtgcaatatgtaaccatggtcatcttcacatgcagtgccaaacatgccgccgtgtcagccggacaatttgattcctgtgcatggatgccgaatctcccgccaagcatgcaattgccacccccaacgtccaagggcctagccacctgtgagggcttcattgcaactttaccaccagtcaacgccacttgcgacgtgatccttgcactttggctgctgtcaaaagaacccggcgatcagcgcccccttggcacttaccccgatgagcattttaccgaagaggctccccgcaggtccatcgccaccttccagagccgcctggcacagatttcccggggcatccaggaacgcaaccaggggttggttctgccctacacttacctggatccacctctgattgagaattccgtgtctatctag

SEQ ID NO: 23761 - DNA, 3123 bp, Artificial Sequence
  Description of Artificial Sequence: Synthetic coding sequence
atggtgagcagcgcccagatgggcttcaacctgcaggccctgctggaacagctgtcccaggacgaactgagcaaattcaaatacctgattacaaccttcagcctcgctcacgagctgcagaaaatccctcacaaggaagtcgataaggcagacggcaaacagcttgtggaaattctgacaacccattgtgactcttactgggtcgagatggcatcactccaggtgtttgaaaagatgcatagaatggacctgtctgagcgggcaaaggacgaagttagagaagcggcactcaaatcttttaacaagcgcaaacccctgtccctggggatcactcggaaggagcggcctcctctggacgttgatgaaatgctggagcgtttcaagacagaggcccaggacaaggataacaggtgtcgctatatattgaaaacaaaatttcgagaaatgtggaaatcttggccgggcgacagcaaggaagtacaggtgatggcagagcggtacaagatgctcatcccattctctaatccacgagtgcttccagggcctttctcatatacggtcgtcctctatgggcccgctggcctcggcaaaacgaccctggcacaaaagttaatgctcgattgggcagaggacaatttgattcataagtttaagtacgcgttttatctctcatgtcgcgagttatcccggctaggcccatgttctttcgctgaactcgttttccgggactggcctgaactgcaggatgatatcccccacattcttgcccaggccaggaagatcctgtttgtcatcgacggctttgatgaactgggtgcagcccccggggcattaattgaagatatctgcggtgattgggagaagaagaaacctgtcccagttctgttaggatctttgcttaaccgtgtcatgctgcccaaggccgccctgttagtcacaaccaggccaagggcactccgcgatctcagaatacttgcagaggaaccaatctatattcgcgtggaagggtttctagaggaggacagacgcgcgtacttcctgcgacacttcggcgacgaagatcaagccatgcgcgccttcgagctcatgcgctctaatgctgctctgttccagcttggcagtgcacccgccgtctgttggatagtatgtacaaccctgaagcttcaaatggagaagggtgaggacccggttcccacctgcctgactcggacaggactgttcctgcgctttttgtgttcgagatttccccagggagctcagttgaggggcgcactgaggacattatctctccttgcagcccaaggactctgggctcaaacaagtgtgctacaccgagaggacctggaacgtctgggagttcaggaatccgatctgaggttgttcctggacggggatatcctacgacaagatcgggtaagtaagggctgctacagcttcattcacttatcatttcagcagttcctcaccgcgctgttctacaccttggagaaagaagaagaagaagaccgtgatggccacacttgggacattggcgacgtgcaaaaactcctgagtggggtcgaacgactccgcaatcccgacctcatccaggctggctactatagcttcggcttggctaacgagaaacgggctaaggagctggaggccacattcggttgtaggatgagtccagacatcaagcaggagcttctaaggtgcgatatttcatgcaagggcggtcacagcacagtgaccgatctgcaggagcttttggggtgcctgtatgaatcccaagaagaggagctcgtgaaggaagttatggctcagtttaaggagatttccctgcacctgaatgcggtcgatgtggttccatccagtttttgcgtcaagcactgcaggaatctccagaagatgtcactgcaggtgataaaggagaatctgccagaaaatgtcaccgcaagtgagagcgatgccgaagttgagaggtcacaagatgatcaacacatgctgcctttttggacagatctctgttcaattttcgggtccaataaggacttaatgggcctggccattaatgactcatttctgtccgctagtctggtccggattctgtgcgaacaaattgctagtgacacttgccatcttcaacgggttgtctttaaaaatatctccccggccgatgcccatcggaacctttgtcttgccctccgggggcataagaccgtgacgtatttgacactgcagggtaatgatcaggacgatatgttccccgcgctatgtgaggttttaagacacccagaatgcaacctgaggtaccttggtttggtctcatgctccgctacgactcagcagtgggctgatctgtcattagccctggaagttaatcagtctctgacgtgtgtcaatctgagcgacaacgaactgttagatgagggtgccaagctgttatacacaactcttcgacacccaaaatgcttcttacagaggttatcactcgagaattgccacctgacggaagccaactgcaaagacttggctgccgttctcgtggtatccagagaattaacccacctgtgcctcgccaagaatccaatagggaacacaggcgtgaagtttctgtgcgaggggctcagataccctgagtgcaaactgcagacccttgtactatggaactgtgacataacgagtgacggctgctgtgatcttaccaaactcctacaggaaaaaagttccctgctttgcctggacctaggcttgaatcacattggcgtgaaaggaatgaaattcctgtgcgaggccctgcgtaagcccctgtgcaaccttcgatgtctctggctctgggggtgctccattcctcccttctcatgcgaggacttgtgctccgcactgagttgcaaccagagtcttgtaactcttgatctggggcagaatcctctggggagtagcggagtcaagatgctatttgagaccctgacatgctcgagcggaacactcagaactcttcggctcaagatcgacgacttcaacgatgagctcaataaattgctcgaggagattgaagagaaaaaccctcagctaattattgacacagaaaagcaccacccttgggcagaaaggccatccagccacgactttatgatctag

SEQ ID NO: 23762 - DNA, 3864 bp, Artificial Sequence
  Description of Artificial Sequence: Synthetic coding sequence
atggtgcccggcgaggagaaccagctggtgcccaaggaggcccccctagaccacacctctgataagtccttgctggatgccaattttgagcccggaaagaaaaatttccttcacctgacggacaaagatggcgaacagccgcagatcctactggaagactctagtgcgggcgaggatagtgtccatgacaggtttatagggccactgccccgggaggggtccgggggcagcacatcggattacgtatcccagtcatatagttactctagcatcctgaacaaaagtgagactggatacgtcggacttgtcaatcaggctatgacatgttatcttaattcattactgcagactctctttatgacaccagaatttagaaatgctttatataaatgggaatttgaagaaagcgaagaagacccagtgaccagcataccttatcagctccagcgtctcttcgtactgcttcagacttcgaagaagcgggcaatagagacaaccgacgtgactcgctcctttggctgggactcatccgaggcttggcagcagcatgacgtgcaagaattatgcagggtcatgtttgacgcactcgagcagaagtggaagcagactgaacaggcggatctgatcaatgagctgtatcaggggaagttgaaagattacgtgcgctgtctagaatgcggctacgaaggatggaggatcgatacttatctcgatattcccttggtgattcgcccttacggctcctcccaagcttttgccagtgttgaggaagctctgcacgctttcatccagccggagattctggatggacccaatcaatatttctgtgagcgctgcaagaaaaaatgcgacgcgcggaagggcctacggtttcttcactttccctacctccttacacttcagctgaagcgtttcgacttcgactatactacgatgcatagaatcaaactaaatgatcgaatgacctttcctgaagaactggacatgagtacctttatcgacgttgaggatgaaaagtctcctcagactgagtcgtgcaccgactctggagcggagaatgaaggatcctgccactctgaccagatgagcaatgacttttccaatgacgacggtgtggatgagggcatctgtctagaaaccaactcgggcaccgagaagatctcgaagtcaggcctggaaaaaaattccctgatctacgagctgttttctgtgatggttcattccggatccgccgccggtggacactactacgcatgcattaaatcattctccgacgagcagtggtactccttcaatgaccaacacgttagccgcataactcaggaggacattaagaaaactcacggtgggtcaagtggaagccgggggtactattcgtcagccttcgcatcaagcactaatgcctacatgttaatctacaggttaaaagaccccgcccggaacgcaaagttcctggaggtggatgagtaccccgaacatattaaaaatctggtgcagaaagagagagaacttgaagagcaggagaaacgccagcgcgagattgagcgtaatacatgcaaaatcaaactattctgtctgcatccaactaaacaggtgatgatggagaataagttggaggtgcacaaagataagactttgaaggaggcggtggagatggcttataagatgatggatttggaagaagtcataccactggactgctgcagactcgtcaagtacgacgagttccacgattacctggagaggagctacgagggcgaggaggacacccctatgggcctgcttttgggcggcgtgaaatccacctacatgttcgaccttctactggaaacgagaaagcctgatcaggtatttcagtcatataaaccaggtgaagtgatggtgaaggtgcacgtcgtggatctgaaggcggaatctgttgccgcgccaattactgtgcgggcatatctaaatcaaactgtaactgagttcaagcaactgataagcaaagcaattcacttaccggccgagacaatgcggattgttttggagagatgctacaacgatcttagactcctgtccgtgagttctaagactttaaaagccgaggggttttttagatctaacaaagttttcgtggagagcagtgagacactcgattaccagatggcattcgctgattctcacttgtggaaactcctcgacaggcacgccaataccattcggctcttcgtgttattacctgagcagagccctgtctcctattcaaaaagaacggcctaccagaaagcaggcggggactccgggaatgtggatgacgattgcgagagagtgaaaggccccgttgggtccctcaagagtgtcgaggctattctggaagagagcacagagaaattgaaatctctctccctgcagcagcaacaagatggagacaatggggactctagcaagagtactgagacttctgatttcgagaatattgagtcgcctcttaacgaacgcgactcttccgcttccgtggacaacagagagttggaacagcacatccaaactagtgatccagagaatttccaatccgaagaacgcagcgacagcgatgtcaataatgatcggtccaccagtagcgtggatagcgatattctgtcttcgtctcactcctcagataccttatgcaatgctgacaacgcacagatcccgctggcaaacggactcgattcccattctattaccagctccagaagaacaaaagccaacgaagggaaaaaggagacttgggacacagccgaggaggacagcgggacagactctgaatatgacgaatccggcaaaagcagaggagagatgcagtatatgtactttaaagctgagccatacgccgccgacgaaggcagtggcgaaggtcacaagtggctgatggtgcacgtcgataagagaatcacactcgccgcatttaaacagcatcttgagccctttgtgggagtcctaagctcccacttcaaagtgtttcgtgtatacgcatctaatcaagaattcgagtcagtcagattaaatgaaaccctgtcctcattttctgatgacaataagattaccataagattgggccgggctctcaaaaaaggggaataccgggtcaaggtttaccagctccttgtgaacgaacaggagccgtgcaaattcctgctcgacgcagtctttgctaagggcatgaccgtacggcaatctaaagaggaactcatccctcagctgagagagcaatgcggactggagttatcaattgataggtttagattgagaaagaagacatggaagaatcccggtacagtgttcctcgactaccacatatatgaagaggacatcaacatatccagtaattgggaagttttcctcgaggttctcgatggagtagaaaagatgaagagtatgagccagctagctgtactgtcgcgtcggtggaagccgagtgagatgaaacttgatccgtttcaggaagtcgtcctcgagtcatccagtgtggacgaactgagagaaaagttaagcgagataagcggcattcctttggacgacattgaattcgcgaaaggtagaggaaccttcccatgtgatatctctgtacttgatattcaccaggacctggactggaatcccaaggtttctactctgaatgtctggcccctgtacatatgtgacgatggagccgtgattttttacagggacaagactgaagaactgatggagctgaccgatgagcaacgtaacgagctgatgaaaaaagagtccagcaggctacagaagacgggtcatcgtgtgacctacagccccagaaaggagaaggctttgaagatctatttggatggggctcccaataaggacttgacgcaggactag

SEQ ID NO: 23763 - DNA, 420 bp, Artificial Sequence
  Description of Artificial Sequence: Synthetic coding sequence
atgccctggcgggccggcaacggcgtgggcctggaggcccaggccggcacccaagaagcagggcccgaggaatactgtcaggaggagttaggggcggaggaggaaatggccgcccgcgccgcctggccagtgctccgctccgtcaattctagagaactctcccggatcattatctgcaatcacagcccacgtattgtgctaccagtttggcttaattactatgggaagctgcttccctatctcacgctgttaccagggagagattttcgtattcacaacttccggtcccacccctggctgttccgtgatgctcgcacccacgataagttgctggtcaaccagacagagctcttcgtgccgtcttcaaatgtgaatggccagccagtgtttgcaaatatcacacttcagtgtatcccatag

SEQ ID NO: 23764 - DNA, 582 bp, Artificial Sequence
  Description of Artificial Sequence: Synthetic coding sequence
atggagggctgcgtgagcaacctgatggtgtgcaacctggcctactctggcaagctagaagagctgaaggagtccattctagcggataaatcattagcaactaggacagaccaggccggttggagcccattgcacattgctgcctccgccgggagggatgagatcgtaaaagcactcctcggcaagggcgcgcaggtcaacgctgttaaccagaatgggtgtacccccctccactatgcagcgagcaagaacaggcacgagatcgcagtcatgctgttggagggtggcgctaaccctgatgccaaagatcattatgaggctacggccatgcacagagcagctgccaaaggcaaccttaagatgatccatatcctactgtactacaaggcttccacaaatatccaggatacagagggtaatactccacttcacttagcgtgcgacgaggagcgagtggaggaggcgaagctgctggtttctcagggcgccagtatatacatcgaaaataaggaggagaagactccactacaagtggcaaaaggaggtctggggctgatcctcaagcggatggtcgaaggatag

SEQ ID NO: 23765 - DNA, 612 bp, Artificial Sequence
  Description of Artificial Sequence: Synthetic coding sequence
atgagcgagaacgccgcccccggcctgatcagcgagctgaagctggcagtcccctggggacatatcgcagcaaaagcctggggatcgctccaagggcctcccgtgctctgtttgcatggctggttagacaacgctagcagctttgaccggctgatcccactgcttccccaagacttttactatgtggccatggattttggcggccacggactttcttcccattactcacccggcgtgccctactatctccagactttcgtttctgagatacgtagagttgtagcggcactgaagtggaatagattttcaatccttggccatagtttcgggggagtggtgggcggaatgtttttctgcacgtttcccgaaatggttgataaattaattcttttagacactccgctgttcttgctggagtcagacgaaatggaaaacctgctgacttataagcgcagggccatcgaacacgtgttgcaagtggaagcgtcgcaggagccctcacacgtattctctctgaagcagctgctgcagaggcaaagaactgcacttacctcaagcgccggaagttgtgtgaggatcccctcggggtcatgtaggccaatgagttgttag

SEQ ID NO: 23766 - DNA, 765 bp, Artificial Sequence
  Description of Artificial Sequence: Synthetic coding sequence
atgcccgccggcagcatgagcaccaccggctaccccggcgtgtgctctactacttcatatcgaacgcactgctatatccctgtgaccagctctgtgactctatcctcctcagatctgagcccaactttcggccactgcctcccttcttcctaccagggtaatctgtggctgttggactactgtcaggaaagctacggagaggcccctacctgtaaatctccaagctgcgagccaaaaacatgctcaactaccggttgtgatccctcaaatagtagtgtgccctgcaactctccatccgcaggccaggtcttcagcgtgtgcgagaccactaatgtgtcaccatccccctcatgcagtccgagcacacagaccaatggttatgtctgcaattgtcacatccctaccaggaacgcctcaaaagcctgtcaaaccctccggaatggctctaattgctttggacagctaaattgtctttccaagtcgtttcagaccctgaaccactgcaggctttctacgttaggctacaagtcgtatcagaacccttgtttcataccctcctacgtttcgccgctgtgctacatatccaattcttgccagccccagtcttacttagtgaggaattaccattatagttcctaccgtccaacatcctgcaggcctctgtcctacctgagccgctcatttcggtctttgtcgtatataccctctaccttcccacccttgcgctacctttgctccggctcaagaccgctgaagtgttactag

SEQ ID NO: 23767 - DNA, 1338 bp, Artificial Sequence
  Description of Artificial Sequence: Synthetic coding sequence
atgcgggagatcgtgcacctgcaggccggccagtgcggcaaccagatcggggcgaaattctgggaagtaattagcgatgagcacggcatcgaccctaccggtacttatcatggagacagtgacctccagcttgaacggatcaacgtatactataacgaggccactggcggcaagtacgttcccagagcggttttagtggatctggaacccggcaccatggacagcgtccgaagtgggccatttggacagatctttaggcctgacaacttcgtgtttggccaaagtggcgctggaaacaattgggccaagggccattatacagaaggggctgagctcgtggatagcgtactagatgtggtgcggaaagaggccgagtcttgcgattgcttgcagggctttcagctgacccactcactgggcggcggaactggaagcggcatgggcacattgcttatatccaaaattcgcgaagagtatcctgacagaatcatgaacaccttctccgtagtaccttcccccaaagtcagcgatacggtggtagaaccttacaatgcaaccctgtctgttcatcagctcgtggagaacacagacgagacctattgtatagacaatgaggcactgtacgatatctgttttcgtactctgaagctgacaacaccaacctacggtgatctgaatcacctggtgagtgctactatgagtggcgttactacatgcttacgctttcctgggcagctcaacgccgaccttcgcaaacttgctgtgaacatggtaccttttccgcggctgcatttcttcatgcctggatttgcgcctctgacatccaggggtagccagcagtaccgagccctcaccgtcccagagctgactcagcagatgttcgacgccaagaatatgatggctgcttgcgatccacgacacgggagatatttaactgttgcagctgtcttcagggggcggatgagcatgaaggaagtggacgaacagatgttaaacgtgcagaacaaaaatagtagctactttgtggaatggatcccaaataacgtcaagaccgctgtgtgcgacattccacctaggggacttaagatgagtgcgacttttatcggcaacagcactgccatccaagagctattcaagcgaatctcagagcagttcacagctatgttcaggagaaaagccttcctgcattggtacacaggcgaaggaatggacgaaatggaattcacggaggccgaatccaatatgaatgacctggtttccgagtatcagcagtatcaagatgctaccgcagaagaagaaggggaatttgaggaagaggcggaggaggaagtcgcttag

SEQ ID NO: 23768 - DNA, 750 bp, Artificial Sequence
  Description of Artificial Sequence: Synthetic coding sequence
atggccgagcggggcgagctggacctgaccggcgccaagcagaacacgggagtctggctcgtgaaggtgcctaagtacctcagccagcagtgggccaaggcatccggaagaggcgaggtcggaaagctgcgcattgcgaaaacacagggtcgcacagaggtcagttttacactgaatgaagatttagcgaacatacatgatatcggtgggaagcccgcctctgtcagcgccccacgggagcaccccttcgtgcttcagagcgtgggaggccagacactgacagtgtttacagagtcctcctcagacaagctgagtctcgagggaatcgtggtgcagagagccgagtgccggccagccgctagcgagaactacatgaggcttaaacggcttcagatagaggaatcctccaagcctgtgcggctctcccaacagcttgataaagtcgtgacaactaattacaaacctgttgccaaccatcagtacaacatagagtatgagcgaaaaaagaaagaggacgggaaacgagcccgcgctgacaagcagcacgtattggacatgttgtttagcgctttcgaaaagcatcaatactacaatctgaaagacttggtggacatcactaaacagcccgtcgtctacctgaaagagatcctgaaggagatcggcgtccagaacgtgaaggggatccataagaatacttgggagttgaagcctgagtataggcactaccagggagaggagaaaagtgattag

SEQ ID NO: 23769 - DNA, 2511 bp, Artificial Sequence
  Description of Artificial Sequence: Synthetic coding sequence
atgtggagcctgggctgcgtgatcgccgagctgttcctgggctggcctttgtacccgggggcttcggagtacgatcagatccggtacatatctcagactcagggcctgcctgcggaatacctcttgagcgccggcactaaaacaacgagatttttcaatcgcgatcctaacttagggtaccccctctggcgcctcaagaccccagaagagcacgaactggagaccggtatcaagtcgaaagaagcacggaaatacatctttaactgcctagacgatatggctcaggtgaacatgagcacagatcttgaagggactgacatgctggctgaaaaggccgaccggagggagtatatagatctgctcaaaaagatgttgactatcgacgccgataagcgcatcactcctcttaagacgctgaatcatcaattcgttacaatgacacacctccttgatttcccccattccaaccatgttaaatcatgctttcaaaacatggaaatctgcaagaggcgggttcatatgtatgatacagtgtctcagataaagagtcctttcacaactcatgtcgcaccgaacacgagcactaatctcacaatgagcttttcaaaccagctgaacacggttcacaatcaagcttccgtgctcgcatcgtcctctacagctgcggcagctactctctctttggctaatagtgatgtaagcctacttaactaccagagcgcgctgtaccccagtagtgccgcccccgtaccaggtgtagctcagcagggtgtaagcctccagccgggaactacacaaatctgtacgcaaacggacccatttcaacagacatttatcgtctgtccccccgcgttccaaactggtcttcaggccaccaccaaacacagcggattccctgtgcgcatggataatgctgtccctatcgtaccacaggcacctgccgcccagcctttacagatccagagtggggtgttaacccagggctcatgcactccgttaatggttgctacacttcacccacaagtcgccaccatcacgcctcagtacgccgttcctttcactctatcctgcgccgcagggcgaccagcactggtcgaacagaccgcagccgtgcttcaggcttggcccggcggtactcagcagatcctgctgcccagcacctggcagcagctgcctggtgtggcactccataattctgtgcagccgacggccatgatccctgaagcgatgggaagtgggcagcagctggcagactggaggaacgcgcatagccacggcaatcagtattctaccattatgcagcaaccttccttgttgactaaccacgtaaccttggcaactgcccagcctctgaatgttggagtggctcacgtcgtccgacaacagcagtcttcctctctgcctagtaaaaagaacaagcagagtgctcctgttagtagtaagagctcacttgacgtcttaccttcacaggtttacagcctcgttggaagcagcccccttcggactactagctcatataattccctcgtgccggttcaggaccagcatcagcccataatcatccccgacaccccgtccccccccgtatctgttataacgatccgctccgataccgacgaggaggaagataataaatataagccttcatccagcggactcaagccgcgatcgaatgtcatctcctacgtgacagtcaacgatagtcctgactcagatagctctctgtcgtctccctatagcacggacactctatctgccctgagggggaactctggatccgtgctcgagggcccagggagagtggtggcagatggaaccggcactagaaccattatcgttccaccactgaagacccagctcggcgattgtacagtggcgacacaggcctccggcctactgtcgaataaaaccaagccagttgcttccgtctccggtcagtcttcgggctgctgtatcacaccaaccgggtatagagcccagagaggcggaacatccgctgcgcagcccctgaacttgagccaaaatcagcagagttctgctgcccccacctctcaggagcggtccagcaaccccgcccccagaaggcagcaggcttttgtcgctcctttaagccaggccccatatacgttccagcatggaagcccactgcactcaacagggcacccccacctggcacctgcccctgcccacttgccatctcaggcacatctctatacatacgctgccccgaccagtgctgcagccctggggtccacttcctctatcgcgcacctcttcagcccacagggctcttcccggcacgcagccgcatacacaactcatcccagcaccctggtacaccaggtgcctgtcagcgtgggtccttctctgctgaccagcgcgtccgtggctcccgcgcagtatcagcaccagttcgcgacacagagttatataggatcatcacgtggctctactatttacacaggttacccattgagcccaacaaagatctctcagtactcttacctgtag

SEQ ID NO: 23770 - DNA, 2352 bp, Artificial Sequence
  Description of Artificial Sequence: Synthetic coding sequence
atgagccaggtgaagagcagctacagctacgacgcccccagcgactttatcaacttctctagcctggacgatgagggggacacccagaatatcgactcttggtttgaggaaaaagccaacctggaaaacaagctcttaggaaagaacggaacgggcggcctgttccaaggcaaaacacctctgagaaaagccaacctgcagcaagcaattgtgacaccgctgaaacctgtggataatacatactacaaagaagctgaaaaagaaaacctggtagaacagagcattccaagtaatgcatgctccagtcttgaggtcgaagccgctatctccaggaagactcccgctcagccccaaaggcgatcgcttagactgtctgcccagaaagatcttgagcagaaggagaaacatcatgtgaagatgaaagccaagagatgcgccacccctgtgattatcgacgagatcttgccatcgaagaagatgaaggtcagcaacaataaaaagaagcccgaggaggaaggatcagcacaccaggatacagccgagaaaaacgcgtcatcaccagagaaagccaaggggagacatacagtgccctgtatgccccctgccaaacagaagttcctgaagtccacagaagagcaagagttggagaagtcgatgaaaatgcagcaggaagtcgtggagatgcgcaagaagaacgaagagttcaagaagctggcgctcgccggtatcggtcaacctgtaaagaagagtgtgtcccaggtgaccaagtctgtagatttccatttccggacggacgagaggataaagcagcacccaaaaaaccaagaagagtacaaagaagtgaattttacgagtgaactaaggaaacaccctagtagtccagcacgcgtcaccaaaggttgcacaatcgtgaagccatttaacctctcacagggcaagaagcgtacatttgacgagacagtgtccacctacgtgcctctagcacaacaggtggaggatttccacaaaagaacaccaaatcgctatcatctgcggtctaaaaaggatgatattaagactggcagctgcagcgtcactcaggctggagtacaatggagagaccacggatcactgcagtgcccgacgcctgggctcaagcagagctcctgcctgtctctgccgaatttattgccgtcgaagagctccgttacgaagatttgccgcgacccacagactcccgtgttgcagacaaaacacagagctagggccgtcacttgcaagtccaccgccgagctggaagctgaggagctggagaaactgcagcaatataagtttaaggcacgcgagttggatccgcgaatcctcgagggcgggcctattctgccgaaaaagcctcccgtgaagccacccactgagccgattggtttcgatctagaaattgaaaaacgaattcaagaacgggagtccaagaagaaaacggaagacgagcatttcgagttccactcccgcccgtgtcccaccaagatcttagaggatgttgtcggagtcccagagaaaaaggtccttcctatcactgtgcctaaaagtcccgccttcgcactgaagaatcggatcagaatgcccactaaggaggatgaggaggaggatgaaccggttgtgattaaggcgcaacctgttcctcattacggtgtgccgtttaagcctcaaatccccgaagccagaactgtagaaatttgtccattttcttttgattctagggacaaggagcggcagctgcaaaaagagaagaagatcaaagaacttcagaagggcgaggtgccaaagttcaaggcattgcctctgccacattttgacactattaacttgcctgaaaagaaagtgaaaaacgtcactcagattgaacccttctgtctagagacagaccggcgcggcgctctcaaagcccaaacctggaaacaccagctggaggaggagctccggcagcaaaaggaggccgcctgctttaaggcccggccgaacacggtgatcagccaagagcctttcgttcccaagaaggagaagaagtccgttgcggaggggttgagtggtagcttagtacaggaacccttccagctggctactgaaaaacgagctaaggaacgccaggagttggagaagcggatggccgaagtcgaagcccagaaggctcagcagctggaggaggccaggcttcaggaggaggagcagaagaaagaggaactggccaggctcaggcgggaactcgtccacaaagcaaatcctatccgaaaatatcagggcctcgagatcaaaagttcagatcaacctcttaccgtgcccgtgagccctaagttttccacccggtttcactgttag

SEQ ID NO: 23771 - DNA, 2061 bp, Artificial Sequence
  Description of Artificial Sequence: Synthetic coding sequence
atgggcagctacctgagcgtgcccgcctacttcaccagccgggacctattccggtgcagcgaatgtcaggatagtttgacgaattggtactacgagaaggatggaaagttgtattgccccaaggattattggggaaagttcggggaattttgtcacggctgttctctgttaatgactggtccatttatggtggctggcgagttcaaatatcacccggagtgcttcgcatgtatgagttgcaaagtaataatagaggacggtgatgcctacgctcttgtgcagcacgccacactgtactgtgggaagtgtcacaatgaggtggtgctagctcccatgttcgaacgcttaagcacagaatcagtgcaggaacaattgccctactcagtcactctgatttcaatgcctgccacgaccgagggccgacgaggcttctcggttagtgtggaaagcgcatgttcgaactatgccaccaccgttcaggtgaaggaggtgaacagaatgcatatcagccccaacaaccggaatgctatccatccaggcgataggatcctggagatcaacggcacccctgtgaggaccctccgcgtcgaagaggtggaggacgctatcagccaaacgtctcagacccttcagctgttaattgagcacgaccccgtatcccagaggctggaccagctacggctggaggcacgactggcccctcacatgcagaatgcggggcatccacacgccctgagtacccttgacacgaaggagaatttggaagggacgctgaggagacgtagccttaggcgatccaatagcatctcaaaatctccgggccctagctctccaaaggaacctctgctgttcagcagagacatcagcagaagcgagagtctgcgttgtagttcctcttactcacagcaaatctttcggccttgcgacctgatccatggagaggtgctaggaaaagggtttttcggccaggcaatcaaggtcactcacaaggctacaggcaaggtcatggtgatgaaggagctgattaggtgcgatgaggaaacacagaaaacctttctgaccgaagttaaagtcatgcgcagtctcgatcacccaaacgttctcaagtttataggggtcctctataaggataagaagctgaacttgctgaccgagtacatcgaggggggcaccttaaaggattttttgagaagcatggatcctttcccctggcagcagaaggtgcgcttcgccaagggaattgcctcgggcatggcttatttacactcaatgtgcattatccacagagatctcaactcgcataattgcctcattaagttagacaagaccgtggttgtagccgattttggactatcacgcctcatcgtcgaagagcgtaagagagcacccatggaaaaggccacaaccaaaaagcgcactctcagaaagaatgacaggaagaagcggtatacagtggtcggcaacccttattggatggccccagagatgctgaacgggaagagctacgacgaaacagtggacatcttttcattcgggattgtgctgtgcgaaatcatcggacaggtgtacgctgacccggactgcctgccacgaactctagactttgggctgaatgtaaaactgttctgggagaaatttgtcccgacagactgcccaccagcattcttcccactcgctgcgatatgctgccgtctcgaaccagaaagcagagcccccccgggggctgctggtgagggtcccggctgtgctgacgacgaaggtccagtgcggcgccagggaaaagtcaccattaagtacgaccccaaggagctccgcaaacacctgaatctcgaagaatggattttggaacaactgacacgcctgtatgattgtcaagaggaggaaatctctgagctagagattgatgtcgatgagctcctcgatatggagtctgacgatgcttgggcctctagggtcaaggagctattggtcgattgctataaaccgacagaggcctttatcagcggactgcttgacaaaatcagggccatgcagaagctgagtactccacagaaaaaatag

SEQ ID NO: 23772 - DNA, 840 bp, Artificial Sequence
  Description of Artificial Sequence: Synthetic coding sequence
atgcgggccctgaccgtgcagcgggtgaagttcgccatggacctgccgctactgaagcgggctggacaagatctagccgagaaaaccaaaaactttgtttcaagatcactcgtcatcggggaggttcttagtatggccgacatggctaccggcgtgaaatgcggcattatatactggttattcggcggcgctattagaaaccttgggtcccccgagcatgtgacaaaatggtttcagcccctacaggagcaaaagtataccggcatgttcgcgatgactgagcgcggacatggatctaacgctagaggcattcagactgaggccacatttgacctaagcgcacaagaattcgtgatagatacaccttgcgagaatgccgaaaaaatgtacattggtaatgcgatgtacggaaattatgctgccgtgttcgcccagttgatcatcgacggacgaagccagggtccccactgcttcatcgtccctgtacgcgatgagaatggttccctttatcccggcgtaacggcaattgacatgatgtacaaggaggggttgcacggggtggacaatggaatattgatttttgacaaggttcggatacctagggagaatctgctcgacaagtttggctccgttgcccccgatggccagtatcactccccgattcgtaataagtcagcccgctttaacgcaatgctcgcggccctaaccccgtctagattggcagtggcatttcaggcaatgggggcgatgaaattgggcctgactattgctataagatactcccaccggagtagaataatctcccaaaactgctgttcggcccccgcaggcctttactag

SEQ ID NO: 23773 - DNA, 597 bp, Artificial Sequence
  Description of Artificial Sequence: Synthetic coding sequence
atgaccctgcggtgcctggagcccagcggcaacggcggcgagggcaccagatcgcagtggggcactgctggcagcgccgaggaaccctcccctcaggcagcgagactggcaaaggcattgcgcgagctcgggcaaacaggctggtactggggctcaatgacagtcaacgaggctaaagagaagctcaaggaagccccagaggggacctttttgatcagggactcctcacattctgattacctgttgactataagtgtgaagacatctgcaggcccgacaaacctgcgcatcgagtatcaagatggcaagtttagactcgattctattatttgtgtaaagtccaaactgaagcagttcgatagcgtggtccacctgattgactactacgtccaaatgtgcaaggataagcggactggccccgaggcaccacgcaatggcaccgtccatctttacctgaccaagcctctctatacttctgcgccatcactgcagcatctttgccgcctcacaataaataaatgcacaggagccatatggggactgcccctgcccacccggctgaaggattatcttgaagagtataagttccaggtgtag

SEQ ID NO: 23774 - DNA, 570 bp, Artificial Sequence
  Description of Artificial Sequence: Synthetic coding sequence
atggaggccgacggcgacggcgaggagctggcccggctgcggagcgtgtttgccgcctgtgacgcgaataggagcggccggctggagagggaggaattccgagccctgtgtaccgaactaagggtccggcccgctgatgctgaggccgtttttcagcgcctggatgcagatcgggacggggcgattacgtttcaagagtttgcgcgggggttcctggggagtttaagggggggccgcagaagggattggggcccactggaccctgctcctgctgtaagcgaggctggccccgagacacatgactccgaagaagacgagggtgatgaggatgcggccgcggccctggccacctcttgcgggcctgccagccccggccgcgcctggcaggattttcaggctcggcttggcgatgaggccaagttcattccacggttcggatatacaatttctaaacctgctttcgtgttcgtgcgacacttgattacactgtgcgccttaagttgggccaaaaaggaaggtagagaaactctttggaccatagaagaaggaggggcgaagatggccgaatag

SEQ ID NO: 23775 - DNA, 300 bp, Artificial Sequence
  Description of Artificial Sequence: Synthetic coding sequence
gccctggacgtggccgtgaagaccttcccccccgagcggcacgtggctgtaaaatgttttgggaaaaaaaaggagaagaagaataacgctaactcccctgcttctgtgtctaacccaaccgtgaccaaacacgcgtttggaatggaggaggagttgcagagagagggaagcattgaaaccctttctaactccagtggcagtacgtcaggatccatcccacgaaactttgacggctacaggagcccactcccaacgaatgagtcccagcccctcagtctcttccctacaggatttccttag

SEQ ID NO: 23776 - DNA, 1170 bp, Artificial Sequence
  Description of Artificial Sequence: Synthetic coding sequence
atggagcggaaggacttcgagacctggctggacaacatcagcgtgactttcctgtccctgaccgatctgcaaaaaaacgagactttggaccatctgattagcttgagtggggctgtccagctgcggcatctgtccaataatctggaaaccctgctgaagagggactttctcaagctcctgcctctcgagctgtctttttacctgctgaaatggttagatcctcaaactctgctcacctgctgtctcgtctccaagcagtggaataaagtcatttccgcttgtacagaggtgtggcaaaccgcctgcaagaacctgggctggcagattgacgattcagtccaggacgccctccactggaagaaggtgtacctcaaggctatcttgcgaatgaagcagctggaagaccacgaggccttcgagacttcatccctcatcggccattccgcccgcgtgtacgctctctattataaggacgggctgctttgtaccgtgttcagcgtcgattacaatgatgagttggatatactggtctcaggctcagccgacttcacggtgaaggtgtgggcactctcggctggcacgtgtctaaacacattgaccggtcataccgagtgggtgacaaaggtggtgctgcagaaatgcaaggtgaaatctctcttgcatagtcccggcgattacattctcctaagcgccgataagtacgaaataaagatttggcctatcggaagagaaatcaactgcaagtgtctgaagacactatcagtgagcgaggatcgatcgatatgcctccagccaaggctgcattttgatggaaagtacatagtctgttcgagcgctttgggcctctatcagtgggatttcgcttcttatgacattctgcgggtgatcaagaccccagagattgcgaacctcgccctgctcggatttggggatatcttcgctttactcttcgacaatagatacctctatatcatggatcttagaaccgagagcctgatttcccgttggcctcttcccgagtaccgcaaaagcaaaagagggagcagttttcttgctggtgaggcttcatggctgaatggcctggatggacacaacgacaccggcctcgtgttcgccactagcatgcctgatcatagcattcacctggtcttgtggaaggagcatggctag

SEQ ID NO: 23777 - DNA, 2439 bp, Artificial Sequence
  Description of Artificial Sequence: Synthetic coding sequence
atgaagaagcagttcaaccggatgcggcagctggccaaccagaccgtcggccgtgctgagaaaaccgaagtgctgtctgaagacctactccaagtagagaaaaggttagaactggtgaaacaggttagccattccacccataagaagttgaccgcctgtctgcaggggcagcaaggtgctgaggccgataaacgctcaaagaaactccccctgactactctggcacaatgtttaatggaaggcagtgcgattttaggagacgacactcttttgggaaagatgctgaagctttgtggagagacagaggacaagctcgcacaagaactcatacacttcgagcttcaggtcgagcgggatgtgattgaacctctattccttcttgcggaggtcgaaattcctaatatacagaagcagcggaaacatcttgctaagttagtcctggacatggattcctcccgcactagatggcagcagacttcaaaatccagcggtctctccagttctttgcagccggccggggcaaaagctgatgccctgcgtgaagagatggaggaggcggccaacagggttgaaatatgtcgagaccagctgtccgctgatatgtattcatttgtggccaaagaaatagattacgcaaactacttccagactttaattgaggttcaggcagaataccacagaaaatccctgacactcctacaggcagtgctgccacagattaaagcccagcaggaagcttgggtggagaaaccctcgtttgggaagccactcgaagagcacctgactattagcgggcgggagatcgcgtttcccattgaggcttgcgtaactatgcttctagagtgtggaatgcaggaggaaggcctatttcgtgtggccccatctgcctctaagctgaaaaaactgaaggccgctcttgactgctgtgtagtggacgtgcaggagtatagcgctgaccctcatgcgattgccggggctctgaaatcctatctgcgtgaacttccagaaccgctgatgacctttgaactgtacgacgagtggatccaagccagcaatgttcaggagcaagataaaaaattgcaggccttgtggaacgcatgcgagaagttaccaaaggccaaccacaataatataaggtatctcattaagttcctcagtaagctgagcgagtatcaggacgtgaataaaatgactccttctaatatggcaatcgtcctgggtcccaaccttctgtggccgcaggccgaaggcaatattaccgagatgatgactactgtgagtctacagattgtgggaattatagaacctatcattcagcatgccgattggttcttccctggagaaattgagtttaacattaccgggaactatggatctcctgttcatgtgaatcacaatgcaaattattcttcaatgccatctcctgatatggaccctgcagatcgaagacagcccgagcaagcgaggaggccactttcagttgcgaccgacaatatgatgctggagttctacaagaaagacggaatgggagtgcgtgttatggacaccaattgggtagctagacggggctctagcgcgggtagaaaggtttcttgcgcacccccttccatgcaacctccggcccccccagccgagctggccgctcccctgcccagccccctgcccgaacaacccctggactcgcccgccgcccctgccctcagtccctctggcctgggcctccagcctggccctgaacgaacatcaacaacaaagtctaaggaactgagtcctggcagcgcccagaagggctctcccgggtcctcccaaggaactgcttgtgccggaacccagcccggggcccaacccggtgcccagccaggcgccagcccatctcccagccagcctccagcagatcaatctccacatactttaagaaaggtgtccaagaaactggcacccataccgccgaaggtgccctttgggcaacccggggccatggccgatcagagcgctggtcagccatcccctgtcagtctcagccccacacccccgagtacaccatctccttacggactgtcctacccacagggctattctctcgcaagcggacaactctctcccgccgccgcccccccacttgcttcgccaagtgtcttcacgagtaccctttctaagagcagaccgacgccaaagcctagacagcggcccacgctaccgccgccccagcctcccactgtcaaccttagtgcctcttcaccccagagtacagaggcgcccatgcttgacggtatgagcccaggcgagtcaatgagtactgatctggtccattttgatataccatcaattcacatcgagctggggtccactcttaggctttctccactggagcatatgaggagacatagcgtgacagataagagagactccgaggaggagtccgaatctactgccctctag

SEQ ID NO: 23778 - DNA, 1119 bp, Artificial Sequence
  Description of Artificial Sequence: Synthetic coding sequence
atgagcaagagcgagagccccaaggagcccgagcagctgcggaagctctttatcggagggctctcctttgaaaccacggatgaatctctgcgaagtcattttgaacagtgggggactctgacggactgtgtcgtgatgcgagatccgaacactaagagatcacgggggtttgggttcgtgacttacgcgacggtggaggaggtagacgcagccatgaatgcccggccacataaggttgatggcagggtggtggagccaaagcgcgccgtgtcacgcgaggactcacagcggcctggggctcacctgacagtgaaaaaaatctttgtggggggcatcaaggaggatacagaggaacaccacctccgtgactactttgagcagtatggtaagatagaagttatcgagatcatgaccgatagaggcagcggcaaaaaaaggggctttgcgttcgtgacattcgatgatcatgactcagtggataagattgtcattcagaagtatcataccgtgaacgggcacaactgtgaagtgagaaaggcgcttagcaaacaagagatggcctccgcctcaagcagccaaaggggcagaagcggctccggaaacttcggcggcggtcgggggggaggttttggagggaacgacaatttcggccggggaggaaactttagcggaagagggggtttcgggggcagcagaggtgggggaggctacggcgggtctggcgacggttacaatggcttcggaaacgatgggggttacgggggtggtggcccgggctacagtggtggctctcgcggttatggatccggcggccagggctacggtaatcagggaagcggttatggaggctcaggaagctacgatagttacaacaatggtggaggcggaggttttggtggcggaagcggctccaactttggcgggggcggctcttacaatgactttggcaactataacaatcaaagttccaacttcgggcccatgaagggcggcaacttcggaggacgcagttccggtccatacggagggggtggccagtatttcgctaaacccagaaaccaggggggttatggtggctcttcctcatcatccagttacgggagcggcaggcggttttag

SEQ ID NO: 23779 - DNA, 1491 bp, Artificial Sequence
  Description of Artificial Sequence: Synthetic coding sequence
atgaagctgggcaagaagcccatgtacaagcccgtggacccctacagccgcatgcaaagcacctataactataacatgagaggcggggcctatccccctcgctatttttatccatttcctgttcccccattgctataccaggttgagcttagtgtaggaggccaacagtttaatgggaaaggaaagacaagacaggccgcaaagcacgacgctgccgcgaaggccctgcgtatcctacagaatgaaccactgcctgaacggctggaggttaatgggcgagaatcggaagaggagaatctaaacaaaagcgaaatctcccaggtgttcgagatagcccttaaaagaaatctccctgtgaacttcgaagtggctcgagaatctggtccacctcatatgaagaattttgttaccaaagtgagtgtcggggaattcgtcggtgagggcgaaggtaagtcaaagaaaatctccaaaaaaaacgccgccattgccgtcctggaagaactgaaaaagttacctcctctgcctgccgtcgagagagtcaagcctcggattaaaaagaaaacaaagcctatcgtgaaacctcagacatcacccgaatacggacagggtataaacccaatctccagattggctcagatccaacaggccaagaaggagaaagagccagagtacacactcttgaccgagcggggactgcctagacgtcgtgagttcgttatgcaagtgaaagttggcaaccacactgctgaggggaccggaacaaataaaaaggtcgcaaagagaaacgccgccgaaaatatgttggagattttgggcttcaaagtgccgcaagctcagcccactaaaccagctctgaaatctgaagaaaagacccctataaaaaaaccaggggacggtagaaaggtgacttttttcgaacccggatcaggtgatgaaaacgggacaagcaacaaggaggacgagttcagaatgccctacctatcacaccaacagctacctgctggtatacttcccatggtgcctgaagttgcccaagcagtcggagtctcacaagggcaccacacgaaagactttaccagagccgcacctaaccctgccaaggccactgttacagccatgattgccagagagttgttgtacggcggcaccagtcctactgctgagactatcctgaaaaacaacatctctagcggacacgtcccacacggtcccttgacaaggccaagcgaacagcttgattatctgtcgcgcgtgcagggttttcaggtcgagtacaaagatttcccgaagaacaataaaaatgagttcgtgagtctcatcaactgttcatcccaaccccctctcatcagtcacggaatcggaaaggatgtcgagagctgccacgacatggccgccctgaacatcttgaagctgctgtctgagctggaccagcagtctacggagatgccccggaccggcaacgggccaatgtccgtgtgtggaaggtgttag

SEQ ID NO: 23780 - DNA, 5835 bp, Artificial Sequence
  Description of Artificial Sequence: Synthetic coding sequence
atgagcaacttctacgaggagcggaccaccatgatcgccgcccgggatctgcaagagttcgtcccctttggtcgggatcattgcaaacaccatcccaacgcactgaatcttcagctgaggcagctacagcctgcttctgagttgtggtcaagcgacggggccgccggcttagtcggctcactgcaggaggtgaccatccatgagaagcagaaggaatcttggcagctgcggaagggcgtcagtgagattggagaagacgtagattatgatgaagagctgtacgtggctggcaatatggtcatttggagcaaaggcagtaaatcacaggctttggccgtctataaggcctttacagtggattcacccgtgcagcaagctctatggtgtgatttcattatttctcaggataaatccgaaaaggcttatagcagtaacgaggtggagaaatgtatctgcattctccagtccagttgcataaatatgcattcaatcgagggaaaagactatattgcttctctgccttttcaggtggcaaacgtgtggccaactaagtatggcctgctgtttgagagaagtgcctctagccacgaggtgccacccgggtcccctcgtgagcccctccccacgatgttctctatgttacatccactggatgaaattactccgctcgtttgtaagtcaggaagtttattcggttcctcgcgcgtgcagtatgtggtagaccatgccatgaaaatcgttttcctgaacacggacccctcgattgtgatgacatacgacgcagtgcagaacgtgcattcagtatggacactgaggagagtgaaatcagaggaggagaacgtcgtgctgaaattctccgaacaggggggaactccgcaaaatgtggctactagtagctcactgacagctcatcttagatctctctccaaaggcgacagtcctgttacttcgccgttccagaattatagcagcatccacagccagagccgcagcactagcagtccatccctccacagccggagtcccagcatttcaaacatggcggcactgtcgagggcgcactcccccgctcttggtgtgcactcctttagtggcgtccagcggtttaacatttcatctcataaccagtctccgaaaaggcactcaatctctcacagcccaaattcaaatagcaacggctccttcctggcccccgaaactgagcccatcgttcccgagttgtgtatagaccacctctggaccgaaactataacgaacatccgagagaagaacagccaggcatctaaggtctttataacttccgacctgtgtggccaaaagtttctttgtttcttggtcgaatctcagcttcagttgcgctgcgtcaaatttcaggaatccaacgataaaacacagttgatattcggtagcgtcacgaatattcctgccaaagatgctgcccccgtggagaaaatagatacaatgctagtgctggagggctcagggaatctggtcttatatacaggcgttgtcagagtggggaaggtgttcattcccggcttgcctgcacctagtctgaccatgtccaatacaatgccacggccttcgacgcctttggacggggtgtccacccctaaaccgttgtccaaactgctgggaagcttggatgaagtggtgctactctcacccgtacccgagctaagggacagttccaaactgcatgactccctttacaatgaagactgcacctttcagcagctcggaacatacatccattctatcagagacccagttcacaatcgagtcaccctggagctatccaacgggagtatggtgcgcatcactatccccgagattgcgacttcagagctggtccaaacgtgcctgcaggctatcaagtttatcctgccaaaagagattgcagtacagatgctggtcaagtggtataacgtgcactccgctccagggggaccctcctaccactcggagtggaatctgttcgttacctgcttgatgaacatgatgggatataatacagatagattggcttggaccagaaactttgactttgagggctccttgagtccagtcatagccccgaagaaagctagaccctccgaaactgggtcagacgacgactgggagtatctgctgaattcggattatcaccagaacgtcgagtcccatttacttaatcggtccctgtgtctttctcctagcgaggccagccagatgaaggacgaggatttctctcagaatctgtctctggacagctcgaccttactatttacgcatataccagctatcttcttcgtactacatcttgtgtacgaagagttgaagctgaataccctaatgggagaagggatttgtagtttggtggagttgctggtgcaactggccagggaccttaaactcgggccatacgtcgaccactactaccgggactacccgacactggtgcgcactacaggtcaggtttgcacaatcgaccctggacagacaggattcatgcaccaccctagtttctttacaagcgagcctcccagcatttaccagtgggtttcaagttgtctaaagggggaaggcatgccaccttacccttacctgccgggcatctgtgagcgctcaagactggtcgtgctgagcattgccctttatatcttgggcgacgaatccttggtaagcgatgaatcatctcagtatctgacccggattaccatcgccccccagaagctccaggtcgaacaggaggaaaaccgattctccttcagacattcaacttctgtatccagtcttgccgagcgactcgtggtatggatgacaaacgtaggcttcacccttcgcgacttggagactcttcccttcgggattgcattacctattcgtgatgccatctatcactgcagggaacaaccagcttctgactggccggaggccgtctgcttactcattggccggcaggacctctctaagcaggcctgcgaaggcaatttaccaaaaggaaagtccgtgctgagctctgacgtaccgtccggcactgagactgaagaggaagatgacggcatgaacgacatgaaccacgaggtaatgtcactcatctggtccgaggatttacgggtacaggacgtccgaaggcttctccagagcgcacaccccgtgagggttaacgtcgttcagtaccctgagttgtcagatcatgagttcatcgaagaaaaagaaaacagactcctgcagctgtgccagaggaccatggccctacccgtaggtcgaggaatgtttaccctgttcagctaccaccccgtcccaactgagccactgccaatacctaagctcaatctcaccggtcgggccccacctcgaaataccacggtcgatttgaatagtggaaacattgacgtgcctccaaatatgacatcttgggccagttttcacaatggtgtggccgctgggttaaagatagcccccgcttcccagatagatagtgcgtggatcgtatacaacaagcctaaacacgccgagctggcaaatgagtacgctgggttcttaatggcacttggtctgaacggccacctgaccaagcttgccaccctcaatattcatgattacctgacaaagggccacgagatgactagtatcggcctgctgctaggtgttagcgctgccaaacttggcacaatggacatgagcattaccaggctgctgagtattcatatccctgcgctgctgcctccaacgagtactgagttggatgtgccacataatgtgcaggttgccgcggtcgttggaatcggactggtataccagggcaccgcccatcggcacacagctgaggtcctcctggctgaaataggcaggccaccgggccccgaaatggaatactgcactgatagagaatcctatagcctggcagcgggactggcactgggcatggtatgcctagggcatgggtccaacttaatcgggatgtctgatctgaatgtgcccgaacagttgtaccagtacatggtcgggggtcaccgcagattccagacagggatgcatcgagagaaacataagtctccctcctatcagatcaaggagggggatacaataaatgtagacgtgacatgtcctggcgccacacttgccctggccatgatttatctgaagaccaacaacagaagtatagctgattggcttcgagcacctgacaccatgtatttgttggactttgtgaaaccggagttcttattgctgagaacgctggctcgctgtctcatcctatgggatgatatcttgcctaactcaaagtgggttgactctaatgtgcctcagatcatccgcgagaactctatctcattgagcgaaatagagctgccatgcagcgaagatctgaatttggagacccttagccaggcccatgtgtatatcattgccggagcttgcctgtctctggggtttcggttcgccgggagcgagaacctctccgcgttcaactgcttacataagttcgcgaaggattttatgacttatctgtcagcccctaatgcaagcgtgactggcccacataatctagagacctgcctttctgttgtactgctctctctcgcgatggtgatggctggaagcggcaacctaaaagtcctccagctctgcaggtttctgcacatgaagactggcggcgagatgaattacgggtttcatctcgcccaccacatggctctcggcttgctgttcctcggcggcggacgttactctctgagcacttcgaattcttcaatcgccgccctgttgtgcgccttatatccccatttccccgctcactcaaccgataataggtatcacctgcaggctctgagacacctgtacgtgctggctgccgagccccgactgctggtccctgtggacgtcgacaccaacacgccatgctacgcattactagaggtcacctacaaggggacacagtggtacgagcagaccaaggaagagctgatggctcctacgctgctccctgagctccacctcctgaaacaaataaaagtcaaaggccctagatattgggaactcctgatcgacctttcaaaggggacccagcacctgaagagcatcctgagtaaggacggtgtcctgtacgttaaactcagagccggacaactgtcttataaggaagatcctatgggctggcagtcactgttagctcagactgttgctaatcgaaactctgaagcacgtgcattcaaacccgaaaccattagcgcctttacatctgatccagctctgctgtcgtttgccgagtatttttgcaagccaacagtaaacatgggccagaaacaggagatcttggacctgttttcgtcggtactctacgaatgtgtgactcaggaaactcccgaaatgctgcctgcgtacatagccatggatcaagccatccggcggctaggcagacgtgagatgtctgagacctccgagctctggcagatcaagttagtgctcgaattttttagtagtaggagtcaccaggagagattgcagaaccatccaaagcgcggtttatttatgaatagcgagtttctgcccgtggttaagtgtacgatcgacaacacactagatcagtggctgcaagtgggaggggatatgtgtgttcacgcatatttatctggccaaccattggaggaatctcagctctcaatgctcgcctgttttctcgtgtaccatagtgtacctgcgccccaacacctaccccctatcgggctggaaggctctacgagtttcgctgaactgctgttcaaattcaagcagctgaaaatgccagtacgcgctttgttacggctggctccactcttgctgggcaacccccagcctatggtcatgtag

SEQ ID NO: 23781 - DNA, 1263 bp, Artificial Sequence
  Description of Artificial Sequence: Synthetic coding sequence
atgctgaaggccgtgatcctgatcggcggcccccagaagggcaccagatttcggcccttatccttcgaggttcctaagcccctgtttccagtcgccggcgtccccatgatccagcaccatatcgaagcatgtgcccaagtgcctggtatgcaggagattctattgataggattttaccagcctgatgaaccactcactcagtttcttgaagccgcacagcaggaatttaacctgcctgtccggtacctacaggagttcgcacctcttgggactggggggggcctgtaccactttagagaccaaatattggctggctcccccgaggccttctttgtactaaacgccgacgtgtgcagcgattttccactgtcagccatgctggaagcacacagaaggcagcggcatcccttcctgctgctgggaactaccgcaaatcggacccagtcgttgaactacggatgcattgttgaaaacccgcagactcacgaggtgctgcattacgtggagaagcctagcacgtttatttctgatatcatcaactgcggcatttacctcttttcccccgaggccctgaaaccattgcgcgatgttttccagaggaaccagcaagatggacagctggaagatagccccggcctctggcccggcgcaggtacaattcggttggagcaggatgtgtttagcgccttggccgggcaaggacagatttatgtccatttgaccgacggaatttggtctcaaatcaagtctgccggctctgctctttacgcttctaggctttatctgtcacgctatcaggacacacaccccgaacgattagcaaagcacacaccgggcggtccatggatcaggggcaatgtttatatccatcctacagcaaaagtggcaccctccgccgttttggggccaaatgtttctatcggcaagggcgtaactgttggcgagggggtcagattgcgagaatcgattgttttgcacggagcaacacttcaggagcacacctgcgtccttcactccatcgtgggatggggtagcactgtcgggcgttgggcacgtgtggagggcacaccctccgatcccaatcctaacgacccgcgtgctcggatggattccgagtccttatttaaggacggaaagctccttcccgctatcaccatcctgggatgtcgtgtccggattccagcagaggtgctgatactgaacagtatcgtacttcctcacaaagagttatcccgctcattcactaaccagattatcctgtag

SEQ ID NO: 23782 - DNA, 1257 bp, Artificial Sequence
  Description of Artificial Sequence: Synthetic coding sequence
atgcgggagtgcatcagcatccacgtgggccaggccggcgtgcagatcggcaatgcctgttgggagctttattgtctcgagcacgggattcagcccgatggacaaatgccgtccgacaagactataggggggggggatgatagcttcaatacattcttttctgaaaccggtgccggcaaacacgtgccaagagccgtgttcgtagacctcgagccaacagttgttgatgaggtgcgaactggaacttatagacagctctttcatccagagcaactgattaccggcaaagaggacgccgctaacaactatgcgagaggccactatactattggcaaggaaattgtcgatttggtgcttgaccgcatccgcaagctggcagacctgtgcaccggattacagggatttctgatatttcattccttcggaggcggtactggcagcggtttcgcatccctcctgatggagagactgtctgtggattatgggaaaaagtccaaactcgagttcgccatttaccccgcccctcaggtctctaccgcagttgtggaaccttataactcaatcctaacaacacacacaacattggaacactcagattgcgcattcatggtggacaacgaagctatctatgatatttgtagacgtaacctcgacatcgaaagacctacatatacgaatctgaatcgcctcattggccaaatcgtttcaagtattaccgctagtctgagattcgacggagccctgaacgtcgatctgaccgaatttcagacgaatcttgtcccatatccacggatccactttcccctcgccacatatgcacccgtaataagcgcagagaaggcttatcacgaacagctgtctgtcgccgaaatcaccaatgcttgtttcgagccagccaaccagatggtgaaatgcgatccgaggcatggaaaatacatggcctgctgcatgctgtatcgcggtgacgtggtcccgaaggatgtcaacgctgccatcgcgacaattaaaacaaaaagaaccatccagttcgttgactggtgccctacggggtttaaggtgggaatcaattaccagccaccaaccgtagtacccggcggtgaccttgcaaaggtgcagagagccgtgtgtatgctgtctaatactaccgcgatcgcagaggcctgggctcgtctggacctggctgccctcgaaaaagactatgaagaagtaggtgtggattcagtggaagccgaggctgaggagggtgaagagtattag

SEQ ID NO: 23783 - DNA, 417 bp, Artificial Sequence
  Description of Artificial Sequence: Synthetic coding sequence
atgcagctgccccccttcgacatgtggaaggactacttcaacctgtcacaggtcgtgtgggctctgattgcgtcccgggggcagcgattggaaacgcaggaaatcgaagaacccagcccagggcctcctctgggtcaggatcaaggcttgggagctcccggtgcaaatggtggactggggacattatgcaacttttgtaagcataacggcgaatcgcgtcacgtttactctagtcaccagctgaagactcccgacggggtggtcgtctgtcctattttgaggcactacgtttgtccagtctgtggagccaccggcgatcaagcccacacgctcaagtattgccctctcaatgggggccagcaatcattatacagacgtagtggaagaaatagcgctggcaggagagtgaaacggtag

SEQ ID NO: 23784 - DNA, 375 bp, Artificial Sequence
  Description of Artificial Sequence: Synthetic coding sequence
atgcgggccagcccctgcatcagccagcccgccgccagctggcaccctagaccaagcgccctccgacctaccgctggatccggccctgatacccgcacaccggggacagtggaagacggctccgccccatgcccagcgttcagaagtcctgcagtcagtccatgcggtgaagagccctgttgctttcagatcagccccgctgaggagacacttgaattggggaggttagtcagccctggcaactgcgatactctcagcccccgggcagctgggttctatgcatgtcacgtaaggtcgctgatcccctgccggtccacaaagggtcgatggccgctgacggcgtccgccgccggcctgagttcctttagcggctag

SEQ ID NO: 23785 - DNA, 363 bp, Artificial Sequence
  Description of Artificial Sequence: Synthetic coding sequence
atggccgagcccagcagcgcccggcggcccgtgcccctgatcgagtccgagttgtacttcttgatcgccaggtatctaagtgccgggccctgtagaagggcggcacaggtgctggttcaagaactggaacagtatcagctgctgcccaagcgcctggattgggagggcaatgagcacaatagatcctatgaagaattagtgctgtccaacaaacacgtagcaccagaccatcttctgcaaatttgtcaacgaatcggacccatgctcgataaggaaattcctccatcaattagtcgggtgacctctctcttgggtgctgggcgccagtccctgctgagaacggctaagggaaccctaatctag

SEQ ID NO: 23786 - DNA, 2607 bp, Artificial Sequence
  Description of Artificial Sequence: Synthetic coding sequence
atgatccccaagagcctggtgcaggccgccgagacccagcggggcctctgcgagcccgggggtaaaggtcgcgaggggcgctccgggggcaagggtgagacacggcctcgaggcgttggcacccaggaagggaagggcaccatcccaggctcacctcgcgagaaacgtggcgaacgtggcgagggcgaccccgccctcctcccagctgaggacctgtggcgcctgcctggcagcaaggaccgactacgttcttcgcttctccccccccctggcccccccagttctgactctgggccaggacccccaagttcacatagcggcaagacagcccaggggccacgtactttgaattgggctcgcaaacagtccgcccgcacctcaagtaatctgtgcgcttggtctctggccatggctacaaaaatggctgagatccccagttccccctacgaacctggccagagggggatgaaagatactcagcggggggacgcaccccagagagggagcccggagccacgcatcttgcagctggctagggtgggaaatgtatacctaaaggaagaatcttctcggtctgggaggctagaagccaaaaagtggataccgacgaaattccttgaaaacctcagcgtaccgcacgtggacttgggaggcaaccagttgtggagtggcggcatggaagcattgacaacccagcttggaccaggcagggagggctcttcttcgcccaattcaaagcaggaactccagccttactctgggagctctgctctcaagccaaaccaggtgggagagacgagcctttacggagtccccatcgtgagtctggtgatcgatggacaggagcgcctgtgcctcgcacagatcagcaacactctgctgaagaactacagttacaatgaaatacacaacagacgggtggcactcggcatcacttgtgtccagtgcacccccgtgcaactggaaatcctgcggagggctggggctatgcccatctcttctcgaaggtgcggaatgattacaaagcgggaggcagaacgcctgtgtaagtcgtttctcggcgaacacaaacctcccaaacttccagagaactttgccttcgatgtggtgcatgaatgcgcgtggggttcaaggggatcctttatcccagcgcggtacaactcatccagagccaaatgcattaaatgcgggtactgctccatgtatttctccccgaacaagttcatctttcatagccaccgcaccccagatgcaaagtacacgcagccagacgccgcaaacttcaactcgtggcgccgccacctgaaattgtccgataagagcgcgaccgatgagctgtctcacgcttgggaggaccgggggcttgggctggccacaggagcctccggtccagcaggccccggcggccctgggggcggcgctggagtaagaagttatcccgtgatcccagtgccaagtaaaggctttggcctcttgcagaagctgcctccccctctttttccgcacccctacggcttcccaacggcatttggattgtgccctaagaaagatgacccagtgctgggcgccggagagcctaagggcggctcatacgtgagtgcctttaggccagtcgttaaggacacggagtccatcgcgaagctctacggcagcgccagagaagcctacggcgccggaccggcgcgcggaccaggacctggcgctggtagcgggggttatgtaagtccggatttcctgtcggagggatcaagctcttataacagcgcctcgccggacgtggacacagctgacgagccagaggtggatgtggaaagcaatcgattcccagacgacgaagacgctcaggaggaaaccgaaccaagtgccccctccgctggcggcggtcccgacgctgggcgccctgcatttggagatctcgcagctgaggacctcgtgcgccgtccagagcgctctcccccaagtggaggcggcggatatgagctccgagaaccctgcggacccttggggggcccagcccccgccaaggttttcgcccccgagagggatgagcacgtgaagtcagctgcagttgcactgggtccggctgccagttatgtgtgtaccccggaggcacatgaacccgacaaggaggataatcattcaccagcggatgacctagagaccagaaaatcctaccctgatcagcggagcattagtcagccgagcccagcgaacaccgaccgcggagaggatggacttacacttgacgtaacggggacacatcttgtggagaaagatatcgaaaacctagcccgcgaagagttgcagaagttactcctggaacagatggagctacggaagaaactagaaagggaattccagtccctaaaagacaatttccaggaccagatgaaacgagaattggcgtatcgggaggagatggtccagcagctccagattgttagagatacactctgtaatgagctcgaccaggagagaaaagctcgctacgcaattcagcaaaagctaaaagaagcccacgatgccctccaccacttctcctgcaaaatgttgacccctcgtcactgtactgggaactgctcatttaaaccccctctgctgccatag

SEQ ID NO: 23787 - DNA, 3585 bp, Artificial Sequence
  Description of Artificial Sequence: Synthetic coding sequence
atgcacgacctgccccccgacagcggcgcccggcggggcggccgggggctggcagatcacagttttcccgcaggtgcgcgcgccccaggtcagccaccatcacggggggccgcgtacagacgtgcctgtccccgcgatggcgagaggggcggaggaggcaggccacgccagcaagtcagcccacctaggtccccacagcgggaaccaaggggcgggcagctccgtaccccccgcatgcgcccttcctgcagccgttcgctggaaagcctcagggtaggggcaaaaccacctcccttccagcgctggccatcagattcttggatacgctgtggcgcccacagggattgggacgaacccccaccccggggggggagaatggacggctggtcaggagatcgagcccgggccgctgctcccactgggctgcaaccccccggatgtaaggaccacgggtgttcctccggatctcccttcagggatccagccggcagtagtgtcatcaggagtggaaaaggcgatagacaggaaggtcccagtttccttcgcccgcccgcagtcaccgtgaaaaagcttcaaaaatggatgtataagggccgtcttctatctctgggaatgaaggggcgcgccaggggaacagctccgaaggtaactggaactcaggccgcctctccgaacgtgggtgccctgaaagtccgagagaaccgcgtgcttagcgtccctcccgatcagaggatcaccctgactgacctgttcgagaatgcctatggcagcagcatgaaaggtcgtgaacttgaggagctgaaagataatatcgagttcaggggtcacaagcctctgaatagcataacagtgtcaaagaagcgaaattggctctatcaatcaaccctcagacccctgaatttagaggaggagaataaaaaatgccaggataggagccatttgtccatcagcccagtgagtctgcctaagcatcagctgtcccagagctttttgaagtcaagtaaggagtactgcacttacgtggtatgcaatgcaaccaactcctcgctgtctaaaaactgcgccctcgacttcaacgaggagaacgatgctgacgacgagggcgaaatctggtataaccccattcccgaggatgatgacctggggattagttctgccctgtcctttggcgaggctgacagtgctgtgttgaaattgccggccgtgaacctctctatgctttcggggagtgatcttatgaaggcagaacgacataccgaggatagcctgtgctcctccgaacacgcaggcgacatacagaccacacggagtaacgggatgaaccccatacatcccgctcattctaccgaattcgttcagcagtacaagcagaagctaggtcataaaactcaggaggggataatggtggaggacagccctatgctgaaatccccttttgcaggctccggcatcttggccgctactaactccactgagttggggatcatggaacccagttcccctaatccctcacccgtaaagaagggcagctccatcaactggtccttgcccgacaagattaaatcccccaggaccgttagaaaactctccatgaagatgaagaaattgcccgaattttcacggaagttaagcgtcaaggggactctcaattacattaatagccccgataataccccaagcctgagcaaatataattgtcgggaagtgcaccacaccgatatcctaccctccggaaataccaccaccgccgcaaaaagaaacgtgatcagccggtaccacctcgacacctcagtaagttctcagcagtcttatcagaagaaaaattccatgagctcgaaatactcttgcaaggggggatatctatcagacggggactctccagaactcaccacaaaggcatccaaacacggctcagagaataaatttggtaagggaaaggagattatctccaatagttgcagcaagaatgaaattgatattgatgcctttaggcactacagttttagtgaccaacccaagtgcagtcagtacatatccggcctgatgtctgtccacttctatggcgctgaggatttaaagcccccccgcattgattcgaaggacgttttctgtgccatacaagtggactcagtgaacaaagccaggaccgccctcttgacctgtcggactacctttttggacatggatcacactttcaatatcgagatcgagaacgcccagcatctgaagcttgtcgtgtttagctgggagccgacaccacggaagaaccgtgtgtgctgtcacgggactgtcgtgctcccaactctattcagggttaccaagactcatcagttggctgttaagctagagccccgtgggctcatctacgtgaaagtgacactgatggagcagtgggagaattccctccacggcttggacataaaccaagagcccattatcttcggcgtggatatacaaaaggttgtggaaaaggaaaacatcggactcatggtacctctgcttattcagaaatgcatcatggagatcgaaaagcgcggatgccaggtagttggtttatacagactctgcggaagcgcagccgttaagaaggagttaagggaggccttcgaaagggacagcaaggccgttgggctgtgcgagaaccagtacccagatatcaacgttataacgggggtgctaaaggactacctgcgtgaacttccaagccccctgatcacaaaacagctttatgaagcggtgctcgacgccatggccaaatcacccctcaagatgagctcaaatggttgcgagaacgacccaggcgacagcaaatataccgtagatctgttggactgtctgcctgaaatcgaaaaggcaactctgaaaatgctgcttgatcatctgaagctggttgcgagctatcacgaggtgaacaagatgacgtgccagaacctcgcagtctgtttcggccccgtgctgctctctcagcgccaggaacctagcacacacaataaccgcgtattcaccgacagcgaggaactcgcatctgcacttgacttcaagaagcatatcgaggtcttgcactacctcctccagctctggcccgtgcagcgcttaactgtgaagaagagcaccgacaacctgtttcctgagcagaagtcttccctaaactatctgcgccagaaaaaggagcgcccccacatgttaaatctcagcggtacagattccagcggggttctcaggccaaggcaaaacaggctcgattctccgctctccaatcggtacgctggggattggagcagctgtggcgagaactatttcctgaatacaaaagaaaaccttaacgacgtggactatgatgatgtgccatcagaggatcggaagataggggagaattatagcaagatggatggacccgaggtcatgattgagcaacctattcctatgtctaaagagtgtacctttcaaacataccttactatgcaaacagtagagagtaccgtcgatcgcaagaacaacctaaaggatctgcaggaaagcattgacacgctcatcgggaatctcgagcgggaattgaacaaaaacaagctaaatatgagcttttag

SEQ ID NO: 23788 - DNA, 1353 bp, Artificial Sequence
  Description of Artificial Sequence: Synthetic coding sequence
atggaccccggcaacgagaacagcgccaccgaggccgccgccatcattgatctggaccctgactttgagcctcagtccagaccccgctcctgcacttggcccttgcctaggcccgagattgctaaccagccttccgagccccccgaagtggagcccgaccttggcgagaaagcaatcgagagcgcccctgagaagaggctaaccctagcacagatttacgagtggatggtgcgcaccgttccatacttcaaggacaagggagactcaaactcctccgcaggctggaaaaactccatccggcacaacctcagcctgcactcgaagtttatcaaggtccacaacgaagcgaccggtaaatcatcttggtggatgcttaatccagagggaggcaagtccggaaaagcacctagaagacgagcagcctccatggattccagttctaagctcctcagaggccgtagcaaggctcctaaaaagaagccatctgtgctgccagctccgcctgaaggggccacccctacctcacccgtcgggcatttcgctaaatggagtggaagcccgtgttcccgtaacagagaagaagctgacatgtggaccacgtttagaccccgtagcagctcgaatgcgagttctgtctccactcgactctcacctctgcgcccagagtctgaagtgctcgcagaggaaatccccgcctctgtgtccagttatgcaggaggcgtgccccccaccctcaacgaaggactggaactactcgatggactgaacctcacgtcttctcattccttactctcccgatccggattgagcggcttttcacttcagcacccaggagtgactgggcctctacacacctattcaagctccttattttctccggctgagggccctctgtctgctggtgagggctgttttagtagttctcaggctctggaggctctgctcactagcgacactccccccccgccagcggacgtgctgatgacccaggttgatccaattctgagccaggctccaaccctactactcctgggaggcctgccgtcctcctccaagctggccaccggggtgggactgtgccccaaaccacttgaagctccaggacccagcagtttagtccccactctctcaatgatagctcctcccccagttatggcgtctgcccccattccgaaagcccttgggacccccgtgctgaccccacctacggaagcagcgagtcaggatagaatgccacaagatctggacctggacatgtacatggagaaccttgagtgtgacatggataatattattagcgatctaatggatgagggcgaaggtttggactttaattttgaacctgatccctag

SEQ ID NO: 23789 - DNA, 1125 bp, Artificial Sequence
  Description of Artificial Sequence: Synthetic coding sequence
atggccggctacctgagcgagagcgacttcgtgatggtggaggagggattcagcacaagagatttactgaaggaattaacgttaggagcctcgcaggcaaccaccgacgaagtcgctgccttttttgtcgcagatctcggggcaattgtgcgcaaacatttctgcttcctgaaatgcctgcccagagtgagacctttctacgcagtgaagtgcaattcctccccgggcgtactgaaggtgctagcccaactggggttgggcttctcttgcgcaaacaaggcggaaatggagctggtccagcacattggcatcccagctagcaagatcatctgtgctaatccttgcaagcagatcgcacagatcaaatatgcggctaaacacggtatccaattattgtcctttgacaatgagatggagctggctaaggtcgtgaagtcgcaccccagcgctaaatttgtgcagcagagaggtactgcgtgcctgatccgaatggtgctctgtattgccacggatgacagccattcgctgagttgcctgtccctgaagttcggggtgagtctgaagagctgccggcatctcttggagaacgctaaaaaacatcacgtggaagtggtgggagtcagtttccacattggaagcgggtgtccggatccccaggcatatgcacagtctattgccgatgcgaggctggtgtttgagatgggaactgaactaggtcacaagatgcacgtcttggacctcggtggcgggtttccaggcactgaaggcgctaaagtccggtttgaggagattgcgtctgtaattaattcagctctggatctgtatttcccagaggggtgtggcgttgatatctttgctgaactgggtcggtactatgtcacctccgccttcaccgttgccgttagcataattgccaaaaaagaagttctgttggatcagccaggacgggaggaagagaatgggagcacaagcaagacaatcgtatatcacttggatgaaggagtgtacggtattttcaatagtgtgctctttgacaatatttgtcctacaccgatcttgcagaagtccaaaaaccattccccgtgttacatgtccctagagagcatccacttcattgctgtctag
